United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 33

SEQ ID NO: 1462280 - RNA, 21 nt, Human
auugagcuggaccucaccaag

SEQ ID NO: 1462281 - RNA, 14 nt, Human
auugagcuugcaug

SEQ ID NO: 1462282 - RNA, 17 nt, Human
auucguuaucuaauagg

SEQ ID NO: 1462283 - RNA, 22 nt, Human
auucguagauauuggacaaaga

SEQ ID NO: 1462284 - RNA, 16 nt, Human
auucgaaugacacugu

SEQ ID NO: 1462285 - RNA, 13 nt, Human
auucuuucccaac

SEQ ID NO: 1462286 - RNA, 18 nt, Human
auucauuccauucuggaa

SEQ ID NO: 1462287 - RNA, 19 nt, Human
auucauuccauucuggaag

SEQ ID NO: 1462288 - RNA, 17 nt, Human
auucauuccauucugga

SEQ ID NO: 1462289 - RNA, 12 nt, Human
auucauuccauu

SEQ ID NO: 1462290 - RNA, 22 nt, Human
auuacaggcgugagccaccucg

SEQ ID NO: 1462291 - RNA, 13 nt, Human
auucaauaaagcu

SEQ ID NO: 1462292 - RNA, 12 nt, Human
auucaauaaagc

SEQ ID NO: 1462293 - RNA, 20 nt, Human
auuaugugacauuuuacauu

SEQ ID NO: 1462294 - RNA, 23 nt, Human
auuaugugccagauuuaugcaua

SEQ ID NO: 1462295 - RNA, 21 nt, Human
auuaugugccagauuuaugca

SEQ ID NO: 1462296 - RNA, 13 nt, Human
auuaugugccaga

SEQ ID NO: 1462297 - RNA, 19 nt, Human
auuaugugacauuuuacau

SEQ ID NO: 1462298 - RNA, 13 nt, Human
auuaugugacauu

SEQ ID NO: 1462299 - RNA, 21 nt, Human
auuagagggaggagaaugagc

SEQ ID NO: 1462300 - RNA, 15 nt, Human
auuuaccacuugugu

SEQ ID NO: 1462301 - RNA, 16 nt, Human
auuuacaucauuucuu

SEQ ID NO: 1462302 - RNA, 22 nt, Human
auuuaccacuuguguuuugcaa

SEQ ID NO: 1462303 - RNA, 13 nt, Human
auuuaaaucuguu

SEQ ID NO: 1462304 - RNA, 16 nt, Human
auuuaaauagcuuuuu

SEQ ID NO: 1462305 - RNA, 23 nt, Human
auuuaaaauagcaaaagaagaag

SEQ ID NO: 1462306 - RNA, 22 nt, Human
auuuaaaguuguuugugccuuu

SEQ ID NO: 1462307 - RNA, 16 nt, Human
auuguaguccuguaau

SEQ ID NO: 1462308 - RNA, 17 nt, Human
auuguagcauccuggaa

SEQ ID NO: 1462309 - RNA, 20 nt, Human
auuguagcauccuggaauau

SEQ ID NO: 1462310 - RNA, 21 nt, Human
auuguacuaaagccaaacaua

SEQ ID NO: 1462311 - RNA, 13 nt, Human
auuguaguaaucu

SEQ ID NO: 1462312 - RNA, 19 nt, Human
auuguuuuacaauaguucu

SEQ ID NO: 1462313 - RNA, 19 nt, Human
auuguuuuaucugaauuuu

SEQ ID NO: 1462314 - RNA, 13 nt, Human
auuuaaaauagca

SEQ ID NO: 1462315 - RNA, 15 nt, Human
auuuaaaauagcaaa

SEQ ID NO: 1462316 - RNA, 18 nt, Human
auuuaaaauagcaaaaga

SEQ ID NO: 1462317 - RNA, 20 nt, Human
auuuaaaauagcaaaagaag

SEQ ID NO: 1462318 - RNA, 21 nt, Human
auuuaaaauagcaaaagaaga

SEQ ID NO: 1462319 - RNA, 22 nt, Human
auuuaaaauagcaaaagaagaa

SEQ ID NO: 1462320 - RNA, 15 nt, Human
auuuauaaacuuuuu

SEQ ID NO: 1462321 - RNA, 17 nt, Human
auuuaguguucauaaau

SEQ ID NO: 1462322 - RNA, 13 nt, Human
auuuagaaaacuu

SEQ ID NO: 1462323 - RNA, 14 nt, Human
auuuagaaaacuuu

SEQ ID NO: 1462324 - RNA, 16 nt, Human
auuuaguuguaaacca

SEQ ID NO: 1462325 - RNA, 16 nt, Human
auuuaguguucauaaa

SEQ ID NO: 1462326 - RNA, 19 nt, Human
auuuauuacuguaagaaaa

SEQ ID NO: 1462327 - RNA, 20 nt, Human
auuuauuacuguaagaaaau

SEQ ID NO: 1462328 - RNA, 21 nt, Human
auuuauuuuaauaauguuuca

SEQ ID NO: 1462329 - RNA, 12 nt, Human
auuuauuuugac

SEQ ID NO: 1462330 - RNA, 13 nt, Human
auuuauuuugaca

SEQ ID NO: 1462331 - RNA, 14 nt, Human
auuuauuuugacau

SEQ ID NO: 1462332 - RNA, 21 nt, Human
auuuauuuugacauaaaguug

SEQ ID NO: 1462333 - RNA, 18 nt, Human
auuucaugcuaucucugu

SEQ ID NO: 1462334 - RNA, 14 nt, Human
auuucaugaaaauu

SEQ ID NO: 1462335 - RNA, 19 nt, Human
auuuccuauuuuuggaaga

SEQ ID NO: 1462336 - RNA, 20 nt, Human
auuuccuccgucaccucaga

SEQ ID NO: 1462337 - RNA, 19 nt, Human
auuuccuuuuuuguuauua

SEQ ID NO: 1462338 - RNA, 21 nt, Human
auuucgucuguuuauaaacau

SEQ ID NO: 1462339 - RNA, 21 nt, Human
auuuccuaaauauauuuuaag

SEQ ID NO: 1462340 - RNA, 19 nt, Human
auuuccuaauuuugagaaa

SEQ ID NO: 1462341 - RNA, 14 nt, Human
auuuccuaaauaua

SEQ ID NO: 1462342 - RNA, 12 nt, Human
auuugguuuuca

SEQ ID NO: 1462343 - RNA, 14 nt, Human
auuugguuuucaca

SEQ ID NO: 1462344 - RNA, 17 nt, Human
auuuguaauagauguuu

SEQ ID NO: 1462345 - RNA, 22 nt, Human
auuuguaauagauguuugauag

SEQ ID NO: 1462346 - RNA, 21 nt, Human
auuuguacauaguuauuuauu

SEQ ID NO: 1462347 - RNA, 15 nt, Human
auuuggauccugugu

SEQ ID NO: 1462348 - RNA, 14 nt, Human
auuuggcaucccug

SEQ ID NO: 1462349 - RNA, 16 nt, Human
auuuggcaucccuggg

SEQ ID NO: 1462350 - RNA, 17 nt, Human
auuuggcaucccugggc

SEQ ID NO: 1462351 - RNA, 18 nt, Human
auuugauaugugaacagu

SEQ ID NO: 1462352 - RNA, 19 nt, Human
auuugauaugugaacaguu

SEQ ID NO: 1462353 - RNA, 18 nt, Human
auuugagagaaauaugaa

SEQ ID NO: 1462354 - RNA, 17 nt, Human
auuugagagaaauauga

SEQ ID NO: 1462355 - RNA, 14 nt, Human
auuggaaacaaguc

SEQ ID NO: 1462356 - RNA, 23 nt, Human
auuggggaagagagccugcagga

SEQ ID NO: 1462357 - RNA, 15 nt, Human
auuguacuaaagcca

SEQ ID NO: 1462358 - RNA, 22 nt, Human
auuguacuaaagccaaacauau

SEQ ID NO: 1462359 - RNA, 16 nt, Human
auuggggaagagagcc

SEQ ID NO: 1462360 - RNA, 22 nt, Human
auuggggaagagagccugcagg

SEQ ID NO: 1462361 - RNA, 16 nt, Human
auuggagcucguggaa

SEQ ID NO: 1462362 - RNA, 17 nt, Human
auuggagcucgugggac

SEQ ID NO: 1462363 - RNA, 19 nt, Human
auuggagcucgugggacag

SEQ ID NO: 1462364 - RNA, 12 nt, Human
auugauuuuugg

SEQ ID NO: 1462365 - RNA, 12 nt, Human
auugauuuugaa

SEQ ID NO: 1462366 - RNA, 13 nt, Human
auugauuuugaac

SEQ ID NO: 1462367 - RNA, 21 nt, Human
auugaauuaucuugguugaaa

SEQ ID NO: 1462368 - RNA, 21 nt, Human
auugaauggcuauguuuuuaa

SEQ ID NO: 1462369 - RNA, 22 nt, Human
auugaauggcuauguuuuuaau

SEQ ID NO: 1462370 - RNA, 23 nt, Human
auugaauggcuauguuuuuaaug

SEQ ID NO: 1462371 - RNA, 13 nt, Human
auugaauuaucuu

SEQ ID NO: 1462372 - RNA, 19 nt, Human
auugaaguauuuugcugga

SEQ ID NO: 1462373 - RNA, 15 nt, Human
auugaaggcuuaaac

SEQ ID NO: 1462374 - RNA, 19 nt, Human
auugaaggcuuaaacccau

SEQ ID NO: 1462375 - RNA, 15 nt, Human
auguguguuuuaaaa

SEQ ID NO: 1462376 - RNA, 12 nt, Human
auguguuugcuu

SEQ ID NO: 1462377 - RNA, 15 nt, Human
auguguuugcuuucu

SEQ ID NO: 1462378 - RNA, 16 nt, Human
auguguuugcuuucug

SEQ ID NO: 1462379 - RNA, 17 nt, Human
auguguuugcuuucuga

SEQ ID NO: 1462380 - RNA, 15 nt, Human
auguuaaaaaaauaa

SEQ ID NO: 1462381 - RNA, 21 nt, Human
augugcuaguaauuggaaagg

SEQ ID NO: 1462382 - RNA, 19 nt, Human
augugcuauacugcauacu

SEQ ID NO: 1462383 - RNA, 18 nt, Human
augugcuauacugcauac

SEQ ID NO: 1462384 - RNA, 17 nt, Human
augugcauucuccagcc

SEQ ID NO: 1462385 - RNA, 24 nt, Human
auguuaugacuauguaaacuacuu

SEQ ID NO: 1462386 - RNA, 18 nt, Human
auguuaugacuauguaaa

SEQ ID NO: 1462387 - RNA, 18 nt, Human
auguuaagacuugacagu

SEQ ID NO: 1462388 - RNA, 15 nt, Human
auguuauuuguaaua

SEQ ID NO: 1462389 - RNA, 19 nt, Human
auguuauuuguaauagaug

SEQ ID NO: 1462390 - RNA, 16 nt, Human
auguuaagacuugaca

SEQ ID NO: 1462391 - RNA, 20 nt, Human
auguuaagacuugacagugg

SEQ ID NO: 1462392 - RNA, 20 nt, Human
auguucuuuuaaaugauuga

SEQ ID NO: 1462393 - RNA, 22 nt, Human
auguugaaauaugauguuaaaa

SEQ ID NO: 1462394 - RNA, 15 nt, Human
auguugcuggacugu

SEQ ID NO: 1462395 - RNA, 19 nt, Human
auguugcuggacugucaua

SEQ ID NO: 1462396 - RNA, 16 nt, Human
uuuucuauaauuuaaa

SEQ ID NO: 1462397 - RNA, 17 nt, Human
uuuucucugauacagaa

SEQ ID NO: 1462398 - RNA, 17 nt, Human
uuuucucugaacacauu

SEQ ID NO: 1462399 - RNA, 20 nt, Human
uuuucucuaggaaauauacu

SEQ ID NO: 1462400 - RNA, 20 nt, Human
uuuucaggcuagauguaugu

SEQ ID NO: 1462401 - RNA, 21 nt, Human
uuuuccaacuuggcugcagga

SEQ ID NO: 1462402 - RNA, 19 nt, Human
uuuuaguugcaacuuugua

SEQ ID NO: 1462403 - RNA, 19 nt, Human
uuuuagugaacuugaaaua

SEQ ID NO: 1462404 - RNA, 18 nt, Human
uuuuagugauuuuaauaa

SEQ ID NO: 1462405 - RNA, 12 nt, Human
uuuuaguugaau

SEQ ID NO: 1462406 - RNA, 12 nt, Human
uuuuauuaauaa

SEQ ID NO: 1462407 - RNA, 22 nt, Human
uuuuauuaauaaacauucuauc

SEQ ID NO: 1462408 - RNA, 19 nt, Human
uuuuauuaauaaacauucu

SEQ ID NO: 1462409 - RNA, 15 nt, Human
auguuuuuuuuuaaa

SEQ ID NO: 1462410 - RNA, 12 nt, Human
auguuuuuaaug

SEQ ID NO: 1462411 - RNA, 13 nt, Human
auguuuuuaaugu

SEQ ID NO: 1462412 - RNA, 14 nt, Human
auguuuuuaaugua

SEQ ID NO: 1462413 - RNA, 19 nt, Human
auguuuuuaauguauagua

SEQ ID NO: 1462414 - RNA, 16 nt, Human
auguuuuuaauguaua

SEQ ID NO: 1462415 - RNA, 21 nt, Human
uuuucuuaaccagaucauugu

SEQ ID NO: 1462416 - RNA, 17 nt, Human
uuuucuggaauacauga

SEQ ID NO: 1462417 - RNA, 21 nt, Human
uuuucuggaauacaugaaaua

SEQ ID NO: 1462418 - RNA, 14 nt, Human
auguuuaaaccuuu

SEQ ID NO: 1462419 - RNA, 14 nt, Human
auguuuaaaacauc

SEQ ID NO: 1462420 - RNA, 18 nt, Human
auguuggucauuuuaugu

SEQ ID NO: 1462421 - RNA, 15 nt, Human
uuuguaguagcguuu

SEQ ID NO: 1462422 - RNA, 19 nt, Human
uuuguacauaguuauuuau

SEQ ID NO: 1462423 - RNA, 19 nt, Human
uuuguaguagcguuuuuua

SEQ ID NO: 1462424 - RNA, 15 nt, Human
uuuguagugauuuuu

SEQ ID NO: 1462425 - RNA, 17 nt, Human
uuuguaguguuggagaa

SEQ ID NO: 1462426 - RNA, 17 nt, Human
uuuguaguagcguuuuu

SEQ ID NO: 1462427 - RNA, 22 nt, Human
uuuguagugauuuuuaugccac

SEQ ID NO: 1462428 - RNA, 18 nt, Human
uuuguaagguuuuuguag

SEQ ID NO: 1462429 - RNA, 16 nt, Human
uuuguaaguugaagca

SEQ ID NO: 1462430 - RNA, 20 nt, Human
uuuguaaguugaagcaaauc

SEQ ID NO: 1462431 - RNA, 22 nt, Human
uuuguaaguuagguaacuguau

SEQ ID NO: 1462432 - RNA, 15 nt, Human
uuugugauucaaucu

SEQ ID NO: 1462433 - RNA, 20 nt, Human
uuugugauucaaucuguaaa

SEQ ID NO: 1462434 - RNA, 13 nt, Human
uuugugcauucug

SEQ ID NO: 1462435 - RNA, 14 nt, Human
uuuguuuccuuugu

SEQ ID NO: 1462436 - RNA, 15 nt, Human
uuuguuuccuuuguu

SEQ ID NO: 1462437 - RNA, 23 nt, Human
augucgucaaagcugaaauggac

SEQ ID NO: 1462438 - RNA, 16 nt, Human
augugacagguaaacu

SEQ ID NO: 1462439 - RNA, 17 nt, Human
augugauaaggaaauca

SEQ ID NO: 1462440 - RNA, 20 nt, Human
augugauaaggaaaucaacu

SEQ ID NO: 1462441 - RNA, 18 nt, Human
augugauaaggaaaucaa

SEQ ID NO: 1462442 - RNA, 21 nt, Human
augucauguguacaaaaguuu

SEQ ID NO: 1462443 - RNA, 13 nt, Human
augucauuaaaug

SEQ ID NO: 1462444 - RNA, 15 nt, Human
augucauuucauuuc

SEQ ID NO: 1462445 - RNA, 18 nt, Human
augucauuucauuuccua

SEQ ID NO: 1462446 - RNA, 19 nt, Human
auguauacuauaguaccag

SEQ ID NO: 1462447 - RNA, 14 nt, Human
uuuggguccaggag

SEQ ID NO: 1462448 - RNA, 13 nt, Human
uuuggguccagga

SEQ ID NO: 1462449 - RNA, 15 nt, Human
uuuggguccaggagg

SEQ ID NO: 1462450 - RNA, 12 nt, Human
auguauaguaaa

SEQ ID NO: 1462451 - RNA, 15 nt, Human
auguauaguaaauca

SEQ ID NO: 1462452 - RNA, 16 nt, Human
auguauaguaaaucac

SEQ ID NO: 1462453 - RNA, 21 nt, Human
uuugggcagcaauuuaaaugu

SEQ ID NO: 1462454 - RNA, 19 nt, Human
uuugcuaagcauuccaacu

SEQ ID NO: 1462455 - RNA, 22 nt, Human
uuugcuguaauguuaauauuga

SEQ ID NO: 1462456 - RNA, 20 nt, Human
uuugagacagagucuuccuc

SEQ ID NO: 1462457 - RNA, 21 nt, Human
uuugagagaaauaugaagaac

SEQ ID NO: 1462458 - RNA, 19 nt, Human
uuucccuuccuuccucucc

SEQ ID NO: 1462459 - RNA, 17 nt, Human
uuucccuacugaagccc

SEQ ID NO: 1462460 - RNA, 23 nt, Human
uuucccuacugaagcccuuguga

SEQ ID NO: 1462461 - RNA, 13 nt, Human
uuucccuccuugg

SEQ ID NO: 1462462 - RNA, 11 nt, Human
uuucccuccuu

SEQ ID NO: 1462463 - RNA, 16 nt, Human
uuucccugccucucau

SEQ ID NO: 1462464 - RNA, 14 nt, Human
uuucccuccuuggu

SEQ ID NO: 1462465 - RNA, 18 nt, Human
uuugacaaagguaaauca

SEQ ID NO: 1462466 - RNA, 15 nt, Human
auucagccuggcuuc

SEQ ID NO: 1462467 - RNA, 23 nt, Human
auucaaaaauuaucuauagcuaa

SEQ ID NO: 1462468 - RNA, 16 nt, Human
auucaaaaauuaucua

SEQ ID NO: 1462469 - RNA, 11 nt, Human
auucaaaacau

SEQ ID NO: 1462470 - RNA, 20 nt, Human
auuauuggaauauaauuguu

SEQ ID NO: 1462471 - RNA, 18 nt, Human
auuauuguugcauuaaaa

SEQ ID NO: 1462472 - RNA, 22 nt, Human
auuauuuaaaccgcuaaaagaa

SEQ ID NO: 1462473 - RNA, 21 nt, Human
auucacucugaguguuuuaug

SEQ ID NO: 1462474 - RNA, 22 nt, Human
auuauaaccuuaauuuauuauu

SEQ ID NO: 1462475 - RNA, 14 nt, Human
auuauaaccuuaau

SEQ ID NO: 1462476 - RNA, 17 nt, Human
auuauaacuggaaagaa

SEQ ID NO: 1462477 - RNA, 19 nt, Human
auuauaucaauuuccucau

SEQ ID NO: 1462478 - RNA, 14 nt, Human
auuauucacuagua

SEQ ID NO: 1462479 - RNA, 20 nt, Human
auuauauggcuugaguuuaa

SEQ ID NO: 1462480 - RNA, 14 nt, Human
auucagccuggcuu

SEQ ID NO: 1462481 - RNA, 17 nt, Human
auuccaagugauugaaa

SEQ ID NO: 1462482 - RNA, 18 nt, Human
auuccagaccugaagaau

SEQ ID NO: 1462483 - RNA, 23 nt, Human
auuccagacugcuuccaauuuuc

SEQ ID NO: 1462484 - RNA, 17 nt, Human
auuccagaccugaagaa

SEQ ID NO: 1462485 - RNA, 22 nt, Human
auucccacccaauucaaaacau

SEQ ID NO: 1462486 - RNA, 16 nt, Human
auuccccaucucaggc

SEQ ID NO: 1462487 - RNA, 18 nt, Human
auuccccaucucaggcca

SEQ ID NO: 1462488 - RNA, 14 nt, Human
auuccccauucuuc

SEQ ID NO: 1462489 - RNA, 15 nt, Human
auuccccauucuucc

SEQ ID NO: 1462490 - RNA, 15 nt, Human
auuacuguaagaaaa

SEQ ID NO: 1462491 - RNA, 16 nt, Human
auuacuguaagaaaau

SEQ ID NO: 1462492 - RNA, 15 nt, Human
auuacugguccaaaa

SEQ ID NO: 1462493 - RNA, 13 nt, Human
auuaaguucuuua

SEQ ID NO: 1462494 - RNA, 24 nt, Human
auuaagucugugagauucauucau

SEQ ID NO: 1462495 - RNA, 17 nt, Human
auuaauauuccucaguu

SEQ ID NO: 1462496 - RNA, 20 nt, Human
auuagacuggacagcuugug

SEQ ID NO: 1462497 - RNA, 19 nt, Human
auuagacuggacagcuugu

SEQ ID NO: 1462498 - RNA, 15 nt, Human
auuagacuggaacuu

SEQ ID NO: 1462499 - RNA, 22 nt, Human
auuagacuggaacuugaacuga

SEQ ID NO: 1462500 - RNA, 14 nt, Human
auuagacuggacag

SEQ ID NO: 1462501 - RNA, 15 nt, Human
auuagacuggacagc

SEQ ID NO: 1462502 - RNA, 16 nt, Human
auuagacuggacagcu

SEQ ID NO: 1462503 - RNA, 11 nt, Human
uuuuuacauuu

SEQ ID NO: 1462504 - RNA, 15 nt, Human
uuuuuacaaagcccu

SEQ ID NO: 1462505 - RNA, 19 nt, Human
uuuuguuguuucuuaaaua

SEQ ID NO: 1462506 - RNA, 21 nt, Human
uuuuguuguuucuuaaauaag

SEQ ID NO: 1462507 - RNA, 14 nt, Human
uuuugugaagcaaa

SEQ ID NO: 1462508 - RNA, 16 nt, Human
uuuuugagacagaguc

SEQ ID NO: 1462509 - RNA, 13 nt, Human
uuuuugauacuaa

SEQ ID NO: 1462510 - RNA, 15 nt, Human
uuuuugauacuaagc

SEQ ID NO: 1462511 - RNA, 17 nt, Human
uuuuugcauuuaaaaca

SEQ ID NO: 1462512 - RNA, 22 nt, Human
uuuuuggaagaggacuccuuaa

SEQ ID NO: 1462513 - RNA, 13 nt, Human
uuuuucaaaagaa

SEQ ID NO: 1462514 - RNA, 17 nt, Human
uuuuuauauuugaaaua

SEQ ID NO: 1462515 - RNA, 13 nt, Human
uuuuuauuuaaaa

SEQ ID NO: 1462516 - RNA, 11 nt, Human
uuuuuguagua

SEQ ID NO: 1462517 - RNA, 23 nt, Human
uuuuugggcagcaauuuaaaugu

SEQ ID NO: 1462518 - RNA, 21 nt, Human
uuuuugggcagcaauuuaaau

SEQ ID NO: 1462519 - RNA, 20 nt, Human
uuuuugggcagcaauuuaaa

SEQ ID NO: 1462520 - RNA, 20 nt, Human
uugucaauaaaauccauaca

SEQ ID NO: 1462521 - RNA, 16 nt, Human
uuguagcauccuggaa

SEQ ID NO: 1462522 - RNA, 18 nt, Human
uuguagcauccuggaaua

SEQ ID NO: 1462523 - RNA, 12 nt, Human
uuguacaaaaua

SEQ ID NO: 1462524 - RNA, 14 nt, Human
uuguacaaaauaaa

SEQ ID NO: 1462525 - RNA, 23 nt, Human
uugugaaucaagggucaggccuu

SEQ ID NO: 1462526 - RNA, 20 nt, Human
uugugaaucaagggucaggc

SEQ ID NO: 1462527 - RNA, 21 nt, Human
uugugaaucaagggucaggcc

SEQ ID NO: 1462528 - RNA, 21 nt, Human
uugugacagggcggggguggc

SEQ ID NO: 1462529 - RNA, 13 nt, Human
uugugacaaaaaa

SEQ ID NO: 1462530 - RNA, 14 nt, Human
uugugacaaaaaau

SEQ ID NO: 1462531 - RNA, 16 nt, Human
uugugacaaaaaauua

SEQ ID NO: 1462532 - RNA, 22 nt, Human
uugugacaaaaaauuaaagcau

SEQ ID NO: 1462533 - RNA, 18 nt, Human
uugugaugugaguugcac

SEQ ID NO: 1462534 - RNA, 19 nt, Human
uugugauucaaucuguaaa

SEQ ID NO: 1462535 - RNA, 23 nt, Human
uugugauucaaucuguaaacugu

SEQ ID NO: 1462536 - RNA, 14 nt, Human
uugugauucugccu

SEQ ID NO: 1462537 - RNA, 22 nt, Human
uugugucccauucccccagugc

SEQ ID NO: 1462538 - RNA, 18 nt, Human
uugugucccauuccccca

SEQ ID NO: 1462539 - RNA, 9 nt, Human
uuguguccc

SEQ ID NO: 1462540 - RNA, 19 nt, Human
uugugucauguuuaagaaa

SEQ ID NO: 1462541 - RNA, 19 nt, Human
uugugucuggcaguuuaua

SEQ ID NO: 1462542 - RNA, 20 nt, Human
uuuaaaaaagaaacauuugg

SEQ ID NO: 1462543 - RNA, 21 nt, Human
uuuaaaaaacuaaaaacuaga

SEQ ID NO: 1462544 - RNA, 15 nt, Human
uuuaaaaaacuaaaa

SEQ ID NO: 1462545 - RNA, 14 nt, Human
uuuaaaaaacuaaa

SEQ ID NO: 1462546 - RNA, 12 nt, Human
uuuaaaaaguaa

SEQ ID NO: 1462547 - RNA, 15 nt, Human
uuuaaaaaccuugua

SEQ ID NO: 1462548 - RNA, 21 nt, Human
uuuaaauauaugcuaagucuu

SEQ ID NO: 1462549 - RNA, 20 nt, Human
uuuaaaucuguuuuucuaac

SEQ ID NO: 1462550 - RNA, 13 nt, Human
uuuaaauguauac

SEQ ID NO: 1462551 - RNA, 12 nt, Human
uuuaaauguaua

SEQ ID NO: 1462552 - RNA, 15 nt, Human
uuuaaauguaaagau

SEQ ID NO: 1462553 - RNA, 18 nt, Human
uuuaaauguaaagauauu

SEQ ID NO: 1462554 - RNA, 12 nt, Human
uuuaaaucuguu

SEQ ID NO: 1462555 - RNA, 14 nt, Human
uuuaaaugaagaaa

SEQ ID NO: 1462556 - RNA, 18 nt, Human
uuuaaaugcauaaaugca

SEQ ID NO: 1462557 - RNA, 14 nt, Human
uuuaagagacagcc

SEQ ID NO: 1462558 - RNA, 18 nt, Human
uuuaaaaaaauuccaagu

SEQ ID NO: 1462559 - RNA, 15 nt, Human
augcagaaagcaucc

SEQ ID NO: 1462560 - RNA, 16 nt, Human
augcacugauguugug

SEQ ID NO: 1462561 - RNA, 12 nt, Human
augcagaauguu

SEQ ID NO: 1462562 - RNA, 21 nt, Human
augcagaauguugauuacagu

SEQ ID NO: 1462563 - RNA, 19 nt, Human
augcagaauguugauuaca

SEQ ID NO: 1462564 - RNA, 16 nt, Human
augcagaaagcauccc

SEQ ID NO: 1462565 - RNA, 14 nt, Human
uuguucuucuuaaa

SEQ ID NO: 1462566 - RNA, 18 nt, Human
augauuuagagugcuguc

SEQ ID NO: 1462567 - RNA, 17 nt, Human
augauuuuuuuuucaua

SEQ ID NO: 1462568 - RNA, 21 nt, Human
augauuuuuuuuucauacacu

SEQ ID NO: 1462569 - RNA, 15 nt, Human
augccccugaauuua

SEQ ID NO: 1462570 - RNA, 20 nt, Human
augccccugaauuuaaauag

SEQ ID NO: 1462571 - RNA, 20 nt, Human
augccuuuucccaacuccag

SEQ ID NO: 1462572 - RNA, 22 nt, Human
augccuuuucccaacuccagaa

SEQ ID NO: 1462573 - RNA, 17 nt, Human
augcccggcuaauuuuu

SEQ ID NO: 1462574 - RNA, 19 nt, Human
augcgagugcucauuucag

SEQ ID NO: 1462575 - RNA, 21 nt, Human
augccuuuucccaaaauguug

SEQ ID NO: 1462576 - RNA, 23 nt, Human
augccuuuucccaaaauguugaa

SEQ ID NO: 1462577 - RNA, 16 nt, Human
uuuagugaacuugaaa

SEQ ID NO: 1462578 - RNA, 21 nt, Human
uuuauauguaccguaggcuuu

SEQ ID NO: 1462579 - RNA, 21 nt, Human
uuuauaugcuucuguuuuaua

SEQ ID NO: 1462580 - RNA, 17 nt, Human
uuuagggguagcauuug

SEQ ID NO: 1462581 - RNA, 13 nt, Human
uuuaggagcagug

SEQ ID NO: 1462582 - RNA, 16 nt, Human
augcguguuucugacu

SEQ ID NO: 1462583 - RNA, 17 nt, Human
augcguguuucugacuc

SEQ ID NO: 1462584 - RNA, 13 nt, Human
uuucacauuggaa

SEQ ID NO: 1462585 - RNA, 17 nt, Human
uuucacauuagaagaca

SEQ ID NO: 1462586 - RNA, 18 nt, Human
uuucacauuagaagacaa

SEQ ID NO: 1462587 - RNA, 19 nt, Human
uuucacauuagaagacaau

SEQ ID NO: 1462588 - RNA, 14 nt, Human
uuucacauuggaaa

SEQ ID NO: 1462589 - RNA, 19 nt, Human
uuucacauuggaaacaagu

SEQ ID NO: 1462590 - RNA, 18 nt, Human
uuucaccuggaagcauuu

SEQ ID NO: 1462591 - RNA, 22 nt, Human
uuucaccuggaagcauuuguuu

SEQ ID NO: 1462592 - RNA, 13 nt, Human
uuucaccuguaaa

SEQ ID NO: 1462593 - RNA, 14 nt, Human
uuucaccuguaaac

SEQ ID NO: 1462594 - RNA, 17 nt, Human
uuucaccuguaaaccug

SEQ ID NO: 1462595 - RNA, 18 nt, Human
uuucaccuguaaaccuga

SEQ ID NO: 1462596 - RNA, 19 nt, Human
uuucaaacauauauaacaa

SEQ ID NO: 1462597 - RNA, 21 nt, Human
uuucaugcuguucaugaaaga

SEQ ID NO: 1462598 - RNA, 19 nt, Human
uuucaugcuguucaugaaa

SEQ ID NO: 1462599 - RNA, 13 nt, Human
uuucaucauuuuu

SEQ ID NO: 1462600 - RNA, 22 nt, Human
uuucccuaagccagcugccccc

SEQ ID NO: 1462601 - RNA, 20 nt, Human
uuucccuaagccagcugccc

SEQ ID NO: 1462602 - RNA, 11 nt, Human
uuucccuaagc

SEQ ID NO: 1462603 - RNA, 20 nt, Human
uuuccauggcaggaaggcuu

SEQ ID NO: 1462604 - RNA, 21 nt, Human
uuuccauggcaggaaggcuug

SEQ ID NO: 1462605 - RNA, 19 nt, Human
uuuccaugggaccacaacu

SEQ ID NO: 1462606 - RNA, 22 nt, Human
uuuccaugggaccacaacuauu

SEQ ID NO: 1462607 - RNA, 23 nt, Human
augcuguauuuuaaaagaaugau

SEQ ID NO: 1462608 - RNA, 22 nt, Human
augcuguauuuuaaaagaauga

SEQ ID NO: 1462609 - RNA, 21 nt, Human
augcuucuguuuuauaauuuu

SEQ ID NO: 1462610 - RNA, 12 nt, Human
uuguaaugaaaa

SEQ ID NO: 1462611 - RNA, 22 nt, Human
uuguaagcaugcacaaauucug

SEQ ID NO: 1462612 - RNA, 14 nt, Human
uuguaauaaaaugu

SEQ ID NO: 1462613 - RNA, 21 nt, Human
uuguaauagauguuugauaga

SEQ ID NO: 1462614 - RNA, 20 nt, Human
uugguuuucacauuggaaac

SEQ ID NO: 1462615 - RNA, 18 nt, Human
uuguaagacaaagguuuu

SEQ ID NO: 1462616 - RNA, 21 nt, Human
uuguaagacaaagguuuuccu

SEQ ID NO: 1462617 - RNA, 22 nt, Human
uuguaagacaaagguuuuccuc

SEQ ID NO: 1462618 - RNA, 23 nt, Human
uuggguagaaagagauacagagg

SEQ ID NO: 1462619 - RNA, 14 nt, Human
uuggguccaggagg

SEQ ID NO: 1462620 - RNA, 12 nt, Human
uuggguccagga

SEQ ID NO: 1462621 - RNA, 13 nt, Human
uuggguccaggag

SEQ ID NO: 1462622 - RNA, 14 nt, Human
uugguggccacaua

SEQ ID NO: 1462623 - RNA, 14 nt, Human
uugguuugccuucc

SEQ ID NO: 1462624 - RNA, 19 nt, Human
uuggccaugcagaaagcau

SEQ ID NO: 1462625 - RNA, 13 nt, Human
uuggccaugcaga

SEQ ID NO: 1462626 - RNA, 14 nt, Human
uuggccaugggagg

SEQ ID NO: 1462627 - RNA, 13 nt, Human
augaaauauuaug

SEQ ID NO: 1462628 - RNA, 12 nt, Human
augaacaaaugg

SEQ ID NO: 1462629 - RNA, 14 nt, Human
augaagcaaugcuu

SEQ ID NO: 1462630 - RNA, 19 nt, Human
augaagaaaaucacuuagg

SEQ ID NO: 1462631 - RNA, 14 nt, Human
augaagaacugagg

SEQ ID NO: 1462632 - RNA, 16 nt, Human
augaacagaacauaga

SEQ ID NO: 1462633 - RNA, 23 nt, Human
augaaccucaagcugcaucuaga

SEQ ID NO: 1462634 - RNA, 15 nt, Human
augaagcaaugcuuc

SEQ ID NO: 1462635 - RNA, 15 nt, Human
aucuuauaauuuaaa

SEQ ID NO: 1462636 - RNA, 16 nt, Human
aucuuauaauuuaaaa

SEQ ID NO: 1462637 - RNA, 16 nt, Human
aucuuaauuauuguac

SEQ ID NO: 1462638 - RNA, 14 nt, Human
aucuguuuuucuaa

SEQ ID NO: 1462639 - RNA, 17 nt, Human
uuggagaagaacugaaa

SEQ ID NO: 1462640 - RNA, 22 nt, Human
uuggagaagaacugaaaucaua

SEQ ID NO: 1462641 - RNA, 15 nt, Human
uuggagaagaacuga

SEQ ID NO: 1462642 - RNA, 16 nt, Human
uuggacuugucccggg

SEQ ID NO: 1462643 - RNA, 20 nt, Human
uuggagauaaucuagaacac

SEQ ID NO: 1462644 - RNA, 16 nt, Human
uugcuuuuaaaaucca

SEQ ID NO: 1462645 - RNA, 20 nt, Human
uugcuuuguauuguauauua

SEQ ID NO: 1462646 - RNA, 18 nt, Human
uugcucuugaugccuggc

SEQ ID NO: 1462647 - RNA, 17 nt, Human
uugcucuugaugccugg

SEQ ID NO: 1462648 - RNA, 14 nt, Human
uugcucuugaugcc

SEQ ID NO: 1462649 - RNA, 21 nt, Human
aucuuuaaaagaugcuuuuaa

SEQ ID NO: 1462650 - RNA, 20 nt, Human
aucuuuaaaagaugcuuuua

SEQ ID NO: 1462651 - RNA, 19 nt, Human
uugcuuaucaacuuccuaa

SEQ ID NO: 1462652 - RNA, 13 nt, Human
uugcuuaugacau

SEQ ID NO: 1462653 - RNA, 17 nt, Human
uugcaacuuuguauaaa

SEQ ID NO: 1462654 - RNA, 16 nt, Human
uugcaacuuuguauaa

SEQ ID NO: 1462655 - RNA, 18 nt, Human
uugcaacuuuguauaaaa

SEQ ID NO: 1462656 - RNA, 22 nt, Human
uugcaagccagauuuuccugaa

SEQ ID NO: 1462657 - RNA, 22 nt, Human
aucugagaaaagcuuugaaccc

SEQ ID NO: 1462658 - RNA, 21 nt, Human
aucugacccuaugggucuagg

SEQ ID NO: 1462659 - RNA, 18 nt, Human
aucugagaaaagcuuuga

SEQ ID NO: 1462660 - RNA, 16 nt, Human
aucucuuguuuaaauu

SEQ ID NO: 1462661 - RNA, 18 nt, Human
aucucaccaggcagccuc

SEQ ID NO: 1462662 - RNA, 20 nt, Human
aucucacacucaugcauugu

SEQ ID NO: 1462663 - RNA, 11 nt, Human
aucucacacuc

SEQ ID NO: 1462664 - RNA, 15 nt, Human
aucucaccaggcagc

SEQ ID NO: 1462665 - RNA, 22 nt, Human
aucucaccaggcagccucuggg

SEQ ID NO: 1462666 - RNA, 22 nt, Human
aucucacacucaugcauugucc

SEQ ID NO: 1462667 - RNA, 18 nt, Human
uugcaaucccuuaauauc

SEQ ID NO: 1462668 - RNA, 21 nt, Human
uugccaagggcauaaauuauu

SEQ ID NO: 1462669 - RNA, 13 nt, Human
uugacaugggaca

SEQ ID NO: 1462670 - RNA, 23 nt, Human
uugacacuagcccaaugaaauga

SEQ ID NO: 1462671 - RNA, 20 nt, Human
aucccuuaauauccuaaaca

SEQ ID NO: 1462672 - RNA, 21 nt, Human
aucccuuaauauccuaaacau

SEQ ID NO: 1462673 - RNA, 16 nt, Human
uugacaauugggagcu

SEQ ID NO: 1462674 - RNA, 19 nt, Human
uugagaaaaauauauacua

SEQ ID NO: 1462675 - RNA, 11 nt, Human
uugagaaaaau

SEQ ID NO: 1462676 - RNA, 17 nt, Human
uugacuuuuugcauuua

SEQ ID NO: 1462677 - RNA, 16 nt, Human
uugacuuuuugcauuu

SEQ ID NO: 1462678 - RNA, 12 nt, Human
uugacuuuuuau

SEQ ID NO: 1462679 - RNA, 15 nt, Human
uugagcaucacagaa

SEQ ID NO: 1462680 - RNA, 16 nt, Human
uugagcaucacagaau

SEQ ID NO: 1462681 - RNA, 13 nt, Human
uugaguguuuaaa

SEQ ID NO: 1462682 - RNA, 15 nt, Human
uugauagaaaugcca

SEQ ID NO: 1462683 - RNA, 13 nt, Human
aucuaauuuauaa

SEQ ID NO: 1462684 - RNA, 14 nt, Human
aucuaauuuauaaa

SEQ ID NO: 1462685 - RNA, 15 nt, Human
aucuaauuuauaaaa

SEQ ID NO: 1462686 - RNA, 19 nt, Human
aucuaauuuauaaaaaggu

SEQ ID NO: 1462687 - RNA, 23 nt, Human
aucuaauuuauaaaaagguguuu

SEQ ID NO: 1462688 - RNA, 19 nt, Human
aucuauuuuuggcagucug

SEQ ID NO: 1462689 - RNA, 23 nt, Human
aucuauuuuuggcagucugaauu

SEQ ID NO: 1462690 - RNA, 14 nt, Human
auauuugaaauauu

SEQ ID NO: 1462691 - RNA, 19 nt, Human
auauuugaaauauugacuu

SEQ ID NO: 1462692 - RNA, 23 nt, Human
auauuugaaauauugacuuuuua

SEQ ID NO: 1462693 - RNA, 13 nt, Human
auauuuguacaua

SEQ ID NO: 1462694 - RNA, 12 nt, Human
auauuuguacau

SEQ ID NO: 1462695 - RNA, 18 nt, Human
auauuugugacaaaaaau

SEQ ID NO: 1462696 - RNA, 15 nt, Human
auauuuguuauguag

SEQ ID NO: 1462697 - RNA, 14 nt, Human
auauuuuaaagaau

SEQ ID NO: 1462698 - RNA, 15 nt, Human
auauuuuaaagaauu

SEQ ID NO: 1462699 - RNA, 16 nt, Human
auauuuuaaagaauug

SEQ ID NO: 1462700 - RNA, 20 nt, Human
auauuuuaaagaauuguguc

SEQ ID NO: 1462701 - RNA, 13 nt, Human
auauuugaaauau

SEQ ID NO: 1462702 - RNA, 21 nt, Human
auauuguggguguuaauuuuu

SEQ ID NO: 1462703 - RNA, 19 nt, Human
auauuguggguguuaauuu

SEQ ID NO: 1462704 - RNA, 13 nt, Human
auauugauuuauu

SEQ ID NO: 1462705 - RNA, 15 nt, Human
auauugauuuauuaa

SEQ ID NO: 1462706 - RNA, 22 nt, Human
auauucucacagcuccaagaau

SEQ ID NO: 1462707 - RNA, 23 nt, Human
auauucucacagcuccaagaauu

SEQ ID NO: 1462708 - RNA, 17 nt, Human
auauuccuauugugcaa

SEQ ID NO: 1462709 - RNA, 22 nt, Human
auauuccuauugugcaauguaa

SEQ ID NO: 1462710 - RNA, 23 nt, Human
auauuccuauugugcaauguaaa

SEQ ID NO: 1462711 - RNA, 22 nt, Human
auauugauccagaaagaaaacu

SEQ ID NO: 1462712 - RNA, 15 nt, Human
auauugauccagaaa

SEQ ID NO: 1462713 - RNA, 14 nt, Human
auauuaauauuccu

SEQ ID NO: 1462714 - RNA, 16 nt, Human
uucaugucugcuauca

SEQ ID NO: 1462715 - RNA, 18 nt, Human
auauuuucaugcuguuca

SEQ ID NO: 1462716 - RNA, 21 nt, Human
auauuuucaugcuguucauga

SEQ ID NO: 1462717 - RNA, 16 nt, Human
uuccuucagcacuuua

SEQ ID NO: 1462718 - RNA, 19 nt, Human
uuccuucagcacuuuagaa

SEQ ID NO: 1462719 - RNA, 15 nt, Human
uuccuucagcacuuu

SEQ ID NO: 1462720 - RNA, 16 nt, Human
uuccugggagcuuuug

SEQ ID NO: 1462721 - RNA, 16 nt, Human
uuccugggaacaucac

SEQ ID NO: 1462722 - RNA, 15 nt, Human
uuccugggagcuuuu

SEQ ID NO: 1462723 - RNA, 19 nt, Human
uuccuggugccaauuucaa

SEQ ID NO: 1462724 - RNA, 20 nt, Human
uuccuggugccaauuucaag

SEQ ID NO: 1462725 - RNA, 18 nt, Human
uuccucugucuccuaagc

SEQ ID NO: 1462726 - RNA, 20 nt, Human
uuccucuucuauuuuguaaa

SEQ ID NO: 1462727 - RNA, 14 nt, Human
auauuuuaagacga

SEQ ID NO: 1462728 - RNA, 12 nt, Human
auauuuuaaaua

SEQ ID NO: 1462729 - RNA, 13 nt, Human
aucaagagacuga

SEQ ID NO: 1462730 - RNA, 13 nt, Human
aucaaucaacuua

SEQ ID NO: 1462731 - RNA, 17 nt, Human
aucacuagcccuccuuu

SEQ ID NO: 1462732 - RNA, 12 nt, Human
uuccuuuuaauu

SEQ ID NO: 1462733 - RNA, 22 nt, Human
uuccuuuuacuuuucuucuauu

SEQ ID NO: 1462734 - RNA, 12 nt, Human
uuccuuuuacuu

SEQ ID NO: 1462735 - RNA, 18 nt, Human
uuccuuuuacuuuucuuc

SEQ ID NO: 1462736 - RNA, 22 nt, Human
aucacuagcccuccuuuuucca

SEQ ID NO: 1462737 - RNA, 20 nt, Human
aucacuguuuagaacacaca

SEQ ID NO: 1462738 - RNA, 18 nt, Human
aucacuguuuagaacaca

SEQ ID NO: 1462739 - RNA, 14 nt, Human
aucauucauuuucu

SEQ ID NO: 1462740 - RNA, 15 nt, Human
aucauucauuuuugu

SEQ ID NO: 1462741 - RNA, 17 nt, Human
aucagaguugcugcaaa

SEQ ID NO: 1462742 - RNA, 15 nt, Human
aucagauagcaucuu

SEQ ID NO: 1462743 - RNA, 17 nt, Human
aucauaagauauuuuuc

SEQ ID NO: 1462744 - RNA, 12 nt, Human
aucauagaaaug

SEQ ID NO: 1462745 - RNA, 15 nt, Human
aucauagaaauguaa

SEQ ID NO: 1462746 - RNA, 14 nt, Human
uucucaacuccaaa

SEQ ID NO: 1462747 - RNA, 18 nt, Human
uucucaacuccaaacuga

SEQ ID NO: 1462748 - RNA, 17 nt, Human
uucuaguucugccagga

SEQ ID NO: 1462749 - RNA, 14 nt, Human
uucuaguugaaaau

SEQ ID NO: 1462750 - RNA, 14 nt, Human
uucuagguaggaaa

SEQ ID NO: 1462751 - RNA, 18 nt, Human
uucuagguaggaaaugug

SEQ ID NO: 1462752 - RNA, 20 nt, Human
uucucacagcuccaagaauu

SEQ ID NO: 1462753 - RNA, 14 nt, Human
uucucaguuuucau

SEQ ID NO: 1462754 - RNA, 15 nt, Human
uucucaguuuucaua

SEQ ID NO: 1462755 - RNA, 12 nt, Human
uucucauaacuu

SEQ ID NO: 1462756 - RNA, 17 nt, Human
aucagagcgcacaggga

SEQ ID NO: 1462757 - RNA, 22 nt, Human
uucugguaugaacuugaggaca

SEQ ID NO: 1462758 - RNA, 21 nt, Human
uucugguaugaacuugaggac

SEQ ID NO: 1462759 - RNA, 19 nt, Human
uucuguaagaaaccuacug

SEQ ID NO: 1462760 - RNA, 15 nt, Human
uucuguaagaaaccu

SEQ ID NO: 1462761 - RNA, 12 nt, Human
uucugccaggag

SEQ ID NO: 1462762 - RNA, 14 nt, Human
uucugaagaagaug

SEQ ID NO: 1462763 - RNA, 12 nt, Human
uucugaagaaga

SEQ ID NO: 1462764 - RNA, 13 nt, Human
uucugaagaagau

SEQ ID NO: 1462765 - RNA, 21 nt, Human
uucugaaauuuccugggagcu

SEQ ID NO: 1462766 - RNA, 20 nt, Human
aucauuuuaccuuugacaaa

SEQ ID NO: 1462767 - RNA, 15 nt, Human
auccauucuccugag

SEQ ID NO: 1462768 - RNA, 11 nt, Human
aucccaacacu

SEQ ID NO: 1462769 - RNA, 15 nt, Human
aucccaacacugcca

SEQ ID NO: 1462770 - RNA, 16 nt, Human
aucccaacacugccag

SEQ ID NO: 1462771 - RNA, 17 nt, Human
aucccaacacugccagc

SEQ ID NO: 1462772 - RNA, 23 nt, Human
aucauuucuuuuugggagagacu

SEQ ID NO: 1462773 - RNA, 18 nt, Human
aucauuuguuggaaugaa

SEQ ID NO: 1462774 - RNA, 12 nt, Human
aucccuccuguu

SEQ ID NO: 1462775 - RNA, 15 nt, Human
aucccuccuguuggg

SEQ ID NO: 1462776 - RNA, 13 nt, Human
aucccuccuguug

SEQ ID NO: 1462777 - RNA, 12 nt, Human
aucccuggcccc

SEQ ID NO: 1462778 - RNA, 16 nt, Human
aucccuggcccccucc

SEQ ID NO: 1462779 - RNA, 22 nt, Human
aucccuggcccccucccuggau

SEQ ID NO: 1462780 - RNA, 10 nt, Human
aucccuggcc

SEQ ID NO: 1462781 - RNA, 11 nt, Human
aucccuggccc

SEQ ID NO: 1462782 - RNA, 20 nt, Human
aucccugggccuugggcucc

SEQ ID NO: 1462783 - RNA, 15 nt, Human
aucccugggccuugg

SEQ ID NO: 1462784 - RNA, 16 nt, Human
uucaaaauuguuacaa

SEQ ID NO: 1462785 - RNA, 15 nt, Human
uucaaacauauauaa

SEQ ID NO: 1462786 - RNA, 19 nt, Human
uucaacuuauuaacaauua

SEQ ID NO: 1462787 - RNA, 18 nt, Human
uucaagugcuucuccagc

SEQ ID NO: 1462788 - RNA, 23 nt, Human
uucaaguuccaaguugcuaauac

SEQ ID NO: 1462789 - RNA, 23 nt, Human
uucaagaaacugaggaauuuucu

SEQ ID NO: 1462790 - RNA, 22 nt, Human
uucaagaaagcuucaaacugca

SEQ ID NO: 1462791 - RNA, 12 nt, Human
uucaacuuuucc

SEQ ID NO: 1462792 - RNA, 12 nt, Human
uucaagaaacug

SEQ ID NO: 1462793 - RNA, 13 nt, Human
uucaagaaacuga

SEQ ID NO: 1462794 - RNA, 20 nt, Human
uucaagaaacugaggaauuu

SEQ ID NO: 1462795 - RNA, 23 nt, Human
auagggcaauuaauuccuucagc

SEQ ID NO: 1462796 - RNA, 22 nt, Human
auagggcaauuaauuccuucag

SEQ ID NO: 1462797 - RNA, 21 nt, Human
auagggcaauuaauuccuuca

SEQ ID NO: 1462798 - RNA, 22 nt, Human
auagggaaaauucuaacccagg

SEQ ID NO: 1462799 - RNA, 17 nt, Human
auagggcugagcucucu

SEQ ID NO: 1462800 - RNA, 14 nt, Human
auagggcugagcuc

SEQ ID NO: 1462801 - RNA, 14 nt, Human
auagggucuaacuc

SEQ ID NO: 1462802 - RNA, 22 nt, Human
auaggauuuauuuaaaauagca

SEQ ID NO: 1462803 - RNA, 16 nt, Human
auagggaaaauucuaa

SEQ ID NO: 1462804 - RNA, 17 nt, Human
auaggcacaggaaacca

SEQ ID NO: 1462805 - RNA, 23 nt, Human
auaggauuuauuuaaaauagcaa

SEQ ID NO: 1462806 - RNA, 23 nt, Human
auaggaucauuuguuggaaugaa

SEQ ID NO: 1462807 - RNA, 16 nt, Human
auaggauuuauuuaaa

SEQ ID NO: 1462808 - RNA, 21 nt, Human
auaggauuuauuuaaaauagc

SEQ ID NO: 1462809 - RNA, 14 nt, Human
uucacauuggaaac

SEQ ID NO: 1462810 - RNA, 19 nt, Human
uucacauuuuccuuuucaa

SEQ ID NO: 1462811 - RNA, 14 nt, Human
uucaccaaaucuug

SEQ ID NO: 1462812 - RNA, 17 nt, Human
uucacauuuuuguauuu

SEQ ID NO: 1462813 - RNA, 18 nt, Human
uucaccagauuugcuaau

SEQ ID NO: 1462814 - RNA, 19 nt, Human
uucacauuguauucagagu

SEQ ID NO: 1462815 - RNA, 13 nt, Human
uucacauuggaaa

SEQ ID NO: 1462816 - RNA, 12 nt, Human
uucaauaaagcu

SEQ ID NO: 1462817 - RNA, 13 nt, Human
uucaauaaagcug

SEQ ID NO: 1462818 - RNA, 18 nt, Human
auagcuaaguacacaaua

SEQ ID NO: 1462819 - RNA, 15 nt, Human
auagcuaaguacaca

SEQ ID NO: 1462820 - RNA, 14 nt, Human
auagcuaaguacac

SEQ ID NO: 1462821 - RNA, 13 nt, Human
auagcuaaguaca

SEQ ID NO: 1462822 - RNA, 13 nt, Human
auagcuaaauacc

SEQ ID NO: 1462823 - RNA, 17 nt, Human
auagcuacuaauuuuaa

SEQ ID NO: 1462824 - RNA, 14 nt, Human
auagcuacuaauuu

SEQ ID NO: 1462825 - RNA, 16 nt, Human
auaagauauuuuucau

SEQ ID NO: 1462826 - RNA, 15 nt, Human
auaagauauuuuuca

SEQ ID NO: 1462827 - RNA, 19 nt, Human
auaacuugagaccuaaucu

SEQ ID NO: 1462828 - RNA, 21 nt, Human
auaacuugagaccuaaucucu

SEQ ID NO: 1462829 - RNA, 15 nt, Human
auaagagcucaggau

SEQ ID NO: 1462830 - RNA, 18 nt, Human
auagcuacuaauuuuaaa

SEQ ID NO: 1462831 - RNA, 12 nt, Human
uuauuucaauau

SEQ ID NO: 1462832 - RNA, 15 nt, Human
uuauuucaugaaaau

SEQ ID NO: 1462833 - RNA, 15 nt, Human
uuauuuauuggagau

SEQ ID NO: 1462834 - RNA, 14 nt, Human
auagcugaucaguu

SEQ ID NO: 1462835 - RNA, 22 nt, Human
uuauuuaaaauagcaaaagaag

SEQ ID NO: 1462836 - RNA, 21 nt, Human
uuauuuaaaauagcaaaagaa

SEQ ID NO: 1462837 - RNA, 23 nt, Human
uuauuuaaaccgcuaaaagaaac

SEQ ID NO: 1462838 - RNA, 17 nt, Human
uuauuuaaaaaacuaaa

SEQ ID NO: 1462839 - RNA, 15 nt, Human
uuauuuaaaauagca

SEQ ID NO: 1462840 - RNA, 16 nt, Human
uuauuuaaaauagcaa

SEQ ID NO: 1462841 - RNA, 14 nt, Human
uuauuuaaaucugu

SEQ ID NO: 1462842 - RNA, 18 nt, Human
auauauucagccuggcuu

SEQ ID NO: 1462843 - RNA, 16 nt, Human
auauauuaucuuuuca

SEQ ID NO: 1462844 - RNA, 17 nt, Human
auaucuauauuuuacau

SEQ ID NO: 1462845 - RNA, 16 nt, Human
auaucuauauuuuaca

SEQ ID NO: 1462846 - RNA, 20 nt, Human
auaucuauauuuuacauaaa

SEQ ID NO: 1462847 - RNA, 22 nt, Human
auaucuauauuuuacauaaauu

SEQ ID NO: 1462848 - RNA, 14 nt, Human
uucaucauuuuuua

SEQ ID NO: 1462849 - RNA, 13 nt, Human
auauauuaucuuu

SEQ ID NO: 1462850 - RNA, 14 nt, Human
auauauuaucuuuu

SEQ ID NO: 1462851 - RNA, 15 nt, Human
auauauuaucuuuuc

SEQ ID NO: 1462852 - RNA, 18 nt, Human
uucauagagacuugggaa

SEQ ID NO: 1462853 - RNA, 13 nt, Human
auaugauucaaau

SEQ ID NO: 1462854 - RNA, 22 nt, Human
auaugauucaaaugucuauaaa

SEQ ID NO: 1462855 - RNA, 12 nt, Human
auaugauucaaa

SEQ ID NO: 1462856 - RNA, 13 nt, Human
auaugugaacagu

SEQ ID NO: 1462857 - RNA, 22 nt, Human
auaugucaagugcugugcaagg

SEQ ID NO: 1462858 - RNA, 17 nt, Human
auauaacaaugcuguau

SEQ ID NO: 1462859 - RNA, 19 nt, Human
auauaagcuuguauuccuu

SEQ ID NO: 1462860 - RNA, 12 nt, Human
auauaagcuuuu

SEQ ID NO: 1462861 - RNA, 12 nt, Human
auauaacaaugc

SEQ ID NO: 1462862 - RNA, 15 nt, Human
auauaacaaugcugu

SEQ ID NO: 1462863 - RNA, 17 nt, Human
auauauaacaaugcugu

SEQ ID NO: 1462864 - RNA, 18 nt, Human
auauauaacaaugcugua

SEQ ID NO: 1462865 - RNA, 19 nt, Human
auauauaacaaugcuguau

SEQ ID NO: 1462866 - RNA, 12 nt, Human
auauaguuuuac

SEQ ID NO: 1462867 - RNA, 13 nt, Human
auauaguuuuacu

SEQ ID NO: 1462868 - RNA, 16 nt, Human
auauaguuuuacuuuu

SEQ ID NO: 1462869 - RNA, 18 nt, Human
auauaguuuuacuuuuaa

SEQ ID NO: 1462870 - RNA, 23 nt, Human
auauaguuuuacuuuuaaacugu

SEQ ID NO: 1462871 - RNA, 18 nt, Human
auagucaaauugugugaa

SEQ ID NO: 1462872 - RNA, 20 nt, Human
auaggguuugugacagggcg

SEQ ID NO: 1462873 - RNA, 18 nt, Human
auagguagaauguaaagc

SEQ ID NO: 1462874 - RNA, 20 nt, Human
auagguagaauguaaagcuu

SEQ ID NO: 1462875 - RNA, 22 nt, Human
auagucauguaagcugaaaaua

SEQ ID NO: 1462876 - RNA, 18 nt, Human
auaguuuggauauguaaa

SEQ ID NO: 1462877 - RNA, 23 nt, Human
auaguuuggauauguaaaacauu

SEQ ID NO: 1462878 - RNA, 17 nt, Human
auaguccagcuuuguuc

SEQ ID NO: 1462879 - RNA, 19 nt, Human
auaguuuggauauguaaaa

SEQ ID NO: 1462880 - RNA, 15 nt, Human
auaguuuuacuuuua

SEQ ID NO: 1462881 - RNA, 21 nt, Human
auaguuuuacuuuuaaacugu

SEQ ID NO: 1462882 - RNA, 22 nt, Human
auaguuuuacuuuuaaacugug

SEQ ID NO: 1462883 - RNA, 23 nt, Human
auaguuuuacuuuuaaacugugu

SEQ ID NO: 1462884 - RNA, 16 nt, Human
auaguuuuauuaauaa

SEQ ID NO: 1462885 - RNA, 22 nt, Human
auauaaauauuagaaacagcuu

SEQ ID NO: 1462886 - RNA, 16 nt, Human
auauaaauauuagaaa

SEQ ID NO: 1462887 - RNA, 18 nt, Human
uucagaugugaaccauua

SEQ ID NO: 1462888 - RNA, 20 nt, Human
uucagcaaacucuuuuccca

SEQ ID NO: 1462889 - RNA, 15 nt, Human
uucagaugugaacca

SEQ ID NO: 1462890 - RNA, 16 nt, Human
uucagaugugaaccau

SEQ ID NO: 1462891 - RNA, 19 nt, Human
uucagcaaguuagaacuag

SEQ ID NO: 1462892 - RNA, 14 nt, Human
auauauacuauuaa

SEQ ID NO: 1462893 - RNA, 15 nt, Human
uucacuguagaauga

SEQ ID NO: 1462894 - RNA, 22 nt, Human
uucacuguagaaugauuucaug

SEQ ID NO: 1462895 - RNA, 15 nt, Human
uuacuguaagaaaau

SEQ ID NO: 1462896 - RNA, 18 nt, Human
uuacugguccaaaagauu

SEQ ID NO: 1462897 - RNA, 14 nt, Human
uuacugguccaaaa

SEQ ID NO: 1462898 - RNA, 15 nt, Human
uuacugguccaaaag

SEQ ID NO: 1462899 - RNA, 17 nt, Human
uuacugguccaaaagau

SEQ ID NO: 1462900 - RNA, 15 nt, Human
uuacuguaacugauu

SEQ ID NO: 1462901 - RNA, 17 nt, Human
uuagaagacaauugaca

SEQ ID NO: 1462902 - RNA, 14 nt, Human
uuacugauauauuu

SEQ ID NO: 1462903 - RNA, 23 nt, Human
uuacugauauauuuuacaauuuu

SEQ ID NO: 1462904 - RNA, 20 nt, Human
uuacauaauucacucugagu

SEQ ID NO: 1462905 - RNA, 13 nt, Human
uuacaucauuucu

SEQ ID NO: 1462906 - RNA, 14 nt, Human
uuacaucauuucuu

SEQ ID NO: 1462907 - RNA, 18 nt, Human
auaaacacucuugaaaaa

SEQ ID NO: 1462908 - RNA, 16 nt, Human
auaaaguugauaaaga

SEQ ID NO: 1462909 - RNA, 21 nt, Human
auaaaguugauaaagauuuuu

SEQ ID NO: 1462910 - RNA, 17 nt, Human
auaaaguugauaaagau

SEQ ID NO: 1462911 - RNA, 20 nt, Human
auaaaguugauaaagauuuu

SEQ ID NO: 1462912 - RNA, 21 nt, Human
auaaauauccuuuaauugauc

SEQ ID NO: 1462913 - RNA, 14 nt, Human
auaaauauccuuua

SEQ ID NO: 1462914 - RNA, 13 nt, Human
auaaauguaucau

SEQ ID NO: 1462915 - RNA, 17 nt, Human
auaaauguaucauagaa

SEQ ID NO: 1462916 - RNA, 21 nt, Human
auaaauguaucauagaaaugu

SEQ ID NO: 1462917 - RNA, 21 nt, Human
auaacuaacaaccaaagacua

SEQ ID NO: 1462918 - RNA, 20 nt, Human
auaaaaggucggaccagcuu

SEQ ID NO: 1462919 - RNA, 16 nt, Human
auaaaauaauuuuuau

SEQ ID NO: 1462920 - RNA, 21 nt, Human
auaaaauaauuuuuauauuug

SEQ ID NO: 1462921 - RNA, 22 nt, Human
auaaaauaauuuuuauauuuga

SEQ ID NO: 1462922 - RNA, 18 nt, Human
auaaaauccauacauuug

SEQ ID NO: 1462923 - RNA, 19 nt, Human
auaaaauccauacauuugu

SEQ ID NO: 1462924 - RNA, 18 nt, Human
uuaaguaaugauaacugg

SEQ ID NO: 1462925 - RNA, 18 nt, Human
uuaaguaaggaauuuuau

SEQ ID NO: 1462926 - RNA, 22 nt, Human
uuaagaagacugcauuauauuu

SEQ ID NO: 1462927 - RNA, 20 nt, Human
uuaauuccuucagcacuuua

SEQ ID NO: 1462928 - RNA, 19 nt, Human
uuaauuccuucagcacuuu

SEQ ID NO: 1462929 - RNA, 17 nt, Human
uuaauuccuucagcacu

SEQ ID NO: 1462930 - RNA, 14 nt, Human
uuaaugaacaaaug

SEQ ID NO: 1462931 - RNA, 17 nt, Human
uuaauaaacacucuuga

SEQ ID NO: 1462932 - RNA, 13 nt, Human
uuaauaaacacuc

SEQ ID NO: 1462933 - RNA, 20 nt, Human
auaaaauuuuuaaucuuuaa

SEQ ID NO: 1462934 - RNA, 15 nt, Human
uuaauuuagaaaacu

SEQ ID NO: 1462935 - RNA, 16 nt, Human
uuaauuuagaaaacuu

SEQ ID NO: 1462936 - RNA, 16 nt, Human
uuaaaauuacaacuaa

SEQ ID NO: 1462937 - RNA, 16 nt, Human
uuaaaaagguuuacag

SEQ ID NO: 1462938 - RNA, 20 nt, Human
uuaaaaaguaauaaaauuca

SEQ ID NO: 1462939 - RNA, 14 nt, Human
uuaaaaacugagug

SEQ ID NO: 1462940 - RNA, 14 nt, Human
uuaacaacuugucu

SEQ ID NO: 1462941 - RNA, 19 nt, Human
uuaacagagucugaaccua

SEQ ID NO: 1462942 - RNA, 12 nt, Human
uuaacauaccua

SEQ ID NO: 1462943 - RNA, 22 nt, Human
uuaacauaccuaagaaguacau

SEQ ID NO: 1462944 - RNA, 17 nt, Human
uuaacauaccuaagaag

SEQ ID NO: 1462945 - RNA, 20 nt, Human
uuaaauuuuuuuuacauuuu

SEQ ID NO: 1462946 - RNA, 19 nt, Human
uuaaauuuuuuuuacauuu

SEQ ID NO: 1462947 - RNA, 18 nt, Human
uuaaauuuuuuuuacauu

SEQ ID NO: 1462948 - RNA, 18 nt, Human
uuaacaaauguaucacua

SEQ ID NO: 1462949 - RNA, 17 nt, Human
uuaaauuuuuuuuacau

SEQ ID NO: 1462950 - RNA, 15 nt, Human
uuaaauaagaaacuu

SEQ ID NO: 1462951 - RNA, 17 nt, Human
uuaaauaagaaacuuuu

SEQ ID NO: 1462952 - RNA, 15 nt, Human
aguuguuugugccuu

SEQ ID NO: 1462953 - RNA, 17 nt, Human
aguuuaauaaauuuauu

SEQ ID NO: 1462954 - RNA, 22 nt, Human
aguuuaauggugccuucauuug

SEQ ID NO: 1462955 - RNA, 20 nt, Human
aguuuaauggugccuucauu

SEQ ID NO: 1462956 - RNA, 12 nt, Human
aguuuagggugg

SEQ ID NO: 1462957 - RNA, 13 nt, Human
aguuuaggguggg

SEQ ID NO: 1462958 - RNA, 14 nt, Human
aguuuagggugggg

SEQ ID NO: 1462959 - RNA, 10 nt, Human
aguugcagcc

SEQ ID NO: 1462960 - RNA, 22 nt, Human
aguugcauagguuuaauaauuu

SEQ ID NO: 1462961 - RNA, 18 nt, Human
aguugggacuacaggcgu

SEQ ID NO: 1462962 - RNA, 15 nt, Human
aguugcuauuugaac

SEQ ID NO: 1462963 - RNA, 16 nt, Human
aguugcugcaaaccug

SEQ ID NO: 1462964 - RNA, 17 nt, Human
aguugcugcaaaccuga

SEQ ID NO: 1462965 - RNA, 16 nt, Human
uguuuauaaacauugu

SEQ ID NO: 1462966 - RNA, 19 nt, Human
uguugccuugcauaauggu

SEQ ID NO: 1462967 - RNA, 19 nt, Human
uguuucuuuguaaugaaaa

SEQ ID NO: 1462968 - RNA, 18 nt, Human
uguuucuuuguaaugaaa

SEQ ID NO: 1462969 - RNA, 13 nt, Human
uguuugauagauu

SEQ ID NO: 1462970 - RNA, 14 nt, Human
uguuuugcaagcca

SEQ ID NO: 1462971 - RNA, 12 nt, Human
aguucugccagg

SEQ ID NO: 1462972 - RNA, 23 nt, Human
aguucuuacugcuuaauucaaau

SEQ ID NO: 1462973 - RNA, 19 nt, Human
aguucuuacugcuuaauuc

SEQ ID NO: 1462974 - RNA, 13 nt, Human
aguucugccagga

SEQ ID NO: 1462975 - RNA, 14 nt, Human
aguucugccaggag

SEQ ID NO: 1462976 - RNA, 20 nt, Human
aguucugccaggagacaggu

SEQ ID NO: 1462977 - RNA, 21 nt, Human
uguuuuauuuaaccucuaaau

SEQ ID NO: 1462978 - RNA, 14 nt, Human
uguuuuaugagaaa

SEQ ID NO: 1462979 - RNA, 15 nt, Human
uguuuuaugagaaag

SEQ ID NO: 1462980 - RNA, 19 nt, Human
uguuuuaugagaaagccuu

SEQ ID NO: 1462981 - RNA, 18 nt, Human
uguuugcaccuuucuagu

SEQ ID NO: 1462982 - RNA, 20 nt, Human
uguuugcaccuuucuaguug

SEQ ID NO: 1462983 - RNA, 23 nt, Human
uguuugcaccuuucuaguugaaa

SEQ ID NO: 1462984 - RNA, 22 nt, Human
uguuugcaccuuucuaguugaa

SEQ ID NO: 1462985 - RNA, 12 nt, Human
uguuugcuuucu

SEQ ID NO: 1462986 - RNA, 22 nt, Human
uguuugcuuucugaucaaggcc

SEQ ID NO: 1462987 - RNA, 13 nt, Human
uguuugcuuucug

SEQ ID NO: 1462988 - RNA, 16 nt, Human
uguuuuaugagaaagc

SEQ ID NO: 1462989 - RNA, 11 nt, Human
uguuuucuucu

SEQ ID NO: 1462990 - RNA, 13 nt, Human
uguguugaagagg

SEQ ID NO: 1462991 - RNA, 13 nt, Human
uguguguuuggaa

SEQ ID NO: 1462992 - RNA, 19 nt, Human
uguguucccauuucagcug

SEQ ID NO: 1462993 - RNA, 20 nt, Human
uguuaagggaagaauuccag

SEQ ID NO: 1462994 - RNA, 15 nt, Human
uguuaauuuagaaaa

SEQ ID NO: 1462995 - RNA, 17 nt, Human
uguuaauuuagaaaacu

SEQ ID NO: 1462996 - RNA, 18 nt, Human
uguuaauuuagaaaacuu

SEQ ID NO: 1462997 - RNA, 20 nt, Human
uguuaauuuagaaaacuuua

SEQ ID NO: 1462998 - RNA, 22 nt, Human
uguuaauuuagaaaacuuuaaa

SEQ ID NO: 1462999 - RNA, 13 nt, Human
uguuaauuuuuga

SEQ ID NO: 1463000 - RNA, 15 nt, Human
uguuaauuuuugaua

SEQ ID NO: 1463001 - RNA, 16 nt, Human
uguuaauuuuugauac

SEQ ID NO: 1463002 - RNA, 20 nt, Human
ugugugaaagguacuucaaa

SEQ ID NO: 1463003 - RNA, 13 nt, Human
uguguaaguagau

SEQ ID NO: 1463004 - RNA, 18 nt, Human
uguguaagacaaaaagcu

SEQ ID NO: 1463005 - RNA, 14 nt, Human
uguggguguuaauu

SEQ ID NO: 1463006 - RNA, 22 nt, Human
uguggguguuaauuuuugauac

SEQ ID NO: 1463007 - RNA, 18 nt, Human
agugcugugcaagguauu

SEQ ID NO: 1463008 - RNA, 17 nt, Human
agugcugugcugugcua

SEQ ID NO: 1463009 - RNA, 12 nt, Human
agugcugugcug

SEQ ID NO: 1463010 - RNA, 19 nt, Human
agugcugaauuucccucuc

SEQ ID NO: 1463011 - RNA, 15 nt, Human
agugcugaauuuccc

SEQ ID NO: 1463012 - RNA, 15 nt, Human
uguuauaaucuuuca

SEQ ID NO: 1463013 - RNA, 15 nt, Human
uguuauauaaucauu

SEQ ID NO: 1463014 - RNA, 16 nt, Human
uguuauauaaucauua

SEQ ID NO: 1463015 - RNA, 18 nt, Human
uguucugugauauaagug

SEQ ID NO: 1463016 - RNA, 15 nt, Human
uguucugugauauaa

SEQ ID NO: 1463017 - RNA, 13 nt, Human
aguggacaggagu

SEQ ID NO: 1463018 - RNA, 14 nt, Human
uguuacaaauugua

SEQ ID NO: 1463019 - RNA, 15 nt, Human
aguguagaaccuaau

SEQ ID NO: 1463020 - RNA, 20 nt, Human
aguguagaaccuaauucaau

SEQ ID NO: 1463021 - RNA, 16 nt, Human
uguggcauccagaguc

SEQ ID NO: 1463022 - RNA, 18 nt, Human
ugugcccccaaccauuuc

SEQ ID NO: 1463023 - RNA, 23 nt, Human
ugugcccccaaccauuuccucag

SEQ ID NO: 1463024 - RNA, 19 nt, Human
uguggcauccagagucccu

SEQ ID NO: 1463025 - RNA, 21 nt, Human
uguggcauccagagucccugc

SEQ ID NO: 1463026 - RNA, 11 nt, Human
uguggccagga

SEQ ID NO: 1463027 - RNA, 12 nt, Human
uguggccaggag

SEQ ID NO: 1463028 - RNA, 14 nt, Human
uguggccaggaggu

SEQ ID NO: 1463029 - RNA, 13 nt, Human
uguggccaggagg

SEQ ID NO: 1463030 - RNA, 18 nt, Human
ugugccagauuuaugcau

SEQ ID NO: 1463031 - RNA, 20 nt, Human
ugugccagauuuaugcauau

SEQ ID NO: 1463032 - RNA, 16 nt, Human
ugugccaugucaaaca

SEQ ID NO: 1463033 - RNA, 21 nt, Human
ugugccaugucaaacaaauag

SEQ ID NO: 1463034 - RNA, 17 nt, Human
agugaaagaaaauaaca

SEQ ID NO: 1463035 - RNA, 15 nt, Human
agugaaagaaaauaa

SEQ ID NO: 1463036 - RNA, 20 nt, Human
ugugaacaguuguguuugaa

SEQ ID NO: 1463037 - RNA, 12 nt, Human
ugugacucuuuc

SEQ ID NO: 1463038 - RNA, 14 nt, Human
ugugacucuuucca

SEQ ID NO: 1463039 - RNA, 12 nt, Human
ugugaaauuauu

SEQ ID NO: 1463040 - RNA, 14 nt, Human
ugugaaauuuacau

SEQ ID NO: 1463041 - RNA, 22 nt, Human
agucucuauaccaauaaaguga

SEQ ID NO: 1463042 - RNA, 21 nt, Human
agucucuauaccaauaaagug

SEQ ID NO: 1463043 - RNA, 20 nt, Human
agucucuauaccaauaaagu

SEQ ID NO: 1463044 - RNA, 19 nt, Human
agucucuauaccaauaaag

SEQ ID NO: 1463045 - RNA, 17 nt, Human
agucucuauaccaauaa

SEQ ID NO: 1463046 - RNA, 15 nt, Human
agucucuauaccaau

SEQ ID NO: 1463047 - RNA, 15 nt, Human
ugugacucuuuccaa

SEQ ID NO: 1463048 - RNA, 17 nt, Human
ugugacucuuuccaacc

SEQ ID NO: 1463049 - RNA, 17 nt, Human
agucuuuggaacccuaa

SEQ ID NO: 1463050 - RNA, 14 nt, Human
uguaguguuggaga

SEQ ID NO: 1463051 - RNA, 15 nt, Human
uguaguguuggagaa

SEQ ID NO: 1463052 - RNA, 16 nt, Human
uguaguguuggagaag

SEQ ID NO: 1463053 - RNA, 15 nt, Human
uguaucauagaaaug

SEQ ID NO: 1463054 - RNA, 16 nt, Human
uguaucauagaaaugu

SEQ ID NO: 1463055 - RNA, 17 nt, Human
uguaucauagaaaugua

SEQ ID NO: 1463056 - RNA, 22 nt, Human
uguauuacaaauccaaugaaau

SEQ ID NO: 1463057 - RNA, 13 nt, Human
uguauuacaaauc

SEQ ID NO: 1463058 - RNA, 21 nt, Human
ugucaaggguucaagauuguu

SEQ ID NO: 1463059 - RNA, 13 nt, Human
ugucaaacaaaua

SEQ ID NO: 1463060 - RNA, 21 nt, Human
ugucaaacaaauagucuauca

SEQ ID NO: 1463061 - RNA, 18 nt, Human
aguauuagaauaccacag

SEQ ID NO: 1463062 - RNA, 17 nt, Human
aguauuucuaugaaaua

SEQ ID NO: 1463063 - RNA, 18 nt, Human
aguauuucuaugaaauau

SEQ ID NO: 1463064 - RNA, 22 nt, Human
aguauuucuaugaaauauuaug

SEQ ID NO: 1463065 - RNA, 21 nt, Human
aguauuagaauaccacaggaa

SEQ ID NO: 1463066 - RNA, 14 nt, Human
agucaccucaugga

SEQ ID NO: 1463067 - RNA, 15 nt, Human
agucaccucauggaa

SEQ ID NO: 1463068 - RNA, 17 nt, Human
agucaccucauggaauu

SEQ ID NO: 1463069 - RNA, 20 nt, Human
agucacccuaccugugccug

SEQ ID NO: 1463070 - RNA, 19 nt, Human
agucacccuaccugugccu

SEQ ID NO: 1463071 - RNA, 23 nt, Human
uguacuugcucuugaugccuggc

SEQ ID NO: 1463072 - RNA, 22 nt, Human
uguacuugcucuugaugccugg

SEQ ID NO: 1463073 - RNA, 21 nt, Human
agguuuaugaaaaagaagaau

SEQ ID NO: 1463074 - RNA, 14 nt, Human
agguuuaugaaaaa

SEQ ID NO: 1463075 - RNA, 16 nt, Human
agguuuaugaaaaaga

SEQ ID NO: 1463076 - RNA, 14 nt, Human
agguuuacagaauu

SEQ ID NO: 1463077 - RNA, 13 nt, Human
aguaaaauccaca

SEQ ID NO: 1463078 - RNA, 19 nt, Human
agguuuuuguagugauuuu

SEQ ID NO: 1463079 - RNA, 19 nt, Human
agguuuuuguuuguuuccu

SEQ ID NO: 1463080 - RNA, 16 nt, Human
aguaaaagcaaaaaag

SEQ ID NO: 1463081 - RNA, 18 nt, Human
aguaaugauaacuggaaa

SEQ ID NO: 1463082 - RNA, 20 nt, Human
aguaaugauaacuggaaacu

SEQ ID NO: 1463083 - RNA, 17 nt, Human
aguaaugauaacuggaa

SEQ ID NO: 1463084 - RNA, 17 nt, Human
aguaaaauaauaauuuu

SEQ ID NO: 1463085 - RNA, 12 nt, Human
aguaaaagcaaa

SEQ ID NO: 1463086 - RNA, 22 nt, Human
aguacaugauaaaugauagaca

SEQ ID NO: 1463087 - RNA, 19 nt, Human
aguacauuguuaccucuau

SEQ ID NO: 1463088 - RNA, 14 nt, Human
aguacauuguuacc

SEQ ID NO: 1463089 - RNA, 21 nt, Human
aguagaaucucaguugauuuu

SEQ ID NO: 1463090 - RNA, 19 nt, Human
aguacccguucacauuuuu

SEQ ID NO: 1463091 - RNA, 21 nt, Human
aguaccuagcuggcucuguga

SEQ ID NO: 1463092 - RNA, 23 nt, Human
uguaguagcguuuuuuaaaugua

SEQ ID NO: 1463093 - RNA, 20 nt, Human
uguaguaggcauuuuuacca

SEQ ID NO: 1463094 - RNA, 22 nt, Human
uguaguagcguuuuuuaaaugu

SEQ ID NO: 1463095 - RNA, 21 nt, Human
uguaguagcguuuuuuaaaug

SEQ ID NO: 1463096 - RNA, 16 nt, Human
uguaguagcguuuuuu

SEQ ID NO: 1463097 - RNA, 20 nt, Human
aguagcguuuuuuaaaugua

SEQ ID NO: 1463098 - RNA, 19 nt, Human
aguagcguuuuuuaaaugu

SEQ ID NO: 1463099 - RNA, 18 nt, Human
aguagcguuuuuuaaaug

SEQ ID NO: 1463100 - RNA, 14 nt, Human
aguagaaucucagu

SEQ ID NO: 1463101 - RNA, 22 nt, Human
uguaaacuguguauuccaagac

SEQ ID NO: 1463102 - RNA, 13 nt, Human
ugguuucccaaga

SEQ ID NO: 1463103 - RNA, 17 nt, Human
ugguuucccaagagcua

SEQ ID NO: 1463104 - RNA, 18 nt, Human
ugguuucccaagagcuac

SEQ ID NO: 1463105 - RNA, 19 nt, Human
uguaaacuguguauuccaa

SEQ ID NO: 1463106 - RNA, 16 nt, Human
ugguuugccuuccaga

SEQ ID NO: 1463107 - RNA, 17 nt, Human
ugguuugccuuccagaa

SEQ ID NO: 1463108 - RNA, 23 nt, Human
agguguggcuuuaggagcagugg

SEQ ID NO: 1463109 - RNA, 13 nt, Human
aggugccacugga

SEQ ID NO: 1463110 - RNA, 18 nt, Human
aggugccacuggagugug

SEQ ID NO: 1463111 - RNA, 16 nt, Human
aggugagaccaccucu

SEQ ID NO: 1463112 - RNA, 13 nt, Human
aggugagaaauuu

SEQ ID NO: 1463113 - RNA, 15 nt, Human
aggugagaccaccuc

SEQ ID NO: 1463114 - RNA, 14 nt, Human
aggugagaccaccu

SEQ ID NO: 1463115 - RNA, 19 nt, Human
aggucuucuuaauauguuc

SEQ ID NO: 1463116 - RNA, 15 nt, Human
aggucagcaugucua

SEQ ID NO: 1463117 - RNA, 16 nt, Human
aggucagcaugucuau

SEQ ID NO: 1463118 - RNA, 23 nt, Human
uggugcuucucagauuucugagg

SEQ ID NO: 1463119 - RNA, 21 nt, Human
ugguggaugauccccacgcca

SEQ ID NO: 1463120 - RNA, 13 nt, Human
ugguuagaaaagu

SEQ ID NO: 1463121 - RNA, 13 nt, Human
ugguuagaaaugc

SEQ ID NO: 1463122 - RNA, 14 nt, Human
ugguuagaaaugca

SEQ ID NO: 1463123 - RNA, 12 nt, Human
uggugccuucau

SEQ ID NO: 1463124 - RNA, 14 nt, Human
uggugccuucauuu

SEQ ID NO: 1463125 - RNA, 18 nt, Human
ugggucgcccuggacugu

SEQ ID NO: 1463126 - RNA, 16 nt, Human
ugggucgcccuggacu

SEQ ID NO: 1463127 - RNA, 21 nt, Human
aggguggggggggggcgcggc

SEQ ID NO: 1463128 - RNA, 20 nt, Human
uggucacguuuggugcuucu

SEQ ID NO: 1463129 - RNA, 17 nt, Human
ugguagaccaaaauaaa

SEQ ID NO: 1463130 - RNA, 13 nt, Human
ugguaccagaugc

SEQ ID NO: 1463131 - RNA, 16 nt, Human
aggggaauugaggaca

SEQ ID NO: 1463132 - RNA, 16 nt, Human
agggggcaagaggaau

SEQ ID NO: 1463133 - RNA, 23 nt, Human
agggggccccuuugcugacccuc

SEQ ID NO: 1463134 - RNA, 23 nt, Human
uggggcuccuccaggguggcagc

SEQ ID NO: 1463135 - RNA, 13 nt, Human
uggggagagacgg

SEQ ID NO: 1463136 - RNA, 20 nt, Human
agggaggaggcagagaagaa

SEQ ID NO: 1463137 - RNA, 21 nt, Human
agggacaccugggagaaaucu

SEQ ID NO: 1463138 - RNA, 14 nt, Human
agggacaccuggga

SEQ ID NO: 1463139 - RNA, 23 nt, Human
ugggagaccggccugccaggagg

SEQ ID NO: 1463140 - RNA, 12 nt, Human
ugggagagacuu

SEQ ID NO: 1463141 - RNA, 14 nt, Human
ugggagagacuugu

SEQ ID NO: 1463142 - RNA, 15 nt, Human
ugggagagacuuguu

SEQ ID NO: 1463143 - RNA, 21 nt, Human
ugggagagacuuguuuuggau

SEQ ID NO: 1463144 - RNA, 20 nt, Human
ugggagaccggccugccagg

SEQ ID NO: 1463145 - RNA, 21 nt, Human
ugggagaccggccugccagga

SEQ ID NO: 1463146 - RNA, 22 nt, Human
ugggagaccggccugccaggag

SEQ ID NO: 1463147 - RNA, 23 nt, Human
agggaacccagcucuaauacauu

SEQ ID NO: 1463148 - RNA, 22 nt, Human
agggaacccagcucuaauacau

SEQ ID NO: 1463149 - RNA, 14 nt, Human
agggaagagacagc

SEQ ID NO: 1463150 - RNA, 19 nt, Human
agggaagagacagcccagg

SEQ ID NO: 1463151 - RNA, 15 nt, Human
agggaaggaucccau

SEQ ID NO: 1463152 - RNA, 22 nt, Human
agggaaggaucccaugagcucc

SEQ ID NO: 1463153 - RNA, 23 nt, Human
agggaaggaucccaugagcuccu

SEQ ID NO: 1463154 - RNA, 19 nt, Human
agggaaggcuggacuaggc

SEQ ID NO: 1463155 - RNA, 14 nt, Human
agggaaugugaaau

SEQ ID NO: 1463156 - RNA, 16 nt, Human
agggaauugcagagua

SEQ ID NO: 1463157 - RNA, 13 nt, Human
agggaaugugaaa

SEQ ID NO: 1463158 - RNA, 19 nt, Human
agggaauaagguacaagaa

SEQ ID NO: 1463159 - RNA, 19 nt, Human
ugggccccugccucucugc

SEQ ID NO: 1463160 - RNA, 15 nt, Human
ugggccccugccucu

SEQ ID NO: 1463161 - RNA, 20 nt, Human
ugggccccugccucucugca

SEQ ID NO: 1463162 - RNA, 19 nt, Human
ugggccccauguuaacccc

SEQ ID NO: 1463163 - RNA, 13 nt, Human
ugcuauuugaagu

SEQ ID NO: 1463164 - RNA, 23 nt, Human
aggaaaccaguuaggucucaaua

SEQ ID NO: 1463165 - RNA, 16 nt, Human
aggaaaauugaaugca

SEQ ID NO: 1463166 - RNA, 21 nt, Human
aggaaaauuuuagcgugcuca

SEQ ID NO: 1463167 - RNA, 14 nt, Human
aggaaaauugaaug

SEQ ID NO: 1463168 - RNA, 17 nt, Human
ugcucuugaugccuggc

SEQ ID NO: 1463169 - RNA, 18 nt, Human
ugcucuuagcugucugcu

SEQ ID NO: 1463170 - RNA, 16 nt, Human
aggaagaucccccaga

SEQ ID NO: 1463171 - RNA, 23 nt, Human
ugcugagccuguaaaauaaaagg

SEQ ID NO: 1463172 - RNA, 20 nt, Human
ugcugagauacauacagaau

SEQ ID NO: 1463173 - RNA, 10 nt, Human
ugcugagacu

SEQ ID NO: 1463174 - RNA, 18 nt, Human
ugcugagauacauacaga

SEQ ID NO: 1463175 - RNA, 19 nt, Human
ugcugagauacauacagaa

SEQ ID NO: 1463176 - RNA, 20 nt, Human
ugcugagauuacagguguga

SEQ ID NO: 1463177 - RNA, 16 nt, Human
aggaauuacgugcucu

SEQ ID NO: 1463178 - RNA, 22 nt, Human
aggaaggcagggaggaggcaga

SEQ ID NO: 1463179 - RNA, 20 nt, Human
aggaaggcagggaggaggca

SEQ ID NO: 1463180 - RNA, 18 nt, Human
aggaaggcagggaggagg

SEQ ID NO: 1463181 - RNA, 16 nt, Human
aggaaggcagggagga

SEQ ID NO: 1463182 - RNA, 22 nt, Human
aggaaggaggacccaggacagg

SEQ ID NO: 1463183 - RNA, 17 nt, Human
aggaagaucccccagaa

SEQ ID NO: 1463184 - RNA, 18 nt, Human
aggaagaucccccagaaa

SEQ ID NO: 1463185 - RNA, 17 nt, Human
aggaagauuacucagua

SEQ ID NO: 1463186 - RNA, 19 nt, Human
aggaagcaaauagaagaga

SEQ ID NO: 1463187 - RNA, 14 nt, Human
aggaagcagccaag

SEQ ID NO: 1463188 - RNA, 20 nt, Human
ugcuaauuuugaaaaacugc

SEQ ID NO: 1463189 - RNA, 19 nt, Human
ugcuaauuuugaaaaacug

SEQ ID NO: 1463190 - RNA, 18 nt, Human
ugcuaauuuugaaaaacu

SEQ ID NO: 1463191 - RNA, 16 nt, Human
ugcuaauuuugaaaaa

SEQ ID NO: 1463192 - RNA, 13 nt, Human
ugcuaccaaagca

SEQ ID NO: 1463193 - RNA, 19 nt, Human
ugccuuuucccaacuccag

SEQ ID NO: 1463194 - RNA, 15 nt, Human
ugccuugucacgcca

SEQ ID NO: 1463195 - RNA, 13 nt, Human
ugcuaaucuucuu

SEQ ID NO: 1463196 - RNA, 20 nt, Human
ugcuaaucuucuuaugcaau

SEQ ID NO: 1463197 - RNA, 22 nt, Human
ugcuaaucuucuuaugcaauuu

SEQ ID NO: 1463198 - RNA, 18 nt, Human
ugcuaauuuauccugaaa

SEQ ID NO: 1463199 - RNA, 19 nt, Human
agcuuaauggcugauaauu

SEQ ID NO: 1463200 - RNA, 22 nt, Human
agcuuaauggcugauaauuuua

SEQ ID NO: 1463201 - RNA, 18 nt, Human
agcuuguggcaagugaau

SEQ ID NO: 1463202 - RNA, 17 nt, Human
agcuuguggcaagugaa

SEQ ID NO: 1463203 - RNA, 19 nt, Human
agcuuuggaccuaauccaa

SEQ ID NO: 1463204 - RNA, 18 nt, Human
agcuuuggaccuaaucca

SEQ ID NO: 1463205 - RNA, 18 nt, Human
agcuuugcucuuugguag

SEQ ID NO: 1463206 - RNA, 21 nt, Human
agcuuugcucuuugguagaaa

SEQ ID NO: 1463207 - RNA, 23 nt, Human
agcuuugcucuuugguagaaaag

SEQ ID NO: 1463208 - RNA, 10 nt, Human
agcuuugcua

SEQ ID NO: 1463209 - RNA, 16 nt, Human
agcuuugcuaccaaag

SEQ ID NO: 1463210 - RNA, 21 nt, Human
agcuuugcuaccaaagcaccu

SEQ ID NO: 1463211 - RNA, 10 nt, Human
agcuuugcuc

SEQ ID NO: 1463212 - RNA, 12 nt, Human
agcuuucccugc

SEQ ID NO: 1463213 - RNA, 16 nt, Human
agcuuucccugccucu

SEQ ID NO: 1463214 - RNA, 15 nt, Human
agcucugaaagagaa

SEQ ID NO: 1463215 - RNA, 22 nt, Human
agcucugaaagagaaacacgua

SEQ ID NO: 1463216 - RNA, 16 nt, Human
agcucugaaagagaaa

SEQ ID NO: 1463217 - RNA, 21 nt, Human
agcucugaagaacucucugga

SEQ ID NO: 1463218 - RNA, 20 nt, Human
agcucugacauucugauucg

SEQ ID NO: 1463219 - RNA, 22 nt, Human
agcucugaagaacucucuggaa

SEQ ID NO: 1463220 - RNA, 14 nt, Human
agcugcccccagag

SEQ ID NO: 1463221 - RNA, 21 nt, Human
agcugcccccagagccacagu

SEQ ID NO: 1463222 - RNA, 20 nt, Human
agcugcccccagagccacag

SEQ ID NO: 1463223 - RNA, 19 nt, Human
agcugcccccagagccaca

SEQ ID NO: 1463224 - RNA, 17 nt, Human
agcugcccccagagcca

SEQ ID NO: 1463225 - RNA, 16 nt, Human
agcugcccccagagcc

SEQ ID NO: 1463226 - RNA, 22 nt, Human
ugccgagaguccaucagccucc

SEQ ID NO: 1463227 - RNA, 21 nt, Human
ugccugcuuuuuauggccugu

SEQ ID NO: 1463228 - RNA, 20 nt, Human
ugccugcuuuuuauggccug

SEQ ID NO: 1463229 - RNA, 22 nt, Human
ugccugcuuuuuauggccugug

SEQ ID NO: 1463230 - RNA, 18 nt, Human
ugccuggaagagcagccc

SEQ ID NO: 1463231 - RNA, 19 nt, Human
ugccuggaagagcagcccu

SEQ ID NO: 1463232 - RNA, 20 nt, Human
ugccuggaagagcagcccua

SEQ ID NO: 1463233 - RNA, 22 nt, Human
agcugugcuuaugguaccagau

SEQ ID NO: 1463234 - RNA, 17 nt, Human
agcugugcgugugugug

SEQ ID NO: 1463235 - RNA, 16 nt, Human
agcugugcgugugugu

SEQ ID NO: 1463236 - RNA, 19 nt, Human
agcugugcuuaugguacca

SEQ ID NO: 1463237 - RNA, 17 nt, Human
uggagcucguggaacag

SEQ ID NO: 1463238 - RNA, 21 nt, Human
uggagcucguggaacaguuac

SEQ ID NO: 1463239 - RNA, 21 nt, Human
uggagcucgugggacagucac

SEQ ID NO: 1463240 - RNA, 23 nt, Human
aggcacacaccaccacgccuggc

SEQ ID NO: 1463241 - RNA, 19 nt, Human
aggcaguaauaaaaagauu

SEQ ID NO: 1463242 - RNA, 20 nt, Human
aggcagcuuuuucucuccca

SEQ ID NO: 1463243 - RNA, 19 nt, Human
aggcaggaacaaacagggc

SEQ ID NO: 1463244 - RNA, 16 nt, Human
aggcaggauuggggaa

SEQ ID NO: 1463245 - RNA, 19 nt, Human
aggcaggauuggggaagag

SEQ ID NO: 1463246 - RNA, 23 nt, Human
aggcaggauuggggaagagagcc

SEQ ID NO: 1463247 - RNA, 20 nt, Human
aggcaggauuggggaagaga

SEQ ID NO: 1463248 - RNA, 15 nt, Human
aggcaggcucccagg

SEQ ID NO: 1463249 - RNA, 16 nt, Human
aggcaggcucccaggg

SEQ ID NO: 1463250 - RNA, 12 nt, Human
uggauuccagag

SEQ ID NO: 1463251 - RNA, 18 nt, Human
uggauuccccaucucagg

SEQ ID NO: 1463252 - RNA, 22 nt, Human
uggauuccccaucucaggccag

SEQ ID NO: 1463253 - RNA, 19 nt, Human
uggauuccccaucucaggc

SEQ ID NO: 1463254 - RNA, 15 nt, Human
uggauucuaaaaugc

SEQ ID NO: 1463255 - RNA, 13 nt, Human
uggauucuaaaau

SEQ ID NO: 1463256 - RNA, 13 nt, Human
uggagugcagugg

SEQ ID NO: 1463257 - RNA, 16 nt, Human
uggagugcaccaaaga

SEQ ID NO: 1463258 - RNA, 18 nt, Human
uggagugcaccaaagaga

SEQ ID NO: 1463259 - RNA, 14 nt, Human
uggaguugaaaauc

SEQ ID NO: 1463260 - RNA, 19 nt, Human
aggcccccaccuggcucac

SEQ ID NO: 1463261 - RNA, 17 nt, Human
aggcccccaccuggcuc

SEQ ID NO: 1463262 - RNA, 18 nt, Human
aggcccccaccuggcuca

SEQ ID NO: 1463263 - RNA, 16 nt, Human
ugcuuuuuauggccug

SEQ ID NO: 1463264 - RNA, 15 nt, Human
ugcuuuuucaccaga

SEQ ID NO: 1463265 - RNA, 13 nt, Human
uggaaauaaaugu

SEQ ID NO: 1463266 - RNA, 15 nt, Human
uggaaauaaauguau

SEQ ID NO: 1463267 - RNA, 23 nt, Human
uggaaauaaauguaucauagaaa

SEQ ID NO: 1463268 - RNA, 16 nt, Human
uggaaauuggaagagc

SEQ ID NO: 1463269 - RNA, 17 nt, Human
uggaaauuggaagagca

SEQ ID NO: 1463270 - RNA, 23 nt, Human
uggaagacgcaagggccugaugg

SEQ ID NO: 1463271 - RNA, 17 nt, Human
uggaagacgcaagggcc

SEQ ID NO: 1463272 - RNA, 21 nt, Human
ugcuugagccaggaggccugc

SEQ ID NO: 1463273 - RNA, 18 nt, Human
aggaggacccaggacagg

SEQ ID NO: 1463274 - RNA, 16 nt, Human
aggaggacccagggcu

SEQ ID NO: 1463275 - RNA, 17 nt, Human
aggaggacccagggcuc

SEQ ID NO: 1463276 - RNA, 17 nt, Human
aggaggacccaggacag

SEQ ID NO: 1463277 - RNA, 16 nt, Human
aggaggacccaggaca

SEQ ID NO: 1463278 - RNA, 15 nt, Human
aggaggacccaggac

SEQ ID NO: 1463279 - RNA, 14 nt, Human
aggaggacccagga

SEQ ID NO: 1463280 - RNA, 13 nt, Human
aggaggacccagg

SEQ ID NO: 1463281 - RNA, 12 nt, Human
aggaggacccag

SEQ ID NO: 1463282 - RNA, 15 nt, Human
uggaagccagcuuuc

SEQ ID NO: 1463283 - RNA, 16 nt, Human
uggaagccagcuuucc

SEQ ID NO: 1463284 - RNA, 18 nt, Human
uggaagccagcuuucccu

SEQ ID NO: 1463285 - RNA, 20 nt, Human
uggaagccccugggcccagu

SEQ ID NO: 1463286 - RNA, 16 nt, Human
uggaagccccugggcc

SEQ ID NO: 1463287 - RNA, 18 nt, Human
aggaggacccagggcucu

SEQ ID NO: 1463288 - RNA, 11 nt, Human
aggauccaggc

SEQ ID NO: 1463289 - RNA, 21 nt, Human
aggaucauuuguuggaaugaa

SEQ ID NO: 1463290 - RNA, 17 nt, Human
aggaucaguuaacuauu

SEQ ID NO: 1463291 - RNA, 20 nt, Human
aggaucauuuguuggaauga

SEQ ID NO: 1463292 - RNA, 23 nt, Human
aggaucaguuaacuauugcauuu

SEQ ID NO: 1463293 - RNA, 15 nt, Human
aggaucaguuaacua

SEQ ID NO: 1463294 - RNA, 16 nt, Human
aggacacaguuccugg

SEQ ID NO: 1463295 - RNA, 15 nt, Human
aggacacaguuccug

SEQ ID NO: 1463296 - RNA, 18 nt, Human
aggacacaguuccuggga

SEQ ID NO: 1463297 - RNA, 21 nt, Human
aggacacaguuccugggaaca

SEQ ID NO: 1463298 - RNA, 17 nt, Human
aggacuccuuaaauuug

SEQ ID NO: 1463299 - RNA, 23 nt, Human
aggagcccuucuauacccaccca

SEQ ID NO: 1463300 - RNA, 22 nt, Human
aggagauccagggcaaggccau

SEQ ID NO: 1463301 - RNA, 15 nt, Human
ugauuaaguaaugau

SEQ ID NO: 1463302 - RNA, 16 nt, Human
ugauuaaguaaugaua

SEQ ID NO: 1463303 - RNA, 15 nt, Human
ugauggcaauuuugu

SEQ ID NO: 1463304 - RNA, 17 nt, Human
ugauggcaauuuuguaa

SEQ ID NO: 1463305 - RNA, 17 nt, Human
ugaucuagagccaguua

SEQ ID NO: 1463306 - RNA, 23 nt, Human
ugauccagaaagaaaacuuguau

SEQ ID NO: 1463307 - RNA, 13 nt, Human
ugauccagaaaga

SEQ ID NO: 1463308 - RNA, 18 nt, Human
ugauccccacgccacagc

SEQ ID NO: 1463309 - RNA, 13 nt, Human
ugauccccacgcc

SEQ ID NO: 1463310 - RNA, 19 nt, Human
ugauccccacgccacagcc

SEQ ID NO: 1463311 - RNA, 20 nt, Human
ugauccccacgccacagccc

SEQ ID NO: 1463312 - RNA, 21 nt, Human
agccaaacauauauauacuau

SEQ ID NO: 1463313 - RNA, 13 nt, Human
agccacaccagga

SEQ ID NO: 1463314 - RNA, 14 nt, Human
agccacaccaggau

SEQ ID NO: 1463315 - RNA, 24 nt, Human
agccacaccaggauagagacugga

SEQ ID NO: 1463316 - RNA, 17 nt, Human
agccacaccaggauaga

SEQ ID NO: 1463317 - RNA, 20 nt, Human
agccacaguuccccuaugug

SEQ ID NO: 1463318 - RNA, 15 nt, Human
agcaucccucaccca

SEQ ID NO: 1463319 - RNA, 17 nt, Human
agcauccccuugaacuc

SEQ ID NO: 1463320 - RNA, 20 nt, Human
agcauccccuugaacucuuc

SEQ ID NO: 1463321 - RNA, 14 nt, Human
agcauccuggaaua

SEQ ID NO: 1463322 - RNA, 15 nt, Human
agcauccuggaauau

SEQ ID NO: 1463323 - RNA, 13 nt, Human
agcauccuggaau

SEQ ID NO: 1463324 - RNA, 18 nt, Human
agcauccccuugaacucu

SEQ ID NO: 1463325 - RNA, 21 nt, Human
agcaucaggccuagaggccug

SEQ ID NO: 1463326 - RNA, 16 nt, Human
agcaucaggccuagag

SEQ ID NO: 1463327 - RNA, 19 nt, Human
ugaucaccgacugaaaaua

SEQ ID NO: 1463328 - RNA, 17 nt, Human
ugaucaccgacugaaaa

SEQ ID NO: 1463329 - RNA, 17 nt, Human
agcauuuguguugaaga

SEQ ID NO: 1463330 - RNA, 18 nt, Human
agcauuuguguugaagag

SEQ ID NO: 1463331 - RNA, 14 nt, Human
agcauuuguuucua

SEQ ID NO: 1463332 - RNA, 19 nt, Human
agcauuuguuucuacuuug

SEQ ID NO: 1463333 - RNA, 17 nt, Human
agcauuuguuucuacuu

SEQ ID NO: 1463334 - RNA, 15 nt, Human
agcauuuagaaaacu

SEQ ID NO: 1463335 - RNA, 17 nt, Human
agcauuuuguaaguuga

SEQ ID NO: 1463336 - RNA, 14 nt, Human
agccaaaaauagcu

SEQ ID NO: 1463337 - RNA, 15 nt, Human
agccaaaaauagcua

SEQ ID NO: 1463338 - RNA, 18 nt, Human
agccaaaaauagcuaaau

SEQ ID NO: 1463339 - RNA, 22 nt, Human
agccaaaaauagcuaaauaccu

SEQ ID NO: 1463340 - RNA, 12 nt, Human
agccaaaccagg

SEQ ID NO: 1463341 - RNA, 22 nt, Human
agcauuuagauguauagguuga

SEQ ID NO: 1463342 - RNA, 12 nt, Human
agcauucugucu

SEQ ID NO: 1463343 - RNA, 14 nt, Human
agcauucagaagaa

SEQ ID NO: 1463344 - RNA, 15 nt, Human
agcauucagaagaaa

SEQ ID NO: 1463345 - RNA, 17 nt, Human
agcauucagaagaaaaa

SEQ ID NO: 1463346 - RNA, 19 nt, Human
agcauucagaagaaaaaga

SEQ ID NO: 1463347 - RNA, 21 nt, Human
agcauucagaagaaaaagaag

SEQ ID NO: 1463348 - RNA, 17 nt, Human
agcagucaggaaagaga

SEQ ID NO: 1463349 - RNA, 18 nt, Human
agcagucaggaaagagaa

SEQ ID NO: 1463350 - RNA, 19 nt, Human
agcagucaggaaagagaac

SEQ ID NO: 1463351 - RNA, 15 nt, Human
agcaguuugaaauug

SEQ ID NO: 1463352 - RNA, 20 nt, Human
ugagucacccuaccugugcc

SEQ ID NO: 1463353 - RNA, 22 nt, Human
ugagucacccuaccugugccug

SEQ ID NO: 1463354 - RNA, 14 nt, Human
ugauaauuuuaaau

SEQ ID NO: 1463355 - RNA, 13 nt, Human
ugauaauuuuaaa

SEQ ID NO: 1463356 - RNA, 21 nt, Human
ugaguguuuuaugagaaagcc

SEQ ID NO: 1463357 - RNA, 19 nt, Human
ugaguguuuuaugagaaag

SEQ ID NO: 1463358 - RNA, 14 nt, Human
ugaguuacagaaau

SEQ ID NO: 1463359 - RNA, 16 nt, Human
agcagggacuguaaac

SEQ ID NO: 1463360 - RNA, 17 nt, Human
agccuccuuagaaaaaa

SEQ ID NO: 1463361 - RNA, 16 nt, Human
agccuccuuucuggcu

SEQ ID NO: 1463362 - RNA, 16 nt, Human
agccucuccacucaug

SEQ ID NO: 1463363 - RNA, 13 nt, Human
ugcagacaggaau

SEQ ID NO: 1463364 - RNA, 15 nt, Human
ugcagacaggaaucu

SEQ ID NO: 1463365 - RNA, 16 nt, Human
ugcagacaggaaucuu

SEQ ID NO: 1463366 - RNA, 18 nt, Human
ugcagacaggaaucuuaa

SEQ ID NO: 1463367 - RNA, 20 nt, Human
ugcagacaggaaucuuaagg

SEQ ID NO: 1463368 - RNA, 22 nt, Human
ugcaggucccuaauaaagcugu

SEQ ID NO: 1463369 - RNA, 11 nt, Human
ugcaggucccu

SEQ ID NO: 1463370 - RNA, 19 nt, Human
ugcagggggugugucugcu

SEQ ID NO: 1463371 - RNA, 22 nt, Human
ugcagggggugugucugcucag

SEQ ID NO: 1463372 - RNA, 17 nt, Human
ugcauagaauaaaauuu

SEQ ID NO: 1463373 - RNA, 18 nt, Human
ugcauacuuuuuaaaugu

SEQ ID NO: 1463374 - RNA, 19 nt, Human
ugcauacuuuuuaaaugua

SEQ ID NO: 1463375 - RNA, 22 nt, Human
ugcauacuuuuuaaauguaaag

SEQ ID NO: 1463376 - RNA, 23 nt, Human
ugcauacuuuuuaaauguaaaga

SEQ ID NO: 1463377 - RNA, 16 nt, Human
ugcaguaugaaaauaa

SEQ ID NO: 1463378 - RNA, 15 nt, Human
ugcaguaugaaaaua

SEQ ID NO: 1463379 - RNA, 11 nt, Human
ugcauggaaau

SEQ ID NO: 1463380 - RNA, 21 nt, Human
ugcaucuagaggcuuccuuca

SEQ ID NO: 1463381 - RNA, 23 nt, Human
ugcauggaaauucccuucaucug

SEQ ID NO: 1463382 - RNA, 19 nt, Human
ugcauggaaauucccuuca

SEQ ID NO: 1463383 - RNA, 16 nt, Human
agccuuggggauucuu

SEQ ID NO: 1463384 - RNA, 23 nt, Human
agccuuggggauucuuccaucug

SEQ ID NO: 1463385 - RNA, 12 nt, Human
agccugugccuc

SEQ ID NO: 1463386 - RNA, 18 nt, Human
agccuuaaucagguccuc

SEQ ID NO: 1463387 - RNA, 14 nt, Human
agccuucucuguuc

SEQ ID NO: 1463388 - RNA, 15 nt, Human
agccuucucuguuca

SEQ ID NO: 1463389 - RNA, 19 nt, Human
agccuucucuguucauuuc

SEQ ID NO: 1463390 - RNA, 20 nt, Human
agccuucucuguucauuucc

SEQ ID NO: 1463391 - RNA, 21 nt, Human
agccuucucuguucauuuccu

SEQ ID NO: 1463392 - RNA, 22 nt, Human
agccuucucuguucauuuccuc

SEQ ID NO: 1463393 - RNA, 23 nt, Human
agccuucucuguucauuuccuca

SEQ ID NO: 1463394 - RNA, 20 nt, Human
ugcauuuaaaacagacacug

SEQ ID NO: 1463395 - RNA, 22 nt, Human
ugcauuuaaaacagacacuggc

SEQ ID NO: 1463396 - RNA, 15 nt, Human
ugcauuuaaaacaga

SEQ ID NO: 1463397 - RNA, 17 nt, Human
ugcauuuaaaacagaca

SEQ ID NO: 1463398 - RNA, 19 nt, Human
ugcauuuaaaacagacacu

SEQ ID NO: 1463399 - RNA, 23 nt, Human
ugccaagccauggguagccuggg

SEQ ID NO: 1463400 - RNA, 15 nt, Human
ugccaguuguccucc

SEQ ID NO: 1463401 - RNA, 22 nt, Human
ugccaguuguccuccuuccggg

SEQ ID NO: 1463402 - RNA, 20 nt, Human
agcccugggaggcucuggag

SEQ ID NO: 1463403 - RNA, 18 nt, Human
agcccugggaggcucugg

SEQ ID NO: 1463404 - RNA, 22 nt, Human
agcccugcaccaugcugcuggg

SEQ ID NO: 1463405 - RNA, 16 nt, Human
ugcaccaaagagaaug

SEQ ID NO: 1463406 - RNA, 12 nt, Human
agcccugcacca

SEQ ID NO: 1463407 - RNA, 13 nt, Human
agcccugcaccau

SEQ ID NO: 1463408 - RNA, 14 nt, Human
agcccugcaccaug

SEQ ID NO: 1463409 - RNA, 20 nt, Human
agcccugcaccaugcugcug

SEQ ID NO: 1463410 - RNA, 23 nt, Human
agccccgcguggaacucgugucu

SEQ ID NO: 1463411 - RNA, 14 nt, Human
agccccugggccca

SEQ ID NO: 1463412 - RNA, 16 nt, Human
agccccugggcccagu

SEQ ID NO: 1463413 - RNA, 23 nt, Human
ugcaaggccugguguuucuugau

SEQ ID NO: 1463414 - RNA, 21 nt, Human
ugcaaggccugguguuucuug

SEQ ID NO: 1463415 - RNA, 13 nt, Human
ugcaaggcaaaga

SEQ ID NO: 1463416 - RNA, 17 nt, Human
ugcaaggaccuaaaaca

SEQ ID NO: 1463417 - RNA, 21 nt, Human
ugcaagguauuacacucugua

SEQ ID NO: 1463418 - RNA, 22 nt, Human
ugcaagguauuacacucuguaa

SEQ ID NO: 1463419 - RNA, 16 nt, Human
ugcaaggucuuugguu

SEQ ID NO: 1463420 - RNA, 15 nt, Human
ugcaaucccuuaaua

SEQ ID NO: 1463421 - RNA, 15 nt, Human
ugcaagccagauuuu

SEQ ID NO: 1463422 - RNA, 21 nt, Human
ugcaagccagauuuuccugaa

SEQ ID NO: 1463423 - RNA, 12 nt, Human
ugcaaauuucau

SEQ ID NO: 1463424 - RNA, 21 nt, Human
ugcaaaugcuaugagaugcau

SEQ ID NO: 1463425 - RNA, 15 nt, Human
agccacgguguucug

SEQ ID NO: 1463426 - RNA, 19 nt, Human
agccacggggacucagccc

SEQ ID NO: 1463427 - RNA, 22 nt, Human
ugauuuaucugagucaacuccu

SEQ ID NO: 1463428 - RNA, 23 nt, Human
ugauuuauuaauauauauuaucu

SEQ ID NO: 1463429 - RNA, 13 nt, Human
ugcaaauaaauau

SEQ ID NO: 1463430 - RNA, 23 nt, Human
ugcaaauaaauauccuuuaauug

SEQ ID NO: 1463431 - RNA, 18 nt, Human
agaugcaguucugaagaa

SEQ ID NO: 1463432 - RNA, 19 nt, Human
agaugcaguucugaagaag

SEQ ID NO: 1463433 - RNA, 20 nt, Human
agaugcaguucugaagaaga

SEQ ID NO: 1463434 - RNA, 17 nt, Human
agaugcuggcuugggca

SEQ ID NO: 1463435 - RNA, 19 nt, Human
agaugcuggcuugggcagc

SEQ ID NO: 1463436 - RNA, 18 nt, Human
agaugcuggcuugggcag

SEQ ID NO: 1463437 - RNA, 18 nt, Human
agaucccaacacugccag

SEQ ID NO: 1463438 - RNA, 19 nt, Human
agaucccaacacugccagc

SEQ ID NO: 1463439 - RNA, 20 nt, Human
agaucccaacacugccagca

SEQ ID NO: 1463440 - RNA, 10 nt, Human
agaucccaaa

SEQ ID NO: 1463441 - RNA, 22 nt, Human
agaucccaaguagaaucucagu

SEQ ID NO: 1463442 - RNA, 15 nt, Human
agauguucacccaac

SEQ ID NO: 1463443 - RNA, 12 nt, Human
agaucauuguga

SEQ ID NO: 1463444 - RNA, 19 nt, Human
agaucaggaagagaaggag

SEQ ID NO: 1463445 - RNA, 18 nt, Human
agaucaggaagagaagga

SEQ ID NO: 1463446 - RNA, 17 nt, Human
agaucaggaagagaagg

SEQ ID NO: 1463447 - RNA, 13 nt, Human
agaucaggaagag

SEQ ID NO: 1463448 - RNA, 14 nt, Human
ugacauaaaguuga

SEQ ID NO: 1463449 - RNA, 22 nt, Human
ugacagcuaggaugugcauucu

SEQ ID NO: 1463450 - RNA, 20 nt, Human
ugacagcuaggaugugcauu

SEQ ID NO: 1463451 - RNA, 18 nt, Human
ugacaguggaacuacauu

SEQ ID NO: 1463452 - RNA, 16 nt, Human
ugacaguggaacuaca

SEQ ID NO: 1463453 - RNA, 16 nt, Human
ugacaguguugaaaau

SEQ ID NO: 1463454 - RNA, 19 nt, Human
ugacaguguugaaaauguu

SEQ ID NO: 1463455 - RNA, 16 nt, Human
agaguuuagcuggaaa

SEQ ID NO: 1463456 - RNA, 17 nt, Human
agaguuuagcuggaaaa

SEQ ID NO: 1463457 - RNA, 20 nt, Human
agaguugaugguuguacaua

SEQ ID NO: 1463458 - RNA, 23 nt, Human
agagucuggugaagcucacuucu

SEQ ID NO: 1463459 - RNA, 16 nt, Human
agagucugaaccuauu

SEQ ID NO: 1463460 - RNA, 18 nt, Human
agagucuggugaagcuca

SEQ ID NO: 1463461 - RNA, 15 nt, Human
ugaauguaaauuugu

SEQ ID NO: 1463462 - RNA, 16 nt, Human
ugaauguaaauuugua

SEQ ID NO: 1463463 - RNA, 18 nt, Human
ugaauguaaauuuguacu

SEQ ID NO: 1463464 - RNA, 19 nt, Human
ugaauguaaauuuguacua

SEQ ID NO: 1463465 - RNA, 23 nt, Human
agaguccaucagccuccauccua

SEQ ID NO: 1463466 - RNA, 14 nt, Human
agagucccugccug

SEQ ID NO: 1463467 - RNA, 17 nt, Human
agagucccugccuggac

SEQ ID NO: 1463468 - RNA, 12 nt, Human
agauacugaaau

SEQ ID NO: 1463469 - RNA, 13 nt, Human
agauacugaaaua

SEQ ID NO: 1463470 - RNA, 15 nt, Human
agauacugaaauaaa

SEQ ID NO: 1463471 - RNA, 17 nt, Human
agauaaagguucaugca

SEQ ID NO: 1463472 - RNA, 17 nt, Human
agauaugggacauuuuu

SEQ ID NO: 1463473 - RNA, 15 nt, Human
agauauuaccaguuu

SEQ ID NO: 1463474 - RNA, 18 nt, Human
agauauuccuauugugca

SEQ ID NO: 1463475 - RNA, 14 nt, Human
agauauuggacaaa

SEQ ID NO: 1463476 - RNA, 17 nt, Human
agauauuggacaaagaa

SEQ ID NO: 1463477 - RNA, 16 nt, Human
agauauuggacaaaga

SEQ ID NO: 1463478 - RNA, 11 nt, Human
ugaauuucauc

SEQ ID NO: 1463479 - RNA, 16 nt, Human
ugaauuuuacauggcu

SEQ ID NO: 1463480 - RNA, 21 nt, Human
agaucaccaguguguggcuuu

SEQ ID NO: 1463481 - RNA, 15 nt, Human
ugaauuuuuuuuaac

SEQ ID NO: 1463482 - RNA, 16 nt, Human
ugaauuuuuuuuaaca

SEQ ID NO: 1463483 - RNA, 17 nt, Human
ugaauuuuuuuuaacau

SEQ ID NO: 1463484 - RNA, 18 nt, Human
ugaauuuuuuuuaacauu

SEQ ID NO: 1463485 - RNA, 19 nt, Human
ugaauuuuuuuuaacauuc

SEQ ID NO: 1463486 - RNA, 20 nt, Human
ugaauuuuuuuuaacauucc

SEQ ID NO: 1463487 - RNA, 21 nt, Human
ugaauuuuuuuuaacauuccu

SEQ ID NO: 1463488 - RNA, 16 nt, Human
ugaauuuuuuuuuccu

SEQ ID NO: 1463489 - RNA, 19 nt, Human
ugaauuuuuuuuuccuagc

SEQ ID NO: 1463490 - RNA, 20 nt, Human
ugaauuuuuuuuuccuagcc

SEQ ID NO: 1463491 - RNA, 22 nt, Human
ugaauuuuuuuuaacauuccuc

SEQ ID NO: 1463492 - RNA, 19 nt, Human
ugacaaaaaauuaaagcau

SEQ ID NO: 1463493 - RNA, 12 nt, Human
agagguuuuaaa

SEQ ID NO: 1463494 - RNA, 22 nt, Human
ugaagcacagugaucaaguuau

SEQ ID NO: 1463495 - RNA, 20 nt, Human
ugaagcaaaucgaaugaaau

SEQ ID NO: 1463496 - RNA, 14 nt, Human
agagguugucugug

SEQ ID NO: 1463497 - RNA, 17 nt, Human
agagguauuuaucuuua

SEQ ID NO: 1463498 - RNA, 21 nt, Human
agaggccauucuuucccaaca

SEQ ID NO: 1463499 - RNA, 19 nt, Human
agaggcuauuauuuucacu

SEQ ID NO: 1463500 - RNA, 22 nt, Human
agagcuggagaugaggccagac

SEQ ID NO: 1463501 - RNA, 23 nt, Human
agagcuggagaugaggccagacc

SEQ ID NO: 1463502 - RNA, 21 nt, Human
agagcuggagaugaggccaga

SEQ ID NO: 1463503 - RNA, 16 nt, Human
ugaacuuugcugagcc

SEQ ID NO: 1463504 - RNA, 17 nt, Human
ugaacuuuuuauugauu

SEQ ID NO: 1463505 - RNA, 15 nt, Human
ugaagaaaaucacuu

SEQ ID NO: 1463506 - RNA, 21 nt, Human
ugaagaaaaucacuuaggaaa

SEQ ID NO: 1463507 - RNA, 15 nt, Human
ugaacuuugcugagc

SEQ ID NO: 1463508 - RNA, 11 nt, Human
ugaacuuugcu

SEQ ID NO: 1463509 - RNA, 21 nt, Human
ugaacuaggauuguaguccca

SEQ ID NO: 1463510 - RNA, 23 nt, Human
ugaacuaggguggugcauuuuug

SEQ ID NO: 1463511 - RNA, 18 nt, Human
ugaacuaggcugagcaau

SEQ ID NO: 1463512 - RNA, 17 nt, Human
ugaacuaggcugagcaa

SEQ ID NO: 1463513 - RNA, 14 nt, Human
ugaacucaaacuga

SEQ ID NO: 1463514 - RNA, 16 nt, Human
ugaacucaaacugagg

SEQ ID NO: 1463515 - RNA, 17 nt, Human
ugaacucaaacugagga

SEQ ID NO: 1463516 - RNA, 18 nt, Human
ugaacucaaacugaggaa

SEQ ID NO: 1463517 - RNA, 18 nt, Human
ugaaccugaugaaaauaa

SEQ ID NO: 1463518 - RNA, 23 nt, Human
ugaaccugaugaaaauaaagaau

SEQ ID NO: 1463519 - RNA, 12 nt, Human
ugaaccugcccu

SEQ ID NO: 1463520 - RNA, 16 nt, Human
agagcacugcuccagu

SEQ ID NO: 1463521 - RNA, 12 nt, Human
agagcacugcuc

SEQ ID NO: 1463522 - RNA, 15 nt, Human
agagcacugccacca

SEQ ID NO: 1463523 - RNA, 18 nt, Human
agagcacugccaccagua

SEQ ID NO: 1463524 - RNA, 14 nt, Human
agagcacugccacc

SEQ ID NO: 1463525 - RNA, 18 nt, Human
agagcaaaauaauuuuaa

SEQ ID NO: 1463526 - RNA, 13 nt, Human
agagauuuuucau

SEQ ID NO: 1463527 - RNA, 18 nt, Human
agagacagcccaggauac

SEQ ID NO: 1463528 - RNA, 16 nt, Human
agagacagcccaggau

SEQ ID NO: 1463529 - RNA, 18 nt, Human
agagcaggugcuggcucu

SEQ ID NO: 1463530 - RNA, 11 nt, Human
agagccacagu

SEQ ID NO: 1463531 - RNA, 23 nt, Human
ugaaauuuccugggagcuuuugu

SEQ ID NO: 1463532 - RNA, 14 nt, Human
ugaaauuuuaaccu

SEQ ID NO: 1463533 - RNA, 20 nt, Human
ugaaauuuuaaccuaugaua

SEQ ID NO: 1463534 - RNA, 22 nt, Human
ugaaauuuuaaccuaugauauu

SEQ ID NO: 1463535 - RNA, 16 nt, Human
ugaaauuuuauaugcu

SEQ ID NO: 1463536 - RNA, 18 nt, Human
ugaaauuuuauaugcuua

SEQ ID NO: 1463537 - RNA, 22 nt, Human
ugaaauuuuauaugcuuacuga

SEQ ID NO: 1463538 - RNA, 15 nt, Human
ugaaauuguauuaca

SEQ ID NO: 1463539 - RNA, 18 nt, Human
ugaaauauuauguuaaaa

SEQ ID NO: 1463540 - RNA, 20 nt, Human
ugaaauaugauguuaaaaaa

SEQ ID NO: 1463541 - RNA, 16 nt, Human
ugaaauaugauguuaa

SEQ ID NO: 1463542 - RNA, 15 nt, Human
ugaaauauccugcuu

SEQ ID NO: 1463543 - RNA, 17 nt, Human
ugaaauauccugcuuga

SEQ ID NO: 1463544 - RNA, 14 nt, Human
agagcgcacaggga

SEQ ID NO: 1463545 - RNA, 20 nt, Human
ucugugaagugagaccuucc

SEQ ID NO: 1463546 - RNA, 19 nt, Human
ucugugaagugagaccuuc

SEQ ID NO: 1463547 - RNA, 23 nt, Human
ucuguauuuccccaacauguaau

SEQ ID NO: 1463548 - RNA, 20 nt, Human
ucuguauuuccccaacaugu

SEQ ID NO: 1463549 - RNA, 23 nt, Human
ucugguaugaacuugaggacaca

SEQ ID NO: 1463550 - RNA, 22 nt, Human
ucugguaugaacuugaggacac

SEQ ID NO: 1463551 - RNA, 14 nt, Human
agaauuacuguaac

SEQ ID NO: 1463552 - RNA, 20 nt, Human
agaauuccaggguauggcca

SEQ ID NO: 1463553 - RNA, 14 nt, Human
ucugggcugugggc

SEQ ID NO: 1463554 - RNA, 19 nt, Human
ucugggcugucuauucuag

SEQ ID NO: 1463555 - RNA, 13 nt, Human
ucugggggguggc

SEQ ID NO: 1463556 - RNA, 17 nt, Human
ucugggggguggccagg

SEQ ID NO: 1463557 - RNA, 18 nt, Human
ucugggggguggccaggc

SEQ ID NO: 1463558 - RNA, 19 nt, Human
ucugggggguggccaggcc

SEQ ID NO: 1463559 - RNA, 20 nt, Human
ucugggggguggccaggccg

SEQ ID NO: 1463560 - RNA, 13 nt, Human
agaauuacuguaa

SEQ ID NO: 1463561 - RNA, 20 nt, Human
agaauuacuguaacugauua

SEQ ID NO: 1463562 - RNA, 16 nt, Human
agaaugucauuuuggu

SEQ ID NO: 1463563 - RNA, 20 nt, Human
agaaugucauuuugguacuu

SEQ ID NO: 1463564 - RNA, 23 nt, Human
agaaugucauuuugguacuuugg

SEQ ID NO: 1463565 - RNA, 14 nt, Human
agaauguuaagacu

SEQ ID NO: 1463566 - RNA, 19 nt, Human
agaauguuaagacuugaca

SEQ ID NO: 1463567 - RNA, 21 nt, Human
agaauguuaagacuugacagu

SEQ ID NO: 1463568 - RNA, 17 nt, Human
agaaccccuacaugaaa

SEQ ID NO: 1463569 - RNA, 19 nt, Human
agaaccccuacaugaaaca

SEQ ID NO: 1463570 - RNA, 12 nt, Human
agacagaaaaaa

SEQ ID NO: 1463571 - RNA, 22 nt, Human
agacacgcacggcagccacagc

SEQ ID NO: 1463572 - RNA, 21 nt, Human
agacacgcacggcagccacag

SEQ ID NO: 1463573 - RNA, 20 nt, Human
agacacgcacggcagccaca

SEQ ID NO: 1463574 - RNA, 15 nt, Human
agacacgcacggcag

SEQ ID NO: 1463575 - RNA, 13 nt, Human
agacacgcacggc

SEQ ID NO: 1463576 - RNA, 17 nt, Human
agacagaaccccuacau

SEQ ID NO: 1463577 - RNA, 12 nt, Human
agacagaagaaa

SEQ ID NO: 1463578 - RNA, 14 nt, Human
agacagaagaaaca

SEQ ID NO: 1463579 - RNA, 15 nt, Human
agacagaagaaacaa

SEQ ID NO: 1463580 - RNA, 16 nt, Human
agacagaagaaacaag

SEQ ID NO: 1463581 - RNA, 17 nt, Human
agacagaagaaacaagg

SEQ ID NO: 1463582 - RNA, 16 nt, Human
agacacacugaagaag

SEQ ID NO: 1463583 - RNA, 13 nt, Human
agacacaccugag

SEQ ID NO: 1463584 - RNA, 14 nt, Human
agacacaccugagg

SEQ ID NO: 1463585 - RNA, 17 nt, Human
agacacacugaagaagc

SEQ ID NO: 1463586 - RNA, 19 nt, Human
ucuuacugucuuuuuucua

SEQ ID NO: 1463587 - RNA, 20 nt, Human
ucuuacuuauuaucuucagg

SEQ ID NO: 1463588 - RNA, 22 nt, Human
ucuuacugcuuaauucaaauaa

SEQ ID NO: 1463589 - RNA, 15 nt, Human
ucuuacuauuucaca

SEQ ID NO: 1463590 - RNA, 21 nt, Human
ucuuaccuguaugucuccagu

SEQ ID NO: 1463591 - RNA, 23 nt, Human
ucuuaccuguaugucuccaguau

SEQ ID NO: 1463592 - RNA, 23 nt, Human
ucuuagaugcaguucugaagaag

SEQ ID NO: 1463593 - RNA, 19 nt, Human
ucuuacaauaauucuauga

SEQ ID NO: 1463594 - RNA, 14 nt, Human
agacaguucaagaa

SEQ ID NO: 1463595 - RNA, 15 nt, Human
agacaguucaagaaa

SEQ ID NO: 1463596 - RNA, 22 nt, Human
agacauuuuaaaaaauggucac

SEQ ID NO: 1463597 - RNA, 19 nt, Human
agacauuuuaaaaaauggu

SEQ ID NO: 1463598 - RNA, 12 nt, Human
ucuucuuaugca

SEQ ID NO: 1463599 - RNA, 22 nt, Human
ucuucuuaauauguucuuuuaa

SEQ ID NO: 1463600 - RNA, 13 nt, Human
ucuucuugaaauu

SEQ ID NO: 1463601 - RNA, 17 nt, Human
ucuucuugaaauuuuaa

SEQ ID NO: 1463602 - RNA, 18 nt, Human
ucuucugaauaaagcaau

SEQ ID NO: 1463603 - RNA, 19 nt, Human
ucuucugagcuauuucauc

SEQ ID NO: 1463604 - RNA, 21 nt, Human
ucuucugagcuauuucaucua

SEQ ID NO: 1463605 - RNA, 17 nt, Human
ucuucugaauaaagcaa

SEQ ID NO: 1463606 - RNA, 18 nt, Human
ucuuauuucaugaaaauu

SEQ ID NO: 1463607 - RNA, 16 nt, Human
ucuuauuucaugaaaa

SEQ ID NO: 1463608 - RNA, 15 nt, Human
ucuuauucauuuucu

SEQ ID NO: 1463609 - RNA, 16 nt, Human
ucuuauucauuuucuc

SEQ ID NO: 1463610 - RNA, 14 nt, Human
ucuuauuucaugaa

SEQ ID NO: 1463611 - RNA, 18 nt, Human
ucuucuggacugguuuuc

SEQ ID NO: 1463612 - RNA, 15 nt, Human
agaccgaucggcggc

SEQ ID NO: 1463613 - RNA, 15 nt, Human
agaccggccugccag

SEQ ID NO: 1463614 - RNA, 17 nt, Human
agaccggccugccagga

SEQ ID NO: 1463615 - RNA, 18 nt, Human
agaccggccugccaggag

SEQ ID NO: 1463616 - RNA, 19 nt, Human
agaccggccugccaggagg

SEQ ID NO: 1463617 - RNA, 20 nt, Human
agaccggccugccaggagga

SEQ ID NO: 1463618 - RNA, 23 nt, Human
agaccggccugccaggaggaccc

SEQ ID NO: 1463619 - RNA, 20 nt, Human
agacauuuuaaaaaaugguc

SEQ ID NO: 1463620 - RNA, 13 nt, Human
agaccaaaauaaa

SEQ ID NO: 1463621 - RNA, 18 nt, Human
agaccucagugccuuccu

SEQ ID NO: 1463622 - RNA, 20 nt, Human
agaccucagugccuuccugu

SEQ ID NO: 1463623 - RNA, 18 nt, Human
agaccucugugcacuuau

SEQ ID NO: 1463624 - RNA, 13 nt, Human
agaccugaagaau

SEQ ID NO: 1463625 - RNA, 22 nt, Human
agacuggguaggaaagaggaag

SEQ ID NO: 1463626 - RNA, 18 nt, Human
agacuggguaggaaagag

SEQ ID NO: 1463627 - RNA, 19 nt, Human
agacuucccacggcuccuc

SEQ ID NO: 1463628 - RNA, 16 nt, Human
agacuuuauguaguuu

SEQ ID NO: 1463629 - RNA, 17 nt, Human
agacuuuauguaguuuu

SEQ ID NO: 1463630 - RNA, 20 nt, Human
agagacaaacaccucccagg

SEQ ID NO: 1463631 - RNA, 15 nt, Human
agagacagcccagga

SEQ ID NO: 1463632 - RNA, 14 nt, Human
agagacagcccagg

SEQ ID NO: 1463633 - RNA, 22 nt, Human
agagaauuucuaccauuucaga

SEQ ID NO: 1463634 - RNA, 23 nt, Human
agagaauuucuaccauuucagag

SEQ ID NO: 1463635 - RNA, 19 nt, Human
agagacaaacaccucccag

SEQ ID NO: 1463636 - RNA, 21 nt, Human
agagacaaacaccucccagga

SEQ ID NO: 1463637 - RNA, 14 nt, Human
ucuuuaauuuuaca

SEQ ID NO: 1463638 - RNA, 23 nt, Human
ucuugguugaaaauaaaaagauc

SEQ ID NO: 1463639 - RNA, 19 nt, Human
ucuugguugaaaauaaaaa

SEQ ID NO: 1463640 - RNA, 17 nt, Human
agacuccuucaacaauu

SEQ ID NO: 1463641 - RNA, 21 nt, Human
agacuccuucaacaauucuaa

SEQ ID NO: 1463642 - RNA, 13 nt, Human
ucuuucuuccaaa

SEQ ID NO: 1463643 - RNA, 13 nt, Human
ucugauacagaaa

SEQ ID NO: 1463644 - RNA, 15 nt, Human
ucugauaaugaaaau

SEQ ID NO: 1463645 - RNA, 16 nt, Human
ucugaguuuuaccaaa

SEQ ID NO: 1463646 - RNA, 14 nt, Human
ucugaguuuuacca

SEQ ID NO: 1463647 - RNA, 14 nt, Human
ucugagagaggcca

SEQ ID NO: 1463648 - RNA, 20 nt, Human
ucugagagaggccauucuuu

SEQ ID NO: 1463649 - RNA, 23 nt, Human
ucugaguguuuuaugagaaagcc

SEQ ID NO: 1463650 - RNA, 17 nt, Human
ucugaguuccugcaugc

SEQ ID NO: 1463651 - RNA, 17 nt, Human
agaaauuuauaaacuuu

SEQ ID NO: 1463652 - RNA, 16 nt, Human
agaaauuuauaaacuu

SEQ ID NO: 1463653 - RNA, 22 nt, Human
agaaauuaugugccagauuuau

SEQ ID NO: 1463654 - RNA, 21 nt, Human
agaaauuaugugccagauuua

SEQ ID NO: 1463655 - RNA, 13 nt, Human
agaaauuaugugc

SEQ ID NO: 1463656 - RNA, 18 nt, Human
ucugcaggucccuaauaa

SEQ ID NO: 1463657 - RNA, 17 nt, Human
ucugcaggucccuaaua

SEQ ID NO: 1463658 - RNA, 16 nt, Human
ucugcaggucccuaau

SEQ ID NO: 1463659 - RNA, 15 nt, Human
ucugcaggucccuaa

SEQ ID NO: 1463660 - RNA, 17 nt, Human
agaaaugaaaaaauaua

SEQ ID NO: 1463661 - RNA, 15 nt, Human
agaaaucuaaaaaac

SEQ ID NO: 1463662 - RNA, 22 nt, Human
agaaaucauuuugcaaucccuu

SEQ ID NO: 1463663 - RNA, 12 nt, Human
agaaaucuaaaa

SEQ ID NO: 1463664 - RNA, 14 nt, Human
agaaaucauagcug

SEQ ID NO: 1463665 - RNA, 15 nt, Human
agaaacuuucuuucu

SEQ ID NO: 1463666 - RNA, 15 nt, Human
agaaacuuuuuuauu

SEQ ID NO: 1463667 - RNA, 19 nt, Human
agaaacuuuuuuauuuaaa

SEQ ID NO: 1463668 - RNA, 13 nt, Human
agaaagccuucuu

SEQ ID NO: 1463669 - RNA, 15 nt, Human
agaaagccuucuuuu

SEQ ID NO: 1463670 - RNA, 13 nt, Human
agaaagcugccug

SEQ ID NO: 1463671 - RNA, 23 nt, Human
agaaaugaaaaaauauauaucaa

SEQ ID NO: 1463672 - RNA, 18 nt, Human
agaaaugaaaaaauauau

SEQ ID NO: 1463673 - RNA, 12 nt, Human
ucugaagaagau

SEQ ID NO: 1463674 - RNA, 17 nt, Human
agaaaucauuuugcaau

SEQ ID NO: 1463675 - RNA, 15 nt, Human
ucugaauuuuuaaac

SEQ ID NO: 1463676 - RNA, 16 nt, Human
ucugaauuuuuaaaca

SEQ ID NO: 1463677 - RNA, 17 nt, Human
ucugaauuuuuaaacaa

SEQ ID NO: 1463678 - RNA, 19 nt, Human
ucugaauuuuuaaacaagu

SEQ ID NO: 1463679 - RNA, 17 nt, Human
ucucucacuuguuuuau

SEQ ID NO: 1463680 - RNA, 21 nt, Human
ucucucacuuguuuuauuuaa

SEQ ID NO: 1463681 - RNA, 18 nt, Human
acuuucucaguuuucaua

SEQ ID NO: 1463682 - RNA, 15 nt, Human
ucucucauacccucc

SEQ ID NO: 1463683 - RNA, 12 nt, Human
ucucucaugaac

SEQ ID NO: 1463684 - RNA, 15 nt, Human
ucucucaugaaccuc

SEQ ID NO: 1463685 - RNA, 17 nt, Human
ucucucaugaaccucaa

SEQ ID NO: 1463686 - RNA, 22 nt, Human
ucucucaugaaccucaagcugc

SEQ ID NO: 1463687 - RNA, 15 nt, Human
ucucuggaauuugaa

SEQ ID NO: 1463688 - RNA, 19 nt, Human
ucucuggaauuugaaacac

SEQ ID NO: 1463689 - RNA, 20 nt, Human
ucucuggaagccccugggcc

SEQ ID NO: 1463690 - RNA, 19 nt, Human
ucucuggaagccccugggc

SEQ ID NO: 1463691 - RNA, 21 nt, Human
agaaaacuuguauuaugugug

SEQ ID NO: 1463692 - RNA, 14 nt, Human
agaaaaagaagcaa

SEQ ID NO: 1463693 - RNA, 23 nt, Human
agaaacacguaucccaccugaca

SEQ ID NO: 1463694 - RNA, 17 nt, Human
agaaacacccucacacu

SEQ ID NO: 1463695 - RNA, 21 nt, Human
ucucuuuaaaaggaaagaaaa

SEQ ID NO: 1463696 - RNA, 19 nt, Human
ucucuuuaaaaggaaagaa

SEQ ID NO: 1463697 - RNA, 18 nt, Human
ucucuuuaaaaggaaaga

SEQ ID NO: 1463698 - RNA, 21 nt, Human
ucucuugccucaaccucccaa

SEQ ID NO: 1463699 - RNA, 13 nt, Human
ucucuugccucaa

SEQ ID NO: 1463700 - RNA, 12 nt, Human
ucucuugauuuu

SEQ ID NO: 1463701 - RNA, 12 nt, Human
ucucuugccuca

SEQ ID NO: 1463702 - RNA, 16 nt, Human
ucucagcucacugcaa

SEQ ID NO: 1463703 - RNA, 15 nt, Human
ucucagcucacugca

SEQ ID NO: 1463704 - RNA, 18 nt, Human
ucucagcucacugcaacc

SEQ ID NO: 1463705 - RNA, 14 nt, Human
ucuccaaaccacuu

SEQ ID NO: 1463706 - RNA, 19 nt, Human
ucuccaguauccacuuugc

SEQ ID NO: 1463707 - RNA, 15 nt, Human
ucuccagugcaccug

SEQ ID NO: 1463708 - RNA, 16 nt, Human
acuuguguuuugcaag

SEQ ID NO: 1463709 - RNA, 12 nt, Human
ucuccucccagg

SEQ ID NO: 1463710 - RNA, 13 nt, Human
acuuucucaguuu

SEQ ID NO: 1463711 - RNA, 14 nt, Human
acuuucucaguuuu

SEQ ID NO: 1463712 - RNA, 17 nt, Human
acuuucucaguuuucau

SEQ ID NO: 1463713 - RNA, 12 nt, Human
acuuuaaagcgu

SEQ ID NO: 1463714 - RNA, 19 nt, Human
acuuuaauuaccaaccugu

SEQ ID NO: 1463715 - RNA, 19 nt, Human
ucuccuaagcuggagugca

SEQ ID NO: 1463716 - RNA, 17 nt, Human
ucuccauggcccugcca

SEQ ID NO: 1463717 - RNA, 16 nt, Human
ucuccauggcccugcc

SEQ ID NO: 1463718 - RNA, 24 nt, Human
ucuccauggcccugccaugcucuc

SEQ ID NO: 1463719 - RNA, 20 nt, Human
ucuccauggcccugccaugc

SEQ ID NO: 1463720 - RNA, 19 nt, Human
ucucccacuagacaagucc

SEQ ID NO: 1463721 - RNA, 14 nt, Human
acuugcucuugaug

SEQ ID NO: 1463722 - RNA, 16 nt, Human
acuugaggacacaugu

SEQ ID NO: 1463723 - RNA, 15 nt, Human
acuugaggacacaug

SEQ ID NO: 1463724 - RNA, 22 nt, Human
acuugcucagguacuuguaaau

SEQ ID NO: 1463725 - RNA, 20 nt, Human
acuugcucagguacuuguaa

SEQ ID NO: 1463726 - RNA, 23 nt, Human
acuugucccgggacaccuaggcu

SEQ ID NO: 1463727 - RNA, 24 nt, Human
acuugucauuguuauauaaucauu

SEQ ID NO: 1463728 - RNA, 16 nt, Human
acuugucaauaaaauc

SEQ ID NO: 1463729 - RNA, 13 nt, Human
acuugucauguga

SEQ ID NO: 1463730 - RNA, 23 nt, Human
acuugucauuguuauauaaucau

SEQ ID NO: 1463731 - RNA, 14 nt, Human
acuugaggacacau

SEQ ID NO: 1463732 - RNA, 13 nt, Human
acuugaggacaca

SEQ ID NO: 1463733 - RNA, 12 nt, Human
acuugaggacac

SEQ ID NO: 1463734 - RNA, 11 nt, Human
acuugaggaca

SEQ ID NO: 1463735 - RNA, 14 nt, Human
acuugagaccuaau

SEQ ID NO: 1463736 - RNA, 21 nt, Human
acuugagaccuaaucucugua

SEQ ID NO: 1463737 - RNA, 20 nt, Human
acuucucauuuuuuaaaaaa

SEQ ID NO: 1463738 - RNA, 21 nt, Human
ucucacagcuccaagaauuuc

SEQ ID NO: 1463739 - RNA, 14 nt, Human
ucucacuaaaucuu

SEQ ID NO: 1463740 - RNA, 19 nt, Human
acuucucauuuuuuaaaaa

SEQ ID NO: 1463741 - RNA, 13 nt, Human
acuggccccaccc

SEQ ID NO: 1463742 - RNA, 12 nt, Human
acuggccccacc

SEQ ID NO: 1463743 - RNA, 17 nt, Human
acuggccucaaagcaag

SEQ ID NO: 1463744 - RNA, 15 nt, Human
acuggccucaaagca

SEQ ID NO: 1463745 - RNA, 22 nt, Human
acuggccucaaagcaagcauuc

SEQ ID NO: 1463746 - RNA, 15 nt, Human
uccuuccaccaaguu

SEQ ID NO: 1463747 - RNA, 24 nt, Human
uccuucugagcccgguaagagcaa

SEQ ID NO: 1463748 - RNA, 15 nt, Human
uccuucuauucuagc

SEQ ID NO: 1463749 - RNA, 13 nt, Human
uccuugucacugg

SEQ ID NO: 1463750 - RNA, 13 nt, Human
ucgaagugcugag

SEQ ID NO: 1463751 - RNA, 12 nt, Human
ucgaagugcuga

SEQ ID NO: 1463752 - RNA, 13 nt, Human
uccuuucuggcuu

SEQ ID NO: 1463753 - RNA, 20 nt, Human
uccuuucuagagcacugcca

SEQ ID NO: 1463754 - RNA, 19 nt, Human
uccuuucuagagcacugcc

SEQ ID NO: 1463755 - RNA, 17 nt, Human
ucgagaucccaacacug

SEQ ID NO: 1463756 - RNA, 12 nt, Human
ucgaaugaaauu

SEQ ID NO: 1463757 - RNA, 17 nt, Human
ucgaaugaaauuaacug

SEQ ID NO: 1463758 - RNA, 15 nt, Human
ucgaaugacacuguu

SEQ ID NO: 1463759 - RNA, 14 nt, Human
ucgaaugacacugu

SEQ ID NO: 1463760 - RNA, 18 nt, Human
ucgagaucccaacacugc

SEQ ID NO: 1463761 - RNA, 21 nt, Human
ucgagaucccaacacugccag

SEQ ID NO: 1463762 - RNA, 13 nt, Human
acuggcuucagca

SEQ ID NO: 1463763 - RNA, 15 nt, Human
acuggcuucagcaag

SEQ ID NO: 1463764 - RNA, 13 nt, Human
acugccuucucaa

SEQ ID NO: 1463765 - RNA, 19 nt, Human
acugccuucucaacuccaa

SEQ ID NO: 1463766 - RNA, 20 nt, Human
acugccuucucaacuccaaa

SEQ ID NO: 1463767 - RNA, 14 nt, Human
acugcuguggccag

SEQ ID NO: 1463768 - RNA, 15 nt, Human
acugcuguggccagg

SEQ ID NO: 1463769 - RNA, 16 nt, Human
acugcuguggccagga

SEQ ID NO: 1463770 - RNA, 17 nt, Human
acugcuguggccaggag

SEQ ID NO: 1463771 - RNA, 13 nt, Human
acugcuuaauuca

SEQ ID NO: 1463772 - RNA, 16 nt, Human
acugcuuaauucaaau

SEQ ID NO: 1463773 - RNA, 18 nt, Human
acugcuguggccaggagg

SEQ ID NO: 1463774 - RNA, 19 nt, Human
acugcuguggccaggaggu

SEQ ID NO: 1463775 - RNA, 20 nt, Human
acugcuguggccaggaggug

SEQ ID NO: 1463776 - RNA, 17 nt, Human
acuggagugugcguggu

SEQ ID NO: 1463777 - RNA, 22 nt, Human
acuggagugugcgugguggucc

SEQ ID NO: 1463778 - RNA, 14 nt, Human
acuggcacagaggu

SEQ ID NO: 1463779 - RNA, 12 nt, Human
acuggcacagag

SEQ ID NO: 1463780 - RNA, 21 nt, Human
acugccuauuuuaauaaacac

SEQ ID NO: 1463781 - RNA, 16 nt, Human
acugccuauuuuaaua

SEQ ID NO: 1463782 - RNA, 15 nt, Human
acugcauuauauuua

SEQ ID NO: 1463783 - RNA, 14 nt, Human
acugcauuauauuu

SEQ ID NO: 1463784 - RNA, 15 nt, Human
acugcauccagccug

SEQ ID NO: 1463785 - RNA, 14 nt, Human
acugcauccagccu

SEQ ID NO: 1463786 - RNA, 20 nt, Human
acugcauacuuuuuaaaugu

SEQ ID NO: 1463787 - RNA, 23 nt, Human
acugcauacuuuuuaaauguaaa

SEQ ID NO: 1463788 - RNA, 12 nt, Human
acugcaugcacu

SEQ ID NO: 1463789 - RNA, 14 nt, Human
acugcaugcacuuc

SEQ ID NO: 1463790 - RNA, 18 nt, Human
acugcaugcacuucuuac

SEQ ID NO: 1463791 - RNA, 13 nt, Human
acugcauacuuuu

SEQ ID NO: 1463792 - RNA, 16 nt, Human
acugcauacuuuuuaa

SEQ ID NO: 1463793 - RNA, 17 nt, Human
acugcauacuuuuuaaa

SEQ ID NO: 1463794 - RNA, 18 nt, Human
acugcauacuuuuuaaau

SEQ ID NO: 1463795 - RNA, 20 nt, Human
ucuaaagccauuguaguccu

SEQ ID NO: 1463796 - RNA, 14 nt, Human
ucuaccauuucaga

SEQ ID NO: 1463797 - RNA, 15 nt, Human
ucuaccauuucagag

SEQ ID NO: 1463798 - RNA, 18 nt, Human
ucuaccauuucagagagg

SEQ ID NO: 1463799 - RNA, 19 nt, Human
acuguuguagaagacaaaa

SEQ ID NO: 1463800 - RNA, 18 nt, Human
acuuauaguacaugauaa

SEQ ID NO: 1463801 - RNA, 17 nt, Human
acuuauaguacaugaua

SEQ ID NO: 1463802 - RNA, 15 nt, Human
acuuauaguacauga

SEQ ID NO: 1463803 - RNA, 14 nt, Human
acuuauaguacaug

SEQ ID NO: 1463804 - RNA, 18 nt, Human
acuuauauggaaauucug

SEQ ID NO: 1463805 - RNA, 13 nt, Human
acuuacuuuuucu

SEQ ID NO: 1463806 - RNA, 21 nt, Human
acuuacuuuuucuggucucua

SEQ ID NO: 1463807 - RNA, 19 nt, Human
acuuacaugauucauuuua

SEQ ID NO: 1463808 - RNA, 17 nt, Human
acuuacaugauucauuu

SEQ ID NO: 1463809 - RNA, 18 nt, Human
acuuacaugauucauuuu

SEQ ID NO: 1463810 - RNA, 21 nt, Human
acuuaccaggcaccaaaagaa

SEQ ID NO: 1463811 - RNA, 22 nt, Human
acuuaccaggcaccaaaagaag

SEQ ID NO: 1463812 - RNA, 18 nt, Human
acuuaccaggcaccaaaa

SEQ ID NO: 1463813 - RNA, 21 nt, Human
acugugugcucaggagcccug

SEQ ID NO: 1463814 - RNA, 20 nt, Human
acugugugcucaggagcccu

SEQ ID NO: 1463815 - RNA, 19 nt, Human
acugugugcucaggagccc

SEQ ID NO: 1463816 - RNA, 15 nt, Human
acugugugcucagga

SEQ ID NO: 1463817 - RNA, 12 nt, Human
acugugugcuca

SEQ ID NO: 1463818 - RNA, 21 nt, Human
acuguguauuccaagacaugu

SEQ ID NO: 1463819 - RNA, 17 nt, Human
acuguguacauaacuga

SEQ ID NO: 1463820 - RNA, 15 nt, Human
acuguguauuccaag

SEQ ID NO: 1463821 - RNA, 16 nt, Human
acuguguauuccaaga

SEQ ID NO: 1463822 - RNA, 19 nt, Human
acuguguaagggccagaaa

SEQ ID NO: 1463823 - RNA, 21 nt, Human
acuguguaagggccagaaaua

SEQ ID NO: 1463824 - RNA, 12 nt, Human
acuguguacaua

SEQ ID NO: 1463825 - RNA, 16 nt, Human
acuguguacauaacug

SEQ ID NO: 1463826 - RNA, 18 nt, Human
acuguguacauaacugaa

SEQ ID NO: 1463827 - RNA, 18 nt, Human
acuguggguagacacaca

SEQ ID NO: 1463828 - RNA, 17 nt, Human
acugggagaaaugaaaa

SEQ ID NO: 1463829 - RNA, 15 nt, Human
acugucacuguuccu

SEQ ID NO: 1463830 - RNA, 16 nt, Human
acugggagaaaugaaa

SEQ ID NO: 1463831 - RNA, 18 nt, Human
acugggacaggggagaac

SEQ ID NO: 1463832 - RNA, 19 nt, Human
acugucagcagggacugua

SEQ ID NO: 1463833 - RNA, 22 nt, Human
acugucagcagggacuguaaac

SEQ ID NO: 1463834 - RNA, 13 nt, Human
ucguaaaauuaag

SEQ ID NO: 1463835 - RNA, 16 nt, Human
ucguaaaauuaagaaa

SEQ ID NO: 1463836 - RNA, 22 nt, Human
ucguuuucaaaauuguuacaaa

SEQ ID NO: 1463837 - RNA, 14 nt, Human
ucguuuuuuacaaa

SEQ ID NO: 1463838 - RNA, 19 nt, Human
uccuaaauauauuuuaaga

SEQ ID NO: 1463839 - RNA, 14 nt, Human
uccuaaauauuaug

SEQ ID NO: 1463840 - RNA, 21 nt, Human
uccuaaauauuaugagaugcu

SEQ ID NO: 1463841 - RNA, 20 nt, Human
ucccuggguagcgggggagg

SEQ ID NO: 1463842 - RNA, 21 nt, Human
ucccuuaauauccuaaacauc

SEQ ID NO: 1463843 - RNA, 17 nt, Human
ucccuuaauauccuaaa

SEQ ID NO: 1463844 - RNA, 14 nt, Human
ucccuuaauauccu

SEQ ID NO: 1463845 - RNA, 13 nt, Human
acucauuagacug

SEQ ID NO: 1463846 - RNA, 14 nt, Human
acucauuagacugg

SEQ ID NO: 1463847 - RNA, 15 nt, Human
acucauuagacugga

SEQ ID NO: 1463848 - RNA, 21 nt, Human
acucauuagacuggaacuuga

SEQ ID NO: 1463849 - RNA, 18 nt, Human
acucaugugacucuuucc

SEQ ID NO: 1463850 - RNA, 19 nt, Human
acucaugugacucuuucca

SEQ ID NO: 1463851 - RNA, 15 nt, Human
acucacuuucuagau

SEQ ID NO: 1463852 - RNA, 21 nt, Human
acuacuagggaaaugccuuug

SEQ ID NO: 1463853 - RNA, 23 nt, Human
uccccuauguggaaguggggcgg

SEQ ID NO: 1463854 - RNA, 14 nt, Human
uccccuccaucccu

SEQ ID NO: 1463855 - RNA, 15 nt, Human
uccccuccaucccug

SEQ ID NO: 1463856 - RNA, 16 nt, Human
uccccuccaucccugg

SEQ ID NO: 1463857 - RNA, 20 nt, Human
uccccuccaucccuggcccc

SEQ ID NO: 1463858 - RNA, 18 nt, Human
uccccuccaucccuggcc

SEQ ID NO: 1463859 - RNA, 24 nt, Human
uccccuuugcuucauucaagucag

SEQ ID NO: 1463860 - RNA, 18 nt, Human
acucacuaauucauuaau

SEQ ID NO: 1463861 - RNA, 20 nt, Human
acucacuaauucauuaaucu

SEQ ID NO: 1463862 - RNA, 21 nt, Human
ucccgggacaccuaggcuagg

SEQ ID NO: 1463863 - RNA, 17 nt, Human
acgugggcauucaaaug

SEQ ID NO: 1463864 - RNA, 20 nt, Human
acgugggcauucaaauguau

SEQ ID NO: 1463865 - RNA, 22 nt, Human
acguauaaaagccuguuuaaga

SEQ ID NO: 1463866 - RNA, 20 nt, Human
acguacugcagccuccagag

SEQ ID NO: 1463867 - RNA, 13 nt, Human
acguauuuaauag

SEQ ID NO: 1463868 - RNA, 15 nt, Human
acguauuuaauagca

SEQ ID NO: 1463869 - RNA, 15 nt, Human
acggggacucagccc

SEQ ID NO: 1463870 - RNA, 18 nt, Human
acgggacugcggaggaag

SEQ ID NO: 1463871 - RNA, 16 nt, Human
ucccaaguugugcuug

SEQ ID NO: 1463872 - RNA, 20 nt, Human
ucccaaguagcugagacuac

SEQ ID NO: 1463873 - RNA, 16 nt, Human
ucccaaguagaaucuc

SEQ ID NO: 1463874 - RNA, 17 nt, Human
ucccaaguagaaucuca

SEQ ID NO: 1463875 - RNA, 19 nt, Human
ucccaaguagaaucucagu

SEQ ID NO: 1463876 - RNA, 13 nt, Human
ucccaaagugcug

SEQ ID NO: 1463877 - RNA, 21 nt, Human
ucccaaaguccugggauuaca

SEQ ID NO: 1463878 - RNA, 20 nt, Human
ucccaaaagcccauucauuc

SEQ ID NO: 1463879 - RNA, 14 nt, Human
ucccaaaaaacuac

SEQ ID NO: 1463880 - RNA, 21 nt, Human
ucccaaagaaguucugguaug

SEQ ID NO: 1463881 - RNA, 20 nt, Human
ucccaaaauguugaaauaug

SEQ ID NO: 1463882 - RNA, 14 nt, Human
uccauucuggaagu

SEQ ID NO: 1463883 - RNA, 13 nt, Human
uccauucuggaag

SEQ ID NO: 1463884 - RNA, 12 nt, Human
uccauucuggaa

SEQ ID NO: 1463885 - RNA, 14 nt, Human
uccauucuccugag

SEQ ID NO: 1463886 - RNA, 20 nt, Human
uccaucucuuguuuaaauuc

SEQ ID NO: 1463887 - RNA, 20 nt, Human
uccauccuugagucaaaaaa

SEQ ID NO: 1463888 - RNA, 15 nt, Human
acuacaguuagggcu

SEQ ID NO: 1463889 - RNA, 16 nt, Human
acuacagucuaaagcu

SEQ ID NO: 1463890 - RNA, 17 nt, Human
acuacagucuaaagcug

SEQ ID NO: 1463891 - RNA, 20 nt, Human
ucccagcaugcugagauuac

SEQ ID NO: 1463892 - RNA, 20 nt, Human
acuacaggcacacaccacca

SEQ ID NO: 1463893 - RNA, 17 nt, Human
acuacaggcgugagcca

SEQ ID NO: 1463894 - RNA, 22 nt, Human
acuacacacuguguacugcagu

SEQ ID NO: 1463895 - RNA, 16 nt, Human
acuacaaccaauggaa

SEQ ID NO: 1463896 - RNA, 14 nt, Human
ucccaucccugcgu

SEQ ID NO: 1463897 - RNA, 12 nt, Human
ucccaucccugc

SEQ ID NO: 1463898 - RNA, 14 nt, Human
uccccauucuuccu

SEQ ID NO: 1463899 - RNA, 17 nt, Human
uccccauucuuccuagu

SEQ ID NO: 1463900 - RNA, 22 nt, Human
uccccauucuuccuaguuuucu

SEQ ID NO: 1463901 - RNA, 19 nt, Human
uccccauuuagguuucuga

SEQ ID NO: 1463902 - RNA, 14 nt, Human
uccacucaugugac

SEQ ID NO: 1463903 - RNA, 21 nt, Human
uccacucaugugacucuuucc

SEQ ID NO: 1463904 - RNA, 21 nt, Human
accuuagaccaccaagccuug

SEQ ID NO: 1463905 - RNA, 20 nt, Human
accuuagaccaccaagccuu

SEQ ID NO: 1463906 - RNA, 19 nt, Human
accuuagaccaccaagccu

SEQ ID NO: 1463907 - RNA, 18 nt, Human
accuuagaccaccaagcc

SEQ ID NO: 1463908 - RNA, 22 nt, Human
accuuagaccaccaagccuuga

SEQ ID NO: 1463909 - RNA, 15 nt, Human
uccagaccugaagaa

SEQ ID NO: 1463910 - RNA, 16 nt, Human
uccagaccugaagaau

SEQ ID NO: 1463911 - RNA, 22 nt, Human
uccagacugcuuccaauuuucu

SEQ ID NO: 1463912 - RNA, 23 nt, Human
uccagacugcuuccaauuuucug

SEQ ID NO: 1463913 - RNA, 15 nt, Human
uccagagacaacagg

SEQ ID NO: 1463914 - RNA, 14 nt, Human
uccagagacaacag

SEQ ID NO: 1463915 - RNA, 14 nt, Human
acgagaaaacaaua

SEQ ID NO: 1463916 - RNA, 15 nt, Human
uccaggcuguguuug

SEQ ID NO: 1463917 - RNA, 16 nt, Human
uccagagacaacaggu

SEQ ID NO: 1463918 - RNA, 13 nt, Human
uccaggcaccagg

SEQ ID NO: 1463919 - RNA, 21 nt, Human
uccaggcaccaggacuagggc

SEQ ID NO: 1463920 - RNA, 21 nt, Human
uccaggcaggucugaagcuca

SEQ ID NO: 1463921 - RNA, 15 nt, Human
uccaacccuagcaaa

SEQ ID NO: 1463922 - RNA, 21 nt, Human
uccaaccggcuuuguggcacu

SEQ ID NO: 1463923 - RNA, 14 nt, Human
uccaacccuagcaa

SEQ ID NO: 1463924 - RNA, 13 nt, Human
uccaacccuagca

SEQ ID NO: 1463925 - RNA, 15 nt, Human
uccaacuuggcugca

SEQ ID NO: 1463926 - RNA, 23 nt, Human
uccaacuuggcugcaggaaucuu

SEQ ID NO: 1463927 - RNA, 16 nt, Human
accuggguugcagaca

SEQ ID NO: 1463928 - RNA, 18 nt, Human
accuggguugcagacagg

SEQ ID NO: 1463929 - RNA, 20 nt, Human
accuggguugcagacaggaa

SEQ ID NO: 1463930 - RNA, 21 nt, Human
accuagggugauauuaaccag

SEQ ID NO: 1463931 - RNA, 14 nt, Human
accuaguuuuccau

SEQ ID NO: 1463932 - RNA, 17 nt, Human
accuaaucucuguaaag

SEQ ID NO: 1463933 - RNA, 21 nt, Human
accuaaucucuguaaagcuaa

SEQ ID NO: 1463934 - RNA, 13 nt, Human
accgcuaaaagaa

SEQ ID NO: 1463935 - RNA, 15 nt, Human
accgcuaaaagaaac

SEQ ID NO: 1463936 - RNA, 16 nt, Human
accgcuaaaagaaacu

SEQ ID NO: 1463937 - RNA, 23 nt, Human
accuaaacauagaaauugccuga

SEQ ID NO: 1463938 - RNA, 12 nt, Human
accuaaagaaaa

SEQ ID NO: 1463939 - RNA, 13 nt, Human
accuaaagaaaaa

SEQ ID NO: 1463940 - RNA, 17 nt, Human
accuaaagaaaaacaaa

SEQ ID NO: 1463941 - RNA, 13 nt, Human
ucaucucagcuca

SEQ ID NO: 1463942 - RNA, 16 nt, Human
ucaugaauuaguuuua

SEQ ID NO: 1463943 - RNA, 12 nt, Human
ucaugaauguaa

SEQ ID NO: 1463944 - RNA, 14 nt, Human
ucaucuaggauuuu

SEQ ID NO: 1463945 - RNA, 18 nt, Human
ucaucuagguaaauuaca

SEQ ID NO: 1463946 - RNA, 22 nt, Human
ucauccucuccacagcugccuc

SEQ ID NO: 1463947 - RNA, 12 nt, Human
ucauccugcagg

SEQ ID NO: 1463948 - RNA, 13 nt, Human
ucauccugcaggc

SEQ ID NO: 1463949 - RNA, 19 nt, Human
accucccucaaccucaucc

SEQ ID NO: 1463950 - RNA, 16 nt, Human
accucaacugccuacu

SEQ ID NO: 1463951 - RNA, 22 nt, Human
accucaacugccuacuccaaaa

SEQ ID NO: 1463952 - RNA, 22 nt, Human
accucuccagccucagcucuca

SEQ ID NO: 1463953 - RNA, 20 nt, Human
accucuccagccucagcucu

SEQ ID NO: 1463954 - RNA, 18 nt, Human
accucuccagccucagcu

SEQ ID NO: 1463955 - RNA, 16 nt, Human
accucuccagccucag

SEQ ID NO: 1463956 - RNA, 23 nt, Human
accucucaauauucaauaaagcu

SEQ ID NO: 1463957 - RNA, 21 nt, Human
accucucaauauucaauaaag

SEQ ID NO: 1463958 - RNA, 20 nt, Human
accucucaauauucaauaaa

SEQ ID NO: 1463959 - RNA, 19 nt, Human
accucucaauauucaauaa

SEQ ID NO: 1463960 - RNA, 12 nt, Human
accucucaauau

SEQ ID NO: 1463961 - RNA, 14 nt, Human
accucuaaauucuu

SEQ ID NO: 1463962 - RNA, 17 nt, Human
accucuccccuggaacu

SEQ ID NO: 1463963 - RNA, 12 nt, Human
accugagcuaaa

SEQ ID NO: 1463964 - RNA, 22 nt, Human
accugagcuaaauaaagauauu

SEQ ID NO: 1463965 - RNA, 16 nt, Human
accugaccccugcuca

SEQ ID NO: 1463966 - RNA, 17 nt, Human
accugaccccugcucag

SEQ ID NO: 1463967 - RNA, 23 nt, Human
accugaccccugcucaguaaagc

SEQ ID NO: 1463968 - RNA, 22 nt, Human
accugagucacccuaccugugc

SEQ ID NO: 1463969 - RNA, 23 nt, Human
accugagucacccuaccugugcc

SEQ ID NO: 1463970 - RNA, 21 nt, Human
accugagucguacagaaagcu

SEQ ID NO: 1463971 - RNA, 17 nt, Human
accucgugauccacccg

SEQ ID NO: 1463972 - RNA, 21 nt, Human
ucaugaauuaguuuuauaugc

SEQ ID NO: 1463973 - RNA, 13 nt, Human
ucaugaauguaaa

SEQ ID NO: 1463974 - RNA, 14 nt, Human
ucaugaauguaaau

SEQ ID NO: 1463975 - RNA, 19 nt, Human
ucaugaauguaaauuugua

SEQ ID NO: 1463976 - RNA, 20 nt, Human
ucaugaauguaaauuuguac

SEQ ID NO: 1463977 - RNA, 21 nt, Human
ucaugaauguaaauuuguacu

SEQ ID NO: 1463978 - RNA, 16 nt, Human
ucaugauccaacuaau

SEQ ID NO: 1463979 - RNA, 18 nt, Human
ucauuaaucugccucccu

SEQ ID NO: 1463980 - RNA, 17 nt, Human
ucauuaaucugccuccc

SEQ ID NO: 1463981 - RNA, 12 nt, Human
ucauuacuauaa

SEQ ID NO: 1463982 - RNA, 18 nt, Human
ucauucuuauuucaugaa

SEQ ID NO: 1463983 - RNA, 14 nt, Human
ucauucuuauuuca

SEQ ID NO: 1463984 - RNA, 12 nt, Human
uauuuuuaucuu

SEQ ID NO: 1463985 - RNA, 18 nt, Human
uauuuuuacauucugaau

SEQ ID NO: 1463986 - RNA, 19 nt, Human
ucaaaauuguuacaaauug

SEQ ID NO: 1463987 - RNA, 16 nt, Human
ucaaaauuguuacaaa

SEQ ID NO: 1463988 - RNA, 16 nt, Human
ucaaaauauuuguaca

SEQ ID NO: 1463989 - RNA, 17 nt, Human
ucaaaauauuuguacau

SEQ ID NO: 1463990 - RNA, 19 nt, Human
ucaaaauauuuguacauag

SEQ ID NO: 1463991 - RNA, 18 nt, Human
ucaaaauauuuguacaua

SEQ ID NO: 1463992 - RNA, 21 nt, Human
ucaaaauaugccccauucaac

SEQ ID NO: 1463993 - RNA, 14 nt, Human
ucaaaguuuaauaa

SEQ ID NO: 1463994 - RNA, 13 nt, Human
ucaaaguuuaaua

SEQ ID NO: 1463995 - RNA, 19 nt, Human
ucaaagcuguguguuugga

SEQ ID NO: 1463996 - RNA, 15 nt, Human
ucaaagcuuuuucca

SEQ ID NO: 1463997 - RNA, 16 nt, Human
ucaaagcuuuuuccag

SEQ ID NO: 1463998 - RNA, 14 nt, Human
ucaaagcugaaaug

SEQ ID NO: 1463999 - RNA, 24 nt, Human
ucaaaauuagugcuuuuuguguca

SEQ ID NO: 1464000 - RNA, 21 nt, Human
ucaaacaccaacauaaaaaug

SEQ ID NO: 1464001 - RNA, 16 nt, Human
acaugaaguccaagca

SEQ ID NO: 1464002 - RNA, 19 nt, Human
acaugaagcuguuguguga

SEQ ID NO: 1464003 - RNA, 13 nt, Human
acaugaagcuguu

SEQ ID NO: 1464004 - RNA, 20 nt, Human
ucaaauacgugggcauucaa

SEQ ID NO: 1464005 - RNA, 22 nt, Human
ucaagaacacagcccugcuucu

SEQ ID NO: 1464006 - RNA, 21 nt, Human
ucaagaaagcuucaaacugca

SEQ ID NO: 1464007 - RNA, 17 nt, Human
ucaagaaauaaguuuuu

SEQ ID NO: 1464008 - RNA, 14 nt, Human
ucaagaaauaaguu

SEQ ID NO: 1464009 - RNA, 21 nt, Human
ucaagaauaaucacgcuuucc

SEQ ID NO: 1464010 - RNA, 15 nt, Human
ucaagagacugaguc

SEQ ID NO: 1464011 - RNA, 15 nt, Human
ucaacagugaagaca

SEQ ID NO: 1464012 - RNA, 17 nt, Human
ucaacagugaagacaga

SEQ ID NO: 1464013 - RNA, 22 nt, Human
ucaacagugaagacagaaguuu

SEQ ID NO: 1464014 - RNA, 18 nt, Human
ucaacagugaagacagaa

SEQ ID NO: 1464015 - RNA, 14 nt, Human
ucaacaguuuuccu

SEQ ID NO: 1464016 - RNA, 15 nt, Human
ucaacaguuuuccua

SEQ ID NO: 1464017 - RNA, 17 nt, Human
ucaacaguuuuccuaug

SEQ ID NO: 1464018 - RNA, 20 nt, Human
ucaacaguuuuccuaugcuu

SEQ ID NO: 1464019 - RNA, 22 nt, Human
ucaacaguuuuccuaugcuuug

SEQ ID NO: 1464020 - RNA, 23 nt, Human
ucaacaguuuuccuaugcuuuga

SEQ ID NO: 1464021 - RNA, 12 nt, Human
ucaagaaacuga

SEQ ID NO: 1464022 - RNA, 13 nt, Human
ucaagaaacugag

SEQ ID NO: 1464023 - RNA, 17 nt, Human
ucaagaaacugaggaau

SEQ ID NO: 1464024 - RNA, 18 nt, Human
ucaagaaacugaggaauu

SEQ ID NO: 1464025 - RNA, 20 nt, Human
ucaagaaacugaggaauuuu

SEQ ID NO: 1464026 - RNA, 22 nt, Human
ucaagaaacugaggaauuuucu

SEQ ID NO: 1464027 - RNA, 23 nt, Human
ucaagaaacugaggaauuuucuu

SEQ ID NO: 1464028 - RNA, 16 nt, Human
ucaagggucaggccuu

SEQ ID NO: 1464029 - RNA, 13 nt, Human
ucaagggucaggc

SEQ ID NO: 1464030 - RNA, 15 nt, Human
ucaagggucaggccu

SEQ ID NO: 1464031 - RNA, 13 nt, Human
acauuccauccuu

SEQ ID NO: 1464032 - RNA, 15 nt, Human
acauuccaacucgua

SEQ ID NO: 1464033 - RNA, 22 nt, Human
acauuccaacucguauagcaug

SEQ ID NO: 1464034 - RNA, 14 nt, Human
ucaacaauucuaaa

SEQ ID NO: 1464035 - RNA, 15 nt, Human
ucaacaauucuaaaa

SEQ ID NO: 1464036 - RNA, 17 nt, Human
ucaacaauucuaaaaug

SEQ ID NO: 1464037 - RNA, 22 nt, Human
acauuaaauuuuuuuuacauuu

SEQ ID NO: 1464038 - RNA, 18 nt, Human
acaugucuguucuacaua

SEQ ID NO: 1464039 - RNA, 21 nt, Human
acauguccagugggaggugag

SEQ ID NO: 1464040 - RNA, 19 nt, Human
acauguccuucugagcccg

SEQ ID NO: 1464041 - RNA, 17 nt, Human
acaugucuguucuacau

SEQ ID NO: 1464042 - RNA, 19 nt, Human
acauuaggaaaaguugcua

SEQ ID NO: 1464043 - RNA, 13 nt, Human
acauuaacucauu

SEQ ID NO: 1464044 - RNA, 14 nt, Human
acauuaacucauua

SEQ ID NO: 1464045 - RNA, 15 nt, Human
acauuaacucauuag

SEQ ID NO: 1464046 - RNA, 22 nt, Human
acauuaacucauuagacuggaa

SEQ ID NO: 1464047 - RNA, 22 nt, Human
uaugaacuugaggacacauguc

SEQ ID NO: 1464048 - RNA, 23 nt, Human
uaugaacuugaggacacaugucc

SEQ ID NO: 1464049 - RNA, 14 nt, Human
uaugaagaacugag

SEQ ID NO: 1464050 - RNA, 21 nt, Human
uaugaacuugaggacacaugu

SEQ ID NO: 1464051 - RNA, 20 nt, Human
uaugaacuugaggacacaug

SEQ ID NO: 1464052 - RNA, 19 nt, Human
uaugaacuugaggacacau

SEQ ID NO: 1464053 - RNA, 21 nt, Human
uaugaaauauuauguuaaaac

SEQ ID NO: 1464054 - RNA, 16 nt, Human
uaugaagaacugagga

SEQ ID NO: 1464055 - RNA, 17 nt, Human
uaugaagaacugaggag

SEQ ID NO: 1464056 - RNA, 21 nt, Human
uauuuccccaacauguaauaa

SEQ ID NO: 1464057 - RNA, 20 nt, Human
acaguuuaauaccacagcuu

SEQ ID NO: 1464058 - RNA, 15 nt, Human
acaguuuauuuguug

SEQ ID NO: 1464059 - RNA, 14 nt, Human
acauaaaaaggaca

SEQ ID NO: 1464060 - RNA, 14 nt, Human
acauaccuaagaag

SEQ ID NO: 1464061 - RNA, 12 nt, Human
acauacucauuu

SEQ ID NO: 1464062 - RNA, 13 nt, Human
acauacucauuuu

SEQ ID NO: 1464063 - RNA, 14 nt, Human
acauacucauuuuu

SEQ ID NO: 1464064 - RNA, 16 nt, Human
acauacucauuuuuca

SEQ ID NO: 1464065 - RNA, 17 nt, Human
acauacucauuuuucau

SEQ ID NO: 1464066 - RNA, 16 nt, Human
acauagaaauugccug

SEQ ID NO: 1464067 - RNA, 21 nt, Human
acauagaaauugccugacgaa

SEQ ID NO: 1464068 - RNA, 20 nt, Human
acaguuuuccuaugcuuuga

SEQ ID NO: 1464069 - RNA, 12 nt, Human
acaucucauuuu

SEQ ID NO: 1464070 - RNA, 16 nt, Human
acaucaccacaguuua

SEQ ID NO: 1464071 - RNA, 15 nt, Human
acaucacuuguacaa

SEQ ID NO: 1464072 - RNA, 16 nt, Human
acaucacuuguacaaa

SEQ ID NO: 1464073 - RNA, 19 nt, Human
acaucacuuguacaaaaua

SEQ ID NO: 1464074 - RNA, 22 nt, Human
uauuuggugauuacauuuuaaa

SEQ ID NO: 1464075 - RNA, 17 nt, Human
uauuuggugauuacauu

SEQ ID NO: 1464076 - RNA, 19 nt, Human
acauaguauucaugacuau

SEQ ID NO: 1464077 - RNA, 14 nt, Human
acauaguauucaug

SEQ ID NO: 1464078 - RNA, 20 nt, Human
acauagugggacccugucuc

SEQ ID NO: 1464079 - RNA, 15 nt, Human
acauaguuauuuauu

SEQ ID NO: 1464080 - RNA, 19 nt, Human
acauauauaacaaugcugu

SEQ ID NO: 1464081 - RNA, 16 nt, Human
acauagacagaagaaa

SEQ ID NO: 1464082 - RNA, 18 nt, Human
acauagacagaagaaaca

SEQ ID NO: 1464083 - RNA, 17 nt, Human
acauagacagaagaaac

SEQ ID NO: 1464084 - RNA, 20 nt, Human
accacuuuuugcagcuuucu

SEQ ID NO: 1464085 - RNA, 18 nt, Human
accacuuuuugcagcuuu

SEQ ID NO: 1464086 - RNA, 24 nt, Human
accagaaagcaguugagacaagaa

SEQ ID NO: 1464087 - RNA, 17 nt, Human
accacuuuuugcagcuu

SEQ ID NO: 1464088 - RNA, 16 nt, Human
accacuuuuugcagcu

SEQ ID NO: 1464089 - RNA, 15 nt, Human
accacuuuuugcagc

SEQ ID NO: 1464090 - RNA, 14 nt, Human
accacuuuuugcag

SEQ ID NO: 1464091 - RNA, 13 nt, Human
accacuuuuugca

SEQ ID NO: 1464092 - RNA, 23 nt, Human
accagaaagcaguugagacaaga

SEQ ID NO: 1464093 - RNA, 21 nt, Human
accagacuacuugggagcacc

SEQ ID NO: 1464094 - RNA, 23 nt, Human
accagacuacuugggagcaccgc

SEQ ID NO: 1464095 - RNA, 18 nt, Human
accacuuguguuuugcaa

SEQ ID NO: 1464096 - RNA, 21 nt, Human
accacugcugauauuuucucu

SEQ ID NO: 1464097 - RNA, 14 nt, Human
accagccgugagca

SEQ ID NO: 1464098 - RNA, 19 nt, Human
accagccgugagcauguuu

SEQ ID NO: 1464099 - RNA, 18 nt, Human
accaggcuugccugcagg

SEQ ID NO: 1464100 - RNA, 22 nt, Human
accagccgugagcauguuugga

SEQ ID NO: 1464101 - RNA, 19 nt, Human
accaggcuugccugcaggc

SEQ ID NO: 1464102 - RNA, 19 nt, Human
ucaccugagucacccuacc

SEQ ID NO: 1464103 - RNA, 18 nt, Human
ucacuagcccuccuuuuu

SEQ ID NO: 1464104 - RNA, 21 nt, Human
ucacuagcccuccuuuuucca

SEQ ID NO: 1464105 - RNA, 22 nt, Human
ucaccuuagaccaccaagccuu

SEQ ID NO: 1464106 - RNA, 21 nt, Human
ucaccuuagaccaccaagccu

SEQ ID NO: 1464107 - RNA, 20 nt, Human
ucaccuuagaccaccaagcc

SEQ ID NO: 1464108 - RNA, 19 nt, Human
ucaccuuagaccaccaagc

SEQ ID NO: 1464109 - RNA, 16 nt, Human
ucaccuuagaccacca

SEQ ID NO: 1464110 - RNA, 23 nt, Human
ucaauucuucccuaucuuugcca

SEQ ID NO: 1464111 - RNA, 19 nt, Human
ucaauucuucccuaucuuu

SEQ ID NO: 1464112 - RNA, 17 nt, Human
ucaauucuucccuaucu

SEQ ID NO: 1464113 - RNA, 15 nt, Human
ucaauucuugccaaa

SEQ ID NO: 1464114 - RNA, 14 nt, Human
accacaaacuguaa

SEQ ID NO: 1464115 - RNA, 13 nt, Human
accaaucaugaau

SEQ ID NO: 1464116 - RNA, 15 nt, Human
accaaucaugaauua

SEQ ID NO: 1464117 - RNA, 14 nt, Human
ucaagucagcucuu

SEQ ID NO: 1464118 - RNA, 19 nt, Human
ucacccagguuggagugca

SEQ ID NO: 1464119 - RNA, 19 nt, Human
ucacccaggcuggacugca

SEQ ID NO: 1464120 - RNA, 18 nt, Human
ucaccaguguguggcuuu

SEQ ID NO: 1464121 - RNA, 23 nt, Human
ucaccaguguguggcuuucagag

SEQ ID NO: 1464122 - RNA, 17 nt, Human
ucaccaggcagccucug

SEQ ID NO: 1464123 - RNA, 19 nt, Human
ucaccaggcagccucuggg

SEQ ID NO: 1464124 - RNA, 22 nt, Human
ucaccaggcagccucugggggg

SEQ ID NO: 1464125 - RNA, 20 nt, Human
ucaccaggcagccucugggg

SEQ ID NO: 1464126 - RNA, 21 nt, Human
accauguaaagaacauaaaua

SEQ ID NO: 1464127 - RNA, 13 nt, Human
accauugaaggcu

SEQ ID NO: 1464128 - RNA, 16 nt, Human
accauugaaggcuuaa

SEQ ID NO: 1464129 - RNA, 18 nt, Human
accauugauuuaauguaa

SEQ ID NO: 1464130 - RNA, 13 nt, Human
accauuaaccaga

SEQ ID NO: 1464131 - RNA, 19 nt, Human
accauuauaaccuuaauuu

SEQ ID NO: 1464132 - RNA, 21 nt, Human
accauuauaaccuuaauuuau

SEQ ID NO: 1464133 - RNA, 21 nt, Human
acccagauaaagguucaugca

SEQ ID NO: 1464134 - RNA, 23 nt, Human
accauuucuugagguaaaagcau

SEQ ID NO: 1464135 - RNA, 14 nt, Human
accauugucucaga

SEQ ID NO: 1464136 - RNA, 15 nt, Human
accauugucucagag

SEQ ID NO: 1464137 - RNA, 18 nt, Human
accauugucucagagcag

SEQ ID NO: 1464138 - RNA, 19 nt, Human
accauugucucagagcagg

SEQ ID NO: 1464139 - RNA, 23 nt, Human
accauuuggauccuguguggaga

SEQ ID NO: 1464140 - RNA, 19 nt, Human
accauuuccucagacucua

SEQ ID NO: 1464141 - RNA, 22 nt, Human
accauuuggcaucccugggccu

SEQ ID NO: 1464142 - RNA, 19 nt, Human
accauuuggcaucccuggg

SEQ ID NO: 1464143 - RNA, 20 nt, Human
accauuuggcaucccugggc

SEQ ID NO: 1464144 - RNA, 14 nt, Human
ucagaaugucauuu

SEQ ID NO: 1464145 - RNA, 23 nt, Human
accccagcuggggccaggcuggg

SEQ ID NO: 1464146 - RNA, 14 nt, Human
accccagacacugg

SEQ ID NO: 1464147 - RNA, 20 nt, Human
ucagccagugaccaaccuuu

SEQ ID NO: 1464148 - RNA, 14 nt, Human
ucagccauguauuu

SEQ ID NO: 1464149 - RNA, 21 nt, Human
ucagagaggccuuuuggaaug

SEQ ID NO: 1464150 - RNA, 22 nt, Human
ucagagaggccuuuuggaaugu

SEQ ID NO: 1464151 - RNA, 21 nt, Human
ucagagccuccuuucuggcuu

SEQ ID NO: 1464152 - RNA, 14 nt, Human
ucagagcgcacagg

SEQ ID NO: 1464153 - RNA, 16 nt, Human
ucagagcgcacaggga

SEQ ID NO: 1464154 - RNA, 19 nt, Human
ucagccuacaggccucaca

SEQ ID NO: 1464155 - RNA, 13 nt, Human
ucaggaaagagaa

SEQ ID NO: 1464156 - RNA, 12 nt, Human
ucaggaaaauug

SEQ ID NO: 1464157 - RNA, 19 nt, Human
ucaggaaagagaacuucca

SEQ ID NO: 1464158 - RNA, 18 nt, Human
ucaggaaaauugaaugca

SEQ ID NO: 1464159 - RNA, 12 nt, Human
ucagcucaugga

SEQ ID NO: 1464160 - RNA, 19 nt, Human
ucagcuucguuuauuuuca

SEQ ID NO: 1464161 - RNA, 21 nt, Human
ucagcuucguuuauuuucaag

SEQ ID NO: 1464162 - RNA, 21 nt, Human
aaugccccugaauuuaaauag

SEQ ID NO: 1464163 - RNA, 21 nt, Human
aauggaaugugauguucaugg

SEQ ID NO: 1464164 - RNA, 12 nt, Human
aaugcuuugaua

SEQ ID NO: 1464165 - RNA, 18 nt, Human
aaugcuuugauauuucaa

SEQ ID NO: 1464166 - RNA, 12 nt, Human
aaugcuuucgau

SEQ ID NO: 1464167 - RNA, 14 nt, Human
aaugccaagcacuu

SEQ ID NO: 1464168 - RNA, 19 nt, Human
aaugccaagcacuucuuuu

SEQ ID NO: 1464169 - RNA, 14 nt, Human
aaugcauaaaugca

SEQ ID NO: 1464170 - RNA, 22 nt, Human
aaugcauuauaggaucauuugu

SEQ ID NO: 1464171 - RNA, 23 nt, Human
aaugcauuauaggaucauuuguu

SEQ ID NO: 1464172 - RNA, 15 nt, Human
uacaaguaacaaaaa

SEQ ID NO: 1464173 - RNA, 19 nt, Human
uacaaguaacaaaaauaaa

SEQ ID NO: 1464174 - RNA, 20 nt, Human
uacaaaauaaacaaauaaca

SEQ ID NO: 1464175 - RNA, 19 nt, Human
uacaaaauaaacaaauaac

SEQ ID NO: 1464176 - RNA, 13 nt, Human
uacaaaaauuccu

SEQ ID NO: 1464177 - RNA, 14 nt, Human
uaauuuaugcagaa

SEQ ID NO: 1464178 - RNA, 14 nt, Human
uaauuuauuauuaa

SEQ ID NO: 1464179 - RNA, 14 nt, Human
aaugaggagacaca

SEQ ID NO: 1464180 - RNA, 16 nt, Human
uaauucaauucaaagc

SEQ ID NO: 1464181 - RNA, 15 nt, Human
uacaggccucacaca

SEQ ID NO: 1464182 - RNA, 19 nt, Human
uacacuaagagagaaugag

SEQ ID NO: 1464183 - RNA, 13 nt, Human
uacacuaucuuaa

SEQ ID NO: 1464184 - RNA, 19 nt, Human
aauggacuuuuguacauag

SEQ ID NO: 1464185 - RNA, 17 nt, Human
uacauagaugcuuaguc

SEQ ID NO: 1464186 - RNA, 22 nt, Human
uacauauaagugauugcugguu

SEQ ID NO: 1464187 - RNA, 19 nt, Human
uacauauaagugauugcug

SEQ ID NO: 1464188 - RNA, 16 nt, Human
aaugugauauuauaca

SEQ ID NO: 1464189 - RNA, 20 nt, Human
uaauagggcaauuaauuccu

SEQ ID NO: 1464190 - RNA, 19 nt, Human
uaauagguuuggacaaaau

SEQ ID NO: 1464191 - RNA, 14 nt, Human
uaauagguuuggac

SEQ ID NO: 1464192 - RNA, 18 nt, Human
uaauagggaaaauucuaa

SEQ ID NO: 1464193 - RNA, 19 nt, Human
uaauacugcugagauacau

SEQ ID NO: 1464194 - RNA, 15 nt, Human
uaaucacgcuuuccu

SEQ ID NO: 1464195 - RNA, 14 nt, Human
uaauacugcugaga

SEQ ID NO: 1464196 - RNA, 23 nt, Human
uaauacugcugagauacauacag

SEQ ID NO: 1464197 - RNA, 17 nt, Human
uaaugaaacaaagaguu

SEQ ID NO: 1464198 - RNA, 20 nt, Human
uaaugacaucaccacaguuu

SEQ ID NO: 1464199 - RNA, 23 nt, Human
uaaugaaacaaagaguucaagaa

SEQ ID NO: 1464200 - RNA, 17 nt, Human
uaaucacgcuuuccuga

SEQ ID NO: 1464201 - RNA, 15 nt, Human
aaugaaaaccacauu

SEQ ID NO: 1464202 - RNA, 11 nt, Human
aaugacacugu

SEQ ID NO: 1464203 - RNA, 22 nt, Human
aaugacaguccgucaaaacaga

SEQ ID NO: 1464204 - RNA, 18 nt, Human
aaugacaucaccacaguu

SEQ ID NO: 1464205 - RNA, 15 nt, Human
aaugagacauccagc

SEQ ID NO: 1464206 - RNA, 14 nt, Human
aaugagacauccag

SEQ ID NO: 1464207 - RNA, 13 nt, Human
aaugagacaucca

SEQ ID NO: 1464208 - RNA, 21 nt, Human
aaugagagacacacugaagaa

SEQ ID NO: 1464209 - RNA, 17 nt, Human
aaucuuuaaaagaugcu

SEQ ID NO: 1464210 - RNA, 16 nt, Human
uaaugauaacuggaaa

SEQ ID NO: 1464211 - RNA, 16 nt, Human
uaauggugccuucauu

SEQ ID NO: 1464212 - RNA, 18 nt, Human
uaauggugccuucauuug

SEQ ID NO: 1464213 - RNA, 17 nt, Human
aaucuugucauguguau

SEQ ID NO: 1464214 - RNA, 18 nt, Human
aaucuugucauguguaua

SEQ ID NO: 1464215 - RNA, 19 nt, Human
aaucuugucauguguauaa

SEQ ID NO: 1464216 - RNA, 20 nt, Human
aauccucaguuuuugugaaa

SEQ ID NO: 1464217 - RNA, 13 nt, Human
aauccuugaagau

SEQ ID NO: 1464218 - RNA, 19 nt, Human
aauccuuagaucuggcaug

SEQ ID NO: 1464219 - RNA, 20 nt, Human
aauccuuagaucuggcaugu

SEQ ID NO: 1464220 - RNA, 13 nt, Human
aauccuugcuuau

SEQ ID NO: 1464221 - RNA, 19 nt, Human
aauccuucuauucuagccu

SEQ ID NO: 1464222 - RNA, 22 nt, Human
aauccuucuauucuagccugca

SEQ ID NO: 1464223 - RNA, 17 nt, Human
aauccuugcuuaugaca

SEQ ID NO: 1464224 - RNA, 18 nt, Human
aauccuugcuuaugacau

SEQ ID NO: 1464225 - RNA, 16 nt, Human
aaucuuauaauuuaaa

SEQ ID NO: 1464226 - RNA, 14 nt, Human
aaucuuauaauuua

SEQ ID NO: 1464227 - RNA, 15 nt, Human
aaucaucaagucuuu

SEQ ID NO: 1464228 - RNA, 17 nt, Human
aaucauggugcucagag

SEQ ID NO: 1464229 - RNA, 19 nt, Human
aaucaugaauuaguuuuau

SEQ ID NO: 1464230 - RNA, 17 nt, Human
aaucaugaauuaguuuu

SEQ ID NO: 1464231 - RNA, 23 nt, Human
aaucaugaauuaguuuuauaugc

SEQ ID NO: 1464232 - RNA, 17 nt, Human
aaucagacuaugaaguu

SEQ ID NO: 1464233 - RNA, 14 nt, Human
aaucagacuaugaa

SEQ ID NO: 1464234 - RNA, 20 nt, Human
aaucagagaccuuccagaaa

SEQ ID NO: 1464235 - RNA, 14 nt, Human
aaucagauagauau

SEQ ID NO: 1464236 - RNA, 16 nt, Human
aaucagauagauauuc

SEQ ID NO: 1464237 - RNA, 21 nt, Human
aaucagauagauauuccuauu

SEQ ID NO: 1464238 - RNA, 18 nt, Human
uaaguuuuuuuuuaaaaa

SEQ ID NO: 1464239 - RNA, 19 nt, Human
uaaguucaaauucuucuga

SEQ ID NO: 1464240 - RNA, 20 nt, Human
uaaguuauuuuuacauucug

SEQ ID NO: 1464241 - RNA, 20 nt, Human
uaaguucaaauucuucugaa

SEQ ID NO: 1464242 - RNA, 18 nt, Human
aauaggcguaacuaauuu

SEQ ID NO: 1464243 - RNA, 21 nt, Human
aauagggcugagcucucugug

SEQ ID NO: 1464244 - RNA, 24 nt, Human
aauagcuuuuuucucugauacaga

SEQ ID NO: 1464245 - RNA, 14 nt, Human
uaaauuuuuuuccu

SEQ ID NO: 1464246 - RNA, 21 nt, Human
aauagauauccacuugagaca

SEQ ID NO: 1464247 - RNA, 11 nt, Human
aauagauguuu

SEQ ID NO: 1464248 - RNA, 22 nt, Human
aauagauguuugauagauuuuc

SEQ ID NO: 1464249 - RNA, 19 nt, Human
aauagauguuugauagauu

SEQ ID NO: 1464250 - RNA, 12 nt, Human
aauaucacuugu

SEQ ID NO: 1464251 - RNA, 16 nt, Human
aauaguauuucccauu

SEQ ID NO: 1464252 - RNA, 15 nt, Human
aauaguauuucccau

SEQ ID NO: 1464253 - RNA, 15 nt, Human
aauaucacuugucaa

SEQ ID NO: 1464254 - RNA, 20 nt, Human
aauaucacuugucaauaaaa

SEQ ID NO: 1464255 - RNA, 23 nt, Human
aauaucccuccuguugggagagg

SEQ ID NO: 1464256 - RNA, 12 nt, Human
aauaucccuccu

SEQ ID NO: 1464257 - RNA, 19 nt, Human
aauaucccuccuguuggga

SEQ ID NO: 1464258 - RNA, 22 nt, Human
aauaucccuccuguugggagag

SEQ ID NO: 1464259 - RNA, 14 nt, Human
aauauccuaaacau

SEQ ID NO: 1464260 - RNA, 18 nt, Human
aauauccuaaacaucauu

SEQ ID NO: 1464261 - RNA, 16 nt, Human
uaaccucuaaauucuu

SEQ ID NO: 1464262 - RNA, 15 nt, Human
aauauccuaaacauc

SEQ ID NO: 1464263 - RNA, 16 nt, Human
aauauccuaaacauca

SEQ ID NO: 1464264 - RNA, 17 nt, Human
aauauccuaaacaucau

SEQ ID NO: 1464265 - RNA, 14 nt, Human
uaacaugauuuggg

SEQ ID NO: 1464266 - RNA, 22 nt, Human
uaacauaccuaagaaguacauu

SEQ ID NO: 1464267 - RNA, 16 nt, Human
aauaucuccgucaacu

SEQ ID NO: 1464268 - RNA, 21 nt, Human
aauaucuccgucaacucauau

SEQ ID NO: 1464269 - RNA, 13 nt, Human
aauauccugcuug

SEQ ID NO: 1464270 - RNA, 17 nt, Human
aauaucuucacuuguca

SEQ ID NO: 1464271 - RNA, 22 nt, Human
uaagacccuuauugcuguccug

SEQ ID NO: 1464272 - RNA, 16 nt, Human
aauauuuuaaagaauu

SEQ ID NO: 1464273 - RNA, 19 nt, Human
aaucacuguuuagaacaca

SEQ ID NO: 1464274 - RNA, 21 nt, Human
aaucacuguuuagaacacaca

SEQ ID NO: 1464275 - RNA, 16 nt, Human
aaucacuuaggaaaug

SEQ ID NO: 1464276 - RNA, 17 nt, Human
aauauuguuuuacaaua

SEQ ID NO: 1464277 - RNA, 18 nt, Human
aauauuguuuuacaauag

SEQ ID NO: 1464278 - RNA, 15 nt, Human
aauauuucagauaau

SEQ ID NO: 1464279 - RNA, 12 nt, Human
aauauuucuuca

SEQ ID NO: 1464280 - RNA, 16 nt, Human
aauaugauguuaaaaa

SEQ ID NO: 1464281 - RNA, 14 nt, Human
aauaauuuuaucuc

SEQ ID NO: 1464282 - RNA, 11 nt, Human
aauaauuuuau

SEQ ID NO: 1464283 - RNA, 16 nt, Human
aauaauuuuaaacaaa

SEQ ID NO: 1464284 - RNA, 12 nt, Human
aauaauuuagac

SEQ ID NO: 1464285 - RNA, 21 nt, Human
aauaauuuagacuucaagcau

SEQ ID NO: 1464286 - RNA, 16 nt, Human
aauaauuuuuauauuu

SEQ ID NO: 1464287 - RNA, 17 nt, Human
aauaauuuuuauauuug

SEQ ID NO: 1464288 - RNA, 19 nt, Human
aauaauuuuuauauuugaa

SEQ ID NO: 1464289 - RNA, 13 nt, Human
aauaagaaacuuu

SEQ ID NO: 1464290 - RNA, 21 nt, Human
uaaauaaaguuuguugaaaca

SEQ ID NO: 1464291 - RNA, 12 nt, Human
uaaauaaaguuu

SEQ ID NO: 1464292 - RNA, 20 nt, Human
aauaauuuuuauauuugaaa

SEQ ID NO: 1464293 - RNA, 22 nt, Human
aauaauuuuucacuucaaaaca

SEQ ID NO: 1464294 - RNA, 11 nt, Human
uaaauaagaaa

SEQ ID NO: 1464295 - RNA, 13 nt, Human
uaaauaagaaacu

SEQ ID NO: 1464296 - RNA, 16 nt, Human
uaaauaagaaacuuuu

SEQ ID NO: 1464297 - RNA, 15 nt, Human
uaaauaagaaacuuu

SEQ ID NO: 1464298 - RNA, 24 nt, Human
uaaauguuuuuuuuuaaagacuuu

SEQ ID NO: 1464299 - RNA, 15 nt, Human
uaaauguugacaugg

SEQ ID NO: 1464300 - RNA, 23 nt, Human
uaaauguuaugacuauguaaacu

SEQ ID NO: 1464301 - RNA, 22 nt, Human
uaaauguuaugacuauguaaac

SEQ ID NO: 1464302 - RNA, 13 nt, Human
uaaaucuuuuaua

SEQ ID NO: 1464303 - RNA, 16 nt, Human
uaaaugcauaaaugca

SEQ ID NO: 1464304 - RNA, 14 nt, Human
uaaaugcauuauag

SEQ ID NO: 1464305 - RNA, 15 nt, Human
uaaauagacacgcac

SEQ ID NO: 1464306 - RNA, 17 nt, Human
uaaauagaccauuaauc

SEQ ID NO: 1464307 - RNA, 22 nt, Human
uaaaguaaaaacaaagaaauua

SEQ ID NO: 1464308 - RNA, 21 nt, Human
uaaaguaaaaacaaagaaauu

SEQ ID NO: 1464309 - RNA, 19 nt, Human
uaaaguaaaaacaaagaaa

SEQ ID NO: 1464310 - RNA, 22 nt, Human
uaaagguucaugcaaacuuuau

SEQ ID NO: 1464311 - RNA, 20 nt, Human
uaaaguaucaggauacuaua

SEQ ID NO: 1464312 - RNA, 22 nt, Human
uaaagguuacaagccugcacaa

SEQ ID NO: 1464313 - RNA, 13 nt, Human
aauaaaaccagcu

SEQ ID NO: 1464314 - RNA, 17 nt, Human
aauaaaaagaucacuuu

SEQ ID NO: 1464315 - RNA, 19 nt, Human
aauaaaaagaucacuuucu

SEQ ID NO: 1464316 - RNA, 23 nt, Human
aauaaaaagaucacuuucucagu

SEQ ID NO: 1464317 - RNA, 21 nt, Human
aauaacaaugaaaguugauaa

SEQ ID NO: 1464318 - RNA, 15 nt, Human
aauaacgauaaaaga

SEQ ID NO: 1464319 - RNA, 20 nt, Human
aauaaauuuauuuucuugga

SEQ ID NO: 1464320 - RNA, 13 nt, Human
aauaacaaugugc

SEQ ID NO: 1464321 - RNA, 19 nt, Human
aauaacaaugugcucucgg

SEQ ID NO: 1464322 - RNA, 12 nt, Human
aauaaagugacc

SEQ ID NO: 1464323 - RNA, 12 nt, Human
aauaaaguguau

SEQ ID NO: 1464324 - RNA, 13 nt, Human
acacccagcaaua

SEQ ID NO: 1464325 - RNA, 23 nt, Human
acacccagcaauagagacgggac

SEQ ID NO: 1464326 - RNA, 17 nt, Human
acaccccgacuuuuguu

SEQ ID NO: 1464327 - RNA, 13 nt, Human
acaccucccagga

SEQ ID NO: 1464328 - RNA, 19 nt, Human
acaccucccaggagacagu

SEQ ID NO: 1464329 - RNA, 22 nt, Human
acaccugcccugcccugccacc

SEQ ID NO: 1464330 - RNA, 20 nt, Human
acaccugcccugcccugcca

SEQ ID NO: 1464331 - RNA, 18 nt, Human
acaccugcccugcccugc

SEQ ID NO: 1464332 - RNA, 17 nt, Human
acaccugcccugcccug

SEQ ID NO: 1464333 - RNA, 15 nt, Human
acaccugcccugccc

SEQ ID NO: 1464334 - RNA, 12 nt, Human
acaccugcccug

SEQ ID NO: 1464335 - RNA, 14 nt, Human
acaccugcccugcc

SEQ ID NO: 1464336 - RNA, 13 nt, Human
acaccugcccugc

SEQ ID NO: 1464337 - RNA, 18 nt, Human
acacuaagagagaaugag

SEQ ID NO: 1464338 - RNA, 19 nt, Human
acacuaagagagaaugaga

SEQ ID NO: 1464339 - RNA, 15 nt, Human
acacuacacccagca

SEQ ID NO: 1464340 - RNA, 14 nt, Human
acacuacacccagc

SEQ ID NO: 1464341 - RNA, 13 nt, Human
acacuacacccag

SEQ ID NO: 1464342 - RNA, 17 nt, Human
acacuacacacugugua

SEQ ID NO: 1464343 - RNA, 17 nt, Human
acacuaagagagaauga

SEQ ID NO: 1464344 - RNA, 17 nt, Human
acacuacacccagcaau

SEQ ID NO: 1464345 - RNA, 23 nt, Human
acacuacacccagcaauagagac

SEQ ID NO: 1464346 - RNA, 16 nt, Human
acacuagacaagccag

SEQ ID NO: 1464347 - RNA, 17 nt, Human
acacuagcccaaugaaa

SEQ ID NO: 1464348 - RNA, 20 nt, Human
acacuagcccaaugaaauga

SEQ ID NO: 1464349 - RNA, 14 nt, Human
uauaagcuuuucuu

SEQ ID NO: 1464350 - RNA, 15 nt, Human
uauaaccuuaauuua

SEQ ID NO: 1464351 - RNA, 20 nt, Human
uauaaccuuaauuuauuauu

SEQ ID NO: 1464352 - RNA, 23 nt, Human
acacaugcuucccuuuccugagu

SEQ ID NO: 1464353 - RNA, 21 nt, Human
acacaugcuucccuuuccuga

SEQ ID NO: 1464354 - RNA, 19 nt, Human
acacaugcuucccuuuccu

SEQ ID NO: 1464355 - RNA, 16 nt, Human
acacauuaggaaaagu

SEQ ID NO: 1464356 - RNA, 15 nt, Human
acacauguauuuggu

SEQ ID NO: 1464357 - RNA, 22 nt, Human
acacauugaguuggaaucacug

SEQ ID NO: 1464358 - RNA, 15 nt, Human
acacccacacucaga

SEQ ID NO: 1464359 - RNA, 21 nt, Human
uauaaaaauaaaaaacacugg

SEQ ID NO: 1464360 - RNA, 20 nt, Human
uauaaaaauaaaaaacacug

SEQ ID NO: 1464361 - RNA, 22 nt, Human
uauaaaaauaaaaaagauccca

SEQ ID NO: 1464362 - RNA, 19 nt, Human
uauaaaaauaaaaaagauc

SEQ ID NO: 1464363 - RNA, 15 nt, Human
uaguuuuuauauguu

SEQ ID NO: 1464364 - RNA, 22 nt, Human
uagguuuggacaaaauggaaua

SEQ ID NO: 1464365 - RNA, 14 nt, Human
acacacugaagaag

SEQ ID NO: 1464366 - RNA, 19 nt, Human
uagucucacugcuugaacu

SEQ ID NO: 1464367 - RNA, 12 nt, Human
uaguguuggaga

SEQ ID NO: 1464368 - RNA, 16 nt, Human
uaguguuggagaagaa

SEQ ID NO: 1464369 - RNA, 17 nt, Human
uaguguuggagaagaac

SEQ ID NO: 1464370 - RNA, 13 nt, Human
acacacugaagaa

SEQ ID NO: 1464371 - RNA, 17 nt, Human
acacaacuauauuguuu

SEQ ID NO: 1464372 - RNA, 14 nt, Human
acaaugcuguauuu

SEQ ID NO: 1464373 - RNA, 17 nt, Human
acaaugcuguauuuuaa

SEQ ID NO: 1464374 - RNA, 18 nt, Human
acaaugcuguauuuuaaa

SEQ ID NO: 1464375 - RNA, 22 nt, Human
uagcuuaucuacuuccaaacua

SEQ ID NO: 1464376 - RNA, 15 nt, Human
uagcuuaucuacuuc

SEQ ID NO: 1464377 - RNA, 19 nt, Human
uagcuuaucuacuuccaaa

SEQ ID NO: 1464378 - RNA, 12 nt, Human
acacugaagaag

SEQ ID NO: 1464379 - RNA, 14 nt, Human
acacugaagaagca

SEQ ID NO: 1464380 - RNA, 13 nt, Human
acacucuguaauu

SEQ ID NO: 1464381 - RNA, 20 nt, Human
acacucucaaagcaaauaau

SEQ ID NO: 1464382 - RNA, 16 nt, Human
uauaaguagcaggcca

SEQ ID NO: 1464383 - RNA, 19 nt, Human
acacucagauccuccucau

SEQ ID NO: 1464384 - RNA, 12 nt, Human
uauauuuacaaa

SEQ ID NO: 1464385 - RNA, 15 nt, Human
uauauuuaacaagau

SEQ ID NO: 1464386 - RNA, 19 nt, Human
uauauuuaacucucuuuau

SEQ ID NO: 1464387 - RNA, 13 nt, Human
uauauuaucuuuu

SEQ ID NO: 1464388 - RNA, 22 nt, Human
acacuuuaauuaccaaccuguu

SEQ ID NO: 1464389 - RNA, 12 nt, Human
acagaaacaaaa

SEQ ID NO: 1464390 - RNA, 17 nt, Human
acagaaacaaaaacacu

SEQ ID NO: 1464391 - RNA, 20 nt, Human
acagcccuucuuuccacaga

SEQ ID NO: 1464392 - RNA, 21 nt, Human
acagcccuucuuuccacagaa

SEQ ID NO: 1464393 - RNA, 17 nt, Human
acagcaacaauuuauga

SEQ ID NO: 1464394 - RNA, 20 nt, Human
acagcaacaauuuaugaauu

SEQ ID NO: 1464395 - RNA, 23 nt, Human
uaucuuggugaauuuuuuuuucc

SEQ ID NO: 1464396 - RNA, 16 nt, Human
acagcccuuuugucuc

SEQ ID NO: 1464397 - RNA, 15 nt, Human
acagcccuuuugucu

SEQ ID NO: 1464398 - RNA, 23 nt, Human
acagagcuggagaugaggccaga

SEQ ID NO: 1464399 - RNA, 16 nt, Human
uaucucugugugcaca

SEQ ID NO: 1464400 - RNA, 17 nt, Human
uaucucugugugcacaa

SEQ ID NO: 1464401 - RNA, 18 nt, Human
uaucucugugugcacaaa

SEQ ID NO: 1464402 - RNA, 23 nt, Human
uaucucugugugcacaaauauuu

SEQ ID NO: 1464403 - RNA, 15 nt, Human
uauauuuauuacugu

SEQ ID NO: 1464404 - RNA, 19 nt, Human
uauauuuauuacuguaaga

SEQ ID NO: 1464405 - RNA, 20 nt, Human
uauauuuauuacuguaagaa

SEQ ID NO: 1464406 - RNA, 14 nt, Human
uaucccuccuguug

SEQ ID NO: 1464407 - RNA, 20 nt, Human
uaucccuccuguugggagag

SEQ ID NO: 1464408 - RNA, 19 nt, Human
uaucccuccuguugggaga

SEQ ID NO: 1464409 - RNA, 12 nt, Human
uaucucacacuc

SEQ ID NO: 1464410 - RNA, 16 nt, Human
uauccuaucucuccaa

SEQ ID NO: 1464411 - RNA, 19 nt, Human
uacugaaauaaacgucuua

SEQ ID NO: 1464412 - RNA, 22 nt, Human
uacugaaauaaacgucuuaaau

SEQ ID NO: 1464413 - RNA, 23 nt, Human
uacugguccaaaagauugcugaa

SEQ ID NO: 1464414 - RNA, 18 nt, Human
uacuggucuuguggaauu

SEQ ID NO: 1464415 - RNA, 13 nt, Human
uacugguccaaaa

SEQ ID NO: 1464416 - RNA, 18 nt, Human
uacugguccaaaagauug

SEQ ID NO: 1464417 - RNA, 23 nt, Human
uacuguacagacagaaaaaacug

SEQ ID NO: 1464418 - RNA, 19 nt, Human
uacuguacagacagaaaaa

SEQ ID NO: 1464419 - RNA, 18 nt, Human
aauugaggacacugauau

SEQ ID NO: 1464420 - RNA, 15 nt, Human
aauugagaaggaaaa

SEQ ID NO: 1464421 - RNA, 23 nt, Human
aauugagaaaaauauauacuaaa

SEQ ID NO: 1464422 - RNA, 19 nt, Human
aauugagaaaaauauauac

SEQ ID NO: 1464423 - RNA, 13 nt, Human
aauugauuuugaa

SEQ ID NO: 1464424 - RNA, 14 nt, Human
aauugauuuugaac

SEQ ID NO: 1464425 - RNA, 22 nt, Human
aauugcacgcggagugaguuuu

SEQ ID NO: 1464426 - RNA, 18 nt, Human
uacuagggaaaugccuuu

SEQ ID NO: 1464427 - RNA, 12 nt, Human
uacuauuuaacu

SEQ ID NO: 1464428 - RNA, 13 nt, Human
uacuauuuaacug

SEQ ID NO: 1464429 - RNA, 14 nt, Human
uacuauuuaacuga

SEQ ID NO: 1464430 - RNA, 19 nt, Human
uacuauuuaacugacuauu

SEQ ID NO: 1464431 - RNA, 16 nt, Human
uacuauuuaacugacu

SEQ ID NO: 1464432 - RNA, 13 nt, Human
uacuauuucacaa

SEQ ID NO: 1464433 - RNA, 12 nt, Human
uacuauuucaca

SEQ ID NO: 1464434 - RNA, 14 nt, Human
aauugaauauuauu

SEQ ID NO: 1464435 - RNA, 15 nt, Human
aauugaaucacugcu

SEQ ID NO: 1464436 - RNA, 22 nt, Human
aauugaaucacugcucacacug

SEQ ID NO: 1464437 - RNA, 15 nt, Human
aauugaauauuauuc

SEQ ID NO: 1464438 - RNA, 18 nt, Human
aauugaaugcaaaccaua

SEQ ID NO: 1464439 - RNA, 14 nt, Human
aaugugggauuaug

SEQ ID NO: 1464440 - RNA, 16 nt, Human
aaugugguagccucac

SEQ ID NO: 1464441 - RNA, 21 nt, Human
aauguguaagaacaacuaccu

SEQ ID NO: 1464442 - RNA, 13 nt, Human
aauguguaagaac

SEQ ID NO: 1464443 - RNA, 22 nt, Human
aauguguauuacaaauauuuug

SEQ ID NO: 1464444 - RNA, 22 nt, Human
aauuuauaaacuuuuuucuuac

SEQ ID NO: 1464445 - RNA, 12 nt, Human
aauuuaguuuca

SEQ ID NO: 1464446 - RNA, 14 nt, Human
aauuuaguuucaua

SEQ ID NO: 1464447 - RNA, 22 nt, Human
aauuuaguuucauauaaaguau

SEQ ID NO: 1464448 - RNA, 21 nt, Human
aauuuaguuucauauaaagua

SEQ ID NO: 1464449 - RNA, 16 nt, Human
aauuuauaaaaaggug

SEQ ID NO: 1464450 - RNA, 22 nt, Human
aauuuauaaaaagguguuuuga

SEQ ID NO: 1464451 - RNA, 16 nt, Human
aauuuauauuguaaau

SEQ ID NO: 1464452 - RNA, 23 nt, Human
aauuucuaggacugaauuaugaa

SEQ ID NO: 1464453 - RNA, 18 nt, Human
aauuucuaggacugaauu

SEQ ID NO: 1464454 - RNA, 22 nt, Human
aauuucuaggacugaauuauga

SEQ ID NO: 1464455 - RNA, 17 nt, Human
aauuucuaggacugaau

SEQ ID NO: 1464456 - RNA, 11 nt, Human
aauuuaaaugu

SEQ ID NO: 1464457 - RNA, 13 nt, Human
aauuuaaauguua

SEQ ID NO: 1464458 - RNA, 15 nt, Human
aauuggagcucgugg

SEQ ID NO: 1464459 - RNA, 20 nt, Human
aauuggaagcugcccugccc

SEQ ID NO: 1464460 - RNA, 22 nt, Human
aauugcuuuaccuuuuuucuua

SEQ ID NO: 1464461 - RNA, 13 nt, Human
aauuuaguauuuu

SEQ ID NO: 1464462 - RNA, 15 nt, Human
uacuugaaaauuaac

SEQ ID NO: 1464463 - RNA, 22 nt, Human
uacuucuuuuuucaaaagaaag

SEQ ID NO: 1464464 - RNA, 20 nt, Human
uacuucuuuuuucaaaagaa

SEQ ID NO: 1464465 - RNA, 15 nt, Human
uacuuugugcauucu

SEQ ID NO: 1464466 - RNA, 14 nt, Human
uacuuugacuuuuu

SEQ ID NO: 1464467 - RNA, 19 nt, Human
uacuucuuaggguuaugau

SEQ ID NO: 1464468 - RNA, 22 nt, Human
uacuucguguccgacucuucug

SEQ ID NO: 1464469 - RNA, 20 nt, Human
uacuucucauuuuuuaaaaa

SEQ ID NO: 1464470 - RNA, 15 nt, Human
aauuugaaacacuuu

SEQ ID NO: 1464471 - RNA, 16 nt, Human
uacuuauauggaaauu

SEQ ID NO: 1464472 - RNA, 17 nt, Human
uacuuauuuuugacagu

SEQ ID NO: 1464473 - RNA, 19 nt, Human
uacuuauuuuugacagugu

SEQ ID NO: 1464474 - RNA, 14 nt, Human
uacuuccaaacuaa

SEQ ID NO: 1464475 - RNA, 14 nt, Human
uacuuuuaaacugu

SEQ ID NO: 1464476 - RNA, 15 nt, Human
uacuuuuaaacugug

SEQ ID NO: 1464477 - RNA, 21 nt, Human
uacuuuuaaacagugagccug

SEQ ID NO: 1464478 - RNA, 13 nt, Human
aauuugguuuuca

SEQ ID NO: 1464479 - RNA, 18 nt, Human
aauuugggggacuuacau

SEQ ID NO: 1464480 - RNA, 21 nt, Human
aauuugggggacuuacaugau

SEQ ID NO: 1464481 - RNA, 16 nt, Human
aauuugccuguaacaa

SEQ ID NO: 1464482 - RNA, 22 nt, Human
aauuugccuguaacaagccaga

SEQ ID NO: 1464483 - RNA, 15 nt, Human
aauuugguuuucaca

SEQ ID NO: 1464484 - RNA, 21 nt, Human
aauuugguuuucacauuggaa

SEQ ID NO: 1464485 - RNA, 22 nt, Human
aauuuuuaaucuuuaauuuuac

SEQ ID NO: 1464486 - RNA, 13 nt, Human
aauuuuuaaacaa

SEQ ID NO: 1464487 - RNA, 15 nt, Human
aauuuuuaaacaagu

SEQ ID NO: 1464488 - RNA, 19 nt, Human
aauuuuuaaacaaguauuu

SEQ ID NO: 1464489 - RNA, 13 nt, Human
aauuuuugauacu

SEQ ID NO: 1464490 - RNA, 16 nt, Human
aauuuuuuuuacauuu

SEQ ID NO: 1464491 - RNA, 12 nt, Human
aauuuuuuuuac

SEQ ID NO: 1464492 - RNA, 15 nt, Human
aauuuuuuuuaacau

SEQ ID NO: 1464493 - RNA, 17 nt, Human
aauuuuuuuuaacauuc

SEQ ID NO: 1464494 - RNA, 18 nt, Human
aauuuuuuuuaacauucc

SEQ ID NO: 1464495 - RNA, 19 nt, Human
aauuuuuuuuaacauuccu

SEQ ID NO: 1464496 - RNA, 18 nt, Human
aauuuuuuuguauuuuag

SEQ ID NO: 1464497 - RNA, 14 nt, Human
aauuuuuuuuaaca

SEQ ID NO: 1464498 - RNA, 22 nt, Human
uagauaggucagugcaaauacu

SEQ ID NO: 1464499 - RNA, 17 nt, Human
uagauaggccaugggca

SEQ ID NO: 1464500 - RNA, 12 nt, Human
acaaauauuuau

SEQ ID NO: 1464501 - RNA, 18 nt, Human
acaaauauuuauuuucuu

SEQ ID NO: 1464502 - RNA, 22 nt, Human
acaaauauuuauuuucuuucug

SEQ ID NO: 1464503 - RNA, 23 nt, Human
acaaauauuuauuuucuuucugu

SEQ ID NO: 1464504 - RNA, 16 nt, Human
uagaucuggcauguua

SEQ ID NO: 1464505 - RNA, 15 nt, Human
uagaucuggcauguu

SEQ ID NO: 1464506 - RNA, 21 nt, Human
uagaugcaguucugaagaaga

SEQ ID NO: 1464507 - RNA, 15 nt, Human
uagaugcauuugggu

SEQ ID NO: 1464508 - RNA, 19 nt, Human
uagaugcauuuggguccag

SEQ ID NO: 1464509 - RNA, 20 nt, Human
uagaugcauuuggguccagg

SEQ ID NO: 1464510 - RNA, 21 nt, Human
uagaugcauuuggguccagga

SEQ ID NO: 1464511 - RNA, 23 nt, Human
uagaugcauuuggguccaggagg

SEQ ID NO: 1464512 - RNA, 22 nt, Human
uagaugcauuuggguccaggag

SEQ ID NO: 1464513 - RNA, 22 nt, Human
uagaugcucuaugugcuuguaa

SEQ ID NO: 1464514 - RNA, 17 nt, Human
uagcaaagauaucucau

SEQ ID NO: 1464515 - RNA, 19 nt, Human
uagcaaagauaucucaucu

SEQ ID NO: 1464516 - RNA, 19 nt, Human
acaaaguuuaccagaaagc

SEQ ID NO: 1464517 - RNA, 15 nt, Human
acaaagcccuuuuau

SEQ ID NO: 1464518 - RNA, 16 nt, Human
acaaagcccuuuuaua

SEQ ID NO: 1464519 - RNA, 14 nt, Human
acaaaacugcauuu

SEQ ID NO: 1464520 - RNA, 16 nt, Human
acaaaacugcauuuca

SEQ ID NO: 1464521 - RNA, 19 nt, Human
aauuuuuuuuuccuagccc

SEQ ID NO: 1464522 - RNA, 16 nt, Human
acaaaacuagagacuc

SEQ ID NO: 1464523 - RNA, 16 nt, Human
uagcuacuaauuuuaa

SEQ ID NO: 1464524 - RNA, 16 nt, Human
uagccuucucuguuca

SEQ ID NO: 1464525 - RNA, 20 nt, Human
uagccuucucuguucauuuc

SEQ ID NO: 1464526 - RNA, 22 nt, Human
uagccuucucuguucauuuccu

SEQ ID NO: 1464527 - RNA, 13 nt, Human
uagccuucucugu

SEQ ID NO: 1464528 - RNA, 14 nt, Human
uagccuucucuguu

SEQ ID NO: 1464529 - RNA, 15 nt, Human
uagccuucucuguuc

SEQ ID NO: 1464530 - RNA, 17 nt, Human
acaaguuauuuaaaucu

SEQ ID NO: 1464531 - RNA, 16 nt, Human
acaaguuauuuaaauc

SEQ ID NO: 1464532 - RNA, 22 nt, Human
acaaguuauuuaaaucuguuuu

SEQ ID NO: 1464533 - RNA, 14 nt, Human
acaauaaaaauguu

SEQ ID NO: 1464534 - RNA, 16 nt, Human
acaauaaaaauguuua

SEQ ID NO: 1464535 - RNA, 21 nt, Human
acaaauucugucucuggauua

SEQ ID NO: 1464536 - RNA, 22 nt, Human
uagcaacuacagucuaaagcug

SEQ ID NO: 1464537 - RNA, 21 nt, Human
uagcaacuacagucuaaagcu

SEQ ID NO: 1464538 - RNA, 14 nt, Human
acaacagcugccug

SEQ ID NO: 1464539 - RNA, 16 nt, Human
acaacagguaaaacag

SEQ ID NO: 1464540 - RNA, 23 nt, Human
acaacaguuacauaauucacucu

SEQ ID NO: 1464541 - RNA, 14 nt, Human
acaaauggccuuua

SEQ ID NO: 1464542 - RNA, 17 nt, Human
guuguaauauuucuuca

SEQ ID NO: 1464543 - RNA, 13 nt, Human
guuuaauguuuug

SEQ ID NO: 1464544 - RNA, 17 nt, Human
guuuaagccaaaacaau

SEQ ID NO: 1464545 - RNA, 20 nt, Human
guuuaagccaaaacaauguu

SEQ ID NO: 1464546 - RNA, 20 nt, Human
guuuucuuaaccagaucauu

SEQ ID NO: 1464547 - RNA, 20 nt, Human
guuuuacaauaguucugugg

SEQ ID NO: 1464548 - RNA, 16 nt, Human
guuuuacaauaguucu

SEQ ID NO: 1464549 - RNA, 13 nt, Human
guuuuacaauagu

SEQ ID NO: 1464550 - RNA, 11 nt, Human
guuuuacaaua

SEQ ID NO: 1464551 - RNA, 20 nt, Human
aaguaauaaaauucaacaaa

SEQ ID NO: 1464552 - RNA, 13 nt, Human
guuuggcuuucag

SEQ ID NO: 1464553 - RNA, 18 nt, Human
guuuggcuuucagggagg

SEQ ID NO: 1464554 - RNA, 17 nt, Human
guuugcaccuuucuagu

SEQ ID NO: 1464555 - RNA, 21 nt, Human
guuucaaacauauauaacaau

SEQ ID NO: 1464556 - RNA, 17 nt, Human
aaggcuuguugugcuuu

SEQ ID NO: 1464557 - RNA, 19 nt, Human
aaggcuuguugugcuuuua

SEQ ID NO: 1464558 - RNA, 20 nt, Human
aaggcuuguugugcuuuuag

SEQ ID NO: 1464559 - RNA, 14 nt, Human
aaggcuuucucuac

SEQ ID NO: 1464560 - RNA, 21 nt, Human
aaggcuuugcccugcugcccu

SEQ ID NO: 1464561 - RNA, 22 nt, Human
aaggcuuugcccugcugcccuc

SEQ ID NO: 1464562 - RNA, 17 nt, Human
aaggggaauugaggaca

SEQ ID NO: 1464563 - RNA, 20 nt, Human
aaguaaaaacaaagaaauua

SEQ ID NO: 1464564 - RNA, 13 nt, Human
aaguaaaaacaaa

SEQ ID NO: 1464565 - RNA, 22 nt, Human
aaguaaaaacaaagaaauuaug

SEQ ID NO: 1464566 - RNA, 14 nt, Human
aaguaauaaaauuc

SEQ ID NO: 1464567 - RNA, 13 nt, Human
aagguacuucaaa

SEQ ID NO: 1464568 - RNA, 18 nt, Human
aagguaaaaugccaugau

SEQ ID NO: 1464569 - RNA, 18 nt, Human
aagguacaagaagcauuu

SEQ ID NO: 1464570 - RNA, 19 nt, Human
aagguacaagaagcauuuu

SEQ ID NO: 1464571 - RNA, 20 nt, Human
aagguuuuccucuucuauuu

SEQ ID NO: 1464572 - RNA, 14 nt, Human
aagguaaaaugcca

SEQ ID NO: 1464573 - RNA, 22 nt, Human
aagguaaaaugccaugaugccu

SEQ ID NO: 1464574 - RNA, 19 nt, Human
aagccuccuuagaaaaaaa

SEQ ID NO: 1464575 - RNA, 16 nt, Human
guuauuuguaauagau

SEQ ID NO: 1464576 - RNA, 17 nt, Human
guuauuuguaauagaug

SEQ ID NO: 1464577 - RNA, 11 nt, Human
guuauuuaaau

SEQ ID NO: 1464578 - RNA, 17 nt, Human
guuagccaauauuuuuc

SEQ ID NO: 1464579 - RNA, 13 nt, Human
guguuugcuuucu

SEQ ID NO: 1464580 - RNA, 18 nt, Human
guguuuuaaaaugagaaa

SEQ ID NO: 1464581 - RNA, 14 nt, Human
guguuuggcuuuca

SEQ ID NO: 1464582 - RNA, 14 nt, Human
guugacaugggaca

SEQ ID NO: 1464583 - RNA, 18 nt, Human
guugacaugggacauuug

SEQ ID NO: 1464584 - RNA, 16 nt, Human
guucuuacugcuuaau

SEQ ID NO: 1464585 - RNA, 23 nt, Human
guucuuuaaaauguaaagccaug

SEQ ID NO: 1464586 - RNA, 23 nt, Human
guucugguaugaacuugaggaca

SEQ ID NO: 1464587 - RNA, 22 nt, Human
guucuuaccuguaugucuccag

SEQ ID NO: 1464588 - RNA, 17 nt, Human
aagcuaucguaaaauua

SEQ ID NO: 1464589 - RNA, 18 nt, Human
aagcuucaaacugcauga

SEQ ID NO: 1464590 - RNA, 19 nt, Human
aagcuucagugcugccgau

SEQ ID NO: 1464591 - RNA, 17 nt, Human
guuccccuuugcuucau

SEQ ID NO: 1464592 - RNA, 16 nt, Human
guucccauuucagcug

SEQ ID NO: 1464593 - RNA, 15 nt, Human
gugugucugcucagu

SEQ ID NO: 1464594 - RNA, 16 nt, Human
gugugucugcucagua

SEQ ID NO: 1464595 - RNA, 15 nt, Human
gugugucuguucacu

SEQ ID NO: 1464596 - RNA, 22 nt, Human
gugugucuguucacuuuuccuc

SEQ ID NO: 1464597 - RNA, 14 nt, Human
aagagguuuuaaag

SEQ ID NO: 1464598 - RNA, 18 nt, Human
aagagguuuuaaagcuuc

SEQ ID NO: 1464599 - RNA, 17 nt, Human
aagagguguuuuuucua

SEQ ID NO: 1464600 - RNA, 19 nt, Human
aagauaugggacauuuuug

SEQ ID NO: 1464601 - RNA, 16 nt, Human
aagauaugggacauuu

SEQ ID NO: 1464602 - RNA, 11 nt, Human
aagaucuuuua

SEQ ID NO: 1464603 - RNA, 15 nt, Human
aagaucuuuuauuuu

SEQ ID NO: 1464604 - RNA, 17 nt, Human
aagaucuuuuauuuugc

SEQ ID NO: 1464605 - RNA, 18 nt, Human
aagaucuuuuauuuugcc

SEQ ID NO: 1464606 - RNA, 18 nt, Human
aagcaaccucaguaauuu

SEQ ID NO: 1464607 - RNA, 19 nt, Human
aagcaaccucaguaauuua

SEQ ID NO: 1464608 - RNA, 20 nt, Human
aagcaaccucaguaauuuag

SEQ ID NO: 1464609 - RNA, 21 nt, Human
aagcaaccucaguaauuuaga

SEQ ID NO: 1464610 - RNA, 22 nt, Human
aagcaaccucaguaauuuagaa

SEQ ID NO: 1464611 - RNA, 17 nt, Human
gugggaggugagaccac

SEQ ID NO: 1464612 - RNA, 15 nt, Human
gugggaggguaccag

SEQ ID NO: 1464613 - RNA, 16 nt, Human
gugggaggguaccagc

SEQ ID NO: 1464614 - RNA, 20 nt, Human
gugggaggguaccagcagaa

SEQ ID NO: 1464615 - RNA, 19 nt, Human
guggcgugaucucagcuca

SEQ ID NO: 1464616 - RNA, 21 nt, Human
gugggacagucaccucaugga

SEQ ID NO: 1464617 - RNA, 19 nt, Human
guggcgcgaucucagcuca

SEQ ID NO: 1464618 - RNA, 14 nt, Human
guggguagacacac

SEQ ID NO: 1464619 - RNA, 14 nt, Human
gugguggcucggga

SEQ ID NO: 1464620 - RNA, 15 nt, Human
gugguggucccuggg

SEQ ID NO: 1464621 - RNA, 16 nt, Human
gugguggucccugggu

SEQ ID NO: 1464622 - RNA, 23 nt, Human
guggggggggggcgcggcuggga

SEQ ID NO: 1464623 - RNA, 14 nt, Human
aagaggaagcaaau

SEQ ID NO: 1464624 - RNA, 13 nt, Human
aagaggaagcaaa

SEQ ID NO: 1464625 - RNA, 14 nt, Human
aagagcuacauaau

SEQ ID NO: 1464626 - RNA, 14 nt, Human
aagagcuuaagaac

SEQ ID NO: 1464627 - RNA, 16 nt, Human
aagagcuacauaauuu

SEQ ID NO: 1464628 - RNA, 15 nt, Human
aagagcaaaagaaug

SEQ ID NO: 1464629 - RNA, 17 nt, Human
aagagauuuuucaugau

SEQ ID NO: 1464630 - RNA, 15 nt, Human
aagagauuuuucaug

SEQ ID NO: 1464631 - RNA, 14 nt, Human
aagagauuuuucau

SEQ ID NO: 1464632 - RNA, 13 nt, Human
aagagauuuuuca

SEQ ID NO: 1464633 - RNA, 20 nt, Human
aagagcaaaagaauggcaga

SEQ ID NO: 1464634 - RNA, 22 nt, Human
aagacuaucuuacuauuucaca

SEQ ID NO: 1464635 - RNA, 18 nt, Human
gugcuaguaauuggaaag

SEQ ID NO: 1464636 - RNA, 12 nt, Human
aagaauacuucu

SEQ ID NO: 1464637 - RNA, 16 nt, Human
aagaauacuucucauu

SEQ ID NO: 1464638 - RNA, 17 nt, Human
aagaauacuucucauuu

SEQ ID NO: 1464639 - RNA, 22 nt, Human
aagaauacuucucauuuuuuaa

SEQ ID NO: 1464640 - RNA, 15 nt, Human
aagaaggcaaaaaua

SEQ ID NO: 1464641 - RNA, 19 nt, Human
aagaaggcaaaaauaguuu

SEQ ID NO: 1464642 - RNA, 13 nt, Human
aagaaauauaccu

SEQ ID NO: 1464643 - RNA, 15 nt, Human
aagaaauagaacaag

SEQ ID NO: 1464644 - RNA, 20 nt, Human
aagaaauagaacaaggcuga

SEQ ID NO: 1464645 - RNA, 14 nt, Human
aagaaauagaacaa

SEQ ID NO: 1464646 - RNA, 16 nt, Human
aagaaagaacggaaga

SEQ ID NO: 1464647 - RNA, 14 nt, Human
aagaaacuuuuuua

SEQ ID NO: 1464648 - RNA, 14 nt, Human
aagaaagaacggaa

SEQ ID NO: 1464649 - RNA, 23 nt, Human
aagaaacuuucuuucucacuaaa

SEQ ID NO: 1464650 - RNA, 17 nt, Human
aagaaacuuguccuucc

SEQ ID NO: 1464651 - RNA, 11 nt, Human
aagaaacuuuc

SEQ ID NO: 1464652 - RNA, 21 nt, Human
aagaaacuggggcuccuccag

SEQ ID NO: 1464653 - RNA, 21 nt, Human
aagaaacugaggaauuuucuu

SEQ ID NO: 1464654 - RNA, 16 nt, Human
aagaaacugaggaauu

SEQ ID NO: 1464655 - RNA, 19 nt, Human
aagaaacugaggaauuuuc

SEQ ID NO: 1464656 - RNA, 20 nt, Human
aagaaacugaggaauuuucu

SEQ ID NO: 1464657 - RNA, 15 nt, Human
aagaaaccuacugcc

SEQ ID NO: 1464658 - RNA, 16 nt, Human
aagaaaccuacugccc

SEQ ID NO: 1464659 - RNA, 21 nt, Human
aagaaaccuacugcccaggca

SEQ ID NO: 1464660 - RNA, 15 nt, Human
aagaaaaagaagcaa

SEQ ID NO: 1464661 - RNA, 16 nt, Human
aacuuguauuaugugu

SEQ ID NO: 1464662 - RNA, 15 nt, Human
aacuuguauuaugug

SEQ ID NO: 1464663 - RNA, 18 nt, Human
aacuuggcugcaggaauc

SEQ ID NO: 1464664 - RNA, 19 nt, Human
aacuuggcugcaggaaucu

SEQ ID NO: 1464665 - RNA, 19 nt, Human
aacuuuaaagcguuugcac

SEQ ID NO: 1464666 - RNA, 16 nt, Human
gugcucaggagcccug

SEQ ID NO: 1464667 - RNA, 15 nt, Human
gugcucaggagcccu

SEQ ID NO: 1464668 - RNA, 14 nt, Human
gugcuauggugcuc

SEQ ID NO: 1464669 - RNA, 16 nt, Human
gugcuauggugcucug

SEQ ID NO: 1464670 - RNA, 20 nt, Human
gugcugggauuacaggugua

SEQ ID NO: 1464671 - RNA, 16 nt, Human
aagaaugauuaugaau

SEQ ID NO: 1464672 - RNA, 12 nt, Human
aagaaucucauc

SEQ ID NO: 1464673 - RNA, 20 nt, Human
aagaaucucaucucagugaa

SEQ ID NO: 1464674 - RNA, 20 nt, Human
aagaaucuugguuugccuuc

SEQ ID NO: 1464675 - RNA, 21 nt, Human
aagaaucuugguuugccuucc

SEQ ID NO: 1464676 - RNA, 14 nt, Human
guggcacuggggca

SEQ ID NO: 1464677 - RNA, 20 nt, Human
aagacaaaaagcuacuuauu

SEQ ID NO: 1464678 - RNA, 23 nt, Human
aagacaaaaagcuacuuauugua

SEQ ID NO: 1464679 - RNA, 17 nt, Human
aagacaaagguuuuccu

SEQ ID NO: 1464680 - RNA, 13 nt, Human
aagacccuccccg

SEQ ID NO: 1464681 - RNA, 18 nt, Human
aagaaugauuaugaauua

SEQ ID NO: 1464682 - RNA, 13 nt, Human
aagaaugcuuaau

SEQ ID NO: 1464683 - RNA, 17 nt, Human
aagaaugcuuaaucaga

SEQ ID NO: 1464684 - RNA, 20 nt, Human
aagaauggcagaaaaguuua

SEQ ID NO: 1464685 - RNA, 17 nt, Human
aagaauggcagaaaagu

SEQ ID NO: 1464686 - RNA, 13 nt, Human
guaggcaggauug

SEQ ID NO: 1464687 - RNA, 18 nt, Human
guaggcaggauuggggaa

SEQ ID NO: 1464688 - RNA, 19 nt, Human
guaggagacuguuuggaaa

SEQ ID NO: 1464689 - RNA, 20 nt, Human
guaggagacuguuuggaaau

SEQ ID NO: 1464690 - RNA, 16 nt, Human
guaggaaagaggaagc

SEQ ID NO: 1464691 - RNA, 12 nt, Human
guagcuuugcuc

SEQ ID NO: 1464692 - RNA, 13 nt, Human
guaggaaaugugg

SEQ ID NO: 1464693 - RNA, 13 nt, Human
aaaggacuguaau

SEQ ID NO: 1464694 - RNA, 17 nt, Human
guagcugggacuacagg

SEQ ID NO: 1464695 - RNA, 14 nt, Human
aaauccuugaagau

SEQ ID NO: 1464696 - RNA, 19 nt, Human
aaauccuuagaucuggcau

SEQ ID NO: 1464697 - RNA, 13 nt, Human
aaaucgaaugaaa

SEQ ID NO: 1464698 - RNA, 20 nt, Human
aaaucgaaugaaauuaacug

SEQ ID NO: 1464699 - RNA, 21 nt, Human
aaauccuuagaucuggcaugu

SEQ ID NO: 1464700 - RNA, 13 nt, Human
aaaucuaccacug

SEQ ID NO: 1464701 - RNA, 17 nt, Human
aaaucuaccacuguaug

SEQ ID NO: 1464702 - RNA, 11 nt, Human
aaaugagaaau

SEQ ID NO: 1464703 - RNA, 11 nt, Human
aaaugaagaaa

SEQ ID NO: 1464704 - RNA, 16 nt, Human
aaaugagaaaucuaaa

SEQ ID NO: 1464705 - RNA, 14 nt, Human
aaaugagaaaucua

SEQ ID NO: 1464706 - RNA, 13 nt, Human
aaaugagaaaucu

SEQ ID NO: 1464707 - RNA, 13 nt, Human
aaaugcauguugc

SEQ ID NO: 1464708 - RNA, 20 nt, Human
aaaugcauuauaggaucauu

SEQ ID NO: 1464709 - RNA, 15 nt, Human
aaaugcauaaaugca

SEQ ID NO: 1464710 - RNA, 13 nt, Human
aaaugaucuaaac

SEQ ID NO: 1464711 - RNA, 17 nt, Human
aaaugauuacuaaggaa

SEQ ID NO: 1464712 - RNA, 14 nt, Human
aaaugauuguagua

SEQ ID NO: 1464713 - RNA, 19 nt, Human
aaauggcuuccuggcaaua

SEQ ID NO: 1464714 - RNA, 22 nt, Human
aaaugccaugaugccucugucu

SEQ ID NO: 1464715 - RNA, 14 nt, Human
aaaugcauuucuaa

SEQ ID NO: 1464716 - RNA, 21 nt, Human
guauggguuagggaaaacauu

SEQ ID NO: 1464717 - RNA, 19 nt, Human
guauguguaucucacacuc

SEQ ID NO: 1464718 - RNA, 14 nt, Human
guaugauucccagc

SEQ ID NO: 1464719 - RNA, 13 nt, Human
guauggaaauaaa

SEQ ID NO: 1464720 - RNA, 22 nt, Human
guauauugauccagaaagaaaa

SEQ ID NO: 1464721 - RNA, 18 nt, Human
guauauuacaaugaucac

SEQ ID NO: 1464722 - RNA, 15 nt, Human
guauauuacaaugau

SEQ ID NO: 1464723 - RNA, 17 nt, Human
guauauuacaaugauca

SEQ ID NO: 1464724 - RNA, 18 nt, Human
guauaaaagggacugaga

SEQ ID NO: 1464725 - RNA, 21 nt, Human
guauaaaagccuguuuaagag

SEQ ID NO: 1464726 - RNA, 18 nt, Human
guauaaaagccuguuuaa

SEQ ID NO: 1464727 - RNA, 17 nt, Human
guauaaaagccuguuua

SEQ ID NO: 1464728 - RNA, 16 nt, Human
guauuuaauucauguu

SEQ ID NO: 1464729 - RNA, 20 nt, Human
guauuuaauagguuuggaca

SEQ ID NO: 1464730 - RNA, 22 nt, Human
aaauguuaugacuauguaaacu

SEQ ID NO: 1464731 - RNA, 19 nt, Human
aaauucccuucaucuggaa

SEQ ID NO: 1464732 - RNA, 16 nt, Human
aaauucccuucaucug

SEQ ID NO: 1464733 - RNA, 15 nt, Human
aaauuauaucaauuu

SEQ ID NO: 1464734 - RNA, 18 nt, Human
aaauuucagcagcugcag

SEQ ID NO: 1464735 - RNA, 17 nt, Human
aaauuucagcagcugca

SEQ ID NO: 1464736 - RNA, 18 nt, Human
aaauucccuucaucugga

SEQ ID NO: 1464737 - RNA, 20 nt, Human
aaauuuaguauuuuguuuca

SEQ ID NO: 1464738 - RNA, 17 nt, Human
aaauuuacaucauuucu

SEQ ID NO: 1464739 - RNA, 22 nt, Human
aaauuuccugggagcuuuugua

SEQ ID NO: 1464740 - RNA, 16 nt, Human
aaauuuauauuguaaa

SEQ ID NO: 1464741 - RNA, 12 nt, Human
aaauuucagauu

SEQ ID NO: 1464742 - RNA, 16 nt, Human
gucaaauugugugaaa

SEQ ID NO: 1464743 - RNA, 14 nt, Human
gucaacaguuuucc

SEQ ID NO: 1464744 - RNA, 21 nt, Human
gucaacaguuuuccuaugcuu

SEQ ID NO: 1464745 - RNA, 22 nt, Human
gucaacaguuuuccuaugcuuu

SEQ ID NO: 1464746 - RNA, 19 nt, Human
gucaacucauauuuucaug

SEQ ID NO: 1464747 - RNA, 23 nt, Human
gucaaaaauuaaaccggaccauc

SEQ ID NO: 1464748 - RNA, 13 nt, Human
gucaaaaauuaaa

SEQ ID NO: 1464749 - RNA, 14 nt, Human
gucaaaaauuaaac

SEQ ID NO: 1464750 - RNA, 20 nt, Human
gucuccuaagcuggagugca

SEQ ID NO: 1464751 - RNA, 12 nt, Human
gucucccuccuc

SEQ ID NO: 1464752 - RNA, 16 nt, Human
gucucccuccucugcc

SEQ ID NO: 1464753 - RNA, 10 nt, Human
aaccaaguuc

SEQ ID NO: 1464754 - RNA, 16 nt, Human
aaccaaagaagaaagu

SEQ ID NO: 1464755 - RNA, 17 nt, Human
aaccacacccacacuca

SEQ ID NO: 1464756 - RNA, 20 nt, Human
aaccacauuggagauguuua

SEQ ID NO: 1464757 - RNA, 20 nt, Human
aaccuagggugauauuaacc

SEQ ID NO: 1464758 - RNA, 22 nt, Human
aaccuaugauauuuucugugcc

SEQ ID NO: 1464759 - RNA, 22 nt, Human
aaccuauuucuuaaacacuugc

SEQ ID NO: 1464760 - RNA, 15 nt, Human
aaccccagacacugg

SEQ ID NO: 1464761 - RNA, 16 nt, Human
aaccucaacugccuac

SEQ ID NO: 1464762 - RNA, 17 nt, Human
aaccucaacugccuacu

SEQ ID NO: 1464763 - RNA, 18 nt, Human
aaccucaacugccuacuc

SEQ ID NO: 1464764 - RNA, 20 nt, Human
aaccauguaaagaacauaaa

SEQ ID NO: 1464765 - RNA, 17 nt, Human
aacccauauuguaaaac

SEQ ID NO: 1464766 - RNA, 21 nt, Human
aacccauauuguaaaacaggu

SEQ ID NO: 1464767 - RNA, 14 nt, Human
aacuccagaaagug

SEQ ID NO: 1464768 - RNA, 18 nt, Human
aacuagccaaaccaggac

SEQ ID NO: 1464769 - RNA, 21 nt, Human
aacuagccaaaccaggacccu

SEQ ID NO: 1464770 - RNA, 21 nt, Human
aacuccagaaagugacaagcu

SEQ ID NO: 1464771 - RNA, 18 nt, Human
aacucguuaauuuguagu

SEQ ID NO: 1464772 - RNA, 19 nt, Human
aacucgugucuggcacagc

SEQ ID NO: 1464773 - RNA, 15 nt, Human
aacucguuuuuuaca

SEQ ID NO: 1464774 - RNA, 17 nt, Human
aaccuggagauggugga

SEQ ID NO: 1464775 - RNA, 15 nt, Human
aaccuggagauggug

SEQ ID NO: 1464776 - RNA, 12 nt, Human
aacuaaugccuu

SEQ ID NO: 1464777 - RNA, 15 nt, Human
aacuaaugccuuacu

SEQ ID NO: 1464778 - RNA, 23 nt, Human
aacuaauuuuuauuuuugcugag

SEQ ID NO: 1464779 - RNA, 20 nt, Human
aacuacaaccaauggaaugu

SEQ ID NO: 1464780 - RNA, 14 nt, Human
aacuacagucuaaa

SEQ ID NO: 1464781 - RNA, 23 nt, Human
gucugcucagacagaaccccuac

SEQ ID NO: 1464782 - RNA, 14 nt, Human
gucuuccucugucu

SEQ ID NO: 1464783 - RNA, 14 nt, Human
gucuuccugacacu

SEQ ID NO: 1464784 - RNA, 18 nt, Human
gucuuccugacacuuuaa

SEQ ID NO: 1464785 - RNA, 19 nt, Human
gucuuccugacacuuuaau

SEQ ID NO: 1464786 - RNA, 19 nt, Human
gucuuauauauuguagaua

SEQ ID NO: 1464787 - RNA, 21 nt, Human
guccaagcauuuagauguaua

SEQ ID NO: 1464788 - RNA, 12 nt, Human
aacacugccagc

SEQ ID NO: 1464789 - RNA, 22 nt, Human
aacacugccagcauuucccuuc

SEQ ID NO: 1464790 - RNA, 14 nt, Human
aacaaugcuguauu

SEQ ID NO: 1464791 - RNA, 13 nt, Human
aacaauuuaugaa

SEQ ID NO: 1464792 - RNA, 16 nt, Human
aacaauuuaugaauug

SEQ ID NO: 1464793 - RNA, 15 nt, Human
aacaagucagucauu

SEQ ID NO: 1464794 - RNA, 12 nt, Human
aacaaguauuug

SEQ ID NO: 1464795 - RNA, 20 nt, Human
aacaaguauuuguuaauuua

SEQ ID NO: 1464796 - RNA, 23 nt, Human
aacaaguauuuguuaauuuagaa

SEQ ID NO: 1464797 - RNA, 18 nt, Human
aacaagucagucauucag

SEQ ID NO: 1464798 - RNA, 15 nt, Human
aacaaggaugaauua

SEQ ID NO: 1464799 - RNA, 21 nt, Human
aacaagccuccuuuuaaagua

SEQ ID NO: 1464800 - RNA, 17 nt, Human
aaauuuuuguaguagcg

SEQ ID NO: 1464801 - RNA, 23 nt, Human
aaauuuuuaaucuuuaauuuuac

SEQ ID NO: 1464802 - RNA, 19 nt, Human
aacaguuguguuugaagca

SEQ ID NO: 1464803 - RNA, 23 nt, Human
aacagaaaaauauguaccaagaa

SEQ ID NO: 1464804 - RNA, 13 nt, Human
aacagaaacaaaa

SEQ ID NO: 1464805 - RNA, 16 nt, Human
aacagaaacaaaaaca

SEQ ID NO: 1464806 - RNA, 18 nt, Human
aacagaacauagacagaa

SEQ ID NO: 1464807 - RNA, 22 nt, Human
aacauuuguucuauagcuuuuc

SEQ ID NO: 1464808 - RNA, 17 nt, Human
guccuuaggccucugag

SEQ ID NO: 1464809 - RNA, 18 nt, Human
guccuuaggccucugaga

SEQ ID NO: 1464810 - RNA, 13 nt, Human
guccuucaaaggc

SEQ ID NO: 1464811 - RNA, 20 nt, Human
aacauuuguucuauagcuuu

SEQ ID NO: 1464812 - RNA, 18 nt, Human
aacauuugguaaggggaa

SEQ ID NO: 1464813 - RNA, 19 nt, Human
aacauuuauuuugacauaa

SEQ ID NO: 1464814 - RNA, 22 nt, Human
aacauuucuauagccaaaaaua

SEQ ID NO: 1464815 - RNA, 13 nt, Human
aacauuguguucc

SEQ ID NO: 1464816 - RNA, 23 nt, Human
aacauuguguucccauuucagcu

SEQ ID NO: 1464817 - RNA, 15 nt, Human
aacauuuauuuugac

SEQ ID NO: 1464818 - RNA, 17 nt, Human
aacauuuauuuugacau

SEQ ID NO: 1464819 - RNA, 17 nt, Human
aacauaccuaagaagua

SEQ ID NO: 1464820 - RNA, 16 nt, Human
caagaccgaucggcgg

SEQ ID NO: 1464821 - RNA, 18 nt, Human
caagaaauaaguuuuugu

SEQ ID NO: 1464822 - RNA, 17 nt, Human
caagaccucagugccuu

SEQ ID NO: 1464823 - RNA, 12 nt, Human
caagacugcugu

SEQ ID NO: 1464824 - RNA, 19 nt, Human
caagacugcuguggccagg

SEQ ID NO: 1464825 - RNA, 20 nt, Human
caagacugcuguggccagga

SEQ ID NO: 1464826 - RNA, 21 nt, Human
caagacugcuguggccaggag

SEQ ID NO: 1464827 - RNA, 22 nt, Human
caagacugcuguggccaggagg

SEQ ID NO: 1464828 - RNA, 23 nt, Human
caagacugcuguggccaggaggu

SEQ ID NO: 1464829 - RNA, 16 nt, Human
caagcauuuagaugua

SEQ ID NO: 1464830 - RNA, 19 nt, Human
caagcauuuagauguauag

SEQ ID NO: 1464831 - RNA, 14 nt, Human
caagcauucugucu

SEQ ID NO: 1464832 - RNA, 21 nt, Human
caagccauggguagccugggu

SEQ ID NO: 1464833 - RNA, 22 nt, Human
caagcaguugggacuacaggcg

SEQ ID NO: 1464834 - RNA, 18 nt, Human
caagcauggcuauuuuau

SEQ ID NO: 1464835 - RNA, 21 nt, Human
caagcauggcuauuuuauauu

SEQ ID NO: 1464836 - RNA, 16 nt, Human
caagcauucagaagaa

SEQ ID NO: 1464837 - RNA, 22 nt, Human
caagcauucagaagaaaaagaa

SEQ ID NO: 1464838 - RNA, 17 nt, Human
caagcauucagaagaaa

SEQ ID NO: 1464839 - RNA, 14 nt, Human
caagcuguuuucuu

SEQ ID NO: 1464840 - RNA, 16 nt, Human
caagcuguuuucuucu

SEQ ID NO: 1464841 - RNA, 20 nt, Human
caagcuuaauggcugauaau

SEQ ID NO: 1464842 - RNA, 18 nt, Human
caagggcauaaauuauug

SEQ ID NO: 1464843 - RNA, 23 nt, Human
caagggcagggggccccuuugcu

SEQ ID NO: 1464844 - RNA, 22 nt, Human
caagggcagggggccccuuugc

SEQ ID NO: 1464845 - RNA, 14 nt, Human
caagggccugaugg

SEQ ID NO: 1464846 - RNA, 18 nt, Human
caagguucaacuuauuaa

SEQ ID NO: 1464847 - RNA, 20 nt, Human
caaccuccgcauccgggguu

SEQ ID NO: 1464848 - RNA, 20 nt, Human
caaccuccaccuccuggguu

SEQ ID NO: 1464849 - RNA, 14 nt, Human
caaccuccaccucc

SEQ ID NO: 1464850 - RNA, 18 nt, Human
caacugaaugaggucagc

SEQ ID NO: 1464851 - RNA, 12 nt, Human
caacuggcaggc

SEQ ID NO: 1464852 - RNA, 14 nt, Human
caacuggcaggcag

SEQ ID NO: 1464853 - RNA, 15 nt, Human
caaccucauccucuc

SEQ ID NO: 1464854 - RNA, 15 nt, Human
caaccucaguaauuu

SEQ ID NO: 1464855 - RNA, 18 nt, Human
caaccucaguaauuuaga

SEQ ID NO: 1464856 - RNA, 18 nt, Human
caaccucaacugccuacu

SEQ ID NO: 1464857 - RNA, 16 nt, Human
caacaguuacauaauu

SEQ ID NO: 1464858 - RNA, 12 nt, Human
caacaguuuucc

SEQ ID NO: 1464859 - RNA, 13 nt, Human
caacaguuuuccu

SEQ ID NO: 1464860 - RNA, 20 nt, Human
caacaguuuuccuaugcuuu

SEQ ID NO: 1464861 - RNA, 22 nt, Human
caacaguuuuccuaugcuuuga

SEQ ID NO: 1464862 - RNA, 17 nt, Human
caaauuguaagcaugca

SEQ ID NO: 1464863 - RNA, 14 nt, Human
caaauucuucugaa

SEQ ID NO: 1464864 - RNA, 15 nt, Human
caaauucuucugaac

SEQ ID NO: 1464865 - RNA, 15 nt, Human
caaauauuuauuuuc

SEQ ID NO: 1464866 - RNA, 16 nt, Human
caaauauuuauuuucu

SEQ ID NO: 1464867 - RNA, 12 nt, Human
caaauauuuauu

SEQ ID NO: 1464868 - RNA, 14 nt, Human
caaauauuuauuuu

SEQ ID NO: 1464869 - RNA, 21 nt, Human
caaaggcuuugcccugcugcc

SEQ ID NO: 1464870 - RNA, 23 nt, Human
caaaggcuuugcccugcugcccu

SEQ ID NO: 1464871 - RNA, 15 nt, Human
caaaggcuuugcccu

SEQ ID NO: 1464872 - RNA, 22 nt, Human
caaaggggaggcaucagugucc

SEQ ID NO: 1464873 - RNA, 17 nt, Human
auuuguacuauuuaacu

SEQ ID NO: 1464874 - RNA, 18 nt, Human
auuuguacuauuuaacug

SEQ ID NO: 1464875 - RNA, 18 nt, Human
auuuuaauaauguuucaa

SEQ ID NO: 1464876 - RNA, 19 nt, Human
auuuuaauaauguuucaaa

SEQ ID NO: 1464877 - RNA, 22 nt, Human
caaacugaggaauuucaccugu

SEQ ID NO: 1464878 - RNA, 15 nt, Human
caaagaaauuaugug

SEQ ID NO: 1464879 - RNA, 13 nt, Human
caaagaaauuaug

SEQ ID NO: 1464880 - RNA, 12 nt, Human
caaagaaauuau

SEQ ID NO: 1464881 - RNA, 14 nt, Human
caaacugccuucuu

SEQ ID NO: 1464882 - RNA, 15 nt, Human
caaagaguucaagaa

SEQ ID NO: 1464883 - RNA, 16 nt, Human
caaagaguucaagaaa

SEQ ID NO: 1464884 - RNA, 16 nt, Human
caaagagguauuuauc

SEQ ID NO: 1464885 - RNA, 22 nt, Human
cacaccuacuagucaccagaga

SEQ ID NO: 1464886 - RNA, 14 nt, Human
cacaccaggauaga

SEQ ID NO: 1464887 - RNA, 19 nt, Human
cacacacaaaagggaaccc

SEQ ID NO: 1464888 - RNA, 21 nt, Human
cacacaaauuaucuuaaaacu

SEQ ID NO: 1464889 - RNA, 18 nt, Human
cacacaaugugucugaga

SEQ ID NO: 1464890 - RNA, 12 nt, Human
caauuuuguaac

SEQ ID NO: 1464891 - RNA, 11 nt, Human
caauuuuguaa

SEQ ID NO: 1464892 - RNA, 12 nt, Human
caauucaaaaca

SEQ ID NO: 1464893 - RNA, 20 nt, Human
caauuuucuggaauacauga

SEQ ID NO: 1464894 - RNA, 15 nt, Human
cacaaaccaugcaaa

SEQ ID NO: 1464895 - RNA, 17 nt, Human
caaugcaccuaaagaaa

SEQ ID NO: 1464896 - RNA, 18 nt, Human
caaugcaccuaaagaaaa

SEQ ID NO: 1464897 - RNA, 23 nt, Human
caaugcaccuaaagaaaaacaaa

SEQ ID NO: 1464898 - RNA, 14 nt, Human
caauguaaauauuu

SEQ ID NO: 1464899 - RNA, 16 nt, Human
caauuagggccuagcc

SEQ ID NO: 1464900 - RNA, 17 nt, Human
caauguaaauauuuuaa

SEQ ID NO: 1464901 - RNA, 21 nt, Human
caauuauaagaggauaugaac

SEQ ID NO: 1464902 - RNA, 23 nt, Human
caauuaggcagacucuuuaugcu

SEQ ID NO: 1464903 - RNA, 13 nt, Human
cacaaauauuuau

SEQ ID NO: 1464904 - RNA, 21 nt, Human
cacaaauauuuauuuucuuuc

SEQ ID NO: 1464905 - RNA, 23 nt, Human
cacaaauauuuauuuucuuucug

SEQ ID NO: 1464906 - RNA, 17 nt, Human
caauauucaauaaagcu

SEQ ID NO: 1464907 - RNA, 16 nt, Human
caauauucaauaaagc

SEQ ID NO: 1464908 - RNA, 15 nt, Human
caauauucaauaaag

SEQ ID NO: 1464909 - RNA, 14 nt, Human
caauauucaauaaa

SEQ ID NO: 1464910 - RNA, 11 nt, Human
caaugaaauga

SEQ ID NO: 1464911 - RNA, 13 nt, Human
caaugaaaugaau

SEQ ID NO: 1464912 - RNA, 24 nt, Human
caaugauggcaauuuuguaacgaa

SEQ ID NO: 1464913 - RNA, 14 nt, Human
caagugcugugcaa

SEQ ID NO: 1464914 - RNA, 19 nt, Human
caauguaaauauuuuaaag

SEQ ID NO: 1464915 - RNA, 17 nt, Human
cacaugaaguccaagca

SEQ ID NO: 1464916 - RNA, 20 nt, Human
cacaugaaguccaagcauuu

SEQ ID NO: 1464917 - RNA, 21 nt, Human
cacaugucagcaaguccuaag

SEQ ID NO: 1464918 - RNA, 16 nt, Human
cacaugauuccagcca

SEQ ID NO: 1464919 - RNA, 16 nt, Human
cacaggcaaaauccuu

SEQ ID NO: 1464920 - RNA, 20 nt, Human
cacaggcaaaauccuugcuu

SEQ ID NO: 1464921 - RNA, 16 nt, Human
cacagcaauuccucag

SEQ ID NO: 1464922 - RNA, 18 nt, Human
cacagcaauuccucaggc

SEQ ID NO: 1464923 - RNA, 21 nt, Human
caccauauuggccagucuggu

SEQ ID NO: 1464924 - RNA, 17 nt, Human
caccauagguagaaugu

SEQ ID NO: 1464925 - RNA, 21 nt, Human
caccaguguguggcuuucaga

SEQ ID NO: 1464926 - RNA, 23 nt, Human
caccaguguguggcuuucagagc

SEQ ID NO: 1464927 - RNA, 17 nt, Human
caccaugcugcugggga

SEQ ID NO: 1464928 - RNA, 19 nt, Human
caccaugcugcuggggaag

SEQ ID NO: 1464929 - RNA, 22 nt, Human
caccaugcugcuggggaagaca

SEQ ID NO: 1464930 - RNA, 13 nt, Human
caccaagcugcug

SEQ ID NO: 1464931 - RNA, 22 nt, Human
caccaaguuggaacauccuugg

SEQ ID NO: 1464932 - RNA, 23 nt, Human
caccaaguuggaacauccuugga

SEQ ID NO: 1464933 - RNA, 20 nt, Human
caccauguuggccaggcuug

SEQ ID NO: 1464934 - RNA, 13 nt, Human
caccauugaaggc

SEQ ID NO: 1464935 - RNA, 14 nt, Human
caccauugaaggcu

SEQ ID NO: 1464936 - RNA, 15 nt, Human
caccauugaaggcuu

SEQ ID NO: 1464937 - RNA, 16 nt, Human
caccauugaaggcuua

SEQ ID NO: 1464938 - RNA, 17 nt, Human
caccauuuggauccugu

SEQ ID NO: 1464939 - RNA, 18 nt, Human
caccauuuggcaucccug

SEQ ID NO: 1464940 - RNA, 19 nt, Human
caccauuuggcaucccugg

SEQ ID NO: 1464941 - RNA, 20 nt, Human
caccauuuggcaucccuggg

SEQ ID NO: 1464942 - RNA, 21 nt, Human
caccauuuggcaucccugggc

SEQ ID NO: 1464943 - RNA, 22 nt, Human
caccauuuggcaucccugggcc

SEQ ID NO: 1464944 - RNA, 23 nt, Human
caccauuuggcaucccugggccu

SEQ ID NO: 1464945 - RNA, 24 nt, Human
caccauuuggcaucccugggccuu

SEQ ID NO: 1464946 - RNA, 22 nt, Human
cacccaaagagguauuuaucuu

SEQ ID NO: 1464947 - RNA, 13 nt, Human
uuuuuucuuacug

SEQ ID NO: 1464948 - RNA, 20 nt, Human
uuuugaaaagcagacauuuu

SEQ ID NO: 1464949 - RNA, 21 nt, Human
uuuugaaaccaugaagagauu

SEQ ID NO: 1464950 - RNA, 20 nt, Human
uuuuuuauacaggaugauga

SEQ ID NO: 1464951 - RNA, 12 nt, Human
uuuuuucugaaa

SEQ ID NO: 1464952 - RNA, 13 nt, Human
uuuuuuaguugaa

SEQ ID NO: 1464953 - RNA, 17 nt, Human
uuuagaauaugccuugu

SEQ ID NO: 1464954 - RNA, 15 nt, Human
uuuagacuucaagca

SEQ ID NO: 1464955 - RNA, 20 nt, Human
uuuagaaacacaacuauauu

SEQ ID NO: 1464956 - RNA, 12 nt, Human
uuuagaaaacuu

SEQ ID NO: 1464957 - RNA, 13 nt, Human
uuuagaaaacuuu

SEQ ID NO: 1464958 - RNA, 14 nt, Human
uuuagaaaacuuua

SEQ ID NO: 1464959 - RNA, 15 nt, Human
uuuagaaaacuuuaa

SEQ ID NO: 1464960 - RNA, 16 nt, Human
uuuagaaaacuuuaaa

SEQ ID NO: 1464961 - RNA, 18 nt, Human
uuuagaaaucauuuugca

SEQ ID NO: 1464962 - RNA, 12 nt, Human
uuuagaaacaca

SEQ ID NO: 1464963 - RNA, 14 nt, Human
uuuacuuuucuucu

SEQ ID NO: 1464964 - RNA, 15 nt, Human
uuuacuuuuaaacag

SEQ ID NO: 1464965 - RNA, 18 nt, Human
uuuacuuuuaaacaguga

SEQ ID NO: 1464966 - RNA, 15 nt, Human
uuuacuuuuaaacug

SEQ ID NO: 1464967 - RNA, 16 nt, Human
uuuacuuuuaaacugu

SEQ ID NO: 1464968 - RNA, 22 nt, Human
uuuacauggcuggagcuagaau

SEQ ID NO: 1464969 - RNA, 17 nt, Human
uuuacaauaguucugug

SEQ ID NO: 1464970 - RNA, 16 nt, Human
uuuacaaguaacaaaa

SEQ ID NO: 1464971 - RNA, 17 nt, Human
uuuacauggcuggagcu

SEQ ID NO: 1464972 - RNA, 19 nt, Human
uuuacaauuuuuuaucaug

SEQ ID NO: 1464973 - RNA, 19 nt, Human
uuguauuguauauuacaau

SEQ ID NO: 1464974 - RNA, 18 nt, Human
uuguauuguauauuacaa

SEQ ID NO: 1464975 - RNA, 18 nt, Human
uuuaucuuuauaugaaga

SEQ ID NO: 1464976 - RNA, 19 nt, Human
uuuaugaaaaagaagaauc

SEQ ID NO: 1464977 - RNA, 14 nt, Human
uuuaugcauauuau

SEQ ID NO: 1464978 - RNA, 16 nt, Human
uuuauuggcugagaua

SEQ ID NO: 1464979 - RNA, 22 nt, Human
uuucucccuggauuuuuaccag

SEQ ID NO: 1464980 - RNA, 16 nt, Human
uuucuaggacugaauu

SEQ ID NO: 1464981 - RNA, 15 nt, Human
uuucuccucccagga

SEQ ID NO: 1464982 - RNA, 23 nt, Human
uuucucccuggauuuuuaccagu

SEQ ID NO: 1464983 - RNA, 21 nt, Human
uuucucccuggauuuuuacca

SEQ ID NO: 1464984 - RNA, 20 nt, Human
uuucucccuggauuuuuacc

SEQ ID NO: 1464985 - RNA, 14 nt, Human
uuucucccuggauu

SEQ ID NO: 1464986 - RNA, 12 nt, Human
uuucucccugga

SEQ ID NO: 1464987 - RNA, 14 nt, Human
uuucuaaugagaua

SEQ ID NO: 1464988 - RNA, 16 nt, Human
uuucuagauuaagaua

SEQ ID NO: 1464989 - RNA, 21 nt, Human
uuuccucuucuauuuuguaaa

SEQ ID NO: 1464990 - RNA, 22 nt, Human
uuuccucuucuauuuuguaaac

SEQ ID NO: 1464991 - RNA, 15 nt, Human
uuuccuaugcuuuga

SEQ ID NO: 1464992 - RNA, 17 nt, Human
uuuccuagcccucucac

SEQ ID NO: 1464993 - RNA, 23 nt, Human
uuuccuagcccucucacauuuau

SEQ ID NO: 1464994 - RNA, 17 nt, Human
uuucuaagaaacauuua

SEQ ID NO: 1464995 - RNA, 14 nt, Human
uuucuaagaaacau

SEQ ID NO: 1464996 - RNA, 15 nt, Human
uuucagauaaucaca

SEQ ID NO: 1464997 - RNA, 13 nt, Human
uuucagagccucc

SEQ ID NO: 1464998 - RNA, 13 nt, Human
uuuauuuguugag

SEQ ID NO: 1464999 - RNA, 14 nt, Human
uuuauuuguugaga

SEQ ID NO: 1465000 - RNA, 15 nt, Human
uuucagcagcugcag

SEQ ID NO: 1465001 - RNA, 21 nt, Human
uuucagauaaucacaauacau

SEQ ID NO: 1465002 - RNA, 12 nt, Human
uuuauuuguuga

SEQ ID NO: 1465003 - RNA, 18 nt, Human
uuuauuuguugagagugu

SEQ ID NO: 1465004 - RNA, 22 nt, Human
uuucaggagagaguugaaccua

SEQ ID NO: 1465005 - RNA, 19 nt, Human
uuuccagaggcuauuauuu

SEQ ID NO: 1465006 - RNA, 22 nt, Human
uuucuuacugucuuuuuucuaa

SEQ ID NO: 1465007 - RNA, 20 nt, Human
uuucuuacugauuuuuaagu

SEQ ID NO: 1465008 - RNA, 16 nt, Human
uuucugaguuccugca

SEQ ID NO: 1465009 - RNA, 16 nt, Human
uuucugaguuuuacca

SEQ ID NO: 1465010 - RNA, 15 nt, Human
uuucugaguuuuacc

SEQ ID NO: 1465011 - RNA, 16 nt, Human
uuugauacuaagcauu

SEQ ID NO: 1465012 - RNA, 17 nt, Human
uuugauacuaagcauug

SEQ ID NO: 1465013 - RNA, 18 nt, Human
uuugauacuaagcauuga

SEQ ID NO: 1465014 - RNA, 23 nt, Human
uuugcauaacguauaaaagccug

SEQ ID NO: 1465015 - RNA, 19 nt, Human
uuugcauaacguauaaaag

SEQ ID NO: 1465016 - RNA, 11 nt, Human
uuugcagcuuu

SEQ ID NO: 1465017 - RNA, 21 nt, Human
uuugcagcugagagaaaauaa

SEQ ID NO: 1465018 - RNA, 21 nt, Human
uuugauacuaagcauugaaug

SEQ ID NO: 1465019 - RNA, 21 nt, Human
uuugauagauuuucugcuacu

SEQ ID NO: 1465020 - RNA, 18 nt, Human
uuuggaacccuaaauaau

SEQ ID NO: 1465021 - RNA, 21 nt, Human
uuuguauaaaauaauuuuuau

SEQ ID NO: 1465022 - RNA, 12 nt, Human
uuuguuaauuua

SEQ ID NO: 1465023 - RNA, 12 nt, Human
uuugucccaggu

SEQ ID NO: 1465024 - RNA, 22 nt, Human
uuuguguuucagccauguauuu

SEQ ID NO: 1465025 - RNA, 22 nt, Human
uuuuaaaaugagaaaucuaaaa

SEQ ID NO: 1465026 - RNA, 15 nt, Human
uuuuaaaaugagaaa

SEQ ID NO: 1465027 - RNA, 20 nt, Human
uuuguuuaaaaaguaauaaa

SEQ ID NO: 1465028 - RNA, 14 nt, Human
uuuguuuaaaaagu

SEQ ID NO: 1465029 - RNA, 13 nt, Human
uuuuacauuaaau

SEQ ID NO: 1465030 - RNA, 15 nt, Human
uuuuacauucugaau

SEQ ID NO: 1465031 - RNA, 13 nt, Human
uuuuaccaaguuu

SEQ ID NO: 1465032 - RNA, 22 nt, Human
uuuuacauaaauuuaguauuuu

SEQ ID NO: 1465033 - RNA, 17 nt, Human
uuuuaauuugguuuuca

SEQ ID NO: 1465034 - RNA, 21 nt, Human
uuuuaauuugguuuucacauu

SEQ ID NO: 1465035 - RNA, 14 nt, Human
uuuuacuguacaga

SEQ ID NO: 1465036 - RNA, 15 nt, Human
uuuuauaugcuucug

SEQ ID NO: 1465037 - RNA, 20 nt, Human
uuuuauaugcuucuguuuua

SEQ ID NO: 1465038 - RNA, 10 nt, Human
uuuuauauuu

SEQ ID NO: 1465039 - RNA, 16 nt, Human
uuuuaucaugcauguc

SEQ ID NO: 1465040 - RNA, 20 nt, Human
uuuuaugauacuugaaaauu

SEQ ID NO: 1465041 - RNA, 16 nt, Human
uuuuaugauacuugaa

SEQ ID NO: 1465042 - RNA, 13 nt, Human
uuuuccugaaaac

SEQ ID NO: 1465043 - RNA, 18 nt, Human
uuuucccaaaauguugaa

SEQ ID NO: 1465044 - RNA, 13 nt, Human
uuuuccucccuca

SEQ ID NO: 1465045 - RNA, 20 nt, Human
uuuuccaugcguguuucuga

SEQ ID NO: 1465046 - RNA, 22 nt, Human
uuuuccauggcaggaaggcuug

SEQ ID NO: 1465047 - RNA, 21 nt, Human
uuuuccauggcaggaaggcuu

SEQ ID NO: 1465048 - RNA, 18 nt, Human
uuuuccucuucuauuuug

SEQ ID NO: 1465049 - RNA, 17 nt, Human
uuuuccuuugaauccuc

SEQ ID NO: 1465050 - RNA, 14 nt, Human
uuuucaagaaacug

SEQ ID NO: 1465051 - RNA, 15 nt, Human
uuuucaagaaacuga

SEQ ID NO: 1465052 - RNA, 16 nt, Human
uuuucaagaauaauca

SEQ ID NO: 1465053 - RNA, 16 nt, Human
uuuucacuguagaaug

SEQ ID NO: 1465054 - RNA, 19 nt, Human
uucaaugccccugaauuua

SEQ ID NO: 1465055 - RNA, 16 nt, Human
uucaaucuguaaacug

SEQ ID NO: 1465056 - RNA, 17 nt, Human
uucaaucuguaaacugu

SEQ ID NO: 1465057 - RNA, 18 nt, Human
uucaaucuguaaacugug

SEQ ID NO: 1465058 - RNA, 20 nt, Human
uucaaucuguaaacugugua

SEQ ID NO: 1465059 - RNA, 15 nt, Human
uucaauguuagccuc

SEQ ID NO: 1465060 - RNA, 15 nt, Human
uucaauucaaagcug

SEQ ID NO: 1465061 - RNA, 18 nt, Human
uucaacaauucuaaaaug

SEQ ID NO: 1465062 - RNA, 14 nt, Human
uucaacaauucuaa

SEQ ID NO: 1465063 - RNA, 15 nt, Human
uucaacaauucuaaa

SEQ ID NO: 1465064 - RNA, 19 nt, Human
uucaacaauucuaaaauga

SEQ ID NO: 1465065 - RNA, 14 nt, Human
uucaaucuguaaac

SEQ ID NO: 1465066 - RNA, 15 nt, Human
uucaaucuguaaacu

SEQ ID NO: 1465067 - RNA, 12 nt, Human
uuauuuucacug

SEQ ID NO: 1465068 - RNA, 15 nt, Human
uuacgugcucugugg

SEQ ID NO: 1465069 - RNA, 15 nt, Human
uuauuuugacauaaa

SEQ ID NO: 1465070 - RNA, 17 nt, Human
uuauuuugacauaaagu

SEQ ID NO: 1465071 - RNA, 12 nt, Human
uucaacaaacau

SEQ ID NO: 1465072 - RNA, 20 nt, Human
uucaacaaacauuugcugaa

SEQ ID NO: 1465073 - RNA, 16 nt, Human
uucaaagcaugaaaug

SEQ ID NO: 1465074 - RNA, 20 nt, Human
uucacucuucaaaugccuga

SEQ ID NO: 1465075 - RNA, 18 nt, Human
uucaggacacucacuaca

SEQ ID NO: 1465076 - RNA, 20 nt, Human
uucaggagagaguugaaccu

SEQ ID NO: 1465077 - RNA, 21 nt, Human
uucaggagagaguugaaccua

SEQ ID NO: 1465078 - RNA, 15 nt, Human
uucagcucugaaaga

SEQ ID NO: 1465079 - RNA, 21 nt, Human
uucccaaaagcccauucauuc

SEQ ID NO: 1465080 - RNA, 11 nt, Human
uucccaaaagc

SEQ ID NO: 1465081 - RNA, 22 nt, Human
uucccaaaauguugaaauauga

SEQ ID NO: 1465082 - RNA, 19 nt, Human
uucccaaaauguugaaaua

SEQ ID NO: 1465083 - RNA, 12 nt, Human
uuccaucugauu

SEQ ID NO: 1465084 - RNA, 12 nt, Human
uuccagccauca

SEQ ID NO: 1465085 - RNA, 13 nt, Human
uucauuuucucua

SEQ ID NO: 1465086 - RNA, 16 nt, Human
uucaugaccaguaaag

SEQ ID NO: 1465087 - RNA, 12 nt, Human
uucaugauaaug

SEQ ID NO: 1465088 - RNA, 15 nt, Human
uucaugauaaugaac

SEQ ID NO: 1465089 - RNA, 18 nt, Human
uucaugauaaugaacaga

SEQ ID NO: 1465090 - RNA, 13 nt, Human
uucauuuccucaa

SEQ ID NO: 1465091 - RNA, 16 nt, Human
uucauuuccucaaaaa

SEQ ID NO: 1465092 - RNA, 16 nt, Human
uucauuuccuccguca

SEQ ID NO: 1465093 - RNA, 18 nt, Human
uucauuuuaacaucugag

SEQ ID NO: 1465094 - RNA, 21 nt, Human
uucauuuuaacaucugagaaa

SEQ ID NO: 1465095 - RNA, 18 nt, Human
uucaugaaagauucaaug

SEQ ID NO: 1465096 - RNA, 22 nt, Human
uucaguuuauuugaaccaauaa

SEQ ID NO: 1465097 - RNA, 12 nt, Human
uucauaaguauu

SEQ ID NO: 1465098 - RNA, 19 nt, Human
uucauaaguauuaugucuc

SEQ ID NO: 1465099 - RNA, 20 nt, Human
uucauaaguauuaugucucu

SEQ ID NO: 1465100 - RNA, 15 nt, Human
uucaucuaggauuuu

SEQ ID NO: 1465101 - RNA, 23 nt, Human
uucaucuauuuuuggcagucuga

SEQ ID NO: 1465102 - RNA, 16 nt, Human
uucccuucaucuggaa

SEQ ID NO: 1465103 - RNA, 15 nt, Human
uucccuucaucugga

SEQ ID NO: 1465104 - RNA, 14 nt, Human
uucccuucaucugg

SEQ ID NO: 1465105 - RNA, 13 nt, Human
uucccuuuccuga

SEQ ID NO: 1465106 - RNA, 20 nt, Human
uuccuagguauaauucacau

SEQ ID NO: 1465107 - RNA, 14 nt, Human
uuccuagcccucuc

SEQ ID NO: 1465108 - RNA, 18 nt, Human
uuccuagcccucucacau

SEQ ID NO: 1465109 - RNA, 23 nt, Human
uuccucaguucauccauucuauu

SEQ ID NO: 1465110 - RNA, 15 nt, Human
uuccuaguuuucucc

SEQ ID NO: 1465111 - RNA, 18 nt, Human
uuccuaguuuucuccucc

SEQ ID NO: 1465112 - RNA, 14 nt, Human
uuccucaugaaugu

SEQ ID NO: 1465113 - RNA, 15 nt, Human
uuccucaugaaugua

SEQ ID NO: 1465114 - RNA, 16 nt, Human
uuccucaugaauguaa

SEQ ID NO: 1465115 - RNA, 17 nt, Human
uuccucaugaauguaaa

SEQ ID NO: 1465116 - RNA, 18 nt, Human
uuccucaugaauguaaau

SEQ ID NO: 1465117 - RNA, 21 nt, Human
uuccucaugaauguaaauuug

SEQ ID NO: 1465118 - RNA, 21 nt, Human
uuccuucccugcugugaaaga

SEQ ID NO: 1465119 - RNA, 19 nt, Human
uuccuucccugcugugaaa

SEQ ID NO: 1465120 - RNA, 15 nt, Human
uuccuucccugcugu

SEQ ID NO: 1465121 - RNA, 17 nt, Human
uuccuucauuuccuccg

SEQ ID NO: 1465122 - RNA, 13 nt, Human
uuccuccugcuca

SEQ ID NO: 1465123 - RNA, 15 nt, Human
uuccuccugcucaua

SEQ ID NO: 1465124 - RNA, 15 nt, Human
uucuaaaaugauugu

SEQ ID NO: 1465125 - RNA, 14 nt, Human
uucuaaaaugccuu

SEQ ID NO: 1465126 - RNA, 22 nt, Human
uuccuuugaauccucucucugu

SEQ ID NO: 1465127 - RNA, 14 nt, Human
uucucugauacaga

SEQ ID NO: 1465128 - RNA, 15 nt, Human
uucucugauacagaa

SEQ ID NO: 1465129 - RNA, 16 nt, Human
uucucugauacagaaa

SEQ ID NO: 1465130 - RNA, 17 nt, Human
uucucugauacagaaaa

SEQ ID NO: 1465131 - RNA, 15 nt, Human
uucugacucugagcu

SEQ ID NO: 1465132 - RNA, 16 nt, Human
uucugacucugagcua

SEQ ID NO: 1465133 - RNA, 23 nt, Human
uucucuccucuccccaugauguu

SEQ ID NO: 1465134 - RNA, 16 nt, Human
uucuccccugcacugu

SEQ ID NO: 1465135 - RNA, 15 nt, Human
uucuccccugcacug

SEQ ID NO: 1465136 - RNA, 18 nt, Human
uucuccauggcccugcca

SEQ ID NO: 1465137 - RNA, 23 nt, Human
uucucccaauucauccucacuca

SEQ ID NO: 1465138 - RNA, 15 nt, Human
uucuccauccuacca

SEQ ID NO: 1465139 - RNA, 17 nt, Human
uucuauugccucugaga

SEQ ID NO: 1465140 - RNA, 15 nt, Human
uucuauugccucuga

SEQ ID NO: 1465141 - RNA, 14 nt, Human
uucuauugccucug

SEQ ID NO: 1465142 - RNA, 13 nt, Human
uucuauugccucu

SEQ ID NO: 1465143 - RNA, 14 nt, Human
uucuaauaguuuua

SEQ ID NO: 1465144 - RNA, 15 nt, Human
uucuauuguuguaca

SEQ ID NO: 1465145 - RNA, 13 nt, Human
uucuauuuuguaa

SEQ ID NO: 1465146 - RNA, 16 nt, Human
uucuauuuuguaaacu

SEQ ID NO: 1465147 - RNA, 16 nt, Human
uucuauuuuuaucuga

SEQ ID NO: 1465148 - RNA, 14 nt, Human
uucucaugauccaa

SEQ ID NO: 1465149 - RNA, 16 nt, Human
uucuccaagagcuaca

SEQ ID NO: 1465150 - RNA, 15 nt, Human
uucucauccugcagg

SEQ ID NO: 1465151 - RNA, 23 nt, Human
uugaagaauguuaagacuugaca

SEQ ID NO: 1465152 - RNA, 21 nt, Human
uugaagaauguuaagacuuga

SEQ ID NO: 1465153 - RNA, 15 nt, Human
uugaagaauguuaag

SEQ ID NO: 1465154 - RNA, 19 nt, Human
uugaagaauguuaagacuu

SEQ ID NO: 1465155 - RNA, 20 nt, Human
uugaacucuucacucuucaa

SEQ ID NO: 1465156 - RNA, 14 nt, Human
uucugagcauuuaa

SEQ ID NO: 1465157 - RNA, 19 nt, Human
uucugagcccgguaagagc

SEQ ID NO: 1465158 - RNA, 16 nt, Human
uucugagcuauuucau

SEQ ID NO: 1465159 - RNA, 23 nt, Human
uucugagcuauuucaucuauuuu

SEQ ID NO: 1465160 - RNA, 22 nt, Human
uucugagcccgguaagagcaaa

SEQ ID NO: 1465161 - RNA, 16 nt, Human
uucuuauuucaugaaa

SEQ ID NO: 1465162 - RNA, 14 nt, Human
uucuuauuucauga

SEQ ID NO: 1465163 - RNA, 16 nt, Human
uucuucaccaaaucuu

SEQ ID NO: 1465164 - RNA, 22 nt, Human
uugaccugccucccuucaugca

SEQ ID NO: 1465165 - RNA, 23 nt, Human
uugaccugccucccuucaugcau

SEQ ID NO: 1465166 - RNA, 21 nt, Human
uugaccugccucccuucaugc

SEQ ID NO: 1465167 - RNA, 20 nt, Human
uugaauggcuauguuuuuaa

SEQ ID NO: 1465168 - RNA, 16 nt, Human
uugaauggcuauguuu

SEQ ID NO: 1465169 - RNA, 15 nt, Human
uugaaugcaaaccau

SEQ ID NO: 1465170 - RNA, 16 nt, Human
uugaaugcaaaccaua

SEQ ID NO: 1465171 - RNA, 11 nt, Human
uugaggacaca

SEQ ID NO: 1465172 - RNA, 22 nt, Human
uugacuagaaaauuuaaaacau

SEQ ID NO: 1465173 - RNA, 16 nt, Human
uugaggacacaugucc

SEQ ID NO: 1465174 - RNA, 15 nt, Human
uugaggacacauguc

SEQ ID NO: 1465175 - RNA, 14 nt, Human
uugaggacacaugu

SEQ ID NO: 1465176 - RNA, 13 nt, Human
uugaggacacaug

SEQ ID NO: 1465177 - RNA, 14 nt, Human
uugaggacacugau

SEQ ID NO: 1465178 - RNA, 15 nt, Human
uugaggacacugaua

SEQ ID NO: 1465179 - RNA, 14 nt, Human
uugaggggaccagg

SEQ ID NO: 1465180 - RNA, 17 nt, Human
uugaggggaccaggagu

SEQ ID NO: 1465181 - RNA, 15 nt, Human
uugaggggaccagga

SEQ ID NO: 1465182 - RNA, 21 nt, Human
uugauuggugauuagguggug

SEQ ID NO: 1465183 - RNA, 12 nt, Human
uugaugaagaag

SEQ ID NO: 1465184 - RNA, 13 nt, Human
uugaugaagaagu

SEQ ID NO: 1465185 - RNA, 14 nt, Human
uugauuuucuggau

SEQ ID NO: 1465186 - RNA, 20 nt, Human
uugauuuuugccucuuccag

SEQ ID NO: 1465187 - RNA, 15 nt, Human
uugcaaaaacuacaa

SEQ ID NO: 1465188 - RNA, 20 nt, Human
uugcaaaaacuacaaccaau

SEQ ID NO: 1465189 - RNA, 19 nt, Human
uugcaaaaacuacaaccaa

SEQ ID NO: 1465190 - RNA, 14 nt, Human
uugcauagaauaaa

SEQ ID NO: 1465191 - RNA, 13 nt, Human
uugccacccucau

SEQ ID NO: 1465192 - RNA, 16 nt, Human
uugccacccucaugcu

SEQ ID NO: 1465193 - RNA, 18 nt, Human
uugcagacaggaaucuua

SEQ ID NO: 1465194 - RNA, 11 nt, Human
uugcagacagg

SEQ ID NO: 1465195 - RNA, 15 nt, Human
uugcagacaggaauc

SEQ ID NO: 1465196 - RNA, 16 nt, Human
uugcagacaggaaucu

SEQ ID NO: 1465197 - RNA, 14 nt, Human
uugcaaccgucugu

SEQ ID NO: 1465198 - RNA, 16 nt, Human
uuggaacucugcuuga

SEQ ID NO: 1465199 - RNA, 16 nt, Human
uugcuguaauguuaau

SEQ ID NO: 1465200 - RNA, 13 nt, Human
uugcuguuuugau

SEQ ID NO: 1465201 - RNA, 20 nt, Human
uugccaguuguccuccuucc

SEQ ID NO: 1465202 - RNA, 19 nt, Human
uugccaguuguccuccuuc

SEQ ID NO: 1465203 - RNA, 17 nt, Human
uugccaguuguccuccu

SEQ ID NO: 1465204 - RNA, 15 nt, Human
uugccaguuguccuc

SEQ ID NO: 1465205 - RNA, 18 nt, Human
uugccucugagagcauca

SEQ ID NO: 1465206 - RNA, 13 nt, Human
uugcugcaaaccu

SEQ ID NO: 1465207 - RNA, 15 nt, Human
uugcugcaaaccuga

SEQ ID NO: 1465208 - RNA, 18 nt, Human
uugcugcaguaugaaaau

SEQ ID NO: 1465209 - RNA, 17 nt, Human
uugccucuuccagucuu

SEQ ID NO: 1465210 - RNA, 19 nt, Human
uugccucuuccagucuucc

SEQ ID NO: 1465211 - RNA, 19 nt, Human
uugccucugagagcaucag

SEQ ID NO: 1465212 - RNA, 12 nt, Human
uugccugcaggc

SEQ ID NO: 1465213 - RNA, 14 nt, Human
uugcggcuccucag

SEQ ID NO: 1465214 - RNA, 14 nt, Human
uugcgguucaggaa

SEQ ID NO: 1465215 - RNA, 14 nt, Human
uugguaaaccuuuu

SEQ ID NO: 1465216 - RNA, 12 nt, Human
uugguaaaccuu

SEQ ID NO: 1465217 - RNA, 22 nt, Human
uuggccaaugcaccuaaagaaa

SEQ ID NO: 1465218 - RNA, 23 nt, Human
uuggccaaugcaccuaaagaaaa

SEQ ID NO: 1465219 - RNA, 15 nt, Human
uuggcaucccugggc

SEQ ID NO: 1465220 - RNA, 13 nt, Human
uuggcaucccugg

SEQ ID NO: 1465221 - RNA, 17 nt, Human
uuggcaucccugggccu

SEQ ID NO: 1465222 - RNA, 16 nt, Human
uuguaaaggaauuuaa

SEQ ID NO: 1465223 - RNA, 13 nt, Human
uuguaaauauugu

SEQ ID NO: 1465224 - RNA, 14 nt, Human
uuguaaauauugug

SEQ ID NO: 1465225 - RNA, 21 nt, Human
uuguauucagaguugaugguu

SEQ ID NO: 1465226 - RNA, 14 nt, Human
uuguauucagaguu

SEQ ID NO: 1465227 - RNA, 22 nt, Human
uuguauucaaaaauuaucuaua

SEQ ID NO: 1465228 - RNA, 17 nt, Human
uguagauaauacaguuc

SEQ ID NO: 1465229 - RNA, 20 nt, Human
uguacugaaaaaugguaauu

SEQ ID NO: 1465230 - RNA, 12 nt, Human
uguacugaaaaa

SEQ ID NO: 1465231 - RNA, 15 nt, Human
uguacuauuuaacug

SEQ ID NO: 1465232 - RNA, 18 nt, Human
uguacuauuuaacugacu

SEQ ID NO: 1465233 - RNA, 14 nt, Human
uguacuauuuaacu

SEQ ID NO: 1465234 - RNA, 15 nt, Human
uguacuaaagccaaa

SEQ ID NO: 1465235 - RNA, 16 nt, Human
uguacuaaagccaaac

SEQ ID NO: 1465236 - RNA, 18 nt, Human
uguacuaaagccaaacau

SEQ ID NO: 1465237 - RNA, 20 nt, Human
uguacuaaagccaaacauau

SEQ ID NO: 1465238 - RNA, 11 nt, Human
uguaaacacag

SEQ ID NO: 1465239 - RNA, 21 nt, Human
uguaacuauaguccagcuuug

SEQ ID NO: 1465240 - RNA, 19 nt, Human
uguaacuauaguccagcuu

SEQ ID NO: 1465241 - RNA, 18 nt, Human
uguauuguauauuacaau

SEQ ID NO: 1465242 - RNA, 16 nt, Human
uguauuguauauuaca

SEQ ID NO: 1465243 - RNA, 16 nt, Human
uguaugcacaguaaaa

SEQ ID NO: 1465244 - RNA, 18 nt, Human
uguaucuaugcauuuucu

SEQ ID NO: 1465245 - RNA, 14 nt, Human
uguauacuauagua

SEQ ID NO: 1465246 - RNA, 17 nt, Human
uguauacuauaguacca

SEQ ID NO: 1465247 - RNA, 15 nt, Human
uguauacuauaguac

SEQ ID NO: 1465248 - RNA, 19 nt, Human
uguauacuauaguaccagu

SEQ ID NO: 1465249 - RNA, 20 nt, Human
uguagcaacuacagucuaaa

SEQ ID NO: 1465250 - RNA, 14 nt, Human
ugucacgccagacu

SEQ ID NO: 1465251 - RNA, 14 nt, Human
ugucacucaaggcg

SEQ ID NO: 1465252 - RNA, 17 nt, Human
ugucacucaaggcggug

SEQ ID NO: 1465253 - RNA, 20 nt, Human
ugucacucaaggcggugcuu

SEQ ID NO: 1465254 - RNA, 22 nt, Human
ugucacucaaggcggugcuuga

SEQ ID NO: 1465255 - RNA, 17 nt, Human
ugucacugacacacacg

SEQ ID NO: 1465256 - RNA, 14 nt, Human
ugucccagguccuc

SEQ ID NO: 1465257 - RNA, 16 nt, Human
ugucccagguccucac

SEQ ID NO: 1465258 - RNA, 17 nt, Human
ugucccagguccucacu

SEQ ID NO: 1465259 - RNA, 15 nt, Human
ugucauagaaauuac

SEQ ID NO: 1465260 - RNA, 16 nt, Human
ugucauagaaauuaca

SEQ ID NO: 1465261 - RNA, 14 nt, Human
ugucaucaauuaaa

SEQ ID NO: 1465262 - RNA, 15 nt, Human
ugucaucaauuaaag

SEQ ID NO: 1465263 - RNA, 23 nt, Human
ugucauuaaauggggcucacaaa

SEQ ID NO: 1465264 - RNA, 12 nt, Human
ugucauuguuau

SEQ ID NO: 1465265 - RNA, 14 nt, Human
ugucauuguuauau

SEQ ID NO: 1465266 - RNA, 20 nt, Human
ugucauuguuauauaaucau

SEQ ID NO: 1465267 - RNA, 13 nt, Human
ugugauauaagug

SEQ ID NO: 1465268 - RNA, 18 nt, Human
ugugcaagguauuacacu

SEQ ID NO: 1465269 - RNA, 17 nt, Human
ugugcaauguaaauauu

SEQ ID NO: 1465270 - RNA, 18 nt, Human
ugugcaauguaaauauuu

SEQ ID NO: 1465271 - RNA, 13 nt, Human
ugugauaaggaaa

SEQ ID NO: 1465272 - RNA, 15 nt, Human
ugugagggugcugac

SEQ ID NO: 1465273 - RNA, 16 nt, Human
ugugaaucauuuuacc

SEQ ID NO: 1465274 - RNA, 16 nt, Human
ugugaaucaaggguca

SEQ ID NO: 1465275 - RNA, 17 nt, Human
ugugaaucaagggucag

SEQ ID NO: 1465276 - RNA, 21 nt, Human
ugugaaucaagggucaggccu

SEQ ID NO: 1465277 - RNA, 22 nt, Human
ugugaaucaagggucaggccuu

SEQ ID NO: 1465278 - RNA, 12 nt, Human
ugugacaaaaaa

SEQ ID NO: 1465279 - RNA, 15 nt, Human
ugugacaaaaaauua

SEQ ID NO: 1465280 - RNA, 16 nt, Human
ugugacaaaaaauuaa

SEQ ID NO: 1465281 - RNA, 21 nt, Human
ugugacaaaaaauuaaagcau

SEQ ID NO: 1465282 - RNA, 12 nt, Human
ugugacagggcg

SEQ ID NO: 1465283 - RNA, 13 nt, Human
ugugaaacauguu

SEQ ID NO: 1465284 - RNA, 21 nt, Human
ugucuggugguggcaccaucu

SEQ ID NO: 1465285 - RNA, 14 nt, Human
ugucuuuuuucuaa

SEQ ID NO: 1465286 - RNA, 15 nt, Human
ugugccugacccuac

SEQ ID NO: 1465287 - RNA, 19 nt, Human
ugugcuuaugguaccagau

SEQ ID NO: 1465288 - RNA, 16 nt, Human
ugugcuuuuaaaugca

SEQ ID NO: 1465289 - RNA, 16 nt, Human
ugugcguggugguccc

SEQ ID NO: 1465290 - RNA, 19 nt, Human
ugugcgugguggucccugg

SEQ ID NO: 1465291 - RNA, 21 nt, Human
ugugcgugguggucccugggu

SEQ ID NO: 1465292 - RNA, 22 nt, Human
ugugcgugguggucccugggua

SEQ ID NO: 1465293 - RNA, 13 nt, Human
ugugcaucaggcu

SEQ ID NO: 1465294 - RNA, 19 nt, Human
ugugcaguacuuugugcau

SEQ ID NO: 1465295 - RNA, 17 nt, Human
uguggcuuucagagccu

SEQ ID NO: 1465296 - RNA, 19 nt, Human
uguggguaguggggaagag

SEQ ID NO: 1465297 - RNA, 12 nt, Human
uguuuaaaacau

SEQ ID NO: 1465298 - RNA, 15 nt, Human
uguuuaaaacaucau

SEQ ID NO: 1465299 - RNA, 16 nt, Human
uguuuaaaacaucauu

SEQ ID NO: 1465300 - RNA, 15 nt, Human
uguuguuucuuaaau

SEQ ID NO: 1465301 - RNA, 16 nt, Human
uguuguuucuuaaaua

SEQ ID NO: 1465302 - RNA, 21 nt, Human
uguuguuucuuaaauaagaaa

SEQ ID NO: 1465303 - RNA, 17 nt, Human
uguuguuucuuaaauaa

SEQ ID NO: 1465304 - RNA, 19 nt, Human
uguugaagagguuuuaaag

SEQ ID NO: 1465305 - RNA, 13 nt, Human
uguugagacagag

SEQ ID NO: 1465306 - RNA, 15 nt, Human
uguugagagugugac

SEQ ID NO: 1465307 - RNA, 16 nt, Human
uguugagcaucacaga

SEQ ID NO: 1465308 - RNA, 17 nt, Human
uguugagcaucacagaa

SEQ ID NO: 1465309 - RNA, 20 nt, Human
uguugagcaucacagaaugu

SEQ ID NO: 1465310 - RNA, 21 nt, Human
uguuggagaagaacugaaauc

SEQ ID NO: 1465311 - RNA, 16 nt, Human
uguucauuccuccagg

SEQ ID NO: 1465312 - RNA, 15 nt, Human
uguucauuccuccag

SEQ ID NO: 1465313 - RNA, 14 nt, Human
uguucauuccucca

SEQ ID NO: 1465314 - RNA, 11 nt, Human
uguucauuucc

SEQ ID NO: 1465315 - RNA, 13 nt, Human
uguucauuuccuc

SEQ ID NO: 1465316 - RNA, 13 nt, Human
uguucauaaauaa

SEQ ID NO: 1465317 - RNA, 12 nt, Human
uguucuauagcu

SEQ ID NO: 1465318 - RNA, 24 nt, Human
uguugaaagguaauuugagagaaa

SEQ ID NO: 1465319 - RNA, 14 nt, Human
uguugaaaauguuc

SEQ ID NO: 1465320 - RNA, 17 nt, Human
uguugaaaauguucaga

SEQ ID NO: 1465321 - RNA, 15 nt, Human
uguucugauaaugaa

SEQ ID NO: 1465322 - RNA, 22 nt, Human
uguguuuaggaacuacugagga

SEQ ID NO: 1465323 - RNA, 20 nt, Human
uguguuuacuuuauguuacu

SEQ ID NO: 1465324 - RNA, 15 nt, Human
ugugugcaucaggcu

SEQ ID NO: 1465325 - RNA, 22 nt, Human
ugugugcaucaggcuuucuuuu

SEQ ID NO: 1465326 - RNA, 17 nt, Human
ugugugcaucaggcuuu

SEQ ID NO: 1465327 - RNA, 14 nt, Human
uguguauuccaaga

SEQ ID NO: 1465328 - RNA, 16 nt, Human
uguguaugugugugug

SEQ ID NO: 1465329 - RNA, 21 nt, Human
uguguauaaaaauaaaaaaga

SEQ ID NO: 1465330 - RNA, 21 nt, Human
uguguauauauauauauaugu

SEQ ID NO: 1465331 - RNA, 12 nt, Human
uguuauaaucuu

SEQ ID NO: 1465332 - RNA, 23 nt, Human
uguuaguuucugaguuuuaccaa

SEQ ID NO: 1465333 - RNA, 16 nt, Human
uguucacaauauauuu

SEQ ID NO: 1465334 - RNA, 21 nt, Human
uguucaagcgauucuccugcc

SEQ ID NO: 1465335 - RNA, 14 nt, Human
uguguuugcuuucu

SEQ ID NO: 1465336 - RNA, 15 nt, Human
uguguuugcuuucug

SEQ ID NO: 1465337 - RNA, 17 nt, Human
uguguuuggaagacuau

SEQ ID NO: 1465338 - RNA, 15 nt, Human
uguguuuggcuuuca

SEQ ID NO: 1465339 - RNA, 16 nt, Human
uguguuuggcuuucag

SEQ ID NO: 1465340 - RNA, 17 nt, Human
uguguuuggcuuucagg

SEQ ID NO: 1465341 - RNA, 14 nt, Human
uuacauuuguauaa

SEQ ID NO: 1465342 - RNA, 15 nt, Human
uuacauuuguauaaa

SEQ ID NO: 1465343 - RNA, 14 nt, Human
uuacauuuccuaaa

SEQ ID NO: 1465344 - RNA, 14 nt, Human
uuacauguuugcac

SEQ ID NO: 1465345 - RNA, 22 nt, Human
uuacauggcuggagcuagaauu

SEQ ID NO: 1465346 - RNA, 23 nt, Human
uuacauggcuggagcuagaauuu

SEQ ID NO: 1465347 - RNA, 12 nt, Human
uuacauguuugc

SEQ ID NO: 1465348 - RNA, 13 nt, Human
uuacauguuugca

SEQ ID NO: 1465349 - RNA, 17 nt, Human
uuacaauaguucugugg

SEQ ID NO: 1465350 - RNA, 15 nt, Human
uuacaauaguucugu

SEQ ID NO: 1465351 - RNA, 14 nt, Human
uuaauuauuguaca

SEQ ID NO: 1465352 - RNA, 16 nt, Human
uuacggaacucaaaua

SEQ ID NO: 1465353 - RNA, 20 nt, Human
uuaccuuuuuauuugcaugu

SEQ ID NO: 1465354 - RNA, 21 nt, Human
uuaccacuuguguuuugcaag

SEQ ID NO: 1465355 - RNA, 15 nt, Human
uuaccuuuuuauuug

SEQ ID NO: 1465356 - RNA, 18 nt, Human
uuaccuuuuuauuugcau

SEQ ID NO: 1465357 - RNA, 21 nt, Human
uuaccagauuuuuacacaugu

SEQ ID NO: 1465358 - RNA, 24 nt, Human
uuaccagauuuuuacacauguauc

SEQ ID NO: 1465359 - RNA, 20 nt, Human
uuacauuuguauaaaauaau

SEQ ID NO: 1465360 - RNA, 21 nt, Human
uuaauagguuuggacaaaaug

SEQ ID NO: 1465361 - RNA, 14 nt, Human
uuaauauccuaaac

SEQ ID NO: 1465362 - RNA, 17 nt, Human
uuaauauccuaaacauc

SEQ ID NO: 1465363 - RNA, 19 nt, Human
uuaauauccuaaacaucau

SEQ ID NO: 1465364 - RNA, 16 nt, Human
uuaauggcugauaauu

SEQ ID NO: 1465365 - RNA, 18 nt, Human
uuaagggaagaauuccag

SEQ ID NO: 1465366 - RNA, 18 nt, Human
uuaauaauguuucaaaca

SEQ ID NO: 1465367 - RNA, 16 nt, Human
uuaauagguuuggaca

SEQ ID NO: 1465368 - RNA, 19 nt, Human
uuaauaauuuagacuucaa

SEQ ID NO: 1465369 - RNA, 23 nt, Human
uuaacauuccucaugaauguaaa

SEQ ID NO: 1465370 - RNA, 15 nt, Human
uuaaagcuuccauug

SEQ ID NO: 1465371 - RNA, 20 nt, Human
uuaaagcuuccauuguuguc

SEQ ID NO: 1465372 - RNA, 19 nt, Human
uuaaauagcuuuuuucucu

SEQ ID NO: 1465373 - RNA, 14 nt, Human
uuaaagcuguuauu

SEQ ID NO: 1465374 - RNA, 11 nt, Human
uuaacauuccu

SEQ ID NO: 1465375 - RNA, 13 nt, Human
uuaaauguaaaga

SEQ ID NO: 1465376 - RNA, 17 nt, Human
uuaaauguaaagauauu

SEQ ID NO: 1465377 - RNA, 19 nt, Human
uuaaaagaaugauuaugaa

SEQ ID NO: 1465378 - RNA, 21 nt, Human
uuaaaacagacacuggcaugg

SEQ ID NO: 1465379 - RNA, 14 nt, Human
uuaaaacagacacu

SEQ ID NO: 1465380 - RNA, 23 nt, Human
uguuuuaaaaugagaaaucuaaa

SEQ ID NO: 1465381 - RNA, 13 nt, Human
uguuuuucacauu

SEQ ID NO: 1465382 - RNA, 12 nt, Human
uguuuuuucuaa

SEQ ID NO: 1465383 - RNA, 22 nt, Human
uguuucuauuuuuugaaaagca

SEQ ID NO: 1465384 - RNA, 16 nt, Human
uguuucuauuuuuuga

SEQ ID NO: 1465385 - RNA, 18 nt, Human
uguuuuaaaaugagaaau

SEQ ID NO: 1465386 - RNA, 17 nt, Human
uguuuguuuccuuuguu

SEQ ID NO: 1465387 - RNA, 23 nt, Human
uggguaggaaagaggaagcaaau

SEQ ID NO: 1465388 - RNA, 17 nt, Human
uggguaguggggaagag

SEQ ID NO: 1465389 - RNA, 16 nt, Human
uggguagccugggugu

SEQ ID NO: 1465390 - RNA, 12 nt, Human
uggguccaggag

SEQ ID NO: 1465391 - RNA, 14 nt, Human
uggguccaggagga

SEQ ID NO: 1465392 - RNA, 22 nt, Human
ugggguggggggggugcugggc

SEQ ID NO: 1465393 - RNA, 21 nt, Human
ugggguggggggggugcuggg

SEQ ID NO: 1465394 - RNA, 17 nt, Human
uggguagacacacauga

SEQ ID NO: 1465395 - RNA, 16 nt, Human
uggguagacacacaug

SEQ ID NO: 1465396 - RNA, 19 nt, Human
ugggguggggggggugcug

SEQ ID NO: 1465397 - RNA, 16 nt, Human
uggggcaggggccggg

SEQ ID NO: 1465398 - RNA, 18 nt, Human
uggggcaggggccggggg

SEQ ID NO: 1465399 - RNA, 16 nt, Human
uggguugcagacagga

SEQ ID NO: 1465400 - RNA, 21 nt, Human
uggguugcagacaggaaucuu

SEQ ID NO: 1465401 - RNA, 13 nt, Human
uggguccaggagg

SEQ ID NO: 1465402 - RNA, 13 nt, Human
ugggcauucaaau

SEQ ID NO: 1465403 - RNA, 16 nt, Human
ugggagcuuuuguaga

SEQ ID NO: 1465404 - RNA, 19 nt, Human
ugggagcugguuagaaaug

SEQ ID NO: 1465405 - RNA, 16 nt, Human
ugggagcuugggaaug

SEQ ID NO: 1465406 - RNA, 18 nt, Human
ugggagcugguuagaaau

SEQ ID NO: 1465407 - RNA, 20 nt, Human
ugggagcugguuagaaaugc

SEQ ID NO: 1465408 - RNA, 14 nt, Human
ugggccuugggcuc

SEQ ID NO: 1465409 - RNA, 15 nt, Human
ugggccuugggcucc

SEQ ID NO: 1465410 - RNA, 16 nt, Human
ugggccuugggcuccg

SEQ ID NO: 1465411 - RNA, 19 nt, Human
ugggacauuugcucaugga

SEQ ID NO: 1465412 - RNA, 20 nt, Human
ugggacauuugcucauggaa

SEQ ID NO: 1465413 - RNA, 17 nt, Human
ugggaccacaacuauuu

SEQ ID NO: 1465414 - RNA, 20 nt, Human
uggcuuugugauucaaucug

SEQ ID NO: 1465415 - RNA, 23 nt, Human
ugggaauggaggggcagagccag

SEQ ID NO: 1465416 - RNA, 18 nt, Human
ugggacagucaccucaug

SEQ ID NO: 1465417 - RNA, 20 nt, Human
ugggacagucaccucaugga

SEQ ID NO: 1465418 - RNA, 21 nt, Human
ugggacagucaccucauggaa

SEQ ID NO: 1465419 - RNA, 19 nt, Human
ugggaauggaggggcagag

SEQ ID NO: 1465420 - RNA, 17 nt, Human
ugggaauggaggggcag

SEQ ID NO: 1465421 - RNA, 18 nt, Human
uggcgcgaucucagcuca

SEQ ID NO: 1465422 - RNA, 21 nt, Human
uggcgcgaucucggcucacug

SEQ ID NO: 1465423 - RNA, 15 nt, Human
uggcgcaggaacuca

SEQ ID NO: 1465424 - RNA, 18 nt, Human
uggccuuguaagacccuu

SEQ ID NO: 1465425 - RNA, 22 nt, Human
uggccuuuauuaaaaacugagu

SEQ ID NO: 1465426 - RNA, 12 nt, Human
uggccuuuauua

SEQ ID NO: 1465427 - RNA, 23 nt, Human
uggccuuguaagacccuuauugc

SEQ ID NO: 1465428 - RNA, 20 nt, Human
uggcuggggcauggaaggca

SEQ ID NO: 1465429 - RNA, 14 nt, Human
uggcuggggcaugg

SEQ ID NO: 1465430 - RNA, 16 nt, Human
uggaauacucuuauau

SEQ ID NO: 1465431 - RNA, 14 nt, Human
uggaauacaugaaa

SEQ ID NO: 1465432 - RNA, 15 nt, Human
uggaauacaugaaau

SEQ ID NO: 1465433 - RNA, 23 nt, Human
uggaauguggccccugaacaaga

SEQ ID NO: 1465434 - RNA, 21 nt, Human
uggaauguggccccugaacaa

SEQ ID NO: 1465435 - RNA, 22 nt, Human
uggaaucacuguuuagaacaca

SEQ ID NO: 1465436 - RNA, 16 nt, Human
uggaaucagcucagga

SEQ ID NO: 1465437 - RNA, 19 nt, Human
uggaacccuaaauaauaaa

SEQ ID NO: 1465438 - RNA, 23 nt, Human
uggaacugucucucaugaaccuc

SEQ ID NO: 1465439 - RNA, 13 nt, Human
uggaacucugcuu

SEQ ID NO: 1465440 - RNA, 14 nt, Human
ugcuucuguuuuau

SEQ ID NO: 1465441 - RNA, 20 nt, Human
ugcuucuaguucugccagga

SEQ ID NO: 1465442 - RNA, 18 nt, Human
ugcuucuaguucugccag

SEQ ID NO: 1465443 - RNA, 19 nt, Human
ugcuucuaguucugccagg

SEQ ID NO: 1465444 - RNA, 13 nt, Human
uggagauguuuag

SEQ ID NO: 1465445 - RNA, 24 nt, Human
uggagaugaggccagaccauggac

SEQ ID NO: 1465446 - RNA, 14 nt, Human
uggagaugguggau

SEQ ID NO: 1465447 - RNA, 18 nt, Human
uggagaugaggccagacc

SEQ ID NO: 1465448 - RNA, 22 nt, Human
uggagaugaggccagaccaugg

SEQ ID NO: 1465449 - RNA, 19 nt, Human
uggagaugaggccagacca

SEQ ID NO: 1465450 - RNA, 15 nt, Human
uggagagggaaugug

SEQ ID NO: 1465451 - RNA, 16 nt, Human
uggagagggaauguga

SEQ ID NO: 1465452 - RNA, 17 nt, Human
uggagagggaaugugaa

SEQ ID NO: 1465453 - RNA, 19 nt, Human
uggagagggaaugugaaau

SEQ ID NO: 1465454 - RNA, 18 nt, Human
uggagagggaaugugaaa

SEQ ID NO: 1465455 - RNA, 18 nt, Human
uggacaggauguguuugc

SEQ ID NO: 1465456 - RNA, 12 nt, Human
uggacagcuugu

SEQ ID NO: 1465457 - RNA, 13 nt, Human
uggacagcuugug

SEQ ID NO: 1465458 - RNA, 13 nt, Human
uggacaggaugug

SEQ ID NO: 1465459 - RNA, 22 nt, Human
uggaggccauugugugagccua

SEQ ID NO: 1465460 - RNA, 16 nt, Human
uggauauaguuuuacu

SEQ ID NO: 1465461 - RNA, 14 nt, Human
uggaugacauuaaa

SEQ ID NO: 1465462 - RNA, 22 nt, Human
uggaugauccccacgccacagc

SEQ ID NO: 1465463 - RNA, 20 nt, Human
uggcaguuuauauuuaacuc

SEQ ID NO: 1465464 - RNA, 16 nt, Human
uggcaguuuauauuua

SEQ ID NO: 1465465 - RNA, 20 nt, Human
uggcaggcaggcucccaggg

SEQ ID NO: 1465466 - RNA, 12 nt, Human
uggcagaaaagu

SEQ ID NO: 1465467 - RNA, 16 nt, Human
ugcacuuggcugcaua

SEQ ID NO: 1465468 - RNA, 15 nt, Human
ugcacaucaaaauau

SEQ ID NO: 1465469 - RNA, 12 nt, Human
ugcacaucccug

SEQ ID NO: 1465470 - RNA, 13 nt, Human
ugcaccuaaagaa

SEQ ID NO: 1465471 - RNA, 14 nt, Human
ugcaccuaaagaaa

SEQ ID NO: 1465472 - RNA, 15 nt, Human
ugcaccuaaagaaaa

SEQ ID NO: 1465473 - RNA, 16 nt, Human
ugcaccuaaagaaaaa

SEQ ID NO: 1465474 - RNA, 19 nt, Human
ugcaccuaaagaaaaacaa

SEQ ID NO: 1465475 - RNA, 21 nt, Human
ugcaccuaaagaaaaacaaac

SEQ ID NO: 1465476 - RNA, 20 nt, Human
ugccaggcuggagugcagug

SEQ ID NO: 1465477 - RNA, 17 nt, Human
ugccaagagugaaggga

SEQ ID NO: 1465478 - RNA, 21 nt, Human
ugccaugaugccucugucuuc

SEQ ID NO: 1465479 - RNA, 20 nt, Human
ugccaugaugccucugucuu

SEQ ID NO: 1465480 - RNA, 15 nt, Human
ugcauuauauuuauu

SEQ ID NO: 1465481 - RNA, 20 nt, Human
ugcauuauauuuauuacugu

SEQ ID NO: 1465482 - RNA, 21 nt, Human
ugcauuauauuuauuacugua

SEQ ID NO: 1465483 - RNA, 16 nt, Human
ugccaaaaaaaaauac

SEQ ID NO: 1465484 - RNA, 14 nt, Human
ugccaagacugcug

SEQ ID NO: 1465485 - RNA, 17 nt, Human
ugccaagacugcugugg

SEQ ID NO: 1465486 - RNA, 21 nt, Human
ugccaagacugcuguggccag

SEQ ID NO: 1465487 - RNA, 22 nt, Human
ugccaagacugcuguggccagg

SEQ ID NO: 1465488 - RNA, 23 nt, Human
ugccaagacugcuguggccagga

SEQ ID NO: 1465489 - RNA, 21 nt, Human
ugcauccagccuggggcugag

SEQ ID NO: 1465490 - RNA, 16 nt, Human
ugcauguccuguaaag

SEQ ID NO: 1465491 - RNA, 19 nt, Human
ugcaggaaucuuuaaaaga

SEQ ID NO: 1465492 - RNA, 17 nt, Human
ugcaggaucucaccagg

SEQ ID NO: 1465493 - RNA, 19 nt, Human
ugcaggaucucaccaggca

SEQ ID NO: 1465494 - RNA, 20 nt, Human
ugcaggaucucaccaggcag

SEQ ID NO: 1465495 - RNA, 21 nt, Human
ugcaggaucucaccaggcagc

SEQ ID NO: 1465496 - RNA, 22 nt, Human
ugcaggaucucaccaggcagcc

SEQ ID NO: 1465497 - RNA, 15 nt, Human
ugcugauauuuucuc

SEQ ID NO: 1465498 - RNA, 21 nt, Human
ugcugauauuuucucuaggaa

SEQ ID NO: 1465499 - RNA, 18 nt, Human
ugcugauauuuucucuag

SEQ ID NO: 1465500 - RNA, 15 nt, Human
ugcugauggagccuu

SEQ ID NO: 1465501 - RNA, 16 nt, Human
ugcugauggagccuuc

SEQ ID NO: 1465502 - RNA, 15 nt, Human
ugcucaggagcccug

SEQ ID NO: 1465503 - RNA, 11 nt, Human
ugcucauggaa

SEQ ID NO: 1465504 - RNA, 14 nt, Human
ugcucaggagcccu

SEQ ID NO: 1465505 - RNA, 17 nt, Human
ugcucagcuucuccaac

SEQ ID NO: 1465506 - RNA, 20 nt, Human
ugcucagcuucuccaacaau

SEQ ID NO: 1465507 - RNA, 21 nt, Human
ugcuaggguuaggagguccuu

SEQ ID NO: 1465508 - RNA, 20 nt, Human
ugcuaggguuaggagguccu

SEQ ID NO: 1465509 - RNA, 18 nt, Human
ugcgugguggucccuggg

SEQ ID NO: 1465510 - RNA, 19 nt, Human
ugcgugguggucccugggu

SEQ ID NO: 1465511 - RNA, 21 nt, Human
ugcgugguggucccuggguag

SEQ ID NO: 1465512 - RNA, 23 nt, Human
ugcgguucaggaaaauugaaugc

SEQ ID NO: 1465513 - RNA, 22 nt, Human
ugccuucucaacuccaaacuga

SEQ ID NO: 1465514 - RNA, 15 nt, Human
ugccuuccuguuuuu

SEQ ID NO: 1465515 - RNA, 19 nt, Human
ugccuuccuguuuuucaca

SEQ ID NO: 1465516 - RNA, 21 nt, Human
ugcgcccuuaacugcauccag

SEQ ID NO: 1465517 - RNA, 15 nt, Human
ugccuggcggggugg

SEQ ID NO: 1465518 - RNA, 12 nt, Human
ugccuucauuug

SEQ ID NO: 1465519 - RNA, 15 nt, Human
ugccuuccagaaaac

SEQ ID NO: 1465520 - RNA, 18 nt, Human
ugccuuccagaaaacaaa

SEQ ID NO: 1465521 - RNA, 22 nt, Human
ugccuaaguccaguguuucuuu

SEQ ID NO: 1465522 - RNA, 16 nt, Human
ugccucugucuucugg

SEQ ID NO: 1465523 - RNA, 15 nt, Human
ugccugaauauuugu

SEQ ID NO: 1465524 - RNA, 18 nt, Human
ugccucugucuucuggac

SEQ ID NO: 1465525 - RNA, 22 nt, Human
ucuguuuuauaauuuugugaag

SEQ ID NO: 1465526 - RNA, 17 nt, Human
ucuguuaugcugugaca

SEQ ID NO: 1465527 - RNA, 19 nt, Human
ucuguucacuuuuccuccc

SEQ ID NO: 1465528 - RNA, 21 nt, Human
ucuguucacuuuuccucccuc

SEQ ID NO: 1465529 - RNA, 22 nt, Human
ucuguucacuuuuccucccuca

SEQ ID NO: 1465530 - RNA, 20 nt, Human
ucuguccguucacaugugug

SEQ ID NO: 1465531 - RNA, 21 nt, Human
ucuguaaaacuaagaaacuua

SEQ ID NO: 1465532 - RNA, 14 nt, Human
ucuguaaaacuaag

SEQ ID NO: 1465533 - RNA, 18 nt, Human
ucuguaagcauaagcuua

SEQ ID NO: 1465534 - RNA, 13 nt, Human
ucuggcucugucu

SEQ ID NO: 1465535 - RNA, 23 nt, Human
ucuggagcccacuguacuugcuc

SEQ ID NO: 1465536 - RNA, 21 nt, Human
ucuuguccccaacaccccaca

SEQ ID NO: 1465537 - RNA, 18 nt, Human
ucuuuaaaaggaaagaaa

SEQ ID NO: 1465538 - RNA, 16 nt, Human
ucuuuaaaaggaaaga

SEQ ID NO: 1465539 - RNA, 11 nt, Human
ucuugucaugu

SEQ ID NO: 1465540 - RNA, 13 nt, Human
ucuugucaugugu

SEQ ID NO: 1465541 - RNA, 15 nt, Human
ucuugucauguguau

SEQ ID NO: 1465542 - RNA, 17 nt, Human
ucuugucauguguauaa

SEQ ID NO: 1465543 - RNA, 16 nt, Human
ucuugccucaaccucc

SEQ ID NO: 1465544 - RNA, 16 nt, Human
ucuucuauugccucug

SEQ ID NO: 1465545 - RNA, 13 nt, Human
ucuucuauuuugu

SEQ ID NO: 1465546 - RNA, 15 nt, Human
ucuucuauugccucu

SEQ ID NO: 1465547 - RNA, 14 nt, Human
ucuucuauugccuc

SEQ ID NO: 1465548 - RNA, 14 nt, Human
ucuucuaccaccca

SEQ ID NO: 1465549 - RNA, 12 nt, Human
ucuuaaaacucc

SEQ ID NO: 1465550 - RNA, 13 nt, Human
ucuuaaaacuccu

SEQ ID NO: 1465551 - RNA, 17 nt, Human
ucuuucacauuuaaaua

SEQ ID NO: 1465552 - RNA, 19 nt, Human
ucuuuaaaagaugcuuuua

SEQ ID NO: 1465553 - RNA, 19 nt, Human
ucuuuuguaagguuuuugu

SEQ ID NO: 1465554 - RNA, 19 nt, Human
ucuuuuugggagagacuug

SEQ ID NO: 1465555 - RNA, 19 nt, Human
ucuuuuuuaaaugaagaaa

SEQ ID NO: 1465556 - RNA, 22 nt, Human
ucuuuuugggagagacuuguuu

SEQ ID NO: 1465557 - RNA, 13 nt, Human
ugaaagauucaau

SEQ ID NO: 1465558 - RNA, 16 nt, Human
ugaaaagauaaauuau

SEQ ID NO: 1465559 - RNA, 14 nt, Human
ugaaauccugcuuc

SEQ ID NO: 1465560 - RNA, 19 nt, Human
ugaaaugcagagucaauga

SEQ ID NO: 1465561 - RNA, 19 nt, Human
ugaaauggacuuuuguaca

SEQ ID NO: 1465562 - RNA, 17 nt, Human
ugaacaccauugaaggc

SEQ ID NO: 1465563 - RNA, 20 nt, Human
ugaacaccauugaaggcuua

SEQ ID NO: 1465564 - RNA, 13 nt, Human
ugaacagaacaua

SEQ ID NO: 1465565 - RNA, 17 nt, Human
ugaacauauuguugaaa

SEQ ID NO: 1465566 - RNA, 15 nt, Human
ugaacucuucacucu

SEQ ID NO: 1465567 - RNA, 13 nt, Human
ugaacugaacacc

SEQ ID NO: 1465568 - RNA, 14 nt, Human
ugaacugaacacca

SEQ ID NO: 1465569 - RNA, 12 nt, Human
ugaacugaacac

SEQ ID NO: 1465570 - RNA, 12 nt, Human
ugaacugauuca

SEQ ID NO: 1465571 - RNA, 17 nt, Human
ugaacugauucacaucu

SEQ ID NO: 1465572 - RNA, 20 nt, Human
ugaacugauucacaucucau

SEQ ID NO: 1465573 - RNA, 21 nt, Human
ugaacugauucacaucucauu

SEQ ID NO: 1465574 - RNA, 22 nt, Human
ugaacugaacaccauugaaggc

SEQ ID NO: 1465575 - RNA, 19 nt, Human
ugaagagguuuuaaagcuu

SEQ ID NO: 1465576 - RNA, 15 nt, Human
ugaagauauuuuucc

SEQ ID NO: 1465577 - RNA, 21 nt, Human
ugaaguccaagcauuuagaug

SEQ ID NO: 1465578 - RNA, 22 nt, Human
ugaaguccaagcauuuagaugu

SEQ ID NO: 1465579 - RNA, 22 nt, Human
ugaacuuguaaaggaauuuaaa

SEQ ID NO: 1465580 - RNA, 10 nt, Human
ucggaccagc

SEQ ID NO: 1465581 - RNA, 16 nt, Human
ucgcuucauguaacua

SEQ ID NO: 1465582 - RNA, 21 nt, Human
ucgcccagcggcaucaggcuu

SEQ ID NO: 1465583 - RNA, 17 nt, Human
uccuuuuuccaacaaga

SEQ ID NO: 1465584 - RNA, 15 nt, Human
uccuuuuuccaacaa

SEQ ID NO: 1465585 - RNA, 17 nt, Human
uccuuggccaugcagaa

SEQ ID NO: 1465586 - RNA, 16 nt, Human
uccuguauucagacag

SEQ ID NO: 1465587 - RNA, 17 nt, Human
uccuguauucagacaga

SEQ ID NO: 1465588 - RNA, 20 nt, Human
uccuguauucagacagauga

SEQ ID NO: 1465589 - RNA, 19 nt, Human
uccuguaaagguuacaagc

SEQ ID NO: 1465590 - RNA, 20 nt, Human
uccuggugccaauuucaagu

SEQ ID NO: 1465591 - RNA, 21 nt, Human
uccuggugccaauuucaaguu

SEQ ID NO: 1465592 - RNA, 22 nt, Human
uccuugauuuuagccuucucug

SEQ ID NO: 1465593 - RNA, 23 nt, Human
uccuugauuuuagccuucucugu

SEQ ID NO: 1465594 - RNA, 21 nt, Human
uccuuacaaguuagaaaacau

SEQ ID NO: 1465595 - RNA, 22 nt, Human
uccuuacaaguuagaaaacaua

SEQ ID NO: 1465596 - RNA, 21 nt, Human
uccuucaaaguuuaauaaauu

SEQ ID NO: 1465597 - RNA, 18 nt, Human
uccuucaacaauucuaaa

SEQ ID NO: 1465598 - RNA, 20 nt, Human
uccuucaacaauucuaaaau

SEQ ID NO: 1465599 - RNA, 16 nt, Human
uccuuaaggcucuuuu

SEQ ID NO: 1465600 - RNA, 21 nt, Human
uccuguauucagacagaugag

SEQ ID NO: 1465601 - RNA, 19 nt, Human
uccuuaaggcucuuuugua

SEQ ID NO: 1465602 - RNA, 17 nt, Human
uccuuaagucagaacag

SEQ ID NO: 1465603 - RNA, 16 nt, Human
ucuaaauucuuucauu

SEQ ID NO: 1465604 - RNA, 21 nt, Human
ucuacacuaagagagaaugag

SEQ ID NO: 1465605 - RNA, 13 nt, Human
ucuaacucagcaa

SEQ ID NO: 1465606 - RNA, 17 nt, Human
ucuagaacacaggcaaa

SEQ ID NO: 1465607 - RNA, 19 nt, Human
ucuacacucuuguaauaaa

SEQ ID NO: 1465608 - RNA, 15 nt, Human
ucucaacuccaaacu

SEQ ID NO: 1465609 - RNA, 16 nt, Human
ucucaaacuccugacc

SEQ ID NO: 1465610 - RNA, 21 nt, Human
ucucaaacuccugaccucagg

SEQ ID NO: 1465611 - RNA, 23 nt, Human
ucucaaacuccugaccucaggca

SEQ ID NO: 1465612 - RNA, 24 nt, Human
ucuaguauuccagaccugaagaau

SEQ ID NO: 1465613 - RNA, 14 nt, Human
ucucaguugcagcc

SEQ ID NO: 1465614 - RNA, 15 nt, Human
ucucucgugaguaua

SEQ ID NO: 1465615 - RNA, 19 nt, Human
ucucugauuuucaaagcuu

SEQ ID NO: 1465616 - RNA, 20 nt, Human
ucucugauuuucaaagcuuu

SEQ ID NO: 1465617 - RNA, 12 nt, Human
ucucugaacaca

SEQ ID NO: 1465618 - RNA, 19 nt, Human
ucucuauaccaauaaagug

SEQ ID NO: 1465619 - RNA, 17 nt, Human
ucucuauaccaauaaag

SEQ ID NO: 1465620 - RNA, 16 nt, Human
ucucuauaccaauaaa

SEQ ID NO: 1465621 - RNA, 14 nt, Human
ucucuauaccaaua

SEQ ID NO: 1465622 - RNA, 13 nt, Human
ucucuaggaaaua

SEQ ID NO: 1465623 - RNA, 19 nt, Human
ucucuaggaaauauuuauu

SEQ ID NO: 1465624 - RNA, 20 nt, Human
ucucuaccacugcugauauu

SEQ ID NO: 1465625 - RNA, 20 nt, Human
ucucuucugaauaaagcaau

SEQ ID NO: 1465626 - RNA, 19 nt, Human
ucucuucugaauaaagcaa

SEQ ID NO: 1465627 - RNA, 11 nt, Human
ucucugcaggu

SEQ ID NO: 1465628 - RNA, 15 nt, Human
ucucuuauugccuca

SEQ ID NO: 1465629 - RNA, 16 nt, Human
ucucuuauugccucac

SEQ ID NO: 1465630 - RNA, 17 nt, Human
ucucugcaaacugccuu

SEQ ID NO: 1465631 - RNA, 19 nt, Human
ucucugcaaacugccuucu

SEQ ID NO: 1465632 - RNA, 17 nt, Human
ucucuucagucucuaua

SEQ ID NO: 1465633 - RNA, 13 nt, Human
ucucuucagucuc

SEQ ID NO: 1465634 - RNA, 22 nt, Human
ucucuuauugccucacuucagg

SEQ ID NO: 1465635 - RNA, 14 nt, Human
ucugaaauuuccug

SEQ ID NO: 1465636 - RNA, 12 nt, Human
ucugaacucaaa

SEQ ID NO: 1465637 - RNA, 14 nt, Human
ucugaacucaaacu

SEQ ID NO: 1465638 - RNA, 16 nt, Human
ucugaacucaaacuga

SEQ ID NO: 1465639 - RNA, 17 nt, Human
ucugaacucaaacugag

SEQ ID NO: 1465640 - RNA, 21 nt, Human
ucugaacucaaacugaggaau

SEQ ID NO: 1465641 - RNA, 19 nt, Human
ucugauucgaaugacacug

SEQ ID NO: 1465642 - RNA, 22 nt, Human
ucugauucgaaugacacuguuc

SEQ ID NO: 1465643 - RNA, 20 nt, Human
ucugauucgaaugacacugu

SEQ ID NO: 1465644 - RNA, 17 nt, Human
ucugacauucugauucg

SEQ ID NO: 1465645 - RNA, 21 nt, Human
ucagcacuuuagaauaugccu

SEQ ID NO: 1465646 - RNA, 17 nt, Human
ucagcagccucccugaa

SEQ ID NO: 1465647 - RNA, 12 nt, Human
ucaguugcagcc

SEQ ID NO: 1465648 - RNA, 17 nt, Human
ucaguugauuuucugga

SEQ ID NO: 1465649 - RNA, 18 nt, Human
ucaguugauuuucuggau

SEQ ID NO: 1465650 - RNA, 15 nt, Human
ucauaauuauuauuu

SEQ ID NO: 1465651 - RNA, 14 nt, Human
ucauacauuuucua

SEQ ID NO: 1465652 - RNA, 13 nt, Human
ucauacacagaaa

SEQ ID NO: 1465653 - RNA, 19 nt, Human
ucauguaagcugaaaauau

SEQ ID NO: 1465654 - RNA, 18 nt, Human
ucauguaagcugaaaaua

SEQ ID NO: 1465655 - RNA, 20 nt, Human
ucauguaacuucccugaaaa

SEQ ID NO: 1465656 - RNA, 15 nt, Human
ucaugcuaucucugu

SEQ ID NO: 1465657 - RNA, 22 nt, Human
ucaugcuaauuauauaauauuu

SEQ ID NO: 1465658 - RNA, 21 nt, Human
ucauacauuuucuaagaaaca

SEQ ID NO: 1465659 - RNA, 14 nt, Human
ucaucucuucuuuu

SEQ ID NO: 1465660 - RNA, 22 nt, Human
ucauucagauaugauucaaaug

SEQ ID NO: 1465661 - RNA, 16 nt, Human
uccaaaagauugcuga

SEQ ID NO: 1465662 - RNA, 23 nt, Human
ucauuucuuuuugggagagacuu

SEQ ID NO: 1465663 - RNA, 23 nt, Human
uccaaacugacucuuaagaagac

SEQ ID NO: 1465664 - RNA, 19 nt, Human
uccaaaagauugcugaaau

SEQ ID NO: 1465665 - RNA, 20 nt, Human
uccaaaagauugcugaaauu

SEQ ID NO: 1465666 - RNA, 22 nt, Human
uccaaaagauugcugaaauuuu

SEQ ID NO: 1465667 - RNA, 13 nt, Human
uccaaaagcuuuu

SEQ ID NO: 1465668 - RNA, 16 nt, Human
uccaaaagcuuuuuau

SEQ ID NO: 1465669 - RNA, 22 nt, Human
ucauuucuuuuugggagagacu

SEQ ID NO: 1465670 - RNA, 14 nt, Human
uccaagaauuucua

SEQ ID NO: 1465671 - RNA, 22 nt, Human
uccaaaggaggauggcauauaa

SEQ ID NO: 1465672 - RNA, 16 nt, Human
uccaaagcuucccacg

SEQ ID NO: 1465673 - RNA, 13 nt, Human
uccaagcaaaugu

SEQ ID NO: 1465674 - RNA, 17 nt, Human
uccaagcauuuagaugu

SEQ ID NO: 1465675 - RNA, 17 nt, Human
uccaagacaugucuguu

SEQ ID NO: 1465676 - RNA, 20 nt, Human
uccaagacaugucuguucua

SEQ ID NO: 1465677 - RNA, 22 nt, Human
uccaagacaugucuguucuaca

SEQ ID NO: 1465678 - RNA, 16 nt, Human
uccagauccuggaaau

SEQ ID NO: 1465679 - RNA, 17 nt, Human
uccagauccuggaaauc

SEQ ID NO: 1465680 - RNA, 14 nt, Human
uccagauccuggaa

SEQ ID NO: 1465681 - RNA, 22 nt, Human
uccagcagauuuccagccuucu

SEQ ID NO: 1465682 - RNA, 19 nt, Human
uccagaaauacaauuuuag

SEQ ID NO: 1465683 - RNA, 18 nt, Human
uccaccgcagaaggaagg

SEQ ID NO: 1465684 - RNA, 17 nt, Human
uccaccgcagaaggaag

SEQ ID NO: 1465685 - RNA, 16 nt, Human
uccaccgcagaaggaa

SEQ ID NO: 1465686 - RNA, 15 nt, Human
uccaccgcagaagga

SEQ ID NO: 1465687 - RNA, 14 nt, Human
uccaccucaacucc

SEQ ID NO: 1465688 - RNA, 15 nt, Human
uccaagcaaauguga

SEQ ID NO: 1465689 - RNA, 20 nt, Human
uccaagcauuuagauguaua

SEQ ID NO: 1465690 - RNA, 22 nt, Human
uccaauuuucuggaauacauga

SEQ ID NO: 1465691 - RNA, 21 nt, Human
ucccaaguaacugggauuaca

SEQ ID NO: 1465692 - RNA, 20 nt, Human
ucccaaguaacugggauuac

SEQ ID NO: 1465693 - RNA, 15 nt, Human
ucccaggagacaguu

SEQ ID NO: 1465694 - RNA, 16 nt, Human
ucccaggagacaguuc

SEQ ID NO: 1465695 - RNA, 22 nt, Human
ucccaggagacaguucaagaaa

SEQ ID NO: 1465696 - RNA, 13 nt, Human
ucccauuccccca

SEQ ID NO: 1465697 - RNA, 19 nt, Human
ucccauucccccagugcgg

SEQ ID NO: 1465698 - RNA, 14 nt, Human
uccauggcccugcc

SEQ ID NO: 1465699 - RNA, 18 nt, Human
uccauggcaggaaggcuu

SEQ ID NO: 1465700 - RNA, 14 nt, Human
ucccuaauaaagcu

SEQ ID NO: 1465701 - RNA, 13 nt, Human
ucccuaauaaagc

SEQ ID NO: 1465702 - RNA, 15 nt, Human
ucccuacugaagccc

SEQ ID NO: 1465703 - RNA, 18 nt, Human
ucccuacugaagcccuug

SEQ ID NO: 1465704 - RNA, 21 nt, Human
ucccuacugaagcccuuguga

SEQ ID NO: 1465705 - RNA, 12 nt, Human
ucccuaauaaag

SEQ ID NO: 1465706 - RNA, 11 nt, Human
ucccuaauaaa

SEQ ID NO: 1465707 - RNA, 14 nt, Human
ucccuaagccagcu

SEQ ID NO: 1465708 - RNA, 13 nt, Human
ucccuaagccagc

SEQ ID NO: 1465709 - RNA, 11 nt, Human
ucccuaagcca

SEQ ID NO: 1465710 - RNA, 18 nt, Human
uccccuggaacugucucu

SEQ ID NO: 1465711 - RNA, 20 nt, Human
uccccuggaacugucucuca

SEQ ID NO: 1465712 - RNA, 14 nt, Human
uccccgcacccccc

SEQ ID NO: 1465713 - RNA, 21 nt, Human
uccccgcaccccccaagcugu

SEQ ID NO: 1465714 - RNA, 13 nt, Human
uccccugcacugu

SEQ ID NO: 1465715 - RNA, 14 nt, Human
uccccugcacugua

SEQ ID NO: 1465716 - RNA, 15 nt, Human
uccccugcacuguaa

SEQ ID NO: 1465717 - RNA, 16 nt, Human
uccccugcacuguaaa

SEQ ID NO: 1465718 - RNA, 17 nt, Human
uccccugcacuguaaaa

SEQ ID NO: 1465719 - RNA, 18 nt, Human
uccccugcacuguaaaau

SEQ ID NO: 1465720 - RNA, 19 nt, Human
uccccugcacuguaaaaug

SEQ ID NO: 1465721 - RNA, 22 nt, Human
uccccugcacuguaaaaugugg

SEQ ID NO: 1465722 - RNA, 12 nt, Human
ucccccagugcg

SEQ ID NO: 1465723 - RNA, 18 nt, Human
ucccccuccucuccacca

SEQ ID NO: 1465724 - RNA, 15 nt, Human
ucacucugaguguuu

SEQ ID NO: 1465725 - RNA, 20 nt, Human
ucacucugaguguuuuauga

SEQ ID NO: 1465726 - RNA, 14 nt, Human
ucacgcuuuccuga

SEQ ID NO: 1465727 - RNA, 15 nt, Human
ucacgcuuuccugaa

SEQ ID NO: 1465728 - RNA, 16 nt, Human
ucacgcuuuccugaau

SEQ ID NO: 1465729 - RNA, 17 nt, Human
ucacgcuuuccugaauc

SEQ ID NO: 1465730 - RNA, 22 nt, Human
ucacgcuuuccugaauccaaac

SEQ ID NO: 1465731 - RNA, 16 nt, Human
ucacgcuuuuugaaaa

SEQ ID NO: 1465732 - RNA, 18 nt, Human
ucacgccagacuucccac

SEQ ID NO: 1465733 - RNA, 21 nt, Human
ucagcaaacaggaucaguuaa

SEQ ID NO: 1465734 - RNA, 15 nt, Human
ucagcaaacucuuuu

SEQ ID NO: 1465735 - RNA, 21 nt, Human
ucagaguugcugcaaaccuga

SEQ ID NO: 1465736 - RNA, 15 nt, Human
ucagcaaacaggauc

SEQ ID NO: 1465737 - RNA, 22 nt, Human
ucagaguugaugguuguacaua

SEQ ID NO: 1465738 - RNA, 19 nt, Human
ucagcaaguuagaacuagc

SEQ ID NO: 1465739 - RNA, 16 nt, Human
ucagcaacucgcuuua

SEQ ID NO: 1465740 - RNA, 21 nt, Human
ucagcaaguuagaacuagcca

SEQ ID NO: 1465741 - RNA, 19 nt, Human
ucagacucuaagaaagaac

SEQ ID NO: 1465742 - RNA, 17 nt, Human
ucagacucuaagaaaga

SEQ ID NO: 1465743 - RNA, 18 nt, Human
ucagacucuaagaaagaa

SEQ ID NO: 1465744 - RNA, 17 nt, Human
ucacuugucaauaaaau

SEQ ID NO: 1465745 - RNA, 16 nt, Human
ucacuuguacaaaaua

SEQ ID NO: 1465746 - RNA, 17 nt, Human
ucacuuguacaaaauaa

SEQ ID NO: 1465747 - RNA, 13 nt, Human
ucacuuguacaaa

SEQ ID NO: 1465748 - RNA, 14 nt, Human
ucacuuguacaaaa

SEQ ID NO: 1465749 - RNA, 15 nt, Human
ucacuuguacaaaau

SEQ ID NO: 1465750 - RNA, 17 nt, Human
ucacucugaguguuuua

SEQ ID NO: 1465751 - RNA, 12 nt, Human
ucacuuuuccuc

SEQ ID NO: 1465752 - RNA, 14 nt, Human
ucacuuucuagauu

SEQ ID NO: 1465753 - RNA, 14 nt, Human
ucacuuucucaguu

SEQ ID NO: 1465754 - RNA, 19 nt, Human
ucacuuuuaaugaacaaau

SEQ ID NO: 1465755 - RNA, 21 nt, Human
ucacuuuuaaugaacaaaugg

SEQ ID NO: 1465756 - RNA, 13 nt, Human
ucacuuuuccucc

SEQ ID NO: 1465757 - RNA, 18 nt, Human
ucacuuuuccucccucag

SEQ ID NO: 1465758 - RNA, 20 nt, Human
ucagaaaauaucccuccugu

SEQ ID NO: 1465759 - RNA, 16 nt, Human
uauuuuauguugcaua

SEQ ID NO: 1465760 - RNA, 15 nt, Human
uauuuuauguugcau

SEQ ID NO: 1465761 - RNA, 13 nt, Human
uauuuucaagaaa

SEQ ID NO: 1465762 - RNA, 16 nt, Human
uauuuucaagaaacug

SEQ ID NO: 1465763 - RNA, 14 nt, Human
uauuuucagaugug

SEQ ID NO: 1465764 - RNA, 13 nt, Human
uauuuucuuggau

SEQ ID NO: 1465765 - RNA, 18 nt, Human
uauuuugacauaaaguug

SEQ ID NO: 1465766 - RNA, 17 nt, Human
uauuuugacauaaaguu

SEQ ID NO: 1465767 - RNA, 22 nt, Human
uauuuuuuucugaauuauuuuc

SEQ ID NO: 1465768 - RNA, 16 nt, Human
uauuuuuuucugaaau

SEQ ID NO: 1465769 - RNA, 17 nt, Human
uauuuuuuucugaaauu

SEQ ID NO: 1465770 - RNA, 13 nt, Human
ucaaaaaauugca

SEQ ID NO: 1465771 - RNA, 12 nt, Human
ucaaaacauugu

SEQ ID NO: 1465772 - RNA, 22 nt, Human
ucaaaacauugugccaugucaa

SEQ ID NO: 1465773 - RNA, 18 nt, Human
ucaaacuacauauuguaa

SEQ ID NO: 1465774 - RNA, 13 nt, Human
uauuuauuacugu

SEQ ID NO: 1465775 - RNA, 22 nt, Human
uauuucuaugaaauauuauguu

SEQ ID NO: 1465776 - RNA, 21 nt, Human
uauuucuaugaaauauuaugu

SEQ ID NO: 1465777 - RNA, 20 nt, Human
uaucugaauuuuuaaacaag

SEQ ID NO: 1465778 - RNA, 19 nt, Human
uaucugaauuuuuaaacaa

SEQ ID NO: 1465779 - RNA, 13 nt, Human
uauuucuuaaaca

SEQ ID NO: 1465780 - RNA, 16 nt, Human
uauuucuuaaacacuu

SEQ ID NO: 1465781 - RNA, 19 nt, Human
uauuucuuaaaucuaguaa

SEQ ID NO: 1465782 - RNA, 21 nt, Human
uauuuuagugaacuugaaaua

SEQ ID NO: 1465783 - RNA, 19 nt, Human
ucaacuccaaacugacucu

SEQ ID NO: 1465784 - RNA, 19 nt, Human
ucaaaacagauuguuugca

SEQ ID NO: 1465785 - RNA, 11 nt, Human
ucaaccucauc

SEQ ID NO: 1465786 - RNA, 12 nt, Human
ucaaccucccaa

SEQ ID NO: 1465787 - RNA, 18 nt, Human
ucaaacuccugaccucag

SEQ ID NO: 1465788 - RNA, 20 nt, Human
ucaaacuccugaccucaggc

SEQ ID NO: 1465789 - RNA, 21 nt, Human
ucaaacuccugaccucaggca

SEQ ID NO: 1465790 - RNA, 15 nt, Human
ucaaacugaggaauu

SEQ ID NO: 1465791 - RNA, 16 nt, Human
ucaagccccggacuca

SEQ ID NO: 1465792 - RNA, 23 nt, Human
ucacaggacagcccuucuuucca

SEQ ID NO: 1465793 - RNA, 16 nt, Human
ucacaauaauuuucua

SEQ ID NO: 1465794 - RNA, 15 nt, Human
ucacaauaauuuucu

SEQ ID NO: 1465795 - RNA, 16 nt, Human
guuuaguaaucauauu

SEQ ID NO: 1465796 - RNA, 14 nt, Human
gguugcagacagga

SEQ ID NO: 1465797 - RNA, 16 nt, Human
guuuacuuguuucaga

SEQ ID NO: 1465798 - RNA, 16 nt, Human
guuuccuuauauuaug

SEQ ID NO: 1465799 - RNA, 16 nt, Human
guuucccaagagcuac

SEQ ID NO: 1465800 - RNA, 22 nt, Human
guuucaggagagaguugaaccu

SEQ ID NO: 1465801 - RNA, 23 nt, Human
guuucaggagagaguugaaccua

SEQ ID NO: 1465802 - RNA, 18 nt, Human
guuucuuuguaaugaaaa

SEQ ID NO: 1465803 - RNA, 17 nt, Human
guuucuuuguaaugaaa

SEQ ID NO: 1465804 - RNA, 14 nt, Human
guuucuuuguaaug

SEQ ID NO: 1465805 - RNA, 12 nt, Human
guuucuuucuuu

SEQ ID NO: 1465806 - RNA, 23 nt, Human
guuucuuucuuucuuuauuuuga

SEQ ID NO: 1465807 - RNA, 16 nt, Human
guuugugacagggcgg

SEQ ID NO: 1465808 - RNA, 17 nt, Human
guuugugacagggcggg

SEQ ID NO: 1465809 - RNA, 16 nt, Human
guuugauagauuuucu

SEQ ID NO: 1465810 - RNA, 11 nt, Human
uaaaaaacacu

SEQ ID NO: 1465811 - RNA, 22 nt, Human
uaaaaaaauaagaagaaugcuu

SEQ ID NO: 1465812 - RNA, 15 nt, Human
uaaaaaaauaagaag

SEQ ID NO: 1465813 - RNA, 20 nt, Human
uaaaaaaauaagaagaaugc

SEQ ID NO: 1465814 - RNA, 16 nt, Human
guuuuucacauuuucc

SEQ ID NO: 1465815 - RNA, 12 nt, Human
guuuuucacauu

SEQ ID NO: 1465816 - RNA, 14 nt, Human
guuuuucacauuuu

SEQ ID NO: 1465817 - RNA, 21 nt, Human
guuuuuaucugaaaucaauua

SEQ ID NO: 1465818 - RNA, 17 nt, Human
uaaaaacaaagaaauua

SEQ ID NO: 1465819 - RNA, 14 nt, Human
uaaaaaauggucac

SEQ ID NO: 1465820 - RNA, 19 nt, Human
uaaaaaagcuuaaaacuuu

SEQ ID NO: 1465821 - RNA, 17 nt, Human
uaaaaaagaucccaaau

SEQ ID NO: 1465822 - RNA, 17 nt, Human
uaaaaaagcuuaaaacu

SEQ ID NO: 1465823 - RNA, 18 nt, Human
uaaaaaagcuuaaaacuu

SEQ ID NO: 1465824 - RNA, 20 nt, Human
uaaaaacuagaggugagaaa

SEQ ID NO: 1465825 - RNA, 21 nt, Human
uaaaaacugagugacucuaua

SEQ ID NO: 1465826 - RNA, 16 nt, Human
uaaaaacugagugacu

SEQ ID NO: 1465827 - RNA, 19 nt, Human
uaaaaaugauuucaguagc

SEQ ID NO: 1465828 - RNA, 16 nt, Human
uaaaaaagaaacauuu

SEQ ID NO: 1465829 - RNA, 17 nt, Human
uaaaaaacuaaaaacua

SEQ ID NO: 1465830 - RNA, 19 nt, Human
uaaaaaacuaaaaacuaga

SEQ ID NO: 1465831 - RNA, 20 nt, Human
uaaaaaagcuuaaaacuuug

SEQ ID NO: 1465832 - RNA, 12 nt, Human
uaaaaaacacug

SEQ ID NO: 1465833 - RNA, 18 nt, Human
guuuucaggcuagaugua

SEQ ID NO: 1465834 - RNA, 23 nt, Human
guuugugccuuuuuauuuuuguu

SEQ ID NO: 1465835 - RNA, 13 nt, Human
guuuucuccuccc

SEQ ID NO: 1465836 - RNA, 16 nt, Human
guuuucuccucccagg

SEQ ID NO: 1465837 - RNA, 18 nt, Human
guuuucuccucccaggaa

SEQ ID NO: 1465838 - RNA, 21 nt, Human
guuuucuccucccaggaacug

SEQ ID NO: 1465839 - RNA, 18 nt, Human
guuuucuccaagagcuac

SEQ ID NO: 1465840 - RNA, 14 nt, Human
guuuucucugaaca

SEQ ID NO: 1465841 - RNA, 16 nt, Human
uaaaaugagaaaucua

SEQ ID NO: 1465842 - RNA, 15 nt, Human
uaaaaugagaaaucu

SEQ ID NO: 1465843 - RNA, 13 nt, Human
uaaaaugagaaau

SEQ ID NO: 1465844 - RNA, 23 nt, Human
uaaaaucuugucauguguauaaa

SEQ ID NO: 1465845 - RNA, 20 nt, Human
uaaaaucuugucauguguau

SEQ ID NO: 1465846 - RNA, 19 nt, Human
uaaaaucuugucaugugua

SEQ ID NO: 1465847 - RNA, 21 nt, Human
uaaaaucuugucauguguaua

SEQ ID NO: 1465848 - RNA, 22 nt, Human
uaaaaucuugucauguguauaa

SEQ ID NO: 1465849 - RNA, 13 nt, Human
uaaaauauuuauu

SEQ ID NO: 1465850 - RNA, 19 nt, Human
uaaaauccauacauuugug

SEQ ID NO: 1465851 - RNA, 21 nt, Human
uaaaagggacugagaaauuua

SEQ ID NO: 1465852 - RNA, 20 nt, Human
uaaaagggacugagaaauuu

SEQ ID NO: 1465853 - RNA, 19 nt, Human
uaaaagggacugagaaauu

SEQ ID NO: 1465854 - RNA, 17 nt, Human
uaaaagggacugagaaa

SEQ ID NO: 1465855 - RNA, 22 nt, Human
uaaaaauggaaacuauauugac

SEQ ID NO: 1465856 - RNA, 15 nt, Human
uaaaaaugaucuaaa

SEQ ID NO: 1465857 - RNA, 16 nt, Human
uaaaaaugauuucagu

SEQ ID NO: 1465858 - RNA, 12 nt, Human
uaaaagaugcuu

SEQ ID NO: 1465859 - RNA, 14 nt, Human
uaaaagaugcuuuu

SEQ ID NO: 1465860 - RNA, 15 nt, Human
uaaaagaugcuuuua

SEQ ID NO: 1465861 - RNA, 21 nt, Human
uaaacacucuugaaaaaugca

SEQ ID NO: 1465862 - RNA, 22 nt, Human
uaaacaaguauuuguuaauuua

SEQ ID NO: 1465863 - RNA, 14 nt, Human
uaaacacagacagg

SEQ ID NO: 1465864 - RNA, 16 nt, Human
uaaacacuugcaaccu

SEQ ID NO: 1465865 - RNA, 13 nt, Human
uaaacaaguauuu

SEQ ID NO: 1465866 - RNA, 18 nt, Human
uaaacaaguauuuguuaa

SEQ ID NO: 1465867 - RNA, 23 nt, Human
uaaacaaguauuuguuaauuuag

SEQ ID NO: 1465868 - RNA, 16 nt, Human
uaaaaugauuguagua

SEQ ID NO: 1465869 - RNA, 20 nt, Human
uaaacagugagccugaauuu

SEQ ID NO: 1465870 - RNA, 23 nt, Human
uaaacagugagccugaauuuugu

SEQ ID NO: 1465871 - RNA, 22 nt, Human
uaaauauauuuuaagacgaaac

SEQ ID NO: 1465872 - RNA, 16 nt, Human
uaaauauauuuuaaga

SEQ ID NO: 1465873 - RNA, 18 nt, Human
uaaauauaugcuaagucu

SEQ ID NO: 1465874 - RNA, 13 nt, Human
uaaauaaacccuu

SEQ ID NO: 1465875 - RNA, 19 nt, Human
uaaaucacgcuuuuugaaa

SEQ ID NO: 1465876 - RNA, 21 nt, Human
uaaaucacgcuuuuugaaaaa

SEQ ID NO: 1465877 - RNA, 22 nt, Human
uaaaucacgcuuuuugaaaaag

SEQ ID NO: 1465878 - RNA, 20 nt, Human
uaaaucagacuaugaaguuu

SEQ ID NO: 1465879 - RNA, 17 nt, Human
uaaauauuuuaaagaau

SEQ ID NO: 1465880 - RNA, 16 nt, Human
uaaaucacgcuuuuug

SEQ ID NO: 1465881 - RNA, 18 nt, Human
uaaaucacgcuuuuugaa

SEQ ID NO: 1465882 - RNA, 22 nt, Human
uaaauauuuuuucuuuucuauu

SEQ ID NO: 1465883 - RNA, 18 nt, Human
uaaauauuuuaaagaauu

SEQ ID NO: 1465884 - RNA, 14 nt, Human
uaaauauuuuaaag

SEQ ID NO: 1465885 - RNA, 15 nt, Human
uaaauauuuuaaaga

SEQ ID NO: 1465886 - RNA, 20 nt, Human
uaaacuuuuuucuuacuguc

SEQ ID NO: 1465887 - RNA, 14 nt, Human
uaaaggacuguaau

SEQ ID NO: 1465888 - RNA, 12 nt, Human
uaaaggacugua

SEQ ID NO: 1465889 - RNA, 19 nt, Human
uaaagcauuuagaaaacuu

SEQ ID NO: 1465890 - RNA, 13 nt, Human
uaaagcauuuaga

SEQ ID NO: 1465891 - RNA, 15 nt, Human
uaaagcguuugcaca

SEQ ID NO: 1465892 - RNA, 21 nt, Human
uaaagcguuugcacagaucaa

SEQ ID NO: 1465893 - RNA, 15 nt, Human
uaaagcuaaaauaaa

SEQ ID NO: 1465894 - RNA, 22 nt, Human
uaaagcuaaaauaaagaaauag

SEQ ID NO: 1465895 - RNA, 23 nt, Human
uaaagcuaaaauaaagaaauaga

SEQ ID NO: 1465896 - RNA, 16 nt, Human
uaaaggcaaaggcaau

SEQ ID NO: 1465897 - RNA, 17 nt, Human
uaaauaaaaauaauccu

SEQ ID NO: 1465898 - RNA, 14 nt, Human
uaaaguuuguugaa

SEQ ID NO: 1465899 - RNA, 14 nt, Human
uaauguuucaaaca

SEQ ID NO: 1465900 - RNA, 15 nt, Human
uaauguuuaaaacau

SEQ ID NO: 1465901 - RNA, 15 nt, Human
uaauguuucaaacau

SEQ ID NO: 1465902 - RNA, 15 nt, Human
uaaugccuuacucuu

SEQ ID NO: 1465903 - RNA, 21 nt, Human
uaaugccuuacucuucuugaa

SEQ ID NO: 1465904 - RNA, 16 nt, Human
uaauuaccaaccuguu

SEQ ID NO: 1465905 - RNA, 17 nt, Human
uaauuaccaaccuguua

SEQ ID NO: 1465906 - RNA, 21 nt, Human
uaauuaccaaccuguuaccua

SEQ ID NO: 1465907 - RNA, 22 nt, Human
uaauuggaaaggcagcucuaaa

SEQ ID NO: 1465908 - RNA, 16 nt, Human
uaauuguugcuaaucu

SEQ ID NO: 1465909 - RNA, 18 nt, Human
uaauuguacuaaagccaa

SEQ ID NO: 1465910 - RNA, 22 nt, Human
uaauuguacuaaagccaaacau

SEQ ID NO: 1465911 - RNA, 23 nt, Human
uaauuguacuaaagccaaacaua

SEQ ID NO: 1465912 - RNA, 20 nt, Human
uaauuuguaguguuggagaa

SEQ ID NO: 1465913 - RNA, 18 nt, Human
uaauuugguuuucacauu

SEQ ID NO: 1465914 - RNA, 15 nt, Human
uaauuugguuuucac

SEQ ID NO: 1465915 - RNA, 17 nt, Human
uaauuugguuuucacau

SEQ ID NO: 1465916 - RNA, 23 nt, Human
uaauuuguaguguuggagaagaa

SEQ ID NO: 1465917 - RNA, 14 nt, Human
uaauuuuaaacaaa

SEQ ID NO: 1465918 - RNA, 13 nt, Human
uaauuuuaaauuc

SEQ ID NO: 1465919 - RNA, 22 nt, Human
uaauaauuuagacuucaagcau

SEQ ID NO: 1465920 - RNA, 15 nt, Human
uaauaauguuucaaa

SEQ ID NO: 1465921 - RNA, 20 nt, Human
uaauaauuuuuaagaaauaa

SEQ ID NO: 1465922 - RNA, 16 nt, Human
uaauaauuuuuuaauu

SEQ ID NO: 1465923 - RNA, 14 nt, Human
uaauacaaaggcuu

SEQ ID NO: 1465924 - RNA, 15 nt, Human
uaauacacacaguua

SEQ ID NO: 1465925 - RNA, 11 nt, Human
uaauaaagcug

SEQ ID NO: 1465926 - RNA, 15 nt, Human
uaauaagguugaaca

SEQ ID NO: 1465927 - RNA, 20 nt, Human
uaauauguucuuuuaaauga

SEQ ID NO: 1465928 - RNA, 16 nt, Human
uaauauauauuaucuu

SEQ ID NO: 1465929 - RNA, 18 nt, Human
uaauauauauuaucuuuu

SEQ ID NO: 1465930 - RNA, 19 nt, Human
uaauauauauuaucuuuuc

SEQ ID NO: 1465931 - RNA, 15 nt, Human
uaaucuucaauaguu

SEQ ID NO: 1465932 - RNA, 15 nt, Human
uaaucuuauuuagga

SEQ ID NO: 1465933 - RNA, 21 nt, Human
uaaucuuauucauuuucucua

SEQ ID NO: 1465934 - RNA, 22 nt, Human
uaaucuuauucauuuucucuaa

SEQ ID NO: 1465935 - RNA, 18 nt, Human
uaaucucuguaaagcuaa

SEQ ID NO: 1465936 - RNA, 17 nt, Human
uaaucucuguaaagcua

SEQ ID NO: 1465937 - RNA, 16 nt, Human
uaaauugauguugcug

SEQ ID NO: 1465938 - RNA, 14 nt, Human
uaaauuuaguauuu

SEQ ID NO: 1465939 - RNA, 22 nt, Human
uaaauuuaguauuuuguuucag

SEQ ID NO: 1465940 - RNA, 16 nt, Human
uaacaauuaggcagac

SEQ ID NO: 1465941 - RNA, 20 nt, Human
uaacaauuaggcagacucuu

SEQ ID NO: 1465942 - RNA, 17 nt, Human
uaaccaggggccaugaa

SEQ ID NO: 1465943 - RNA, 22 nt, Human
uaaccagaucuagucaaucaag

SEQ ID NO: 1465944 - RNA, 12 nt, Human
uaaccaaguucc

SEQ ID NO: 1465945 - RNA, 11 nt, Human
uaaccaaguuc

SEQ ID NO: 1465946 - RNA, 10 nt, Human
uaacauuccu

SEQ ID NO: 1465947 - RNA, 17 nt, Human
uaacuggguaaugaaac

SEQ ID NO: 1465948 - RNA, 19 nt, Human
uaacuggguaaugaaacaa

SEQ ID NO: 1465949 - RNA, 20 nt, Human
uaacuggguaaugaaacaaa

SEQ ID NO: 1465950 - RNA, 17 nt, Human
uaacugggggaaaagau

SEQ ID NO: 1465951 - RNA, 15 nt, Human
uaacucaucugucac

SEQ ID NO: 1465952 - RNA, 12 nt, Human
uaacucauuaga

SEQ ID NO: 1465953 - RNA, 16 nt, Human
uaacucauuagacugg

SEQ ID NO: 1465954 - RNA, 14 nt, Human
uaacucaucuguca

SEQ ID NO: 1465955 - RNA, 20 nt, Human
uaaccuaugauauuuucugu

SEQ ID NO: 1465956 - RNA, 16 nt, Human
uaagcauuccaacuau

SEQ ID NO: 1465957 - RNA, 18 nt, Human
uaagcauuccaacuaucu

SEQ ID NO: 1465958 - RNA, 20 nt, Human
uaagcauuccaacuaucuca

SEQ ID NO: 1465959 - RNA, 22 nt, Human
uaagcauugaauggcuauguuu

SEQ ID NO: 1465960 - RNA, 16 nt, Human
uaagccaaaacaaugu

SEQ ID NO: 1465961 - RNA, 15 nt, Human
uaagcaugcacaaau

SEQ ID NO: 1465962 - RNA, 18 nt, Human
uaagaucuuuuauuuugc

SEQ ID NO: 1465963 - RNA, 17 nt, Human
uaagaucuauagccucu

SEQ ID NO: 1465964 - RNA, 15 nt, Human
uaaggcaaucauggu

SEQ ID NO: 1465965 - RNA, 15 nt, Human
uaagccagcugcccc

SEQ ID NO: 1465966 - RNA, 22 nt, Human
uaagccagcugcccccagagcc

SEQ ID NO: 1465967 - RNA, 17 nt, Human
uaagagagucuauuuac

SEQ ID NO: 1465968 - RNA, 21 nt, Human
uaagaagaaugcuuaaucaga

SEQ ID NO: 1465969 - RNA, 23 nt, Human
uaagaagcacgugguaaaacacu

SEQ ID NO: 1465970 - RNA, 22 nt, Human
uaagagcaaaagaauggcagaa

SEQ ID NO: 1465971 - RNA, 20 nt, Human
uaagagcaaaagaauggcag

SEQ ID NO: 1465972 - RNA, 12 nt, Human
uaagagcucagg

SEQ ID NO: 1465973 - RNA, 14 nt, Human
uaagagcucaggau

SEQ ID NO: 1465974 - RNA, 15 nt, Human
uaagagcucaggaug

SEQ ID NO: 1465975 - RNA, 22 nt, Human
uaagagcucaggaugagggaaa

SEQ ID NO: 1465976 - RNA, 19 nt, Human
uaagauauuuuucaugauu

SEQ ID NO: 1465977 - RNA, 18 nt, Human
uaagauauuuuucaugau

SEQ ID NO: 1465978 - RNA, 17 nt, Human
uaagauauuuuucauga

SEQ ID NO: 1465979 - RNA, 15 nt, Human
uaagauauuuuucau

SEQ ID NO: 1465980 - RNA, 14 nt, Human
uaagauauuuuuca

SEQ ID NO: 1465981 - RNA, 21 nt, Human
uaagauaugggacauuuuuga

SEQ ID NO: 1465982 - RNA, 19 nt, Human
uaagauaugggacauuuuu

SEQ ID NO: 1465983 - RNA, 16 nt, Human
uagauguauguacuuc

SEQ ID NO: 1465984 - RNA, 20 nt, Human
uagauguauguacuucaugc

SEQ ID NO: 1465985 - RNA, 23 nt, Human
uagauaacaagaccucagugccu

SEQ ID NO: 1465986 - RNA, 18 nt, Human
uagauacaugcuuuuuaa

SEQ ID NO: 1465987 - RNA, 19 nt, Human
uagacuggaacuugaacug

SEQ ID NO: 1465988 - RNA, 14 nt, Human
uagacuggacagcu

SEQ ID NO: 1465989 - RNA, 18 nt, Human
uagacuggacagcuugug

SEQ ID NO: 1465990 - RNA, 16 nt, Human
uagacuggacagcuug

SEQ ID NO: 1465991 - RNA, 15 nt, Human
uagaaccuaauucaa

SEQ ID NO: 1465992 - RNA, 23 nt, Human
uagaaccuaauucaauucaaagc

SEQ ID NO: 1465993 - RNA, 17 nt, Human
uagaguuuagcuggaaa

SEQ ID NO: 1465994 - RNA, 18 nt, Human
uagaguuuagcuggaaaa

SEQ ID NO: 1465995 - RNA, 14 nt, Human
uagagacuggaaca

SEQ ID NO: 1465996 - RNA, 18 nt, Human
uagagacuggaacacuag

SEQ ID NO: 1465997 - RNA, 16 nt, Human
uaggaauuguguuuau

SEQ ID NO: 1465998 - RNA, 22 nt, Human
uaggaaguugacuuauaguaca

SEQ ID NO: 1465999 - RNA, 14 nt, Human
uaggaauuguguuu

SEQ ID NO: 1466000 - RNA, 17 nt, Human
uaggaaguugacuuaua

SEQ ID NO: 1466001 - RNA, 21 nt, Human
uaggccuugcggcuccucagg

SEQ ID NO: 1466002 - RNA, 22 nt, Human
uagcuggcucugugagggugcu

SEQ ID NO: 1466003 - RNA, 22 nt, Human
uaggaaauggcuuugugauuca

SEQ ID NO: 1466004 - RNA, 23 nt, Human
uaggaaauggcuuugugauucaa

SEQ ID NO: 1466005 - RNA, 18 nt, Human
uagcccaaugaaaugaau

SEQ ID NO: 1466006 - RNA, 13 nt, Human
uagccccagugac

SEQ ID NO: 1466007 - RNA, 17 nt, Human
uagccccagugacagcu

SEQ ID NO: 1466008 - RNA, 18 nt, Human
uagcccuccuuuuuccaa

SEQ ID NO: 1466009 - RNA, 20 nt, Human
uagcccuccuuuuuccaaca

SEQ ID NO: 1466010 - RNA, 19 nt, Human
uagccucaauuucugaaca

SEQ ID NO: 1466011 - RNA, 23 nt, Human
uagccucacuuuuaaugaacaaa

SEQ ID NO: 1466012 - RNA, 18 nt, Human
uagccucacuuuuaauga

SEQ ID NO: 1466013 - RNA, 18 nt, Human
uagucaaauugugugaaa

SEQ ID NO: 1466014 - RNA, 15 nt, Human
uagucaaucaagucu

SEQ ID NO: 1466015 - RNA, 18 nt, Human
uagucaaucaagucuguu

SEQ ID NO: 1466016 - RNA, 19 nt, Human
uagucaaucaagucuguuu

SEQ ID NO: 1466017 - RNA, 21 nt, Human
uagucaaucaagucuguuuac

SEQ ID NO: 1466018 - RNA, 13 nt, Human
uaggcuagggugg

SEQ ID NO: 1466019 - RNA, 24 nt, Human
uaggccuugcggcuccucagggac

SEQ ID NO: 1466020 - RNA, 23 nt, Human
uaggccuugcggcuccucaggga

SEQ ID NO: 1466021 - RNA, 20 nt, Human
uagugauuuuuaugccaccu

SEQ ID NO: 1466022 - RNA, 21 nt, Human
uagugauuuuuaugccaccug

SEQ ID NO: 1466023 - RNA, 22 nt, Human
uagugauuuuuaugccaccuga

SEQ ID NO: 1466024 - RNA, 18 nt, Human
uaguuguaaaccaaguga

SEQ ID NO: 1466025 - RNA, 17 nt, Human
uaguggauuacugccau

SEQ ID NO: 1466026 - RNA, 12 nt, Human
uaguuucugagu

SEQ ID NO: 1466027 - RNA, 20 nt, Human
uaguuucugaguuuuaccaa

SEQ ID NO: 1466028 - RNA, 12 nt, Human
uaguugugucug

SEQ ID NO: 1466029 - RNA, 19 nt, Human
uaguuucauauaaaguauc

SEQ ID NO: 1466030 - RNA, 20 nt, Human
uaguuucauauaaaguauca

SEQ ID NO: 1466031 - RNA, 15 nt, Human
uaguuuuauaugcuu

SEQ ID NO: 1466032 - RNA, 20 nt, Human
uaguuuuacuuuuaaacugu

SEQ ID NO: 1466033 - RNA, 22 nt, Human
uaguuuuacuuuuaaacugugu

SEQ ID NO: 1466034 - RNA, 11 nt, Human
uaguuuggaua

SEQ ID NO: 1466035 - RNA, 14 nt, Human
uaguuuuacuuuua

SEQ ID NO: 1466036 - RNA, 18 nt, Human
uauaacaaugcuguauuu

SEQ ID NO: 1466037 - RNA, 20 nt, Human
uauacuauaguaccaguagg

SEQ ID NO: 1466038 - RNA, 19 nt, Human
uauacuauuaaaaagguuu

SEQ ID NO: 1466039 - RNA, 17 nt, Human
uauacucacuuucuaga

SEQ ID NO: 1466040 - RNA, 17 nt, Human
uauacuauaguaccagu

SEQ ID NO: 1466041 - RNA, 20 nt, Human
uauaccugauuuuuuuuccu

SEQ ID NO: 1466042 - RNA, 21 nt, Human
uauacuauuaaaaagguuuac

SEQ ID NO: 1466043 - RNA, 22 nt, Human
uauacccacccagaaugagaca

SEQ ID NO: 1466044 - RNA, 14 nt, Human
uauacccacccaga

SEQ ID NO: 1466045 - RNA, 15 nt, Human
uauacccacccagaa

SEQ ID NO: 1466046 - RNA, 12 nt, Human
uauaccucacuu

SEQ ID NO: 1466047 - RNA, 12 nt, Human
uauaccugauuu

SEQ ID NO: 1466048 - RNA, 15 nt, Human
uauaauucaccuucu

SEQ ID NO: 1466049 - RNA, 14 nt, Human
uauauuuuaagacg

SEQ ID NO: 1466050 - RNA, 16 nt, Human
uauauuuuacaauuuu

SEQ ID NO: 1466051 - RNA, 13 nt, Human
uauauuuuaagac

SEQ ID NO: 1466052 - RNA, 13 nt, Human
uauauuugaaaua

SEQ ID NO: 1466053 - RNA, 14 nt, Human
uauauuugaaauau

SEQ ID NO: 1466054 - RNA, 20 nt, Human
uauauuugaaauauugacuu

SEQ ID NO: 1466055 - RNA, 19 nt, Human
uauauguaccguaggcuuu

SEQ ID NO: 1466056 - RNA, 12 nt, Human
uauauguacagu

SEQ ID NO: 1466057 - RNA, 23 nt, Human
uauauuuauuacuguaagaaaau

SEQ ID NO: 1466058 - RNA, 19 nt, Human
uauaugaggacuugugucu

SEQ ID NO: 1466059 - RNA, 16 nt, Human
uauauaccaaagcaca

SEQ ID NO: 1466060 - RNA, 21 nt, Human
uauauaccaaagcacauuuua

SEQ ID NO: 1466061 - RNA, 21 nt, Human
uauacucucaccauuuggauc

SEQ ID NO: 1466062 - RNA, 22 nt, Human
uaucaugugaaaucauucauuu

SEQ ID NO: 1466063 - RNA, 17 nt, Human
uaucaugugaaaucauu

SEQ ID NO: 1466064 - RNA, 16 nt, Human
uaucucuucagucucu

SEQ ID NO: 1466065 - RNA, 14 nt, Human
uaucucuucagucu

SEQ ID NO: 1466066 - RNA, 13 nt, Human
uaucucuucaguc

SEQ ID NO: 1466067 - RNA, 12 nt, Human
uaucucuucagu

SEQ ID NO: 1466068 - RNA, 23 nt, Human
uaucuaaacuggauucacagcuc

SEQ ID NO: 1466069 - RNA, 18 nt, Human
uaucgcuucauguaacua

SEQ ID NO: 1466070 - RNA, 23 nt, Human
uaucaucaguguagaaccuaauu

SEQ ID NO: 1466071 - RNA, 14 nt, Human
uacagaagaaacug

SEQ ID NO: 1466072 - RNA, 11 nt, Human
uacagaacuac

SEQ ID NO: 1466073 - RNA, 14 nt, Human
uacagaaagcugcc

SEQ ID NO: 1466074 - RNA, 13 nt, Human
uacagaauuuuau

SEQ ID NO: 1466075 - RNA, 23 nt, Human
uacagaauuacuguaacugauua

SEQ ID NO: 1466076 - RNA, 15 nt, Human
uacagaauuacugua

SEQ ID NO: 1466077 - RNA, 18 nt, Human
uacagaaaaguugaauuu

SEQ ID NO: 1466078 - RNA, 22 nt, Human
uacagaaaaguugaauuuuaca

SEQ ID NO: 1466079 - RNA, 13 nt, Human
uacagaaagcugc

SEQ ID NO: 1466080 - RNA, 17 nt, Human
uacaauuuuuuaucaug

SEQ ID NO: 1466081 - RNA, 23 nt, Human
uacaauuuuuuaucaugcauguc

SEQ ID NO: 1466082 - RNA, 21 nt, Human
uacaagaagcauuuuguaagu

SEQ ID NO: 1466083 - RNA, 19 nt, Human
uacaagaagcauuuuguaa

SEQ ID NO: 1466084 - RNA, 17 nt, Human
uaauuuugaaaaacugc

SEQ ID NO: 1466085 - RNA, 13 nt, Human
uaauuuugaaaaa

SEQ ID NO: 1466086 - RNA, 12 nt, Human
uaauuuucuacc

SEQ ID NO: 1466087 - RNA, 13 nt, Human
uaauuuugugaag

SEQ ID NO: 1466088 - RNA, 15 nt, Human
uacacaauaagcaaa

SEQ ID NO: 1466089 - RNA, 16 nt, Human
uacacaauagaauuau

SEQ ID NO: 1466090 - RNA, 18 nt, Human
uacacaauagaauuauaa

SEQ ID NO: 1466091 - RNA, 14 nt, Human
uacacaauaagcaa

SEQ ID NO: 1466092 - RNA, 18 nt, Human
uacacagaaauacaguua

SEQ ID NO: 1466093 - RNA, 17 nt, Human
uacacagcaccagaaug

SEQ ID NO: 1466094 - RNA, 15 nt, Human
uacacagcucuagac

SEQ ID NO: 1466095 - RNA, 20 nt, Human
uacacugucagcagggacug

SEQ ID NO: 1466096 - RNA, 15 nt, Human
uacccaaauuaagag

SEQ ID NO: 1466097 - RNA, 12 nt, Human
uacccacccaga

SEQ ID NO: 1466098 - RNA, 14 nt, Human
uaccaauaaaguga

SEQ ID NO: 1466099 - RNA, 17 nt, Human
uaccaauaaagugaccc

SEQ ID NO: 1466100 - RNA, 13 nt, Human
uaccaauaaagug

SEQ ID NO: 1466101 - RNA, 12 nt, Human
uaccaauaaagu

SEQ ID NO: 1466102 - RNA, 18 nt, Human
uaccaaggucuucuuaau

SEQ ID NO: 1466103 - RNA, 21 nt, Human
uaccaaguuucagguauuaag

SEQ ID NO: 1466104 - RNA, 16 nt, Human
uaccaaguuucaggua

SEQ ID NO: 1466105 - RNA, 18 nt, Human
uaccacaaugcagugccu

SEQ ID NO: 1466106 - RNA, 23 nt, Human
uaccacaggaaccacaagacugc

SEQ ID NO: 1466107 - RNA, 18 nt, Human
uaccaccagucugacugu

SEQ ID NO: 1466108 - RNA, 12 nt, Human
uaccauuucaga

SEQ ID NO: 1466109 - RNA, 15 nt, Human
uaccauuucagagag

SEQ ID NO: 1466110 - RNA, 16 nt, Human
uaccauuucagagagg

SEQ ID NO: 1466111 - RNA, 16 nt, Human
uacauuuguauaaaau

SEQ ID NO: 1466112 - RNA, 17 nt, Human
uacauuuguauaaaaua

SEQ ID NO: 1466113 - RNA, 11 nt, Human
uacauuugugu

SEQ ID NO: 1466114 - RNA, 15 nt, Human
uacaugauucauuuu

SEQ ID NO: 1466115 - RNA, 14 nt, Human
uacaugauucauuu

SEQ ID NO: 1466116 - RNA, 19 nt, Human
uacauuuucuaagaaacau

SEQ ID NO: 1466117 - RNA, 20 nt, Human
uacauuuucuaagaaacauu

SEQ ID NO: 1466118 - RNA, 15 nt, Human
uacauuuucuaagaa

SEQ ID NO: 1466119 - RNA, 12 nt, Human
uaccaaagcaca

SEQ ID NO: 1466120 - RNA, 12 nt, Human
uaccaaccuguu

SEQ ID NO: 1466121 - RNA, 18 nt, Human
uacaguuccuagguauaa

SEQ ID NO: 1466122 - RNA, 21 nt, Human
uacaguuagggcuccuauuca

SEQ ID NO: 1466123 - RNA, 19 nt, Human
uacaguuaucuaaguuaau

SEQ ID NO: 1466124 - RNA, 13 nt, Human
uacaguuaaguuu

SEQ ID NO: 1466125 - RNA, 19 nt, Human
uaccuuugacaaagguaaa

SEQ ID NO: 1466126 - RNA, 19 nt, Human
uacccaguaacucaucugu

SEQ ID NO: 1466127 - RNA, 22 nt, Human
uacccaguaacucaucugucac

SEQ ID NO: 1466128 - RNA, 19 nt, Human
uacccaugucuacacagau

SEQ ID NO: 1466129 - RNA, 17 nt, Human
uaccuugcaucucacag

SEQ ID NO: 1466130 - RNA, 23 nt, Human
uacgacaguacacugucagcagg

SEQ ID NO: 1466131 - RNA, 15 nt, Human
uacuccccuccuuga

SEQ ID NO: 1466132 - RNA, 14 nt, Human
uacugauauauuuu

SEQ ID NO: 1466133 - RNA, 16 nt, Human
uacugauauauuuuac

SEQ ID NO: 1466134 - RNA, 13 nt, Human
uacuacaugcacu

SEQ ID NO: 1466135 - RNA, 20 nt, Human
uacucacuuucuagauuaag

SEQ ID NO: 1466136 - RNA, 14 nt, Human
uacucagaauuaag

SEQ ID NO: 1466137 - RNA, 16 nt, Human
uacucagauaagguaa

SEQ ID NO: 1466138 - RNA, 23 nt, Human
uacucagauaagguaaaaugcca

SEQ ID NO: 1466139 - RNA, 11 nt, Human
uagaaagcuau

SEQ ID NO: 1466140 - RNA, 17 nt, Human
uacuuuauguuacuaca

SEQ ID NO: 1466141 - RNA, 20 nt, Human
uacuuuauguuacuacaugc

SEQ ID NO: 1466142 - RNA, 17 nt, Human
uagaaagagauacagag

SEQ ID NO: 1466143 - RNA, 18 nt, Human
uagaaagagauacagagg

SEQ ID NO: 1466144 - RNA, 11 nt, Human
uagaaaucaua

SEQ ID NO: 1466145 - RNA, 13 nt, Human
uagaaaucauuuu

SEQ ID NO: 1466146 - RNA, 17 nt, Human
uagaaaucauuuugcaa

SEQ ID NO: 1466147 - RNA, 19 nt, Human
uagaaauguaacuuuugua

SEQ ID NO: 1466148 - RNA, 16 nt, Human
uagaaaucauuuugca

SEQ ID NO: 1466149 - RNA, 19 nt, Human
uagaaauuacacccaaaga

SEQ ID NO: 1466150 - RNA, 13 nt, Human
uagaacaaggcug

SEQ ID NO: 1466151 - RNA, 12 nt, Human
uagaacacacac

SEQ ID NO: 1466152 - RNA, 17 nt, Human
uagaacacacacacuua

SEQ ID NO: 1466153 - RNA, 15 nt, Human
uagaacacaggcaaa

SEQ ID NO: 1466154 - RNA, 21 nt, Human
uacuugcucuugaugccuggc

SEQ ID NO: 1466155 - RNA, 16 nt, Human
uacuugcucagguacu

SEQ ID NO: 1466156 - RNA, 17 nt, Human
uacuugcucagguacuu

SEQ ID NO: 1466157 - RNA, 23 nt, Human
uacuuacaugcauuacugcaugc

SEQ ID NO: 1466158 - RNA, 19 nt, Human
uacuuacaugcauuacugc

SEQ ID NO: 1466159 - RNA, 17 nt, Human
uacugcauacuuuuuaa

SEQ ID NO: 1466160 - RNA, 18 nt, Human
uacugcauacuuuuuaaa

SEQ ID NO: 1466161 - RNA, 21 nt, Human
uacugcauacuuuuuaaaugu

SEQ ID NO: 1466162 - RNA, 22 nt, Human
uacugcauacuuuuuaaaugua

SEQ ID NO: 1466163 - RNA, 13 nt, Human
uacugcauacuuu

SEQ ID NO: 1466164 - RNA, 15 nt, Human
uacugcauacuuuuu

SEQ ID NO: 1466165 - RNA, 14 nt, Human
gguggucccugggu

SEQ ID NO: 1466166 - RNA, 15 nt, Human
ggugguggcucggga

SEQ ID NO: 1466167 - RNA, 16 nt, Human
gguuagggaaaacauu

SEQ ID NO: 1466168 - RNA, 22 nt, Human
gguuaggaggguuucauugucu

SEQ ID NO: 1466169 - RNA, 21 nt, Human
gguguccugcaccggggccug

SEQ ID NO: 1466170 - RNA, 19 nt, Human
gguucuugaggggaccagg

SEQ ID NO: 1466171 - RNA, 20 nt, Human
gguucuugaggggaccagga

SEQ ID NO: 1466172 - RNA, 22 nt, Human
gguucuugaggggaccaggagu

SEQ ID NO: 1466173 - RNA, 21 nt, Human
gguucuugaggggaccaggag

SEQ ID NO: 1466174 - RNA, 13 nt, Human
ggugagaaauuua

SEQ ID NO: 1466175 - RNA, 21 nt, Human
ggugagaaccuggguugcaga

SEQ ID NO: 1466176 - RNA, 22 nt, Human
ggucucuucugaauaaagcaau

SEQ ID NO: 1466177 - RNA, 21 nt, Human
ggucucuucugaauaaagcaa

SEQ ID NO: 1466178 - RNA, 20 nt, Human
ggucucuucugaauaaagca

SEQ ID NO: 1466179 - RNA, 19 nt, Human
ggucucucucucucuacaa

SEQ ID NO: 1466180 - RNA, 17 nt, Human
ggucucaaacuccugac

SEQ ID NO: 1466181 - RNA, 15 nt, Human
ggugagaccaccucu

SEQ ID NO: 1466182 - RNA, 15 nt, Human
ggugagaaauuuaaa

SEQ ID NO: 1466183 - RNA, 14 nt, Human
ggugagaccaccuc

SEQ ID NO: 1466184 - RNA, 18 nt, Human
ggugcgagugcgugaaua

SEQ ID NO: 1466185 - RNA, 11 nt, Human
gguggccaggc

SEQ ID NO: 1466186 - RNA, 12 nt, Human
gguggccaggcc

SEQ ID NO: 1466187 - RNA, 16 nt, Human
gguggccaggccggga

SEQ ID NO: 1466188 - RNA, 13 nt, Human
gguggccaggccg

SEQ ID NO: 1466189 - RNA, 12 nt, Human
ggugcucugucu

SEQ ID NO: 1466190 - RNA, 19 nt, Human
ggugcugacuggcuucagc

SEQ ID NO: 1466191 - RNA, 20 nt, Human
gggguggggggggugcuggg

SEQ ID NO: 1466192 - RNA, 13 nt, Human
gggguggccaggc

SEQ ID NO: 1466193 - RNA, 18 nt, Human
ggggugcugggccccugc

SEQ ID NO: 1466194 - RNA, 15 nt, Human
gggggagagggcugc

SEQ ID NO: 1466195 - RNA, 21 nt, Human
gggggacuuacaugauucauu

SEQ ID NO: 1466196 - RNA, 14 nt, Human
ggggcuaccaggaa

SEQ ID NO: 1466197 - RNA, 18 nt, Human
ggggcagucugagagagg

SEQ ID NO: 1466198 - RNA, 15 nt, Human
ggggcagucugagag

SEQ ID NO: 1466199 - RNA, 19 nt, Human
ggggcagucugagagaggc

SEQ ID NO: 1466200 - RNA, 15 nt, Human
ggggcgcggcuggga

SEQ ID NO: 1466201 - RNA, 16 nt, Human
ggggcgcggcugggag

SEQ ID NO: 1466202 - RNA, 17 nt, Human
ggggaggguaggcagga

SEQ ID NO: 1466203 - RNA, 20 nt, Human
ggggauucuuccaucugauu

SEQ ID NO: 1466204 - RNA, 13 nt, Human
ggggaggguaggc

SEQ ID NO: 1466205 - RNA, 16 nt, Human
gggccugggcaggagg

SEQ ID NO: 1466206 - RNA, 17 nt, Human
gggccugggcaggaggg

SEQ ID NO: 1466207 - RNA, 18 nt, Human
gggugcugggccccugcc

SEQ ID NO: 1466208 - RNA, 17 nt, Human
gggugcugggccccugc

SEQ ID NO: 1466209 - RNA, 20 nt, Human
ggguucaccugggcugaggc

SEQ ID NO: 1466210 - RNA, 22 nt, Human
gguaccagaugcagcucaagag

SEQ ID NO: 1466211 - RNA, 18 nt, Human
gguagcauuuguguugaa

SEQ ID NO: 1466212 - RNA, 17 nt, Human
gguagaggaugaggaaa

SEQ ID NO: 1466213 - RNA, 21 nt, Human
gguaccagcagaaagguuagu

SEQ ID NO: 1466214 - RNA, 20 nt, Human
ggucacguuuggugcuucuc

SEQ ID NO: 1466215 - RNA, 22 nt, Human
ggucaacaguuuuccuaugcuu

SEQ ID NO: 1466216 - RNA, 16 nt, Human
ggucaacaguuuuccu

SEQ ID NO: 1466217 - RNA, 11 nt, Human
ggucaggccuu

SEQ ID NO: 1466218 - RNA, 12 nt, Human
ggucaggccuuu

SEQ ID NO: 1466219 - RNA, 20 nt, Human
ggucaggccuuugagcucag

SEQ ID NO: 1466220 - RNA, 13 nt, Human
ggucaggccuuug

SEQ ID NO: 1466221 - RNA, 21 nt, Human
gggccccugccucucugcagg

SEQ ID NO: 1466222 - RNA, 19 nt, Human
gggccccugccucucugca

SEQ ID NO: 1466223 - RNA, 18 nt, Human
gggccccugccucucugc

SEQ ID NO: 1466224 - RNA, 17 nt, Human
gggccccugccucucug

SEQ ID NO: 1466225 - RNA, 15 nt, Human
gggccccugccucuc

SEQ ID NO: 1466226 - RNA, 13 nt, Human
gggccccugccuc

SEQ ID NO: 1466227 - RNA, 22 nt, Human
gggccccugccucucugcaggu

SEQ ID NO: 1466228 - RNA, 18 nt, Human
gggccccuuugcugaccc

SEQ ID NO: 1466229 - RNA, 12 nt, Human
gggccugggcag

SEQ ID NO: 1466230 - RNA, 13 nt, Human
gggccugggcagg

SEQ ID NO: 1466231 - RNA, 15 nt, Human
gggccugggcaggag

SEQ ID NO: 1466232 - RNA, 19 nt, Human
gggccacauagaugcugau

SEQ ID NO: 1466233 - RNA, 20 nt, Human
gggcagucugagagaggcca

SEQ ID NO: 1466234 - RNA, 21 nt, Human
gggcagucugagagaggccau

SEQ ID NO: 1466235 - RNA, 14 nt, Human
gggcauaaauuauu

SEQ ID NO: 1466236 - RNA, 21 nt, Human
gggcaauuaauuccuucagca

SEQ ID NO: 1466237 - RNA, 20 nt, Human
gggcaauuaauuccuucagc

SEQ ID NO: 1466238 - RNA, 13 nt, Human
gggcaagaggaau

SEQ ID NO: 1466239 - RNA, 21 nt, Human
gggcaagccuaagggauccug

SEQ ID NO: 1466240 - RNA, 14 nt, Human
gggauccugccugc

SEQ ID NO: 1466241 - RNA, 13 nt, Human
gggacugagaaau

SEQ ID NO: 1466242 - RNA, 19 nt, Human
gggacucaucuuucccucc

SEQ ID NO: 1466243 - RNA, 12 nt, Human
gggacucagccc

SEQ ID NO: 1466244 - RNA, 19 nt, Human
gggacuacaggcgugagcc

SEQ ID NO: 1466245 - RNA, 20 nt, Human
gggacuacaggcgugagcca

SEQ ID NO: 1466246 - RNA, 18 nt, Human
gggaggugagaccaccuc

SEQ ID NO: 1466247 - RNA, 23 nt, Human
gggaggugcuucuaguucugcca

SEQ ID NO: 1466248 - RNA, 16 nt, Human
gggaguuuaggguggg

SEQ ID NO: 1466249 - RNA, 17 nt, Human
gggcagucugagagagg

SEQ ID NO: 1466250 - RNA, 18 nt, Human
gggcagucugagagaggc

SEQ ID NO: 1466251 - RNA, 19 nt, Human
gggcagucugagagaggcc

SEQ ID NO: 1466252 - RNA, 15 nt, Human
gggaaggaucccaug

SEQ ID NO: 1466253 - RNA, 13 nt, Human
gggaaugaagaua

SEQ ID NO: 1466254 - RNA, 22 nt, Human
gggacguucgugguccugcgcu

SEQ ID NO: 1466255 - RNA, 20 nt, Human
gggaccggcggaccccagcc

SEQ ID NO: 1466256 - RNA, 22 nt, Human
ggcuugaguuuaaauuguaaua

SEQ ID NO: 1466257 - RNA, 13 nt, Human
ggcuuacacccac

SEQ ID NO: 1466258 - RNA, 23 nt, Human
ggcuuaaacccauauuguaaaac

SEQ ID NO: 1466259 - RNA, 15 nt, Human
ggcugcugcuacaau

SEQ ID NO: 1466260 - RNA, 14 nt, Human
ggcucuggagccca

SEQ ID NO: 1466261 - RNA, 13 nt, Human
ggcucuggagccc

SEQ ID NO: 1466262 - RNA, 20 nt, Human
ggccccugccaccuccugcc

SEQ ID NO: 1466263 - RNA, 13 nt, Human
ggccccugccucu

SEQ ID NO: 1466264 - RNA, 15 nt, Human
ggcugagauaugaac

SEQ ID NO: 1466265 - RNA, 15 nt, Human
ggcugagcucucugu

SEQ ID NO: 1466266 - RNA, 20 nt, Human
ggcugagcucucugugggcu

SEQ ID NO: 1466267 - RNA, 15 nt, Human
ggcugauaauuuuaa

SEQ ID NO: 1466268 - RNA, 15 nt, Human
ggcugauggaguaaa

SEQ ID NO: 1466269 - RNA, 14 nt, Human
ggcugauuucuagg

SEQ ID NO: 1466270 - RNA, 20 nt, Human
ggccaggcaggagcccuucu

SEQ ID NO: 1466271 - RNA, 13 nt, Human
ggccaggaggugc

SEQ ID NO: 1466272 - RNA, 22 nt, Human
ggccaggcugggucgcccugga

SEQ ID NO: 1466273 - RNA, 18 nt, Human
ggccaggcugggucgccc

SEQ ID NO: 1466274 - RNA, 14 nt, Human
ggccaggaggugcc

SEQ ID NO: 1466275 - RNA, 22 nt, Human
ggccaaugcaccuaaagaaaaa

SEQ ID NO: 1466276 - RNA, 19 nt, Human
ggcagucugaauuuuuaaa

SEQ ID NO: 1466277 - RNA, 20 nt, Human
ggcagucugagagaggccau

SEQ ID NO: 1466278 - RNA, 15 nt, Human
ggccaugggaggccu

SEQ ID NO: 1466279 - RNA, 13 nt, Human
ggccaugggaggc

SEQ ID NO: 1466280 - RNA, 22 nt, Human
ggccaugggaggccuuucccua

SEQ ID NO: 1466281 - RNA, 21 nt, Human
ggccaugggaggccuuucccu

SEQ ID NO: 1466282 - RNA, 16 nt, Human
ggcccccaccuggcuc

SEQ ID NO: 1466283 - RNA, 17 nt, Human
ggcccccaccuggcuca

SEQ ID NO: 1466284 - RNA, 14 nt, Human
ggcccccccagcug

SEQ ID NO: 1466285 - RNA, 13 nt, Human
ggcccccucccug

SEQ ID NO: 1466286 - RNA, 16 nt, Human
ggcccccucccuggau

SEQ ID NO: 1466287 - RNA, 17 nt, Human
ggcccccucccuggaug

SEQ ID NO: 1466288 - RNA, 21 nt, Human
ggaucaguuaacuauugcauu

SEQ ID NO: 1466289 - RNA, 19 nt, Human
ggaucagagcgcacaggga

SEQ ID NO: 1466290 - RNA, 17 nt, Human
ggaucccaugagcuccu

SEQ ID NO: 1466291 - RNA, 20 nt, Human
ggaucccaugagcuccuuaa

SEQ ID NO: 1466292 - RNA, 16 nt, Human
ggcaacgcacaaaaca

SEQ ID NO: 1466293 - RNA, 15 nt, Human
ggcagcaacaauaaa

SEQ ID NO: 1466294 - RNA, 15 nt, Human
ggcagcaauuuaaau

SEQ ID NO: 1466295 - RNA, 22 nt, Human
ggcagcaacaauaaauagacac

SEQ ID NO: 1466296 - RNA, 17 nt, Human
ggcagcaacaauaaaua

SEQ ID NO: 1466297 - RNA, 16 nt, Human
ggcagcaauuuaaaug

SEQ ID NO: 1466298 - RNA, 15 nt, Human
ggcaggaacaaacag

SEQ ID NO: 1466299 - RNA, 18 nt, Human
ggaggaggcagagaagaa

SEQ ID NO: 1466300 - RNA, 17 nt, Human
ggaggaggcagagaaga

SEQ ID NO: 1466301 - RNA, 14 nt, Human
ggaggagggcaggc

SEQ ID NO: 1466302 - RNA, 15 nt, Human
ggaggagggcaggca

SEQ ID NO: 1466303 - RNA, 20 nt, Human
ggaggagggcaggcaucggg

SEQ ID NO: 1466304 - RNA, 16 nt, Human
ggagccgggagccuga

SEQ ID NO: 1466305 - RNA, 13 nt, Human
ggaggagaaugag

SEQ ID NO: 1466306 - RNA, 13 nt, Human
ggaggaugugaau

SEQ ID NO: 1466307 - RNA, 13 nt, Human
ggagggcaggcau

SEQ ID NO: 1466308 - RNA, 14 nt, Human
ggagggcaggcauc

SEQ ID NO: 1466309 - RNA, 12 nt, Human
ggagucuugcuc

SEQ ID NO: 1466310 - RNA, 13 nt, Human
ggacccaggacag

SEQ ID NO: 1466311 - RNA, 10 nt, Human
ggacccagga

SEQ ID NO: 1466312 - RNA, 11 nt, Human
ggaccaggagu

SEQ ID NO: 1466313 - RNA, 20 nt, Human
ggaccaggagugggugggga

SEQ ID NO: 1466314 - RNA, 21 nt, Human
ggaccaggaguggguggggag

SEQ ID NO: 1466315 - RNA, 13 nt, Human
ggacccagggcuc

SEQ ID NO: 1466316 - RNA, 22 nt, Human
ggaccagcuuuucccaaaagcc

SEQ ID NO: 1466317 - RNA, 17 nt, Human
ggaccagcuuuucccaa

SEQ ID NO: 1466318 - RNA, 15 nt, Human
ggaccagcuuuuccc

SEQ ID NO: 1466319 - RNA, 17 nt, Human
ggaaggaucccaugagc

SEQ ID NO: 1466320 - RNA, 19 nt, Human
ggaaggaggacccaggaca

SEQ ID NO: 1466321 - RNA, 16 nt, Human
ggaaggaggacccagg

SEQ ID NO: 1466322 - RNA, 13 nt, Human
ggagcccugggag

SEQ ID NO: 1466323 - RNA, 12 nt, Human
ggagcccuggga

SEQ ID NO: 1466324 - RNA, 13 nt, Human
ggagagggcgcag

SEQ ID NO: 1466325 - RNA, 22 nt, Human
ggagauucucauaacuugagac

SEQ ID NO: 1466326 - RNA, 23 nt, Human
ggagauucucauaacuugagacc

SEQ ID NO: 1466327 - RNA, 16 nt, Human
ggacugcggaggaagg

SEQ ID NO: 1466328 - RNA, 15 nt, Human
ggacugcggaggaag

SEQ ID NO: 1466329 - RNA, 15 nt, Human
ggacugucauagaaa

SEQ ID NO: 1466330 - RNA, 17 nt, Human
ggagaccggccugccag

SEQ ID NO: 1466331 - RNA, 22 nt, Human
ggagaccggccugccaggagga

SEQ ID NO: 1466332 - RNA, 19 nt, Human
ggagaccggccugccagga

SEQ ID NO: 1466333 - RNA, 20 nt, Human
ggagaccggccugccaggag

SEQ ID NO: 1466334 - RNA, 21 nt, Human
ggagaccggccugccaggagg

SEQ ID NO: 1466335 - RNA, 19 nt, Human
ggagagggaaugugaaauu

SEQ ID NO: 1466336 - RNA, 14 nt, Human
ggagagggaaugug

SEQ ID NO: 1466337 - RNA, 14 nt, Human
ggaagaucccccag

SEQ ID NO: 1466338 - RNA, 17 nt, Human
ggaacucgugucuggca

SEQ ID NO: 1466339 - RNA, 22 nt, Human
ggaagaucccccagaaaagaaa

SEQ ID NO: 1466340 - RNA, 18 nt, Human
ggaagaucccccagaaaa

SEQ ID NO: 1466341 - RNA, 19 nt, Human
ggaagcauuuguuucuacu

SEQ ID NO: 1466342 - RNA, 15 nt, Human
ggaaccgaggcaggg

SEQ ID NO: 1466343 - RNA, 16 nt, Human
ggaaccgaggcaggga

SEQ ID NO: 1466344 - RNA, 20 nt, Human
ggaaccgaggcagggaagga

SEQ ID NO: 1466345 - RNA, 12 nt, Human
ggaaauauuuau

SEQ ID NO: 1466346 - RNA, 13 nt, Human
ggaaauauuuauu

SEQ ID NO: 1466347 - RNA, 15 nt, Human
ggaaauauuuauuuu

SEQ ID NO: 1466348 - RNA, 17 nt, Human
ggaaauauuuauuuuaa

SEQ ID NO: 1466349 - RNA, 18 nt, Human
ggaaauauuuauuuuaau

SEQ ID NO: 1466350 - RNA, 22 nt, Human
ggaaaucaaaagggccaaagaa

SEQ ID NO: 1466351 - RNA, 16 nt, Human
ggaaaauaauacugcu

SEQ ID NO: 1466352 - RNA, 16 nt, Human
ggaaaggugguguuuc

SEQ ID NO: 1466353 - RNA, 20 nt, Human
ggaaaaaauaacaaugaaag

SEQ ID NO: 1466354 - RNA, 19 nt, Human
gcuuuuaacagagucugaa

SEQ ID NO: 1466355 - RNA, 12 nt, Human
ggaaaaccagac

SEQ ID NO: 1466356 - RNA, 22 nt, Human
ggaaaaccagacuacuugggag

SEQ ID NO: 1466357 - RNA, 19 nt, Human
ggaaaaaguggguuuuuua

SEQ ID NO: 1466358 - RNA, 17 nt, Human
gcuuuggaccuaaucca

SEQ ID NO: 1466359 - RNA, 14 nt, Human
gcuuggagcugagc

SEQ ID NO: 1466360 - RNA, 15 nt, Human
gcuuggagcugagca

SEQ ID NO: 1466361 - RNA, 18 nt, Human
gcuuuaacuuaaauagua

SEQ ID NO: 1466362 - RNA, 20 nt, Human
gcuugauagaaaugccaagc

SEQ ID NO: 1466363 - RNA, 14 nt, Human
gcuugauuuuugcc

SEQ ID NO: 1466364 - RNA, 19 nt, Human
gcuugaugggauucuggac

SEQ ID NO: 1466365 - RNA, 20 nt, Human
gcuugaugggauucuggaca

SEQ ID NO: 1466366 - RNA, 22 nt, Human
gcuugaugggauucuggacagg

SEQ ID NO: 1466367 - RNA, 18 nt, Human
gcuucuaguucugccagg

SEQ ID NO: 1466368 - RNA, 21 nt, Human
gcuucuaguucugccaggaga

SEQ ID NO: 1466369 - RNA, 19 nt, Human
gcuucuaguucugccagga

SEQ ID NO: 1466370 - RNA, 20 nt, Human
gcuucuaguucugccaggag

SEQ ID NO: 1466371 - RNA, 15 nt, Human
gcuucuggccaggaa

SEQ ID NO: 1466372 - RNA, 14 nt, Human
gcuucuggccagga

SEQ ID NO: 1466373 - RNA, 18 nt, Human
gcuucuggccaggaagcu

SEQ ID NO: 1466374 - RNA, 16 nt, Human
gcuucuggccaggaag

SEQ ID NO: 1466375 - RNA, 17 nt, Human
gcuucuggccaggaagc

SEQ ID NO: 1466376 - RNA, 19 nt, Human
gcuggggccaggcuggguc

SEQ ID NO: 1466377 - RNA, 16 nt, Human
gcuggggccaggcugg

SEQ ID NO: 1466378 - RNA, 21 nt, Human
gcuggggcauggaaggcaaga

SEQ ID NO: 1466379 - RNA, 17 nt, Human
gcugggaggagggcagg

SEQ ID NO: 1466380 - RNA, 19 nt, Human
gcugggaggagggcaggca

SEQ ID NO: 1466381 - RNA, 22 nt, Human
gcuguauuuuaaaagaaugauu

SEQ ID NO: 1466382 - RNA, 14 nt, Human
gcugguuagaaaug

SEQ ID NO: 1466383 - RNA, 18 nt, Human
gcugucugaggcuaggug

SEQ ID NO: 1466384 - RNA, 16 nt, Human
gcuagcaaauaguaau

SEQ ID NO: 1466385 - RNA, 12 nt, Human
gcuagcaaauag

SEQ ID NO: 1466386 - RNA, 18 nt, Human
gcuagauguauguacuuc

SEQ ID NO: 1466387 - RNA, 18 nt, Human
gcuagaggaagcagccaa

SEQ ID NO: 1466388 - RNA, 18 nt, Human
gcugcccuguaccccagc

SEQ ID NO: 1466389 - RNA, 15 nt, Human
gcugccuuuggacuu

SEQ ID NO: 1466390 - RNA, 20 nt, Human
gcugccuuuggacuuguccc

SEQ ID NO: 1466391 - RNA, 13 nt, Human
gcugcuagaguga

SEQ ID NO: 1466392 - RNA, 20 nt, Human
gcugcuagagugacucacua

SEQ ID NO: 1466393 - RNA, 20 nt, Human
gcugcuguggccaucaaccu

SEQ ID NO: 1466394 - RNA, 19 nt, Human
gcugcuagagugacucacu

SEQ ID NO: 1466395 - RNA, 14 nt, Human
gcugggacuacagg

SEQ ID NO: 1466396 - RNA, 23 nt, Human
gcugggacaccccgacuuuuguu

SEQ ID NO: 1466397 - RNA, 22 nt, Human
gcccuucuauacccacccagaa

SEQ ID NO: 1466398 - RNA, 21 nt, Human
gcccuucuauacccacccaga

SEQ ID NO: 1466399 - RNA, 19 nt, Human
gcccuucuuuccacagaag

SEQ ID NO: 1466400 - RNA, 20 nt, Human
gcccuucuauacccacccag

SEQ ID NO: 1466401 - RNA, 21 nt, Human
gccgagaguccaucagccucc

SEQ ID NO: 1466402 - RNA, 13 nt, Human
gccgggagccuga

SEQ ID NO: 1466403 - RNA, 14 nt, Human
gccgggagccugac

SEQ ID NO: 1466404 - RNA, 19 nt, Human
gccgggagccugacccuca

SEQ ID NO: 1466405 - RNA, 17 nt, Human
gccuauuuuaauaaaca

SEQ ID NO: 1466406 - RNA, 22 nt, Human
gccucaaagcaagcauucagaa

SEQ ID NO: 1466407 - RNA, 22 nt, Human
gccucaauuucugaacaccaua

SEQ ID NO: 1466408 - RNA, 14 nt, Human
gccgugacgucugg

SEQ ID NO: 1466409 - RNA, 18 nt, Human
gccgugacgucugggugg

SEQ ID NO: 1466410 - RNA, 22 nt, Human
gccgugacgucuggguggcccu

SEQ ID NO: 1466411 - RNA, 18 nt, Human
gccucucugcaggucccu

SEQ ID NO: 1466412 - RNA, 17 nt, Human
gccucucugcagguccc

SEQ ID NO: 1466413 - RNA, 16 nt, Human
gccucucugcaggucc

SEQ ID NO: 1466414 - RNA, 14 nt, Human
gccucucugcaggu

SEQ ID NO: 1466415 - RNA, 10 nt, Human
gccucucugc

SEQ ID NO: 1466416 - RNA, 14 nt, Human
gccucccauguuca

SEQ ID NO: 1466417 - RNA, 16 nt, Human
gcuacagaagaaacug

SEQ ID NO: 1466418 - RNA, 13 nt, Human
gcuaccaggaaag

SEQ ID NO: 1466419 - RNA, 13 nt, Human
gcuacauaauuua

SEQ ID NO: 1466420 - RNA, 20 nt, Human
gcuaccaaagcaccuuagcu

SEQ ID NO: 1466421 - RNA, 18 nt, Human
gcgccuccaacccuagca

SEQ ID NO: 1466422 - RNA, 14 nt, Human
gcgccaggauggcg

SEQ ID NO: 1466423 - RNA, 23 nt, Human
gcggggaucagagcgcacaggga

SEQ ID NO: 1466424 - RNA, 21 nt, Human
gccuuuauuaaaaacugagug

SEQ ID NO: 1466425 - RNA, 18 nt, Human
gccuuggggcugaugcag

SEQ ID NO: 1466426 - RNA, 20 nt, Human
gccuuggcugacaugaagcu

SEQ ID NO: 1466427 - RNA, 17 nt, Human
gccuugggcuccgugug

SEQ ID NO: 1466428 - RNA, 18 nt, Human
gccuugggcuccgugugg

SEQ ID NO: 1466429 - RNA, 20 nt, Human
gccuugggcuccguguggga

SEQ ID NO: 1466430 - RNA, 22 nt, Human
gccuugggcuccgugugggaga

SEQ ID NO: 1466431 - RNA, 21 nt, Human
gccuugggcuccgugugggag

SEQ ID NO: 1466432 - RNA, 21 nt, Human
gccuucccaaguugugcuuga

SEQ ID NO: 1466433 - RNA, 20 nt, Human
gccuucccaaguugugcuug

SEQ ID NO: 1466434 - RNA, 19 nt, Human
gccuucccaaguugugcuu

SEQ ID NO: 1466435 - RNA, 13 nt, Human
gccuucaaaucaa

SEQ ID NO: 1466436 - RNA, 22 nt, Human
gccuuauuggaaagcagucccc

SEQ ID NO: 1466437 - RNA, 14 nt, Human
gccugguuagaggc

SEQ ID NO: 1466438 - RNA, 19 nt, Human
gccuguaacaagccagauu

SEQ ID NO: 1466439 - RNA, 22 nt, Human
gcccaucugggggccucuucug

SEQ ID NO: 1466440 - RNA, 22 nt, Human
gcccaguaccuagcuggcucug

SEQ ID NO: 1466441 - RNA, 22 nt, Human
gcccagugcacuugcuggaaga

SEQ ID NO: 1466442 - RNA, 19 nt, Human
gcccagugcacuugcugga

SEQ ID NO: 1466443 - RNA, 21 nt, Human
gcccggacgcccaggacccca

SEQ ID NO: 1466444 - RNA, 19 nt, Human
gcccggacgcccaggaccc

SEQ ID NO: 1466445 - RNA, 14 nt, Human
gcccucccccuccu

SEQ ID NO: 1466446 - RNA, 21 nt, Human
gccccuagcgcuaucucccug

SEQ ID NO: 1466447 - RNA, 18 nt, Human
gccccuacccuggacuug

SEQ ID NO: 1466448 - RNA, 13 nt, Human
gccccgcguggaa

SEQ ID NO: 1466449 - RNA, 16 nt, Human
gcccacagcuguauga

SEQ ID NO: 1466450 - RNA, 15 nt, Human
gccauuugcuuuuuc

SEQ ID NO: 1466451 - RNA, 19 nt, Human
gccaggaagaucccccaga

SEQ ID NO: 1466452 - RNA, 15 nt, Human
gccagcuuucccugc

SEQ ID NO: 1466453 - RNA, 22 nt, Human
gccagagccaaggggcuucagg

SEQ ID NO: 1466454 - RNA, 21 nt, Human
gcaggaguuucguuuucaaaa

SEQ ID NO: 1466455 - RNA, 20 nt, Human
gcaggaguuucguuuucaaa

SEQ ID NO: 1466456 - RNA, 15 nt, Human
gcaggagggaggugc

SEQ ID NO: 1466457 - RNA, 16 nt, Human
gcagcaacaauaaaua

SEQ ID NO: 1466458 - RNA, 11 nt, Human
gcagcaacaau

SEQ ID NO: 1466459 - RNA, 20 nt, Human
gcacagccucuuagaugcag

SEQ ID NO: 1466460 - RNA, 12 nt, Human
gcacagccuggc

SEQ ID NO: 1466461 - RNA, 19 nt, Human
gcacagccuggcuguggcc

SEQ ID NO: 1466462 - RNA, 13 nt, Human
gcacagcuaugaa

SEQ ID NO: 1466463 - RNA, 16 nt, Human
gcacagcuaugaaggc

SEQ ID NO: 1466464 - RNA, 16 nt, Human
gcacaggcuaauuuuu

SEQ ID NO: 1466465 - RNA, 15 nt, Human
gcacaggcuaauuuu

SEQ ID NO: 1466466 - RNA, 19 nt, Human
gcaccaccaugccaggcua

SEQ ID NO: 1466467 - RNA, 17 nt, Human
gcacugauguuguguuu

SEQ ID NO: 1466468 - RNA, 20 nt, Human
gcacugauguuguguuuuua

SEQ ID NO: 1466469 - RNA, 18 nt, Human
gcacugauguuguguuuu

SEQ ID NO: 1466470 - RNA, 11 nt, Human
gcaggucccua

SEQ ID NO: 1466471 - RNA, 10 nt, Human
gcaggucccu

SEQ ID NO: 1466472 - RNA, 13 nt, Human
gcaggucccuaau

SEQ ID NO: 1466473 - RNA, 12 nt, Human
gcaggucccuaa

SEQ ID NO: 1466474 - RNA, 17 nt, Human
gcaggaucucaccaggc

SEQ ID NO: 1466475 - RNA, 18 nt, Human
gcaggaucucaccaggca

SEQ ID NO: 1466476 - RNA, 19 nt, Human
gcaggaucucaccaggcag

SEQ ID NO: 1466477 - RNA, 20 nt, Human
gcaggaucucaccaggcagc

SEQ ID NO: 1466478 - RNA, 22 nt, Human
gcaggaucucaccaggcagccu

SEQ ID NO: 1466479 - RNA, 21 nt, Human
gcaggaucucaccaggcagcc

SEQ ID NO: 1466480 - RNA, 20 nt, Human
gcaggauuggggaagagagc

SEQ ID NO: 1466481 - RNA, 21 nt, Human
gcaggauuggggaagagagcc

SEQ ID NO: 1466482 - RNA, 14 nt, Human
gcaggcucccaggg

SEQ ID NO: 1466483 - RNA, 22 nt, Human
gcaggcucccagggacaccugg

SEQ ID NO: 1466484 - RNA, 13 nt, Human
gcaguucugaaga

SEQ ID NO: 1466485 - RNA, 14 nt, Human
gcaguucugaagaa

SEQ ID NO: 1466486 - RNA, 18 nt, Human
gcagugggaggguaccag

SEQ ID NO: 1466487 - RNA, 19 nt, Human
gcauauuuauaaaaauaaa

SEQ ID NO: 1466488 - RNA, 18 nt, Human
gcauauuauuuuauguug

SEQ ID NO: 1466489 - RNA, 23 nt, Human
gcauauuauuuuauguugcauag

SEQ ID NO: 1466490 - RNA, 15 nt, Human
gcauuauaaaaagaa

SEQ ID NO: 1466491 - RNA, 14 nt, Human
gcauuacugcaugc

SEQ ID NO: 1466492 - RNA, 17 nt, Human
gcauuacugcaugcacu

SEQ ID NO: 1466493 - RNA, 23 nt, Human
gcauggaaauucccuucaucugg

SEQ ID NO: 1466494 - RNA, 21 nt, Human
gcauggaaggcaagauugugu

SEQ ID NO: 1466495 - RNA, 15 nt, Human
gcaugccuucaaauc

SEQ ID NO: 1466496 - RNA, 17 nt, Human
gcaugcuggugagccaa

SEQ ID NO: 1466497 - RNA, 17 nt, Human
gcaugaauuugugaagg

SEQ ID NO: 1466498 - RNA, 15 nt, Human
gcaugaauuugugaa

SEQ ID NO: 1466499 - RNA, 17 nt, Human
gcauuuuacuguacaga

SEQ ID NO: 1466500 - RNA, 16 nt, Human
gcauuuuacuguacag

SEQ ID NO: 1466501 - RNA, 15 nt, Human
gcauuuggguccagg

SEQ ID NO: 1466502 - RNA, 16 nt, Human
gcauuuggguccagga

SEQ ID NO: 1466503 - RNA, 17 nt, Human
gcauuuggguccaggag

SEQ ID NO: 1466504 - RNA, 18 nt, Human
gcauuuggguccaggagg

SEQ ID NO: 1466505 - RNA, 22 nt, Human
gcauuuuguaaguugaagcaaa

SEQ ID NO: 1466506 - RNA, 23 nt, Human
gccaaaacaauguuuaaaccuuu

SEQ ID NO: 1466507 - RNA, 13 nt, Human
gccaaaaauagcu

SEQ ID NO: 1466508 - RNA, 21 nt, Human
gccaaagaaccaaagaagaaa

SEQ ID NO: 1466509 - RNA, 21 nt, Human
gccaaaccaggacccugucca

SEQ ID NO: 1466510 - RNA, 18 nt, Human
gccaaaccaggacccugu

SEQ ID NO: 1466511 - RNA, 18 nt, Human
gacuucccacggcuccuc

SEQ ID NO: 1466512 - RNA, 23 nt, Human
gaucaccgacugaaaauauuguu

SEQ ID NO: 1466513 - RNA, 16 nt, Human
gauaucaugcaaauuu

SEQ ID NO: 1466514 - RNA, 13 nt, Human
gauaucucaucuc

SEQ ID NO: 1466515 - RNA, 14 nt, Human
gauaucucaucucu

SEQ ID NO: 1466516 - RNA, 17 nt, Human
gaucaggaagagaagga

SEQ ID NO: 1466517 - RNA, 18 nt, Human
gaucaggaagagaaggag

SEQ ID NO: 1466518 - RNA, 16 nt, Human
gaucaggaagagaagg

SEQ ID NO: 1466519 - RNA, 15 nt, Human
gaucaggaagagaag

SEQ ID NO: 1466520 - RNA, 12 nt, Human
gaucaggaagag

SEQ ID NO: 1466521 - RNA, 23 nt, Human
gaucagcuuauugucuagugaaa

SEQ ID NO: 1466522 - RNA, 17 nt, Human
gauaggucagugcaaau

SEQ ID NO: 1466523 - RNA, 18 nt, Human
gauaauuuuaaauucucu

SEQ ID NO: 1466524 - RNA, 12 nt, Human
gauaauuuuaaa

SEQ ID NO: 1466525 - RNA, 19 nt, Human
gauauaguuuuacuuuuaa

SEQ ID NO: 1466526 - RNA, 21 nt, Human
gauauaguuuuacuuuuaaac

SEQ ID NO: 1466527 - RNA, 24 nt, Human
gauauaguuuuacuuuuaaacugu

SEQ ID NO: 1466528 - RNA, 14 nt, Human
gaugcagcucaaga

SEQ ID NO: 1466529 - RNA, 14 nt, Human
gauccuggaaauca

SEQ ID NO: 1466530 - RNA, 20 nt, Human
gauccuguauucagacagau

SEQ ID NO: 1466531 - RNA, 12 nt, Human
gauccuccucau

SEQ ID NO: 1466532 - RNA, 16 nt, Human
gauugggaauccgccc

SEQ ID NO: 1466533 - RNA, 15 nt, Human
gauuguuccugcuuu

SEQ ID NO: 1466534 - RNA, 11 nt, Human
gauuguuugca

SEQ ID NO: 1466535 - RNA, 16 nt, Human
gauuucaugcuaucuc

SEQ ID NO: 1466536 - RNA, 18 nt, Human
gauuucaugcuaucucug

SEQ ID NO: 1466537 - RNA, 20 nt, Human
gauuucaugcuaucucugug

SEQ ID NO: 1466538 - RNA, 22 nt, Human
gauuaaguaaugauaacuggaa

SEQ ID NO: 1466539 - RNA, 14 nt, Human
gauuaaguaaugau

SEQ ID NO: 1466540 - RNA, 21 nt, Human
gauucaugccaauuagcaauu

SEQ ID NO: 1466541 - RNA, 19 nt, Human
gauucauuuuaacaucuga

SEQ ID NO: 1466542 - RNA, 23 nt, Human
gcaauccucccacuucagccucc

SEQ ID NO: 1466543 - RNA, 20 nt, Human
gcaauccucccacuucagcc

SEQ ID NO: 1466544 - RNA, 22 nt, Human
gcaaucugacccuaugggucua

SEQ ID NO: 1466545 - RNA, 17 nt, Human
gcaagcauucagaagaa

SEQ ID NO: 1466546 - RNA, 23 nt, Human
gcaagcuuaauggcugauaauuu

SEQ ID NO: 1466547 - RNA, 23 nt, Human
gcaagauggggagugagaggcug

SEQ ID NO: 1466548 - RNA, 14 nt, Human
gcaagauugugucc

SEQ ID NO: 1466549 - RNA, 22 nt, Human
gcaacuuuguauaaaagggacu

SEQ ID NO: 1466550 - RNA, 18 nt, Human
gcaaacuuuauuuugugu

SEQ ID NO: 1466551 - RNA, 19 nt, Human
gcaaaccugaccccugcuc

SEQ ID NO: 1466552 - RNA, 21 nt, Human
gcaaaccugaccccugcucag

SEQ ID NO: 1466553 - RNA, 20 nt, Human
gcaaacuuuauuuuguguuu

SEQ ID NO: 1466554 - RNA, 14 nt, Human
gcaaagaauugacu

SEQ ID NO: 1466555 - RNA, 21 nt, Human
gcaaagacuauucccuucuaa

SEQ ID NO: 1466556 - RNA, 22 nt, Human
gcaaagacuauucccuucuaac

SEQ ID NO: 1466557 - RNA, 23 nt, Human
gcaaaugugaaucauuuuaccuu

SEQ ID NO: 1466558 - RNA, 12 nt, Human
gcaaaugugaau

SEQ ID NO: 1466559 - RNA, 16 nt, Human
gaagagaucaggaaga

SEQ ID NO: 1466560 - RNA, 17 nt, Human
gaagagaucaggaagag

SEQ ID NO: 1466561 - RNA, 15 nt, Human
gaagagauuuuucau

SEQ ID NO: 1466562 - RNA, 18 nt, Human
gaagagauuuuucaugau

SEQ ID NO: 1466563 - RNA, 20 nt, Human
gaagagagccugcaggaucu

SEQ ID NO: 1466564 - RNA, 12 nt, Human
gaagagcagccc

SEQ ID NO: 1466565 - RNA, 15 nt, Human
gaagagaaggagcag

SEQ ID NO: 1466566 - RNA, 15 nt, Human
gaagagacagcccag

SEQ ID NO: 1466567 - RNA, 14 nt, Human
gaagagaaggagca

SEQ ID NO: 1466568 - RNA, 13 nt, Human
gaagagaaggagc

SEQ ID NO: 1466569 - RNA, 12 nt, Human
gaagagaaggag

SEQ ID NO: 1466570 - RNA, 12 nt, Human
gaagaacugaaa

SEQ ID NO: 1466571 - RNA, 19 nt, Human
gaagacugcauuauauuua

SEQ ID NO: 1466572 - RNA, 19 nt, Human
gaacuuugcugagccugua

SEQ ID NO: 1466573 - RNA, 22 nt, Human
gaacucaucuagguaaauuaca

SEQ ID NO: 1466574 - RNA, 16 nt, Human
gaacuuuuuauugauu

SEQ ID NO: 1466575 - RNA, 20 nt, Human
gaacucaucuagguaaauua

SEQ ID NO: 1466576 - RNA, 21 nt, Human
gaacucaucuagguaaauuac

SEQ ID NO: 1466577 - RNA, 15 nt, Human
gaagauacugaaaua

SEQ ID NO: 1466578 - RNA, 20 nt, Human
gaagagguuuuaaagcuucc

SEQ ID NO: 1466579 - RNA, 14 nt, Human
gaagccccugggcc

SEQ ID NO: 1466580 - RNA, 18 nt, Human
gaagccccugggcccagu

SEQ ID NO: 1466581 - RNA, 22 nt, Human
gaacauaaaaaggacaucagca

SEQ ID NO: 1466582 - RNA, 18 nt, Human
gaacauaaaaaggacauc

SEQ ID NO: 1466583 - RNA, 16 nt, Human
gaacauaaaaaggaca

SEQ ID NO: 1466584 - RNA, 14 nt, Human
gaacauaaaaagga

SEQ ID NO: 1466585 - RNA, 16 nt, Human
gaacauagacagaaga

SEQ ID NO: 1466586 - RNA, 12 nt, Human
gaacauauuguu

SEQ ID NO: 1466587 - RNA, 18 nt, Human
gaacauauuguugaaagg

SEQ ID NO: 1466588 - RNA, 17 nt, Human
gaacaucacauuccucu

SEQ ID NO: 1466589 - RNA, 21 nt, Human
gaaauuucagauucccagagc

SEQ ID NO: 1466590 - RNA, 23 nt, Human
gaaauuucagauucccagagcaa

SEQ ID NO: 1466591 - RNA, 17 nt, Human
gaacagauaaucccugu

SEQ ID NO: 1466592 - RNA, 18 nt, Human
gaacagauaaucccugua

SEQ ID NO: 1466593 - RNA, 21 nt, Human
gaacagcagacucagcucuga

SEQ ID NO: 1466594 - RNA, 20 nt, Human
gaacagcagacucagcucug

SEQ ID NO: 1466595 - RNA, 16 nt, Human
gaaauuguauuacaaa

SEQ ID NO: 1466596 - RNA, 12 nt, Human
gaaaauaaagaa

SEQ ID NO: 1466597 - RNA, 13 nt, Human
gaaaauaaagaau

SEQ ID NO: 1466598 - RNA, 16 nt, Human
gaaaauaaagaaugga

SEQ ID NO: 1466599 - RNA, 15 nt, Human
gaaaauaaagaaugg

SEQ ID NO: 1466600 - RNA, 17 nt, Human
gaaauuuauaaacuuuu

SEQ ID NO: 1466601 - RNA, 16 nt, Human
gaaauuuauaaacuuu

SEQ ID NO: 1466602 - RNA, 18 nt, Human
gaaauuguauuacaaauc

SEQ ID NO: 1466603 - RNA, 11 nt, Human
gaaauuucaga

SEQ ID NO: 1466604 - RNA, 14 nt, Human
gaacaucccuccug

SEQ ID NO: 1466605 - RNA, 14 nt, Human
gaacuacugaggau

SEQ ID NO: 1466606 - RNA, 21 nt, Human
gaacuagaguuuagcuggaaa

SEQ ID NO: 1466607 - RNA, 12 nt, Human
gaaguccaagca

SEQ ID NO: 1466608 - RNA, 22 nt, Human
gaaguccaagcauuuagaugua

SEQ ID NO: 1466609 - RNA, 14 nt, Human
gaaguauaccugau

SEQ ID NO: 1466610 - RNA, 14 nt, Human
gaaggugggaggau

SEQ ID NO: 1466611 - RNA, 21 nt, Human
gaaguacccguucacauuuuu

SEQ ID NO: 1466612 - RNA, 13 nt, Human
gaagcguuguccu

SEQ ID NO: 1466613 - RNA, 19 nt, Human
gaagcguuguccucagccc

SEQ ID NO: 1466614 - RNA, 20 nt, Human
gaagcguuguccucagcccc

SEQ ID NO: 1466615 - RNA, 20 nt, Human
gaauacucuuauaucuauau

SEQ ID NO: 1466616 - RNA, 22 nt, Human
gaauauuuguuauguagauaac

SEQ ID NO: 1466617 - RNA, 23 nt, Human
gaauauuuuguuuugugcagaga

SEQ ID NO: 1466618 - RNA, 20 nt, Human
gaauaauccuaaacauauga

SEQ ID NO: 1466619 - RNA, 18 nt, Human
gaauaaucacgcuuuccu

SEQ ID NO: 1466620 - RNA, 19 nt, Human
gaauaaucacgcuuuccug

SEQ ID NO: 1466621 - RNA, 20 nt, Human
gaauaaucacgcuuuccuga

SEQ ID NO: 1466622 - RNA, 21 nt, Human
gaauaaucacgcuuuccugaa

SEQ ID NO: 1466623 - RNA, 17 nt, Human
gaaugaagauacugaaa

SEQ ID NO: 1466624 - RNA, 18 nt, Human
gaaugaagauacugaaau

SEQ ID NO: 1466625 - RNA, 21 nt, Human
gaaugaagauacugaaauaaa

SEQ ID NO: 1466626 - RNA, 19 nt, Human
gaaugaagauacugaaaua

SEQ ID NO: 1466627 - RNA, 16 nt, Human
gaaucaagggucaggc

SEQ ID NO: 1466628 - RNA, 17 nt, Human
gaaucaagggucaggcc

SEQ ID NO: 1466629 - RNA, 19 nt, Human
gaaucuuuaaaagaugcuu

SEQ ID NO: 1466630 - RNA, 19 nt, Human
gaaucaagggucaggccuu

SEQ ID NO: 1466631 - RNA, 22 nt, Human
gaauggaggggcagagccagga

SEQ ID NO: 1466632 - RNA, 21 nt, Human
gaauggaggggcagagccagg

SEQ ID NO: 1466633 - RNA, 20 nt, Human
gaauggaggggcagagccag

SEQ ID NO: 1466634 - RNA, 16 nt, Human
gaauggaggggcagag

SEQ ID NO: 1466635 - RNA, 15 nt, Human
gaauggaggggcaga

SEQ ID NO: 1466636 - RNA, 15 nt, Human
gaauggaaagcuuca

SEQ ID NO: 1466637 - RNA, 20 nt, Human
gaauguaaagcuugucugau

SEQ ID NO: 1466638 - RNA, 15 nt, Human
gaauguaaagcuugu

SEQ ID NO: 1466639 - RNA, 17 nt, Human
gaauguaaauuuguacu

SEQ ID NO: 1466640 - RNA, 14 nt, Human
gaauguaaauuugu

SEQ ID NO: 1466641 - RNA, 23 nt, Human
gaauuguguuuauaauuuuaaau

SEQ ID NO: 1466642 - RNA, 15 nt, Human
gaauuguguuuauaa

SEQ ID NO: 1466643 - RNA, 22 nt, Human
gaauuuaaauagcuuuuuucuc

SEQ ID NO: 1466644 - RNA, 15 nt, Human
gaauuguuaguuucu

SEQ ID NO: 1466645 - RNA, 15 nt, Human
gaauugaguguuuaa

SEQ ID NO: 1466646 - RNA, 19 nt, Human
gaauucuuuaaaauuacaa

SEQ ID NO: 1466647 - RNA, 19 nt, Human
gaauugaguguuuaaaguu

SEQ ID NO: 1466648 - RNA, 15 nt, Human
gaccccagccaucca

SEQ ID NO: 1466649 - RNA, 17 nt, Human
gaccagcaggcuggccu

SEQ ID NO: 1466650 - RNA, 18 nt, Human
gaccagccgugagcaugu

SEQ ID NO: 1466651 - RNA, 22 nt, Human
gacauccagcagauuuccagcc

SEQ ID NO: 1466652 - RNA, 13 nt, Human
gacauccagcaga

SEQ ID NO: 1466653 - RNA, 14 nt, Human
gacaucagcaaaca

SEQ ID NO: 1466654 - RNA, 16 nt, Human
gacaucacuuguacaa

SEQ ID NO: 1466655 - RNA, 22 nt, Human
gacaucacuuguacaaaauaaa

SEQ ID NO: 1466656 - RNA, 23 nt, Human
gacauccauguuccgagaagaac

SEQ ID NO: 1466657 - RNA, 15 nt, Human
gaccaccaagccuug

SEQ ID NO: 1466658 - RNA, 14 nt, Human
gaccaccaagccuu

SEQ ID NO: 1466659 - RNA, 13 nt, Human
gaccaccaagccu

SEQ ID NO: 1466660 - RNA, 12 nt, Human
gaccaccaagcc

SEQ ID NO: 1466661 - RNA, 22 nt, Human
gaccaccaagccuugauuggug

SEQ ID NO: 1466662 - RNA, 20 nt, Human
gacacuacacccagcaauag

SEQ ID NO: 1466663 - RNA, 19 nt, Human
gacacuacacccagcaaua

SEQ ID NO: 1466664 - RNA, 18 nt, Human
gacacuacacccagcaau

SEQ ID NO: 1466665 - RNA, 17 nt, Human
gacacuacacccagcaa

SEQ ID NO: 1466666 - RNA, 16 nt, Human
gacacuacacccagca

SEQ ID NO: 1466667 - RNA, 15 nt, Human
gacacuacacccagc

SEQ ID NO: 1466668 - RNA, 14 nt, Human
gacacuacacccag

SEQ ID NO: 1466669 - RNA, 22 nt, Human
gacacgcacggcagccacagcu

SEQ ID NO: 1466670 - RNA, 21 nt, Human
gacacgcacggcagccacagc

SEQ ID NO: 1466671 - RNA, 20 nt, Human
gacacgcacggcagccacag

SEQ ID NO: 1466672 - RNA, 19 nt, Human
gacacgcacggcagccaca

SEQ ID NO: 1466673 - RNA, 14 nt, Human
gacacgcacggcag

SEQ ID NO: 1466674 - RNA, 12 nt, Human
gaauuucaccug

SEQ ID NO: 1466675 - RNA, 17 nt, Human
gaauuucaccuguaaac

SEQ ID NO: 1466676 - RNA, 21 nt, Human
gaauuucaccuguaaaccuga

SEQ ID NO: 1466677 - RNA, 17 nt, Human
gaauuucccacauaccc

SEQ ID NO: 1466678 - RNA, 18 nt, Human
gacacuagcccaaugaaa

SEQ ID NO: 1466679 - RNA, 16 nt, Human
gacagggcgggggugg

SEQ ID NO: 1466680 - RNA, 17 nt, Human
gacagggcggggguggc

SEQ ID NO: 1466681 - RNA, 14 nt, Human
gacaguucaagaaa

SEQ ID NO: 1466682 - RNA, 22 nt, Human
gacauaaaguugauaaagauuu

SEQ ID NO: 1466683 - RNA, 15 nt, Human
gacaucacuuguaca

SEQ ID NO: 1466684 - RNA, 16 nt, Human
gacaguuuauuuguug

SEQ ID NO: 1466685 - RNA, 17 nt, Human
gacauaaaguugauaaa

SEQ ID NO: 1466686 - RNA, 19 nt, Human
gacauaaaguugauaaaga

SEQ ID NO: 1466687 - RNA, 20 nt, Human
gacauaaaguugauaaagau

SEQ ID NO: 1466688 - RNA, 14 nt, Human
gacaggauguguuu

SEQ ID NO: 1466689 - RNA, 18 nt, Human
gacaggauguguuugcuu

SEQ ID NO: 1466690 - RNA, 23 nt, Human
gacaggaugguucccuugaugaa

SEQ ID NO: 1466691 - RNA, 19 nt, Human
gacaggauguguuugcuuu

SEQ ID NO: 1466692 - RNA, 20 nt, Human
gacaggauguguuugcuuuc

SEQ ID NO: 1466693 - RNA, 18 nt, Human
gacaggauguuugcucag

SEQ ID NO: 1466694 - RNA, 23 nt, Human
gacugcggaggaaggaggaccca

SEQ ID NO: 1466695 - RNA, 15 nt, Human
gacugcggaggaagg

SEQ ID NO: 1466696 - RNA, 18 nt, Human
gacuuauaguacaugaua

SEQ ID NO: 1466697 - RNA, 17 nt, Human
gacuuauaguacaugau

SEQ ID NO: 1466698 - RNA, 16 nt, Human
gacuuauaguacauga

SEQ ID NO: 1466699 - RNA, 21 nt, Human
gacuucaagcauggcuauuuu

SEQ ID NO: 1466700 - RNA, 14 nt, Human
gacuuacaugauuc

SEQ ID NO: 1466701 - RNA, 15 nt, Human
gacuuacaugauuca

SEQ ID NO: 1466702 - RNA, 16 nt, Human
gacuuacaugauucau

SEQ ID NO: 1466703 - RNA, 18 nt, Human
gacuuacaugauucauuu

SEQ ID NO: 1466704 - RNA, 19 nt, Human
gacuuacaugauucauuuu

SEQ ID NO: 1466705 - RNA, 11 nt, Human
gacugagaaau

SEQ ID NO: 1466706 - RNA, 14 nt, Human
gacucuaagaaaga

SEQ ID NO: 1466707 - RNA, 15 nt, Human
gacucuaagaaagaa

SEQ ID NO: 1466708 - RNA, 16 nt, Human
gacucuaagaaagaac

SEQ ID NO: 1466709 - RNA, 20 nt, Human
gacuaauggcaugagaaaua

SEQ ID NO: 1466710 - RNA, 14 nt, Human
gacuaauggcauga

SEQ ID NO: 1466711 - RNA, 16 nt, Human
gacuaauggcaugaga

SEQ ID NO: 1466712 - RNA, 14 nt, Human
gacuacaggcguga

SEQ ID NO: 1466713 - RNA, 19 nt, Human
gacugccaagacugcugug

SEQ ID NO: 1466714 - RNA, 20 nt, Human
gacugccaagacugcugugg

SEQ ID NO: 1466715 - RNA, 12 nt, Human
gacugccaagcc

SEQ ID NO: 1466716 - RNA, 16 nt, Human
gacugccaagccaugg

SEQ ID NO: 1466717 - RNA, 14 nt, Human
gacugccaagccau

SEQ ID NO: 1466718 - RNA, 13 nt, Human
gacugccaagcca

SEQ ID NO: 1466719 - RNA, 15 nt, Human
gacugccaagccaug

SEQ ID NO: 1466720 - RNA, 13 nt, Human
gacugagaaauuu

SEQ ID NO: 1466721 - RNA, 17 nt, Human
gacgucuggguggcccu

SEQ ID NO: 1466722 - RNA, 15 nt, Human
gacuaaucuuauuca

SEQ ID NO: 1466723 - RNA, 22 nt, Human
gacuaaucuuauucauuuucuc

SEQ ID NO: 1466724 - RNA, 16 nt, Human
cuuccuucccugcugu

SEQ ID NO: 1466725 - RNA, 15 nt, Human
cuuccuucccugcug

SEQ ID NO: 1466726 - RNA, 14 nt, Human
cuuccuuccucucc

SEQ ID NO: 1466727 - RNA, 22 nt, Human
cuucucagauuucugaggaaau

SEQ ID NO: 1466728 - RNA, 19 nt, Human
cuucucagauuucugagga

SEQ ID NO: 1466729 - RNA, 14 nt, Human
cuucucagauuucu

SEQ ID NO: 1466730 - RNA, 15 nt, Human
cuucguuuauuuuca

SEQ ID NO: 1466731 - RNA, 16 nt, Human
cuucguuuauuuucaa

SEQ ID NO: 1466732 - RNA, 18 nt, Human
cuucguuuauuuucaaga

SEQ ID NO: 1466733 - RNA, 19 nt, Human
cuucuccauggcccugcca

SEQ ID NO: 1466734 - RNA, 15 nt, Human
cuucucccaauucau

SEQ ID NO: 1466735 - RNA, 17 nt, Human
cuucuccauggcccugc

SEQ ID NO: 1466736 - RNA, 20 nt, Human
cuucucauuuuuuaaaaaag

SEQ ID NO: 1466737 - RNA, 14 nt, Human
cuucugccuucuca

SEQ ID NO: 1466738 - RNA, 16 nt, Human
cuucugccuucucaug

SEQ ID NO: 1466739 - RNA, 15 nt, Human
cuucuggacugguuu

SEQ ID NO: 1466740 - RNA, 18 nt, Human
cuucagcgguuuauauaa

SEQ ID NO: 1466741 - RNA, 17 nt, Human
cuuauuuuugacagugu

SEQ ID NO: 1466742 - RNA, 13 nt, Human
cuucagcucugaa

SEQ ID NO: 1466743 - RNA, 14 nt, Human
cuucagcucugaaa

SEQ ID NO: 1466744 - RNA, 14 nt, Human
cuucauuuccuccg

SEQ ID NO: 1466745 - RNA, 18 nt, Human
cuucauuugggaugcuac

SEQ ID NO: 1466746 - RNA, 22 nt, Human
cuuccggggaaggauuuugcag

SEQ ID NO: 1466747 - RNA, 23 nt, Human
cuuccaccaaguuggaacauccu

SEQ ID NO: 1466748 - RNA, 20 nt, Human
cuuccagucuuccugacacu

SEQ ID NO: 1466749 - RNA, 21 nt, Human
cuuccagucuuccugacacuu

SEQ ID NO: 1466750 - RNA, 22 nt, Human
cuuccagucuuccugacacuuu

SEQ ID NO: 1466751 - RNA, 19 nt, Human
cuguuuuauaauuuuguga

SEQ ID NO: 1466752 - RNA, 12 nt, Human
cuguuuucuucu

SEQ ID NO: 1466753 - RNA, 18 nt, Human
cuguuuucuucuauucca

SEQ ID NO: 1466754 - RNA, 15 nt, Human
cuguuuuucggacag

SEQ ID NO: 1466755 - RNA, 17 nt, Human
cuguuuuucggacaguu

SEQ ID NO: 1466756 - RNA, 20 nt, Human
cuguuuuucggacaguuuau

SEQ ID NO: 1466757 - RNA, 17 nt, Human
cuguuuuucuaacuggg

SEQ ID NO: 1466758 - RNA, 22 nt, Human
cuguuuuucggacaguuuauuu

SEQ ID NO: 1466759 - RNA, 15 nt, Human
cuguuuacugcaagg

SEQ ID NO: 1466760 - RNA, 17 nt, Human
cuguuuacugcaagguu

SEQ ID NO: 1466761 - RNA, 13 nt, Human
cuguuuagaacac

SEQ ID NO: 1466762 - RNA, 14 nt, Human
cuguuuagaacaca

SEQ ID NO: 1466763 - RNA, 20 nt, Human
cuguuuaguagcagugauug

SEQ ID NO: 1466764 - RNA, 13 nt, Human
cugguugggcagc

SEQ ID NO: 1466765 - RNA, 17 nt, Human
cugguugggcagccaga

SEQ ID NO: 1466766 - RNA, 14 nt, Human
cuguuuuuuuguua

SEQ ID NO: 1466767 - RNA, 21 nt, Human
cuuaagaagacugcauuauau

SEQ ID NO: 1466768 - RNA, 18 nt, Human
cuuaagucagaacagcag

SEQ ID NO: 1466769 - RNA, 17 nt, Human
cuuaagucagaacagca

SEQ ID NO: 1466770 - RNA, 16 nt, Human
cuuaagugcugcaauu

SEQ ID NO: 1466771 - RNA, 21 nt, Human
cuuaaucagauagauauuccu

SEQ ID NO: 1466772 - RNA, 20 nt, Human
cuuaaucagguccucagaga

SEQ ID NO: 1466773 - RNA, 22 nt, Human
cuuaaucagguccucagagaau

SEQ ID NO: 1466774 - RNA, 19 nt, Human
cuuauaguacaugauaaau

SEQ ID NO: 1466775 - RNA, 17 nt, Human
cuuauaguacaugauaa

SEQ ID NO: 1466776 - RNA, 13 nt, Human
cuuauaguacaug

SEQ ID NO: 1466777 - RNA, 14 nt, Human
cuuauaauuuaaaa

SEQ ID NO: 1466778 - RNA, 17 nt, Human
cuuauaauaaaggacug

SEQ ID NO: 1466779 - RNA, 20 nt, Human
cuuauaauaaaggacuguaa

SEQ ID NO: 1466780 - RNA, 16 nt, Human
cuuauaauaaaggacu

SEQ ID NO: 1466781 - RNA, 14 nt, Human
cuuauaauaaagga

SEQ ID NO: 1466782 - RNA, 13 nt, Human
cuuauaauuuaaa

SEQ ID NO: 1466783 - RNA, 21 nt, Human
cuuaggguuaugauuaaguaa

SEQ ID NO: 1466784 - RNA, 21 nt, Human
cuuagaucuggcauguuagcc

SEQ ID NO: 1466785 - RNA, 12 nt, Human
cuuauuuucaag

SEQ ID NO: 1466786 - RNA, 14 nt, Human
cuuauuuucaagaa

SEQ ID NO: 1466787 - RNA, 15 nt, Human
cuuauuuucaagaaa

SEQ ID NO: 1466788 - RNA, 18 nt, Human
cuuauuuucaagaaacug

SEQ ID NO: 1466789 - RNA, 19 nt, Human
cuuauuuucaagaaacuga

SEQ ID NO: 1466790 - RNA, 21 nt, Human
cuuaugacaucacuuguacaa

SEQ ID NO: 1466791 - RNA, 22 nt, Human
cuuaugacaucacuuguacaaa

SEQ ID NO: 1466792 - RNA, 19 nt, Human
cuuagaugcaguucugaag

SEQ ID NO: 1466793 - RNA, 20 nt, Human
cuuagaugcaguucugaaga

SEQ ID NO: 1466794 - RNA, 15 nt, Human
cuuagaucuggcaug

SEQ ID NO: 1466795 - RNA, 16 nt, Human
cuuagaucuggcaugu

SEQ ID NO: 1466796 - RNA, 20 nt, Human
cuuagaccaccaagccuuga

SEQ ID NO: 1466797 - RNA, 19 nt, Human
cuuagaccaccaagccuug

SEQ ID NO: 1466798 - RNA, 17 nt, Human
cuuagaccaccaagccu

SEQ ID NO: 1466799 - RNA, 15 nt, Human
cuuagaccaccaagc

SEQ ID NO: 1466800 - RNA, 16 nt, Human
cuuaauggcugauaau

SEQ ID NO: 1466801 - RNA, 20 nt, Human
cuuaauggcugauaauuuua

SEQ ID NO: 1466802 - RNA, 22 nt, Human
cuuaauggcugauaauuuuaaa

SEQ ID NO: 1466803 - RNA, 19 nt, Human
cuuaccuuuuuauuugcau

SEQ ID NO: 1466804 - RNA, 20 nt, Human
cuuaccuuuuuauuugcaug

SEQ ID NO: 1466805 - RNA, 18 nt, Human
cuuacuuauuaucuucag

SEQ ID NO: 1466806 - RNA, 20 nt, Human
cuugcuugauuguauggugg

SEQ ID NO: 1466807 - RNA, 21 nt, Human
cuugcugcaguaugaaaauaa

SEQ ID NO: 1466808 - RNA, 19 nt, Human
cuugcucuugaugccuggc

SEQ ID NO: 1466809 - RNA, 18 nt, Human
cuugcucuugaugccugg

SEQ ID NO: 1466810 - RNA, 17 nt, Human
cuugcucuugaugccug

SEQ ID NO: 1466811 - RNA, 23 nt, Human
cuugccacaccccccaccccuag

SEQ ID NO: 1466812 - RNA, 19 nt, Human
cuugccacaccccccaccc

SEQ ID NO: 1466813 - RNA, 13 nt, Human
cuugccacacccc

SEQ ID NO: 1466814 - RNA, 13 nt, Human
cuugccaaauuua

SEQ ID NO: 1466815 - RNA, 15 nt, Human
cuugaggggaccagg

SEQ ID NO: 1466816 - RNA, 16 nt, Human
cuugaggggaccagga

SEQ ID NO: 1466817 - RNA, 17 nt, Human
cuugaggggaccaggag

SEQ ID NO: 1466818 - RNA, 18 nt, Human
cuugaggggaccaggagu

SEQ ID NO: 1466819 - RNA, 21 nt, Human
cuugaggggaccaggaguggg

SEQ ID NO: 1466820 - RNA, 12 nt, Human
cuucuggccagg

SEQ ID NO: 1466821 - RNA, 22 nt, Human
cuucuggccaggaagcuuuggu

SEQ ID NO: 1466822 - RNA, 13 nt, Human
cuucuggccagga

SEQ ID NO: 1466823 - RNA, 15 nt, Human
cuucuggccaggaag

SEQ ID NO: 1466824 - RNA, 13 nt, Human
cuucuggccuugu

SEQ ID NO: 1466825 - RNA, 17 nt, Human
cuucuggccaggaagcu

SEQ ID NO: 1466826 - RNA, 19 nt, Human
cuugaggggaccaggagug

SEQ ID NO: 1466827 - RNA, 16 nt, Human
cuuggggcugaugcag

SEQ ID NO: 1466828 - RNA, 21 nt, Human
cuugggcuccgugugggagac

SEQ ID NO: 1466829 - RNA, 18 nt, Human
cuuggggcugaugcaguu

SEQ ID NO: 1466830 - RNA, 15 nt, Human
cuugguuugccuucc

SEQ ID NO: 1466831 - RNA, 12 nt, Human
cuuguacaaaau

SEQ ID NO: 1466832 - RNA, 13 nt, Human
cuuguacaaaaua

SEQ ID NO: 1466833 - RNA, 13 nt, Human
cuuguuucauauu

SEQ ID NO: 1466834 - RNA, 17 nt, Human
cuuugacaaagguaaau

SEQ ID NO: 1466835 - RNA, 13 nt, Human
cuuugaaacagaa

SEQ ID NO: 1466836 - RNA, 20 nt, Human
cuuucugaucaaggccuuau

SEQ ID NO: 1466837 - RNA, 20 nt, Human
cuuucucuuuuccucuacca

SEQ ID NO: 1466838 - RNA, 15 nt, Human
cuuucugaucaaggc

SEQ ID NO: 1466839 - RNA, 16 nt, Human
cuuucugaucaaggcc

SEQ ID NO: 1466840 - RNA, 17 nt, Human
cuuucugaucaaggccu

SEQ ID NO: 1466841 - RNA, 18 nt, Human
cuuucugaucaaggccuu

SEQ ID NO: 1466842 - RNA, 15 nt, Human
cuuuaggagcagugg

SEQ ID NO: 1466843 - RNA, 23 nt, Human
cuuuaggcauuaaauuuuagcaa

SEQ ID NO: 1466844 - RNA, 15 nt, Human
cuuuaggcauuaaau

SEQ ID NO: 1466845 - RNA, 24 nt, Human
cuuuggcaggugcagcccccacug

SEQ ID NO: 1466846 - RNA, 13 nt, Human
cuuuggcaggugc

SEQ ID NO: 1466847 - RNA, 22 nt, Human
cuuugugauucaaucuguaaac

SEQ ID NO: 1466848 - RNA, 23 nt, Human
cuuugugauucaaucuguaaacu

SEQ ID NO: 1466849 - RNA, 16 nt, Human
cuuuguguagcuuugc

SEQ ID NO: 1466850 - RNA, 18 nt, Human
cuuuguguagcuuugcuc

SEQ ID NO: 1466851 - RNA, 23 nt, Human
cuuugcuucauucaagucagcuc

SEQ ID NO: 1466852 - RNA, 18 nt, Human
cuuugccacccucaugcu

SEQ ID NO: 1466853 - RNA, 12 nt, Human
cuuugcuucauu

SEQ ID NO: 1466854 - RNA, 17 nt, Human
cuuugccacccucaugc

SEQ ID NO: 1466855 - RNA, 16 nt, Human
cuuugccacccucaug

SEQ ID NO: 1466856 - RNA, 19 nt, Human
cuuugacaaagguaaauca

SEQ ID NO: 1466857 - RNA, 22 nt, Human
cuuugacaauugggagcugcca

SEQ ID NO: 1466858 - RNA, 23 nt, Human
cuuugacaauugggagcugccaa

SEQ ID NO: 1466859 - RNA, 21 nt, Human
cuuugacaauugggagcugcc

SEQ ID NO: 1466860 - RNA, 18 nt, Human
cuuugacaauugggagcu

SEQ ID NO: 1466861 - RNA, 14 nt, Human
gaaaacaaggauga

SEQ ID NO: 1466862 - RNA, 13 nt, Human
gaaaacaaaacug

SEQ ID NO: 1466863 - RNA, 19 nt, Human
gaaaaauauauacuaaaca

SEQ ID NO: 1466864 - RNA, 16 nt, Human
gaaaaauauguaccaa

SEQ ID NO: 1466865 - RNA, 19 nt, Human
gaaaauaacaauaaaagac

SEQ ID NO: 1466866 - RNA, 14 nt, Human
gaaaaguauguuag

SEQ ID NO: 1466867 - RNA, 17 nt, Human
gaaaagguuuaugaaaa

SEQ ID NO: 1466868 - RNA, 22 nt, Human
gaaaagguuuaugaaaaagaag

SEQ ID NO: 1466869 - RNA, 23 nt, Human
gaaaagguuuaugaaaaagaaga

SEQ ID NO: 1466870 - RNA, 20 nt, Human
gaaaaguauguuagugcaaa

SEQ ID NO: 1466871 - RNA, 17 nt, Human
gaaaacauuccauccuu

SEQ ID NO: 1466872 - RNA, 13 nt, Human
gaaaacauuccau

SEQ ID NO: 1466873 - RNA, 11 nt, Human
gaaaaccuuuc

SEQ ID NO: 1466874 - RNA, 15 nt, Human
gaaaaccuuucuuca

SEQ ID NO: 1466875 - RNA, 18 nt, Human
cuuuuuuaaaugaagaaa

SEQ ID NO: 1466876 - RNA, 14 nt, Human
cuuuuugcagcuuu

SEQ ID NO: 1466877 - RNA, 13 nt, Human
cuuuuugcagcuu

SEQ ID NO: 1466878 - RNA, 12 nt, Human
cuuuuugcagcu

SEQ ID NO: 1466879 - RNA, 13 nt, Human
cuuuuuauuugca

SEQ ID NO: 1466880 - RNA, 14 nt, Human
cuuuuuauuugcau

SEQ ID NO: 1466881 - RNA, 15 nt, Human
cuuuuuauuugcaug

SEQ ID NO: 1466882 - RNA, 15 nt, Human
cuuuucuuaaaccuu

SEQ ID NO: 1466883 - RNA, 16 nt, Human
cuuuucuuaaaccuuc

SEQ ID NO: 1466884 - RNA, 23 nt, Human
cuuuucuucuauugccucugaga

SEQ ID NO: 1466885 - RNA, 19 nt, Human
cuuuucuucuauugccucu

SEQ ID NO: 1466886 - RNA, 18 nt, Human
cuuuucuucuauugccuc

SEQ ID NO: 1466887 - RNA, 17 nt, Human
cuuuguguagcuuugcu

SEQ ID NO: 1466888 - RNA, 21 nt, Human
cuggauuccccaucucaggcc

SEQ ID NO: 1466889 - RNA, 15 nt, Human
cuggauuuuuaccag

SEQ ID NO: 1466890 - RNA, 14 nt, Human
cuggauuuuuacca

SEQ ID NO: 1466891 - RNA, 13 nt, Human
cuggcacagaggu

SEQ ID NO: 1466892 - RNA, 12 nt, Human
cuggcacagagg

SEQ ID NO: 1466893 - RNA, 14 nt, Human
cuggcacagccugg

SEQ ID NO: 1466894 - RNA, 13 nt, Human
cuggauuccagag

SEQ ID NO: 1466895 - RNA, 20 nt, Human
cuggauuccccaucucaggc

SEQ ID NO: 1466896 - RNA, 21 nt, Human
cuggauuccagagcacugcuc

SEQ ID NO: 1466897 - RNA, 17 nt, Human
cuggauuauauuaugaa

SEQ ID NO: 1466898 - RNA, 16 nt, Human
cuggccucaaagcaag

SEQ ID NO: 1466899 - RNA, 21 nt, Human
cuggccucaaagcaagcauuc

SEQ ID NO: 1466900 - RNA, 20 nt, Human
cuggagcccacuguacuugc

SEQ ID NO: 1466901 - RNA, 17 nt, Human
cuggagcccacuguacu

SEQ ID NO: 1466902 - RNA, 16 nt, Human
cuggagcccacuguac

SEQ ID NO: 1466903 - RNA, 15 nt, Human
cuggagcccacugua

SEQ ID NO: 1466904 - RNA, 13 nt, Human
cuggagcccacug

SEQ ID NO: 1466905 - RNA, 21 nt, Human
cuggagcccacuguacuugcu

SEQ ID NO: 1466906 - RNA, 16 nt, Human
cuggagcuagaauuug

SEQ ID NO: 1466907 - RNA, 17 nt, Human
cuggagcuagaauuuga

SEQ ID NO: 1466908 - RNA, 22 nt, Human
cuggagcuagaauuugauaugu

SEQ ID NO: 1466909 - RNA, 12 nt, Human
cuggacagcuug

SEQ ID NO: 1466910 - RNA, 14 nt, Human
cuggacagcuugug

SEQ ID NO: 1466911 - RNA, 14 nt, Human
cuggaccacugggc

SEQ ID NO: 1466912 - RNA, 15 nt, Human
cuggaccacugggca

SEQ ID NO: 1466913 - RNA, 12 nt, Human
cuggaccagccu

SEQ ID NO: 1466914 - RNA, 23 nt, Human
cuggaauaauccuaaacauauga

SEQ ID NO: 1466915 - RNA, 21 nt, Human
cuggaagugcuaauuuugaaa

SEQ ID NO: 1466916 - RNA, 14 nt, Human
cuggaauaaguuca

SEQ ID NO: 1466917 - RNA, 15 nt, Human
cuggaauacaugaaa

SEQ ID NO: 1466918 - RNA, 16 nt, Human
cugggagcuuuuguag

SEQ ID NO: 1466919 - RNA, 23 nt, Human
cugggaacaucacauuccucugc

SEQ ID NO: 1466920 - RNA, 16 nt, Human
cugggaggcucuggag

SEQ ID NO: 1466921 - RNA, 15 nt, Human
cugggaggcucugga

SEQ ID NO: 1466922 - RNA, 17 nt, Human
cugggccccugccucuc

SEQ ID NO: 1466923 - RNA, 16 nt, Human
cugggccccugccucu

SEQ ID NO: 1466924 - RNA, 12 nt, Human
cugggccccugc

SEQ ID NO: 1466925 - RNA, 21 nt, Human
cugggauuacaggcgugagcc

SEQ ID NO: 1466926 - RNA, 19 nt, Human
cugggcaaugauggcaauu

SEQ ID NO: 1466927 - RNA, 12 nt, Human
cuggcuucuggc

SEQ ID NO: 1466928 - RNA, 13 nt, Human
cuggcuucuggcc

SEQ ID NO: 1466929 - RNA, 17 nt, Human
cuggcuucuggccagga

SEQ ID NO: 1466930 - RNA, 19 nt, Human
cuggcuucuggccaggaag

SEQ ID NO: 1466931 - RNA, 17 nt, Human
cuggguaggaaagagga

SEQ ID NO: 1466932 - RNA, 15 nt, Human
cuggguaggaaagag

SEQ ID NO: 1466933 - RNA, 14 nt, Human
cuggguaggaaaga

SEQ ID NO: 1466934 - RNA, 17 nt, Human
cuggguagcgggggagg

SEQ ID NO: 1466935 - RNA, 19 nt, Human
cugggccccugccucucug

SEQ ID NO: 1466936 - RNA, 11 nt, Human
cugggccuugg

SEQ ID NO: 1466937 - RNA, 14 nt, Human
cugggccuugggcu

SEQ ID NO: 1466938 - RNA, 15 nt, Human
cugggccuugggcuc

SEQ ID NO: 1466939 - RNA, 17 nt, Human
cugggccuugggcuccg

SEQ ID NO: 1466940 - RNA, 19 nt, Human
cuggguaggaaagaggaag

SEQ ID NO: 1466941 - RNA, 15 nt, Human
cuggguugcagacag

SEQ ID NO: 1466942 - RNA, 18 nt, Human
cuggguugcagacaggaa

SEQ ID NO: 1466943 - RNA, 11 nt, Human
cugcccugccc

SEQ ID NO: 1466944 - RNA, 21 nt, Human
cugcccugccaccugucuguc

SEQ ID NO: 1466945 - RNA, 20 nt, Human
cugcccugccaccugucugu

SEQ ID NO: 1466946 - RNA, 18 nt, Human
cugcccugccaccugucu

SEQ ID NO: 1466947 - RNA, 17 nt, Human
cugcccugccaccuguc

SEQ ID NO: 1466948 - RNA, 16 nt, Human
cugcccugccaccugu

SEQ ID NO: 1466949 - RNA, 15 nt, Human
cugcccugccaccug

SEQ ID NO: 1466950 - RNA, 14 nt, Human
cugcccugccaccu

SEQ ID NO: 1466951 - RNA, 13 nt, Human
cugcccugccacc

SEQ ID NO: 1466952 - RNA, 11 nt, Human
cugcccugcca

SEQ ID NO: 1466953 - RNA, 18 nt, Human
cugcccgggagcucagga

SEQ ID NO: 1466954 - RNA, 14 nt, Human
cugcccaggcacug

SEQ ID NO: 1466955 - RNA, 15 nt, Human
cugcccaggcacugc

SEQ ID NO: 1466956 - RNA, 16 nt, Human
cugcccaggcacugca

SEQ ID NO: 1466957 - RNA, 16 nt, Human
cugcccagugcacuug

SEQ ID NO: 1466958 - RNA, 19 nt, Human
cugcccagugcacuugcug

SEQ ID NO: 1466959 - RNA, 20 nt, Human
cugccagcauuucccuuccu

SEQ ID NO: 1466960 - RNA, 16 nt, Human
cugccaggagacaggu

SEQ ID NO: 1466961 - RNA, 15 nt, Human
cugccaggagcuuug

SEQ ID NO: 1466962 - RNA, 11 nt, Human
cugccaggagg

SEQ ID NO: 1466963 - RNA, 16 nt, Human
cugccaggaggaccca

SEQ ID NO: 1466964 - RNA, 18 nt, Human
cugccaggaggacccagg

SEQ ID NO: 1466965 - RNA, 19 nt, Human
cugccaggaggacccaggg

SEQ ID NO: 1466966 - RNA, 21 nt, Human
cugccaggaggacccagggcu

SEQ ID NO: 1466967 - RNA, 22 nt, Human
cugccaggaggacccagggcuc

SEQ ID NO: 1466968 - RNA, 23 nt, Human
cugccaggaggacccagggcucu

SEQ ID NO: 1466969 - RNA, 14 nt, Human
cugccucucugcag

SEQ ID NO: 1466970 - RNA, 21 nt, Human
cugccucucgcuccucaaccc

SEQ ID NO: 1466971 - RNA, 13 nt, Human
cugccucucugca

SEQ ID NO: 1466972 - RNA, 12 nt, Human
cugccucucugc

SEQ ID NO: 1466973 - RNA, 19 nt, Human
cugccucuucccucuuccu

SEQ ID NO: 1466974 - RNA, 18 nt, Human
cugccucuucccucuucc

SEQ ID NO: 1466975 - RNA, 19 nt, Human
cugccucuuaaauaaaccu

SEQ ID NO: 1466976 - RNA, 22 nt, Human
cugaucagugggccuccaagga

SEQ ID NO: 1466977 - RNA, 19 nt, Human
cugauaggguuugugacag

SEQ ID NO: 1466978 - RNA, 20 nt, Human
cugauaggguuugugacagg

SEQ ID NO: 1466979 - RNA, 23 nt, Human
cugauaggguuugugacagggcg

SEQ ID NO: 1466980 - RNA, 16 nt, Human
cugaguuuuccauggc

SEQ ID NO: 1466981 - RNA, 17 nt, Human
cugauucacaucucauu

SEQ ID NO: 1466982 - RNA, 21 nt, Human
cugauucacaucucauuuuuc

SEQ ID NO: 1466983 - RNA, 17 nt, Human
cugauucgaaugacacu

SEQ ID NO: 1466984 - RNA, 19 nt, Human
cugauucgaaugacacugu

SEQ ID NO: 1466985 - RNA, 12 nt, Human
cugauguugugu

SEQ ID NO: 1466986 - RNA, 13 nt, Human
cugagucccaucc

SEQ ID NO: 1466987 - RNA, 17 nt, Human
cugagucguacagaaag

SEQ ID NO: 1466988 - RNA, 18 nt, Human
cugagucguacagaaagc

SEQ ID NO: 1466989 - RNA, 19 nt, Human
cugagucguacagaaagcu

SEQ ID NO: 1466990 - RNA, 20 nt, Human
cugagucguacagaaagcug

SEQ ID NO: 1466991 - RNA, 21 nt, Human
cugagucguacagaaagcugc

SEQ ID NO: 1466992 - RNA, 23 nt, Human
cugagucguacagaaagcugccu

SEQ ID NO: 1466993 - RNA, 11 nt, Human
cugagugacuc

SEQ ID NO: 1466994 - RNA, 21 nt, Human
cugagugacucuauauagcug

SEQ ID NO: 1466995 - RNA, 18 nt, Human
cugaguuuuccauggcag

SEQ ID NO: 1466996 - RNA, 19 nt, Human
cugaguuuuccauggcagg

SEQ ID NO: 1466997 - RNA, 20 nt, Human
cugaguuuuccauggcagga

SEQ ID NO: 1466998 - RNA, 22 nt, Human
cugaguuuuccauggcaggaag

SEQ ID NO: 1466999 - RNA, 18 nt, Human
cugcaaaccugaccccug

SEQ ID NO: 1467000 - RNA, 20 nt, Human
cugcaaaccugaccccugcu

SEQ ID NO: 1467001 - RNA, 19 nt, Human
cugcaccaugcugcugggg

SEQ ID NO: 1467002 - RNA, 20 nt, Human
cugcaccaugcugcugggga

SEQ ID NO: 1467003 - RNA, 23 nt, Human
cugcaccaugcugcuggggaaga

SEQ ID NO: 1467004 - RNA, 21 nt, Human
cugcaccaugcugcuggggaa

SEQ ID NO: 1467005 - RNA, 22 nt, Human
cugaaggugaaacauuuucucc

SEQ ID NO: 1467006 - RNA, 23 nt, Human
cugaaccuauuucuuaaacacuu

SEQ ID NO: 1467007 - RNA, 14 nt, Human
cugaauuuaaauag

SEQ ID NO: 1467008 - RNA, 18 nt, Human
cugaauuuaaauagcuuu

SEQ ID NO: 1467009 - RNA, 23 nt, Human
cugaauuuaaauagcuuuuuucu

SEQ ID NO: 1467010 - RNA, 19 nt, Human
cugaauccaaacuaaucca

SEQ ID NO: 1467011 - RNA, 20 nt, Human
cugaauccaaacuaauccau

SEQ ID NO: 1467012 - RNA, 15 nt, Human
cugacauucugauuc

SEQ ID NO: 1467013 - RNA, 13 nt, Human
cucuucagucucu

SEQ ID NO: 1467014 - RNA, 19 nt, Human
cucuuccagucuuccugac

SEQ ID NO: 1467015 - RNA, 22 nt, Human
cucuuccagucuuccugacacu

SEQ ID NO: 1467016 - RNA, 23 nt, Human
cucuuccagucuuccugacacuu

SEQ ID NO: 1467017 - RNA, 13 nt, Human
cucuuaagaagac

SEQ ID NO: 1467018 - RNA, 19 nt, Human
cucuggagcccacuguacu

SEQ ID NO: 1467019 - RNA, 15 nt, Human
cucuggagcccacug

SEQ ID NO: 1467020 - RNA, 21 nt, Human
cucuuggggaguuuagggugg

SEQ ID NO: 1467021 - RNA, 15 nt, Human
cucucauacccuccc

SEQ ID NO: 1467022 - RNA, 16 nt, Human
cucucaucaacugaau

SEQ ID NO: 1467023 - RNA, 22 nt, Human
cucucaguugcagcccugcugc

SEQ ID NO: 1467024 - RNA, 19 nt, Human
cucucaguugcagcccugc

SEQ ID NO: 1467025 - RNA, 15 nt, Human
cucucaguugcagcc

SEQ ID NO: 1467026 - RNA, 17 nt, Human
cucucaucaacugaaug

SEQ ID NO: 1467027 - RNA, 18 nt, Human
cucucaucaacugaauga

SEQ ID NO: 1467028 - RNA, 13 nt, Human
cucucaugaaccu

SEQ ID NO: 1467029 - RNA, 14 nt, Human
cucucaugaaccuc

SEQ ID NO: 1467030 - RNA, 17 nt, Human
cucuccacagcugccuc

SEQ ID NO: 1467031 - RNA, 19 nt, Human
cucuccacucaugugacuc

SEQ ID NO: 1467032 - RNA, 15 nt, Human
cucuaauacauucca

SEQ ID NO: 1467033 - RNA, 19 nt, Human
cucuaauauggcaaccauu

SEQ ID NO: 1467034 - RNA, 13 nt, Human
cucucccaaaaaa

SEQ ID NO: 1467035 - RNA, 23 nt, Human
cucuccaggcaggucugaagcuc

SEQ ID NO: 1467036 - RNA, 22 nt, Human
cucucugcaggucccuaauaaa

SEQ ID NO: 1467037 - RNA, 19 nt, Human
cucucugcaggucccuaau

SEQ ID NO: 1467038 - RNA, 17 nt, Human
cucucugcaggucccua

SEQ ID NO: 1467039 - RNA, 16 nt, Human
cucucugcaggucccu

SEQ ID NO: 1467040 - RNA, 14 nt, Human
cucucugcaggucc

SEQ ID NO: 1467041 - RNA, 13 nt, Human
cucucugcagguc

SEQ ID NO: 1467042 - RNA, 12 nt, Human
cucucugcaggu

SEQ ID NO: 1467043 - RNA, 19 nt, Human
cucucggguugugugucug

SEQ ID NO: 1467044 - RNA, 19 nt, Human
cucucuacaaacucccacu

SEQ ID NO: 1467045 - RNA, 12 nt, Human
cucuggagccca

SEQ ID NO: 1467046 - RNA, 14 nt, Human
cucuggaauuugaa

SEQ ID NO: 1467047 - RNA, 14 nt, Human
cucugcagucucua

SEQ ID NO: 1467048 - RNA, 23 nt, Human
cucugcaggucccuaauaaagcu

SEQ ID NO: 1467049 - RNA, 22 nt, Human
cucugcagucucuauaccaaua

SEQ ID NO: 1467050 - RNA, 16 nt, Human
cucugcaaacugccuu

SEQ ID NO: 1467051 - RNA, 20 nt, Human
cucugcaaacugccuucuuc

SEQ ID NO: 1467052 - RNA, 21 nt, Human
cucugaggggcuaccaggaaa

SEQ ID NO: 1467053 - RNA, 20 nt, Human
cucugaggggcuaccaggaa

SEQ ID NO: 1467054 - RNA, 22 nt, Human
cucugauuuucaaagcuuuuuc

SEQ ID NO: 1467055 - RNA, 20 nt, Human
cucugauuuucaaagcuuuu

SEQ ID NO: 1467056 - RNA, 15 nt, Human
cucugcaaacugccu

SEQ ID NO: 1467057 - RNA, 15 nt, Human
cucugauuuucaaag

SEQ ID NO: 1467058 - RNA, 18 nt, Human
cucugauuuucaaagcuu

SEQ ID NO: 1467059 - RNA, 19 nt, Human
cucugauuuucaaagcuuu

SEQ ID NO: 1467060 - RNA, 16 nt, Human
cucugagaagcucuga

SEQ ID NO: 1467061 - RNA, 14 nt, Human
cucauauuuucaug

SEQ ID NO: 1467062 - RNA, 13 nt, Human
cucaucaacugaa

SEQ ID NO: 1467063 - RNA, 19 nt, Human
cucauauugugauucugcc

SEQ ID NO: 1467064 - RNA, 21 nt, Human
cucauauugugauucugccuu

SEQ ID NO: 1467065 - RNA, 13 nt, Human
cucauauugugau

SEQ ID NO: 1467066 - RNA, 13 nt, Human
cucauccugcagg

SEQ ID NO: 1467067 - RNA, 21 nt, Human
cucaucuagguaaauuacagu

SEQ ID NO: 1467068 - RNA, 14 nt, Human
cucauccugcaggc

SEQ ID NO: 1467069 - RNA, 17 nt, Human
cucaucuccccaucauu

SEQ ID NO: 1467070 - RNA, 11 nt, Human
cucaucucagu

SEQ ID NO: 1467071 - RNA, 18 nt, Human
cucaucucagugaagaau

SEQ ID NO: 1467072 - RNA, 14 nt, Human
cucauuagacugga

SEQ ID NO: 1467073 - RNA, 17 nt, Human
cguuuuuuaaauguaua

SEQ ID NO: 1467074 - RNA, 17 nt, Human
cucaggggccugcccag

SEQ ID NO: 1467075 - RNA, 15 nt, Human
cucagguacuuguaa

SEQ ID NO: 1467076 - RNA, 14 nt, Human
cucauaacuugaga

SEQ ID NO: 1467077 - RNA, 17 nt, Human
cucauaacuugagaccu

SEQ ID NO: 1467078 - RNA, 20 nt, Human
cucauaacuugagaccuaau

SEQ ID NO: 1467079 - RNA, 20 nt, Human
cucaguucauccauucuauu

SEQ ID NO: 1467080 - RNA, 18 nt, Human
cucaguucauccauucua

SEQ ID NO: 1467081 - RNA, 15 nt, Human
cuccacagcugccuc

SEQ ID NO: 1467082 - RNA, 14 nt, Human
cuccacucuuucuu

SEQ ID NO: 1467083 - RNA, 14 nt, Human
cuccagccucagcu

SEQ ID NO: 1467084 - RNA, 17 nt, Human
cuccagccucagccucc

SEQ ID NO: 1467085 - RNA, 15 nt, Human
cuccagccucagccu

SEQ ID NO: 1467086 - RNA, 12 nt, Human
cuccagccucag

SEQ ID NO: 1467087 - RNA, 20 nt, Human
cuccagccaucaagagacug

SEQ ID NO: 1467088 - RNA, 21 nt, Human
cuccagccaucaagagacuga

SEQ ID NO: 1467089 - RNA, 13 nt, Human
cuccuuagaaaaa

SEQ ID NO: 1467090 - RNA, 22 nt, Human
cuccuuaaggcucuuuuguaag

SEQ ID NO: 1467091 - RNA, 13 nt, Human
cuccuuaaggcuc

SEQ ID NO: 1467092 - RNA, 24 nt, Human
cuccuguugggagagggcgcaggc

SEQ ID NO: 1467093 - RNA, 22 nt, Human
cuccuguugggagagggcgcag

SEQ ID NO: 1467094 - RNA, 13 nt, Human
cuccuguugggag

SEQ ID NO: 1467095 - RNA, 14 nt, Human
cuccuguugggaga

SEQ ID NO: 1467096 - RNA, 16 nt, Human
cuccuguugggagagg

SEQ ID NO: 1467097 - RNA, 19 nt, Human
cuccugaggauguguccca

SEQ ID NO: 1467098 - RNA, 14 nt, Human
cuccuuagaaaaaa

SEQ ID NO: 1467099 - RNA, 22 nt, Human
cuccuugagggcaagagccaca

SEQ ID NO: 1467100 - RNA, 21 nt, Human
cuccuugauuuuagccuucuc

SEQ ID NO: 1467101 - RNA, 13 nt, Human
cucuaaauucuuu

SEQ ID NO: 1467102 - RNA, 17 nt, Human
cucuaaauucuuucauu

SEQ ID NO: 1467103 - RNA, 14 nt, Human
cucggaucucuccu

SEQ ID NO: 1467104 - RNA, 14 nt, Human
cuccucuccaccau

SEQ ID NO: 1467105 - RNA, 13 nt, Human
cuccucuccacca

SEQ ID NO: 1467106 - RNA, 15 nt, Human
cuccucuccaccauc

SEQ ID NO: 1467107 - RNA, 14 nt, Human
cuccugaccucagg

SEQ ID NO: 1467108 - RNA, 16 nt, Human
cuccugaccucaggca

SEQ ID NO: 1467109 - RNA, 15 nt, Human
cuccugaccucaggc

SEQ ID NO: 1467110 - RNA, 22 nt, Human
cuccugaaaagguuuaugaaaa

SEQ ID NO: 1467111 - RNA, 21 nt, Human
cucccuucucuacacucuugu

SEQ ID NO: 1467112 - RNA, 22 nt, Human
cuccuaguacuaacuccuagga

SEQ ID NO: 1467113 - RNA, 16 nt, Human
cgucaacucauauuuu

SEQ ID NO: 1467114 - RNA, 22 nt, Human
cgucaaaacagauuguuugcaa

SEQ ID NO: 1467115 - RNA, 20 nt, Human
cgucaacucauauuuucaug

SEQ ID NO: 1467116 - RNA, 21 nt, Human
cgucaaaacagauuguuugca

SEQ ID NO: 1467117 - RNA, 12 nt, Human
cgucaccucaga

SEQ ID NO: 1467118 - RNA, 21 nt, Human
cgucaccccuguuucuggcac

SEQ ID NO: 1467119 - RNA, 15 nt, Human
cguauuuaauagcaa

SEQ ID NO: 1467120 - RNA, 21 nt, Human
cguauuuaauagcaaagaauu

SEQ ID NO: 1467121 - RNA, 23 nt, Human
cguauuuaauagcaaagaauuga

SEQ ID NO: 1467122 - RNA, 19 nt, Human
cgucagcugggacaccccg

SEQ ID NO: 1467123 - RNA, 14 nt, Human
cgucagugcugugc

SEQ ID NO: 1467124 - RNA, 19 nt, Human
cguccaggagccugugccu

SEQ ID NO: 1467125 - RNA, 22 nt, Human
cguauaaaagccuguuuaagag

SEQ ID NO: 1467126 - RNA, 21 nt, Human
cguauaaaagccuguuuaaga

SEQ ID NO: 1467127 - RNA, 17 nt, Human
cguauaaaagccuguuu

SEQ ID NO: 1467128 - RNA, 16 nt, Human
cguauaaaagccuguu

SEQ ID NO: 1467129 - RNA, 23 nt, Human
cguagauauuggacaaagaaccu

SEQ ID NO: 1467130 - RNA, 22 nt, Human
cguagauauuggacaaagaacc

SEQ ID NO: 1467131 - RNA, 12 nt, Human
cgucuggguggc

SEQ ID NO: 1467132 - RNA, 17 nt, Human
cgucuguuuauaaacau

SEQ ID NO: 1467133 - RNA, 15 nt, Human
cguuuauuuucaaga

SEQ ID NO: 1467134 - RNA, 14 nt, Human
cguuuauuuucaag

SEQ ID NO: 1467135 - RNA, 13 nt, Human
cgaucucagcuca

SEQ ID NO: 1467136 - RNA, 20 nt, Human
cgaucuugguucacugcaac

SEQ ID NO: 1467137 - RNA, 16 nt, Human
cgauucucuugccuca

SEQ ID NO: 1467138 - RNA, 12 nt, Human
cgcagaaggaag

SEQ ID NO: 1467139 - RNA, 14 nt, Human
cgcaagggccugau

SEQ ID NO: 1467140 - RNA, 14 nt, Human
ccuuguuuuuuucu

SEQ ID NO: 1467141 - RNA, 17 nt, Human
ccuuggccaugcagaaa

SEQ ID NO: 1467142 - RNA, 15 nt, Human
ccuuggccaugcaga

SEQ ID NO: 1467143 - RNA, 20 nt, Human
ccuuggcugacaugaagcug

SEQ ID NO: 1467144 - RNA, 14 nt, Human
ccuuugacaaaggu

SEQ ID NO: 1467145 - RNA, 20 nt, Human
ccuuugaauccucucucugu

SEQ ID NO: 1467146 - RNA, 14 nt, Human
ccuuugaauccucu

SEQ ID NO: 1467147 - RNA, 16 nt, Human
ccuuugaauccucucu

SEQ ID NO: 1467148 - RNA, 20 nt, Human
ccuuuggcaggugcagcccc

SEQ ID NO: 1467149 - RNA, 19 nt, Human
ccuuuggcaggugcagccc

SEQ ID NO: 1467150 - RNA, 18 nt, Human
ccuuuggcaggugcagcc

SEQ ID NO: 1467151 - RNA, 16 nt, Human
ccuuugcccagaaaga

SEQ ID NO: 1467152 - RNA, 18 nt, Human
ccuuugcugacccucccc

SEQ ID NO: 1467153 - RNA, 21 nt, Human
ccuuugcugacccuccccaaa

SEQ ID NO: 1467154 - RNA, 17 nt, Human
ccuuugcugacccuccc

SEQ ID NO: 1467155 - RNA, 14 nt, Human
ccuuugcugacccu

SEQ ID NO: 1467156 - RNA, 18 nt, Human
cgcuagaggaagcagcca

SEQ ID NO: 1467157 - RNA, 15 nt, Human
cgcgaucucagcuca

SEQ ID NO: 1467158 - RNA, 14 nt, Human
cgcgaucucagcuc

SEQ ID NO: 1467159 - RNA, 13 nt, Human
cgcagaaggaagg

SEQ ID NO: 1467160 - RNA, 14 nt, Human
cgcccaggacccca

SEQ ID NO: 1467161 - RNA, 22 nt, Human
cggaagaagagaucaggaagag

SEQ ID NO: 1467162 - RNA, 21 nt, Human
cggaagaagagaucaggaaga

SEQ ID NO: 1467163 - RNA, 21 nt, Human
cggaauccugucgauuagacu

SEQ ID NO: 1467164 - RNA, 22 nt, Human
cggaauccugucgauuagacug

SEQ ID NO: 1467165 - RNA, 21 nt, Human
cgcuaucucccugccuccugc

SEQ ID NO: 1467166 - RNA, 18 nt, Human
cgcuaucugggaagcuau

SEQ ID NO: 1467167 - RNA, 14 nt, Human
cgcucucuccaggc

SEQ ID NO: 1467168 - RNA, 16 nt, Human
cggaaagaagaaggug

SEQ ID NO: 1467169 - RNA, 15 nt, Human
cggaccccagccauc

SEQ ID NO: 1467170 - RNA, 16 nt, Human
cggacgcccaggaccc

SEQ ID NO: 1467171 - RNA, 16 nt, Human
cggauuuauuuuucca

SEQ ID NO: 1467172 - RNA, 13 nt, Human
cggccugccagga

SEQ ID NO: 1467173 - RNA, 14 nt, Human
cggccugccaggag

SEQ ID NO: 1467174 - RNA, 15 nt, Human
cggccugccaggagg

SEQ ID NO: 1467175 - RNA, 22 nt, Human
cggccugccaggaggacccagg

SEQ ID NO: 1467176 - RNA, 16 nt, Human
cgggagcucaggaacc

SEQ ID NO: 1467177 - RNA, 22 nt, Human
cggcugggaggagggcaggcau

SEQ ID NO: 1467178 - RNA, 18 nt, Human
cggcugggaggagggcag

SEQ ID NO: 1467179 - RNA, 23 nt, Human
cggcugggaggagggcaggcauc

SEQ ID NO: 1467180 - RNA, 15 nt, Human
cggccuuucuagccu

SEQ ID NO: 1467181 - RNA, 20 nt, Human
ccuggaaaccuuccacccag

SEQ ID NO: 1467182 - RNA, 18 nt, Human
ccuggaaaccuuccaccc

SEQ ID NO: 1467183 - RNA, 17 nt, Human
ccuggaaaccuuccacc

SEQ ID NO: 1467184 - RNA, 14 nt, Human
ccuggaccagccuc

SEQ ID NO: 1467185 - RNA, 15 nt, Human
ccuggaccagccucu

SEQ ID NO: 1467186 - RNA, 16 nt, Human
ccuggaccagccucuc

SEQ ID NO: 1467187 - RNA, 20 nt, Human
ccuggacugugugcucagga

SEQ ID NO: 1467188 - RNA, 17 nt, Human
ccuggacugugugcuca

SEQ ID NO: 1467189 - RNA, 13 nt, Human
ccuggacuugccu

SEQ ID NO: 1467190 - RNA, 16 nt, Human
ccuggacuugccucug

SEQ ID NO: 1467191 - RNA, 12 nt, Human
ccuggcggggug

SEQ ID NO: 1467192 - RNA, 13 nt, Human
ccuggcccccucc

SEQ ID NO: 1467193 - RNA, 17 nt, Human
ccuggcucaccuugugc

SEQ ID NO: 1467194 - RNA, 16 nt, Human
ccuggcuauguccuaa

SEQ ID NO: 1467195 - RNA, 20 nt, Human
ccuggcccccucccuggaug

SEQ ID NO: 1467196 - RNA, 13 nt, Human
ccugggauuacag

SEQ ID NO: 1467197 - RNA, 21 nt, Human
ccugggaggcucuggagccca

SEQ ID NO: 1467198 - RNA, 13 nt, Human
ccugggaggcucu

SEQ ID NO: 1467199 - RNA, 21 nt, Human
ccugcuugaugggauucugga

SEQ ID NO: 1467200 - RNA, 22 nt, Human
ccugcuugaugggauucuggac

SEQ ID NO: 1467201 - RNA, 14 nt, Human
ccuggaaaccuucc

SEQ ID NO: 1467202 - RNA, 20 nt, Human
ccugcuuuuuauggccugug

SEQ ID NO: 1467203 - RNA, 16 nt, Human
ccugauuuuuuuuccu

SEQ ID NO: 1467204 - RNA, 22 nt, Human
ccugugagcuaggaauuguguu

SEQ ID NO: 1467205 - RNA, 16 nt, Human
ccuguccaaucuuuga

SEQ ID NO: 1467206 - RNA, 20 nt, Human
ccugugccuccucaccccca

SEQ ID NO: 1467207 - RNA, 21 nt, Human
ccugugccuccucacccccag

SEQ ID NO: 1467208 - RNA, 15 nt, Human
ccugugccuccucac

SEQ ID NO: 1467209 - RNA, 17 nt, Human
ccuguaugucuccagua

SEQ ID NO: 1467210 - RNA, 15 nt, Human
ccuguauucagacag

SEQ ID NO: 1467211 - RNA, 16 nt, Human
ccuguauucagacaga

SEQ ID NO: 1467212 - RNA, 14 nt, Human
ccuugaugaagaag

SEQ ID NO: 1467213 - RNA, 16 nt, Human
ccuugacaacuggcag

SEQ ID NO: 1467214 - RNA, 21 nt, Human
ccuugacaacuggcaggcagg

SEQ ID NO: 1467215 - RNA, 15 nt, Human
ccuugacaacuggca

SEQ ID NO: 1467216 - RNA, 13 nt, Human
ccuuccacccagu

SEQ ID NO: 1467217 - RNA, 14 nt, Human
ccuucaucuggaac

SEQ ID NO: 1467218 - RNA, 20 nt, Human
ccuucaucuggauuccagag

SEQ ID NO: 1467219 - RNA, 13 nt, Human
ccuucaucuggaa

SEQ ID NO: 1467220 - RNA, 18 nt, Human
ccuucaguuaugauuuuu

SEQ ID NO: 1467221 - RNA, 14 nt, Human
ccuuccagaaaaca

SEQ ID NO: 1467222 - RNA, 24 nt, Human
ccuguggaacauaaaaaggacauc

SEQ ID NO: 1467223 - RNA, 23 nt, Human
ccuguggaacauaaaaaggacau

SEQ ID NO: 1467224 - RNA, 19 nt, Human
ccuguggaacauaaaaagg

SEQ ID NO: 1467225 - RNA, 21 nt, Human
ccuuacccugccccagcuggg

SEQ ID NO: 1467226 - RNA, 16 nt, Human
ccuuagaccaccaagc

SEQ ID NO: 1467227 - RNA, 15 nt, Human
ccuuagaccaccaag

SEQ ID NO: 1467228 - RNA, 14 nt, Human
ccuuauuuucaaga

SEQ ID NO: 1467229 - RNA, 18 nt, Human
ccuuauuuucaagaaacu

SEQ ID NO: 1467230 - RNA, 19 nt, Human
ccuuauugcuguccuggag

SEQ ID NO: 1467231 - RNA, 18 nt, Human
ccuuagaccaccaagccu

SEQ ID NO: 1467232 - RNA, 21 nt, Human
ccuuagaccaccaagccuuga

SEQ ID NO: 1467233 - RNA, 14 nt, Human
ccuuagaucuggca

SEQ ID NO: 1467234 - RNA, 22 nt, Human
ccuucaacaauucuaaaaugau

SEQ ID NO: 1467235 - RNA, 23 nt, Human
ccucugcagucucuauaccaaua

SEQ ID NO: 1467236 - RNA, 17 nt, Human
ccucugcagucucuaua

SEQ ID NO: 1467237 - RNA, 16 nt, Human
ccucugcagucucuau

SEQ ID NO: 1467238 - RNA, 19 nt, Human
ccucugcacacccuccaga

SEQ ID NO: 1467239 - RNA, 20 nt, Human
ccucugcacacccuccagag

SEQ ID NO: 1467240 - RNA, 15 nt, Human
ccucugggggguggc

SEQ ID NO: 1467241 - RNA, 19 nt, Human
ccucugggggguggccagg

SEQ ID NO: 1467242 - RNA, 20 nt, Human
ccucugggggguggccaggc

SEQ ID NO: 1467243 - RNA, 19 nt, Human
ccucugguaaccucuuacu

SEQ ID NO: 1467244 - RNA, 23 nt, Human
ccuccuguugggagagggcgcag

SEQ ID NO: 1467245 - RNA, 23 nt, Human
ccucuccacucaugugacucuuu

SEQ ID NO: 1467246 - RNA, 17 nt, Human
ccuccugggaaugaagc

SEQ ID NO: 1467247 - RNA, 19 nt, Human
ccuccugccggcuccuugg

SEQ ID NO: 1467248 - RNA, 14 nt, Human
ccuccucugcccgg

SEQ ID NO: 1467249 - RNA, 15 nt, Human
ccuccucugcccggg

SEQ ID NO: 1467250 - RNA, 21 nt, Human
ccucccucaaccucauccucu

SEQ ID NO: 1467251 - RNA, 17 nt, Human
ccucccucaaccucauc

SEQ ID NO: 1467252 - RNA, 22 nt, Human
ccucccuacccuaaccaaguuc

SEQ ID NO: 1467253 - RNA, 20 nt, Human
ccucagaaaacaaggaugaa

SEQ ID NO: 1467254 - RNA, 18 nt, Human
ccucacuuuuaaugaaca

SEQ ID NO: 1467255 - RNA, 22 nt, Human
ccucacuuuuaaugaacaaaug

SEQ ID NO: 1467256 - RNA, 15 nt, Human
ccucagacucuaaga

SEQ ID NO: 1467257 - RNA, 19 nt, Human
ccucagacucuaagaaaga

SEQ ID NO: 1467258 - RNA, 20 nt, Human
ccucagacucuaagaaagaa

SEQ ID NO: 1467259 - RNA, 21 nt, Human
ccucagacucuaagaaagaac

SEQ ID NO: 1467260 - RNA, 20 nt, Human
ccugaacaggauauucucac

SEQ ID NO: 1467261 - RNA, 21 nt, Human
ccugaacaagaauuggaagcu

SEQ ID NO: 1467262 - RNA, 17 nt, Human
ccugaacugaacaccau

SEQ ID NO: 1467263 - RNA, 23 nt, Human
ccugaagcuaucguaaaauuaag

SEQ ID NO: 1467264 - RNA, 22 nt, Human
ccugaagcuaucguaaaauuaa

SEQ ID NO: 1467265 - RNA, 17 nt, Human
ccugaauccaaacuaau

SEQ ID NO: 1467266 - RNA, 20 nt, Human
ccugaauccaaacuaaucca

SEQ ID NO: 1467267 - RNA, 21 nt, Human
ccugaauccaaacuaauccau

SEQ ID NO: 1467268 - RNA, 18 nt, Human
ccucuuccgugacgucac

SEQ ID NO: 1467269 - RNA, 14 nt, Human
ccugaaauuucaga

SEQ ID NO: 1467270 - RNA, 15 nt, Human
ccugaaauuucagau

SEQ ID NO: 1467271 - RNA, 13 nt, Human
ccugaacaagaau

SEQ ID NO: 1467272 - RNA, 15 nt, Human
ccugaacaagaauug

SEQ ID NO: 1467273 - RNA, 16 nt, Human
ccugaacaagaauugg

SEQ ID NO: 1467274 - RNA, 17 nt, Human
ccugaacaagaauugga

SEQ ID NO: 1467275 - RNA, 23 nt, Human
ccucuuuuuccaacuuggcugca

SEQ ID NO: 1467276 - RNA, 23 nt, Human
ccucuuagaugcaguucugaaga

SEQ ID NO: 1467277 - RNA, 17 nt, Human
ccucuuaaauaaaccuu

SEQ ID NO: 1467278 - RNA, 18 nt, Human
ccucuuaaauaaaccuuu

SEQ ID NO: 1467279 - RNA, 15 nt, Human
ccucugucuucugga

SEQ ID NO: 1467280 - RNA, 16 nt, Human
ccucugucuucuggac

SEQ ID NO: 1467281 - RNA, 23 nt, Human
ccucuguauuugaaucagccuac

SEQ ID NO: 1467282 - RNA, 21 nt, Human
ccugaugggguggaaggcaug

SEQ ID NO: 1467283 - RNA, 15 nt, Human
ccugaugaaaauaaa

SEQ ID NO: 1467284 - RNA, 17 nt, Human
ccugaugaaaauaaaga

SEQ ID NO: 1467285 - RNA, 18 nt, Human
ccugaugaaaauaaagaa

SEQ ID NO: 1467286 - RNA, 19 nt, Human
ccugaugaaaauaaagaau

SEQ ID NO: 1467287 - RNA, 21 nt, Human
ccugaugaaaauaaagaaugg

SEQ ID NO: 1467288 - RNA, 13 nt, Human
ccugaugaaaaua

SEQ ID NO: 1467289 - RNA, 14 nt, Human
ccugaugaaaauaa

SEQ ID NO: 1467290 - RNA, 13 nt, Human
ccugaggccuaga

SEQ ID NO: 1467291 - RNA, 21 nt, Human
ccugaauuuuguugcuguuuu

SEQ ID NO: 1467292 - RNA, 16 nt, Human
cccuuuccugaguccc

SEQ ID NO: 1467293 - RNA, 17 nt, Human
cccuuugcccagaaaga

SEQ ID NO: 1467294 - RNA, 15 nt, Human
cccuuugcugacccu

SEQ ID NO: 1467295 - RNA, 16 nt, Human
cccuugaugaagaagu

SEQ ID NO: 1467296 - RNA, 13 nt, Human
cccuuuugucucu

SEQ ID NO: 1467297 - RNA, 22 nt, Human
ccgacuuuuguuuaccagagaa

SEQ ID NO: 1467298 - RNA, 13 nt, Human
ccgagaagaacag

SEQ ID NO: 1467299 - RNA, 20 nt, Human
ccccuaaaagaaacccugca

SEQ ID NO: 1467300 - RNA, 23 nt, Human
ccccuaaugacaucaccacaguu

SEQ ID NO: 1467301 - RNA, 13 nt, Human
ccccuccccucca

SEQ ID NO: 1467302 - RNA, 18 nt, Human
cccccaguaucucuucag

SEQ ID NO: 1467303 - RNA, 23 nt, Human
cccccagcuuugcuaccaaagca

SEQ ID NO: 1467304 - RNA, 20 nt, Human
cccccaaccauuuccucaga

SEQ ID NO: 1467305 - RNA, 19 nt, Human
cccccaagcuguuuucuuc

SEQ ID NO: 1467306 - RNA, 22 nt, Human
ccccagcugucaucaauuaaag

SEQ ID NO: 1467307 - RNA, 23 nt, Human
ccccagcugucaucaauuaaagg

SEQ ID NO: 1467308 - RNA, 17 nt, Human
ccucacccccagcuuug

SEQ ID NO: 1467309 - RNA, 19 nt, Human
ccucacccccagcuuugcu

SEQ ID NO: 1467310 - RNA, 23 nt, Human
ccucacacacaaugugucugaga

SEQ ID NO: 1467311 - RNA, 16 nt, Human
ccucaauuucugaaca

SEQ ID NO: 1467312 - RNA, 18 nt, Human
ccuaugucauuucauuuc

SEQ ID NO: 1467313 - RNA, 20 nt, Human
ccuaucagaguugcugcaaa

SEQ ID NO: 1467314 - RNA, 12 nt, Human
ccuagaggccug

SEQ ID NO: 1467315 - RNA, 18 nt, Human
ccuacccuaaccaaguuc

SEQ ID NO: 1467316 - RNA, 16 nt, Human
ccuacccuaaccaagu

SEQ ID NO: 1467317 - RNA, 15 nt, Human
ccuacccuaaccaag

SEQ ID NO: 1467318 - RNA, 13 nt, Human
ccuaccuccaaag

SEQ ID NO: 1467319 - RNA, 14 nt, Human
ccuaccugugccug

SEQ ID NO: 1467320 - RNA, 15 nt, Human
ccuaccugugccuga

SEQ ID NO: 1467321 - RNA, 16 nt, Human
ccuaccugugccugac

SEQ ID NO: 1467322 - RNA, 16 nt, Human
ccuaaagaaaaacaaa

SEQ ID NO: 1467323 - RNA, 15 nt, Human
cccaauugagaaaaa

SEQ ID NO: 1467324 - RNA, 13 nt, Human
cccaacaccucuu

SEQ ID NO: 1467325 - RNA, 12 nt, Human
cccacacucaga

SEQ ID NO: 1467326 - RNA, 16 nt, Human
cccagcggcaucaggc

SEQ ID NO: 1467327 - RNA, 16 nt, Human
cccaguaucucuucag

SEQ ID NO: 1467328 - RNA, 15 nt, Human
cccaguaucucuuca

SEQ ID NO: 1467329 - RNA, 15 nt, Human
cccagugacagcuag

SEQ ID NO: 1467330 - RNA, 14 nt, Human
cccagugacagcua

SEQ ID NO: 1467331 - RNA, 19 nt, Human
cccagguuggagugcagug

SEQ ID NO: 1467332 - RNA, 18 nt, Human
cccagguuggagugcagu

SEQ ID NO: 1467333 - RNA, 13 nt, Human
cccagguccucac

SEQ ID NO: 1467334 - RNA, 17 nt, Human
cccaggauacuggcaca

SEQ ID NO: 1467335 - RNA, 19 nt, Human
cccaggauacuggcacaga

SEQ ID NO: 1467336 - RNA, 13 nt, Human
cccaggcacugca

SEQ ID NO: 1467337 - RNA, 14 nt, Human
ccccaagcuguuuu

SEQ ID NO: 1467338 - RNA, 16 nt, Human
ccccaagcuguuuucu

SEQ ID NO: 1467339 - RNA, 17 nt, Human
ccccaagcuguuuucuu

SEQ ID NO: 1467340 - RNA, 16 nt, Human
ccccaacaugcacuga

SEQ ID NO: 1467341 - RNA, 23 nt, Human
ccccaaccauuuccucagacucu

SEQ ID NO: 1467342 - RNA, 16 nt, Human
cccagugcacuugcug

SEQ ID NO: 1467343 - RNA, 22 nt, Human
cccauggcagugggaaaaaugu

SEQ ID NO: 1467344 - RNA, 23 nt, Human
ccaucagaaacacccucacacug

SEQ ID NO: 1467345 - RNA, 13 nt, Human
ccaucagccucca

SEQ ID NO: 1467346 - RNA, 22 nt, Human
ccaucagaaacacccucacacu

SEQ ID NO: 1467347 - RNA, 18 nt, Human
ccaucaaggguacacugc

SEQ ID NO: 1467348 - RNA, 14 nt, Human
ccaugcagaaagca

SEQ ID NO: 1467349 - RNA, 15 nt, Human
ccaugcagaaagcau

SEQ ID NO: 1467350 - RNA, 11 nt, Human
ccaugcagaaa

SEQ ID NO: 1467351 - RNA, 21 nt, Human
ccaugcccggcuaauuuuugu

SEQ ID NO: 1467352 - RNA, 20 nt, Human
ccaugcguguuucugacucu

SEQ ID NO: 1467353 - RNA, 22 nt, Human
ccaugcugcuggggaagacagu

SEQ ID NO: 1467354 - RNA, 23 nt, Human
ccaugcugcuggggaagacagug

SEQ ID NO: 1467355 - RNA, 16 nt, Human
ccaugauguuuagaaa

SEQ ID NO: 1467356 - RNA, 21 nt, Human
ccaugcacccucauacacaga

SEQ ID NO: 1467357 - RNA, 22 nt, Human
ccaugaagagauuuuucaugau

SEQ ID NO: 1467358 - RNA, 18 nt, Human
ccaugaagagauuuuuca

SEQ ID NO: 1467359 - RNA, 15 nt, Human
ccauucuggaaguga

SEQ ID NO: 1467360 - RNA, 12 nt, Human
ccauucuggaag

SEQ ID NO: 1467361 - RNA, 21 nt, Human
ccaugcugcuggggaagacag

SEQ ID NO: 1467362 - RNA, 13 nt, Human
ccaggacaggauc

SEQ ID NO: 1467363 - RNA, 19 nt, Human
ccaggacaggauccaggcc

SEQ ID NO: 1467364 - RNA, 17 nt, Human
ccaggacaggauccagg

SEQ ID NO: 1467365 - RNA, 15 nt, Human
ccaggacaggaucca

SEQ ID NO: 1467366 - RNA, 23 nt, Human
ccagcuggggccaggcugggucg

SEQ ID NO: 1467367 - RNA, 22 nt, Human
ccagcuggggccaggcuggguc

SEQ ID NO: 1467368 - RNA, 21 nt, Human
ccagcuggggccaggcugggu

SEQ ID NO: 1467369 - RNA, 20 nt, Human
ccagcuggggccaggcuggg

SEQ ID NO: 1467370 - RNA, 19 nt, Human
ccagcuggggccaggcugg

SEQ ID NO: 1467371 - RNA, 18 nt, Human
ccagcuggggccaggcug

SEQ ID NO: 1467372 - RNA, 17 nt, Human
ccagcuggggccaggcu

SEQ ID NO: 1467373 - RNA, 15 nt, Human
ccaggaagcuuuggu

SEQ ID NO: 1467374 - RNA, 22 nt, Human
ccagcugcccccagagccacag

SEQ ID NO: 1467375 - RNA, 21 nt, Human
ccagcugcccccagagccaca

SEQ ID NO: 1467376 - RNA, 19 nt, Human
ccagcugcccccagagcca

SEQ ID NO: 1467377 - RNA, 17 nt, Human
ccagcugcccccagagc

SEQ ID NO: 1467378 - RNA, 23 nt, Human
ccagcugcccccagagccacagu

SEQ ID NO: 1467379 - RNA, 16 nt, Human
ccaguaucucuucagu

SEQ ID NO: 1467380 - RNA, 15 nt, Human
ccaguaucucuucag

SEQ ID NO: 1467381 - RNA, 20 nt, Human
ccaguaggggcuuauaauaa

SEQ ID NO: 1467382 - RNA, 18 nt, Human
ccaguaccuagcuggcuc

SEQ ID NO: 1467383 - RNA, 20 nt, Human
ccaguaucucuucagucucu

SEQ ID NO: 1467384 - RNA, 18 nt, Human
ccaguaucucuucagucu

SEQ ID NO: 1467385 - RNA, 17 nt, Human
ccagucuuccugacacu

SEQ ID NO: 1467386 - RNA, 22 nt, Human
ccagucuuccugacacuuuaau

SEQ ID NO: 1467387 - RNA, 15 nt, Human
ccaguaacucaucug

SEQ ID NO: 1467388 - RNA, 16 nt, Human
ccaguaacucaucugu

SEQ ID NO: 1467389 - RNA, 23 nt, Human
ccaggugaacaaaguuuaccaga

SEQ ID NO: 1467390 - RNA, 19 nt, Human
ccaggcuuuuuuaucaugu

SEQ ID NO: 1467391 - RNA, 18 nt, Human
ccaggcuugccugcaggc

SEQ ID NO: 1467392 - RNA, 17 nt, Human
ccaggcuugccugcagg

SEQ ID NO: 1467393 - RNA, 14 nt, Human
ccaggaggacccag

SEQ ID NO: 1467394 - RNA, 15 nt, Human
ccaggaggacccagg

SEQ ID NO: 1467395 - RNA, 18 nt, Human
ccaggaggacccagggcu

SEQ ID NO: 1467396 - RNA, 19 nt, Human
ccaggaggacccagggcuc

SEQ ID NO: 1467397 - RNA, 21 nt, Human
ccaggaggacccagggcucug

SEQ ID NO: 1467398 - RNA, 20 nt, Human
ccaggaggacccagggcucu

SEQ ID NO: 1467399 - RNA, 20 nt, Human
ccacaggaaccacaagacug

SEQ ID NO: 1467400 - RNA, 22 nt, Human
ccacagcuuuuuaccaaguuuc

SEQ ID NO: 1467401 - RNA, 21 nt, Human
ccacacucagauccuccucau

SEQ ID NO: 1467402 - RNA, 11 nt, Human
ccacacucaga

SEQ ID NO: 1467403 - RNA, 18 nt, Human
ccacacucagauccuccu

SEQ ID NO: 1467404 - RNA, 19 nt, Human
ccacacucagauccuccuc

SEQ ID NO: 1467405 - RNA, 16 nt, Human
ccacaggcccacagua

SEQ ID NO: 1467406 - RNA, 22 nt, Human
ccaauagggcugagcucucugu

SEQ ID NO: 1467407 - RNA, 20 nt, Human
ccacagugccuaauaauacu

SEQ ID NO: 1467408 - RNA, 22 nt, Human
ccacaucccacucacaacagcu

SEQ ID NO: 1467409 - RNA, 16 nt, Human
ccaccauggccagcua

SEQ ID NO: 1467410 - RNA, 16 nt, Human
ccaccauuuggcaucc

SEQ ID NO: 1467411 - RNA, 17 nt, Human
ccaccauuuggcauccc

SEQ ID NO: 1467412 - RNA, 18 nt, Human
ccaccauuuggcaucccu

SEQ ID NO: 1467413 - RNA, 22 nt, Human
ccaccauuuggcaucccugggc

SEQ ID NO: 1467414 - RNA, 21 nt, Human
ccaccauuuggcaucccuggg

SEQ ID NO: 1467415 - RNA, 14 nt, Human
ccacgguguucugu

SEQ ID NO: 1467416 - RNA, 17 nt, Human
ccacggggacucagccc

SEQ ID NO: 1467417 - RNA, 16 nt, Human
ccaccugucugucugu

SEQ ID NO: 1467418 - RNA, 14 nt, Human
ccaccugucugucu

SEQ ID NO: 1467419 - RNA, 12 nt, Human
ccaccugucugu

SEQ ID NO: 1467420 - RNA, 11 nt, Human
ccaccugucug

SEQ ID NO: 1467421 - RNA, 22 nt, Human
ccaccugucugucugucugucc

SEQ ID NO: 1467422 - RNA, 18 nt, Human
ccaccccauccaguucau

SEQ ID NO: 1467423 - RNA, 21 nt, Human
ccacgucagcugggacacccc

SEQ ID NO: 1467424 - RNA, 13 nt, Human
ccacguacugcag

SEQ ID NO: 1467425 - RNA, 16 nt, Human
ccacguacugcagccu

SEQ ID NO: 1467426 - RNA, 17 nt, Human
ccacguacugcagccuc

SEQ ID NO: 1467427 - RNA, 14 nt, Human
ccacuucagccucc

SEQ ID NO: 1467428 - RNA, 21 nt, Human
ccagaaagcaguugagacaag

SEQ ID NO: 1467429 - RNA, 22 nt, Human
ccacuuauuccccauucuuccu

SEQ ID NO: 1467430 - RNA, 16 nt, Human
ccagaauuuaaaccua

SEQ ID NO: 1467431 - RNA, 12 nt, Human
ccagacacuggu

SEQ ID NO: 1467432 - RNA, 11 nt, Human
ccagacacugg

SEQ ID NO: 1467433 - RNA, 13 nt, Human
ccagacacugguu

SEQ ID NO: 1467434 - RNA, 20 nt, Human
ccaagcaccugggauuacaa

SEQ ID NO: 1467435 - RNA, 18 nt, Human
ccaagcacuucuuuuucu

SEQ ID NO: 1467436 - RNA, 14 nt, Human
ccaagcaaguauua

SEQ ID NO: 1467437 - RNA, 17 nt, Human
ccaagcauuuagaugua

SEQ ID NO: 1467438 - RNA, 22 nt, Human
ccaagcaguugggacuacaggc

SEQ ID NO: 1467439 - RNA, 20 nt, Human
ccaagcaguugggacuacag

SEQ ID NO: 1467440 - RNA, 21 nt, Human
ccaagcaguugggacuacagg

SEQ ID NO: 1467441 - RNA, 17 nt, Human
ccaagcuauucaauucu

SEQ ID NO: 1467442 - RNA, 22 nt, Human
ccaagccuuggggauucuucca

SEQ ID NO: 1467443 - RNA, 22 nt, Human
ccaagccuugauugguguugcc

SEQ ID NO: 1467444 - RNA, 20 nt, Human
ccaagccauggguagccugg

SEQ ID NO: 1467445 - RNA, 21 nt, Human
ccaagccauggguagccuggg

SEQ ID NO: 1467446 - RNA, 20 nt, Human
ccaaguagcugagacuacag

SEQ ID NO: 1467447 - RNA, 20 nt, Human
ccaaguaacugggauuacag

SEQ ID NO: 1467448 - RNA, 22 nt, Human
ccaaguagaaucucaguugauu

SEQ ID NO: 1467449 - RNA, 16 nt, Human
ccaaggucuucuuaau

SEQ ID NO: 1467450 - RNA, 18 nt, Human
ccaauagggcugagcucu

SEQ ID NO: 1467451 - RNA, 20 nt, Human
ccaaguugugcuugagccag

SEQ ID NO: 1467452 - RNA, 17 nt, Human
ccaaguugugcuugagc

SEQ ID NO: 1467453 - RNA, 22 nt, Human
ccaaguugugcuugagccagga

SEQ ID NO: 1467454 - RNA, 16 nt, Human
ccaaggcuuucucuac

SEQ ID NO: 1467455 - RNA, 19 nt, Human
ccaagggcauaaauuauug

SEQ ID NO: 1467456 - RNA, 16 nt, Human
ccaaggggcuucaggu

SEQ ID NO: 1467457 - RNA, 21 nt, Human
ccaacaagauugcuuaauaaa

SEQ ID NO: 1467458 - RNA, 21 nt, Human
ccaacaagaagggacugagag

SEQ ID NO: 1467459 - RNA, 13 nt, Human
ccaacacugccag

SEQ ID NO: 1467460 - RNA, 14 nt, Human
ccaacacugccagc

SEQ ID NO: 1467461 - RNA, 15 nt, Human
ccaacacugccagca

SEQ ID NO: 1467462 - RNA, 16 nt, Human
ccaacacugccagcau

SEQ ID NO: 1467463 - RNA, 13 nt, Human
ccaaccauuuccu

SEQ ID NO: 1467464 - RNA, 14 nt, Human
ccaaccauuuccuc

SEQ ID NO: 1467465 - RNA, 17 nt, Human
ccaaccauuuccucaga

SEQ ID NO: 1467466 - RNA, 22 nt, Human
ccaaacugacucuuaagaagac

SEQ ID NO: 1467467 - RNA, 14 nt, Human
ccaaaggaggaugg

SEQ ID NO: 1467468 - RNA, 17 nt, Human
ccaaagcuucccacggc

SEQ ID NO: 1467469 - RNA, 12 nt, Human
ccaacccuagca

SEQ ID NO: 1467470 - RNA, 11 nt, Human
ccaagaaucuu

SEQ ID NO: 1467471 - RNA, 18 nt, Human
ccaagauacuuaagugcu

SEQ ID NO: 1467472 - RNA, 17 nt, Human
ccaagacugcuguggcc

SEQ ID NO: 1467473 - RNA, 18 nt, Human
ccaagacugcuguggcca

SEQ ID NO: 1467474 - RNA, 21 nt, Human
ccaagacugcuguggccagga

SEQ ID NO: 1467475 - RNA, 23 nt, Human
ccaagacugcuguggccaggagg

SEQ ID NO: 1467476 - RNA, 22 nt, Human
ccaagacugcuguggccaggag

SEQ ID NO: 1467477 - RNA, 23 nt, Human
cauuguauucagaguugaugguu

SEQ ID NO: 1467478 - RNA, 14 nt, Human
cauugucucagagc

SEQ ID NO: 1467479 - RNA, 20 nt, Human
cauugucuuuuuagaugccc

SEQ ID NO: 1467480 - RNA, 14 nt, Human
cauugucuuuuuag

SEQ ID NO: 1467481 - RNA, 13 nt, Human
cauuguccucuuu

SEQ ID NO: 1467482 - RNA, 22 nt, Human
cauugugccaugucaaacaaau

SEQ ID NO: 1467483 - RNA, 14 nt, Human
cauuguagaaaagc

SEQ ID NO: 1467484 - RNA, 22 nt, Human
cauuguauaguuggaaucauau

SEQ ID NO: 1467485 - RNA, 14 nt, Human
cauuuccucagacu

SEQ ID NO: 1467486 - RNA, 22 nt, Human
cauuuccucagacucuaagaaa

SEQ ID NO: 1467487 - RNA, 20 nt, Human
cauuucuagcgcauggccug

SEQ ID NO: 1467488 - RNA, 19 nt, Human
cauuuuagggguagcauuu

SEQ ID NO: 1467489 - RNA, 11 nt, Human
cauuugcugaa

SEQ ID NO: 1467490 - RNA, 16 nt, Human
cauuuuucaugauaau

SEQ ID NO: 1467491 - RNA, 16 nt, Human
cauuuuuccguaaaaa

SEQ ID NO: 1467492 - RNA, 16 nt, Human
ccaaacaggcucagag

SEQ ID NO: 1467493 - RNA, 13 nt, Human
cauuugcucaugg

SEQ ID NO: 1467494 - RNA, 14 nt, Human
cauuugcucaugga

SEQ ID NO: 1467495 - RNA, 23 nt, Human
cauuucuauagccaaaaauagcu

SEQ ID NO: 1467496 - RNA, 13 nt, Human
ggccuuugagcuc

SEQ ID NO: 1467497 - RNA, 17 nt, Human
ggccuuucccuaagcca

SEQ ID NO: 1467498 - RNA, 15 nt, Human
ggccuuucccuaagc

SEQ ID NO: 1467499 - RNA, 13 nt, Human
ggccuugggcucc

SEQ ID NO: 1467500 - RNA, 12 nt, Human
ggccuugggcuc

SEQ ID NO: 1467501 - RNA, 17 nt, Human
ggccuugcggcuccuca

SEQ ID NO: 1467502 - RNA, 18 nt, Human
ggccuugcggcuccucag

SEQ ID NO: 1467503 - RNA, 19 nt, Human
ggccuugcggcuccucagg

SEQ ID NO: 1467504 - RNA, 16 nt, Human
ggccuuugagcucaga

SEQ ID NO: 1467505 - RNA, 22 nt, Human
ggcgaagcguuguccucagccc

SEQ ID NO: 1467506 - RNA, 23 nt, Human
ggccccacccucguggacaccug

SEQ ID NO: 1467507 - RNA, 22 nt, Human
ggcccaguaccuagcuggcucu

SEQ ID NO: 1467508 - RNA, 20 nt, Human
ggcccuuaugacugccaaga

SEQ ID NO: 1467509 - RNA, 18 nt, Human
ggccccuuugcugacccu

SEQ ID NO: 1467510 - RNA, 16 nt, Human
ggcacuggcgaggaga

SEQ ID NO: 1467511 - RNA, 15 nt, Human
ggcacuggggcaggg

SEQ ID NO: 1467512 - RNA, 22 nt, Human
ggcauccagagucccugccugg

SEQ ID NO: 1467513 - RNA, 12 nt, Human
ggcaucccuggg

SEQ ID NO: 1467514 - RNA, 14 nt, Human
ggcaucccugggcc

SEQ ID NO: 1467515 - RNA, 13 nt, Human
ggcaucccugggc

SEQ ID NO: 1467516 - RNA, 17 nt, Human
ggcauccucuuuuucca

SEQ ID NO: 1467517 - RNA, 20 nt, Human
ggcauccuuccucacaccag

SEQ ID NO: 1467518 - RNA, 18 nt, Human
ggccaggcuugucucgaa

SEQ ID NO: 1467519 - RNA, 21 nt, Human
ggcauuuuuaccaucacugag

SEQ ID NO: 1467520 - RNA, 14 nt, Human
ggccagagccaagg

SEQ ID NO: 1467521 - RNA, 17 nt, Human
ggaggugagaccaccuc

SEQ ID NO: 1467522 - RNA, 16 nt, Human
ggaggugccacuggag

SEQ ID NO: 1467523 - RNA, 20 nt, Human
ggagguccuuaggccucuga

SEQ ID NO: 1467524 - RNA, 15 nt, Human
ggaggcccugugccc

SEQ ID NO: 1467525 - RNA, 23 nt, Human
ggaggcccugugccccuugacaa

SEQ ID NO: 1467526 - RNA, 23 nt, Human
ggaggccuuucccuaagccagcu

SEQ ID NO: 1467527 - RNA, 13 nt, Human
ggaggguaggcag

SEQ ID NO: 1467528 - RNA, 13 nt, Human
ggaggacccagga

SEQ ID NO: 1467529 - RNA, 12 nt, Human
ggaggacccagg

SEQ ID NO: 1467530 - RNA, 18 nt, Human
ggaggaaggaggacccag

SEQ ID NO: 1467531 - RNA, 21 nt, Human
ggaggaaggcuuacacccaca

SEQ ID NO: 1467532 - RNA, 18 nt, Human
ggagcugguuagaaaugc

SEQ ID NO: 1467533 - RNA, 23 nt, Human
ggagcugguuagaaaugcagaau

SEQ ID NO: 1467534 - RNA, 19 nt, Human
ggcaauuaauuccuucagc

SEQ ID NO: 1467535 - RNA, 20 nt, Human
ggcaauuaauuccuucagca

SEQ ID NO: 1467536 - RNA, 17 nt, Human
ggcaauuaauuccuuca

SEQ ID NO: 1467537 - RNA, 14 nt, Human
ggcacacaccacca

SEQ ID NO: 1467538 - RNA, 14 nt, Human
ggcaauuuuguaac

SEQ ID NO: 1467539 - RNA, 12 nt, Human
ggcacagccugg

SEQ ID NO: 1467540 - RNA, 13 nt, Human
ggcacagccuggc

SEQ ID NO: 1467541 - RNA, 15 nt, Human
ggaguuuugcaaagu

SEQ ID NO: 1467542 - RNA, 16 nt, Human
ggaguuuuuuguacca

SEQ ID NO: 1467543 - RNA, 13 nt, Human
ggaguugugggua

SEQ ID NO: 1467544 - RNA, 12 nt, Human
ggagugcagugg

SEQ ID NO: 1467545 - RNA, 12 nt, Human
guaaaaucuugu

SEQ ID NO: 1467546 - RNA, 15 nt, Human
guaaaaucuugucau

SEQ ID NO: 1467547 - RNA, 16 nt, Human
guaaaaucuugucaug

SEQ ID NO: 1467548 - RNA, 18 nt, Human
guaaaaucuugucaugug

SEQ ID NO: 1467549 - RNA, 19 nt, Human
guaaaaucuugucaugugu

SEQ ID NO: 1467550 - RNA, 20 nt, Human
guaaaaucuugucaugugua

SEQ ID NO: 1467551 - RNA, 21 nt, Human
guaaaaucuugucauguguau

SEQ ID NO: 1467552 - RNA, 22 nt, Human
guaaaaucuugucauguguaua

SEQ ID NO: 1467553 - RNA, 23 nt, Human
guaaaaucuugucauguguauaa

SEQ ID NO: 1467554 - RNA, 22 nt, Human
guaaauuauuaauuuaugcaga

SEQ ID NO: 1467555 - RNA, 18 nt, Human
guaaaaugugggauuaug

SEQ ID NO: 1467556 - RNA, 13 nt, Human
guaaagaauuauu

SEQ ID NO: 1467557 - RNA, 14 nt, Human
guaaagaauuauuu

SEQ ID NO: 1467558 - RNA, 15 nt, Human
guaaagaauuauuuu

SEQ ID NO: 1467559 - RNA, 19 nt, Human
guaaagauauuuuuaucuu

SEQ ID NO: 1467560 - RNA, 22 nt, Human
guaaagauauuuuuaucuuuau

SEQ ID NO: 1467561 - RNA, 15 nt, Human
aaauaauuuuuauau

SEQ ID NO: 1467562 - RNA, 18 nt, Human
aaauaauuuuuauauuug

SEQ ID NO: 1467563 - RNA, 20 nt, Human
aaauaauuuuuauauuugaa

SEQ ID NO: 1467564 - RNA, 19 nt, Human
aaauaaugaauacauuucc

SEQ ID NO: 1467565 - RNA, 11 nt, Human
aaaguuuuuua

SEQ ID NO: 1467566 - RNA, 22 nt, Human
aaaguuuuuuauuaugcauuau

SEQ ID NO: 1467567 - RNA, 16 nt, Human
aaauaaaaaagauccc

SEQ ID NO: 1467568 - RNA, 15 nt, Human
aaauaaaaaagaucc

SEQ ID NO: 1467569 - RNA, 20 nt, Human
gguuuggacaaaauggaaua

SEQ ID NO: 1467570 - RNA, 18 nt, Human
aaaguucaacauguuauu

SEQ ID NO: 1467571 - RNA, 20 nt, Human
aaaguugauaaagauuuuuu

SEQ ID NO: 1467572 - RNA, 16 nt, Human
aaaguugaauuuuaca

SEQ ID NO: 1467573 - RNA, 17 nt, Human
aaaguugauaaagauuu

SEQ ID NO: 1467574 - RNA, 18 nt, Human
aaaguugauaaagauuuu

SEQ ID NO: 1467575 - RNA, 23 nt, Human
aaaguugauaaagauuuuuuaau

SEQ ID NO: 1467576 - RNA, 16 nt, Human
aaaguuuguugaaaca

SEQ ID NO: 1467577 - RNA, 19 nt, Human
aaaguuuagccccugaaag

SEQ ID NO: 1467578 - RNA, 19 nt, Human
gguuucaccauguuggcca

SEQ ID NO: 1467579 - RNA, 20 nt, Human
gguuucaccauguuggccag

SEQ ID NO: 1467580 - RNA, 17 nt, Human
gguuucugaguuccugc

SEQ ID NO: 1467581 - RNA, 18 nt, Human
aaagccuguuuaagagac

SEQ ID NO: 1467582 - RNA, 16 nt, Human
aaagccuguuuaagag

SEQ ID NO: 1467583 - RNA, 18 nt, Human
aaagccuucuuuuggggg

SEQ ID NO: 1467584 - RNA, 11 nt, Human
aaagccuucuu

SEQ ID NO: 1467585 - RNA, 12 nt, Human
aaagcgaaaaaa

SEQ ID NO: 1467586 - RNA, 16 nt, Human
aaagcgaaaaaaucag

SEQ ID NO: 1467587 - RNA, 17 nt, Human
ggugggaggaugugaau

SEQ ID NO: 1467588 - RNA, 17 nt, Human
gguggggggggugcugg

SEQ ID NO: 1467589 - RNA, 23 nt, Human
gguggggguaggguuucccuacu

SEQ ID NO: 1467590 - RNA, 14 nt, Human
ggucggaccagcuu

SEQ ID NO: 1467591 - RNA, 13 nt, Human
ggucggaccagcu

SEQ ID NO: 1467592 - RNA, 14 nt, Human
ggucuaggacacag

SEQ ID NO: 1467593 - RNA, 20 nt, Human
aaagcaagcauucagaagaa

SEQ ID NO: 1467594 - RNA, 21 nt, Human
gguccucagagaauuucuacc

SEQ ID NO: 1467595 - RNA, 14 nt, Human
gguccucagagaau

SEQ ID NO: 1467596 - RNA, 23 nt, Human
aaagauugaaguauuuugcugga

SEQ ID NO: 1467597 - RNA, 15 nt, Human
aaagauugagagaau

SEQ ID NO: 1467598 - RNA, 19 nt, Human
aaagauugcugaaauuuua

SEQ ID NO: 1467599 - RNA, 21 nt, Human
aaagauugcugaaauuuuaua

SEQ ID NO: 1467600 - RNA, 20 nt, Human
ggugcugggccccugccucu

SEQ ID NO: 1467601 - RNA, 23 nt, Human
ggugccaauuucaaguuccaagu

SEQ ID NO: 1467602 - RNA, 24 nt, Human
aaagcaucccucacccauccuaga

SEQ ID NO: 1467603 - RNA, 17 nt, Human
aaagcaucccucaccca

SEQ ID NO: 1467604 - RNA, 15 nt, Human
aaagcaucccucacc

SEQ ID NO: 1467605 - RNA, 12 nt, Human
aaagcaucccuc

SEQ ID NO: 1467606 - RNA, 20 nt, Human
aaagcaucauggcuaucugu

SEQ ID NO: 1467607 - RNA, 17 nt, Human
aaagcaggcagaacuca

SEQ ID NO: 1467608 - RNA, 19 nt, Human
aaagcaggcagaacucauc

SEQ ID NO: 1467609 - RNA, 21 nt, Human
ggugcuucuaguucugccagg

SEQ ID NO: 1467610 - RNA, 22 nt, Human
gguaugaacuugaggacacaug

SEQ ID NO: 1467611 - RNA, 21 nt, Human
gguaugaacuugaggacacau

SEQ ID NO: 1467612 - RNA, 12 nt, Human
gguaggaaaugu

SEQ ID NO: 1467613 - RNA, 23 nt, Human
gguaugaacuugaggacacaugu

SEQ ID NO: 1467614 - RNA, 13 nt, Human
gguccaggcugug

SEQ ID NO: 1467615 - RNA, 18 nt, Human
ggguggggggggugcugg

SEQ ID NO: 1467616 - RNA, 23 nt, Human
ggguguccugcaccggggccugg

SEQ ID NO: 1467617 - RNA, 17 nt, Human
ggguuugugacagggcg

SEQ ID NO: 1467618 - RNA, 22 nt, Human
gguaauuguugcuaaucuucuu

SEQ ID NO: 1467619 - RNA, 18 nt, Human
gguacaugguguuugugg

SEQ ID NO: 1467620 - RNA, 14 nt, Human
gguaccagaugcag

SEQ ID NO: 1467621 - RNA, 22 nt, Human
gguagcgggggaggguaggcag

SEQ ID NO: 1467622 - RNA, 15 nt, Human
aaacacccucacacu

SEQ ID NO: 1467623 - RNA, 15 nt, Human
aaacaccaacauaaa

SEQ ID NO: 1467624 - RNA, 19 nt, Human
aaacaccaacauaaaaaug

SEQ ID NO: 1467625 - RNA, 14 nt, Human
aaacagugagccug

SEQ ID NO: 1467626 - RNA, 20 nt, Human
aaacaagcacuaaacaaaga

SEQ ID NO: 1467627 - RNA, 13 nt, Human
aaacaaaaacacu

SEQ ID NO: 1467628 - RNA, 23 nt, Human
ggggccugcccagugcacuugcu

SEQ ID NO: 1467629 - RNA, 19 nt, Human
aaacaucauucauuuuugu

SEQ ID NO: 1467630 - RNA, 19 nt, Human
aaaaugugcuauacugcau

SEQ ID NO: 1467631 - RNA, 20 nt, Human
aaaaugugcuauacugcaua

SEQ ID NO: 1467632 - RNA, 22 nt, Human
aaaaugugggauuaugggucac

SEQ ID NO: 1467633 - RNA, 21 nt, Human
aaaaugugggauuauggguca

SEQ ID NO: 1467634 - RNA, 15 nt, Human
gggcuaccaggaaag

SEQ ID NO: 1467635 - RNA, 12 nt, Human
gggcuaccagga

SEQ ID NO: 1467636 - RNA, 14 nt, Human
gggcggggguggcg

SEQ ID NO: 1467637 - RNA, 22 nt, Human
gggcccuggugguggcucggga

SEQ ID NO: 1467638 - RNA, 15 nt, Human
gggccaggcuggguc

SEQ ID NO: 1467639 - RNA, 14 nt, Human
gggccaggcugggu

SEQ ID NO: 1467640 - RNA, 21 nt, Human
gggccaggcugggucgcccug

SEQ ID NO: 1467641 - RNA, 19 nt, Human
aaaaguauguuagugcaaa

SEQ ID NO: 1467642 - RNA, 11 nt, Human
aaaaucuuguc

SEQ ID NO: 1467643 - RNA, 12 nt, Human
aaaaucuuguca

SEQ ID NO: 1467644 - RNA, 13 nt, Human
aaaaucuugucau

SEQ ID NO: 1467645 - RNA, 19 nt, Human
aaaaucuugucauguguau

SEQ ID NO: 1467646 - RNA, 13 nt, Human
aaaagcagacauu

SEQ ID NO: 1467647 - RNA, 13 nt, Human
aaaagaugcuuuu

SEQ ID NO: 1467648 - RNA, 19 nt, Human
aaaagaugcuuuuaacaga

SEQ ID NO: 1467649 - RNA, 14 nt, Human
aaaagcagacauuu

SEQ ID NO: 1467650 - RNA, 17 nt, Human
gggagaccggccugcca

SEQ ID NO: 1467651 - RNA, 20 nt, Human
gggagaccggccugccagga

SEQ ID NO: 1467652 - RNA, 21 nt, Human
gggagaccggccugccaggag

SEQ ID NO: 1467653 - RNA, 22 nt, Human
gggagaccggccugccaggagg

SEQ ID NO: 1467654 - RNA, 17 nt, Human
gggagaggggccucaaa

SEQ ID NO: 1467655 - RNA, 20 nt, Human
gggagagggcgcaggccgug

SEQ ID NO: 1467656 - RNA, 14 nt, Human
gggagagggcgcag

SEQ ID NO: 1467657 - RNA, 22 nt, Human
gggaggcucuggagcccacugu

SEQ ID NO: 1467658 - RNA, 20 nt, Human
gggauuacaggcgugagcca

SEQ ID NO: 1467659 - RNA, 17 nt, Human
gggauuaugggucacag

SEQ ID NO: 1467660 - RNA, 22 nt, Human
aaaagggccaaagaaccaaaga

SEQ ID NO: 1467661 - RNA, 14 nt, Human
aaaagggaggggga

SEQ ID NO: 1467662 - RNA, 16 nt, Human
gggcagauuuucagca

SEQ ID NO: 1467663 - RNA, 15 nt, Human
aaaaauauauacuaa

SEQ ID NO: 1467664 - RNA, 20 nt, Human
gggacauuugcucauggaau

SEQ ID NO: 1467665 - RNA, 21 nt, Human
gggacauuugcucauggaauu

SEQ ID NO: 1467666 - RNA, 21 nt, Human
aaaaauagcuaaauaccucaa

SEQ ID NO: 1467667 - RNA, 23 nt, Human
aaaaauaguuuggauauguaaaa

SEQ ID NO: 1467668 - RNA, 14 nt, Human
aaaaauaguuugga

SEQ ID NO: 1467669 - RNA, 22 nt, Human
gggaagagagccugcaggaucu

SEQ ID NO: 1467670 - RNA, 19 nt, Human
gggaagaggguuaggaggg

SEQ ID NO: 1467671 - RNA, 23 nt, Human
gggaagaggguuaggaggguuuc

SEQ ID NO: 1467672 - RNA, 15 nt, Human
aaaacccagauaaag

SEQ ID NO: 1467673 - RNA, 13 nt, Human
aaaacauuuauuu

SEQ ID NO: 1467674 - RNA, 16 nt, Human
aaaacauuuauuuuga

SEQ ID NO: 1467675 - RNA, 22 nt, Human
aaaacuagaggugagaaauuua

SEQ ID NO: 1467676 - RNA, 16 nt, Human
aaaacauuccauccuu

SEQ ID NO: 1467677 - RNA, 12 nt, Human
aaaacauuuauu

SEQ ID NO: 1467678 - RNA, 17 nt, Human
aaaacauaaucuucugc

SEQ ID NO: 1467679 - RNA, 18 nt, Human
aaaacauaaucuucugcc

SEQ ID NO: 1467680 - RNA, 20 nt, Human
aaaacauaaucuucugccuu

SEQ ID NO: 1467681 - RNA, 24 nt, Human
aaaacauaaucuucugccuucuca

SEQ ID NO: 1467682 - RNA, 22 nt, Human
aaaacagguagaauuaucuaau

SEQ ID NO: 1467683 - RNA, 21 nt, Human
gcuggagaugaggccagacca

SEQ ID NO: 1467684 - RNA, 20 nt, Human
gcuggagaugaggccagacc

SEQ ID NO: 1467685 - RNA, 18 nt, Human
gcuggagaugaggccaga

SEQ ID NO: 1467686 - RNA, 18 nt, Human
gcugcuggggaagacagu

SEQ ID NO: 1467687 - RNA, 19 nt, Human
gcugcuggggaagacagug

SEQ ID NO: 1467688 - RNA, 20 nt, Human
gcugcuggggaagacagugg

SEQ ID NO: 1467689 - RNA, 21 nt, Human
gcugcuggggaagacaguggc

SEQ ID NO: 1467690 - RNA, 13 nt, Human
gcugcuccccacg

SEQ ID NO: 1467691 - RNA, 22 nt, Human
gcugcuccccacgucagcuggg

SEQ ID NO: 1467692 - RNA, 22 nt, Human
gcugcaggaaucuuuaaaagau

SEQ ID NO: 1467693 - RNA, 17 nt, Human
gcugcaggaaucuuuaa

SEQ ID NO: 1467694 - RNA, 16 nt, Human
gcucuggagcccacug

SEQ ID NO: 1467695 - RNA, 15 nt, Human
gcucuggagcccacu

SEQ ID NO: 1467696 - RNA, 19 nt, Human
gcucucugugggcuggcag

SEQ ID NO: 1467697 - RNA, 17 nt, Human
gcucugaaagagaaaca

SEQ ID NO: 1467698 - RNA, 20 nt, Human
gcucucugugggcuggcagu

SEQ ID NO: 1467699 - RNA, 24 nt, Human
gcugaauuucccucucucauaccc

SEQ ID NO: 1467700 - RNA, 17 nt, Human
gcugaauuucccucucu

SEQ ID NO: 1467701 - RNA, 17 nt, Human
gcucuggagcccacugu

SEQ ID NO: 1467702 - RNA, 23 nt, Human
gcucuguaaguagaugcauuugg

SEQ ID NO: 1467703 - RNA, 21 nt, Human
gcucugucuacuugcucaggu

SEQ ID NO: 1467704 - RNA, 22 nt, Human
gcucugugagggugcugacugg

SEQ ID NO: 1467705 - RNA, 13 nt, Human
gcucugucuacuu

SEQ ID NO: 1467706 - RNA, 19 nt, Human
gcucugucuacuugcucag

SEQ ID NO: 1467707 - RNA, 11 nt, Human
gcugaaaauau

SEQ ID NO: 1467708 - RNA, 21 nt, Human
gcucuacuggucuuguggaau

SEQ ID NO: 1467709 - RNA, 23 nt, Human
gcucuagauugagagaagagaca

SEQ ID NO: 1467710 - RNA, 22 nt, Human
gcucccagggacaccugggaga

SEQ ID NO: 1467711 - RNA, 18 nt, Human
gcuccucgagaucccaac

SEQ ID NO: 1467712 - RNA, 16 nt, Human
gcuucaaauuguaagc

SEQ ID NO: 1467713 - RNA, 21 nt, Human
gcuucagguccaggcuguguu

SEQ ID NO: 1467714 - RNA, 15 nt, Human
gcuucagguccaggc

SEQ ID NO: 1467715 - RNA, 15 nt, Human
gcuuaauucaaauaa

SEQ ID NO: 1467716 - RNA, 14 nt, Human
gcuuaauucaaaua

SEQ ID NO: 1467717 - RNA, 20 nt, Human
gcuuaauggcugauaauuuu

SEQ ID NO: 1467718 - RNA, 13 nt, Human
gcuguuuuuuugu

SEQ ID NO: 1467719 - RNA, 12 nt, Human
gcuguauuuuaa

SEQ ID NO: 1467720 - RNA, 13 nt, Human
gcuguauuuuaaa

SEQ ID NO: 1467721 - RNA, 15 nt, Human
gcugguuuaauguuu

SEQ ID NO: 1467722 - RNA, 20 nt, Human
gcuggagugcaguggcgcga

SEQ ID NO: 1467723 - RNA, 19 nt, Human
gcuuccuggcaauagucaa

SEQ ID NO: 1467724 - RNA, 19 nt, Human
gcuugaacuaggcugagca

SEQ ID NO: 1467725 - RNA, 20 nt, Human
gcuugaacuaggcugagcaa

SEQ ID NO: 1467726 - RNA, 15 nt, Human
gcuuucccugccucu

SEQ ID NO: 1467727 - RNA, 17 nt, Human
gcuuucugaucaaggcc

SEQ ID NO: 1467728 - RNA, 18 nt, Human
ggaagacgcaagggccug

SEQ ID NO: 1467729 - RNA, 22 nt, Human
ggaagaagagaucaggaagaga

SEQ ID NO: 1467730 - RNA, 21 nt, Human
ggaagaagagaucaggaagag

SEQ ID NO: 1467731 - RNA, 20 nt, Human
ggaagaagagaucaggaaga

SEQ ID NO: 1467732 - RNA, 20 nt, Human
ggaacacuagacaagccaga

SEQ ID NO: 1467733 - RNA, 21 nt, Human
ggaacacuagacaagccagaa

SEQ ID NO: 1467734 - RNA, 21 nt, Human
ggaaacuaggugcauauuuau

SEQ ID NO: 1467735 - RNA, 18 nt, Human
ggaaaccuuccacccagu

SEQ ID NO: 1467736 - RNA, 20 nt, Human
ggaaauucccuucaucugga

SEQ ID NO: 1467737 - RNA, 16 nt, Human
ggaaauucugcucaga

SEQ ID NO: 1467738 - RNA, 22 nt, Human
ggaaauucccuucaucuggaac

SEQ ID NO: 1467739 - RNA, 16 nt, Human
ggaaauugauuuugaa

SEQ ID NO: 1467740 - RNA, 17 nt, Human
ggaaauuggaagagcac

SEQ ID NO: 1467741 - RNA, 19 nt, Human
ggaaauucccuucaucugg

SEQ ID NO: 1467742 - RNA, 14 nt, Human
ggaacaaacagggc

SEQ ID NO: 1467743 - RNA, 15 nt, Human
ggaacaaacagggcu

SEQ ID NO: 1467744 - RNA, 22 nt, Human
gcuuuuuucucugauacagaaa

SEQ ID NO: 1467745 - RNA, 18 nt, Human
ggaaaauucuaacccagg

SEQ ID NO: 1467746 - RNA, 17 nt, Human
ggaaaccuuccacccag

SEQ ID NO: 1467747 - RNA, 20 nt, Human
gcuuuuuuaucaugugaaau

SEQ ID NO: 1467748 - RNA, 18 nt, Human
gcuuuuuuaucaugugaa

SEQ ID NO: 1467749 - RNA, 15 nt, Human
gcuuuuuuaucaugu

SEQ ID NO: 1467750 - RNA, 19 nt, Human
gcuuuuuauuccuccugcu

SEQ ID NO: 1467751 - RNA, 13 nt, Human
gcuuuuuccagag

SEQ ID NO: 1467752 - RNA, 18 nt, Human
gcgauucucuugccucaa

SEQ ID NO: 1467753 - RNA, 23 nt, Human
gcgauucuccugccucagccucc

SEQ ID NO: 1467754 - RNA, 19 nt, Human
gcgagauaccccaccuccc

SEQ ID NO: 1467755 - RNA, 23 nt, Human
gcuacuuugcugcuaugguuuuc

SEQ ID NO: 1467756 - RNA, 16 nt, Human
gcuacuuugcugcuau

SEQ ID NO: 1467757 - RNA, 19 nt, Human
gcuacuguaaggcaaucau

SEQ ID NO: 1467758 - RNA, 18 nt, Human
gcuacuguaaggcaauca

SEQ ID NO: 1467759 - RNA, 18 nt, Human
gcuaauuuugaaaaacug

SEQ ID NO: 1467760 - RNA, 20 nt, Human
gcuaauuuauccugaaauuu

SEQ ID NO: 1467761 - RNA, 13 nt, Human
gcguggugcgagu

SEQ ID NO: 1467762 - RNA, 21 nt, Human
gcuaauuuuuuuguauuuuag

SEQ ID NO: 1467763 - RNA, 20 nt, Human
gcuaauuuuuguauuuuuag

SEQ ID NO: 1467764 - RNA, 20 nt, Human
gcuaauuuuuuguuguuucu

SEQ ID NO: 1467765 - RNA, 19 nt, Human
gcuaauuuuuuuguauuuu

SEQ ID NO: 1467766 - RNA, 18 nt, Human
gcuacugccgucagugcu

SEQ ID NO: 1467767 - RNA, 22 nt, Human
gcuacugccgucagugcugugc

SEQ ID NO: 1467768 - RNA, 23 nt, Human
gcggaggaaggaggacccaggac

SEQ ID NO: 1467769 - RNA, 16 nt, Human
gcgugaucucagcuca

SEQ ID NO: 1467770 - RNA, 15 nt, Human
gcgugaucucagcuc

SEQ ID NO: 1467771 - RNA, 12 nt, Human
gcgugaucucag

SEQ ID NO: 1467772 - RNA, 16 nt, Human
gcgugguggucccugg

SEQ ID NO: 1467773 - RNA, 13 nt, Human
gcggcugggagga

SEQ ID NO: 1467774 - RNA, 14 nt, Human
gcggcugggaggag

SEQ ID NO: 1467775 - RNA, 17 nt, Human
gcggcugggaggagggc

SEQ ID NO: 1467776 - RNA, 18 nt, Human
gcggcugggaggagggca

SEQ ID NO: 1467777 - RNA, 19 nt, Human
gcggcugggaggagggcag

SEQ ID NO: 1467778 - RNA, 22 nt, Human
gcggcugggaggagggcaggca

SEQ ID NO: 1467779 - RNA, 20 nt, Human
gccuccaacccuagcaaaag

SEQ ID NO: 1467780 - RNA, 22 nt, Human
gccuccaaggaggggcuguaaa

SEQ ID NO: 1467781 - RNA, 23 nt, Human
gccuccaaggaggggcuguaaaa

SEQ ID NO: 1467782 - RNA, 16 nt, Human
gccuccaacccuagca

SEQ ID NO: 1467783 - RNA, 20 nt, Human
gccugcuauuugaaguguaa

SEQ ID NO: 1467784 - RNA, 16 nt, Human
gccauaugaaaaggcu

SEQ ID NO: 1467785 - RNA, 16 nt, Human
gccaguuguccuccuu

SEQ ID NO: 1467786 - RNA, 14 nt, Human
gccaguuguccucc

SEQ ID NO: 1467787 - RNA, 13 nt, Human
gccaguuguccuc

SEQ ID NO: 1467788 - RNA, 14 nt, Human
gccaggauggcgca

SEQ ID NO: 1467789 - RNA, 16 nt, Human
gccaggauggcgcagg

SEQ ID NO: 1467790 - RNA, 23 nt, Human
gcccauucauuccauucuggaag

SEQ ID NO: 1467791 - RNA, 19 nt, Human
gcccauucauuccauucug

SEQ ID NO: 1467792 - RNA, 16 nt, Human
gcccauucauuccauu

SEQ ID NO: 1467793 - RNA, 23 nt, Human
gccccacccucguggacaccugc

SEQ ID NO: 1467794 - RNA, 22 nt, Human
gccccacccucguggacaccug

SEQ ID NO: 1467795 - RNA, 21 nt, Human
gccccacccucguggacaccu

SEQ ID NO: 1467796 - RNA, 20 nt, Human
gccccacccucguggacacc

SEQ ID NO: 1467797 - RNA, 16 nt, Human
gccccugccucucugc

SEQ ID NO: 1467798 - RNA, 15 nt, Human
gccccugccucucug

SEQ ID NO: 1467799 - RNA, 14 nt, Human
gcccccucccugga

SEQ ID NO: 1467800 - RNA, 18 nt, Human
gccccugccucucugcag

SEQ ID NO: 1467801 - RNA, 17 nt, Human
gccccugccucucugca

SEQ ID NO: 1467802 - RNA, 15 nt, Human
gcccccucccuggau

SEQ ID NO: 1467803 - RNA, 16 nt, Human
gcccccucccuggaug

SEQ ID NO: 1467804 - RNA, 17 nt, Human
gccauguguuuauccua

SEQ ID NO: 1467805 - RNA, 22 nt, Human
gccaugugcuaguaauuggaaa

SEQ ID NO: 1467806 - RNA, 15 nt, Human
gccaucaagagacug

SEQ ID NO: 1467807 - RNA, 16 nt, Human
gccaucaagagacuga

SEQ ID NO: 1467808 - RNA, 14 nt, Human
gagauguagccccu

SEQ ID NO: 1467809 - RNA, 16 nt, Human
gagauguaaaagguau

SEQ ID NO: 1467810 - RNA, 17 nt, Human
gagauguaaaagguauu

SEQ ID NO: 1467811 - RNA, 20 nt, Human
gagauucucauaacuugaga

SEQ ID NO: 1467812 - RNA, 23 nt, Human
gagauucucauaacuugagaccu

SEQ ID NO: 1467813 - RNA, 12 nt, Human
gagauuuuucau

SEQ ID NO: 1467814 - RNA, 19 nt, Human
gagaugcuggcuugggcag

SEQ ID NO: 1467815 - RNA, 12 nt, Human
gagaugcuggcu

SEQ ID NO: 1467816 - RNA, 18 nt, Human
gagauggagucuugcucu

SEQ ID NO: 1467817 - RNA, 12 nt, Human
gagcaucacaga

SEQ ID NO: 1467818 - RNA, 13 nt, Human
gagcaucacagaa

SEQ ID NO: 1467819 - RNA, 14 nt, Human
gagcaucacagaau

SEQ ID NO: 1467820 - RNA, 18 nt, Human
gagaaggaaaauuuuagc

SEQ ID NO: 1467821 - RNA, 21 nt, Human
gacuggguaggaaagaggaag

SEQ ID NO: 1467822 - RNA, 15 nt, Human
gacugaaaauauugu

SEQ ID NO: 1467823 - RNA, 17 nt, Human
gacucuuaagaagacug

SEQ ID NO: 1467824 - RNA, 18 nt, Human
gacucuuaagaagacugc

SEQ ID NO: 1467825 - RNA, 16 nt, Human
gacucuuaagaagacu

SEQ ID NO: 1467826 - RNA, 19 nt, Human
gacucugucuaccuggucu

SEQ ID NO: 1467827 - RNA, 16 nt, Human
gacucuuuaugcuugc

SEQ ID NO: 1467828 - RNA, 14 nt, Human
gacucaaaccaaau

SEQ ID NO: 1467829 - RNA, 17 nt, Human
gacuaucuuacuauuuc

SEQ ID NO: 1467830 - RNA, 19 nt, Human
gacuaucuuacuauuucac

SEQ ID NO: 1467831 - RNA, 15 nt, Human
gacuaugaaaagcua

SEQ ID NO: 1467832 - RNA, 21 nt, Human
gacuauucuugauguaaaauc

SEQ ID NO: 1467833 - RNA, 22 nt, Human
gacuauucuugauguaaaaucu

SEQ ID NO: 1467834 - RNA, 23 nt, Human
gacuaggccuugcggcuccucag

SEQ ID NO: 1467835 - RNA, 16 nt, Human
gacuagggagccaugu

SEQ ID NO: 1467836 - RNA, 20 nt, Human
gaaugagagacacacugaag

SEQ ID NO: 1467837 - RNA, 14 nt, Human
gaaugaauuaaaua

SEQ ID NO: 1467838 - RNA, 16 nt, Human
gaaugaauuaaauaaa

SEQ ID NO: 1467839 - RNA, 12 nt, Human
gaaugacacugu

SEQ ID NO: 1467840 - RNA, 15 nt, Human
gaaugagacauccag

SEQ ID NO: 1467841 - RNA, 13 nt, Human
gaaugagacaucc

SEQ ID NO: 1467842 - RNA, 11 nt, Human
gaaugagccuc

SEQ ID NO: 1467843 - RNA, 13 nt, Human
gaaugagccucgg

SEQ ID NO: 1467844 - RNA, 22 nt, Human
gaaugagagacacacugaagaa

SEQ ID NO: 1467845 - RNA, 23 nt, Human
gaaugagagacacacugaagaag

SEQ ID NO: 1467846 - RNA, 21 nt, Human
gaagugacuuuggcugcaugc

SEQ ID NO: 1467847 - RNA, 12 nt, Human
gaagugagaccu

SEQ ID NO: 1467848 - RNA, 20 nt, Human
gaagugacuuuggcugcaug

SEQ ID NO: 1467849 - RNA, 15 nt, Human
gaagugacuuuggcu

SEQ ID NO: 1467850 - RNA, 13 nt, Human
gaagugacuuugg

SEQ ID NO: 1467851 - RNA, 13 nt, Human
gaagggcaaguuu

SEQ ID NO: 1467852 - RNA, 20 nt, Human
gaaggcuuguugugcuuuua

SEQ ID NO: 1467853 - RNA, 17 nt, Human
gaaggcuuguugugcuu

SEQ ID NO: 1467854 - RNA, 19 nt, Human
gaaggcuuguugugcuuuu

SEQ ID NO: 1467855 - RNA, 15 nt, Human
gaagggaagagacag

SEQ ID NO: 1467856 - RNA, 22 nt, Human
gaagggaauaagguacaagaag

SEQ ID NO: 1467857 - RNA, 17 nt, Human
gaagggaauaagguaca

SEQ ID NO: 1467858 - RNA, 14 nt, Human
gaagggacugagag

SEQ ID NO: 1467859 - RNA, 16 nt, Human
gaagcugcccugccca

SEQ ID NO: 1467860 - RNA, 19 nt, Human
gaagcugugcgugugugug

SEQ ID NO: 1467861 - RNA, 14 nt, Human
gacacacugaagaa

SEQ ID NO: 1467862 - RNA, 13 nt, Human
gacacacugaaga

SEQ ID NO: 1467863 - RNA, 16 nt, Human
gacaaacaccucccag

SEQ ID NO: 1467864 - RNA, 12 nt, Human
gacacacaugaa

SEQ ID NO: 1467865 - RNA, 11 nt, Human
gaauuaguuuu

SEQ ID NO: 1467866 - RNA, 12 nt, Human
gaauuaugaaac

SEQ ID NO: 1467867 - RNA, 14 nt, Human
gaauuaucuaauuu

SEQ ID NO: 1467868 - RNA, 20 nt, Human
gaauuaucuugguugaaaau

SEQ ID NO: 1467869 - RNA, 19 nt, Human
gaauuauaacuggaaagaa

SEQ ID NO: 1467870 - RNA, 20 nt, Human
gaauuauaacuggaaagaag

SEQ ID NO: 1467871 - RNA, 21 nt, Human
gaauuuucuuuguguagcuuu

SEQ ID NO: 1467872 - RNA, 23 nt, Human
gaauuuucuuuguguagcuuugc

SEQ ID NO: 1467873 - RNA, 15 nt, Human
gacaaaauggaauac

SEQ ID NO: 1467874 - RNA, 15 nt, Human
gacaaaacuagagac

SEQ ID NO: 1467875 - RNA, 15 nt, Human
gaauuuuguugcugu

SEQ ID NO: 1467876 - RNA, 17 nt, Human
gaauuuuuaaacaagua

SEQ ID NO: 1467877 - RNA, 18 nt, Human
gaauuuuuaaacaaguau

SEQ ID NO: 1467878 - RNA, 14 nt, Human
gacagugaaagaaa

SEQ ID NO: 1467879 - RNA, 17 nt, Human
gacagucaccucaugga

SEQ ID NO: 1467880 - RNA, 16 nt, Human
gacagguuagcugcuc

SEQ ID NO: 1467881 - RNA, 16 nt, Human
gacacugccacacagg

SEQ ID NO: 1467882 - RNA, 16 nt, Human
gacacugguuugaaga

SEQ ID NO: 1467883 - RNA, 15 nt, Human
gacagaaguuugcac

SEQ ID NO: 1467884 - RNA, 20 nt, Human
gacagaaguuugcacuaucu

SEQ ID NO: 1467885 - RNA, 22 nt, Human
gacagaaguuugcacuaucuuu

SEQ ID NO: 1467886 - RNA, 14 nt, Human
gacauuaacucauu

SEQ ID NO: 1467887 - RNA, 21 nt, Human
gacauuaacucauuagacugg

SEQ ID NO: 1467888 - RNA, 22 nt, Human
gacauuaacucauuagacugga

SEQ ID NO: 1467889 - RNA, 16 nt, Human
gauacgacaguacacu

SEQ ID NO: 1467890 - RNA, 17 nt, Human
gauacgacaguacacug

SEQ ID NO: 1467891 - RNA, 17 nt, Human
gauacuugaaaauuaac

SEQ ID NO: 1467892 - RNA, 16 nt, Human
gauacuugaaaauuaa

SEQ ID NO: 1467893 - RNA, 20 nt, Human
gauacuuaagugcugcaauu

SEQ ID NO: 1467894 - RNA, 13 nt, Human
gauaugugaacag

SEQ ID NO: 1467895 - RNA, 14 nt, Human
gauaugugaacagu

SEQ ID NO: 1467896 - RNA, 16 nt, Human
gauauguaaaacauuu

SEQ ID NO: 1467897 - RNA, 17 nt, Human
gauauguaaaacauuua

SEQ ID NO: 1467898 - RNA, 19 nt, Human
gauauguaaaacauuuauu

SEQ ID NO: 1467899 - RNA, 18 nt, Human
gauauguaaaacauuuau

SEQ ID NO: 1467900 - RNA, 16 nt, Human
gauaugggacauuuuu

SEQ ID NO: 1467901 - RNA, 17 nt, Human
gauaugggacauuuuug

SEQ ID NO: 1467902 - RNA, 22 nt, Human
gauauuccuauugugcaaugua

SEQ ID NO: 1467903 - RNA, 16 nt, Human
gaguuuagcuggaaaa

SEQ ID NO: 1467904 - RNA, 14 nt, Human
gaguuuaggguggg

SEQ ID NO: 1467905 - RNA, 15 nt, Human
gaguuuagggugggg

SEQ ID NO: 1467906 - RNA, 15 nt, Human
gaguuguggguagug

SEQ ID NO: 1467907 - RNA, 19 nt, Human
gagugcugaaggaauggaa

SEQ ID NO: 1467908 - RNA, 15 nt, Human
gagugcguggugcga

SEQ ID NO: 1467909 - RNA, 14 nt, Human
gaggugccacugga

SEQ ID NO: 1467910 - RNA, 13 nt, Human
gaggugccacugg

SEQ ID NO: 1467911 - RNA, 14 nt, Human
gagucaaguuguuc

SEQ ID NO: 1467912 - RNA, 13 nt, Human
gaguccaucagcc

SEQ ID NO: 1467913 - RNA, 14 nt, Human
gaguccaucagccu

SEQ ID NO: 1467914 - RNA, 15 nt, Human
gaguccaucagccuc

SEQ ID NO: 1467915 - RNA, 16 nt, Human
gaguccaucagccucc

SEQ ID NO: 1467916 - RNA, 14 nt, Human
gauuaugggucaca

SEQ ID NO: 1467917 - RNA, 16 nt, Human
gauuaugggucacagg

SEQ ID NO: 1467918 - RNA, 17 nt, Human
gauuaugggucacagga

SEQ ID NO: 1467919 - RNA, 18 nt, Human
gauuaugggucacaggaa

SEQ ID NO: 1467920 - RNA, 22 nt, Human
gauuacaggugugagccaccac

SEQ ID NO: 1467921 - RNA, 18 nt, Human
gauuagacuggacagcuu

SEQ ID NO: 1467922 - RNA, 19 nt, Human
gauuagacuggacagcuug

SEQ ID NO: 1467923 - RNA, 20 nt, Human
gauuagacuggacagcuugu

SEQ ID NO: 1467924 - RNA, 18 nt, Human
gauuacugccuauuuuaa

SEQ ID NO: 1467925 - RNA, 14 nt, Human
gauuacauuuuaaa

SEQ ID NO: 1467926 - RNA, 14 nt, Human
gauucucuugccuc

SEQ ID NO: 1467927 - RNA, 16 nt, Human
gauucucuugccucaa

SEQ ID NO: 1467928 - RNA, 15 nt, Human
gauucucuugccuca

SEQ ID NO: 1467929 - RNA, 12 nt, Human
gaucccaacacu

SEQ ID NO: 1467930 - RNA, 16 nt, Human
gaucccaacacugcca

SEQ ID NO: 1467931 - RNA, 23 nt, Human
gauccaggccggcuugccacacc

SEQ ID NO: 1467932 - RNA, 17 nt, Human
gauauuuuuaucuuuau

SEQ ID NO: 1467933 - RNA, 18 nt, Human
gauauuuuuccauuuuuu

SEQ ID NO: 1467934 - RNA, 16 nt, Human
gcagagccaggaagau

SEQ ID NO: 1467935 - RNA, 18 nt, Human
gcagagcugauggagaag

SEQ ID NO: 1467936 - RNA, 19 nt, Human
gcagccagaccagcaggcu

SEQ ID NO: 1467937 - RNA, 22 nt, Human
gcauaacguauaaaagccuguu

SEQ ID NO: 1467938 - RNA, 18 nt, Human
gcaguccuggaagccagc

SEQ ID NO: 1467939 - RNA, 20 nt, Human
gcaguccuggaagccagcuu

SEQ ID NO: 1467940 - RNA, 17 nt, Human
gcaggcuggccuaugug

SEQ ID NO: 1467941 - RNA, 15 nt, Human
gcaguaugaaaauaa

SEQ ID NO: 1467942 - RNA, 13 nt, Human
gcaguaauaaaaa

SEQ ID NO: 1467943 - RNA, 20 nt, Human
gcagaaagcaucccucaccc

SEQ ID NO: 1467944 - RNA, 19 nt, Human
gcagaaagcaucccucacc

SEQ ID NO: 1467945 - RNA, 20 nt, Human
gcacuuuagaauaugccuug

SEQ ID NO: 1467946 - RNA, 19 nt, Human
gcacuuuagaauaugccuu

SEQ ID NO: 1467947 - RNA, 18 nt, Human
gcacuuuagaauaugccu

SEQ ID NO: 1467948 - RNA, 15 nt, Human
gcagagccaggaaga

SEQ ID NO: 1467949 - RNA, 14 nt, Human
gcagagccaggaag

SEQ ID NO: 1467950 - RNA, 17 nt, Human
gcaccuaaagaaaaaca

SEQ ID NO: 1467951 - RNA, 14 nt, Human
gcaccuaaagaaaa

SEQ ID NO: 1467952 - RNA, 21 nt, Human
gcaaguccuaagccuguuagc

SEQ ID NO: 1467953 - RNA, 13 nt, Human
gcaagugaauuug

SEQ ID NO: 1467954 - RNA, 21 nt, Human
gcaauaacguuuaagccaaaa

SEQ ID NO: 1467955 - RNA, 20 nt, Human
gcaccggggccugggcagga

SEQ ID NO: 1467956 - RNA, 19 nt, Human
gcaccggggccugggcagg

SEQ ID NO: 1467957 - RNA, 12 nt, Human
gaaaagaaaaag

SEQ ID NO: 1467958 - RNA, 11 nt, Human
gaaaaugcuga

SEQ ID NO: 1467959 - RNA, 22 nt, Human
gaaaauucuaacccagguaucc

SEQ ID NO: 1467960 - RNA, 18 nt, Human
cuuuuggaagguauuuaa

SEQ ID NO: 1467961 - RNA, 15 nt, Human
cuuuuggcauuuuac

SEQ ID NO: 1467962 - RNA, 19 nt, Human
cuuuuguagaagucacauu

SEQ ID NO: 1467963 - RNA, 10 nt, Human
cuuuuguaag

SEQ ID NO: 1467964 - RNA, 13 nt, Human
cuuuuguaagaca

SEQ ID NO: 1467965 - RNA, 20 nt, Human
cuuuuguaagacaaagguuu

SEQ ID NO: 1467966 - RNA, 15 nt, Human
cuuuugucucugcaa

SEQ ID NO: 1467967 - RNA, 13 nt, Human
gaaaaaaaauuau

SEQ ID NO: 1467968 - RNA, 21 nt, Human
gaaaaacaaacucguuuuuua

SEQ ID NO: 1467969 - RNA, 23 nt, Human
gaaaaacaaacucguuuuuuaca

SEQ ID NO: 1467970 - RNA, 16 nt, Human
cuuuuuuuagagaagu

SEQ ID NO: 1467971 - RNA, 18 nt, Human
gaaauauuuauuuuaaua

SEQ ID NO: 1467972 - RNA, 22 nt, Human
gaaauauuuauuuuaauaaugu

SEQ ID NO: 1467973 - RNA, 17 nt, Human
gaaaggugguguuucug

SEQ ID NO: 1467974 - RNA, 22 nt, Human
gaaaggugguguuucuguaaga

SEQ ID NO: 1467975 - RNA, 17 nt, Human
gaaauauuuauuuuaau

SEQ ID NO: 1467976 - RNA, 14 nt, Human
gaaaggugguguuu

SEQ ID NO: 1467977 - RNA, 16 nt, Human
gaaaggugguguuucu

SEQ ID NO: 1467978 - RNA, 17 nt, Human
gaaacuuuuuuauuuaa

SEQ ID NO: 1467979 - RNA, 18 nt, Human
gaaacuuuuuuauuuaaa

SEQ ID NO: 1467980 - RNA, 13 nt, Human
gaaacuuuuggaa

SEQ ID NO: 1467981 - RNA, 15 nt, Human
gaaacuuuuggaagg

SEQ ID NO: 1467982 - RNA, 16 nt, Human
gaaacuuucuuucuca

SEQ ID NO: 1467983 - RNA, 18 nt, Human
cuuuuaugugaaacaugu

SEQ ID NO: 1467984 - RNA, 14 nt, Human
cuuuuaugugaaac

SEQ ID NO: 1467985 - RNA, 21 nt, Human
cuuuuauaggauuuauuuaaa

SEQ ID NO: 1467986 - RNA, 13 nt, Human
cuuuguaaugaaa

SEQ ID NO: 1467987 - RNA, 16 nt, Human
cuuucuagccuggcua

SEQ ID NO: 1467988 - RNA, 15 nt, Human
cuuugauauuucaau

SEQ ID NO: 1467989 - RNA, 17 nt, Human
cuuuccuugaguaguuu

SEQ ID NO: 1467990 - RNA, 22 nt, Human
cuuuccugagucccaucccugc

SEQ ID NO: 1467991 - RNA, 20 nt, Human
cuuuccugagucccaucccu

SEQ ID NO: 1467992 - RNA, 18 nt, Human
cuuuccugagucccaucc

SEQ ID NO: 1467993 - RNA, 15 nt, Human
cuugcggcuccucag

SEQ ID NO: 1467994 - RNA, 13 nt, Human
cuugaugccuggc

SEQ ID NO: 1467995 - RNA, 13 nt, Human
cuugccugcaggc

SEQ ID NO: 1467996 - RNA, 12 nt, Human
cuugaugccugg

SEQ ID NO: 1467997 - RNA, 13 nt, Human
cuugaugaagaag

SEQ ID NO: 1467998 - RNA, 12 nt, Human
cuugaugaagaa

SEQ ID NO: 1467999 - RNA, 17 nt, Human
cuugauagaaaugccaa

SEQ ID NO: 1468000 - RNA, 22 nt, Human
cuugauagaaaugccaagcacu

SEQ ID NO: 1468001 - RNA, 12 nt, Human
cuugauagaaau

SEQ ID NO: 1468002 - RNA, 14 nt, Human
cuugauagaaaugc

SEQ ID NO: 1468003 - RNA, 21 nt, Human
cuuccugcaggcaggaacaaa

SEQ ID NO: 1468004 - RNA, 20 nt, Human
cuuccugcaggcaggaacaa

SEQ ID NO: 1468005 - RNA, 14 nt, Human
cuucuauuuuguaa

SEQ ID NO: 1468006 - RNA, 15 nt, Human
cuucuauuuuguaaa

SEQ ID NO: 1468007 - RNA, 16 nt, Human
cuucuauuuuguaaac

SEQ ID NO: 1468008 - RNA, 17 nt, Human
cuucuauuuuguaaacu

SEQ ID NO: 1468009 - RNA, 23 nt, Human
cuuauuguagcauccuggaauau

SEQ ID NO: 1468010 - RNA, 15 nt, Human
cuuauuggaacucug

SEQ ID NO: 1468011 - RNA, 17 nt, Human
cuuauuggaacucugcu

SEQ ID NO: 1468012 - RNA, 18 nt, Human
cuuauuggaacucugcuu

SEQ ID NO: 1468013 - RNA, 20 nt, Human
cuuauuguagcauccuggaa

SEQ ID NO: 1468014 - RNA, 16 nt, Human
cuuauuauuuuugaga

SEQ ID NO: 1468015 - RNA, 14 nt, Human
cuuauucauuuucu

SEQ ID NO: 1468016 - RNA, 16 nt, Human
cuuauucauuuucucu

SEQ ID NO: 1468017 - RNA, 17 nt, Human
cuuauucauuuucucua

SEQ ID NO: 1468018 - RNA, 18 nt, Human
cuuauucauuuucucuaa

SEQ ID NO: 1468019 - RNA, 14 nt, Human
cuuauuauuuuuga

SEQ ID NO: 1468020 - RNA, 19 nt, Human
cuuauucauuuucucuaau

SEQ ID NO: 1468021 - RNA, 14 nt, Human
cuuaugcuuaaauu

SEQ ID NO: 1468022 - RNA, 15 nt, Human
cuucacuguaaaaua

SEQ ID NO: 1468023 - RNA, 19 nt, Human
cuucacucuucaaaugccu

SEQ ID NO: 1468024 - RNA, 19 nt, Human
cuucaucuggauuccagag

SEQ ID NO: 1468025 - RNA, 13 nt, Human
cuucaucuggcaa

SEQ ID NO: 1468026 - RNA, 14 nt, Human
cuucaucuggcaac

SEQ ID NO: 1468027 - RNA, 19 nt, Human
cuucaucuggcaacaucuu

SEQ ID NO: 1468028 - RNA, 23 nt, Human
cuucaucuggcaacaucuuuauc

SEQ ID NO: 1468029 - RNA, 15 nt, Human
cuucaucuggaacca

SEQ ID NO: 1468030 - RNA, 13 nt, Human
cuucaucuggaac

SEQ ID NO: 1468031 - RNA, 12 nt, Human
cuucaucuggaa

SEQ ID NO: 1468032 - RNA, 11 nt, Human
cuucaucugga

SEQ ID NO: 1468033 - RNA, 12 nt, Human
cuucauaaucca

SEQ ID NO: 1468034 - RNA, 19 nt, Human
cuucauagagacuugggaa

SEQ ID NO: 1468035 - RNA, 15 nt, Human
cuucaugcauggaaa

SEQ ID NO: 1468036 - RNA, 13 nt, Human
cuucaugcaugga

SEQ ID NO: 1468037 - RNA, 10 nt, Human
cugggacagg

SEQ ID NO: 1468038 - RNA, 19 nt, Human
cuggacugucauagaaauu

SEQ ID NO: 1468039 - RNA, 20 nt, Human
cuggacugucauagaaauua

SEQ ID NO: 1468040 - RNA, 16 nt, Human
cuggacugugugcuca

SEQ ID NO: 1468041 - RNA, 24 nt, Human
cuggcaggcaggcucccagggaca

SEQ ID NO: 1468042 - RNA, 20 nt, Human
cuggcccccucccuggauga

SEQ ID NO: 1468043 - RNA, 18 nt, Human
cuggcaggcaggcuccca

SEQ ID NO: 1468044 - RNA, 18 nt, Human
cuggggccaggcuggguc

SEQ ID NO: 1468045 - RNA, 14 nt, Human
cuggggaagacagu

SEQ ID NO: 1468046 - RNA, 15 nt, Human
cuggggaagacagug

SEQ ID NO: 1468047 - RNA, 16 nt, Human
cuggggaagacagugg

SEQ ID NO: 1468048 - RNA, 17 nt, Human
cuggggaagacaguggc

SEQ ID NO: 1468049 - RNA, 18 nt, Human
cuggggaagacaguggcc

SEQ ID NO: 1468050 - RNA, 13 nt, Human
cugggcagaccuu

SEQ ID NO: 1468051 - RNA, 19 nt, Human
cuggugcacuggccccacc

SEQ ID NO: 1468052 - RNA, 16 nt, Human
cuggugcacuggcccc

SEQ ID NO: 1468053 - RNA, 14 nt, Human
cuggugagccaagc

SEQ ID NO: 1468054 - RNA, 17 nt, Human
cugguuugaagaauguu

SEQ ID NO: 1468055 - RNA, 23 nt, Human
cuguacuugcucuugaugccugg

SEQ ID NO: 1468056 - RNA, 22 nt, Human
cuguacuugcucuugaugccug

SEQ ID NO: 1468057 - RNA, 21 nt, Human
cuguaaaaugugggauuaugg

SEQ ID NO: 1468058 - RNA, 17 nt, Human
cuguaaaauaaaagguc

SEQ ID NO: 1468059 - RNA, 13 nt, Human
cuguaaaacuaag

SEQ ID NO: 1468060 - RNA, 15 nt, Human
cuguaaaauguggga

SEQ ID NO: 1468061 - RNA, 15 nt, Human
cuguaaacacagaca

SEQ ID NO: 1468062 - RNA, 22 nt, Human
cugucacccagguuggagugca

SEQ ID NO: 1468063 - RNA, 15 nt, Human
cugucgauuagacug

SEQ ID NO: 1468064 - RNA, 17 nt, Human
cugucgauuagacugga

SEQ ID NO: 1468065 - RNA, 19 nt, Human
cugucgauuagacuggaca

SEQ ID NO: 1468066 - RNA, 20 nt, Human
cugucgauuagacuggacag

SEQ ID NO: 1468067 - RNA, 23 nt, Human
cugucgauuagacuggacagcuu

SEQ ID NO: 1468068 - RNA, 22 nt, Human
cugugaagugagaccuuccuuu

SEQ ID NO: 1468069 - RNA, 17 nt, Human
cugugaagugagaccuu

SEQ ID NO: 1468070 - RNA, 13 nt, Human
cuggacugugugc

SEQ ID NO: 1468071 - RNA, 18 nt, Human
cuggacugucauagaaau

SEQ ID NO: 1468072 - RNA, 16 nt, Human
cuggaacugucucuca

SEQ ID NO: 1468073 - RNA, 18 nt, Human
cuggaacugucucucaug

SEQ ID NO: 1468074 - RNA, 19 nt, Human
cuggaacugucucucauga

SEQ ID NO: 1468075 - RNA, 16 nt, Human
cuggaacuugaacuga

SEQ ID NO: 1468076 - RNA, 19 nt, Human
cuggaacuugaacugauuc

SEQ ID NO: 1468077 - RNA, 16 nt, Human
cuggaaccaucagaaa

SEQ ID NO: 1468078 - RNA, 15 nt, Human
cuggaaccaucagaa

SEQ ID NO: 1468079 - RNA, 21 nt, Human
cuggaacacuagacaagccag

SEQ ID NO: 1468080 - RNA, 22 nt, Human
cuggaacacuagacaagccaga

SEQ ID NO: 1468081 - RNA, 23 nt, Human
cuggaacacuagacaagccagaa

SEQ ID NO: 1468082 - RNA, 20 nt, Human
cuggaacacuagacaagcca

SEQ ID NO: 1468083 - RNA, 21 nt, Human
cuggaaaucaggguuaguauu

SEQ ID NO: 1468084 - RNA, 18 nt, Human
cugcuuuuuauggccugu

SEQ ID NO: 1468085 - RNA, 17 nt, Human
cugcuuuuuauggccug

SEQ ID NO: 1468086 - RNA, 15 nt, Human
cugcuacaauguccu

SEQ ID NO: 1468087 - RNA, 13 nt, Human
cugcucagacaga

SEQ ID NO: 1468088 - RNA, 14 nt, Human
cugcucagcccugc

SEQ ID NO: 1468089 - RNA, 15 nt, Human
cugcucagcccugca

SEQ ID NO: 1468090 - RNA, 18 nt, Human
cugcucagcccugcacca

SEQ ID NO: 1468091 - RNA, 21 nt, Human
cugcucagcccugcaccaugc

SEQ ID NO: 1468092 - RNA, 20 nt, Human
cugccugguauauccaaaag

SEQ ID NO: 1468093 - RNA, 13 nt, Human
cugcccuguaccc

SEQ ID NO: 1468094 - RNA, 21 nt, Human
cugcccuguaccccagcacuu

SEQ ID NO: 1468095 - RNA, 21 nt, Human
cugccccuacccuggacuugc

SEQ ID NO: 1468096 - RNA, 17 nt, Human
cugccaagacugcugug

SEQ ID NO: 1468097 - RNA, 21 nt, Human
cugccaagacugcuguggcca

SEQ ID NO: 1468098 - RNA, 13 nt, Human
cugccaagccaug

SEQ ID NO: 1468099 - RNA, 20 nt, Human
cugccaagacugcuguggcc

SEQ ID NO: 1468100 - RNA, 12 nt, Human
cugccaagccau

SEQ ID NO: 1468101 - RNA, 23 nt, Human
cugcauugagcuugcaugcuugc

SEQ ID NO: 1468102 - RNA, 17 nt, Human
cugcauugagcuugcau

SEQ ID NO: 1468103 - RNA, 23 nt, Human
cugcauuauuggaauauaauugu

SEQ ID NO: 1468104 - RNA, 20 nt, Human
cucuuagaugcaguucugaa

SEQ ID NO: 1468105 - RNA, 21 nt, Human
cucuuagaugcaguucugaag

SEQ ID NO: 1468106 - RNA, 17 nt, Human
cugaaaauuauuuaaac

SEQ ID NO: 1468107 - RNA, 12 nt, Human
cugaaaaugugc

SEQ ID NO: 1468108 - RNA, 13 nt, Human
cugaaaaugugcu

SEQ ID NO: 1468109 - RNA, 21 nt, Human
cucucacuuguuuuauuuaac

SEQ ID NO: 1468110 - RNA, 19 nt, Human
cucucaauauucaauaaag

SEQ ID NO: 1468111 - RNA, 10 nt, Human
cucucaauau

SEQ ID NO: 1468112 - RNA, 18 nt, Human
cucucaauauucaauaaa

SEQ ID NO: 1468113 - RNA, 17 nt, Human
cucucaaagcaaauaau

SEQ ID NO: 1468114 - RNA, 15 nt, Human
cucuccccaugaugu

SEQ ID NO: 1468115 - RNA, 15 nt, Human
cucuccggucucucu

SEQ ID NO: 1468116 - RNA, 20 nt, Human
cucucuggaagccccugggc

SEQ ID NO: 1468117 - RNA, 19 nt, Human
cucugaagaacucucugga

SEQ ID NO: 1468118 - RNA, 18 nt, Human
cuccguccaggagccugg

SEQ ID NO: 1468119 - RNA, 19 nt, Human
cuccguccaggagccuggc

SEQ ID NO: 1468120 - RNA, 20 nt, Human
cuccguccaggagccugugc

SEQ ID NO: 1468121 - RNA, 22 nt, Human
cuccguccaggagccugugccu

SEQ ID NO: 1468122 - RNA, 12 nt, Human
cuccguguggga

SEQ ID NO: 1468123 - RNA, 14 nt, Human
cuccgugugggaga

SEQ ID NO: 1468124 - RNA, 18 nt, Human
cuccgugugggagaccgg

SEQ ID NO: 1468125 - RNA, 15 nt, Human
cucuuagaugcaguu

SEQ ID NO: 1468126 - RNA, 22 nt, Human
cucuguauuugaaucagccuac

SEQ ID NO: 1468127 - RNA, 18 nt, Human
cucuguaauugaauauua

SEQ ID NO: 1468128 - RNA, 19 nt, Human
cucuguaauugaauauuau

SEQ ID NO: 1468129 - RNA, 15 nt, Human
cucuguaaagcuaaa

SEQ ID NO: 1468130 - RNA, 21 nt, Human
cucuguaaagcuaaaauaaag

SEQ ID NO: 1468131 - RNA, 23 nt, Human
cucuguaaguagaugcauuuggg

SEQ ID NO: 1468132 - RNA, 18 nt, Human
cuccaacccuagcaaaag

SEQ ID NO: 1468133 - RNA, 16 nt, Human
cuccaaagucucugga

SEQ ID NO: 1468134 - RNA, 12 nt, Human
cuccaacaauaa

SEQ ID NO: 1468135 - RNA, 13 nt, Human
cucaugaauguaa

SEQ ID NO: 1468136 - RNA, 16 nt, Human
cucaucuuucuuccaa

SEQ ID NO: 1468137 - RNA, 14 nt, Human
cucaucuuuuuacu

SEQ ID NO: 1468138 - RNA, 12 nt, Human
cucaugaaccuc

SEQ ID NO: 1468139 - RNA, 21 nt, Human
cucaugaaccucaagcugcau

SEQ ID NO: 1468140 - RNA, 12 nt, Human
cucaugaaugua

SEQ ID NO: 1468141 - RNA, 20 nt, Human
cucaguguccucaggggccu

SEQ ID NO: 1468142 - RNA, 20 nt, Human
cucaucuuucccuccuuggu

SEQ ID NO: 1468143 - RNA, 19 nt, Human
cucaucuuucccuccuugg

SEQ ID NO: 1468144 - RNA, 18 nt, Human
cucaucuuucccuccuug

SEQ ID NO: 1468145 - RNA, 17 nt, Human
cucaucuuucccuccuu

SEQ ID NO: 1468146 - RNA, 16 nt, Human
cucaucuuucccuccu

SEQ ID NO: 1468147 - RNA, 15 nt, Human
cucaucuuucccucc

SEQ ID NO: 1468148 - RNA, 14 nt, Human
cucaucuuucccuc

SEQ ID NO: 1468149 - RNA, 18 nt, Human
cucagccucccaaguaac

SEQ ID NO: 1468150 - RNA, 13 nt, Human
cucaggccagagc

SEQ ID NO: 1468151 - RNA, 16 nt, Human
cucaggccagagccaa

SEQ ID NO: 1468152 - RNA, 17 nt, Human
cucaggccagagccaag

SEQ ID NO: 1468153 - RNA, 18 nt, Human
cucaggccagagccaagg

SEQ ID NO: 1468154 - RNA, 20 nt, Human
cucaggcccccaccuggcuc

SEQ ID NO: 1468155 - RNA, 21 nt, Human
cucaggcccccaccuggcuca

SEQ ID NO: 1468156 - RNA, 23 nt, Human
cuccagguauucguuaucuaaua

SEQ ID NO: 1468157 - RNA, 19 nt, Human
cuccaggguggcagcaaca

SEQ ID NO: 1468158 - RNA, 14 nt, Human
cuccccuccauccc

SEQ ID NO: 1468159 - RNA, 15 nt, Human
cuccccuccaucccu

SEQ ID NO: 1468160 - RNA, 16 nt, Human
cuccccuccaucccug

SEQ ID NO: 1468161 - RNA, 19 nt, Human
cuccccuccaucccuggcc

SEQ ID NO: 1468162 - RNA, 23 nt, Human
cuccccuccaucccuggcccccu

SEQ ID NO: 1468163 - RNA, 13 nt, Human
cucccuccucugc

SEQ ID NO: 1468164 - RNA, 14 nt, Human
cucccuccucugcc

SEQ ID NO: 1468165 - RNA, 14 nt, Human
cgugucuggcacag

SEQ ID NO: 1468166 - RNA, 21 nt, Human
cgugucuggcacagccuggcu

SEQ ID NO: 1468167 - RNA, 20 nt, Human
cgugagcauguuuggaaggg

SEQ ID NO: 1468168 - RNA, 15 nt, Human
cgugacgucugggug

SEQ ID NO: 1468169 - RNA, 20 nt, Human
cgugacgucuggguggcccu

SEQ ID NO: 1468170 - RNA, 16 nt, Human
cuaagaaacuuaaauu

SEQ ID NO: 1468171 - RNA, 22 nt, Human
cuaagaaacauuuauauugaua

SEQ ID NO: 1468172 - RNA, 19 nt, Human
cuaagaaacauuuauauug

SEQ ID NO: 1468173 - RNA, 20 nt, Human
cuaagaaacauuuauauuga

SEQ ID NO: 1468174 - RNA, 21 nt, Human
cuaagaaacauuuauauugau

SEQ ID NO: 1468175 - RNA, 12 nt, Human
cuaagaaagaac

SEQ ID NO: 1468176 - RNA, 15 nt, Human
cuaagaaagaacacg

SEQ ID NO: 1468177 - RNA, 12 nt, Human
cuaaccugccga

SEQ ID NO: 1468178 - RNA, 19 nt, Human
cuaaccugccgagagucca

SEQ ID NO: 1468179 - RNA, 21 nt, Human
cuaaccugccgagaguccauc

SEQ ID NO: 1468180 - RNA, 18 nt, Human
cuaccucuccagccucag

SEQ ID NO: 1468181 - RNA, 15 nt, Human
cuacaugaaacagaa

SEQ ID NO: 1468182 - RNA, 16 nt, Human
cuacaugaaacagaaa

SEQ ID NO: 1468183 - RNA, 18 nt, Human
cuacaugaaacagaaaca

SEQ ID NO: 1468184 - RNA, 15 nt, Human
cuacauaauuuaguu

SEQ ID NO: 1468185 - RNA, 13 nt, Human
cuaauuuuuuugu

SEQ ID NO: 1468186 - RNA, 16 nt, Human
cuaauuuuuuuguauu

SEQ ID NO: 1468187 - RNA, 20 nt, Human
cuaauuuuuuuguauuuuag

SEQ ID NO: 1468188 - RNA, 21 nt, Human
cuaauuuuuuuguauuuuagc

SEQ ID NO: 1468189 - RNA, 20 nt, Human
cuaauuuuuguauuuuuagu

SEQ ID NO: 1468190 - RNA, 13 nt, Human
cuaauuuuuguau

SEQ ID NO: 1468191 - RNA, 23 nt, Human
cuaauuuuuguauuuuuaguaga

SEQ ID NO: 1468192 - RNA, 14 nt, Human
cuaauuuuuuguug

SEQ ID NO: 1468193 - RNA, 16 nt, Human
cuaauuuuuuguuguu

SEQ ID NO: 1468194 - RNA, 11 nt, Human
cuaauuuuugu

SEQ ID NO: 1468195 - RNA, 21 nt, Human
cuaauuuuuauuuuugcugag

SEQ ID NO: 1468196 - RNA, 12 nt, Human
cuaauuuauaaa

SEQ ID NO: 1468197 - RNA, 18 nt, Human
cuaauuuuuauuuuugcu

SEQ ID NO: 1468198 - RNA, 16 nt, Human
cuacaaccuccgccuc

SEQ ID NO: 1468199 - RNA, 15 nt, Human
cuacaaccaauggaa

SEQ ID NO: 1468200 - RNA, 22 nt, Human
cuaauuggcaugaaggugucau

SEQ ID NO: 1468201 - RNA, 23 nt, Human
cuaguugaucagcuuauugucua

SEQ ID NO: 1468202 - RNA, 16 nt, Human
cuauaaccagacacau

SEQ ID NO: 1468203 - RNA, 17 nt, Human
cuauaagaacuuugagc

SEQ ID NO: 1468204 - RNA, 19 nt, Human
cuagccugcauugagcuug

SEQ ID NO: 1468205 - RNA, 17 nt, Human
cuagcccuccuuuuucc

SEQ ID NO: 1468206 - RNA, 18 nt, Human
cuagcccuccuuuuucca

SEQ ID NO: 1468207 - RNA, 19 nt, Human
cuagcccuccuuuuuccaa

SEQ ID NO: 1468208 - RNA, 13 nt, Human
cuagcccucucac

SEQ ID NO: 1468209 - RNA, 18 nt, Human
cuagcccucucacauuua

SEQ ID NO: 1468210 - RNA, 19 nt, Human
cuagcccucucacauuuau

SEQ ID NO: 1468211 - RNA, 14 nt, Human
cuaccugagcuaaa

SEQ ID NO: 1468212 - RNA, 14 nt, Human
cuagaacacaggca

SEQ ID NO: 1468213 - RNA, 19 nt, Human
cuagaacacaggcaaaauc

SEQ ID NO: 1468214 - RNA, 21 nt, Human
cuagaacacaggcaaaauccu

SEQ ID NO: 1468215 - RNA, 22 nt, Human
cuagaacacaggcaaaauccuu

SEQ ID NO: 1468216 - RNA, 20 nt, Human
cuagccaaaccaggacccug

SEQ ID NO: 1468217 - RNA, 16 nt, Human
cuagccaaaccaggac

SEQ ID NO: 1468218 - RNA, 17 nt, Human
cggagucaaaaauuaaa

SEQ ID NO: 1468219 - RNA, 17 nt, Human
cggcggccccuagcgcu

SEQ ID NO: 1468220 - RNA, 23 nt, Human
cggcuccucgagaucccaacacu

SEQ ID NO: 1468221 - RNA, 13 nt, Human
cggcuccucaggg

SEQ ID NO: 1468222 - RNA, 14 nt, Human
cggcuccucaggga

SEQ ID NO: 1468223 - RNA, 20 nt, Human
cggcuccucagggacucagg

SEQ ID NO: 1468224 - RNA, 15 nt, Human
cgccggaucugaggg

SEQ ID NO: 1468225 - RNA, 15 nt, Human
cgagugcucauuuca

SEQ ID NO: 1468226 - RNA, 12 nt, Human
ccuuuugucucu

SEQ ID NO: 1468227 - RNA, 22 nt, Human
ccuuuuuuaggaagcaagcuua

SEQ ID NO: 1468228 - RNA, 10 nt, Human
ccuucuggcc

SEQ ID NO: 1468229 - RNA, 20 nt, Human
ccuucugggcagaccuugac

SEQ ID NO: 1468230 - RNA, 16 nt, Human
ccuucuggccuuguaa

SEQ ID NO: 1468231 - RNA, 18 nt, Human
ccagagugcugaaggaau

SEQ ID NO: 1468232 - RNA, 15 nt, Human
ccagauccuggaaau

SEQ ID NO: 1468233 - RNA, 16 nt, Human
ccagagucccugccug

SEQ ID NO: 1468234 - RNA, 17 nt, Human
ccagagucccugccugg

SEQ ID NO: 1468235 - RNA, 18 nt, Human
ccagagucccugccugga

SEQ ID NO: 1468236 - RNA, 19 nt, Human
ccagagucccugccuggac

SEQ ID NO: 1468237 - RNA, 22 nt, Human
ccagagucccugccuggaccag

SEQ ID NO: 1468238 - RNA, 20 nt, Human
ccaggaaagcgccuccaacc

SEQ ID NO: 1468239 - RNA, 19 nt, Human
ccaggaagaucccccagaa

SEQ ID NO: 1468240 - RNA, 18 nt, Human
ccaggaagaucccccaga

SEQ ID NO: 1468241 - RNA, 17 nt, Human
ccaggaagaucccccag

SEQ ID NO: 1468242 - RNA, 14 nt, Human
ccaggaacugggcc

SEQ ID NO: 1468243 - RNA, 18 nt, Human
ccagcagauuuccagccu

SEQ ID NO: 1468244 - RNA, 12 nt, Human
ccaggcacugca

SEQ ID NO: 1468245 - RNA, 13 nt, Human
ccaggcacugcaa

SEQ ID NO: 1468246 - RNA, 17 nt, Human
ccaggcaccaaaagaag

SEQ ID NO: 1468247 - RNA, 17 nt, Human
ccaggcaccaggacuag

SEQ ID NO: 1468248 - RNA, 15 nt, Human
ccaguuguccuccuu

SEQ ID NO: 1468249 - RNA, 14 nt, Human
ccaguuguccuccu

SEQ ID NO: 1468250 - RNA, 13 nt, Human
ccaguuguccucc

SEQ ID NO: 1468251 - RNA, 12 nt, Human
ccaguuguccuc

SEQ ID NO: 1468252 - RNA, 16 nt, Human
ccaguuguccuccuuc

SEQ ID NO: 1468253 - RNA, 12 nt, Human
ccaugagcuccu

SEQ ID NO: 1468254 - RNA, 16 nt, Human
ccaugucaaacaaaua

SEQ ID NO: 1468255 - RNA, 14 nt, Human
cccauccuagaggc

SEQ ID NO: 1468256 - RNA, 15 nt, Human
cccauauuguaaaac

SEQ ID NO: 1468257 - RNA, 18 nt, Human
cccauauuguaaaacagg

SEQ ID NO: 1468258 - RNA, 19 nt, Human
cccauauuguaaaacaggu

SEQ ID NO: 1468259 - RNA, 20 nt, Human
cccacccucguggacaccug

SEQ ID NO: 1468260 - RNA, 23 nt, Human
cccacccucguggacaccugccc

SEQ ID NO: 1468261 - RNA, 22 nt, Human
cccacccucguggacaccugcc

SEQ ID NO: 1468262 - RNA, 15 nt, Human
cccacuucagccucc

SEQ ID NO: 1468263 - RNA, 13 nt, Human
cccacuucagccu

SEQ ID NO: 1468264 - RNA, 14 nt, Human
cccacugccuuuga

SEQ ID NO: 1468265 - RNA, 18 nt, Human
ccccuuugcugacccucc

SEQ ID NO: 1468266 - RNA, 14 nt, Human
cccgggagcucagg

SEQ ID NO: 1468267 - RNA, 14 nt, Human
ccccagagccacag

SEQ ID NO: 1468268 - RNA, 13 nt, Human
ccccagagccaca

SEQ ID NO: 1468269 - RNA, 16 nt, Human
ccccagagccacaguu

SEQ ID NO: 1468270 - RNA, 15 nt, Human
ccccagagccacagu

SEQ ID NO: 1468271 - RNA, 18 nt, Human
ccccauuuagguuucuga

SEQ ID NO: 1468272 - RNA, 13 nt, Human
ccccaucucaggc

SEQ ID NO: 1468273 - RNA, 14 nt, Human
ccccaucucaggcc

SEQ ID NO: 1468274 - RNA, 17 nt, Human
ccccaucucaggccaga

SEQ ID NO: 1468275 - RNA, 20 nt, Human
cccauuuaaauuuuuuuccu

SEQ ID NO: 1468276 - RNA, 14 nt, Human
ccccgacuuuuguu

SEQ ID NO: 1468277 - RNA, 23 nt, Human
ccugacccuccaccgcagaagga

SEQ ID NO: 1468278 - RNA, 22 nt, Human
ccugacccucaucuuucuucca

SEQ ID NO: 1468279 - RNA, 13 nt, Human
ccugaccucaggc

SEQ ID NO: 1468280 - RNA, 18 nt, Human
ccugacugccaagccaug

SEQ ID NO: 1468281 - RNA, 16 nt, Human
ccugacugccaagcca

SEQ ID NO: 1468282 - RNA, 15 nt, Human
ccugacugccaagcc

SEQ ID NO: 1468283 - RNA, 14 nt, Human
ccugacugccaagc

SEQ ID NO: 1468284 - RNA, 13 nt, Human
ccugacugccaag

SEQ ID NO: 1468285 - RNA, 15 nt, Human
ccugcagacucacug

SEQ ID NO: 1468286 - RNA, 15 nt, Human
ccucucugcaggucc

SEQ ID NO: 1468287 - RNA, 13 nt, Human
ccucucugcaggu

SEQ ID NO: 1468288 - RNA, 22 nt, Human
ccucucugcaggucccuaauaa

SEQ ID NO: 1468289 - RNA, 21 nt, Human
ccucucugcaggucccuaaua

SEQ ID NO: 1468290 - RNA, 23 nt, Human
ccucucugcaggucccuaauaaa

SEQ ID NO: 1468291 - RNA, 16 nt, Human
ccuggaugacauuaaa

SEQ ID NO: 1468292 - RNA, 19 nt, Human
ccuggaggggcuggggacu

SEQ ID NO: 1468293 - RNA, 18 nt, Human
ccugcccagugcacuugc

SEQ ID NO: 1468294 - RNA, 22 nt, Human
ccugcccagugcacuugcugga

SEQ ID NO: 1468295 - RNA, 16 nt, Human
ccugcccaugggagcu

SEQ ID NO: 1468296 - RNA, 17 nt, Human
cccuucuuuccacagaa

SEQ ID NO: 1468297 - RNA, 15 nt, Human
cccugugccuuguca

SEQ ID NO: 1468298 - RNA, 20 nt, Human
cccugugccuugucacgcca

SEQ ID NO: 1468299 - RNA, 22 nt, Human
cccugugccuugucacgccaga

SEQ ID NO: 1468300 - RNA, 17 nt, Human
cccucacccauccuaga

SEQ ID NO: 1468301 - RNA, 13 nt, Human
cccucacccaucc

SEQ ID NO: 1468302 - RNA, 11 nt, Human
cccucacccau

SEQ ID NO: 1468303 - RNA, 9 nt, Human
cccuggccc

SEQ ID NO: 1468304 - RNA, 13 nt, Human
cccuggcccccuc

SEQ ID NO: 1468305 - RNA, 21 nt, Human
cccuggcccccucccuggaug

SEQ ID NO: 1468306 - RNA, 20 nt, Human
cccuggcccccucccuggau

SEQ ID NO: 1468307 - RNA, 23 nt, Human
ccuaauaaagcuguguggcaguc

SEQ ID NO: 1468308 - RNA, 20 nt, Human
ccuaauaauaucccacuggg

SEQ ID NO: 1468309 - RNA, 19 nt, Human
ccuaauaauaucccacugg

SEQ ID NO: 1468310 - RNA, 14 nt, Human
ccuaauaaagcugu

SEQ ID NO: 1468311 - RNA, 19 nt, Human
ccuaagcuggagugcagug

SEQ ID NO: 1468312 - RNA, 17 nt, Human
ccuaagccagcugcccc

SEQ ID NO: 1468313 - RNA, 18 nt, Human
ccuaagggauccugccug

SEQ ID NO: 1468314 - RNA, 18 nt, Human
ccuaagcuggagugcagu

SEQ ID NO: 1468315 - RNA, 18 nt, Human
ccuaagccagcugccccc

SEQ ID NO: 1468316 - RNA, 16 nt, Human
ccuaagccagcugccc

SEQ ID NO: 1468317 - RNA, 14 nt, Human
ccuaagccagcugc

SEQ ID NO: 1468318 - RNA, 16 nt, Human
ccguagguuauuuuca

SEQ ID NO: 1468319 - RNA, 19 nt, Human
ccggcuaauuuuuguauuu

SEQ ID NO: 1468320 - RNA, 15 nt, Human
ccggcuaauuuuugu

SEQ ID NO: 1468321 - RNA, 22 nt, Human
ccgucaaaacagauuguuugca

SEQ ID NO: 1468322 - RNA, 17 nt, Human
ccgucaccccuguuucu

SEQ ID NO: 1468323 - RNA, 12 nt, Human
ccgucagugcug

SEQ ID NO: 1468324 - RNA, 16 nt, Human
ccguccaggagccugg

SEQ ID NO: 1468325 - RNA, 18 nt, Human
ccguccaggagccugugc

SEQ ID NO: 1468326 - RNA, 15 nt, Human
ccuauuuuaauaaac

SEQ ID NO: 1468327 - RNA, 16 nt, Human
ccuauuuccagaaaua

SEQ ID NO: 1468328 - RNA, 19 nt, Human
ccuauugugcaauguaaau

SEQ ID NO: 1468329 - RNA, 15 nt, Human
ccucaagcugcaucu

SEQ ID NO: 1468330 - RNA, 20 nt, Human
ccuccaaggaggggcuguaa

SEQ ID NO: 1468331 - RNA, 21 nt, Human
ccuccaaggaggggcuguaaa

SEQ ID NO: 1468332 - RNA, 14 nt, Human
ccucccaagcaguu

SEQ ID NO: 1468333 - RNA, 12 nt, Human
auuguugcauua

SEQ ID NO: 1468334 - RNA, 21 nt, Human
auuguuguacacagaaauaca

SEQ ID NO: 1468335 - RNA, 15 nt, Human
auuguuaguuucuga

SEQ ID NO: 1468336 - RNA, 12 nt, Human
auugcugaaauu

SEQ ID NO: 1468337 - RNA, 13 nt, Human
auugcugaaauuu

SEQ ID NO: 1468338 - RNA, 16 nt, Human
auugcugaaauuuuau

SEQ ID NO: 1468339 - RNA, 13 nt, Human
auugaguuggaau

SEQ ID NO: 1468340 - RNA, 22 nt, Human
auugcuauguuuugacauuuuu

SEQ ID NO: 1468341 - RNA, 16 nt, Human
auucuugauguaaaau

SEQ ID NO: 1468342 - RNA, 17 nt, Human
auucuugauguaaaauc

SEQ ID NO: 1468343 - RNA, 13 nt, Human
auucuucugaacu

SEQ ID NO: 1468344 - RNA, 21 nt, Human
auucuucugaacucaaacuga

SEQ ID NO: 1468345 - RNA, 16 nt, Human
auucuuucccaacacc

SEQ ID NO: 1468346 - RNA, 19 nt, Human
auucuuucccaacaccucu

SEQ ID NO: 1468347 - RNA, 12 nt, Human
auucuugaugua

SEQ ID NO: 1468348 - RNA, 14 nt, Human
auucuugauguaaa

SEQ ID NO: 1468349 - RNA, 18 nt, Human
auuagcagucccuccaca

SEQ ID NO: 1468350 - RNA, 22 nt, Human
auuagcaauugacugucacugu

SEQ ID NO: 1468351 - RNA, 17 nt, Human
auuagccagugaaaaac

SEQ ID NO: 1468352 - RNA, 19 nt, Human
auuacaguggggaaugaag

SEQ ID NO: 1468353 - RNA, 17 nt, Human
auuacaggcgugagcca

SEQ ID NO: 1468354 - RNA, 15 nt, Human
auuacagcuggagaa

SEQ ID NO: 1468355 - RNA, 22 nt, Human
auuaauuccuucagcacuuuag

SEQ ID NO: 1468356 - RNA, 17 nt, Human
auuacaacggagucaaa

SEQ ID NO: 1468357 - RNA, 15 nt, Human
auuacaacggaguca

SEQ ID NO: 1468358 - RNA, 16 nt, Human
auucaaauguauuaca

SEQ ID NO: 1468359 - RNA, 18 nt, Human
auucaaauguauuacagu

SEQ ID NO: 1468360 - RNA, 18 nt, Human
auucaaugccccugaauu

SEQ ID NO: 1468361 - RNA, 20 nt, Human
auucaaugccccugaauuua

SEQ ID NO: 1468362 - RNA, 16 nt, Human
auucaauucaaagcug

SEQ ID NO: 1468363 - RNA, 18 nt, Human
auuaugaauuacauuugu

SEQ ID NO: 1468364 - RNA, 14 nt, Human
auuaugaauuacau

SEQ ID NO: 1468365 - RNA, 17 nt, Human
auuaugaauuacauuug

SEQ ID NO: 1468366 - RNA, 18 nt, Human
auuaugaaacuuuuggaa

SEQ ID NO: 1468367 - RNA, 22 nt, Human
auuaucuuuucauacauuuucu

SEQ ID NO: 1468368 - RNA, 23 nt, Human
auuaucuuuucauacauuuucua

SEQ ID NO: 1468369 - RNA, 21 nt, Human
auucauaauuauuauuuggcc

SEQ ID NO: 1468370 - RNA, 19 nt, Human
auuuuauagcuacuaauuu

SEQ ID NO: 1468371 - RNA, 13 nt, Human
auuuguuucuacu

SEQ ID NO: 1468372 - RNA, 15 nt, Human
auuuguuggaaugaa

SEQ ID NO: 1468373 - RNA, 17 nt, Human
auuuguuuaaaaaguaa

SEQ ID NO: 1468374 - RNA, 16 nt, Human
auuuguuuaaaaagua

SEQ ID NO: 1468375 - RNA, 13 nt, Human
auuuguugagagu

SEQ ID NO: 1468376 - RNA, 22 nt, Human
auuuguugagagugugaccaaa

SEQ ID NO: 1468377 - RNA, 13 nt, Human
auuuguuggaaug

SEQ ID NO: 1468378 - RNA, 14 nt, Human
auuuguuggaauga

SEQ ID NO: 1468379 - RNA, 19 nt, Human
auuugugcccccaaccauu

SEQ ID NO: 1468380 - RNA, 14 nt, Human
auuugcucauggaa

SEQ ID NO: 1468381 - RNA, 17 nt, Human
auuugcucauggaauug

SEQ ID NO: 1468382 - RNA, 18 nt, Human
auuugcuuuuucaccaga

SEQ ID NO: 1468383 - RNA, 16 nt, Human
auuugccuguaacaag

SEQ ID NO: 1468384 - RNA, 11 nt, Human
auuugccugua

SEQ ID NO: 1468385 - RNA, 13 nt, Human
auuugccuguaac

SEQ ID NO: 1468386 - RNA, 15 nt, Human
auuugccuguaacaa

SEQ ID NO: 1468387 - RNA, 22 nt, Human
auuugccuguaacaagccagau

SEQ ID NO: 1468388 - RNA, 22 nt, Human
auuugcagcugagagaaaauaa

SEQ ID NO: 1468389 - RNA, 20 nt, Human
caaacaggaucaguuaacua

SEQ ID NO: 1468390 - RNA, 15 nt, Human
caaacaggcucagag

SEQ ID NO: 1468391 - RNA, 14 nt, Human
caaacaggcucaga

SEQ ID NO: 1468392 - RNA, 19 nt, Human
caaaagggccaaagaacca

SEQ ID NO: 1468393 - RNA, 20 nt, Human
caaaagggccaaagaaccaa

SEQ ID NO: 1468394 - RNA, 16 nt, Human
caaaagauugcugaaa

SEQ ID NO: 1468395 - RNA, 19 nt, Human
caaaagauugcugaaauuu

SEQ ID NO: 1468396 - RNA, 20 nt, Human
caaaagauugcugaaauuuu

SEQ ID NO: 1468397 - RNA, 12 nt, Human
caacaauaaaua

SEQ ID NO: 1468398 - RNA, 13 nt, Human
caacaauucuaaa

SEQ ID NO: 1468399 - RNA, 15 nt, Human
caaauccuugaagau

SEQ ID NO: 1468400 - RNA, 17 nt, Human
caaauccuuagaucugg

SEQ ID NO: 1468401 - RNA, 21 nt, Human
caaauccuuagaucuggcaug

SEQ ID NO: 1468402 - RNA, 14 nt, Human
caacacuaacauga

SEQ ID NO: 1468403 - RNA, 21 nt, Human
caaagucucuggaauuugaaa

SEQ ID NO: 1468404 - RNA, 16 nt, Human
caaagugcaaggaccu

SEQ ID NO: 1468405 - RNA, 12 nt, Human
caaagugcaagg

SEQ ID NO: 1468406 - RNA, 15 nt, Human
caaagguugagaugu

SEQ ID NO: 1468407 - RNA, 11 nt, Human
caaagguuuuc

SEQ ID NO: 1468408 - RNA, 19 nt, Human
caaagguuuuccucuucua

SEQ ID NO: 1468409 - RNA, 22 nt, Human
caaagcaagcauucagaagaaa

SEQ ID NO: 1468410 - RNA, 23 nt, Human
caaagcaagcauucagaagaaaa

SEQ ID NO: 1468411 - RNA, 16 nt, Human
caaagcaauaauagua

SEQ ID NO: 1468412 - RNA, 14 nt, Human
caaagcaauaauag

SEQ ID NO: 1468413 - RNA, 19 nt, Human
cacuggggcaggggccggg

SEQ ID NO: 1468414 - RNA, 17 nt, Human
cacugggacuugcaaaa

SEQ ID NO: 1468415 - RNA, 18 nt, Human
cacugggagaaaugaaaa

SEQ ID NO: 1468416 - RNA, 18 nt, Human
cacugccagcauuucccu

SEQ ID NO: 1468417 - RNA, 22 nt, Human
cacugccagcauuucccuuccu

SEQ ID NO: 1468418 - RNA, 22 nt, Human
cacuuguguuuugcaagccaga

SEQ ID NO: 1468419 - RNA, 18 nt, Human
cacuugucauuguuauau

SEQ ID NO: 1468420 - RNA, 16 nt, Human
cacuugucaauaaaau

SEQ ID NO: 1468421 - RNA, 19 nt, Human
cacuuguguuuugcaagcc

SEQ ID NO: 1468422 - RNA, 20 nt, Human
cacuuauuccccauucuucc

SEQ ID NO: 1468423 - RNA, 21 nt, Human
cacuuauuggaacucugcuug

SEQ ID NO: 1468424 - RNA, 14 nt, Human
cacugguuugaaga

SEQ ID NO: 1468425 - RNA, 15 nt, Human
cacucuuucuuucaa

SEQ ID NO: 1468426 - RNA, 14 nt, Human
cacucuuucuuuca

SEQ ID NO: 1468427 - RNA, 14 nt, Human
cacuaguauuucua

SEQ ID NO: 1468428 - RNA, 23 nt, Human
caccugcccugcccugccaccug

SEQ ID NO: 1468429 - RNA, 22 nt, Human
caccugcccugcccugccaccu

SEQ ID NO: 1468430 - RNA, 21 nt, Human
caccugcccugcccugccacc

SEQ ID NO: 1468431 - RNA, 20 nt, Human
caccugcccugcccugccac

SEQ ID NO: 1468432 - RNA, 19 nt, Human
caccugcccugcccugcca

SEQ ID NO: 1468433 - RNA, 18 nt, Human
caccugcccugcccugcc

SEQ ID NO: 1468434 - RNA, 17 nt, Human
caccugcccugcccugc

SEQ ID NO: 1468435 - RNA, 23 nt, Human
cacccucguggacaccugcccug

SEQ ID NO: 1468436 - RNA, 21 nt, Human
cacccucguggacaccugccc

SEQ ID NO: 1468437 - RNA, 21 nt, Human
cacccucaugcugugugacuc

SEQ ID NO: 1468438 - RNA, 16 nt, Human
cacccucaugcugugu

SEQ ID NO: 1468439 - RNA, 14 nt, Human
cacccucaugcugu

SEQ ID NO: 1468440 - RNA, 13 nt, Human
cacccucaugcug

SEQ ID NO: 1468441 - RNA, 16 nt, Human
cacccuccagagacaa

SEQ ID NO: 1468442 - RNA, 17 nt, Human
cacacaugaaguccaag

SEQ ID NO: 1468443 - RNA, 22 nt, Human
cacacaugaaguccaagcauuu

SEQ ID NO: 1468444 - RNA, 23 nt, Human
cacacagggucugcaaggucuuu

SEQ ID NO: 1468445 - RNA, 21 nt, Human
cacaguaaaaauggaaacuau

SEQ ID NO: 1468446 - RNA, 17 nt, Human
cacagccucuuagaugc

SEQ ID NO: 1468447 - RNA, 21 nt, Human
cacagccucuuagaugcaguu

SEQ ID NO: 1468448 - RNA, 15 nt, Human
caaugcuguauuuua

SEQ ID NO: 1468449 - RNA, 16 nt, Human
caaugcuguauuuuaa

SEQ ID NO: 1468450 - RNA, 17 nt, Human
caaugcuguauuuuaaa

SEQ ID NO: 1468451 - RNA, 14 nt, Human
caauuuaaauguua

SEQ ID NO: 1468452 - RNA, 13 nt, Human
caauuuaaauguu

SEQ ID NO: 1468453 - RNA, 11 nt, Human
caauuuaaaug

SEQ ID NO: 1468454 - RNA, 19 nt, Human
caauucuuuuaacuguugu

SEQ ID NO: 1468455 - RNA, 22 nt, Human
caauucuucccuaucuuugcca

SEQ ID NO: 1468456 - RNA, 21 nt, Human
caauucuucccuaucuuugcc

SEQ ID NO: 1468457 - RNA, 15 nt, Human
caauucuugccaaau

SEQ ID NO: 1468458 - RNA, 14 nt, Human
caauuuaugaauug

SEQ ID NO: 1468459 - RNA, 22 nt, Human
caauaaagcugcugagaaucua

SEQ ID NO: 1468460 - RNA, 23 nt, Human
caauaaagcugcugagaaucuag

SEQ ID NO: 1468461 - RNA, 17 nt, Human
caauaaagcugcugaga

SEQ ID NO: 1468462 - RNA, 15 nt, Human
caauaaagcugcuga

SEQ ID NO: 1468463 - RNA, 15 nt, Human
caagcuauucaauuc

SEQ ID NO: 1468464 - RNA, 20 nt, Human
caaguauuuguuaauuuaga

SEQ ID NO: 1468465 - RNA, 22 nt, Human
caaguaugugggcagauuuuca

SEQ ID NO: 1468466 - RNA, 22 nt, Human
caaguauuuguuaauuuagaaa

SEQ ID NO: 1468467 - RNA, 12 nt, Human
caggguggcagc

SEQ ID NO: 1468468 - RNA, 15 nt, Human
cagggaggaggcaga

SEQ ID NO: 1468469 - RNA, 21 nt, Human
cagggaggaggcagagaagaa

SEQ ID NO: 1468470 - RNA, 23 nt, Human
caggacagcccuucuuuccacag

SEQ ID NO: 1468471 - RNA, 24 nt, Human
caggacagcccuucuuuccacaga

SEQ ID NO: 1468472 - RNA, 14 nt, Human
caggcacugcaaac

SEQ ID NO: 1468473 - RNA, 21 nt, Human
caggcacugcaaaccgccacc

SEQ ID NO: 1468474 - RNA, 17 nt, Human
caggaaaauugaaugca

SEQ ID NO: 1468475 - RNA, 13 nt, Human
caggaaaauugaa

SEQ ID NO: 1468476 - RNA, 21 nt, Human
cagcccccacugccuuugacc

SEQ ID NO: 1468477 - RNA, 24 nt, Human
cagccccgcguggaacucgugucu

SEQ ID NO: 1468478 - RNA, 18 nt, Human
cagccugcagacucacug

SEQ ID NO: 1468479 - RNA, 24 nt, Human
cagccucuccacucaugugacucu

SEQ ID NO: 1468480 - RNA, 20 nt, Human
cagauuugcuaauuuauccu

SEQ ID NO: 1468481 - RNA, 16 nt, Human
cagaucauugugaaau

SEQ ID NO: 1468482 - RNA, 22 nt, Human
cagaucauugugaaauuauuca

SEQ ID NO: 1468483 - RNA, 23 nt, Human
cagagcuggagaugaggccagac

SEQ ID NO: 1468484 - RNA, 22 nt, Human
cagagcuggagaugaggccaga

SEQ ID NO: 1468485 - RNA, 21 nt, Human
cagagcuggagaugaggccag

SEQ ID NO: 1468486 - RNA, 17 nt, Human
cagagcuggagaugagg

SEQ ID NO: 1468487 - RNA, 20 nt, Human
cagagaggccuuuuggaaug

SEQ ID NO: 1468488 - RNA, 13 nt, Human
cagagcgcacagg

SEQ ID NO: 1468489 - RNA, 15 nt, Human
cagagcgcacaggga

SEQ ID NO: 1468490 - RNA, 11 nt, Human
caucagcaaac

SEQ ID NO: 1468491 - RNA, 14 nt, Human
cauccuugagucaa

SEQ ID NO: 1468492 - RNA, 14 nt, Human
caugaccaguaaag

SEQ ID NO: 1468493 - RNA, 18 nt, Human
caugaccuaguuuuccau

SEQ ID NO: 1468494 - RNA, 16 nt, Human
caugauucaugccaau

SEQ ID NO: 1468495 - RNA, 21 nt, Human
caugauucaugccaauuagca

SEQ ID NO: 1468496 - RNA, 13 nt, Human
caugauucauuuu

SEQ ID NO: 1468497 - RNA, 14 nt, Human
caugauucauuuua

SEQ ID NO: 1468498 - RNA, 16 nt, Human
caugaauuaguuuuau

SEQ ID NO: 1468499 - RNA, 14 nt, Human
caugaauuugugaa

SEQ ID NO: 1468500 - RNA, 16 nt, Human
caugaauuugugaagg

SEQ ID NO: 1468501 - RNA, 21 nt, Human
caugauugguuucuaggcagu

SEQ ID NO: 1468502 - RNA, 18 nt, Human
caugauucauuuuaacau

SEQ ID NO: 1468503 - RNA, 14 nt, Human
caugauuccagcca

SEQ ID NO: 1468504 - RNA, 17 nt, Human
caugauuccagccauca

SEQ ID NO: 1468505 - RNA, 16 nt, Human
caugauuccagccauc

SEQ ID NO: 1468506 - RNA, 15 nt, Human
caugauuccagccau

SEQ ID NO: 1468507 - RNA, 14 nt, Human
caugcugcugggga

SEQ ID NO: 1468508 - RNA, 13 nt, Human
cauaaucuucugc

SEQ ID NO: 1468509 - RNA, 15 nt, Human
cauaaucuucugccu

SEQ ID NO: 1468510 - RNA, 21 nt, Human
cauaaucuucugccuucucau

SEQ ID NO: 1468511 - RNA, 22 nt, Human
cauaaucuucugccuucucaug

SEQ ID NO: 1468512 - RNA, 19 nt, Human
caguuuauauuuaacucuc

SEQ ID NO: 1468513 - RNA, 14 nt, Human
caguuuauauuuaa

SEQ ID NO: 1468514 - RNA, 17 nt, Human
caguuuauauuuaacuc

SEQ ID NO: 1468515 - RNA, 13 nt, Human
cauuuuuguauuu

SEQ ID NO: 1468516 - RNA, 20 nt, Human
cauuuuuguauuuuguuuaa

SEQ ID NO: 1468517 - RNA, 14 nt, Human
ccaaaacaauguuu

SEQ ID NO: 1468518 - RNA, 19 nt, Human
ccaaaaauguguaagaaca

SEQ ID NO: 1468519 - RNA, 12 nt, Human
ccaaaaauagcu

SEQ ID NO: 1468520 - RNA, 13 nt, Human
ccaaaaauagcua

SEQ ID NO: 1468521 - RNA, 12 nt, Human
cauuuccaagca

SEQ ID NO: 1468522 - RNA, 14 nt, Human
cauuucauuuccua

SEQ ID NO: 1468523 - RNA, 14 nt, Human
cauuuauuuugaca

SEQ ID NO: 1468524 - RNA, 22 nt, Human
cauggcuggagcuagaauuuga

SEQ ID NO: 1468525 - RNA, 14 nt, Human
cauggcuaacuggc

SEQ ID NO: 1468526 - RNA, 16 nt, Human
cauggcuaacuggcga

SEQ ID NO: 1468527 - RNA, 14 nt, Human
cauguuauuuguaa

SEQ ID NO: 1468528 - RNA, 23 nt, Human
cauguuauuuguaauagauguuu

SEQ ID NO: 1468529 - RNA, 19 nt, Human
cauuaggaaaaguugcuau

SEQ ID NO: 1468530 - RNA, 18 nt, Human
ccaaagugcugggauuaa

SEQ ID NO: 1468531 - RNA, 20 nt, Human
ccaaauccuuagaucuggca

SEQ ID NO: 1468532 - RNA, 21 nt, Human
ccaaauccuuagaucuggcau

SEQ ID NO: 1468533 - RNA, 12 nt, Human
ccaaauuaagag

SEQ ID NO: 1468534 - RNA, 17 nt, Human
ccaacuuggcugcagga

SEQ ID NO: 1468535 - RNA, 19 nt, Human
ccaacuaaugccuuacucu

SEQ ID NO: 1468536 - RNA, 20 nt, Human
ccaacuaaugccuuacucuu

SEQ ID NO: 1468537 - RNA, 14 nt, Human
ccaagcuguuuucu

SEQ ID NO: 1468538 - RNA, 17 nt, Human
ccaagcuguuuucuucu

SEQ ID NO: 1468539 - RNA, 18 nt, Human
ccaagcuguuuucuucua

SEQ ID NO: 1468540 - RNA, 22 nt, Human
augucuauaaaccgaacugaug

SEQ ID NO: 1468541 - RNA, 14 nt, Human
augucuauucagcu

SEQ ID NO: 1468542 - RNA, 15 nt, Human
augucuauucagcuu

SEQ ID NO: 1468543 - RNA, 16 nt, Human
augucuauucagcuuc

SEQ ID NO: 1468544 - RNA, 21 nt, Human
auguaguuuuuauauguugua

SEQ ID NO: 1468545 - RNA, 20 nt, Human
auguaguuuuuauauguugu

SEQ ID NO: 1468546 - RNA, 11 nt, Human
auguaucacua

SEQ ID NO: 1468547 - RNA, 16 nt, Human
auguaucauagaaaug

SEQ ID NO: 1468548 - RNA, 17 nt, Human
auguaucauagaaaugu

SEQ ID NO: 1468549 - RNA, 11 nt, Human
uuugcucaugg

SEQ ID NO: 1468550 - RNA, 12 nt, Human
uuugcucaugga

SEQ ID NO: 1468551 - RNA, 21 nt, Human
uuugcccugcugcccuccccc

SEQ ID NO: 1468552 - RNA, 17 nt, Human
uuugcccugcugcccuc

SEQ ID NO: 1468553 - RNA, 23 nt, Human
uuugcccugcugcccucccccuc

SEQ ID NO: 1468554 - RNA, 16 nt, Human
uuugcuaucugggcug

SEQ ID NO: 1468555 - RNA, 13 nt, Human
uuugcuaguuuuu

SEQ ID NO: 1468556 - RNA, 12 nt, Human
uuugcacagcuc

SEQ ID NO: 1468557 - RNA, 16 nt, Human
uuugcacagcucuccg

SEQ ID NO: 1468558 - RNA, 18 nt, Human
uuugcccagaaagaagau

SEQ ID NO: 1468559 - RNA, 13 nt, Human
uuugcucauggaa

SEQ ID NO: 1468560 - RNA, 18 nt, Human
uuugcucagcuucuccaa

SEQ ID NO: 1468561 - RNA, 23 nt, Human
uuuggccaaugcaccuaaagaaa

SEQ ID NO: 1468562 - RNA, 16 nt, Human
uuuggcuaguccuugu

SEQ ID NO: 1468563 - RNA, 13 nt, Human
uuuggcuuucagg

SEQ ID NO: 1468564 - RNA, 14 nt, Human
uuugggagagacuu

SEQ ID NO: 1468565 - RNA, 23 nt, Human
uuugggagagacuuguuuuggau

SEQ ID NO: 1468566 - RNA, 17 nt, Human
uuuguagaagucacauu

SEQ ID NO: 1468567 - RNA, 23 nt, Human
uuugucucugcaaacugccuucu

SEQ ID NO: 1468568 - RNA, 14 nt, Human
uuuguacugaaaaa

SEQ ID NO: 1468569 - RNA, 15 nt, Human
uuuguacugaaaaau

SEQ ID NO: 1468570 - RNA, 14 nt, Human
augucuguggauuu

SEQ ID NO: 1468571 - RNA, 14 nt, Human
augucuguucuaca

SEQ ID NO: 1468572 - RNA, 16 nt, Human
augucuguucuacaua

SEQ ID NO: 1468573 - RNA, 16 nt, Human
uuuuaaguaaggaauu

SEQ ID NO: 1468574 - RNA, 15 nt, Human
uuuuaaguauuuagg

SEQ ID NO: 1468575 - RNA, 14 nt, Human
uuuuaaaagaauga

SEQ ID NO: 1468576 - RNA, 15 nt, Human
uuuuaaaagaaugau

SEQ ID NO: 1468577 - RNA, 14 nt, Human
uuuuaacauuccuc

SEQ ID NO: 1468578 - RNA, 13 nt, Human
uuuuaacauuccu

SEQ ID NO: 1468579 - RNA, 22 nt, Human
uuuuaaaaauuaaaucaaccuu

SEQ ID NO: 1468580 - RNA, 17 nt, Human
uuuuaaaaaauggucac

SEQ ID NO: 1468581 - RNA, 16 nt, Human
uuuuaaaaaaugguca

SEQ ID NO: 1468582 - RNA, 14 nt, Human
uuuuaaaaaagcuu

SEQ ID NO: 1468583 - RNA, 15 nt, Human
uuuuaaaaaagcuua

SEQ ID NO: 1468584 - RNA, 17 nt, Human
uuuuaaaaaagcuuaaa

SEQ ID NO: 1468585 - RNA, 20 nt, Human
uuuuaaaaaagcuuaaaacu

SEQ ID NO: 1468586 - RNA, 21 nt, Human
uuuuaaaaaagcuuaaaacuu

SEQ ID NO: 1468587 - RNA, 22 nt, Human
uuuuaaaaaagcuuaaaacuuu

SEQ ID NO: 1468588 - RNA, 23 nt, Human
uuuuaaaaaagcuuaaaacuuug

SEQ ID NO: 1468589 - RNA, 13 nt, Human
uuuuaaaaaagaa

SEQ ID NO: 1468590 - RNA, 14 nt, Human
auguuuaguaaacu

SEQ ID NO: 1468591 - RNA, 18 nt, Human
auguuucaaacauauaua

SEQ ID NO: 1468592 - RNA, 21 nt, Human
auguuucaaacauauauaaca

SEQ ID NO: 1468593 - RNA, 14 nt, Human
auguuguaauauuu

SEQ ID NO: 1468594 - RNA, 17 nt, Human
auguuguaauauuucuu

SEQ ID NO: 1468595 - RNA, 19 nt, Human
auguuguaauauuucuuca

SEQ ID NO: 1468596 - RNA, 16 nt, Human
auguuuugacauuuuu

SEQ ID NO: 1468597 - RNA, 14 nt, Human
auguuuugacauuu

SEQ ID NO: 1468598 - RNA, 13 nt, Human
auuaaaaacugag

SEQ ID NO: 1468599 - RNA, 14 nt, Human
auuaaaaacugagu

SEQ ID NO: 1468600 - RNA, 20 nt, Human
auuaaaaacugagugacucu

SEQ ID NO: 1468601 - RNA, 19 nt, Human
auuaaaaagguuuacagaa

SEQ ID NO: 1468602 - RNA, 18 nt, Human
auuaaaaagguuuacaga

SEQ ID NO: 1468603 - RNA, 22 nt, Human
auuaacuggguaaugaaacaaa

SEQ ID NO: 1468604 - RNA, 19 nt, Human
auuaacuggguaaugaaac

SEQ ID NO: 1468605 - RNA, 12 nt, Human
auuaacucauua

SEQ ID NO: 1468606 - RNA, 17 nt, Human
auuaacucauuagacug

SEQ ID NO: 1468607 - RNA, 18 nt, Human
auuaacuggguaaugaaa

SEQ ID NO: 1468608 - RNA, 15 nt, Human
auuaagaaaaucuau

SEQ ID NO: 1468609 - RNA, 21 nt, Human
uuuuauucagcucauggacuu

SEQ ID NO: 1468610 - RNA, 11 nt, Human
uuuucagaugu

SEQ ID NO: 1468611 - RNA, 18 nt, Human
uuuucagaugugaaccau

SEQ ID NO: 1468612 - RNA, 17 nt, Human
uuuucagaugugaacca

SEQ ID NO: 1468613 - RNA, 18 nt, Human
uuuucagcaaacucuuuu

SEQ ID NO: 1468614 - RNA, 19 nt, Human
uuuucagcaaacucuuuuc

SEQ ID NO: 1468615 - RNA, 14 nt, Human
uuuuauuaugcauu

SEQ ID NO: 1468616 - RNA, 22 nt, Human
uuuuauguugcauagaauaaaa

SEQ ID NO: 1468617 - RNA, 19 nt, Human
uuuuaugugaaacauguuu

SEQ ID NO: 1468618 - RNA, 18 nt, Human
uuuuaugugaaacauguu

SEQ ID NO: 1468619 - RNA, 22 nt, Human
uuuuauggcacuaguauuucua

SEQ ID NO: 1468620 - RNA, 19 nt, Human
uuuuauggcacuaguauuu

SEQ ID NO: 1468621 - RNA, 14 nt, Human
uuuuauaauuuugu

SEQ ID NO: 1468622 - RNA, 15 nt, Human
auguugcauagaaua

SEQ ID NO: 1468623 - RNA, 18 nt, Human
auguugauuacagugcag

SEQ ID NO: 1468624 - RNA, 20 nt, Human
uuuuaguuuaaaaaccuugu

SEQ ID NO: 1468625 - RNA, 23 nt, Human
uuuuagcaaagauaucucaucuc

SEQ ID NO: 1468626 - RNA, 16 nt, Human
uuuuagccuucucugu

SEQ ID NO: 1468627 - RNA, 23 nt, Human
uuuuagccuucucuguucauuuc

SEQ ID NO: 1468628 - RNA, 15 nt, Human
auguugacaugggac

SEQ ID NO: 1468629 - RNA, 19 nt, Human
auuagagggaggagaauga

SEQ ID NO: 1468630 - RNA, 14 nt, Human
auuacuuuugcugu

SEQ ID NO: 1468631 - RNA, 21 nt, Human
auuagaagacaauugacaaca

SEQ ID NO: 1468632 - RNA, 16 nt, Human
auuauauuuacaaaug

SEQ ID NO: 1468633 - RNA, 17 nt, Human
auuauaggaucauuugu

SEQ ID NO: 1468634 - RNA, 22 nt, Human
auuaucuauagcuaaguacaca

SEQ ID NO: 1468635 - RNA, 19 nt, Human
auuaucuauagcuaaguac

SEQ ID NO: 1468636 - RNA, 12 nt, Human
auuaucuuaaaa

SEQ ID NO: 1468637 - RNA, 23 nt, Human
auuauuaacauaccuaagaagua

SEQ ID NO: 1468638 - RNA, 17 nt, Human
auuauauuuacaaaugg

SEQ ID NO: 1468639 - RNA, 19 nt, Human
auuaucaauuaccacacca

SEQ ID NO: 1468640 - RNA, 18 nt, Human
auuauuuuauguugcaua

SEQ ID NO: 1468641 - RNA, 16 nt, Human
auuauuuuauguugca

SEQ ID NO: 1468642 - RNA, 16 nt, Human
auuauuaauuuaugca

SEQ ID NO: 1468643 - RNA, 16 nt, Human
auuauuccucaaaaaa

SEQ ID NO: 1468644 - RNA, 13 nt, Human
auuaaguaaugau

SEQ ID NO: 1468645 - RNA, 15 nt, Human
auuaaguaaugauaa

SEQ ID NO: 1468646 - RNA, 21 nt, Human
auuaaguaaugauaacuggaa

SEQ ID NO: 1468647 - RNA, 17 nt, Human
auuaauauauauuaucu

SEQ ID NO: 1468648 - RNA, 16 nt, Human
auuaaucugccucccu

SEQ ID NO: 1468649 - RNA, 23 nt, Human
uuuuuuaaaaaagaaacauuugg

SEQ ID NO: 1468650 - RNA, 13 nt, Human
uuuuuuaaaaaag

SEQ ID NO: 1468651 - RNA, 20 nt, Human
auuaagagagucuauuuacg

SEQ ID NO: 1468652 - RNA, 21 nt, Human
auuaagauaugggacauuuuu

SEQ ID NO: 1468653 - RNA, 13 nt, Human
auuacauuuguau

SEQ ID NO: 1468654 - RNA, 15 nt, Human
auuacauuuguauaa

SEQ ID NO: 1468655 - RNA, 16 nt, Human
auuacauuuguauaaa

SEQ ID NO: 1468656 - RNA, 16 nt, Human
auuaccaaccuguuac

SEQ ID NO: 1468657 - RNA, 14 nt, Human
auuaccaaccuguu

SEQ ID NO: 1468658 - RNA, 19 nt, Human
auuaccuucuauuggucuc

SEQ ID NO: 1468659 - RNA, 15 nt, Human
auuacucugaaauug

SEQ ID NO: 1468660 - RNA, 14 nt, Human
auuacugcaugcac

SEQ ID NO: 1468661 - RNA, 17 nt, Human
auuacugcaugcacuuc

SEQ ID NO: 1468662 - RNA, 13 nt, Human
auuacugccauuc

SEQ ID NO: 1468663 - RNA, 20 nt, Human
auuacugccauucacuucau

SEQ ID NO: 1468664 - RNA, 21 nt, Human
auuccauucuggaagugacuu

SEQ ID NO: 1468665 - RNA, 19 nt, Human
auucccuucaucuggaacc

SEQ ID NO: 1468666 - RNA, 16 nt, Human
auucccuucaucugga

SEQ ID NO: 1468667 - RNA, 14 nt, Human
auucagcucaugga

SEQ ID NO: 1468668 - RNA, 22 nt, Human
auugaccuauuuccagaaauac

SEQ ID NO: 1468669 - RNA, 15 nt, Human
auugccucacuucag

SEQ ID NO: 1468670 - RNA, 14 nt, Human
auugccucugagag

SEQ ID NO: 1468671 - RNA, 19 nt, Human
auucucacagcuccaagaa

SEQ ID NO: 1468672 - RNA, 21 nt, Human
auucucacagcuccaagaauu

SEQ ID NO: 1468673 - RNA, 22 nt, Human
auucucacagcuccaagaauuu

SEQ ID NO: 1468674 - RNA, 16 nt, Human
auuuaaccucuaaauu

SEQ ID NO: 1468675 - RNA, 18 nt, Human
auuuaaccucuaaauucu

SEQ ID NO: 1468676 - RNA, 13 nt, Human
auuuaacucucuu

SEQ ID NO: 1468677 - RNA, 13 nt, Human
auuuaacugacua

SEQ ID NO: 1468678 - RNA, 16 nt, Human
auuuacaaaugggaaa

SEQ ID NO: 1468679 - RNA, 14 nt, Human
auuuaaaguuguuu

SEQ ID NO: 1468680 - RNA, 13 nt, Human
auuuaaaacauua

SEQ ID NO: 1468681 - RNA, 18 nt, Human
auugugccaugucaaaca

SEQ ID NO: 1468682 - RNA, 21 nt, Human
auugugccaugucaaacaaau

SEQ ID NO: 1468683 - RNA, 22 nt, Human
auugugccaugucaaacaaaua

SEQ ID NO: 1468684 - RNA, 15 nt, Human
auuuaaaacagacac

SEQ ID NO: 1468685 - RNA, 16 nt, Human
auuuaaaacagacacu

SEQ ID NO: 1468686 - RNA, 17 nt, Human
auuuaaaacagacacug

SEQ ID NO: 1468687 - RNA, 18 nt, Human
auuuaaaacagacacugg

SEQ ID NO: 1468688 - RNA, 23 nt, Human
auuuaaaacagacacuggcaugg

SEQ ID NO: 1468689 - RNA, 15 nt, Human
auuguauuacaaauc

SEQ ID NO: 1468690 - RNA, 14 nt, Human
auuguauuacaaau

SEQ ID NO: 1468691 - RNA, 15 nt, Human
auugugaaauuauuc

SEQ ID NO: 1468692 - RNA, 16 nt, Human
auugucuuaauauugu

SEQ ID NO: 1468693 - RNA, 15 nt, Human
auugucugugaagug

SEQ ID NO: 1468694 - RNA, 20 nt, Human
auuguauauuacaaugauca

SEQ ID NO: 1468695 - RNA, 19 nt, Human
auuguauauuacaaugauc

SEQ ID NO: 1468696 - RNA, 18 nt, Human
auuguauauuacaaugau

SEQ ID NO: 1468697 - RNA, 17 nt, Human
auuguauauuacaauga

SEQ ID NO: 1468698 - RNA, 15 nt, Human
auuguauauuacaau

SEQ ID NO: 1468699 - RNA, 13 nt, Human
auugccucugaga

SEQ ID NO: 1468700 - RNA, 23 nt, Human
auuuccugggagcuuuuguagaa

SEQ ID NO: 1468701 - RNA, 22 nt, Human
auuuccugggagcuuuuguaga

SEQ ID NO: 1468702 - RNA, 23 nt, Human
auuuaggaaguugacuuauagua

SEQ ID NO: 1468703 - RNA, 16 nt, Human
auuuaggaaguugacu

SEQ ID NO: 1468704 - RNA, 14 nt, Human
auuuagguuucuga

SEQ ID NO: 1468705 - RNA, 17 nt, Human
auuuagguuucugaguu

SEQ ID NO: 1468706 - RNA, 21 nt, Human
auuuagguuucugaguuccug

SEQ ID NO: 1468707 - RNA, 22 nt, Human
auuuauuacuguaagaaaauau

SEQ ID NO: 1468708 - RNA, 23 nt, Human
auuuagguuucugaguuccugca

SEQ ID NO: 1468709 - RNA, 23 nt, Human
auuuagguuuuuguuuguuuccu

SEQ ID NO: 1468710 - RNA, 22 nt, Human
auuugaggacaaccauuccaga

SEQ ID NO: 1468711 - RNA, 18 nt, Human
auuuguaguguuggagaa

SEQ ID NO: 1468712 - RNA, 19 nt, Human
auuuguacuauuuaacuga

SEQ ID NO: 1468713 - RNA, 20 nt, Human
auuuguacuauuuaacugac

SEQ ID NO: 1468714 - RNA, 22 nt, Human
auuuguacuauuuaacugacua

SEQ ID NO: 1468715 - RNA, 23 nt, Human
auuuguacugaaaaaugguaauu

SEQ ID NO: 1468716 - RNA, 21 nt, Human
auuugguuuucacauuggaaa

SEQ ID NO: 1468717 - RNA, 22 nt, Human
auuugguuuucacauuggaaac

SEQ ID NO: 1468718 - RNA, 15 nt, Human
auuugguuuucacau

SEQ ID NO: 1468719 - RNA, 17 nt, Human
auuugguuuucacauug

SEQ ID NO: 1468720 - RNA, 23 nt, Human
auuugguaaggggaauugaggac

SEQ ID NO: 1468721 - RNA, 14 nt, Human
auuuggguccagga

SEQ ID NO: 1468722 - RNA, 15 nt, Human
auuuggguccaggag

SEQ ID NO: 1468723 - RNA, 16 nt, Human
auuuggguccaggagg

SEQ ID NO: 1468724 - RNA, 17 nt, Human
auuuggguccaggagga

SEQ ID NO: 1468725 - RNA, 19 nt, Human
auuuguaguguuggagaag

SEQ ID NO: 1468726 - RNA, 14 nt, Human
auuuuaauaauguu

SEQ ID NO: 1468727 - RNA, 15 nt, Human
auuuuaauaauguuu

SEQ ID NO: 1468728 - RNA, 16 nt, Human
auuuuaauaauguuuc

SEQ ID NO: 1468729 - RNA, 22 nt, Human
auuuuacuguacagacagaaaa

SEQ ID NO: 1468730 - RNA, 20 nt, Human
auuuuacuguacagacagaa

SEQ ID NO: 1468731 - RNA, 13 nt, Human
auuuuacauaaau

SEQ ID NO: 1468732 - RNA, 12 nt, Human
auuuuacaauuu

SEQ ID NO: 1468733 - RNA, 21 nt, Human
auuuuauguugcauagaauaa

SEQ ID NO: 1468734 - RNA, 18 nt, Human
auuuuauguugcauagaa

SEQ ID NO: 1468735 - RNA, 13 nt, Human
aucuguaaacugu

SEQ ID NO: 1468736 - RNA, 14 nt, Human
aucuguaaacugug

SEQ ID NO: 1468737 - RNA, 17 nt, Human
aucuguaaacuguguau

SEQ ID NO: 1468738 - RNA, 22 nt, Human
aucuguaaacuguguauuccaa

SEQ ID NO: 1468739 - RNA, 16 nt, Human
aucuugacucacugca

SEQ ID NO: 1468740 - RNA, 16 nt, Human
aucuuacuauuucaca

SEQ ID NO: 1468741 - RNA, 12 nt, Human
aucugauagggu

SEQ ID NO: 1468742 - RNA, 22 nt, Human
aucugauaggguuugugacagg

SEQ ID NO: 1468743 - RNA, 17 nt, Human
aucugauugugauguga

SEQ ID NO: 1468744 - RNA, 20 nt, Human
aucugcagggggugugucug

SEQ ID NO: 1468745 - RNA, 16 nt, Human
uugcccugcugcccuc

SEQ ID NO: 1468746 - RNA, 18 nt, Human
uugcccugcugcccuccc

SEQ ID NO: 1468747 - RNA, 21 nt, Human
aucucauuuccaagcaaguau

SEQ ID NO: 1468748 - RNA, 20 nt, Human
aucucagugaagaauacuuc

SEQ ID NO: 1468749 - RNA, 14 nt, Human
aucucagugaagaa

SEQ ID NO: 1468750 - RNA, 15 nt, Human
aucucagugaagaau

SEQ ID NO: 1468751 - RNA, 17 nt, Human
aucucagugaagaauac

SEQ ID NO: 1468752 - RNA, 19 nt, Human
aucucaguugauuuucugg

SEQ ID NO: 1468753 - RNA, 21 nt, Human
aucucaguugauuuucuggau

SEQ ID NO: 1468754 - RNA, 23 nt, Human
aucucauuuccaagcaaguauua

SEQ ID NO: 1468755 - RNA, 20 nt, Human
aucucaucucagugaagaau

SEQ ID NO: 1468756 - RNA, 19 nt, Human
aucucaucucagugaagaa

SEQ ID NO: 1468757 - RNA, 21 nt, Human
aucucauuuuuccguaaaaau

SEQ ID NO: 1468758 - RNA, 23 nt, Human
aucucauuuuuccguaaaaauga

SEQ ID NO: 1468759 - RNA, 16 nt, Human
aucuccccaucauugg

SEQ ID NO: 1468760 - RNA, 22 nt, Human
aucuccauugugccuaagucca

SEQ ID NO: 1468761 - RNA, 16 nt, Human
aucucaauucuucccu

SEQ ID NO: 1468762 - RNA, 14 nt, Human
aucucaauucuucc

SEQ ID NO: 1468763 - RNA, 13 nt, Human
aucucaauauuuc

SEQ ID NO: 1468764 - RNA, 16 nt, Human
auccuaucucuccaac

SEQ ID NO: 1468765 - RNA, 21 nt, Human
auccuaucucuccaaccagau

SEQ ID NO: 1468766 - RNA, 15 nt, Human
aucucagcucacuac

SEQ ID NO: 1468767 - RNA, 13 nt, Human
aucucagcucacu

SEQ ID NO: 1468768 - RNA, 11 nt, Human
aucucagcuca

SEQ ID NO: 1468769 - RNA, 14 nt, Human
aucucagcucacug

SEQ ID NO: 1468770 - RNA, 18 nt, Human
aucucaggccagagccaa

SEQ ID NO: 1468771 - RNA, 14 nt, Human
aucucaggccagag

SEQ ID NO: 1468772 - RNA, 17 nt, Human
aucucaggccagagcca

SEQ ID NO: 1468773 - RNA, 14 nt, Human
uugcaucugaaaau

SEQ ID NO: 1468774 - RNA, 15 nt, Human
uugcauguggaucaa

SEQ ID NO: 1468775 - RNA, 16 nt, Human
uugcacagcuaugaag

SEQ ID NO: 1468776 - RNA, 21 nt, Human
aucucuucagucucuauacca

SEQ ID NO: 1468777 - RNA, 13 nt, Human
aucucuucagucu

SEQ ID NO: 1468778 - RNA, 12 nt, Human
aucucuucaguc

SEQ ID NO: 1468779 - RNA, 12 nt, Human
uugaugccuggc

SEQ ID NO: 1468780 - RNA, 15 nt, Human
uugaugggauuuggu

SEQ ID NO: 1468781 - RNA, 22 nt, Human
uugaugccaaaaaaaaauacau

SEQ ID NO: 1468782 - RNA, 14 nt, Human
uugaugccaaaaaa

SEQ ID NO: 1468783 - RNA, 18 nt, Human
uugauggugguauguuuu

SEQ ID NO: 1468784 - RNA, 17 nt, Human
uugaugggauucuggac

SEQ ID NO: 1468785 - RNA, 19 nt, Human
uugauggugguauguuuuc

SEQ ID NO: 1468786 - RNA, 13 nt, Human
uugauguaaaauc

SEQ ID NO: 1468787 - RNA, 15 nt, Human
uugauguaaaaucuu

SEQ ID NO: 1468788 - RNA, 16 nt, Human
uugauguaaaaucuug

SEQ ID NO: 1468789 - RNA, 18 nt, Human
uugauguaaaaucuuguc

SEQ ID NO: 1468790 - RNA, 21 nt, Human
uugauguaaaaucuugucaug

SEQ ID NO: 1468791 - RNA, 16 nt, Human
augaagauacugaaau

SEQ ID NO: 1468792 - RNA, 17 nt, Human
augaagauacugaaaua

SEQ ID NO: 1468793 - RNA, 22 nt, Human
augaagauauuuuuccauuuuu

SEQ ID NO: 1468794 - RNA, 17 nt, Human
augaaauauuauguuaa

SEQ ID NO: 1468795 - RNA, 18 nt, Human
augaaauauuauguuaaa

SEQ ID NO: 1468796 - RNA, 20 nt, Human
augaaauauuauguuaaaac

SEQ ID NO: 1468797 - RNA, 15 nt, Human
augaagauacugaaa

SEQ ID NO: 1468798 - RNA, 15 nt, Human
augaauuaaguuuuu

SEQ ID NO: 1468799 - RNA, 16 nt, Human
augaauuaaauaaacc

SEQ ID NO: 1468800 - RNA, 14 nt, Human
augaauuaaagugg

SEQ ID NO: 1468801 - RNA, 14 nt, Human
augaauuaaauaaa

SEQ ID NO: 1468802 - RNA, 23 nt, Human
uuggggggaguaaagaauuauuu

SEQ ID NO: 1468803 - RNA, 15 nt, Human
uuggagugcaguggc

SEQ ID NO: 1468804 - RNA, 20 nt, Human
uuggauauguaaaacauuua

SEQ ID NO: 1468805 - RNA, 13 nt, Human
uuggauccugugu

SEQ ID NO: 1468806 - RNA, 18 nt, Human
uuggauccuguguggaga

SEQ ID NO: 1468807 - RNA, 19 nt, Human
uuggauauguaaaacauuu

SEQ ID NO: 1468808 - RNA, 23 nt, Human
uuggcugagauaugaacauauug

SEQ ID NO: 1468809 - RNA, 13 nt, Human
aucuuuuuauuca

SEQ ID NO: 1468810 - RNA, 12 nt, Human
augaaagauuca

SEQ ID NO: 1468811 - RNA, 14 nt, Human
aucuuugccacccu

SEQ ID NO: 1468812 - RNA, 15 nt, Human
aucuuugccacccuc

SEQ ID NO: 1468813 - RNA, 16 nt, Human
aucuuugccacccuca

SEQ ID NO: 1468814 - RNA, 21 nt, Human
aucuuuaauuuuacauuuccu

SEQ ID NO: 1468815 - RNA, 16 nt, Human
aucuuuaauuuuacau

SEQ ID NO: 1468816 - RNA, 22 nt, Human
aucuuuaauuuuacauuuccua

SEQ ID NO: 1468817 - RNA, 15 nt, Human
uugguucuugagggg

SEQ ID NO: 1468818 - RNA, 23 nt, Human
uugguucuugaggggaccaggag

SEQ ID NO: 1468819 - RNA, 20 nt, Human
uugguugaaaauaaaaagau

SEQ ID NO: 1468820 - RNA, 22 nt, Human
uugguucuugaggggaccagga

SEQ ID NO: 1468821 - RNA, 23 nt, Human
uuguacaaaauaaacaaauaaca

SEQ ID NO: 1468822 - RNA, 23 nt, Human
uuguaguagcguuuuuuaaaugu

SEQ ID NO: 1468823 - RNA, 22 nt, Human
uuguaguagcguuuuuuaaaug

SEQ ID NO: 1468824 - RNA, 21 nt, Human
uuguaguagcguuuuuuaaau

SEQ ID NO: 1468825 - RNA, 16 nt, Human
uuguauaaaauaauuu

SEQ ID NO: 1468826 - RNA, 17 nt, Human
uuguauaaaauaauuuu

SEQ ID NO: 1468827 - RNA, 23 nt, Human
uuguaguguuggagaagaacuga

SEQ ID NO: 1468828 - RNA, 19 nt, Human
uuguauaaaauaauuuuua

SEQ ID NO: 1468829 - RNA, 20 nt, Human
uuguauaccuuguaauuuga

SEQ ID NO: 1468830 - RNA, 13 nt, Human
augagagacacac

SEQ ID NO: 1468831 - RNA, 14 nt, Human
augagagacacacu

SEQ ID NO: 1468832 - RNA, 17 nt, Human
augagagacacacugaa

SEQ ID NO: 1468833 - RNA, 19 nt, Human
augagagacacacugaaga

SEQ ID NO: 1468834 - RNA, 11 nt, Human
augagaaucua

SEQ ID NO: 1468835 - RNA, 23 nt, Human
augagaaaucuaaaaaacgaaaa

SEQ ID NO: 1468836 - RNA, 14 nt, Human
augagaaagccuuc

SEQ ID NO: 1468837 - RNA, 15 nt, Human
augagaaagccuucu

SEQ ID NO: 1468838 - RNA, 19 nt, Human
augagaaagccuucuuuug

SEQ ID NO: 1468839 - RNA, 15 nt, Human
augagaaauacaaaa

SEQ ID NO: 1468840 - RNA, 22 nt, Human
augagaaauacaaaaauacuca

SEQ ID NO: 1468841 - RNA, 14 nt, Human
augagaacucugag

SEQ ID NO: 1468842 - RNA, 18 nt, Human
augagaaaucuaaaaaac

SEQ ID NO: 1468843 - RNA, 15 nt, Human
augagaaaucuaaaa

SEQ ID NO: 1468844 - RNA, 21 nt, Human
uuuaguagcagugauugucuu

SEQ ID NO: 1468845 - RNA, 16 nt, Human
uuuaguaucuuuuuau

SEQ ID NO: 1468846 - RNA, 22 nt, Human
uuuaguagcagugauugucuua

SEQ ID NO: 1468847 - RNA, 23 nt, Human
uuuaguagauauuaccaguuuuc

SEQ ID NO: 1468848 - RNA, 21 nt, Human
uuuaguagauauuaccaguuu

SEQ ID NO: 1468849 - RNA, 22 nt, Human
uuuaggaaguugacuuauagua

SEQ ID NO: 1468850 - RNA, 18 nt, Human
uuuaggaagcaagcuuaa

SEQ ID NO: 1468851 - RNA, 22 nt, Human
uuuagcuggaaaaguauguuag

SEQ ID NO: 1468852 - RNA, 22 nt, Human
augcccccuaauccccuucucc

SEQ ID NO: 1468853 - RNA, 13 nt, Human
uuuauuaaaaacu

SEQ ID NO: 1468854 - RNA, 18 nt, Human
uuuauuaaaaacugagug

SEQ ID NO: 1468855 - RNA, 20 nt, Human
uuuauguuaagggaagaauu

SEQ ID NO: 1468856 - RNA, 20 nt, Human
uuuauguuacuacaugcacu

SEQ ID NO: 1468857 - RNA, 13 nt, Human
uuuauauaagcuu

SEQ ID NO: 1468858 - RNA, 23 nt, Human
augcugucuacacuaagagagaa

SEQ ID NO: 1468859 - RNA, 22 nt, Human
augcugucuacacuaagagaga

SEQ ID NO: 1468860 - RNA, 16 nt, Human
uuuauuacuguaagaa

SEQ ID NO: 1468861 - RNA, 19 nt, Human
augcucuccaaaccacuuu

SEQ ID NO: 1468862 - RNA, 17 nt, Human
auggaauacucuuauau

SEQ ID NO: 1468863 - RNA, 16 nt, Human
auggaauacucuuaua

SEQ ID NO: 1468864 - RNA, 24 nt, Human
uuucaugaccaguaaaggcugcug

SEQ ID NO: 1468865 - RNA, 17 nt, Human
uuucaugaccaguaaag

SEQ ID NO: 1468866 - RNA, 19 nt, Human
uuucaugauaaugaacaga

SEQ ID NO: 1468867 - RNA, 22 nt, Human
uuucaugauaaugaacagaaca

SEQ ID NO: 1468868 - RNA, 19 nt, Human
uuucaugcuaucucugugu

SEQ ID NO: 1468869 - RNA, 16 nt, Human
uuucaugauuuugaaa

SEQ ID NO: 1468870 - RNA, 16 nt, Human
uuucaugcuaucucug

SEQ ID NO: 1468871 - RNA, 23 nt, Human
uuuccccauuuagguuucugagu

SEQ ID NO: 1468872 - RNA, 13 nt, Human
auggcagaaaagu

SEQ ID NO: 1468873 - RNA, 18 nt, Human
auggcaaccauuauaacc

SEQ ID NO: 1468874 - RNA, 15 nt, Human
auggcaaccauuaua

SEQ ID NO: 1468875 - RNA, 16 nt, Human
auggcaaccauuauaa

SEQ ID NO: 1468876 - RNA, 15 nt, Human
auggcaauuuuguaa

SEQ ID NO: 1468877 - RNA, 16 nt, Human
auggcaauuuuguaac

SEQ ID NO: 1468878 - RNA, 19 nt, Human
auggcaugagaaauacaaa

SEQ ID NO: 1468879 - RNA, 18 nt, Human
auggcaugagaaauacaa

SEQ ID NO: 1468880 - RNA, 13 nt, Human
auggcgcaggaac

SEQ ID NO: 1468881 - RNA, 12 nt, Human
augauucccagc

SEQ ID NO: 1468882 - RNA, 21 nt, Human
augauucaaaugucuauaaac

SEQ ID NO: 1468883 - RNA, 13 nt, Human
augauucauuuua

SEQ ID NO: 1468884 - RNA, 13 nt, Human
augauuccagcca

SEQ ID NO: 1468885 - RNA, 15 nt, Human
uuguugucugcaacu

SEQ ID NO: 1468886 - RNA, 22 nt, Human
augauuaugaauuacauuugua

SEQ ID NO: 1468887 - RNA, 14 nt, Human
augauuucaguagc

SEQ ID NO: 1468888 - RNA, 20 nt, Human
augauuucaugcuaucucug

SEQ ID NO: 1468889 - RNA, 21 nt, Human
augauuucaugcuaucucugu

SEQ ID NO: 1468890 - RNA, 14 nt, Human
augcacaucccugg

SEQ ID NO: 1468891 - RNA, 18 nt, Human
augcaaaucaauuacugg

SEQ ID NO: 1468892 - RNA, 20 nt, Human
augagagacacacugaagaa

SEQ ID NO: 1468893 - RNA, 21 nt, Human
augagagacacacugaagaag

SEQ ID NO: 1468894 - RNA, 23 nt, Human
augagagacacacugaagaagca

SEQ ID NO: 1468895 - RNA, 17 nt, Human
uuguggggaugaugaaa

SEQ ID NO: 1468896 - RNA, 23 nt, Human
uugugugaaagguacuucaaauc

SEQ ID NO: 1468897 - RNA, 14 nt, Human
uuuaaauguuuuuu

SEQ ID NO: 1468898 - RNA, 15 nt, Human
uuuaaauguauacua

SEQ ID NO: 1468899 - RNA, 14 nt, Human
uuuaaauguauacu

SEQ ID NO: 1468900 - RNA, 12 nt, Human
uuuaauuuuaca

SEQ ID NO: 1468901 - RNA, 21 nt, Human
uuuaauguaauagggaaaauu

SEQ ID NO: 1468902 - RNA, 18 nt, Human
uuuaauguauaguaaauc

SEQ ID NO: 1468903 - RNA, 14 nt, Human
uuuaaugagauaau

SEQ ID NO: 1468904 - RNA, 15 nt, Human
uuuaaugaacaaaug

SEQ ID NO: 1468905 - RNA, 16 nt, Human
uuuaaugaacaaaugg

SEQ ID NO: 1468906 - RNA, 12 nt, Human
uuuaagccaaaa

SEQ ID NO: 1468907 - RNA, 20 nt, Human
uuuaagccaaaacaauguuu

SEQ ID NO: 1468908 - RNA, 18 nt, Human
uuuaagccaaaacaaugu

SEQ ID NO: 1468909 - RNA, 18 nt, Human
augcaguucugaagaaga

SEQ ID NO: 1468910 - RNA, 19 nt, Human
augcaguucugaagaagau

SEQ ID NO: 1468911 - RNA, 15 nt, Human
augcaguucugaaga

SEQ ID NO: 1468912 - RNA, 17 nt, Human
augcaguucugaagaag

SEQ ID NO: 1468913 - RNA, 17 nt, Human
augcagugccuuucuuc

SEQ ID NO: 1468914 - RNA, 15 nt, Human
uucuaguguagaauu

SEQ ID NO: 1468915 - RNA, 16 nt, Human
uucuagagcacugcca

SEQ ID NO: 1468916 - RNA, 14 nt, Human
uucuauaauuuaaa

SEQ ID NO: 1468917 - RNA, 13 nt, Human
uucuauaauuuaa

SEQ ID NO: 1468918 - RNA, 15 nt, Human
uucuaguucugccag

SEQ ID NO: 1468919 - RNA, 16 nt, Human
uucuaguucugccagg

SEQ ID NO: 1468920 - RNA, 19 nt, Human
aucagacuaugaaguuuuu

SEQ ID NO: 1468921 - RNA, 20 nt, Human
aucagaaacacccucacacu

SEQ ID NO: 1468922 - RNA, 16 nt, Human
aucagaaacacccuca

SEQ ID NO: 1468923 - RNA, 18 nt, Human
aucacuuucucaguuuuc

SEQ ID NO: 1468924 - RNA, 21 nt, Human
aucacuuucucaguuuucaua

SEQ ID NO: 1468925 - RNA, 20 nt, Human
aucacuuucucaguuuucau

SEQ ID NO: 1468926 - RNA, 16 nt, Human
uucucagauuucugag

SEQ ID NO: 1468927 - RNA, 20 nt, Human
uucucagauuucugaggaaa

SEQ ID NO: 1468928 - RNA, 15 nt, Human
uucucagauuucuga

SEQ ID NO: 1468929 - RNA, 15 nt, Human
uucuaaaguaaaaac

SEQ ID NO: 1468930 - RNA, 14 nt, Human
uucuaagaaacauu

SEQ ID NO: 1468931 - RNA, 16 nt, Human
uucuaagaaacauuua

SEQ ID NO: 1468932 - RNA, 23 nt, Human
uucuaagaaacauuuauauugau

SEQ ID NO: 1468933 - RNA, 20 nt, Human
uucuaagaaacauuuauauu

SEQ ID NO: 1468934 - RNA, 15 nt, Human
uucgaaugacacugu

SEQ ID NO: 1468935 - RNA, 15 nt, Human
auauuuuacauaaau

SEQ ID NO: 1468936 - RNA, 16 nt, Human
auauuuuacauaaauu

SEQ ID NO: 1468937 - RNA, 20 nt, Human
auauuuuacauaaauuuagu

SEQ ID NO: 1468938 - RNA, 23 nt, Human
uucccagagcaaaauaauuuuaa

SEQ ID NO: 1468939 - RNA, 20 nt, Human
uucccacggccuuucuagcc

SEQ ID NO: 1468940 - RNA, 15 nt, Human
uucccacuguuuaag

SEQ ID NO: 1468941 - RNA, 18 nt, Human
uucccagagcaaaauaau

SEQ ID NO: 1468942 - RNA, 16 nt, Human
uucccuaucuuugcca

SEQ ID NO: 1468943 - RNA, 12 nt, Human
auauuuucucua

SEQ ID NO: 1468944 - RNA, 19 nt, Human
auauuuucucuaggaaaua

SEQ ID NO: 1468945 - RNA, 13 nt, Human
auauuuucucuag

SEQ ID NO: 1468946 - RNA, 16 nt, Human
auauuuucucuaggaa

SEQ ID NO: 1468947 - RNA, 14 nt, Human
uuccuucagcacuu

SEQ ID NO: 1468948 - RNA, 20 nt, Human
aucaaaucuaccacuguaug

SEQ ID NO: 1468949 - RNA, 14 nt, Human
aucaaguuauuuuu

SEQ ID NO: 1468950 - RNA, 23 nt, Human
aucaagucuguuuacugcaaggu

SEQ ID NO: 1468951 - RNA, 15 nt, Human
aucaagucuguuuac

SEQ ID NO: 1468952 - RNA, 13 nt, Human
aucaagucuguuu

SEQ ID NO: 1468953 - RNA, 18 nt, Human
aucaaccccagacacugg

SEQ ID NO: 1468954 - RNA, 19 nt, Human
aucaaccccagacacuggu

SEQ ID NO: 1468955 - RNA, 21 nt, Human
uucucuaauauggcaaccauu

SEQ ID NO: 1468956 - RNA, 12 nt, Human
uucucuaauaug

SEQ ID NO: 1468957 - RNA, 15 nt, Human
uucucuuuuccuuug

SEQ ID NO: 1468958 - RNA, 21 nt, Human
uucuccugaggauguguccca

SEQ ID NO: 1468959 - RNA, 13 nt, Human
uucuccucccagg

SEQ ID NO: 1468960 - RNA, 13 nt, Human
auccaaaagcuuu

SEQ ID NO: 1468961 - RNA, 17 nt, Human
aucccaaguagaaucuc

SEQ ID NO: 1468962 - RNA, 20 nt, Human
aucccaaguagaaucucagu

SEQ ID NO: 1468963 - RNA, 14 nt, Human
auccauacauuugu

SEQ ID NO: 1468964 - RNA, 14 nt, Human
aucauuuuuuacuu

SEQ ID NO: 1468965 - RNA, 12 nt, Human
uugaaccaauaa

SEQ ID NO: 1468966 - RNA, 19 nt, Human
uugaaauauugacuuuuua

SEQ ID NO: 1468967 - RNA, 18 nt, Human
uugaaauauccugcuuga

SEQ ID NO: 1468968 - RNA, 16 nt, Human
uucuuaaacacuugca

SEQ ID NO: 1468969 - RNA, 17 nt, Human
uucuuaaacacuugcaa

SEQ ID NO: 1468970 - RNA, 17 nt, Human
uucuuaaagucaagauu

SEQ ID NO: 1468971 - RNA, 12 nt, Human
uucuuuguguag

SEQ ID NO: 1468972 - RNA, 19 nt, Human
uucuuuguguagcuuugcu

SEQ ID NO: 1468973 - RNA, 17 nt, Human
uucuuuguuucuuucuu

SEQ ID NO: 1468974 - RNA, 14 nt, Human
uucuugauguaaaa

SEQ ID NO: 1468975 - RNA, 15 nt, Human
uucuugauguaaaau

SEQ ID NO: 1468976 - RNA, 20 nt, Human
uucuugauguaaaaucuugu

SEQ ID NO: 1468977 - RNA, 19 nt, Human
uucuugauguaaaaucuug

SEQ ID NO: 1468978 - RNA, 20 nt, Human
uucuugaggggaccaggagu

SEQ ID NO: 1468979 - RNA, 19 nt, Human
uucuugaggggaccaggag

SEQ ID NO: 1468980 - RNA, 17 nt, Human
uucuuggccaugggagg

SEQ ID NO: 1468981 - RNA, 22 nt, Human
auagcuuuucccuuuuuuuaag

SEQ ID NO: 1468982 - RNA, 15 nt, Human
auagcuuuuuucucu

SEQ ID NO: 1468983 - RNA, 16 nt, Human
uucacauuagaagaca

SEQ ID NO: 1468984 - RNA, 15 nt, Human
uucacauuagaagac

SEQ ID NO: 1468985 - RNA, 17 nt, Human
auaggcguaacuaauuu

SEQ ID NO: 1468986 - RNA, 19 nt, Human
uucacagccuauaaccaga

SEQ ID NO: 1468987 - RNA, 21 nt, Human
uucacaucgcagauucucccu

SEQ ID NO: 1468988 - RNA, 13 nt, Human
uucacaucucauu

SEQ ID NO: 1468989 - RNA, 12 nt, Human
uucaaaagaaag

SEQ ID NO: 1468990 - RNA, 18 nt, Human
uucaaaacauugugccau

SEQ ID NO: 1468991 - RNA, 17 nt, Human
uuauuuuuuucugaauu

SEQ ID NO: 1468992 - RNA, 13 nt, Human
uuauuuuuuucug

SEQ ID NO: 1468993 - RNA, 23 nt, Human
uuauuuuugacaguguugaaaau

SEQ ID NO: 1468994 - RNA, 18 nt, Human
uuauuuuuacauucugaa

SEQ ID NO: 1468995 - RNA, 14 nt, Human
uucaaacauauaua

SEQ ID NO: 1468996 - RNA, 23 nt, Human
uucaagaauaaucacgcuuuccu

SEQ ID NO: 1468997 - RNA, 13 nt, Human
uucaaaagaaagu

SEQ ID NO: 1468998 - RNA, 21 nt, Human
uucaaaauuguuacaaauugu

SEQ ID NO: 1468999 - RNA, 16 nt, Human
uucaagcaauccuccc

SEQ ID NO: 1469000 - RNA, 14 nt, Human
uucaagcaauccuc

SEQ ID NO: 1469001 - RNA, 18 nt, Human
uucaagcgauucuccugc

SEQ ID NO: 1469002 - RNA, 17 nt, Human
uucaaggucugcuuuuc

SEQ ID NO: 1469003 - RNA, 21 nt, Human
uucaagcgauucuccugccuc

SEQ ID NO: 1469004 - RNA, 21 nt, Human
auauauauuuuuuucugaaau

SEQ ID NO: 1469005 - RNA, 20 nt, Human
auauauauuaucuuuucaua

SEQ ID NO: 1469006 - RNA, 15 nt, Human
auauauauguacagu

SEQ ID NO: 1469007 - RNA, 16 nt, Human
auauauauguacaguu

SEQ ID NO: 1469008 - RNA, 20 nt, Human
auauauauguacaguuaucu

SEQ ID NO: 1469009 - RNA, 16 nt, Human
auauauauuaucuuuu

SEQ ID NO: 1469010 - RNA, 16 nt, Human
auauauauauauaugu

SEQ ID NO: 1469011 - RNA, 14 nt, Human
auauauauauaugu

SEQ ID NO: 1469012 - RNA, 15 nt, Human
auauauauauguaca

SEQ ID NO: 1469013 - RNA, 13 nt, Human
auauaugaggacu

SEQ ID NO: 1469014 - RNA, 14 nt, Human
auauauaacaaugc

SEQ ID NO: 1469015 - RNA, 13 nt, Human
auauaacuaacaa

SEQ ID NO: 1469016 - RNA, 24 nt, Human
auauaaaguaucaucaguguagaa

SEQ ID NO: 1469017 - RNA, 21 nt, Human
auagucucuuuaaaaggaaag

SEQ ID NO: 1469018 - RNA, 14 nt, Human
auagucucuuuaaa

SEQ ID NO: 1469019 - RNA, 13 nt, Human
auaguuguaacua

SEQ ID NO: 1469020 - RNA, 14 nt, Human
uucauuccuccagg

SEQ ID NO: 1469021 - RNA, 13 nt, Human
uucauuccuccag

SEQ ID NO: 1469022 - RNA, 12 nt, Human
uucauuccucca

SEQ ID NO: 1469023 - RNA, 22 nt, Human
uucauucaugucauguguacaa

SEQ ID NO: 1469024 - RNA, 16 nt, Human
uucauuccauucugga

SEQ ID NO: 1469025 - RNA, 14 nt, Human
uucauugucuguga

SEQ ID NO: 1469026 - RNA, 23 nt, Human
uuccacccagugcugaauuuccc

SEQ ID NO: 1469027 - RNA, 16 nt, Human
uuccaaguugcuaaua

SEQ ID NO: 1469028 - RNA, 18 nt, Human
uucccaacuccagaaagu

SEQ ID NO: 1469029 - RNA, 13 nt, Human
uucccaauugcuu

SEQ ID NO: 1469030 - RNA, 21 nt, Human
uucccacccaauucaaaacau

SEQ ID NO: 1469031 - RNA, 23 nt, Human
uucccaaaggcauuauaaaaaga

SEQ ID NO: 1469032 - RNA, 15 nt, Human
auauauuuuaagacg

SEQ ID NO: 1469033 - RNA, 14 nt, Human
auauauuuuaagac

SEQ ID NO: 1469034 - RNA, 19 nt, Human
auaucuccgucaacucaua

SEQ ID NO: 1469035 - RNA, 20 nt, Human
auaucuccgucaacucauau

SEQ ID NO: 1469036 - RNA, 21 nt, Human
auaucuccgucaacucauauu

SEQ ID NO: 1469037 - RNA, 12 nt, Human
auaucucaucuc

SEQ ID NO: 1469038 - RNA, 13 nt, Human
auaucuccugaaa

SEQ ID NO: 1469039 - RNA, 15 nt, Human
auaucuccugaaaag

SEQ ID NO: 1469040 - RNA, 22 nt, Human
auaucuccugaaaagguuuaug

SEQ ID NO: 1469041 - RNA, 23 nt, Human
auaucuccugaaaagguuuauga

SEQ ID NO: 1469042 - RNA, 21 nt, Human
auaugauguuaaaaaaauaag

SEQ ID NO: 1469043 - RNA, 15 nt, Human
auaugauguuaaaaa

SEQ ID NO: 1469044 - RNA, 12 nt, Human
auauguaaaaca

SEQ ID NO: 1469045 - RNA, 13 nt, Human
auauguaaaacau

SEQ ID NO: 1469046 - RNA, 14 nt, Human
auauguaaaacauu

SEQ ID NO: 1469047 - RNA, 15 nt, Human
auauguaaaacauuu

SEQ ID NO: 1469048 - RNA, 16 nt, Human
auauguaaaacauuua

SEQ ID NO: 1469049 - RNA, 18 nt, Human
auauguaaaacauuuauu

SEQ ID NO: 1469050 - RNA, 24 nt, Human
auauguaaaacauuuauuuugaca

SEQ ID NO: 1469051 - RNA, 14 nt, Human
auauguacaguuau

SEQ ID NO: 1469052 - RNA, 16 nt, Human
auauguacaguuaucu

SEQ ID NO: 1469053 - RNA, 11 nt, Human
auauguaccaa

SEQ ID NO: 1469054 - RNA, 19 nt, Human
uucauaauuauuauuuggc

SEQ ID NO: 1469055 - RNA, 13 nt, Human
auauauuuuaaga

SEQ ID NO: 1469056 - RNA, 12 nt, Human
auauauuuuaag

SEQ ID NO: 1469057 - RNA, 14 nt, Human
auauauguacaguu

SEQ ID NO: 1469058 - RNA, 13 nt, Human
auauauguacagu

SEQ ID NO: 1469059 - RNA, 17 nt, Human
uuagggaaaacauucca

SEQ ID NO: 1469060 - RNA, 15 nt, Human
uuagggaaaacauuc

SEQ ID NO: 1469061 - RNA, 13 nt, Human
uuaguuucugagu

SEQ ID NO: 1469062 - RNA, 20 nt, Human
uuaguuucugaguuuuacca

SEQ ID NO: 1469063 - RNA, 22 nt, Human
uuagcaaagauaucucaucucu

SEQ ID NO: 1469064 - RNA, 21 nt, Human
auaauuguuuuaucugaauuu

SEQ ID NO: 1469065 - RNA, 21 nt, Human
uuagccuucucuguucauuuc

SEQ ID NO: 1469066 - RNA, 15 nt, Human
uuagccuucucuguu

SEQ ID NO: 1469067 - RNA, 17 nt, Human
uuagccuucucuguuca

SEQ ID NO: 1469068 - RNA, 12 nt, Human
uuagccuucucu

SEQ ID NO: 1469069 - RNA, 14 nt, Human
uuagccuucucugu

SEQ ID NO: 1469070 - RNA, 19 nt, Human
auaauacuugcuuuggaaa

SEQ ID NO: 1469071 - RNA, 22 nt, Human
auaauacugcugagauacauac

SEQ ID NO: 1469072 - RNA, 21 nt, Human
auaauacugcugagauacaua

SEQ ID NO: 1469073 - RNA, 18 nt, Human
auaauaaaggacuguaau

SEQ ID NO: 1469074 - RNA, 13 nt, Human
auaauaaaggacu

SEQ ID NO: 1469075 - RNA, 11 nt, Human
auaauaaagga

SEQ ID NO: 1469076 - RNA, 21 nt, Human
auaagacggauuuauuuuucc

SEQ ID NO: 1469077 - RNA, 17 nt, Human
auaagacggauuuauuu

SEQ ID NO: 1469078 - RNA, 18 nt, Human
auaauccuaaacauauga

SEQ ID NO: 1469079 - RNA, 12 nt, Human
auaaucuagaac

SEQ ID NO: 1469080 - RNA, 15 nt, Human
auaaucuagaacaca

SEQ ID NO: 1469081 - RNA, 14 nt, Human
auaaauaaaaauaa

SEQ ID NO: 1469082 - RNA, 15 nt, Human
auaaagguucaugca

SEQ ID NO: 1469083 - RNA, 17 nt, Human
auaaagguucaugcaaa

SEQ ID NO: 1469084 - RNA, 13 nt, Human
auaaauaaaaaua

SEQ ID NO: 1469085 - RNA, 14 nt, Human
auaacguauaaaag

SEQ ID NO: 1469086 - RNA, 14 nt, Human
auaaccuuaauuua

SEQ ID NO: 1469087 - RNA, 22 nt, Human
auaacgauaaaagacagugaaa

SEQ ID NO: 1469088 - RNA, 22 nt, Human
auaacguuuaagccaaaacaau

SEQ ID NO: 1469089 - RNA, 20 nt, Human
auaacguuuaagccaaaaca

SEQ ID NO: 1469090 - RNA, 17 nt, Human
auaacguuuaagccaaa

SEQ ID NO: 1469091 - RNA, 18 nt, Human
auaacguuuaagccaaaa

SEQ ID NO: 1469092 - RNA, 13 nt, Human
auaaauuauuguu

SEQ ID NO: 1469093 - RNA, 19 nt, Human
auaaauuauuguuuuucuu

SEQ ID NO: 1469094 - RNA, 20 nt, Human
uuaccuuugacaaagguaaa

SEQ ID NO: 1469095 - RNA, 13 nt, Human
uuaccuuugacaa

SEQ ID NO: 1469096 - RNA, 15 nt, Human
uuaccuuauugcacu

SEQ ID NO: 1469097 - RNA, 13 nt, Human
uuaccuacuuuga

SEQ ID NO: 1469098 - RNA, 23 nt, Human
uuaccuacuuugacuuuuugcau

SEQ ID NO: 1469099 - RNA, 17 nt, Human
uuagaacacacacacuu

SEQ ID NO: 1469100 - RNA, 20 nt, Human
uuagaacacacacacuuacu

SEQ ID NO: 1469101 - RNA, 16 nt, Human
uuagaaaugcagaauc

SEQ ID NO: 1469102 - RNA, 13 nt, Human
uuagaaaucauuu

SEQ ID NO: 1469103 - RNA, 13 nt, Human
uguuucaaacaua

SEQ ID NO: 1469104 - RNA, 19 nt, Human
uguuucaaacauauauaac

SEQ ID NO: 1469105 - RNA, 19 nt, Human
aguuggaguuuuuuguacc

SEQ ID NO: 1469106 - RNA, 20 nt, Human
aguuggaguuuuuuguacca

SEQ ID NO: 1469107 - RNA, 16 nt, Human
aguuggggacacaugu

SEQ ID NO: 1469108 - RNA, 14 nt, Human
aguuuaaauuguaa

SEQ ID NO: 1469109 - RNA, 12 nt, Human
uuaaaaaaauaa

SEQ ID NO: 1469110 - RNA, 21 nt, Human
uuaaagugacuaauggcauga

SEQ ID NO: 1469111 - RNA, 20 nt, Human
uuaaagugacuaauggcaug

SEQ ID NO: 1469112 - RNA, 18 nt, Human
uuaaacagugagccugaa

SEQ ID NO: 1469113 - RNA, 23 nt, Human
uuaaacagugagccugaauuuug

SEQ ID NO: 1469114 - RNA, 14 nt, Human
uuaaacaaagguug

SEQ ID NO: 1469115 - RNA, 18 nt, Human
uuaacaccuuuaaagugu

SEQ ID NO: 1469116 - RNA, 17 nt, Human
uuaacaauuaggcagac

SEQ ID NO: 1469117 - RNA, 13 nt, Human
uuaacagagucug

SEQ ID NO: 1469118 - RNA, 14 nt, Human
uuaacagagucuga

SEQ ID NO: 1469119 - RNA, 16 nt, Human
aguuucauauaaagua

SEQ ID NO: 1469120 - RNA, 13 nt, Human
auaaaagccuguu

SEQ ID NO: 1469121 - RNA, 17 nt, Human
aguuuuuauauguugua

SEQ ID NO: 1469122 - RNA, 19 nt, Human
auaaaagccuguuuaagag

SEQ ID NO: 1469123 - RNA, 18 nt, Human
auaaaagccuguuuaaga

SEQ ID NO: 1469124 - RNA, 12 nt, Human
auaaaauaauuu

SEQ ID NO: 1469125 - RNA, 22 nt, Human
auaaaauaauuuuaucucuuuc

SEQ ID NO: 1469126 - RNA, 15 nt, Human
auaaaauaauuuuua

SEQ ID NO: 1469127 - RNA, 18 nt, Human
aguuuugauauuucuagc

SEQ ID NO: 1469128 - RNA, 16 nt, Human
aguuuugcaaagugca

SEQ ID NO: 1469129 - RNA, 24 nt, Human
uuaaggggaggaaccagagugcug

SEQ ID NO: 1469130 - RNA, 14 nt, Human
uuaagguguagcca

SEQ ID NO: 1469131 - RNA, 17 nt, Human
uuaagguguagccacac

SEQ ID NO: 1469132 - RNA, 20 nt, Human
uuaagaagacugcauuauau

SEQ ID NO: 1469133 - RNA, 16 nt, Human
uuaauauugauuuauu

SEQ ID NO: 1469134 - RNA, 13 nt, Human
uuaauauugauuu

SEQ ID NO: 1469135 - RNA, 13 nt, Human
uuaagucagaaca

SEQ ID NO: 1469136 - RNA, 16 nt, Human
uuaaucuguauuuccc

SEQ ID NO: 1469137 - RNA, 23 nt, Human
aguguuggagaagaacugaaauc

SEQ ID NO: 1469138 - RNA, 17 nt, Human
aguguuggagaagaacu

SEQ ID NO: 1469139 - RNA, 18 nt, Human
aguguuggagaagaacug

SEQ ID NO: 1469140 - RNA, 14 nt, Human
aguguuggagaaga

SEQ ID NO: 1469141 - RNA, 16 nt, Human
aguguuggagaagaac

SEQ ID NO: 1469142 - RNA, 21 nt, Human
aguguucauaaauaaaguuug

SEQ ID NO: 1469143 - RNA, 22 nt, Human
uguuccccuuugcuucauucaa

SEQ ID NO: 1469144 - RNA, 22 nt, Human
aguggaaagacagcuucucauc

SEQ ID NO: 1469145 - RNA, 22 nt, Human
uguuaucaaacaccaacauaaa

SEQ ID NO: 1469146 - RNA, 22 nt, Human
uguuauuauuacuuauuuuuga

SEQ ID NO: 1469147 - RNA, 13 nt, Human
uguugucugcaac

SEQ ID NO: 1469148 - RNA, 16 nt, Human
uguugucugcaacucu

SEQ ID NO: 1469149 - RNA, 14 nt, Human
uguuggucauuuua

SEQ ID NO: 1469150 - RNA, 13 nt, Human
uguugugcuuuua

SEQ ID NO: 1469151 - RNA, 16 nt, Human
uguuuaguagcaguga

SEQ ID NO: 1469152 - RNA, 18 nt, Human
uguuuaguagcagugauu

SEQ ID NO: 1469153 - RNA, 17 nt, Human
uguuuaguaaucauauu

SEQ ID NO: 1469154 - RNA, 14 nt, Human
uguuuaguaaucau

SEQ ID NO: 1469155 - RNA, 13 nt, Human
uguuuaguaauca

SEQ ID NO: 1469156 - RNA, 19 nt, Human
uguuuaguaaacucaauaa

SEQ ID NO: 1469157 - RNA, 20 nt, Human
aguucggugagcuacaaaug

SEQ ID NO: 1469158 - RNA, 19 nt, Human
aguucggugagcuacaaau

SEQ ID NO: 1469159 - RNA, 14 nt, Human
aguuccccuaugug

SEQ ID NO: 1469160 - RNA, 18 nt, Human
aguuccccuauguggaag

SEQ ID NO: 1469161 - RNA, 20 nt, Human
agugcuggcauuacaggugu

SEQ ID NO: 1469162 - RNA, 20 nt, Human
agugcugggauuacaggugu

SEQ ID NO: 1469163 - RNA, 17 nt, Human
uguguucccauuucagc

SEQ ID NO: 1469164 - RNA, 16 nt, Human
uguguucccauuucag

SEQ ID NO: 1469165 - RNA, 14 nt, Human
agugcacuaaugug

SEQ ID NO: 1469166 - RNA, 16 nt, Human
agugcaccaaagagaa

SEQ ID NO: 1469167 - RNA, 18 nt, Human
agugcaccaaagagaaug

SEQ ID NO: 1469168 - RNA, 20 nt, Human
agugcaccaaagagaaugcc

SEQ ID NO: 1469169 - RNA, 22 nt, Human
agugcaaauugucacaggacag

SEQ ID NO: 1469170 - RNA, 13 nt, Human
agugcaccaaaga

SEQ ID NO: 1469171 - RNA, 18 nt, Human
agugcaaauugucacagg

SEQ ID NO: 1469172 - RNA, 21 nt, Human
agugcaaauugucacaggaca

SEQ ID NO: 1469173 - RNA, 15 nt, Human
agugauugucuuaau

SEQ ID NO: 1469174 - RNA, 17 nt, Human
agugauugucuuaauau

SEQ ID NO: 1469175 - RNA, 16 nt, Human
agugauuguaugaauu

SEQ ID NO: 1469176 - RNA, 17 nt, Human
uguggccccugaacaag

SEQ ID NO: 1469177 - RNA, 22 nt, Human
uguggccccugaacaagaauug

SEQ ID NO: 1469178 - RNA, 14 nt, Human
ugugccuccucacc

SEQ ID NO: 1469179 - RNA, 15 nt, Human
ugugccuccucaccc

SEQ ID NO: 1469180 - RNA, 16 nt, Human
ugugccuccucacccc

SEQ ID NO: 1469181 - RNA, 16 nt, Human
ugugccccuugacaac

SEQ ID NO: 1469182 - RNA, 23 nt, Human
ugugccccuugacaacuggcagg

SEQ ID NO: 1469183 - RNA, 18 nt, Human
agucucacugcuugaacu

SEQ ID NO: 1469184 - RNA, 19 nt, Human
uguggcacuggggcagggg

SEQ ID NO: 1469185 - RNA, 15 nt, Human
uguggcaagugaauu

SEQ ID NO: 1469186 - RNA, 14 nt, Human
uguggcaagugaau

SEQ ID NO: 1469187 - RNA, 17 nt, Human
uguggagagggaaugug

SEQ ID NO: 1469188 - RNA, 20 nt, Human
uguggagagggaaugugaaa

SEQ ID NO: 1469189 - RNA, 19 nt, Human
uguggagagggaaugugaa

SEQ ID NO: 1469190 - RNA, 22 nt, Human
uguggauuuuuuccuucaaagu

SEQ ID NO: 1469191 - RNA, 17 nt, Human
uguaagaaaauaucacu

SEQ ID NO: 1469192 - RNA, 20 nt, Human
uguaacuuuuguaagacaaa

SEQ ID NO: 1469193 - RNA, 15 nt, Human
uguaacuuuuguaag

SEQ ID NO: 1469194 - RNA, 16 nt, Human
uguaacuuuuguaaga

SEQ ID NO: 1469195 - RNA, 18 nt, Human
uguaacuuucucuaugaa

SEQ ID NO: 1469196 - RNA, 17 nt, Human
uguaacuuucucuauga

SEQ ID NO: 1469197 - RNA, 20 nt, Human
uguaagacaaagguuuuccu

SEQ ID NO: 1469198 - RNA, 21 nt, Human
uguaagacaaagguuuuccuc

SEQ ID NO: 1469199 - RNA, 22 nt, Human
uguaagacccuuauugcugucc

SEQ ID NO: 1469200 - RNA, 18 nt, Human
uguaagacccuuauugcu

SEQ ID NO: 1469201 - RNA, 19 nt, Human
agguguagccacaccagga

SEQ ID NO: 1469202 - RNA, 13 nt, Human
aggugguguuucu

SEQ ID NO: 1469203 - RNA, 15 nt, Human
uguaaguaaacgguc

SEQ ID NO: 1469204 - RNA, 21 nt, Human
uguaagggccagaaauaucuu

SEQ ID NO: 1469205 - RNA, 18 nt, Human
uguaagggccagaaauau

SEQ ID NO: 1469206 - RNA, 16 nt, Human
uguaaguugaagcaaa

SEQ ID NO: 1469207 - RNA, 18 nt, Human
aggucuuugguucagcua

SEQ ID NO: 1469208 - RNA, 10 nt, Human
aggucccuaa

SEQ ID NO: 1469209 - RNA, 21 nt, Human
agguggugguagagaagcaag

SEQ ID NO: 1469210 - RNA, 14 nt, Human
agguggcccuacug

SEQ ID NO: 1469211 - RNA, 20 nt, Human
aggugcauauuuauaaaaau

SEQ ID NO: 1469212 - RNA, 15 nt, Human
uguaccaagaaucuu

SEQ ID NO: 1469213 - RNA, 23 nt, Human
aguaaggaauuuuauuuuuuucu

SEQ ID NO: 1469214 - RNA, 22 nt, Human
aguaauaugccugcuauuugaa

SEQ ID NO: 1469215 - RNA, 10 nt, Human
agguuuucag

SEQ ID NO: 1469216 - RNA, 22 nt, Human
agguuuuccucuucuauuuugu

SEQ ID NO: 1469217 - RNA, 22 nt, Human
aguacacaauaagcaaaaacaa

SEQ ID NO: 1469218 - RNA, 21 nt, Human
aguacacaauaagcaaaaaca

SEQ ID NO: 1469219 - RNA, 18 nt, Human
aguacacaauaagcaaaa

SEQ ID NO: 1469220 - RNA, 17 nt, Human
aguacacaauaagcaaa

SEQ ID NO: 1469221 - RNA, 16 nt, Human
aguacacaauaagcaa

SEQ ID NO: 1469222 - RNA, 15 nt, Human
aguaauuugaggaca

SEQ ID NO: 1469223 - RNA, 21 nt, Human
aguaauuuguuuaaaaaguaa

SEQ ID NO: 1469224 - RNA, 15 nt, Human
aguaauuuguagauu

SEQ ID NO: 1469225 - RNA, 21 nt, Human
aguaauccaagcaaaugugaa

SEQ ID NO: 1469226 - RNA, 15 nt, Human
aguaauccaagcaaa

SEQ ID NO: 1469227 - RNA, 19 nt, Human
aguacuuuuggcauuuuac

SEQ ID NO: 1469228 - RNA, 13 nt, Human
aguacuuugugca

SEQ ID NO: 1469229 - RNA, 15 nt, Human
aguacuuugugcauu

SEQ ID NO: 1469230 - RNA, 16 nt, Human
aguacuuugugcauuc

SEQ ID NO: 1469231 - RNA, 20 nt, Human
aguacacagcaccagaaugu

SEQ ID NO: 1469232 - RNA, 22 nt, Human
aguagagacgagguuucacugu

SEQ ID NO: 1469233 - RNA, 13 nt, Human
aguagagacaggg

SEQ ID NO: 1469234 - RNA, 12 nt, Human
aguagaaaucau

SEQ ID NO: 1469235 - RNA, 19 nt, Human
aguagauaggccaugggca

SEQ ID NO: 1469236 - RNA, 21 nt, Human
aguagaugcauuuggguccag

SEQ ID NO: 1469237 - RNA, 23 nt, Human
aguagaugcauuuggguccagga

SEQ ID NO: 1469238 - RNA, 22 nt, Human
aguagaugcauuuggguccagg

SEQ ID NO: 1469239 - RNA, 20 nt, Human
uguaggagagguugucugug

SEQ ID NO: 1469240 - RNA, 13 nt, Human
aguauuucuauga

SEQ ID NO: 1469241 - RNA, 15 nt, Human
aguauuucuaugaaa

SEQ ID NO: 1469242 - RNA, 23 nt, Human
aguaugugggcagauuuucagca

SEQ ID NO: 1469243 - RNA, 16 nt, Human
aguauuucuaugaaau

SEQ ID NO: 1469244 - RNA, 19 nt, Human
agucacauuccugaacagg

SEQ ID NO: 1469245 - RNA, 20 nt, Human
agucacauuccugaacagga

SEQ ID NO: 1469246 - RNA, 23 nt, Human
agucacugagaccaaggcuuucu

SEQ ID NO: 1469247 - RNA, 13 nt, Human
agucacugagacc

SEQ ID NO: 1469248 - RNA, 17 nt, Human
uguauuuuuaguagaga

SEQ ID NO: 1469249 - RNA, 13 nt, Human
uguauuccaagac

SEQ ID NO: 1469250 - RNA, 15 nt, Human
uguauuccaagacau

SEQ ID NO: 1469251 - RNA, 20 nt, Human
uguauuccaagacaugucug

SEQ ID NO: 1469252 - RNA, 21 nt, Human
uguauuccaagacaugucugu

SEQ ID NO: 1469253 - RNA, 14 nt, Human
uguauucagacaga

SEQ ID NO: 1469254 - RNA, 18 nt, Human
uguauucagacagaugag

SEQ ID NO: 1469255 - RNA, 14 nt, Human
uguauucagcuuua

SEQ ID NO: 1469256 - RNA, 19 nt, Human
uguaguaaucugcauuauu

SEQ ID NO: 1469257 - RNA, 21 nt, Human
ugucaauaaaauccauacauu

SEQ ID NO: 1469258 - RNA, 20 nt, Human
ugucaaucagccuaguugau

SEQ ID NO: 1469259 - RNA, 15 nt, Human
ugucaaucuguccgu

SEQ ID NO: 1469260 - RNA, 17 nt, Human
aguaggcauuuuuacca

SEQ ID NO: 1469261 - RNA, 22 nt, Human
aguaggcauuuuuaccaucacu

SEQ ID NO: 1469262 - RNA, 22 nt, Human
aguccaggcuuuuuuaucaugu

SEQ ID NO: 1469263 - RNA, 14 nt, Human
agucccugccugga

SEQ ID NO: 1469264 - RNA, 15 nt, Human
agucccugccuggac

SEQ ID NO: 1469265 - RNA, 21 nt, Human
agucccugccuggaccagccu

SEQ ID NO: 1469266 - RNA, 22 nt, Human
agucccugccuggaccagccuc

SEQ ID NO: 1469267 - RNA, 23 nt, Human
agucccugccuggaccagccucu

SEQ ID NO: 1469268 - RNA, 15 nt, Human
aguccgucaaaacag

SEQ ID NO: 1469269 - RNA, 14 nt, Human
aguccgucaaaaca

SEQ ID NO: 1469270 - RNA, 24 nt, Human
agucucacaugauuccagccauca

SEQ ID NO: 1469271 - RNA, 23 nt, Human
agucucacaugauuccagccauc

SEQ ID NO: 1469272 - RNA, 22 nt, Human
agucucacaugauuccagccau

SEQ ID NO: 1469273 - RNA, 21 nt, Human
agucucacaugauuccagcca

SEQ ID NO: 1469274 - RNA, 16 nt, Human
agucaggaaagagaac

SEQ ID NO: 1469275 - RNA, 18 nt, Human
ugucgauuagacuggaca

SEQ ID NO: 1469276 - RNA, 20 nt, Human
ugucgauuagacuggacagc

SEQ ID NO: 1469277 - RNA, 23 nt, Human
ugucgauuagacuggacagcuug

SEQ ID NO: 1469278 - RNA, 22 nt, Human
uguccuaauaauaucccacugg

SEQ ID NO: 1469279 - RNA, 14 nt, Human
ugucgauuagacug

SEQ ID NO: 1469280 - RNA, 13 nt, Human
uguccuuucuaga

SEQ ID NO: 1469281 - RNA, 14 nt, Human
uguccuuucuagag

SEQ ID NO: 1469282 - RNA, 18 nt, Human
uguccuuucuagagcacu

SEQ ID NO: 1469283 - RNA, 19 nt, Human
uguccuuucuagagcacug

SEQ ID NO: 1469284 - RNA, 13 nt, Human
ugucauuuuggua

SEQ ID NO: 1469285 - RNA, 15 nt, Human
uguccgacucuucug

SEQ ID NO: 1469286 - RNA, 20 nt, Human
ugguaaggggaauugaggac

SEQ ID NO: 1469287 - RNA, 16 nt, Human
aggguggcagcaacaa

SEQ ID NO: 1469288 - RNA, 15 nt, Human
aggguggcagcaaca

SEQ ID NO: 1469289 - RNA, 13 nt, Human
aggguggcagcaa

SEQ ID NO: 1469290 - RNA, 11 nt, Human
aggguggcagc

SEQ ID NO: 1469291 - RNA, 21 nt, Human
ugggucuaggacacaguuccu

SEQ ID NO: 1469292 - RNA, 22 nt, Human
ugggucuaggacacaguuccug

SEQ ID NO: 1469293 - RNA, 21 nt, Human
ugggucgcccuggacugugug

SEQ ID NO: 1469294 - RNA, 15 nt, Human
aggggcuaccaggaa

SEQ ID NO: 1469295 - RNA, 14 nt, Human
aggggcuaccagga

SEQ ID NO: 1469296 - RNA, 17 nt, Human
aggggcuaccaggaaag

SEQ ID NO: 1469297 - RNA, 15 nt, Human
agggggagagggcug

SEQ ID NO: 1469298 - RNA, 16 nt, Human
agggggagagggcugc

SEQ ID NO: 1469299 - RNA, 19 nt, Human
ugggguauggauucuaaaa

SEQ ID NO: 1469300 - RNA, 20 nt, Human
ugggguauggauucuaaaau

SEQ ID NO: 1469301 - RNA, 23 nt, Human
agggggugauuagagggaggaga

SEQ ID NO: 1469302 - RNA, 17 nt, Human
aggguuaugauuaagua

SEQ ID NO: 1469303 - RNA, 16 nt, Human
uggucuuguggaauug

SEQ ID NO: 1469304 - RNA, 15 nt, Human
uggucucccuucucu

SEQ ID NO: 1469305 - RNA, 18 nt, Human
uggucucaaacuccugac

SEQ ID NO: 1469306 - RNA, 23 nt, Human
uggucucaaacuccugaccucag

SEQ ID NO: 1469307 - RNA, 20 nt, Human
agguauucguuaucuaauag

SEQ ID NO: 1469308 - RNA, 18 nt, Human
agguauucguuaucuaau

SEQ ID NO: 1469309 - RNA, 14 nt, Human
agguauuacacucu

SEQ ID NO: 1469310 - RNA, 13 nt, Human
agguauaccucac

SEQ ID NO: 1469311 - RNA, 23 nt, Human
agguacuucaaauccuugaagau

SEQ ID NO: 1469312 - RNA, 23 nt, Human
agguauaauucacauuguauuca

SEQ ID NO: 1469313 - RNA, 21 nt, Human
agguagaauguaaagcuuguc

SEQ ID NO: 1469314 - RNA, 14 nt, Human
agguagaauguaaa

SEQ ID NO: 1469315 - RNA, 19 nt, Human
agguagaauguaaagcuug

SEQ ID NO: 1469316 - RNA, 15 nt, Human
agguagucucacugc

SEQ ID NO: 1469317 - RNA, 14 nt, Human
uggggaaugaagau

SEQ ID NO: 1469318 - RNA, 15 nt, Human
uggggaaugaagaua

SEQ ID NO: 1469319 - RNA, 22 nt, Human
uggggaagagagccugcaggau

SEQ ID NO: 1469320 - RNA, 17 nt, Human
uggggaagagagccugc

SEQ ID NO: 1469321 - RNA, 18 nt, Human
uggggaagacaguggccc

SEQ ID NO: 1469322 - RNA, 15 nt, Human
uggggaagagagccu

SEQ ID NO: 1469323 - RNA, 19 nt, Human
ugggcuggcaguccuggaa

SEQ ID NO: 1469324 - RNA, 17 nt, Human
uggggaguggggguggg

SEQ ID NO: 1469325 - RNA, 16 nt, Human
uggggacuugugucug

SEQ ID NO: 1469326 - RNA, 18 nt, Human
uggggaguuuaggguggg

SEQ ID NO: 1469327 - RNA, 19 nt, Human
uggggaguuuagggugggg

SEQ ID NO: 1469328 - RNA, 16 nt, Human
ugggauuuggucaaca

SEQ ID NO: 1469329 - RNA, 21 nt, Human
ugggauucuggacaggaugug

SEQ ID NO: 1469330 - RNA, 19 nt, Human
ugggaggugagaccaccuc

SEQ ID NO: 1469331 - RNA, 14 nt, Human
ugggaguacaaaag

SEQ ID NO: 1469332 - RNA, 16 nt, Human
agggcaggugcuucag

SEQ ID NO: 1469333 - RNA, 16 nt, Human
agggcagggggccccu

SEQ ID NO: 1469334 - RNA, 23 nt, Human
aggacagcccuucuuuccacaga

SEQ ID NO: 1469335 - RNA, 18 nt, Human
ugcuugauagaaaugcca

SEQ ID NO: 1469336 - RNA, 13 nt, Human
ugcuugauagaaa

SEQ ID NO: 1469337 - RNA, 19 nt, Human
ugcuugaugggauucugga

SEQ ID NO: 1469338 - RNA, 20 nt, Human
ugcuugaugggauucuggac

SEQ ID NO: 1469339 - RNA, 22 nt, Human
ugcuugaugggauucuggacag

SEQ ID NO: 1469340 - RNA, 12 nt, Human
ugcuugauuuuu

SEQ ID NO: 1469341 - RNA, 17 nt, Human
ugcuugcauaagagcuu

SEQ ID NO: 1469342 - RNA, 16 nt, Human
ugcuugcauaagagcu

SEQ ID NO: 1469343 - RNA, 15 nt, Human
ugcuuggagcugagc

SEQ ID NO: 1469344 - RNA, 17 nt, Human
ugcuuggagcugagcaa

SEQ ID NO: 1469345 - RNA, 13 nt, Human
uggaagguauuua

SEQ ID NO: 1469346 - RNA, 17 nt, Human
uggaagguauuuaauag

SEQ ID NO: 1469347 - RNA, 11 nt, Human
uggaaggcaug

SEQ ID NO: 1469348 - RNA, 20 nt, Human
uggaaggcaagauugugucc

SEQ ID NO: 1469349 - RNA, 14 nt, Human
uggaaggcauggcg

SEQ ID NO: 1469350 - RNA, 19 nt, Human
aggaucccaugagcuccuu

SEQ ID NO: 1469351 - RNA, 15 nt, Human
aggauaccauauaca

SEQ ID NO: 1469352 - RNA, 22 nt, Human
aggauaccauauacagcucaga

SEQ ID NO: 1469353 - RNA, 18 nt, Human
aggauacgacaguacacu

SEQ ID NO: 1469354 - RNA, 20 nt, Human
aggauacgacaguacacugu

SEQ ID NO: 1469355 - RNA, 18 nt, Human
aggauacuauauuuuagg

SEQ ID NO: 1469356 - RNA, 23 nt, Human
aggauagaaguauaccugauuuu

SEQ ID NO: 1469357 - RNA, 14 nt, Human
aggauagagacugg

SEQ ID NO: 1469358 - RNA, 18 nt, Human
aggauacuggcacagagg

SEQ ID NO: 1469359 - RNA, 22 nt, Human
aggagcugacucacaccugaac

SEQ ID NO: 1469360 - RNA, 13 nt, Human
aggcaaucauggu

SEQ ID NO: 1469361 - RNA, 14 nt, Human
uggagcucguggaa

SEQ ID NO: 1469362 - RNA, 14 nt, Human
uggagaagaacuga

SEQ ID NO: 1469363 - RNA, 15 nt, Human
uggacugugugcuca

SEQ ID NO: 1469364 - RNA, 14 nt, Human
uggacuugccucug

SEQ ID NO: 1469365 - RNA, 13 nt, Human
uggagaagaacug

SEQ ID NO: 1469366 - RNA, 13 nt, Human
uggcaucccuggg

SEQ ID NO: 1469367 - RNA, 14 nt, Human
uggcaucccugggc

SEQ ID NO: 1469368 - RNA, 15 nt, Human
uggcaucccugggcc

SEQ ID NO: 1469369 - RNA, 16 nt, Human
uggcaucccugggccu

SEQ ID NO: 1469370 - RNA, 20 nt, Human
uggcaucccugggccuuggg

SEQ ID NO: 1469371 - RNA, 13 nt, Human
uggcaugagaaau

SEQ ID NO: 1469372 - RNA, 21 nt, Human
uggcaugagaaauacaaaaau

SEQ ID NO: 1469373 - RNA, 18 nt, Human
uggcaugagaaauacaaa

SEQ ID NO: 1469374 - RNA, 21 nt, Human
aggccugacugccaagccaug

SEQ ID NO: 1469375 - RNA, 22 nt, Human
aggccugacugccaagccaugg

SEQ ID NO: 1469376 - RNA, 19 nt, Human
aggccugacugccaagcca

SEQ ID NO: 1469377 - RNA, 18 nt, Human
aggccugacugccaagcc

SEQ ID NO: 1469378 - RNA, 17 nt, Human
aggccugacugccaagc

SEQ ID NO: 1469379 - RNA, 14 nt, Human
uggccauuugcuuu

SEQ ID NO: 1469380 - RNA, 15 nt, Human
uggccauuugcuuuu

SEQ ID NO: 1469381 - RNA, 23 nt, Human
uggccaugggaggccuuucccua

SEQ ID NO: 1469382 - RNA, 22 nt, Human
uggccaugggaggccuuucccu

SEQ ID NO: 1469383 - RNA, 16 nt, Human
uggccaugggaggccu

SEQ ID NO: 1469384 - RNA, 15 nt, Human
uggccaugggaggcc

SEQ ID NO: 1469385 - RNA, 14 nt, Human
uggccaugggaggc

SEQ ID NO: 1469386 - RNA, 16 nt, Human
uggccuaaccugccga

SEQ ID NO: 1469387 - RNA, 17 nt, Human
uggauuauauuaugaag

SEQ ID NO: 1469388 - RNA, 20 nt, Human
uggauuacugccauucacuu

SEQ ID NO: 1469389 - RNA, 13 nt, Human
uggcaauuuugua

SEQ ID NO: 1469390 - RNA, 14 nt, Human
uggcaauuuuguaa

SEQ ID NO: 1469391 - RNA, 15 nt, Human
uggcaauuuuguaac

SEQ ID NO: 1469392 - RNA, 14 nt, Human
ugcucauuucagga

SEQ ID NO: 1469393 - RNA, 14 nt, Human
ugcucauggaauug

SEQ ID NO: 1469394 - RNA, 18 nt, Human
agcuuuaacuuaaauagu

SEQ ID NO: 1469395 - RNA, 16 nt, Human
ugcuaucucugugugc

SEQ ID NO: 1469396 - RNA, 21 nt, Human
ugcuaucucugugugcacaaa

SEQ ID NO: 1469397 - RNA, 20 nt, Human
ugcuaucucugugugcacaa

SEQ ID NO: 1469398 - RNA, 15 nt, Human
ugcuauggugcucug

SEQ ID NO: 1469399 - RNA, 17 nt, Human
ugcuaugguuuucucca

SEQ ID NO: 1469400 - RNA, 14 nt, Human
ugcuaugguuuucu

SEQ ID NO: 1469401 - RNA, 20 nt, Human
ugcuauguuuugacauuuuu

SEQ ID NO: 1469402 - RNA, 21 nt, Human
aggaaaucaacuugcuuauca

SEQ ID NO: 1469403 - RNA, 15 nt, Human
aggaagcaagcuuaa

SEQ ID NO: 1469404 - RNA, 17 nt, Human
aggaagcaagcuuaaug

SEQ ID NO: 1469405 - RNA, 13 nt, Human
aggaaauauuuau

SEQ ID NO: 1469406 - RNA, 15 nt, Human
aggaaauauacuuuu

SEQ ID NO: 1469407 - RNA, 12 nt, Human
aggaaauauuua

SEQ ID NO: 1469408 - RNA, 21 nt, Human
ugcuguauuuuaaaagaauga

SEQ ID NO: 1469409 - RNA, 22 nt, Human
ugcuguauuuuaaaagaaugau

SEQ ID NO: 1469410 - RNA, 13 nt, Human
ugcuguauuuuaa

SEQ ID NO: 1469411 - RNA, 14 nt, Human
aggaauggaagucc

SEQ ID NO: 1469412 - RNA, 16 nt, Human
aggaaggacuaugaaa

SEQ ID NO: 1469413 - RNA, 13 nt, Human
aggacacaugucc

SEQ ID NO: 1469414 - RNA, 12 nt, Human
aggacacauguc

SEQ ID NO: 1469415 - RNA, 11 nt, Human
aggacacaugu

SEQ ID NO: 1469416 - RNA, 15 nt, Human
ugcuuccaauuuucu

SEQ ID NO: 1469417 - RNA, 23 nt, Human
ugcuguauuuuaaaagaaugauu

SEQ ID NO: 1469418 - RNA, 15 nt, Human
ugcugugcugugcua

SEQ ID NO: 1469419 - RNA, 18 nt, Human
ugcugugcugugcuaugg

SEQ ID NO: 1469420 - RNA, 13 nt, Human
ugcuguggccagg

SEQ ID NO: 1469421 - RNA, 14 nt, Human
ugcuguggccagga

SEQ ID NO: 1469422 - RNA, 15 nt, Human
ugcuguggccaggag

SEQ ID NO: 1469423 - RNA, 16 nt, Human
ugcuguggccaggagg

SEQ ID NO: 1469424 - RNA, 17 nt, Human
ugcuguggccaggaggu

SEQ ID NO: 1469425 - RNA, 14 nt, Human
ugcuuacugauaua

SEQ ID NO: 1469426 - RNA, 22 nt, Human
ugcuuacugauauauuuuacaa

SEQ ID NO: 1469427 - RNA, 16 nt, Human
agcuguguggcagucu

SEQ ID NO: 1469428 - RNA, 14 nt, Human
agcuguguggcagu

SEQ ID NO: 1469429 - RNA, 11 nt, Human
agcugucugcu

SEQ ID NO: 1469430 - RNA, 17 nt, Human
agcugucugcucagaca

SEQ ID NO: 1469431 - RNA, 21 nt, Human
agcugggacaccccgacuuuu

SEQ ID NO: 1469432 - RNA, 20 nt, Human
agcuggcucugugagggugc

SEQ ID NO: 1469433 - RNA, 18 nt, Human
agcuggcucugugagggu

SEQ ID NO: 1469434 - RNA, 21 nt, Human
agcuggcucugugagggugcu

SEQ ID NO: 1469435 - RNA, 19 nt, Human
agcugucaucaauuaaagg

SEQ ID NO: 1469436 - RNA, 14 nt, Human
agcuggcucuguga

SEQ ID NO: 1469437 - RNA, 22 nt, Human
agcuggcucugugagggugcug

SEQ ID NO: 1469438 - RNA, 22 nt, Human
agcuguguguuuggaagacuau

SEQ ID NO: 1469439 - RNA, 15 nt, Human
ugccugcccuauucu

SEQ ID NO: 1469440 - RNA, 21 nt, Human
ugccugccccuacccuggacu

SEQ ID NO: 1469441 - RNA, 22 nt, Human
ugccugccccuacccuggacuu

SEQ ID NO: 1469442 - RNA, 15 nt, Human
ugcccaggcacugca

SEQ ID NO: 1469443 - RNA, 15 nt, Human
agcuggcauuacagc

SEQ ID NO: 1469444 - RNA, 21 nt, Human
agcuggcauuacagcuggaga

SEQ ID NO: 1469445 - RNA, 12 nt, Human
ugcuacaauguc

SEQ ID NO: 1469446 - RNA, 23 nt, Human
ugccuuugaccugccucccuuca

SEQ ID NO: 1469447 - RNA, 17 nt, Human
ugccuuugaccugccuc

SEQ ID NO: 1469448 - RNA, 13 nt, Human
ugccuuugaccug

SEQ ID NO: 1469449 - RNA, 23 nt, Human
ugcggaggaaggaggacccagga

SEQ ID NO: 1469450 - RNA, 22 nt, Human
ugcggaggaaggaggacccagg

SEQ ID NO: 1469451 - RNA, 21 nt, Human
ugcggaggaaggaggacccag

SEQ ID NO: 1469452 - RNA, 17 nt, Human
ugccuuuucccaacucc

SEQ ID NO: 1469453 - RNA, 13 nt, Human
ugcggcuccucag

SEQ ID NO: 1469454 - RNA, 15 nt, Human
ugcggcuccucaggg

SEQ ID NO: 1469455 - RNA, 18 nt, Human
agcuaggaauuguguuua

SEQ ID NO: 1469456 - RNA, 12 nt, Human
agcuaggaauga

SEQ ID NO: 1469457 - RNA, 13 nt, Human
agcuaggaaugaa

SEQ ID NO: 1469458 - RNA, 20 nt, Human
agcucaggaaccgaggcagg

SEQ ID NO: 1469459 - RNA, 21 nt, Human
agcucaggaaccgaggcaggg

SEQ ID NO: 1469460 - RNA, 22 nt, Human
agcucaggaaccgaggcaggga

SEQ ID NO: 1469461 - RNA, 19 nt, Human
ugcccagcccuaaacauca

SEQ ID NO: 1469462 - RNA, 19 nt, Human
agcuacuaauuuuaaaaug

SEQ ID NO: 1469463 - RNA, 16 nt, Human
agcuacguauuuaaua

SEQ ID NO: 1469464 - RNA, 22 nt, Human
agcuaccugcucagcccugcac

SEQ ID NO: 1469465 - RNA, 12 nt, Human
agcgggggaggg

SEQ ID NO: 1469466 - RNA, 21 nt, Human
agcgggggaggguaggcagga

SEQ ID NO: 1469467 - RNA, 13 nt, Human
agcuagaauuuga

SEQ ID NO: 1469468 - RNA, 16 nt, Human
agcuagaauuugauau

SEQ ID NO: 1469469 - RNA, 14 nt, Human
agcuagaauugagu

SEQ ID NO: 1469470 - RNA, 20 nt, Human
agcuagaauugaguguuuaa

SEQ ID NO: 1469471 - RNA, 15 nt, Human
agccuguuuaagaga

SEQ ID NO: 1469472 - RNA, 13 nt, Human
agccuguuuaaga

SEQ ID NO: 1469473 - RNA, 21 nt, Human
agccuggguguaaaaccugga

SEQ ID NO: 1469474 - RNA, 22 nt, Human
agccuggguguaaaaccuggag

SEQ ID NO: 1469475 - RNA, 20 nt, Human
agccuggguguaaaaccugg

SEQ ID NO: 1469476 - RNA, 12 nt, Human
agccugggugua

SEQ ID NO: 1469477 - RNA, 23 nt, Human
agcgccuccaacccuagcaaaag

SEQ ID NO: 1469478 - RNA, 22 nt, Human
agcgccuccaacccuagcaaaa

SEQ ID NO: 1469479 - RNA, 19 nt, Human
agcgccuccaacccuagca

SEQ ID NO: 1469480 - RNA, 18 nt, Human
agcgccuccaacccuagc

SEQ ID NO: 1469481 - RNA, 20 nt, Human
agccuuggggcugaugcagu

SEQ ID NO: 1469482 - RNA, 17 nt, Human
ugccaagggcauaaauu

SEQ ID NO: 1469483 - RNA, 21 nt, Human
ugccaagggcauaaauuauug

SEQ ID NO: 1469484 - RNA, 13 nt, Human
ugccaauuucaag

SEQ ID NO: 1469485 - RNA, 15 nt, Human
ugccaauuagcaauu

SEQ ID NO: 1469486 - RNA, 23 nt, Human
ugcagcccccacugccuuugacc

SEQ ID NO: 1469487 - RNA, 17 nt, Human
ugcagcccccacugccu

SEQ ID NO: 1469488 - RNA, 18 nt, Human
agccugacccucaucuuu

SEQ ID NO: 1469489 - RNA, 20 nt, Human
agccugaauuuuguugcugu

SEQ ID NO: 1469490 - RNA, 21 nt, Human
agccugaauuuuguugcuguu

SEQ ID NO: 1469491 - RNA, 17 nt, Human
agccugacaacauuucu

SEQ ID NO: 1469492 - RNA, 14 nt, Human
ugcagcccugcugc

SEQ ID NO: 1469493 - RNA, 20 nt, Human
ugcagcucaagagaucccaa

SEQ ID NO: 1469494 - RNA, 16 nt, Human
ugcaggucccuaauaa

SEQ ID NO: 1469495 - RNA, 15 nt, Human
ugcaggucccuaaua

SEQ ID NO: 1469496 - RNA, 14 nt, Human
ugcaggucccuaau

SEQ ID NO: 1469497 - RNA, 12 nt, Human
ugcaggucccua

SEQ ID NO: 1469498 - RNA, 17 nt, Human
ugcaggucccuaauaaa

SEQ ID NO: 1469499 - RNA, 17 nt, Human
ugcaguacuuugugcau

SEQ ID NO: 1469500 - RNA, 18 nt, Human
ugcaguacuuugugcauu

SEQ ID NO: 1469501 - RNA, 22 nt, Human
ugcagucucuauaccaauaaag

SEQ ID NO: 1469502 - RNA, 23 nt, Human
ugcagucucuauaccaauaaagu

SEQ ID NO: 1469503 - RNA, 21 nt, Human
ugcagucucuauaccaauaaa

SEQ ID NO: 1469504 - RNA, 20 nt, Human
ugcagucucuauaccaauaa

SEQ ID NO: 1469505 - RNA, 19 nt, Human
ugcagucucuauaccaaua

SEQ ID NO: 1469506 - RNA, 18 nt, Human
ugcagucucuauaccaau

SEQ ID NO: 1469507 - RNA, 16 nt, Human
ugcagucucuauacca

SEQ ID NO: 1469508 - RNA, 23 nt, Human
ugcauaacguauaaaagccuguu

SEQ ID NO: 1469509 - RNA, 22 nt, Human
agcccuucuauacccacccaga

SEQ ID NO: 1469510 - RNA, 20 nt, Human
agcccuucuauacccaccca

SEQ ID NO: 1469511 - RNA, 19 nt, Human
agcccuucuauacccaccc

SEQ ID NO: 1469512 - RNA, 15 nt, Human
ugcacuaucuuucag

SEQ ID NO: 1469513 - RNA, 16 nt, Human
ugcacuaucuuucagc

SEQ ID NO: 1469514 - RNA, 23 nt, Human
agcccuucuccauggcccugcca

SEQ ID NO: 1469515 - RNA, 21 nt, Human
agccgacaccuuuuuucaaca

SEQ ID NO: 1469516 - RNA, 21 nt, Human
agcccuucuccauggcccugc

SEQ ID NO: 1469517 - RNA, 23 nt, Human
agcccuucuauacccacccagaa

SEQ ID NO: 1469518 - RNA, 17 nt, Human
agcccuucuuuccacag

SEQ ID NO: 1469519 - RNA, 22 nt, Human
ugcacaccuacuagucaccaga

SEQ ID NO: 1469520 - RNA, 20 nt, Human
ugcacaccuacuagucacca

SEQ ID NO: 1469521 - RNA, 20 nt, Human
ugcacacccuccagagacaa

SEQ ID NO: 1469522 - RNA, 19 nt, Human
ugcaccaugcugcugggga

SEQ ID NO: 1469523 - RNA, 23 nt, Human
ugcaccaugcugcuggggaagac

SEQ ID NO: 1469524 - RNA, 22 nt, Human
ugcaccaugcugcuggggaaga

SEQ ID NO: 1469525 - RNA, 18 nt, Human
ugauucgaaugacacugu

SEQ ID NO: 1469526 - RNA, 15 nt, Human
ugagucaaaaaaucu

SEQ ID NO: 1469527 - RNA, 18 nt, Human
ugagucaaguuguuccuu

SEQ ID NO: 1469528 - RNA, 12 nt, Human
ugauacagaaaa

SEQ ID NO: 1469529 - RNA, 21 nt, Human
ugauacagaaaaguugaauuu

SEQ ID NO: 1469530 - RNA, 14 nt, Human
ugauacuaagcauu

SEQ ID NO: 1469531 - RNA, 16 nt, Human
ugauacuaagcauuga

SEQ ID NO: 1469532 - RNA, 12 nt, Human
ugauaagaucuu

SEQ ID NO: 1469533 - RNA, 15 nt, Human
ugauaagaucuuuua

SEQ ID NO: 1469534 - RNA, 22 nt, Human
ugauaagaucuuuuauuuugcc

SEQ ID NO: 1469535 - RNA, 15 nt, Human
ugauaaugaacagaa

SEQ ID NO: 1469536 - RNA, 16 nt, Human
ugauaaugaacagaac

SEQ ID NO: 1469537 - RNA, 20 nt, Human
ugauaaugaacagaacauag

SEQ ID NO: 1469538 - RNA, 18 nt, Human
ugauaaugaacagaacau

SEQ ID NO: 1469539 - RNA, 23 nt, Human
agcauaaauguugacaugggaca

SEQ ID NO: 1469540 - RNA, 21 nt, Human
agcauaauacuugcuuuggaa

SEQ ID NO: 1469541 - RNA, 21 nt, Human
ugagacaagaaaauaagagcu

SEQ ID NO: 1469542 - RNA, 23 nt, Human
ugagacaagaaaauaagagcuca

SEQ ID NO: 1469543 - RNA, 16 nt, Human
ugagacaaugccuugu

SEQ ID NO: 1469544 - RNA, 15 nt, Human
ugagacaaugccuug

SEQ ID NO: 1469545 - RNA, 22 nt, Human
ugaguaacugauuuguaacaag

SEQ ID NO: 1469546 - RNA, 14 nt, Human
ugaguagaguugau

SEQ ID NO: 1469547 - RNA, 17 nt, Human
ugaguagaguugaucaa

SEQ ID NO: 1469548 - RNA, 18 nt, Human
ugauagacaauugaggua

SEQ ID NO: 1469549 - RNA, 17 nt, Human
ugauagacaauugaggu

SEQ ID NO: 1469550 - RNA, 19 nt, Human
ugauagaaaugccaagcac

SEQ ID NO: 1469551 - RNA, 12 nt, Human
ugauaugggucu

SEQ ID NO: 1469552 - RNA, 15 nt, Human
ugauaugugaacagu

SEQ ID NO: 1469553 - RNA, 16 nt, Human
ugauaugugaacaguu

SEQ ID NO: 1469554 - RNA, 17 nt, Human
ugauauuucuagcuuau

SEQ ID NO: 1469555 - RNA, 19 nt, Human
ugauauuuccccaugguuu

SEQ ID NO: 1469556 - RNA, 19 nt, Human
ugaucaaaaucaauuaaaa

SEQ ID NO: 1469557 - RNA, 15 nt, Human
ugauauuuucucuag

SEQ ID NO: 1469558 - RNA, 14 nt, Human
ugauauuuucucua

SEQ ID NO: 1469559 - RNA, 17 nt, Human
ugauauuuucugugccu

SEQ ID NO: 1469560 - RNA, 20 nt, Human
ugauauuuucugugccugaa

SEQ ID NO: 1469561 - RNA, 11 nt, Human
ugaucaaggcc

SEQ ID NO: 1469562 - RNA, 13 nt, Human
ugaucaaggccuu

SEQ ID NO: 1469563 - RNA, 12 nt, Human
ugaucaaggccu

SEQ ID NO: 1469564 - RNA, 20 nt, Human
agcaucacaugaacuuguaa

SEQ ID NO: 1469565 - RNA, 14 nt, Human
agcaucacagaaug

SEQ ID NO: 1469566 - RNA, 13 nt, Human
agcaucacagaau

SEQ ID NO: 1469567 - RNA, 20 nt, Human
agcaugucgucaaagcugaa

SEQ ID NO: 1469568 - RNA, 17 nt, Human
agcaugucgucaaagcu

SEQ ID NO: 1469569 - RNA, 15 nt, Human
agcauggcuauuuua

SEQ ID NO: 1469570 - RNA, 18 nt, Human
agcauggcuauuuuauau

SEQ ID NO: 1469571 - RNA, 17 nt, Human
agcauggcuauuuuaua

SEQ ID NO: 1469572 - RNA, 17 nt, Human
agcauuucccuuccuuc

SEQ ID NO: 1469573 - RNA, 17 nt, Human
agcaugucuauucagcu

SEQ ID NO: 1469574 - RNA, 19 nt, Human
agcaugucuauucagcuuc

SEQ ID NO: 1469575 - RNA, 15 nt, Human
agcauugaauggcua

SEQ ID NO: 1469576 - RNA, 17 nt, Human
ugaugaagaaguugaua

SEQ ID NO: 1469577 - RNA, 21 nt, Human
ugauccuguauucagacagau

SEQ ID NO: 1469578 - RNA, 20 nt, Human
ugauccuguauucagacaga

SEQ ID NO: 1469579 - RNA, 15 nt, Human
ugauccuuacaaguu

SEQ ID NO: 1469580 - RNA, 15 nt, Human
ugauggugguauguu

SEQ ID NO: 1469581 - RNA, 16 nt, Human
ugauuacagugcagug

SEQ ID NO: 1469582 - RNA, 14 nt, Human
ugauuacagugcag

SEQ ID NO: 1469583 - RNA, 22 nt, Human
agccaggaagaucccccagaaa

SEQ ID NO: 1469584 - RNA, 21 nt, Human
agccaggaagaucccccagaa

SEQ ID NO: 1469585 - RNA, 20 nt, Human
agccaggaagaucccccaga

SEQ ID NO: 1469586 - RNA, 22 nt, Human
agccagcuuucccugccucuca

SEQ ID NO: 1469587 - RNA, 16 nt, Human
agccagcuuucccugc

SEQ ID NO: 1469588 - RNA, 18 nt, Human
agccagcuuucccugccu

SEQ ID NO: 1469589 - RNA, 19 nt, Human
agccaggaggccugcuagg

SEQ ID NO: 1469590 - RNA, 16 nt, Human
agccaggaggccugcu

SEQ ID NO: 1469591 - RNA, 14 nt, Human
agccaggaggccug

SEQ ID NO: 1469592 - RNA, 22 nt, Human
agccagaacuugacccugagcu

SEQ ID NO: 1469593 - RNA, 15 nt, Human
agccagaccagcagg

SEQ ID NO: 1469594 - RNA, 13 nt, Human
agccagcugcccc

SEQ ID NO: 1469595 - RNA, 13 nt, Human
agccagcuuuccc

SEQ ID NO: 1469596 - RNA, 14 nt, Human
agccagcuuucccu

SEQ ID NO: 1469597 - RNA, 20 nt, Human
agccagcugcccccagagcc

SEQ ID NO: 1469598 - RNA, 19 nt, Human
agccagcugcccccagagc

SEQ ID NO: 1469599 - RNA, 14 nt, Human
agccagcugccccc

SEQ ID NO: 1469600 - RNA, 18 nt, Human
agccauggguagccuggg

SEQ ID NO: 1469601 - RNA, 20 nt, Human
ugauucauuuuaacaucuga

SEQ ID NO: 1469602 - RNA, 22 nt, Human
ugauucauuuuaacaucugaga

SEQ ID NO: 1469603 - RNA, 19 nt, Human
ugauuccagccaucaccuu

SEQ ID NO: 1469604 - RNA, 15 nt, Human
ugauuccagccauca

SEQ ID NO: 1469605 - RNA, 16 nt, Human
agaugcaguucugaag

SEQ ID NO: 1469606 - RNA, 17 nt, Human
agaugcaguucugaaga

SEQ ID NO: 1469607 - RNA, 15 nt, Human
agaugcccaaauccu

SEQ ID NO: 1469608 - RNA, 20 nt, Human
agaugcugauggagccuucc

SEQ ID NO: 1469609 - RNA, 17 nt, Human
agauguuugauagauuu

SEQ ID NO: 1469610 - RNA, 19 nt, Human
agauguuugauagauuuuc

SEQ ID NO: 1469611 - RNA, 14 nt, Human
ugacucacaccuga

SEQ ID NO: 1469612 - RNA, 19 nt, Human
ugacucacaccugaacuga

SEQ ID NO: 1469613 - RNA, 13 nt, Human
ugacuagggagcc

SEQ ID NO: 1469614 - RNA, 17 nt, Human
ugacuagggagccaugu

SEQ ID NO: 1469615 - RNA, 18 nt, Human
ugacuagggagccauguu

SEQ ID NO: 1469616 - RNA, 20 nt, Human
ugacuagggagccauguuuc

SEQ ID NO: 1469617 - RNA, 21 nt, Human
ugacuagggagccauguuuca

SEQ ID NO: 1469618 - RNA, 21 nt, Human
ugacccucaucuuucuuccaa

SEQ ID NO: 1469619 - RNA, 13 nt, Human
ugaccccugcuca

SEQ ID NO: 1469620 - RNA, 21 nt, Human
ugacccuaugggucuaggaca

SEQ ID NO: 1469621 - RNA, 17 nt, Human
agcaagaccccaucuca

SEQ ID NO: 1469622 - RNA, 13 nt, Human
agauuuuuuaaua

SEQ ID NO: 1469623 - RNA, 14 nt, Human
agauuuuuuaauaa

SEQ ID NO: 1469624 - RNA, 16 nt, Human
agauuuuuuaauaauu

SEQ ID NO: 1469625 - RNA, 12 nt, Human
agcaaaaaagaa

SEQ ID NO: 1469626 - RNA, 14 nt, Human
agcaaaaaagaaaa

SEQ ID NO: 1469627 - RNA, 21 nt, Human
agcaacuacagucuaaagcug

SEQ ID NO: 1469628 - RNA, 19 nt, Human
agcaagaaggcaaaaauag

SEQ ID NO: 1469629 - RNA, 19 nt, Human
agauuuucugcuacuuugc

SEQ ID NO: 1469630 - RNA, 17 nt, Human
agauuuuucaugauuuu

SEQ ID NO: 1469631 - RNA, 15 nt, Human
agauuucugaggaaa

SEQ ID NO: 1469632 - RNA, 14 nt, Human
agauuucugaggaa

SEQ ID NO: 1469633 - RNA, 21 nt, Human
agauuuccuucuuuuuuucuu

SEQ ID NO: 1469634 - RNA, 16 nt, Human
agauuuccuucuuuuu

SEQ ID NO: 1469635 - RNA, 18 nt, Human
agauuuccauauaaauau

SEQ ID NO: 1469636 - RNA, 22 nt, Human
agauugcugaaauuuuauaugc

SEQ ID NO: 1469637 - RNA, 20 nt, Human
ugaagcuaucguaaaauuaa

SEQ ID NO: 1469638 - RNA, 16 nt, Human
ugaagcucacuucugg

SEQ ID NO: 1469639 - RNA, 21 nt, Human
agagcugauggagaaggaagg

SEQ ID NO: 1469640 - RNA, 20 nt, Human
agagcugauggagaaggaag

SEQ ID NO: 1469641 - RNA, 19 nt, Human
agagcugauggagaaggaa

SEQ ID NO: 1469642 - RNA, 24 nt, Human
agagggaggagaaugagccucggc

SEQ ID NO: 1469643 - RNA, 20 nt, Human
agaggcuuccuucauuuccu

SEQ ID NO: 1469644 - RNA, 18 nt, Human
ugaauauuuaguguucau

SEQ ID NO: 1469645 - RNA, 13 nt, Human
ugaauauuauucc

SEQ ID NO: 1469646 - RNA, 15 nt, Human
ugaauauuauuccuc

SEQ ID NO: 1469647 - RNA, 22 nt, Human
ugaauguaaauuuguacuauuu

SEQ ID NO: 1469648 - RNA, 20 nt, Human
ugaauguaaauuuguacuau

SEQ ID NO: 1469649 - RNA, 21 nt, Human
ugaauguaaauuuguacuauu

SEQ ID NO: 1469650 - RNA, 15 nt, Human
ugaauacuuuauaaa

SEQ ID NO: 1469651 - RNA, 14 nt, Human
ugaauaaagcaauu

SEQ ID NO: 1469652 - RNA, 22 nt, Human
ugaaggguaauuauauaguuac

SEQ ID NO: 1469653 - RNA, 14 nt, Human
agauacauacagaa

SEQ ID NO: 1469654 - RNA, 15 nt, Human
agauacauacagaau

SEQ ID NO: 1469655 - RNA, 16 nt, Human
agauacauacagaauu

SEQ ID NO: 1469656 - RNA, 15 nt, Human
agauaacugaaaauu

SEQ ID NO: 1469657 - RNA, 18 nt, Human
agauaacugaaaauuauu

SEQ ID NO: 1469658 - RNA, 22 nt, Human
agauaacugaaaauuauuuaaa

SEQ ID NO: 1469659 - RNA, 20 nt, Human
ugacaaagguaaaucagacu

SEQ ID NO: 1469660 - RNA, 16 nt, Human
ugacacauggccccuc

SEQ ID NO: 1469661 - RNA, 22 nt, Human
ugacacauggccccucccccug

SEQ ID NO: 1469662 - RNA, 18 nt, Human
ugacacuagcccaaugaa

SEQ ID NO: 1469663 - RNA, 19 nt, Human
ugacacuagcccaaugaaa

SEQ ID NO: 1469664 - RNA, 21 nt, Human
ugacacuagcccaaugaaaug

SEQ ID NO: 1469665 - RNA, 22 nt, Human
ugacacuagcccaaugaaauga

SEQ ID NO: 1469666 - RNA, 23 nt, Human
ugacacuagcccaaugaaaugaa

SEQ ID NO: 1469667 - RNA, 14 nt, Human
ugaauuuuguugcu

SEQ ID NO: 1469668 - RNA, 23 nt, Human
ugaauuugugaagguggaaauaa

SEQ ID NO: 1469669 - RNA, 16 nt, Human
ugaauuuuguugcugu

SEQ ID NO: 1469670 - RNA, 22 nt, Human
ugaauuuuuaaaacccauuuaa

SEQ ID NO: 1469671 - RNA, 17 nt, Human
ugaauuuuuaaacaagu

SEQ ID NO: 1469672 - RNA, 19 nt, Human
ugaauuuuuaaacaaguau

SEQ ID NO: 1469673 - RNA, 23 nt, Human
ugaauuuuuaaacaaguauuugu

SEQ ID NO: 1469674 - RNA, 21 nt, Human
ugaauuuuuaaacaaguauuu

SEQ ID NO: 1469675 - RNA, 21 nt, Human
ugaauuugugaagguggaaau

SEQ ID NO: 1469676 - RNA, 13 nt, Human
ugaauuugugaag

SEQ ID NO: 1469677 - RNA, 12 nt, Human
ugaaacuuuugg

SEQ ID NO: 1469678 - RNA, 17 nt, Human
agagacgggcccuggug

SEQ ID NO: 1469679 - RNA, 16 nt, Human
agagaccuuccagaaa

SEQ ID NO: 1469680 - RNA, 20 nt, Human
agagaucaggaagagaagga

SEQ ID NO: 1469681 - RNA, 19 nt, Human
agagaucaggaagagaagg

SEQ ID NO: 1469682 - RNA, 15 nt, Human
agagaucaggaagag

SEQ ID NO: 1469683 - RNA, 14 nt, Human
agagaucaggaaga

SEQ ID NO: 1469684 - RNA, 18 nt, Human
agagcugauggagaagga

SEQ ID NO: 1469685 - RNA, 17 nt, Human
agagcugauggagaagg

SEQ ID NO: 1469686 - RNA, 16 nt, Human
agagcugauggagaag

SEQ ID NO: 1469687 - RNA, 10 nt, Human
agagcucagg

SEQ ID NO: 1469688 - RNA, 12 nt, Human
agagcucaggau

SEQ ID NO: 1469689 - RNA, 13 nt, Human
agagcucaggaug

SEQ ID NO: 1469690 - RNA, 11 nt, Human
agagcuacaua

SEQ ID NO: 1469691 - RNA, 14 nt, Human
agagcuacauaauu

SEQ ID NO: 1469692 - RNA, 16 nt, Human
agagcuacauaauuua

SEQ ID NO: 1469693 - RNA, 18 nt, Human
agagcuacauaauuuagu

SEQ ID NO: 1469694 - RNA, 14 nt, Human
agagcuacguauuu

SEQ ID NO: 1469695 - RNA, 16 nt, Human
agagcuacguauuuaa

SEQ ID NO: 1469696 - RNA, 17 nt, Human
agagcuacguauuuaau

SEQ ID NO: 1469697 - RNA, 18 nt, Human
agagcaagaccccaucuc

SEQ ID NO: 1469698 - RNA, 21 nt, Human
agagcacgccuguacuagagc

SEQ ID NO: 1469699 - RNA, 20 nt, Human
agagcacgccuguacuagag

SEQ ID NO: 1469700 - RNA, 12 nt, Human
agagcacugcca

SEQ ID NO: 1469701 - RNA, 13 nt, Human
agagcacugccac

SEQ ID NO: 1469702 - RNA, 15 nt, Human
agagcaucaggccua

SEQ ID NO: 1469703 - RNA, 19 nt, Human
agagcaucaggccuagagg

SEQ ID NO: 1469704 - RNA, 18 nt, Human
ugaaacucauagacacug

SEQ ID NO: 1469705 - RNA, 19 nt, Human
ugaaacucauagacacuga

SEQ ID NO: 1469706 - RNA, 19 nt, Human
ugaaacucguuaauuugua

SEQ ID NO: 1469707 - RNA, 20 nt, Human
ugaaaaucuuauaauuuaaa

SEQ ID NO: 1469708 - RNA, 23 nt, Human
ugaaaauauuguuuuacaauagu

SEQ ID NO: 1469709 - RNA, 20 nt, Human
ugaaaauauuguuuuacaau

SEQ ID NO: 1469710 - RNA, 16 nt, Human
ugaaaauauuguuuua

SEQ ID NO: 1469711 - RNA, 19 nt, Human
ugaaaagguuuaugaaaaa

SEQ ID NO: 1469712 - RNA, 21 nt, Human
ugaaaagguuuaugaaaaaga

SEQ ID NO: 1469713 - RNA, 22 nt, Human
ugaaaagguuuaugaaaaagaa

SEQ ID NO: 1469714 - RNA, 23 nt, Human
ugaaaaaauauauaucaaauaua

SEQ ID NO: 1469715 - RNA, 13 nt, Human
ugaaaaagcgaaa

SEQ ID NO: 1469716 - RNA, 13 nt, Human
ugaaaaagaagaa

SEQ ID NO: 1469717 - RNA, 15 nt, Human
ucuuuguuucuuucu

SEQ ID NO: 1469718 - RNA, 18 nt, Human
agagacauuaacucauua

SEQ ID NO: 1469719 - RNA, 22 nt, Human
agagacauuaacucauuagacu

SEQ ID NO: 1469720 - RNA, 23 nt, Human
agagacauuaacucauuagacug

SEQ ID NO: 1469721 - RNA, 13 nt, Human
ucuuuguguagcu

SEQ ID NO: 1469722 - RNA, 15 nt, Human
ucuuuguguagcuuu

SEQ ID NO: 1469723 - RNA, 18 nt, Human
ucuuuguguagcuuugcu

SEQ ID NO: 1469724 - RNA, 21 nt, Human
ucuugaugccuggcggggugg

SEQ ID NO: 1469725 - RNA, 14 nt, Human
ucuugauguaaaau

SEQ ID NO: 1469726 - RNA, 15 nt, Human
ucuugauguaaaauc

SEQ ID NO: 1469727 - RNA, 16 nt, Human
ucuugauguaaaaucu

SEQ ID NO: 1469728 - RNA, 19 nt, Human
ucuugauguaaaaucuugu

SEQ ID NO: 1469729 - RNA, 22 nt, Human
ucuugauguaaaaucuugucau

SEQ ID NO: 1469730 - RNA, 15 nt, Human
ucuugaggggaccag

SEQ ID NO: 1469731 - RNA, 17 nt, Human
ucuugaggggaccagga

SEQ ID NO: 1469732 - RNA, 18 nt, Human
ucuugaggggaccaggag

SEQ ID NO: 1469733 - RNA, 19 nt, Human
ucuugaggggaccaggagu

SEQ ID NO: 1469734 - RNA, 13 nt, Human
agacucagcucug

SEQ ID NO: 1469735 - RNA, 18 nt, Human
agacucagcucugacauu

SEQ ID NO: 1469736 - RNA, 20 nt, Human
agacucagcucugacauucu

SEQ ID NO: 1469737 - RNA, 17 nt, Human
agacuaucuuacuauuu

SEQ ID NO: 1469738 - RNA, 20 nt, Human
agacuaucuuacuauuucac

SEQ ID NO: 1469739 - RNA, 15 nt, Human
ucuuuaugcuugcaa

SEQ ID NO: 1469740 - RNA, 14 nt, Human
ucuuuaugcuugca

SEQ ID NO: 1469741 - RNA, 12 nt, Human
ucuuuauuuuga

SEQ ID NO: 1469742 - RNA, 11 nt, Human
ucuuuauauga

SEQ ID NO: 1469743 - RNA, 15 nt, Human
ucuuuauaugaagaa

SEQ ID NO: 1469744 - RNA, 20 nt, Human
ucuuuaacuuaauugcuaug

SEQ ID NO: 1469745 - RNA, 22 nt, Human
ucuuggccaugggaggccuuuc

SEQ ID NO: 1469746 - RNA, 16 nt, Human
ucuuggccaugggagg

SEQ ID NO: 1469747 - RNA, 22 nt, Human
ucuuggggaguuuagggugggg

SEQ ID NO: 1469748 - RNA, 23 nt, Human
ucuuggggaguuuaggguggggg

SEQ ID NO: 1469749 - RNA, 19 nt, Human
ucuucugaacucaaacuga

SEQ ID NO: 1469750 - RNA, 24 nt, Human
ucuucugaacucaaacugaggaau

SEQ ID NO: 1469751 - RNA, 22 nt, Human
agacauuaacucauuagacugg

SEQ ID NO: 1469752 - RNA, 20 nt, Human
agacauuaacucauuagacu

SEQ ID NO: 1469753 - RNA, 13 nt, Human
ucuuccugacacu

SEQ ID NO: 1469754 - RNA, 15 nt, Human
ucuuccugacacuuu

SEQ ID NO: 1469755 - RNA, 16 nt, Human
ucuuccugacacuuua

SEQ ID NO: 1469756 - RNA, 22 nt, Human
ucuggauuccagagcacugcuc

SEQ ID NO: 1469757 - RNA, 20 nt, Human
ucuggauuccccaucucagg

SEQ ID NO: 1469758 - RNA, 15 nt, Human
ucuggcaacaucuuu

SEQ ID NO: 1469759 - RNA, 16 nt, Human
ucuggcaacaucuuua

SEQ ID NO: 1469760 - RNA, 22 nt, Human
ucuggaagugacuuuggcugca

SEQ ID NO: 1469761 - RNA, 19 nt, Human
ucuggaagugacuuuggcu

SEQ ID NO: 1469762 - RNA, 18 nt, Human
ucuggaagugacuuuggc

SEQ ID NO: 1469763 - RNA, 14 nt, Human
ucuggauuccagag

SEQ ID NO: 1469764 - RNA, 17 nt, Human
ucuggaagccccugggc

SEQ ID NO: 1469765 - RNA, 18 nt, Human
ucuggaagccccugggcc

SEQ ID NO: 1469766 - RNA, 22 nt, Human
ucuggcacagccuggcuguggc

SEQ ID NO: 1469767 - RNA, 13 nt, Human
agaaguugauaug

SEQ ID NO: 1469768 - RNA, 22 nt, Human
agaaguuggggacacauguauu

SEQ ID NO: 1469769 - RNA, 19 nt, Human
agaagcucugaagaacucu

SEQ ID NO: 1469770 - RNA, 13 nt, Human
agaaguuugcacu

SEQ ID NO: 1469771 - RNA, 16 nt, Human
agaaguuugcacuauc

SEQ ID NO: 1469772 - RNA, 21 nt, Human
agaaguuugcacuaucuuuca

SEQ ID NO: 1469773 - RNA, 23 nt, Human
agaaguuugcacuaucuuucagc

SEQ ID NO: 1469774 - RNA, 17 nt, Human
agaauaaucacgcuuuc

SEQ ID NO: 1469775 - RNA, 20 nt, Human
agaauaaucacgcuuuccug

SEQ ID NO: 1469776 - RNA, 21 nt, Human
agaauaaucacgcuuuccuga

SEQ ID NO: 1469777 - RNA, 12 nt, Human
agaaauuaugug

SEQ ID NO: 1469778 - RNA, 21 nt, Human
agaaccuggguugcagacagg

SEQ ID NO: 1469779 - RNA, 18 nt, Human
agaaauuacacccaaaga

SEQ ID NO: 1469780 - RNA, 23 nt, Human
ucugcaggucccuaauaaagcug

SEQ ID NO: 1469781 - RNA, 22 nt, Human
ucugcaggucccuaauaaagcu

SEQ ID NO: 1469782 - RNA, 19 nt, Human
ucugcaggucccuaauaaa

SEQ ID NO: 1469783 - RNA, 21 nt, Human
ucugcaggucccuaauaaagc

SEQ ID NO: 1469784 - RNA, 17 nt, Human
ucugaauaaagcaauua

SEQ ID NO: 1469785 - RNA, 14 nt, Human
ucugaauaaagcaa

SEQ ID NO: 1469786 - RNA, 13 nt, Human
agaacggaagaag

SEQ ID NO: 1469787 - RNA, 12 nt, Human
agaacggaagaa

SEQ ID NO: 1469788 - RNA, 17 nt, Human
agaacuagccaaaccag

SEQ ID NO: 1469789 - RNA, 19 nt, Human
agaacuagccaaaccagga

SEQ ID NO: 1469790 - RNA, 21 nt, Human
agaacuagccaaaccaggacc

SEQ ID NO: 1469791 - RNA, 12 nt, Human
agaaccuucucu

SEQ ID NO: 1469792 - RNA, 14 nt, Human
agaaccuucucuau

SEQ ID NO: 1469793 - RNA, 18 nt, Human
agaaccuucucuaugggg

SEQ ID NO: 1469794 - RNA, 13 nt, Human
agaagcaaguaaa

SEQ ID NO: 1469795 - RNA, 23 nt, Human
agaagcaaccucaguaauuuaga

SEQ ID NO: 1469796 - RNA, 21 nt, Human
agaagcaaccucaguaauuua

SEQ ID NO: 1469797 - RNA, 19 nt, Human
agaagcaccaaucaugaau

SEQ ID NO: 1469798 - RNA, 15 nt, Human
agaacuugacccuga

SEQ ID NO: 1469799 - RNA, 15 nt, Human
agaacuuugagcuac

SEQ ID NO: 1469800 - RNA, 20 nt, Human
agaacuuugagcuacugccg

SEQ ID NO: 1469801 - RNA, 22 nt, Human
ucucucacuuguuuuauuuaac

SEQ ID NO: 1469802 - RNA, 13 nt, Human
ucucuccagugca

SEQ ID NO: 1469803 - RNA, 13 nt, Human
ucucgaucuccug

SEQ ID NO: 1469804 - RNA, 18 nt, Human
acuuugugcauucuggau

SEQ ID NO: 1469805 - RNA, 13 nt, Human
acuuuagggaagu

SEQ ID NO: 1469806 - RNA, 13 nt, Human
acuuucuuucuca

SEQ ID NO: 1469807 - RNA, 22 nt, Human
acuuucuuucucacuaaaucuu

SEQ ID NO: 1469808 - RNA, 16 nt, Human
acuuucuuucucacua

SEQ ID NO: 1469809 - RNA, 17 nt, Human
acuuuagaauaugccuu

SEQ ID NO: 1469810 - RNA, 22 nt, Human
acuuguuuuauuuaaccucuaa

SEQ ID NO: 1469811 - RNA, 16 nt, Human
acuuguuuuggaugcc

SEQ ID NO: 1469812 - RNA, 13 nt, Human
acuuguuuuggau

SEQ ID NO: 1469813 - RNA, 19 nt, Human
acuuuguauaaaagggacu

SEQ ID NO: 1469814 - RNA, 14 nt, Human
acuuugaaguuagc

SEQ ID NO: 1469815 - RNA, 12 nt, Human
agaaaugaaaaa

SEQ ID NO: 1469816 - RNA, 13 nt, Human
agaaaugaaaaaa

SEQ ID NO: 1469817 - RNA, 16 nt, Human
agaaaugaaaaaauau

SEQ ID NO: 1469818 - RNA, 23 nt, Human
agaaauacuacuguguaagggcc

SEQ ID NO: 1469819 - RNA, 13 nt, Human
agaaauagaacaa

SEQ ID NO: 1469820 - RNA, 20 nt, Human
ucugaaggguaauuauauag

SEQ ID NO: 1469821 - RNA, 17 nt, Human
agaaaucuggcuucugg

SEQ ID NO: 1469822 - RNA, 22 nt, Human
agaaagcaucccucacccaucc

SEQ ID NO: 1469823 - RNA, 19 nt, Human
agaaagcaucccucaccca

SEQ ID NO: 1469824 - RNA, 17 nt, Human
agaaagcaucccucacc

SEQ ID NO: 1469825 - RNA, 23 nt, Human
agaaauacaaaaauacucagaua

SEQ ID NO: 1469826 - RNA, 14 nt, Human
agaaauacaaaaau

SEQ ID NO: 1469827 - RNA, 16 nt, Human
agaaaacaaggaugaa

SEQ ID NO: 1469828 - RNA, 16 nt, Human
agaaacacaacuauau

SEQ ID NO: 1469829 - RNA, 13 nt, Human
agaaaagcuauaa

SEQ ID NO: 1469830 - RNA, 21 nt, Human
agaaaagcuauaaaaugaaua

SEQ ID NO: 1469831 - RNA, 14 nt, Human
agaaaagcuuugaa

SEQ ID NO: 1469832 - RNA, 18 nt, Human
agaaacaagguuuucagu

SEQ ID NO: 1469833 - RNA, 12 nt, Human
agaaacauuuau

SEQ ID NO: 1469834 - RNA, 15 nt, Human
agaaacauuuauauu

SEQ ID NO: 1469835 - RNA, 19 nt, Human
agaaacauuuauauugaua

SEQ ID NO: 1469836 - RNA, 21 nt, Human
agaaacuuaaauuuuaguucu

SEQ ID NO: 1469837 - RNA, 15 nt, Human
agaaacauuugguaa

SEQ ID NO: 1469838 - RNA, 21 nt, Human
ucucugcaggucccuaauaaa

SEQ ID NO: 1469839 - RNA, 20 nt, Human
ucucugcaggucccuaauaa

SEQ ID NO: 1469840 - RNA, 19 nt, Human
ucucugcaggucccuaaua

SEQ ID NO: 1469841 - RNA, 22 nt, Human
ucucugcaggucccuaauaaag

SEQ ID NO: 1469842 - RNA, 23 nt, Human
agaaaaacaaacucguuuuuuac

SEQ ID NO: 1469843 - RNA, 21 nt, Human
agaaaacaaaacugcauuuca

SEQ ID NO: 1469844 - RNA, 13 nt, Human
agaaaacaaaacu

SEQ ID NO: 1469845 - RNA, 20 nt, Human
acuuccagauccuggaaauc

SEQ ID NO: 1469846 - RNA, 19 nt, Human
acuuccaaacuaauuuuua

SEQ ID NO: 1469847 - RNA, 14 nt, Human
acuuccaaacuaau

SEQ ID NO: 1469848 - RNA, 16 nt, Human
acuuccaaacuaauuu

SEQ ID NO: 1469849 - RNA, 17 nt, Human
acuuccaaacuaauuuu

SEQ ID NO: 1469850 - RNA, 18 nt, Human
acuuccaaacuaauuuuu

SEQ ID NO: 1469851 - RNA, 21 nt, Human
ucuaccuggucucuccuuguu

SEQ ID NO: 1469852 - RNA, 13 nt, Human
ucuauaauuuaaa

SEQ ID NO: 1469853 - RNA, 13 nt, Human
ucuauaaaccgaa

SEQ ID NO: 1469854 - RNA, 17 nt, Human
ucuauagccaaaaauag

SEQ ID NO: 1469855 - RNA, 20 nt, Human
ucuauagccaaaaauagcua

SEQ ID NO: 1469856 - RNA, 22 nt, Human
ucuaggaaauauacuuuuacaa

SEQ ID NO: 1469857 - RNA, 14 nt, Human
ucuagcuuaucuac

SEQ ID NO: 1469858 - RNA, 15 nt, Human
ucuaggaaauauacu

SEQ ID NO: 1469859 - RNA, 14 nt, Human
ucuaguucugccag

SEQ ID NO: 1469860 - RNA, 15 nt, Human
ucuagauugagagaa

SEQ ID NO: 1469861 - RNA, 13 nt, Human
ucuagccuggcua

SEQ ID NO: 1469862 - RNA, 18 nt, Human
acuugaaaauuaacauga

SEQ ID NO: 1469863 - RNA, 17 nt, Human
acuugaaaauuaacaug

SEQ ID NO: 1469864 - RNA, 21 nt, Human
acuucucuuguuagguaauuu

SEQ ID NO: 1469865 - RNA, 20 nt, Human
acuugaaauauccugcuuga

SEQ ID NO: 1469866 - RNA, 19 nt, Human
acuugaggacacaugucca

SEQ ID NO: 1469867 - RNA, 18 nt, Human
acuugaggacacaugucc

SEQ ID NO: 1469868 - RNA, 17 nt, Human
acuugaggacacauguc

SEQ ID NO: 1469869 - RNA, 21 nt, Human
acuugaacugauucacaucuc

SEQ ID NO: 1469870 - RNA, 13 nt, Human
acuugaacugauu

SEQ ID NO: 1469871 - RNA, 12 nt, Human
acuugacagugg

SEQ ID NO: 1469872 - RNA, 14 nt, Human
acuugacaguggaa

SEQ ID NO: 1469873 - RNA, 13 nt, Human
acuugacagugga

SEQ ID NO: 1469874 - RNA, 14 nt, Human
acuugacccugagc

SEQ ID NO: 1469875 - RNA, 15 nt, Human
acuugacccugagcu

SEQ ID NO: 1469876 - RNA, 18 nt, Human
acuugacccugagcugac

SEQ ID NO: 1469877 - RNA, 14 nt, Human
acuuguauuaugug

SEQ ID NO: 1469878 - RNA, 13 nt, Human
acuuguauuaugu

SEQ ID NO: 1469879 - RNA, 15 nt, Human
acuuguauuaugugu

SEQ ID NO: 1469880 - RNA, 16 nt, Human
acuugucuauuaccug

SEQ ID NO: 1469881 - RNA, 13 nt, Human
acuugccucugca

SEQ ID NO: 1469882 - RNA, 14 nt, Human
acuugccaaauuua

SEQ ID NO: 1469883 - RNA, 19 nt, Human
acuugccaaauuuagauuu

SEQ ID NO: 1469884 - RNA, 20 nt, Human
ucuauuuuuugaaaagcaga

SEQ ID NO: 1469885 - RNA, 22 nt, Human
ucucacaugauuccagccauca

SEQ ID NO: 1469886 - RNA, 19 nt, Human
ucucacaugauuccagcca

SEQ ID NO: 1469887 - RNA, 18 nt, Human
ucucaccaggcagccucu

SEQ ID NO: 1469888 - RNA, 19 nt, Human
ucucaccaggcagccucug

SEQ ID NO: 1469889 - RNA, 22 nt, Human
ucucaccaggcagccucugggg

SEQ ID NO: 1469890 - RNA, 21 nt, Human
ucucaccaggcagccucuggg

SEQ ID NO: 1469891 - RNA, 13 nt, Human
ucucaccaggcag

SEQ ID NO: 1469892 - RNA, 14 nt, Human
ucucaccaggcagc

SEQ ID NO: 1469893 - RNA, 16 nt, Human
ucucaccaggcagccu

SEQ ID NO: 1469894 - RNA, 17 nt, Human
ucucaccaggcagccuc

SEQ ID NO: 1469895 - RNA, 20 nt, Human
ucucacaugauuccagccau

SEQ ID NO: 1469896 - RNA, 15 nt, Human
ucuauuuuuaucuga

SEQ ID NO: 1469897 - RNA, 23 nt, Human
ucuauuguuguacacagaaauac

SEQ ID NO: 1469898 - RNA, 22 nt, Human
ucuauuguuguacacagaaaua

SEQ ID NO: 1469899 - RNA, 19 nt, Human
ucuauagccaaaaauagcu

SEQ ID NO: 1469900 - RNA, 12 nt, Human
ucuauuggucuc

SEQ ID NO: 1469901 - RNA, 20 nt, Human
acuuccuaaauauuaugaga

SEQ ID NO: 1469902 - RNA, 12 nt, Human
ucgccucagccu

SEQ ID NO: 1469903 - RNA, 17 nt, Human
ucgccggaucugaggga

SEQ ID NO: 1469904 - RNA, 16 nt, Human
ucgccggaucugaggg

SEQ ID NO: 1469905 - RNA, 18 nt, Human
ucgcccuggacugugugc

SEQ ID NO: 1469906 - RNA, 22 nt, Human
acugaagaagcaccaaucauga

SEQ ID NO: 1469907 - RNA, 19 nt, Human
acugaacaccauugaaggc

SEQ ID NO: 1469908 - RNA, 19 nt, Human
ucgcccaugcuggagugca

SEQ ID NO: 1469909 - RNA, 17 nt, Human
ucgcuguccuuucuaga

SEQ ID NO: 1469910 - RNA, 11 nt, Human
ucgcuguccuu

SEQ ID NO: 1469911 - RNA, 15 nt, Human
acugggggaaaagau

SEQ ID NO: 1469912 - RNA, 16 nt, Human
acuggggcaggggccg

SEQ ID NO: 1469913 - RNA, 18 nt, Human
acuguacagacagaaaaa

SEQ ID NO: 1469914 - RNA, 14 nt, Human
acuggguaaugaaa

SEQ ID NO: 1469915 - RNA, 20 nt, Human
acuggguaaugaaacaaaga

SEQ ID NO: 1469916 - RNA, 23 nt, Human
acuguacuugcucuugaugccug

SEQ ID NO: 1469917 - RNA, 15 nt, Human
acuguacuugcucuu

SEQ ID NO: 1469918 - RNA, 15 nt, Human
acuguaucuaggcaa

SEQ ID NO: 1469919 - RNA, 22 nt, Human
acuguaucuaggcaacauagua

SEQ ID NO: 1469920 - RNA, 23 nt, Human
acuguaucuaggcaacauaguau

SEQ ID NO: 1469921 - RNA, 13 nt, Human
acugucauagaaa

SEQ ID NO: 1469922 - RNA, 14 nt, Human
ucguuaucuaauag

SEQ ID NO: 1469923 - RNA, 15 nt, Human
ucguucaaagcauga

SEQ ID NO: 1469924 - RNA, 19 nt, Human
ucguuuauuuucaagaaua

SEQ ID NO: 1469925 - RNA, 20 nt, Human
ucggggagccgggagccuga

SEQ ID NO: 1469926 - RNA, 20 nt, Human
ucguaagauuuccuucuuuu

SEQ ID NO: 1469927 - RNA, 15 nt, Human
ucguacagaaagcug

SEQ ID NO: 1469928 - RNA, 16 nt, Human
ucguacagaaagcugc

SEQ ID NO: 1469929 - RNA, 13 nt, Human
acuguggguagac

SEQ ID NO: 1469930 - RNA, 17 nt, Human
ucuaccaaaaaucucaa

SEQ ID NO: 1469931 - RNA, 18 nt, Human
ucuaaguguuucauaaau

SEQ ID NO: 1469932 - RNA, 14 nt, Human
ucuaaguuaauuua

SEQ ID NO: 1469933 - RNA, 16 nt, Human
ucuaaguuaauuuaaa

SEQ ID NO: 1469934 - RNA, 18 nt, Human
ucuaaguuaauuuaaagu

SEQ ID NO: 1469935 - RNA, 20 nt, Human
ucuaaguuaauuuaaaguug

SEQ ID NO: 1469936 - RNA, 21 nt, Human
ucuaaguuaauuuaaaguugu

SEQ ID NO: 1469937 - RNA, 19 nt, Human
ucuaaagcugguuuaaugu

SEQ ID NO: 1469938 - RNA, 21 nt, Human
ucuaaagcugguuuaauguuu

SEQ ID NO: 1469939 - RNA, 21 nt, Human
ucuaaacuggauucacagcuc

SEQ ID NO: 1469940 - RNA, 13 nt, Human
ucuaagaaacauu

SEQ ID NO: 1469941 - RNA, 15 nt, Human
ucuaagaaacauuua

SEQ ID NO: 1469942 - RNA, 17 nt, Human
ucuaagaaacauuuaua

SEQ ID NO: 1469943 - RNA, 22 nt, Human
ucuaagaaacauuuauauugau

SEQ ID NO: 1469944 - RNA, 13 nt, Human
ucuaagaaagaac

SEQ ID NO: 1469945 - RNA, 18 nt, Human
ucuaagaaacauuuauau

SEQ ID NO: 1469946 - RNA, 12 nt, Human
ucuaagaaagaa

SEQ ID NO: 1469947 - RNA, 19 nt, Human
uaugugccagauuuaugca

SEQ ID NO: 1469948 - RNA, 14 nt, Human
uaugugccagauuu

SEQ ID NO: 1469949 - RNA, 23 nt, Human
uaugugccagauuuaugcauauu

SEQ ID NO: 1469950 - RNA, 20 nt, Human
acaucuuuaaggggaggaac

SEQ ID NO: 1469951 - RNA, 11 nt, Human
acaucuuuaag

SEQ ID NO: 1469952 - RNA, 13 nt, Human
acaucuuuauccg

SEQ ID NO: 1469953 - RNA, 22 nt, Human
uauuuuaagacgaaacauuugu

SEQ ID NO: 1469954 - RNA, 14 nt, Human
uauuuuaagacgaa

SEQ ID NO: 1469955 - RNA, 14 nt, Human
uauuuuaaaagaau

SEQ ID NO: 1469956 - RNA, 18 nt, Human
uauuuuaaaagaaugauu

SEQ ID NO: 1469957 - RNA, 14 nt, Human
uauuuguaauagau

SEQ ID NO: 1469958 - RNA, 15 nt, Human
uauuuguaauagaug

SEQ ID NO: 1469959 - RNA, 20 nt, Human
uauuuguaauagauguuuga

SEQ ID NO: 1469960 - RNA, 12 nt, Human
uauuuguacaua

SEQ ID NO: 1469961 - RNA, 14 nt, Human
uauuuuaauaaaca

SEQ ID NO: 1469962 - RNA, 12 nt, Human
uauuuuaaagaa

SEQ ID NO: 1469963 - RNA, 13 nt, Human
uauuuuaaagaau

SEQ ID NO: 1469964 - RNA, 16 nt, Human
uauuuuaaagaauugu

SEQ ID NO: 1469965 - RNA, 14 nt, Human
uauuuuaaagaauu

SEQ ID NO: 1469966 - RNA, 17 nt, Human
uauuuuaauaaacacuc

SEQ ID NO: 1469967 - RNA, 19 nt, Human
uauuuuaauaauguuucaa

SEQ ID NO: 1469968 - RNA, 22 nt, Human
uauuuuaauaauguuucaaaca

SEQ ID NO: 1469969 - RNA, 13 nt, Human
uauuuuacauaaa

SEQ ID NO: 1469970 - RNA, 14 nt, Human
uauuuuacaauuuu

SEQ ID NO: 1469971 - RNA, 23 nt, Human
uauuuuacaauuuuuuaucaugc

SEQ ID NO: 1469972 - RNA, 22 nt, Human
uauuuugccaagggcauaaauu

SEQ ID NO: 1469973 - RNA, 23 nt, Human
uauuuugccaagggcauaaauua

SEQ ID NO: 1469974 - RNA, 14 nt, Human
uauuuugcuggaau

SEQ ID NO: 1469975 - RNA, 20 nt, Human
uauuuuguguuuaggaacua

SEQ ID NO: 1469976 - RNA, 17 nt, Human
uauuuuguguuuaggaa

SEQ ID NO: 1469977 - RNA, 13 nt, Human
uauuuuguaaacu

SEQ ID NO: 1469978 - RNA, 20 nt, Human
uauuuuguaaacucaaaaua

SEQ ID NO: 1469979 - RNA, 21 nt, Human
uauuuuguaaacucaaaauau

SEQ ID NO: 1469980 - RNA, 19 nt, Human
uauuuuuggcagucugaau

SEQ ID NO: 1469981 - RNA, 20 nt, Human
uauuuuuggcagucugaauu

SEQ ID NO: 1469982 - RNA, 20 nt, Human
uauuuuucaugauuuugaaa

SEQ ID NO: 1469983 - RNA, 12 nt, Human
uauuuuucauga

SEQ ID NO: 1469984 - RNA, 21 nt, Human
uauuuuguuuugugcagagau

SEQ ID NO: 1469985 - RNA, 21 nt, Human
uauuuuuaauauauacuauga

SEQ ID NO: 1469986 - RNA, 21 nt, Human
ucaaauacgugggcauucaaa

SEQ ID NO: 1469987 - RNA, 22 nt, Human
ucaaauacgugggcauucaaau

SEQ ID NO: 1469988 - RNA, 13 nt, Human
ucaaauauauuca

SEQ ID NO: 1469989 - RNA, 23 nt, Human
ucaaauacgugggcauucaaaug

SEQ ID NO: 1469990 - RNA, 18 nt, Human
ucaaaguguuuucucuga

SEQ ID NO: 1469991 - RNA, 19 nt, Human
ucaaaguguuuucucugaa

SEQ ID NO: 1469992 - RNA, 13 nt, Human
acaugaaacagaa

SEQ ID NO: 1469993 - RNA, 15 nt, Human
acaugaaacagaaac

SEQ ID NO: 1469994 - RNA, 22 nt, Human
ucaaacaguacacuaucuuaau

SEQ ID NO: 1469995 - RNA, 13 nt, Human
ucaaagcaagcau

SEQ ID NO: 1469996 - RNA, 15 nt, Human
ucaaagcaagcauuc

SEQ ID NO: 1469997 - RNA, 19 nt, Human
ucaaagcaagcauucagaa

SEQ ID NO: 1469998 - RNA, 21 nt, Human
ucaaagcaagcauucagaaga

SEQ ID NO: 1469999 - RNA, 22 nt, Human
ucaaagcaagcauucagaagaa

SEQ ID NO: 1470000 - RNA, 14 nt, Human
ucaaaagggccaaa

SEQ ID NO: 1470001 - RNA, 21 nt, Human
ucaaaagggccaaagaaccaa

SEQ ID NO: 1470002 - RNA, 20 nt, Human
ucaaaagggccaaagaacca

SEQ ID NO: 1470003 - RNA, 22 nt, Human
acauggcuggagcuagaauuug

SEQ ID NO: 1470004 - RNA, 21 nt, Human
acauggccccucccccugcca

SEQ ID NO: 1470005 - RNA, 22 nt, Human
acauggccccucccccugccag

SEQ ID NO: 1470006 - RNA, 14 nt, Human
acauuagaagacaa

SEQ ID NO: 1470007 - RNA, 15 nt, Human
acauuagaagacaau

SEQ ID NO: 1470008 - RNA, 20 nt, Human
acauuagaagacaauugaca

SEQ ID NO: 1470009 - RNA, 21 nt, Human
acauuagaagacaauugacaa

SEQ ID NO: 1470010 - RNA, 18 nt, Human
acauguaucuaugcauuu

SEQ ID NO: 1470011 - RNA, 21 nt, Human
acauguaucuaugcauuuucu

SEQ ID NO: 1470012 - RNA, 16 nt, Human
acauuggaaacaaguc

SEQ ID NO: 1470013 - RNA, 14 nt, Human
acauuuuacauuaa

SEQ ID NO: 1470014 - RNA, 18 nt, Human
acauuuuacauuaaauuu

SEQ ID NO: 1470015 - RNA, 15 nt, Human
acauuuuacauuaaa

SEQ ID NO: 1470016 - RNA, 14 nt, Human
ucaaggucugcuuu

SEQ ID NO: 1470017 - RNA, 15 nt, Human
ucaaggucugcuuuu

SEQ ID NO: 1470018 - RNA, 16 nt, Human
ucaaggcggugcuuga

SEQ ID NO: 1470019 - RNA, 19 nt, Human
ucaagauuguuccugcuuu

SEQ ID NO: 1470020 - RNA, 21 nt, Human
ucaagcaaacagcuucacaaa

SEQ ID NO: 1470021 - RNA, 16 nt, Human
ucaagauuguuccugc

SEQ ID NO: 1470022 - RNA, 23 nt, Human
ucaauauuucagauaaucacaau

SEQ ID NO: 1470023 - RNA, 19 nt, Human
ucaaucagucucagaaugu

SEQ ID NO: 1470024 - RNA, 22 nt, Human
ucaaucagucucagaaugucau

SEQ ID NO: 1470025 - RNA, 21 nt, Human
ucaaucagucucagaauguca

SEQ ID NO: 1470026 - RNA, 16 nt, Human
ucacagaccuuugaac

SEQ ID NO: 1470027 - RNA, 17 nt, Human
accacacccacacucag

SEQ ID NO: 1470028 - RNA, 19 nt, Human
ucacagcuccaagaauuuc

SEQ ID NO: 1470029 - RNA, 13 nt, Human
ucacauuccugaa

SEQ ID NO: 1470030 - RNA, 17 nt, Human
ucacauuccugaacagg

SEQ ID NO: 1470031 - RNA, 22 nt, Human
ucacauuagaagacaauugaca

SEQ ID NO: 1470032 - RNA, 22 nt, Human
ucacauuccucugcccuuccug

SEQ ID NO: 1470033 - RNA, 20 nt, Human
ucacauuccugaacaggaua

SEQ ID NO: 1470034 - RNA, 20 nt, Human
ucacaugauuccagccauca

SEQ ID NO: 1470035 - RNA, 12 nt, Human
ucacauuagaag

SEQ ID NO: 1470036 - RNA, 14 nt, Human
ucacauuagaagac

SEQ ID NO: 1470037 - RNA, 15 nt, Human
ucacauuagaagaca

SEQ ID NO: 1470038 - RNA, 19 nt, Human
ucacaugauuccagccauc

SEQ ID NO: 1470039 - RNA, 17 nt, Human
ucacaugauuccagcca

SEQ ID NO: 1470040 - RNA, 21 nt, Human
ucacaugauuccagccaucac

SEQ ID NO: 1470041 - RNA, 23 nt, Human
accaaaaaucucaauauuucaga

SEQ ID NO: 1470042 - RNA, 14 nt, Human
accaacauaaaaau

SEQ ID NO: 1470043 - RNA, 15 nt, Human
accaacauaaaaaug

SEQ ID NO: 1470044 - RNA, 23 nt, Human
accaacauaaaaaugaucuaaac

SEQ ID NO: 1470045 - RNA, 16 nt, Human
accacaagacugcaca

SEQ ID NO: 1470046 - RNA, 22 nt, Human
accacaaacuguaauacaauga

SEQ ID NO: 1470047 - RNA, 18 nt, Human
accacaaacuguaauaca

SEQ ID NO: 1470048 - RNA, 20 nt, Human
accacaacuauuuucagaug

SEQ ID NO: 1470049 - RNA, 17 nt, Human
accacaaugcagugccu

SEQ ID NO: 1470050 - RNA, 21 nt, Human
ucacugaacuuugcugagccu

SEQ ID NO: 1470051 - RNA, 18 nt, Human
ucacugagaccaaggcuu

SEQ ID NO: 1470052 - RNA, 16 nt, Human
ucaccagcccuggcaa

SEQ ID NO: 1470053 - RNA, 19 nt, Human
ucacauuccugaacaggau

SEQ ID NO: 1470054 - RNA, 20 nt, Human
ucacucaaggcggugcuuga

SEQ ID NO: 1470055 - RNA, 12 nt, Human
ucacucaaggcg

SEQ ID NO: 1470056 - RNA, 18 nt, Human
ucacugcaaccuccaccu

SEQ ID NO: 1470057 - RNA, 14 nt, Human
ucacugcaaccucc

SEQ ID NO: 1470058 - RNA, 21 nt, Human
ucacugaguuuuccauggcag

SEQ ID NO: 1470059 - RNA, 17 nt, Human
ucacugaguuuuccaug

SEQ ID NO: 1470060 - RNA, 23 nt, Human
ucacugaguuuuccauggcagga

SEQ ID NO: 1470061 - RNA, 18 nt, Human
ucacugcaaccucugccu

SEQ ID NO: 1470062 - RNA, 18 nt, Human
ucacugcaagcuccgccu

SEQ ID NO: 1470063 - RNA, 16 nt, Human
ucacuuaauugcuaca

SEQ ID NO: 1470064 - RNA, 21 nt, Human
ucacuuaggaaauggcuuugu

SEQ ID NO: 1470065 - RNA, 21 nt, Human
ucacuucagguauaccucacu

SEQ ID NO: 1470066 - RNA, 16 nt, Human
ucacuucauaauccag

SEQ ID NO: 1470067 - RNA, 22 nt, Human
accaugucaaggguucaagauu

SEQ ID NO: 1470068 - RNA, 20 nt, Human
accauggccagcuaauuuuu

SEQ ID NO: 1470069 - RNA, 24 nt, Human
accauggacacuacacccagcaau

SEQ ID NO: 1470070 - RNA, 23 nt, Human
accauggacacuacacccagcaa

SEQ ID NO: 1470071 - RNA, 22 nt, Human
accauggacacuacacccagca

SEQ ID NO: 1470072 - RNA, 21 nt, Human
accauggacacuacacccagc

SEQ ID NO: 1470073 - RNA, 18 nt, Human
accaugcugcuggggaag

SEQ ID NO: 1470074 - RNA, 19 nt, Human
accaugcugcuggggaaga

SEQ ID NO: 1470075 - RNA, 21 nt, Human
accaugcugcuggggaagaca

SEQ ID NO: 1470076 - RNA, 22 nt, Human
accaugcugcuggggaagacag

SEQ ID NO: 1470077 - RNA, 23 nt, Human
accaugcugcuggggaagacagu

SEQ ID NO: 1470078 - RNA, 16 nt, Human
accaugcaaaugcuau

SEQ ID NO: 1470079 - RNA, 19 nt, Human
accaugccaggcuaauuuu

SEQ ID NO: 1470080 - RNA, 22 nt, Human
accaugcccggcuaauuuuugu

SEQ ID NO: 1470081 - RNA, 20 nt, Human
accaugccaggcuaauuuuu

SEQ ID NO: 1470082 - RNA, 14 nt, Human
accaugcugcuggg

SEQ ID NO: 1470083 - RNA, 16 nt, Human
accaugcugcugggga

SEQ ID NO: 1470084 - RNA, 17 nt, Human
accaugcugcuggggaa

SEQ ID NO: 1470085 - RNA, 23 nt, Human
accauguuggccaggcuugucuc

SEQ ID NO: 1470086 - RNA, 18 nt, Human
acccaaagagguauuuau

SEQ ID NO: 1470087 - RNA, 22 nt, Human
accccagcuggggccaggcugg

SEQ ID NO: 1470088 - RNA, 19 nt, Human
accccagcuggggccaggc

SEQ ID NO: 1470089 - RNA, 13 nt, Human
acccagggcucug

SEQ ID NO: 1470090 - RNA, 12 nt, Human
acccagggcucu

SEQ ID NO: 1470091 - RNA, 15 nt, Human
acccagggcucugua

SEQ ID NO: 1470092 - RNA, 15 nt, Human
ucagauuucugagga

SEQ ID NO: 1470093 - RNA, 19 nt, Human
ucagauucccagagcaaaa

SEQ ID NO: 1470094 - RNA, 21 nt, Human
ucagauucccagagcaaaaua

SEQ ID NO: 1470095 - RNA, 22 nt, Human
ucagauucccagagcaaaauaa

SEQ ID NO: 1470096 - RNA, 14 nt, Human
acccaggacaggau

SEQ ID NO: 1470097 - RNA, 20 nt, Human
acccaggacaggauccaggc

SEQ ID NO: 1470098 - RNA, 17 nt, Human
acccaggacaggaucca

SEQ ID NO: 1470099 - RNA, 16 nt, Human
ucagaauagaaauuag

SEQ ID NO: 1470100 - RNA, 14 nt, Human
acccagcaauagag

SEQ ID NO: 1470101 - RNA, 13 nt, Human
ucagagaauuucu

SEQ ID NO: 1470102 - RNA, 23 nt, Human
ucagagaauuucuaccauuucag

SEQ ID NO: 1470103 - RNA, 16 nt, Human
ucagagaggccuuuug

SEQ ID NO: 1470104 - RNA, 19 nt, Human
ucagagcaggugcuggcuc

SEQ ID NO: 1470105 - RNA, 20 nt, Human
acccucaugcugugugacuc

SEQ ID NO: 1470106 - RNA, 23 nt, Human
acccuccccgcaccccccaagcu

SEQ ID NO: 1470107 - RNA, 22 nt, Human
acccuccccaaaggcuuugccc

SEQ ID NO: 1470108 - RNA, 17 nt, Human
acccucccucccuaccc

SEQ ID NO: 1470109 - RNA, 11 nt, Human
acccucccucc

SEQ ID NO: 1470110 - RNA, 22 nt, Human
acccugagcugaccagccguga

SEQ ID NO: 1470111 - RNA, 17 nt, Human
acccugccccagcuggg

SEQ ID NO: 1470112 - RNA, 14 nt, Human
ucaggccagagcca

SEQ ID NO: 1470113 - RNA, 17 nt, Human
ucaggccagagccaagg

SEQ ID NO: 1470114 - RNA, 14 nt, Human
ucagguacuuguaa

SEQ ID NO: 1470115 - RNA, 17 nt, Human
ucagguauaccucacuu

SEQ ID NO: 1470116 - RNA, 15 nt, Human
ucagguauaccucac

SEQ ID NO: 1470117 - RNA, 21 nt, Human
accgaacugauguaaguaaac

SEQ ID NO: 1470118 - RNA, 17 nt, Human
acccuugguuccuaacu

SEQ ID NO: 1470119 - RNA, 18 nt, Human
ucaguaauuuagaaauca

SEQ ID NO: 1470120 - RNA, 19 nt, Human
ucaguaauuuagaaaucau

SEQ ID NO: 1470121 - RNA, 20 nt, Human
ucaguaauuuagaaaucauu

SEQ ID NO: 1470122 - RNA, 14 nt, Human
ucaguaauuugagg

SEQ ID NO: 1470123 - RNA, 15 nt, Human
ucaguaauuugagga

SEQ ID NO: 1470124 - RNA, 17 nt, Human
ucaguaauuugaggaca

SEQ ID NO: 1470125 - RNA, 18 nt, Human
ucaguaauuugaggacaa

SEQ ID NO: 1470126 - RNA, 18 nt, Human
ucaguaauuuguuuaaaa

SEQ ID NO: 1470127 - RNA, 18 nt, Human
ucauaaauaaaguuuguu

SEQ ID NO: 1470128 - RNA, 24 nt, Human
ucauaaagcaggcagaacucaucu

SEQ ID NO: 1470129 - RNA, 20 nt, Human
ucauaaguauuaugucucuu

SEQ ID NO: 1470130 - RNA, 21 nt, Human
ucauaagauauuuuucaugau

SEQ ID NO: 1470131 - RNA, 18 nt, Human
ucauaagauauuuuucau

SEQ ID NO: 1470132 - RNA, 14 nt, Human
ucagugcugugcug

SEQ ID NO: 1470133 - RNA, 16 nt, Human
ucagugcugugcugug

SEQ ID NO: 1470134 - RNA, 22 nt, Human
ucagugcugugcugugcuaugg

SEQ ID NO: 1470135 - RNA, 13 nt, Human
ucagugcugugcu

SEQ ID NO: 1470136 - RNA, 21 nt, Human
uccugaaaacccuugccaugu

SEQ ID NO: 1470137 - RNA, 22 nt, Human
uccugaaaacccuugccaugug

SEQ ID NO: 1470138 - RNA, 16 nt, Human
uccucugcccgggagc

SEQ ID NO: 1470139 - RNA, 22 nt, Human
uccucugcccgggagcucagga

SEQ ID NO: 1470140 - RNA, 18 nt, Human
acugaaaauauuguuuua

SEQ ID NO: 1470141 - RNA, 15 nt, Human
acugaaaaugugcua

SEQ ID NO: 1470142 - RNA, 17 nt, Human
acugaaaauuauuuaaa

SEQ ID NO: 1470143 - RNA, 19 nt, Human
acugaaaaugugcuauacu

SEQ ID NO: 1470144 - RNA, 19 nt, Human
acucuuucuuucaauaaaa

SEQ ID NO: 1470145 - RNA, 21 nt, Human
uccugaccccaaguuauccac

SEQ ID NO: 1470146 - RNA, 15 nt, Human
uccugaccucaggca

SEQ ID NO: 1470147 - RNA, 22 nt, Human
uccugaauccaaacuaauccau

SEQ ID NO: 1470148 - RNA, 17 nt, Human
uccucuccccaugaugu

SEQ ID NO: 1470149 - RNA, 13 nt, Human
uccucuccugucu

SEQ ID NO: 1470150 - RNA, 16 nt, Human
uccucucucuguguua

SEQ ID NO: 1470151 - RNA, 19 nt, Human
acucuucuugaaauuuuaa

SEQ ID NO: 1470152 - RNA, 19 nt, Human
acucuugaaaaaugcaugu

SEQ ID NO: 1470153 - RNA, 14 nt, Human
acucuugaaaaaug

SEQ ID NO: 1470154 - RNA, 21 nt, Human
acucuugaaaaaugcauguug

SEQ ID NO: 1470155 - RNA, 23 nt, Human
acucguguguuucuauuuuuuga

SEQ ID NO: 1470156 - RNA, 15 nt, Human
acucguguguuucua

SEQ ID NO: 1470157 - RNA, 19 nt, Human
acucguauagcaugcaucu

SEQ ID NO: 1470158 - RNA, 22 nt, Human
acucgugucuggcacagccugg

SEQ ID NO: 1470159 - RNA, 23 nt, Human
acucgugucuggcacagccuggc

SEQ ID NO: 1470160 - RNA, 13 nt, Human
acucuugaaaaau

SEQ ID NO: 1470161 - RNA, 15 nt, Human
acucuucuugaaauu

SEQ ID NO: 1470162 - RNA, 16 nt, Human
acucuucuugaaauuu

SEQ ID NO: 1470163 - RNA, 23 nt, Human
acucuucugagcaccuacuuaca

SEQ ID NO: 1470164 - RNA, 19 nt, Human
acucuucaaggucugcuuu

SEQ ID NO: 1470165 - RNA, 16 nt, Human
acucuucacucuucaa

SEQ ID NO: 1470166 - RNA, 20 nt, Human
acucuucaaggucugcuuuu

SEQ ID NO: 1470167 - RNA, 15 nt, Human
acucuucacucuuca

SEQ ID NO: 1470168 - RNA, 15 nt, Human
acucuucaaaugccu

SEQ ID NO: 1470169 - RNA, 14 nt, Human
acuccagaaaguga

SEQ ID NO: 1470170 - RNA, 18 nt, Human
acuccagaaagugacaag

SEQ ID NO: 1470171 - RNA, 21 nt, Human
uccgugcuuaaccaaagaagc

SEQ ID NO: 1470172 - RNA, 14 nt, Human
uccgugcuuaacca

SEQ ID NO: 1470173 - RNA, 16 nt, Human
uccgugugggagaccg

SEQ ID NO: 1470174 - RNA, 14 nt, Human
acuccuuucucauc

SEQ ID NO: 1470175 - RNA, 20 nt, Human
acuccuucaacaauucuaaa

SEQ ID NO: 1470176 - RNA, 22 nt, Human
acuccuucaacaauucuaaaau

SEQ ID NO: 1470177 - RNA, 23 nt, Human
acuccuugauuuuagccuucucu

SEQ ID NO: 1470178 - RNA, 21 nt, Human
acuccaaacugacucuuaaga

SEQ ID NO: 1470179 - RNA, 23 nt, Human
acucauuuuucaugauaaugaac

SEQ ID NO: 1470180 - RNA, 20 nt, Human
acucauuuuucaugauaaug

SEQ ID NO: 1470181 - RNA, 13 nt, Human
acuccaaaauguu

SEQ ID NO: 1470182 - RNA, 22 nt, Human
acuccaaaauguuggucauuuu

SEQ ID NO: 1470183 - RNA, 19 nt, Human
acucauuuuucaugauaau

SEQ ID NO: 1470184 - RNA, 16 nt, Human
acucaucuuucccucc

SEQ ID NO: 1470185 - RNA, 13 nt, Human
acucaucuuuccc

SEQ ID NO: 1470186 - RNA, 23 nt, Human
acucaucuagguaaauuacaguu

SEQ ID NO: 1470187 - RNA, 22 nt, Human
acucagauaagguaaaaugcca

SEQ ID NO: 1470188 - RNA, 23 nt, Human
ucccucuuccuucccugcuguga

SEQ ID NO: 1470189 - RNA, 21 nt, Human
ucccucuuccuucccugcugu

SEQ ID NO: 1470190 - RNA, 22 nt, Human
ucccucuuccuucccugcugug

SEQ ID NO: 1470191 - RNA, 20 nt, Human
acuagaguuuagcuggaaaa

SEQ ID NO: 1470192 - RNA, 14 nt, Human
acuagaggugagaa

SEQ ID NO: 1470193 - RNA, 18 nt, Human
acuagaggugagaaauuu

SEQ ID NO: 1470194 - RNA, 21 nt, Human
acuagaggugagaaauuuaaa

SEQ ID NO: 1470195 - RNA, 12 nt, Human
acuagacaagcc

SEQ ID NO: 1470196 - RNA, 15 nt, Human
acuagacaagccaga

SEQ ID NO: 1470197 - RNA, 17 nt, Human
acuagacaagccagaac

SEQ ID NO: 1470198 - RNA, 21 nt, Human
acuagacaagccagaacuuga

SEQ ID NO: 1470199 - RNA, 23 nt, Human
acuacuucuuuuuucaaaagaaa

SEQ ID NO: 1470200 - RNA, 17 nt, Human
acuacuugggagcaccg

SEQ ID NO: 1470201 - RNA, 14 nt, Human
acuacuagggaaau

SEQ ID NO: 1470202 - RNA, 13 nt, Human
acuacgccuggcu

SEQ ID NO: 1470203 - RNA, 15 nt, Human
uccccacuguaucua

SEQ ID NO: 1470204 - RNA, 19 nt, Human
uccccacuguaucuaggca

SEQ ID NO: 1470205 - RNA, 13 nt, Human
uccccaucucagg

SEQ ID NO: 1470206 - RNA, 14 nt, Human
uccccaucucaggc

SEQ ID NO: 1470207 - RNA, 16 nt, Human
acuauguaaacuacuu

SEQ ID NO: 1470208 - RNA, 14 nt, Human
acuauguaaacuac

SEQ ID NO: 1470209 - RNA, 12 nt, Human
acuauguaaacu

SEQ ID NO: 1470210 - RNA, 11 nt, Human
acuauguaaac

SEQ ID NO: 1470211 - RNA, 16 nt, Human
uccccggacucaagcc

SEQ ID NO: 1470212 - RNA, 20 nt, Human
uccaugaccuaguuuuccau

SEQ ID NO: 1470213 - RNA, 14 nt, Human
acggccuuucuagc

SEQ ID NO: 1470214 - RNA, 21 nt, Human
acggccuuucuagccuggcua

SEQ ID NO: 1470215 - RNA, 15 nt, Human
uccagucuuccugac

SEQ ID NO: 1470216 - RNA, 19 nt, Human
uccagucuuccugacacuu

SEQ ID NO: 1470217 - RNA, 21 nt, Human
uccagucuuccugacacuuua

SEQ ID NO: 1470218 - RNA, 22 nt, Human
uccagucuuccugacacuuuaa

SEQ ID NO: 1470219 - RNA, 23 nt, Human
uccagucuuccugacacuuuaau

SEQ ID NO: 1470220 - RNA, 16 nt, Human
uccauccuacccccug

SEQ ID NO: 1470221 - RNA, 13 nt, Human
uccaucccuggcc

SEQ ID NO: 1470222 - RNA, 14 nt, Human
uccaucccuggccc

SEQ ID NO: 1470223 - RNA, 15 nt, Human
uccaucccuggcccc

SEQ ID NO: 1470224 - RNA, 20 nt, Human
uccaucccuggcccccuccc

SEQ ID NO: 1470225 - RNA, 20 nt, Human
uccauccuacccccugugcc

SEQ ID NO: 1470226 - RNA, 22 nt, Human
uccaucccuggcccccucccug

SEQ ID NO: 1470227 - RNA, 23 nt, Human
uccaucccuggcccccucccugg

SEQ ID NO: 1470228 - RNA, 24 nt, Human
uccaucccuggcccccucccugga

SEQ ID NO: 1470229 - RNA, 16 nt, Human
ucccaauugagaaaaa

SEQ ID NO: 1470230 - RNA, 20 nt, Human
ucccaauucauccucacuca

SEQ ID NO: 1470231 - RNA, 18 nt, Human
ucccacagguucaggcga

SEQ ID NO: 1470232 - RNA, 19 nt, Human
ucccacccaauucaaaaca

SEQ ID NO: 1470233 - RNA, 15 nt, Human
acgggguuucaccau

SEQ ID NO: 1470234 - RNA, 15 nt, Human
acggcagccacagcu

SEQ ID NO: 1470235 - RNA, 15 nt, Human
acggauuuauuuuuc

SEQ ID NO: 1470236 - RNA, 15 nt, Human
acgcccaggacccca

SEQ ID NO: 1470237 - RNA, 18 nt, Human
uccacauuucccccuagc

SEQ ID NO: 1470238 - RNA, 22 nt, Human
accugggagaaaucuggcuucu

SEQ ID NO: 1470239 - RNA, 22 nt, Human
uccaauuauaagaggauaugaa

SEQ ID NO: 1470240 - RNA, 23 nt, Human
uccaacaagaagggacugagaga

SEQ ID NO: 1470241 - RNA, 20 nt, Human
uccaaggaggggcuguaaaa

SEQ ID NO: 1470242 - RNA, 22 nt, Human
accuucucuauggggcauccuc

SEQ ID NO: 1470243 - RNA, 23 nt, Human
accuucucuauggggcauccucu

SEQ ID NO: 1470244 - RNA, 19 nt, Human
accuucaguuaugauuuuu

SEQ ID NO: 1470245 - RNA, 21 nt, Human
accuuccuuuuacuuuucuuc

SEQ ID NO: 1470246 - RNA, 20 nt, Human
accuuccuuuuacuuuucuu

SEQ ID NO: 1470247 - RNA, 13 nt, Human
accuuccuuuuac

SEQ ID NO: 1470248 - RNA, 23 nt, Human
accugccucccuucaugcaugga

SEQ ID NO: 1470249 - RNA, 21 nt, Human
accugccucccuucaugcaug

SEQ ID NO: 1470250 - RNA, 22 nt, Human
accugccucccuucaugcaugg

SEQ ID NO: 1470251 - RNA, 14 nt, Human
accugaggcugguu

SEQ ID NO: 1470252 - RNA, 13 nt, Human
accugaugaaaau

SEQ ID NO: 1470253 - RNA, 14 nt, Human
accugaugaaaaua

SEQ ID NO: 1470254 - RNA, 11 nt, Human
accugauuuuu

SEQ ID NO: 1470255 - RNA, 16 nt, Human
accugauuuuuuuucc

SEQ ID NO: 1470256 - RNA, 17 nt, Human
accugauuuuuuuuccu

SEQ ID NO: 1470257 - RNA, 20 nt, Human
accugauuuuuuuuccuuuu

SEQ ID NO: 1470258 - RNA, 15 nt, Human
accugaugaaaauaa

SEQ ID NO: 1470259 - RNA, 18 nt, Human
accugaugaaaauaaaga

SEQ ID NO: 1470260 - RNA, 19 nt, Human
accugaugaaaauaaagaa

SEQ ID NO: 1470261 - RNA, 21 nt, Human
accugaugaaaauaaagaaug

SEQ ID NO: 1470262 - RNA, 22 nt, Human
accugaugaaaauaaagaaugg

SEQ ID NO: 1470263 - RNA, 16 nt, Human
ucauaauaaguugcau

SEQ ID NO: 1470264 - RNA, 16 nt, Human
accugaacugaacacc

SEQ ID NO: 1470265 - RNA, 11 nt, Human
accugaagaau

SEQ ID NO: 1470266 - RNA, 14 nt, Human
accugaagaaucac

SEQ ID NO: 1470267 - RNA, 16 nt, Human
accugaagaaucacaa

SEQ ID NO: 1470268 - RNA, 22 nt, Human
accugaagcuaucguaaaauua

SEQ ID NO: 1470269 - RNA, 15 nt, Human
accugaccccugcuc

SEQ ID NO: 1470270 - RNA, 16 nt, Human
accugcucagcccugc

SEQ ID NO: 1470271 - RNA, 17 nt, Human
accugcucagcccugca

SEQ ID NO: 1470272 - RNA, 15 nt, Human
ucauuuuuccguaaa

SEQ ID NO: 1470273 - RNA, 14 nt, Human
ucauuuugguacuu

SEQ ID NO: 1470274 - RNA, 16 nt, Human
accuggagauggugga

SEQ ID NO: 1470275 - RNA, 12 nt, Human
ucauuuucucua

SEQ ID NO: 1470276 - RNA, 13 nt, Human
ucauuuucucuaa

SEQ ID NO: 1470277 - RNA, 15 nt, Human
ucauuuucucuaaua

SEQ ID NO: 1470278 - RNA, 16 nt, Human
ucauuuucucuaauau

SEQ ID NO: 1470279 - RNA, 15 nt, Human
uagaaacacaacuau

SEQ ID NO: 1470280 - RNA, 22 nt, Human
uagaaaauuuaaaacauuacuc

SEQ ID NO: 1470281 - RNA, 11 nt, Human
uagaaaacuuu

SEQ ID NO: 1470282 - RNA, 16 nt, Human
uagaaaacuuuaaagc

SEQ ID NO: 1470283 - RNA, 15 nt, Human
uagaaaacuuuaaag

SEQ ID NO: 1470284 - RNA, 21 nt, Human
uagaaaaggcuagguacacag

SEQ ID NO: 1470285 - RNA, 17 nt, Human
uagaaaauuuaaaacau

SEQ ID NO: 1470286 - RNA, 18 nt, Human
uagaagacaaaauguuca

SEQ ID NO: 1470287 - RNA, 15 nt, Human
uagaaaaaaaauuau

SEQ ID NO: 1470288 - RNA, 16 nt, Human
uagaaaacauaaucuu

SEQ ID NO: 1470289 - RNA, 21 nt, Human
uacuuuuaaacuguguacaua

SEQ ID NO: 1470290 - RNA, 23 nt, Human
uacuuuuacaaguaacaaaaaua

SEQ ID NO: 1470291 - RNA, 20 nt, Human
uacuuuuacaaguaacaaaa

SEQ ID NO: 1470292 - RNA, 21 nt, Human
uacuuuucuucuauugccucu

SEQ ID NO: 1470293 - RNA, 14 nt, Human
uacuuuuuaaaugu

SEQ ID NO: 1470294 - RNA, 22 nt, Human
uacuuuucuucuauugccucug

SEQ ID NO: 1470295 - RNA, 21 nt, Human
aauucauuaaucugccucccu

SEQ ID NO: 1470296 - RNA, 22 nt, Human
uacuuugguggccacauaagcc

SEQ ID NO: 1470297 - RNA, 22 nt, Human
uagaauuugauaugugaacagu

SEQ ID NO: 1470298 - RNA, 20 nt, Human
uagaauuugauaugugaaca

SEQ ID NO: 1470299 - RNA, 20 nt, Human
uagaagacaauugacaacag

SEQ ID NO: 1470300 - RNA, 13 nt, Human
uagacacacauga

SEQ ID NO: 1470301 - RNA, 16 nt, Human
uagacacgcacggcag

SEQ ID NO: 1470302 - RNA, 12 nt, Human
uagacagaagaa

SEQ ID NO: 1470303 - RNA, 14 nt, Human
uagacagaagaaac

SEQ ID NO: 1470304 - RNA, 15 nt, Human
uagacagaagaaaca

SEQ ID NO: 1470305 - RNA, 13 nt, Human
uagaccaaaauaa

SEQ ID NO: 1470306 - RNA, 14 nt, Human
uagaccaaaauaaa

SEQ ID NO: 1470307 - RNA, 12 nt, Human
aauuuuacauuu

SEQ ID NO: 1470308 - RNA, 20 nt, Human
aauuuuacauggcuggagcu

SEQ ID NO: 1470309 - RNA, 16 nt, Human
acaaaaagcuacuuau

SEQ ID NO: 1470310 - RNA, 12 nt, Human
acaaaaauaaaa

SEQ ID NO: 1470311 - RNA, 16 nt, Human
acaaaaauacucagau

SEQ ID NO: 1470312 - RNA, 12 nt, Human
acaaaauaaaca

SEQ ID NO: 1470313 - RNA, 14 nt, Human
acaaaauaaacaaa

SEQ ID NO: 1470314 - RNA, 22 nt, Human
acaaaaguuucauccuuuucau

SEQ ID NO: 1470315 - RNA, 14 nt, Human
acaaauaauuuaga

SEQ ID NO: 1470316 - RNA, 13 nt, Human
acaaauaauuuag

SEQ ID NO: 1470317 - RNA, 16 nt, Human
acaaauaacaaugugc

SEQ ID NO: 1470318 - RNA, 21 nt, Human
acaaagguuuuccucuucuau

SEQ ID NO: 1470319 - RNA, 24 nt, Human
acaaagguugagauguaaaaggua

SEQ ID NO: 1470320 - RNA, 21 nt, Human
uagaggccugacugccaagcc

SEQ ID NO: 1470321 - RNA, 22 nt, Human
uagaggccugacugccaagcca

SEQ ID NO: 1470322 - RNA, 16 nt, Human
uagaggcuuccuucau

SEQ ID NO: 1470323 - RNA, 17 nt, Human
uagaggcuuccuucauu

SEQ ID NO: 1470324 - RNA, 18 nt, Human
uagaggcuuccuucauuu

SEQ ID NO: 1470325 - RNA, 19 nt, Human
uagaggcuuccuucauuuc

SEQ ID NO: 1470326 - RNA, 14 nt, Human
uagaggguguguaa

SEQ ID NO: 1470327 - RNA, 23 nt, Human
uagagggaggagaaugagccucg

SEQ ID NO: 1470328 - RNA, 14 nt, Human
uagcaaaagaagaa

SEQ ID NO: 1470329 - RNA, 16 nt, Human
uagcaaaagaagaagu

SEQ ID NO: 1470330 - RNA, 12 nt, Human
uagcaaagaauu

SEQ ID NO: 1470331 - RNA, 14 nt, Human
uagcaaagaauuga

SEQ ID NO: 1470332 - RNA, 16 nt, Human
uagcaaagauaucuca

SEQ ID NO: 1470333 - RNA, 13 nt, Human
uagcacaaguuau

SEQ ID NO: 1470334 - RNA, 19 nt, Human
uagcacaaguuauuuaaau

SEQ ID NO: 1470335 - RNA, 14 nt, Human
uagcuaaguacaca

SEQ ID NO: 1470336 - RNA, 22 nt, Human
uagcguuuuuuaaauguauacu

SEQ ID NO: 1470337 - RNA, 16 nt, Human
uagcuuuaacuuaaau

SEQ ID NO: 1470338 - RNA, 22 nt, Human
uagcuuuaacuuaaauaguauu

SEQ ID NO: 1470339 - RNA, 13 nt, Human
uagcuuuuuucuc

SEQ ID NO: 1470340 - RNA, 23 nt, Human
uagcuuuuuucucugauacagaa

SEQ ID NO: 1470341 - RNA, 15 nt, Human
uagcuuugcucuuug

SEQ ID NO: 1470342 - RNA, 11 nt, Human
uagcuuugcuc

SEQ ID NO: 1470343 - RNA, 18 nt, Human
uagcguuuuuuaaaugua

SEQ ID NO: 1470344 - RNA, 17 nt, Human
uagcguuuuuuaaaugu

SEQ ID NO: 1470345 - RNA, 16 nt, Human
uagcguuuuuuaaaug

SEQ ID NO: 1470346 - RNA, 17 nt, Human
uagcgugcucacugacc

SEQ ID NO: 1470347 - RNA, 21 nt, Human
uagcgcuaucucccugccucc

SEQ ID NO: 1470348 - RNA, 16 nt, Human
uagcgugcucacugac

SEQ ID NO: 1470349 - RNA, 21 nt, Human
acaaaucucaagcaaacagcu

SEQ ID NO: 1470350 - RNA, 23 nt, Human
uaggggcuuauaauaaaggacug

SEQ ID NO: 1470351 - RNA, 22 nt, Human
uaggggcuuauaauaaaggacu

SEQ ID NO: 1470352 - RNA, 21 nt, Human
uaggggcuuauaauaaaggac

SEQ ID NO: 1470353 - RNA, 23 nt, Human
uagggcaauuaauuccuucagca

SEQ ID NO: 1470354 - RNA, 21 nt, Human
uagggcaauuaauuccuucag

SEQ ID NO: 1470355 - RNA, 18 nt, Human
uagggcaauuaauuccuu

SEQ ID NO: 1470356 - RNA, 18 nt, Human
uagggaaaacauuccauc

SEQ ID NO: 1470357 - RNA, 16 nt, Human
uagggaaaacauucca

SEQ ID NO: 1470358 - RNA, 13 nt, Human
uagggaaaacauu

SEQ ID NO: 1470359 - RNA, 19 nt, Human
uaggaaagaccauuuuucc

SEQ ID NO: 1470360 - RNA, 20 nt, Human
uaggaucauuuguuggaaug

SEQ ID NO: 1470361 - RNA, 21 nt, Human
uaggauccagugauccuuaca

SEQ ID NO: 1470362 - RNA, 16 nt, Human
uaggauuuauuuaaaa

SEQ ID NO: 1470363 - RNA, 17 nt, Human
uaggauuuauuuaaaau

SEQ ID NO: 1470364 - RNA, 22 nt, Human
uaggauuuauuuaaaauagcaa

SEQ ID NO: 1470365 - RNA, 21 nt, Human
uaggauuuauuuaaaauagca

SEQ ID NO: 1470366 - RNA, 21 nt, Human
uaggauuuuuuuuaauguuua

SEQ ID NO: 1470367 - RNA, 22 nt, Human
uaggauuuuuuuuaauguuuaa

SEQ ID NO: 1470368 - RNA, 12 nt, Human
uaggcaacauag

SEQ ID NO: 1470369 - RNA, 12 nt, Human
uaguaaucauau

SEQ ID NO: 1470370 - RNA, 17 nt, Human
uaguaaucugcauuauu

SEQ ID NO: 1470371 - RNA, 14 nt, Human
uaguaaucugcauu

SEQ ID NO: 1470372 - RNA, 23 nt, Human
uagguuuuaauaauuuuuuaauu

SEQ ID NO: 1470373 - RNA, 15 nt, Human
uagguuuuuguuugu

SEQ ID NO: 1470374 - RNA, 13 nt, Human
acacaauaagcaa

SEQ ID NO: 1470375 - RNA, 14 nt, Human
acacaauaagcaaa

SEQ ID NO: 1470376 - RNA, 13 nt, Human
acacaacuauauu

SEQ ID NO: 1470377 - RNA, 14 nt, Human
acacaacuauauug

SEQ ID NO: 1470378 - RNA, 18 nt, Human
acacaaauuaucuuaaaa

SEQ ID NO: 1470379 - RNA, 22 nt, Human
acaaugauccuguauucagaca

SEQ ID NO: 1470380 - RNA, 21 nt, Human
acaaugaucaccgacugaaaa

SEQ ID NO: 1470381 - RNA, 20 nt, Human
acaaugauccuguauucaga

SEQ ID NO: 1470382 - RNA, 16 nt, Human
uagguaaauuacaguu

SEQ ID NO: 1470383 - RNA, 19 nt, Human
uaggguuucccuacugaag

SEQ ID NO: 1470384 - RNA, 19 nt, Human
uaggguuugugacagggcg

SEQ ID NO: 1470385 - RNA, 13 nt, Human
uaucuauagcuaa

SEQ ID NO: 1470386 - RNA, 22 nt, Human
uaucuaguuuaauuaaucugua

SEQ ID NO: 1470387 - RNA, 22 nt, Human
uaucccaccugacauguccuuc

SEQ ID NO: 1470388 - RNA, 16 nt, Human
uauccccauuucuuuu

SEQ ID NO: 1470389 - RNA, 23 nt, Human
uauccaccaaaagggcucccuga

SEQ ID NO: 1470390 - RNA, 14 nt, Human
acagaccuuugaac

SEQ ID NO: 1470391 - RNA, 15 nt, Human
uaucaaaucuaccac

SEQ ID NO: 1470392 - RNA, 19 nt, Human
uaucaauuaccacaccauc

SEQ ID NO: 1470393 - RNA, 17 nt, Human
acacuuacuuuuucugg

SEQ ID NO: 1470394 - RNA, 20 nt, Human
acacuuauuggaacucugcu

SEQ ID NO: 1470395 - RNA, 24 nt, Human
acagaaaugauuacuaaggaagau

SEQ ID NO: 1470396 - RNA, 13 nt, Human
acagaaagcugcc

SEQ ID NO: 1470397 - RNA, 13 nt, Human
acacuugcaaccu

SEQ ID NO: 1470398 - RNA, 14 nt, Human
acacuugguaauug

SEQ ID NO: 1470399 - RNA, 19 nt, Human
acagaaaaauauguaccaa

SEQ ID NO: 1470400 - RNA, 23 nt, Human
uauauauguguaugcacaguaaa

SEQ ID NO: 1470401 - RNA, 21 nt, Human
uauauauguguaugcacagua

SEQ ID NO: 1470402 - RNA, 19 nt, Human
uauauauguacaguuaucu

SEQ ID NO: 1470403 - RNA, 17 nt, Human
uauauauguacaguuau

SEQ ID NO: 1470404 - RNA, 14 nt, Human
uauauauuaucuuu

SEQ ID NO: 1470405 - RNA, 18 nt, Human
uauauauuaucuuuucau

SEQ ID NO: 1470406 - RNA, 14 nt, Human
uauauauguacagu

SEQ ID NO: 1470407 - RNA, 19 nt, Human
uauauauuuuuuucugaaa

SEQ ID NO: 1470408 - RNA, 20 nt, Human
uauauauuuuuuucugaaau

SEQ ID NO: 1470409 - RNA, 21 nt, Human
uauaucuauauuuuacauaaa

SEQ ID NO: 1470410 - RNA, 19 nt, Human
acacucaugcauuguccuc

SEQ ID NO: 1470411 - RNA, 18 nt, Human
uauagccaaaaauagcua

SEQ ID NO: 1470412 - RNA, 19 nt, Human
uauagccaaaaauagcuaa

SEQ ID NO: 1470413 - RNA, 22 nt, Human
uauagccaaaaauagcuaaaua

SEQ ID NO: 1470414 - RNA, 15 nt, Human
uauaggaucauuugu

SEQ ID NO: 1470415 - RNA, 19 nt, Human
uauaggauuuauuuaaaau

SEQ ID NO: 1470416 - RNA, 21 nt, Human
uauaggauuuauuuaaaauag

SEQ ID NO: 1470417 - RNA, 19 nt, Human
uauaagugauugcugguuu

SEQ ID NO: 1470418 - RNA, 16 nt, Human
uauaacuggaaagaag

SEQ ID NO: 1470419 - RNA, 18 nt, Human
uagucaccagagacuuua

SEQ ID NO: 1470420 - RNA, 15 nt, Human
uagucaccagagacu

SEQ ID NO: 1470421 - RNA, 22 nt, Human
uauaauuguuuuaucugaauuu

SEQ ID NO: 1470422 - RNA, 18 nt, Human
uauaauuguuuuaucuga

SEQ ID NO: 1470423 - RNA, 13 nt, Human
uauagaucagcca

SEQ ID NO: 1470424 - RNA, 15 nt, Human
uaugccccauucaac

SEQ ID NO: 1470425 - RNA, 17 nt, Human
uaugccauauaauucac

SEQ ID NO: 1470426 - RNA, 20 nt, Human
uaugccaccugaauaaagaa

SEQ ID NO: 1470427 - RNA, 14 nt, Human
uaugcauuauauca

SEQ ID NO: 1470428 - RNA, 17 nt, Human
uaugauacuugaaaauu

SEQ ID NO: 1470429 - RNA, 22 nt, Human
uaugauauuuucugugccugaa

SEQ ID NO: 1470430 - RNA, 15 nt, Human
uaugauauuuucugu

SEQ ID NO: 1470431 - RNA, 16 nt, Human
uaugcauuauaucaaa

SEQ ID NO: 1470432 - RNA, 15 nt, Human
uaucuauauuuuaca

SEQ ID NO: 1470433 - RNA, 15 nt, Human
acagcaauuccucag

SEQ ID NO: 1470434 - RNA, 17 nt, Human
acagcaauuccucaggc

SEQ ID NO: 1470435 - RNA, 19 nt, Human
acagcaauuccucaggcua

SEQ ID NO: 1470436 - RNA, 13 nt, Human
acagcagacucag

SEQ ID NO: 1470437 - RNA, 18 nt, Human
acagcagacucagcucug

SEQ ID NO: 1470438 - RNA, 19 nt, Human
acagcagacucagcucuga

SEQ ID NO: 1470439 - RNA, 23 nt, Human
acagcagacucagcucugacauu

SEQ ID NO: 1470440 - RNA, 14 nt, Human
uaugaaaaagaaga

SEQ ID NO: 1470441 - RNA, 15 nt, Human
uaugaaaaagaagaa

SEQ ID NO: 1470442 - RNA, 14 nt, Human
uaugaaaagcuaga

SEQ ID NO: 1470443 - RNA, 19 nt, Human
uaugaaaagcuagaauuga

SEQ ID NO: 1470444 - RNA, 19 nt, Human
acagcccuucuuuccacag

SEQ ID NO: 1470445 - RNA, 23 nt, Human
uaugaagcuuuuaugugaaacau

SEQ ID NO: 1470446 - RNA, 21 nt, Human
uaugaaggcuguacacugcac

SEQ ID NO: 1470447 - RNA, 22 nt, Human
uaugaagcuuuuaugugaaaca

SEQ ID NO: 1470448 - RNA, 20 nt, Human
uaugaagcuuuuaugugaaa

SEQ ID NO: 1470449 - RNA, 14 nt, Human
acagcuguaugauu

SEQ ID NO: 1470450 - RNA, 19 nt, Human
acagcuguaugauucccag

SEQ ID NO: 1470451 - RNA, 20 nt, Human
acagcuguaugauucccagc

SEQ ID NO: 1470452 - RNA, 23 nt, Human
acagcuguaugauucccagccag

SEQ ID NO: 1470453 - RNA, 18 nt, Human
acagcucagaaguuucuu

SEQ ID NO: 1470454 - RNA, 20 nt, Human
acagcuucucauccugcagg

SEQ ID NO: 1470455 - RNA, 21 nt, Human
acagcuucucauccugcaggc

SEQ ID NO: 1470456 - RNA, 22 nt, Human
acaggaaccacaagacugcaca

SEQ ID NO: 1470457 - RNA, 19 nt, Human
acaggccucacacacaaug

SEQ ID NO: 1470458 - RNA, 14 nt, Human
uaugucucuucuga

SEQ ID NO: 1470459 - RNA, 19 nt, Human
uaugucucuucugagcuau

SEQ ID NO: 1470460 - RNA, 18 nt, Human
uaauuuuuauauuugaaa

SEQ ID NO: 1470461 - RNA, 16 nt, Human
uaauuuauaaaaaggu

SEQ ID NO: 1470462 - RNA, 19 nt, Human
uaauuuuuauauuugaaau

SEQ ID NO: 1470463 - RNA, 21 nt, Human
uaauuuuuauauuugaaauau

SEQ ID NO: 1470464 - RNA, 14 nt, Human
uaauuuagaaaacu

SEQ ID NO: 1470465 - RNA, 15 nt, Human
uaauuuagaaaacuu

SEQ ID NO: 1470466 - RNA, 16 nt, Human
uaauuuagaaaacuuu

SEQ ID NO: 1470467 - RNA, 17 nt, Human
uaauuuagaaaacuuua

SEQ ID NO: 1470468 - RNA, 21 nt, Human
uaauuuagaaaacuuuaaagc

SEQ ID NO: 1470469 - RNA, 14 nt, Human
uaauuuagaaauca

SEQ ID NO: 1470470 - RNA, 15 nt, Human
uaauuuagaaaucau

SEQ ID NO: 1470471 - RNA, 21 nt, Human
uaauuuagacuucaagcaugg

SEQ ID NO: 1470472 - RNA, 16 nt, Human
uaauuuaguuucauau

SEQ ID NO: 1470473 - RNA, 17 nt, Human
uaauuuaguuucauaua

SEQ ID NO: 1470474 - RNA, 13 nt, Human
uaauuuauaaaaa

SEQ ID NO: 1470475 - RNA, 22 nt, Human
uaauuccguagguuauuuucag

SEQ ID NO: 1470476 - RNA, 11 nt, Human
aaugauuucag

SEQ ID NO: 1470477 - RNA, 15 nt, Human
aaugcaccuaaagaa

SEQ ID NO: 1470478 - RNA, 16 nt, Human
aaugcaccuaaagaaa

SEQ ID NO: 1470479 - RNA, 22 nt, Human
aaugagaaaucuaaaaaacgaa

SEQ ID NO: 1470480 - RNA, 12 nt, Human
aaugagaaaucu

SEQ ID NO: 1470481 - RNA, 22 nt, Human
aaugagagacacacugaagaag

SEQ ID NO: 1470482 - RNA, 14 nt, Human
aaucuguaaacugu

SEQ ID NO: 1470483 - RNA, 15 nt, Human
aaucuguaaacugug

SEQ ID NO: 1470484 - RNA, 16 nt, Human
aaucuguaaacugugu

SEQ ID NO: 1470485 - RNA, 21 nt, Human
aaucuguaaacuguguauucc

SEQ ID NO: 1470486 - RNA, 23 nt, Human
aaucuguaaacuguguauuccaa

SEQ ID NO: 1470487 - RNA, 15 nt, Human
aaugaggucagcaug

SEQ ID NO: 1470488 - RNA, 19 nt, Human
aaugaggucagcaugucua

SEQ ID NO: 1470489 - RNA, 13 nt, Human
aaugauuucaugc

SEQ ID NO: 1470490 - RNA, 22 nt, Human
aaugauuucaugcuaucucugu

SEQ ID NO: 1470491 - RNA, 15 nt, Human
aaugauuguaguaau

SEQ ID NO: 1470492 - RNA, 14 nt, Human
uacacccagcaaua

SEQ ID NO: 1470493 - RNA, 12 nt, Human
uacacccagcaa

SEQ ID NO: 1470494 - RNA, 11 nt, Human
uacacccagca

SEQ ID NO: 1470495 - RNA, 14 nt, Human
uacacccaaagagg

SEQ ID NO: 1470496 - RNA, 22 nt, Human
aauggaggggcagagccaggaa

SEQ ID NO: 1470497 - RNA, 21 nt, Human
aauggaggggcagagccagga

SEQ ID NO: 1470498 - RNA, 20 nt, Human
aauggaggggcagagccagg

SEQ ID NO: 1470499 - RNA, 19 nt, Human
aauggaggggcagagccag

SEQ ID NO: 1470500 - RNA, 17 nt, Human
aauggaggccauugugu

SEQ ID NO: 1470501 - RNA, 14 nt, Human
aauguaaagccaug

SEQ ID NO: 1470502 - RNA, 15 nt, Human
aauguaaagccaugc

SEQ ID NO: 1470503 - RNA, 19 nt, Human
aauguaaagcuugucugau

SEQ ID NO: 1470504 - RNA, 16 nt, Human
aauguaaauauuuuaa

SEQ ID NO: 1470505 - RNA, 17 nt, Human
aauguaaauauuuuaaa

SEQ ID NO: 1470506 - RNA, 19 nt, Human
aauguaaauauuuuaaaga

SEQ ID NO: 1470507 - RNA, 20 nt, Human
aauguaaauauuuuaaagaa

SEQ ID NO: 1470508 - RNA, 21 nt, Human
aauguaaauauuuuaaagaau

SEQ ID NO: 1470509 - RNA, 16 nt, Human
aauguaauagggaaaa

SEQ ID NO: 1470510 - RNA, 22 nt, Human
aaugcuguauuuuaaaagaaug

SEQ ID NO: 1470511 - RNA, 21 nt, Human
aaugcuguauuuuaaaagaau

SEQ ID NO: 1470512 - RNA, 21 nt, Human
uaauuuuuuucaccuagauuu

SEQ ID NO: 1470513 - RNA, 21 nt, Human
uaauuuuugauacuaagcauu

SEQ ID NO: 1470514 - RNA, 20 nt, Human
uaauuuuugauacuaagcau

SEQ ID NO: 1470515 - RNA, 23 nt, Human
uaauuuuugauacuaagcauuga

SEQ ID NO: 1470516 - RNA, 17 nt, Human
uaauuuuucacuucaaa

SEQ ID NO: 1470517 - RNA, 23 nt, Human
uaauuuuuauuuuugcugagacu

SEQ ID NO: 1470518 - RNA, 19 nt, Human
uacaauuaaagcuguuauu

SEQ ID NO: 1470519 - RNA, 17 nt, Human
uacccuaaccaaguucc

SEQ ID NO: 1470520 - RNA, 16 nt, Human
uacccuaaccaaguuc

SEQ ID NO: 1470521 - RNA, 14 nt, Human
uacccuaaccaagu

SEQ ID NO: 1470522 - RNA, 17 nt, Human
uacccguucacauuuuu

SEQ ID NO: 1470523 - RNA, 15 nt, Human
uacccccugugccuu

SEQ ID NO: 1470524 - RNA, 23 nt, Human
uaccugaagcuaucguaaaauua

SEQ ID NO: 1470525 - RNA, 13 nt, Human
aauuacauuugua

SEQ ID NO: 1470526 - RNA, 14 nt, Human
aauuacauuuguau

SEQ ID NO: 1470527 - RNA, 12 nt, Human
uaccugauuuuu

SEQ ID NO: 1470528 - RNA, 18 nt, Human
uaccugauuuuuuuuccu

SEQ ID NO: 1470529 - RNA, 12 nt, Human
uaccugugccug

SEQ ID NO: 1470530 - RNA, 13 nt, Human
uaccuguugagca

SEQ ID NO: 1470531 - RNA, 14 nt, Human
uaccuguugagcau

SEQ ID NO: 1470532 - RNA, 21 nt, Human
uaccuguugagcaucacagaa

SEQ ID NO: 1470533 - RNA, 22 nt, Human
aauuaugugacauuuuacauua

SEQ ID NO: 1470534 - RNA, 22 nt, Human
aauuaugugccagauuuaugca

SEQ ID NO: 1470535 - RNA, 20 nt, Human
aauuaugugacauuuuacau

SEQ ID NO: 1470536 - RNA, 17 nt, Human
aauuaugugacauuuua

SEQ ID NO: 1470537 - RNA, 15 nt, Human
aauuaugugacauuu

SEQ ID NO: 1470538 - RNA, 15 nt, Human
aauuaccaaccuguu

SEQ ID NO: 1470539 - RNA, 21 nt, Human
aauuaccacaccaucucccau

SEQ ID NO: 1470540 - RNA, 16 nt, Human
aauuauuguuuuucuu

SEQ ID NO: 1470541 - RNA, 22 nt, Human
aauuauuuaaaccgcuaaaaga

SEQ ID NO: 1470542 - RNA, 21 nt, Human
aauuauuguacauuuauaguu

SEQ ID NO: 1470543 - RNA, 12 nt, Human
aauuauuguaca

SEQ ID NO: 1470544 - RNA, 15 nt, Human
aauucaauucaaagc

SEQ ID NO: 1470545 - RNA, 13 nt, Human
aauucaauucaaa

SEQ ID NO: 1470546 - RNA, 22 nt, Human
aauguuaugacuauguaaacua

SEQ ID NO: 1470547 - RNA, 19 nt, Human
aauguuaugacuauguaaa

SEQ ID NO: 1470548 - RNA, 18 nt, Human
aauguucacaauauauuu

SEQ ID NO: 1470549 - RNA, 17 nt, Human
aauguuagccucaauuu

SEQ ID NO: 1470550 - RNA, 21 nt, Human
aauguggccccugaacaagaa

SEQ ID NO: 1470551 - RNA, 23 nt, Human
aauguuggucauuuuauguuaag

SEQ ID NO: 1470552 - RNA, 12 nt, Human
aauguucaucau

SEQ ID NO: 1470553 - RNA, 13 nt, Human
uacauuuccuaaa

SEQ ID NO: 1470554 - RNA, 14 nt, Human
uacauuccaacucg

SEQ ID NO: 1470555 - RNA, 13 nt, Human
aauguuuaaaaca

SEQ ID NO: 1470556 - RNA, 12 nt, Human
uaccagaugcag

SEQ ID NO: 1470557 - RNA, 17 nt, Human
uaccaggcaccaaaaga

SEQ ID NO: 1470558 - RNA, 18 nt, Human
uaccaggcaccaaaagaa

SEQ ID NO: 1470559 - RNA, 21 nt, Human
uaccaggcaccaaaagaagua

SEQ ID NO: 1470560 - RNA, 14 nt, Human
uaccagucucacau

SEQ ID NO: 1470561 - RNA, 13 nt, Human
uaagacaaauaug

SEQ ID NO: 1470562 - RNA, 23 nt, Human
uaagacaaaaagcuacuuauugu

SEQ ID NO: 1470563 - RNA, 20 nt, Human
uaagacggauuuauuuuucc

SEQ ID NO: 1470564 - RNA, 21 nt, Human
uaacuucccugaaaaaucuaa

SEQ ID NO: 1470565 - RNA, 17 nt, Human
uaacguauaaaagccug

SEQ ID NO: 1470566 - RNA, 13 nt, Human
uaacguauaaaag

SEQ ID NO: 1470567 - RNA, 17 nt, Human
uaacguuuaagccaaaa

SEQ ID NO: 1470568 - RNA, 20 nt, Human
uaacguuuaagccaaaacaa

SEQ ID NO: 1470569 - RNA, 20 nt, Human
uaacuucccugaaaaaucua

SEQ ID NO: 1470570 - RNA, 23 nt, Human
uaacuauaguccagcuuuguucu

SEQ ID NO: 1470571 - RNA, 15 nt, Human
uaacuuaauugcuau

SEQ ID NO: 1470572 - RNA, 19 nt, Human
uaacaugaauauuuagugu

SEQ ID NO: 1470573 - RNA, 21 nt, Human
uaacaugaauauuuaguguuc

SEQ ID NO: 1470574 - RNA, 20 nt, Human
uaacaugaauauuuaguguu

SEQ ID NO: 1470575 - RNA, 21 nt, Human
aauauauuuuaagacgaaaca

SEQ ID NO: 1470576 - RNA, 21 nt, Human
aauauauucagccuggcuuca

SEQ ID NO: 1470577 - RNA, 21 nt, Human
aauagcuaaauaccucaauca

SEQ ID NO: 1470578 - RNA, 23 nt, Human
aauaccacaggaaccacaagacu

SEQ ID NO: 1470579 - RNA, 18 nt, Human
aauacagcaacaauuuau

SEQ ID NO: 1470580 - RNA, 21 nt, Human
aauacaugcuaagagaaguag

SEQ ID NO: 1470581 - RNA, 22 nt, Human
aauacaugcuaagagaaguaga

SEQ ID NO: 1470582 - RNA, 23 nt, Human
aauacaugcuaagagaaguagaa

SEQ ID NO: 1470583 - RNA, 21 nt, Human
aauacccaugucuacacagau

SEQ ID NO: 1470584 - RNA, 13 nt, Human
aauagcaaaagaa

SEQ ID NO: 1470585 - RNA, 16 nt, Human
aauagcaaaagaagaa

SEQ ID NO: 1470586 - RNA, 19 nt, Human
aauagcaaaagaagaaguu

SEQ ID NO: 1470587 - RNA, 20 nt, Human
aauagcaaaagaagaaguuu

SEQ ID NO: 1470588 - RNA, 14 nt, Human
aauagcaaagaauu

SEQ ID NO: 1470589 - RNA, 15 nt, Human
aauagcaaagaauug

SEQ ID NO: 1470590 - RNA, 18 nt, Human
aauagcaaagaauugacu

SEQ ID NO: 1470591 - RNA, 13 nt, Human
uaacaaugcugua

SEQ ID NO: 1470592 - RNA, 20 nt, Human
uaaauguuaugacuauguaa

SEQ ID NO: 1470593 - RNA, 18 nt, Human
uaaauuauuguuuuucuu

SEQ ID NO: 1470594 - RNA, 21 nt, Human
uaaauguuaugacuauguaaa

SEQ ID NO: 1470595 - RNA, 19 nt, Human
uaaauguuaugacuaugua

SEQ ID NO: 1470596 - RNA, 12 nt, Human
uaaaugaagaaa

SEQ ID NO: 1470597 - RNA, 19 nt, Human
uaaaucuuuuauaggauuu

SEQ ID NO: 1470598 - RNA, 23 nt, Human
uaaaucuuuuauaggauuuauuu

SEQ ID NO: 1470599 - RNA, 11 nt, Human
aaucuguaaaa

SEQ ID NO: 1470600 - RNA, 11 nt, Human
aaucuguaaac

SEQ ID NO: 1470601 - RNA, 12 nt, Human
aaucuguaaacu

SEQ ID NO: 1470602 - RNA, 17 nt, Human
aaucuauuuuguaacuu

SEQ ID NO: 1470603 - RNA, 14 nt, Human
aaucuauuuuguaa

SEQ ID NO: 1470604 - RNA, 18 nt, Human
aauccucucucuguguua

SEQ ID NO: 1470605 - RNA, 18 nt, Human
aauccccaacaugcacug

SEQ ID NO: 1470606 - RNA, 13 nt, Human
aauccccuucucc

SEQ ID NO: 1470607 - RNA, 14 nt, Human
aauccccuucuccc

SEQ ID NO: 1470608 - RNA, 15 nt, Human
aauccccuucucccc

SEQ ID NO: 1470609 - RNA, 16 nt, Human
aauccccuucuccccu

SEQ ID NO: 1470610 - RNA, 17 nt, Human
aauccccuucuccccug

SEQ ID NO: 1470611 - RNA, 20 nt, Human
aauccccuucuccccugcac

SEQ ID NO: 1470612 - RNA, 23 nt, Human
aauccccuucuccccugcacugu

SEQ ID NO: 1470613 - RNA, 13 nt, Human
uaauaaaaauaaa

SEQ ID NO: 1470614 - RNA, 20 nt, Human
aaucauaagauauuuuucau

SEQ ID NO: 1470615 - RNA, 23 nt, Human
aaucauaagauauuuuucaugau

SEQ ID NO: 1470616 - RNA, 17 nt, Human
uaaguguguguuuuuca

SEQ ID NO: 1470617 - RNA, 14 nt, Human
uaaguuaauuuaaa

SEQ ID NO: 1470618 - RNA, 12 nt, Human
uaaguauuuagg

SEQ ID NO: 1470619 - RNA, 20 nt, Human
uaaguauuuagguuuuuguu

SEQ ID NO: 1470620 - RNA, 17 nt, Human
uaaguuuauuucuuaaa

SEQ ID NO: 1470621 - RNA, 13 nt, Human
uaauaaaaagauu

SEQ ID NO: 1470622 - RNA, 16 nt, Human
uaauaaaaagauugaa

SEQ ID NO: 1470623 - RNA, 18 nt, Human
uaaguacacaauaagcaa

SEQ ID NO: 1470624 - RNA, 20 nt, Human
uaaguaaugauaacuggaaa

SEQ ID NO: 1470625 - RNA, 22 nt, Human
uaaggaauuuuauuuuuuucug

SEQ ID NO: 1470626 - RNA, 13 nt, Human
uaagcugaaaaua

SEQ ID NO: 1470627 - RNA, 19 nt, Human
uaaggaaaucaacuugcuu

SEQ ID NO: 1470628 - RNA, 20 nt, Human
uaaggaaaucaacuugcuua

SEQ ID NO: 1470629 - RNA, 21 nt, Human
uaagcauaagcuuaugcuuaa

SEQ ID NO: 1470630 - RNA, 24 nt, Human
aaucagucucagaaugucauuuug

SEQ ID NO: 1470631 - RNA, 17 nt, Human
aaucagucucagaaugu

SEQ ID NO: 1470632 - RNA, 15 nt, Human
aauauuuauuuuaau

SEQ ID NO: 1470633 - RNA, 17 nt, Human
aaucacuaaaaaugauc

SEQ ID NO: 1470634 - RNA, 16 nt, Human
aaucagguggcuuuug

SEQ ID NO: 1470635 - RNA, 16 nt, Human
aaucagccuaguugau

SEQ ID NO: 1470636 - RNA, 17 nt, Human
aaucagccuacaggccu

SEQ ID NO: 1470637 - RNA, 14 nt, Human
aagguacuucaaau

SEQ ID NO: 1470638 - RNA, 14 nt, Human
aaggcucuuuugua

SEQ ID NO: 1470639 - RNA, 16 nt, Human
aaguaaggaauuuuau

SEQ ID NO: 1470640 - RNA, 18 nt, Human
aagguauuuaauagguuu

SEQ ID NO: 1470641 - RNA, 17 nt, Human
guuucuauuuuuugaaa

SEQ ID NO: 1470642 - RNA, 12 nt, Human
guuucugacucu

SEQ ID NO: 1470643 - RNA, 17 nt, Human
guuucugacucugagcu

SEQ ID NO: 1470644 - RNA, 13 nt, Human
guuucugacucug

SEQ ID NO: 1470645 - RNA, 11 nt, Human
guuuacagaau

SEQ ID NO: 1470646 - RNA, 14 nt, Human
guuuauuucuuaaa

SEQ ID NO: 1470647 - RNA, 19 nt, Human
guuuauuuucaagaauaau

SEQ ID NO: 1470648 - RNA, 15 nt, Human
aaggaaagaaaacau

SEQ ID NO: 1470649 - RNA, 12 nt, Human
aaggaaagaaaa

SEQ ID NO: 1470650 - RNA, 17 nt, Human
aaggaggggcuguaaaa

SEQ ID NO: 1470651 - RNA, 19 nt, Human
aaggcauuauaaaaagaau

SEQ ID NO: 1470652 - RNA, 17 nt, Human
aaggcauggcggccccc

SEQ ID NO: 1470653 - RNA, 11 nt, Human
aaggauaaagu

SEQ ID NO: 1470654 - RNA, 17 nt, Human
aaggagucacugagacc

SEQ ID NO: 1470655 - RNA, 18 nt, Human
aaggagucacugagacca

SEQ ID NO: 1470656 - RNA, 19 nt, Human
aaggaguguagcaacuaca

SEQ ID NO: 1470657 - RNA, 22 nt, Human
guuggaaugaauuaaauaaacc

SEQ ID NO: 1470658 - RNA, 23 nt, Human
guugggagagggcgcaggccgug

SEQ ID NO: 1470659 - RNA, 19 nt, Human
guugggcagccagaccagc

SEQ ID NO: 1470660 - RNA, 14 nt, Human
guugggcagccaga

SEQ ID NO: 1470661 - RNA, 12 nt, Human
uaaaagaaugau

SEQ ID NO: 1470662 - RNA, 14 nt, Human
uaaaacuuugaagu

SEQ ID NO: 1470663 - RNA, 15 nt, Human
uaaaacuuugaaguu

SEQ ID NO: 1470664 - RNA, 19 nt, Human
uaaaacccauuuaaauuuu

SEQ ID NO: 1470665 - RNA, 11 nt, Human
uaaaacuaaga

SEQ ID NO: 1470666 - RNA, 18 nt, Human
uaaaacgcaguugcaaac

SEQ ID NO: 1470667 - RNA, 13 nt, Human
uaaaaccuggaga

SEQ ID NO: 1470668 - RNA, 16 nt, Human
uaaaaauaaacauguu

SEQ ID NO: 1470669 - RNA, 19 nt, Human
uaaaaauaaaaaagauccc

SEQ ID NO: 1470670 - RNA, 21 nt, Human
uaaaaauaaaaaagaucccaa

SEQ ID NO: 1470671 - RNA, 21 nt, Human
uaaaaauaaaaaacacuggga

SEQ ID NO: 1470672 - RNA, 16 nt, Human
uaaaaauaaaaaagau

SEQ ID NO: 1470673 - RNA, 17 nt, Human
uaaaaauaaaaaagauc

SEQ ID NO: 1470674 - RNA, 19 nt, Human
uaaaaauaaaaaacacugg

SEQ ID NO: 1470675 - RNA, 18 nt, Human
uaaaaauaaaaaacacug

SEQ ID NO: 1470676 - RNA, 20 nt, Human
uaaaagacagugaaagaaaa

SEQ ID NO: 1470677 - RNA, 21 nt, Human
uaaaaguuuuuuauuaugcau

SEQ ID NO: 1470678 - RNA, 22 nt, Human
uaaaaguuuuuuauuaugcauu

SEQ ID NO: 1470679 - RNA, 22 nt, Human
uaaaauaauuuuaucucuuucu

SEQ ID NO: 1470680 - RNA, 20 nt, Human
uaaaauaauuuuuauauuug

SEQ ID NO: 1470681 - RNA, 21 nt, Human
aagugaucaaacuacauauug

SEQ ID NO: 1470682 - RNA, 13 nt, Human
aaguauuagaaua

SEQ ID NO: 1470683 - RNA, 10 nt, Human
aaguauuuag

SEQ ID NO: 1470684 - RNA, 11 nt, Human
aaguauuuagg

SEQ ID NO: 1470685 - RNA, 16 nt, Human
aaguauuuagguuuuu

SEQ ID NO: 1470686 - RNA, 18 nt, Human
aaguacccguucacauuu

SEQ ID NO: 1470687 - RNA, 20 nt, Human
aaguacccguucacauuuuu

SEQ ID NO: 1470688 - RNA, 14 nt, Human
aaguaaugauaacu

SEQ ID NO: 1470689 - RNA, 19 nt, Human
aaguaaugauaacuggaaa

SEQ ID NO: 1470690 - RNA, 17 nt, Human
guuuugcuacauaauua

SEQ ID NO: 1470691 - RNA, 20 nt, Human
guuucugaguuccugcaugc

SEQ ID NO: 1470692 - RNA, 17 nt, Human
guuucugaguuuuacca

SEQ ID NO: 1470693 - RNA, 16 nt, Human
guuucugaguuuuacc

SEQ ID NO: 1470694 - RNA, 16 nt, Human
aagucuuucacauuua

SEQ ID NO: 1470695 - RNA, 20 nt, Human
aaguauuuguuaauuuagaa

SEQ ID NO: 1470696 - RNA, 19 nt, Human
aaguauuuguuaauuuaga

SEQ ID NO: 1470697 - RNA, 21 nt, Human
aaguauuuguuaauuuagaaa

SEQ ID NO: 1470698 - RNA, 15 nt, Human
guuuuucauaaagca

SEQ ID NO: 1470699 - RNA, 16 nt, Human
guuuuucggacaguuu

SEQ ID NO: 1470700 - RNA, 16 nt, Human
aagugagaccuuccuu

SEQ ID NO: 1470701 - RNA, 23 nt, Human
aagcaucccucacccauccuaga

SEQ ID NO: 1470702 - RNA, 14 nt, Human
aagcaucccucacc

SEQ ID NO: 1470703 - RNA, 13 nt, Human
aagcaucccucac

SEQ ID NO: 1470704 - RNA, 21 nt, Human
aagcauucagaagaaaaagaa

SEQ ID NO: 1470705 - RNA, 15 nt, Human
aagcauucagaagaa

SEQ ID NO: 1470706 - RNA, 16 nt, Human
aagcauuuagauguau

SEQ ID NO: 1470707 - RNA, 13 nt, Human
aagcauucugucu

SEQ ID NO: 1470708 - RNA, 16 nt, Human
aagcauugaauggcua

SEQ ID NO: 1470709 - RNA, 13 nt, Human
aagcauugaaugg

SEQ ID NO: 1470710 - RNA, 16 nt, Human
aagcauuuagaaaacu

SEQ ID NO: 1470711 - RNA, 23 nt, Human
aagcauuuuguaaguugaagcaa

SEQ ID NO: 1470712 - RNA, 18 nt, Human
aagccaaaacaauguuua

SEQ ID NO: 1470713 - RNA, 12 nt, Human
aagccaaaacaa

SEQ ID NO: 1470714 - RNA, 23 nt, Human
aagcccauucauuccauucugga

SEQ ID NO: 1470715 - RNA, 21 nt, Human
aagcccauucauuccauucug

SEQ ID NO: 1470716 - RNA, 16 nt, Human
aagcccauucauucca

SEQ ID NO: 1470717 - RNA, 15 nt, Human
guuaagacuugacag

SEQ ID NO: 1470718 - RNA, 16 nt, Human
guuaagacuugacagu

SEQ ID NO: 1470719 - RNA, 17 nt, Human
guuaagacuugacagug

SEQ ID NO: 1470720 - RNA, 14 nt, Human
aagccccugggccc

SEQ ID NO: 1470721 - RNA, 20 nt, Human
guuagggaaaacauuccauc

SEQ ID NO: 1470722 - RNA, 15 nt, Human
guuagggaaaacauu

SEQ ID NO: 1470723 - RNA, 13 nt, Human
guuaggagguccu

SEQ ID NO: 1470724 - RNA, 19 nt, Human
guuaagacuugacagugga

SEQ ID NO: 1470725 - RNA, 19 nt, Human
guuagaaaugcagaauccu

SEQ ID NO: 1470726 - RNA, 23 nt, Human
guuagggaaaacauuccauccuu

SEQ ID NO: 1470727 - RNA, 20 nt, Human
guuauuuuuacauucugaau

SEQ ID NO: 1470728 - RNA, 19 nt, Human
guuauuuuuacauucugaa

SEQ ID NO: 1470729 - RNA, 14 nt, Human
guucaacuuauuaa

SEQ ID NO: 1470730 - RNA, 19 nt, Human
guucaacuuuuccuuugaa

SEQ ID NO: 1470731 - RNA, 16 nt, Human
guucaagaaauaaguu

SEQ ID NO: 1470732 - RNA, 13 nt, Human
aagcuccagguag

SEQ ID NO: 1470733 - RNA, 14 nt, Human
aagcuccagguaga

SEQ ID NO: 1470734 - RNA, 20 nt, Human
aagcucacagaccuuugaac

SEQ ID NO: 1470735 - RNA, 16 nt, Human
aagcuagcaaauagua

SEQ ID NO: 1470736 - RNA, 14 nt, Human
aagcuaggaaugaa

SEQ ID NO: 1470737 - RNA, 21 nt, Human
aagccugcacaauaaaaaugu

SEQ ID NO: 1470738 - RNA, 22 nt, Human
aagccugcacaauaaaaauguu

SEQ ID NO: 1470739 - RNA, 22 nt, Human
guucagcuaagcuaggaaugaa

SEQ ID NO: 1470740 - RNA, 19 nt, Human
guucagcuaagcuaggaau

SEQ ID NO: 1470741 - RNA, 17 nt, Human
guucaagcgauucucuu

SEQ ID NO: 1470742 - RNA, 18 nt, Human
guucaagcgauucucuug

SEQ ID NO: 1470743 - RNA, 22 nt, Human
aagccuaagggauccugccugc

SEQ ID NO: 1470744 - RNA, 17 nt, Human
aagccuaagggauccug

SEQ ID NO: 1470745 - RNA, 19 nt, Human
aagaggaauuacgugcucu

SEQ ID NO: 1470746 - RNA, 21 nt, Human
guggccuaaccugccgagagu

SEQ ID NO: 1470747 - RNA, 22 nt, Human
guggccuaaccugccgagaguc

SEQ ID NO: 1470748 - RNA, 20 nt, Human
guggcccuuaugacugccaa

SEQ ID NO: 1470749 - RNA, 23 nt, Human
guggcccuuaugacugccaagac

SEQ ID NO: 1470750 - RNA, 16 nt, Human
aagacugcacaucaaa

SEQ ID NO: 1470751 - RNA, 17 nt, Human
aagacugcauuauauuu

SEQ ID NO: 1470752 - RNA, 13 nt, Human
aagacuugacagu

SEQ ID NO: 1470753 - RNA, 14 nt, Human
aagacuugacagug

SEQ ID NO: 1470754 - RNA, 22 nt, Human
aacuugcugcaguaugaaaaua

SEQ ID NO: 1470755 - RNA, 20 nt, Human
aacuugcugcaguaugaaaa

SEQ ID NO: 1470756 - RNA, 21 nt, Human
gugucacucaaggcggugcuu

SEQ ID NO: 1470757 - RNA, 22 nt, Human
gugucacucaaggcggugcuug

SEQ ID NO: 1470758 - RNA, 22 nt, Human
aagaugcuuuuaacagagucug

SEQ ID NO: 1470759 - RNA, 12 nt, Human
aagaugcuuuua

SEQ ID NO: 1470760 - RNA, 23 nt, Human
aagaucugcagggggugugucug

SEQ ID NO: 1470761 - RNA, 20 nt, Human
aaauuguaagcaugcacaaa

SEQ ID NO: 1470762 - RNA, 18 nt, Human
aaauucugucucuggauu

SEQ ID NO: 1470763 - RNA, 19 nt, Human
aaauuguaagcaugcacaa

SEQ ID NO: 1470764 - RNA, 16 nt, Human
aaauucugucucugga

SEQ ID NO: 1470765 - RNA, 15 nt, Human
aaauucugcucagau

SEQ ID NO: 1470766 - RNA, 23 nt, Human
aaauugugcaguacuuugugcau

SEQ ID NO: 1470767 - RNA, 22 nt, Human
aaauuuauuucaauauuagcaa

SEQ ID NO: 1470768 - RNA, 13 nt, Human
gucaaaacagauu

SEQ ID NO: 1470769 - RNA, 15 nt, Human
gucaaaacagauugu

SEQ ID NO: 1470770 - RNA, 20 nt, Human
gucaaaacagauuguuugca

SEQ ID NO: 1470771 - RNA, 17 nt, Human
gucaacacuaacaugau

SEQ ID NO: 1470772 - RNA, 12 nt, Human
gucaaacaaaua

SEQ ID NO: 1470773 - RNA, 18 nt, Human
guauguacuucaugcugu

SEQ ID NO: 1470774 - RNA, 15 nt, Human
guaugguugacacua

SEQ ID NO: 1470775 - RNA, 15 nt, Human
aaauguauuacagug

SEQ ID NO: 1470776 - RNA, 13 nt, Human
guaugucuccagu

SEQ ID NO: 1470777 - RNA, 22 nt, Human
aaaugugggauuaugggucaca

SEQ ID NO: 1470778 - RNA, 20 nt, Human
aaaugugggauuauggguca

SEQ ID NO: 1470779 - RNA, 14 nt, Human
aaauuaagaaagga

SEQ ID NO: 1470780 - RNA, 13 nt, Human
aaauuaagacuuu

SEQ ID NO: 1470781 - RNA, 21 nt, Human
aaauuaguuagccaauauuuu

SEQ ID NO: 1470782 - RNA, 18 nt, Human
aaauuauuaauuuaugca

SEQ ID NO: 1470783 - RNA, 12 nt, Human
aaauuauuguuu

SEQ ID NO: 1470784 - RNA, 20 nt, Human
aaauuauuguuuuucuuuuu

SEQ ID NO: 1470785 - RNA, 12 nt, Human
aaauuauuuaaa

SEQ ID NO: 1470786 - RNA, 13 nt, Human
aaauuauuuaaac

SEQ ID NO: 1470787 - RNA, 15 nt, Human
guauaaaauaauuuu

SEQ ID NO: 1470788 - RNA, 21 nt, Human
guauaaaauaauuuuuauauu

SEQ ID NO: 1470789 - RNA, 23 nt, Human
guauaaaaauaaaaaagauccca

SEQ ID NO: 1470790 - RNA, 12 nt, Human
guaucauagaaa

SEQ ID NO: 1470791 - RNA, 15 nt, Human
guaucauagaaaugu

SEQ ID NO: 1470792 - RNA, 13 nt, Human
guaucaucagugu

SEQ ID NO: 1470793 - RNA, 14 nt, Human
guauccacuuugca

SEQ ID NO: 1470794 - RNA, 19 nt, Human
guauccacuuugcacagcu

SEQ ID NO: 1470795 - RNA, 19 nt, Human
guauaaaagggacugagaa

SEQ ID NO: 1470796 - RNA, 20 nt, Human
guaguuuuuauauguuguaa

SEQ ID NO: 1470797 - RNA, 16 nt, Human
guauaaaaauaaaaaa

SEQ ID NO: 1470798 - RNA, 19 nt, Human
guauaaaaauaaaaaagau

SEQ ID NO: 1470799 - RNA, 17 nt, Human
guaguugccuuaaaaua

SEQ ID NO: 1470800 - RNA, 20 nt, Human
guaguguuggagaagaacug

SEQ ID NO: 1470801 - RNA, 22 nt, Human
aaauguaaagauauuuuuaucu

SEQ ID NO: 1470802 - RNA, 13 nt, Human
aaauguaaagcca

SEQ ID NO: 1470803 - RNA, 17 nt, Human
aaauguaacuuuuguaa

SEQ ID NO: 1470804 - RNA, 18 nt, Human
aaauguaacuuuuguaag

SEQ ID NO: 1470805 - RNA, 20 nt, Human
aaauggucucuaacauuucc

SEQ ID NO: 1470806 - RNA, 12 nt, Human
aaauuugccaag

SEQ ID NO: 1470807 - RNA, 11 nt, Human
aaauuuguacu

SEQ ID NO: 1470808 - RNA, 12 nt, Human
aaauuuguacua

SEQ ID NO: 1470809 - RNA, 13 nt, Human
aaauuuguacuau

SEQ ID NO: 1470810 - RNA, 17 nt, Human
aaauuuguacuauuuaa

SEQ ID NO: 1470811 - RNA, 19 nt, Human
aaauuuguacuauuuaacu

SEQ ID NO: 1470812 - RNA, 20 nt, Human
aaauuuguacuauuuaacug

SEQ ID NO: 1470813 - RNA, 17 nt, Human
gucagaauagaaauuag

SEQ ID NO: 1470814 - RNA, 13 nt, Human
gucagaauagaaa

SEQ ID NO: 1470815 - RNA, 21 nt, Human
gucaggcccuuauuuucaaga

SEQ ID NO: 1470816 - RNA, 22 nt, Human
gucaggcccuuauuuucaagaa

SEQ ID NO: 1470817 - RNA, 20 nt, Human
aaauuuuuucucuaggaaau

SEQ ID NO: 1470818 - RNA, 12 nt, Human
aaauuuuauaug

SEQ ID NO: 1470819 - RNA, 23 nt, Human
aaauuuuagcgugcucacugacc

SEQ ID NO: 1470820 - RNA, 20 nt, Human
aaauuuuuguaguagcguuu

SEQ ID NO: 1470821 - RNA, 22 nt, Human
aacaagaccucagugccuuccu

SEQ ID NO: 1470822 - RNA, 23 nt, Human
aacaagaccucagugccuuccug

SEQ ID NO: 1470823 - RNA, 17 nt, Human
aacaaugcuguauuuua

SEQ ID NO: 1470824 - RNA, 22 nt, Human
aacaaugcuguauuuuaaaaga

SEQ ID NO: 1470825 - RNA, 15 nt, Human
aacacaacuauauug

SEQ ID NO: 1470826 - RNA, 16 nt, Human
aacacaacuauauugu

SEQ ID NO: 1470827 - RNA, 12 nt, Human
aacaauucuaaa

SEQ ID NO: 1470828 - RNA, 14 nt, Human
aacaauucuaaaau

SEQ ID NO: 1470829 - RNA, 22 nt, Human
aacaauucuaaaaugauuguag

SEQ ID NO: 1470830 - RNA, 19 nt, Human
aacaauucuaaaaugauug

SEQ ID NO: 1470831 - RNA, 12 nt, Human
aacaauaaaaga

SEQ ID NO: 1470832 - RNA, 15 nt, Human
aacaaugcuguauuu

SEQ ID NO: 1470833 - RNA, 15 nt, Human
guccaguguuucuuu

SEQ ID NO: 1470834 - RNA, 24 nt, Human
guccagugggaggugagaccaccu

SEQ ID NO: 1470835 - RNA, 17 nt, Human
aacacaacuauauuguu

SEQ ID NO: 1470836 - RNA, 20 nt, Human
gucauuuugguacuuuggug

SEQ ID NO: 1470837 - RNA, 18 nt, Human
gucauuuugguacuuugg

SEQ ID NO: 1470838 - RNA, 20 nt, Human
aacagggccacauagaugcu

SEQ ID NO: 1470839 - RNA, 21 nt, Human
aacagggcugccuucuggccu

SEQ ID NO: 1470840 - RNA, 14 nt, Human
aacagggcugccuu

SEQ ID NO: 1470841 - RNA, 16 nt, Human
aacagggccacauaga

SEQ ID NO: 1470842 - RNA, 16 nt, Human
gucugucugucugucc

SEQ ID NO: 1470843 - RNA, 14 nt, Human
gucugucugucugu

SEQ ID NO: 1470844 - RNA, 22 nt, Human
gucuguagugucacucaaggcg

SEQ ID NO: 1470845 - RNA, 19 nt, Human
gucuggcaguuuauauuua

SEQ ID NO: 1470846 - RNA, 17 nt, Human
gucuggcacagccuggc

SEQ ID NO: 1470847 - RNA, 19 nt, Human
gucuggcacagccuggcug

SEQ ID NO: 1470848 - RNA, 21 nt, Human
aaccugaugaaaauaaagaau

SEQ ID NO: 1470849 - RNA, 22 nt, Human
aaccugaugaaaauaaagaaug

SEQ ID NO: 1470850 - RNA, 20 nt, Human
aaccugagucguacagaaag

SEQ ID NO: 1470851 - RNA, 17 nt, Human
aaccugaugaaaauaaa

SEQ ID NO: 1470852 - RNA, 19 nt, Human
aaccugaugaaaauaaaga

SEQ ID NO: 1470853 - RNA, 20 nt, Human
aaccugaugaaaauaaagaa

SEQ ID NO: 1470854 - RNA, 16 nt, Human
gucuuucacauuuaaa

SEQ ID NO: 1470855 - RNA, 15 nt, Human
gucuuugguucagcu

SEQ ID NO: 1470856 - RNA, 16 nt, Human
gucuuuuuagaugccc

SEQ ID NO: 1470857 - RNA, 21 nt, Human
aacuagaguuuagcuggaaaa

SEQ ID NO: 1470858 - RNA, 20 nt, Human
aacuagaggugagaaauuua

SEQ ID NO: 1470859 - RNA, 21 nt, Human
aacuagaggugagaaauuuaa

SEQ ID NO: 1470860 - RNA, 22 nt, Human
aacuagaggugagaaauuuaaa

SEQ ID NO: 1470861 - RNA, 18 nt, Human
aacuaucuuggugaauuu

SEQ ID NO: 1470862 - RNA, 11 nt, Human
aacuaucuugg

SEQ ID NO: 1470863 - RNA, 15 nt, Human
aacuaccugagcuaa

SEQ ID NO: 1470864 - RNA, 21 nt, Human
aacucguauagcaugcaucug

SEQ ID NO: 1470865 - RNA, 15 nt, Human
aacucguauagcaug

SEQ ID NO: 1470866 - RNA, 19 nt, Human
aacucguauagcaugcauc

SEQ ID NO: 1470867 - RNA, 17 nt, Human
aacucaucugucaccaa

SEQ ID NO: 1470868 - RNA, 23 nt, Human
aacucauuagacuggaacuugaa

SEQ ID NO: 1470869 - RNA, 15 nt, Human
aacucauuagacugg

SEQ ID NO: 1470870 - RNA, 20 nt, Human
aaccaagugaucaaacuaca

SEQ ID NO: 1470871 - RNA, 19 nt, Human
gucucccuccucugcccgg

SEQ ID NO: 1470872 - RNA, 12 nt, Human
aaccauuuccuc

SEQ ID NO: 1470873 - RNA, 15 nt, Human
aaccauuuccucaga

SEQ ID NO: 1470874 - RNA, 16 nt, Human
aaccauuuccucagac

SEQ ID NO: 1470875 - RNA, 19 nt, Human
aacccacaggcccacagua

SEQ ID NO: 1470876 - RNA, 19 nt, Human
aaccauuauaaccuuaauu

SEQ ID NO: 1470877 - RNA, 17 nt, Human
aaccauuaaccagaucu

SEQ ID NO: 1470878 - RNA, 14 nt, Human
aaccucauccucuc

SEQ ID NO: 1470879 - RNA, 18 nt, Human
aaccucaguaauuuagaa

SEQ ID NO: 1470880 - RNA, 14 nt, Human
aaccucaguaauuu

SEQ ID NO: 1470881 - RNA, 13 nt, Human
aaccuccaccucc

SEQ ID NO: 1470882 - RNA, 12 nt, Human
aaccucuaaauu

SEQ ID NO: 1470883 - RNA, 24 nt, Human
aaccucuaaauucuuucauuuuag

SEQ ID NO: 1470884 - RNA, 19 nt, Human
aaccugaccccugcucagu

SEQ ID NO: 1470885 - RNA, 16 nt, Human
aaccugaccccugcuc

SEQ ID NO: 1470886 - RNA, 17 nt, Human
aaccugaccccugcuca

SEQ ID NO: 1470887 - RNA, 14 nt, Human
aacccagauaaagg

SEQ ID NO: 1470888 - RNA, 21 nt, Human
aaccccuacaugaaacagaaa

SEQ ID NO: 1470889 - RNA, 20 nt, Human
aaccccuccccuccaucccu

SEQ ID NO: 1470890 - RNA, 21 nt, Human
aaccccuccccuccaucccug

SEQ ID NO: 1470891 - RNA, 23 nt, Human
aaccccuccccuccaucccuggc

SEQ ID NO: 1470892 - RNA, 12 nt, Human
aacugaaaucau

SEQ ID NO: 1470893 - RNA, 13 nt, Human
aacugaaaucaua

SEQ ID NO: 1470894 - RNA, 17 nt, Human
aacugaaaauuauuuaa

SEQ ID NO: 1470895 - RNA, 12 nt, Human
aacugaaaaugu

SEQ ID NO: 1470896 - RNA, 12 nt, Human
aacugaaaauua

SEQ ID NO: 1470897 - RNA, 13 nt, Human
aacugaaaauuau

SEQ ID NO: 1470898 - RNA, 19 nt, Human
aacucuucaaggucugcuu

SEQ ID NO: 1470899 - RNA, 16 nt, Human
aacucuucaaggucug

SEQ ID NO: 1470900 - RNA, 22 nt, Human
aacucuuauaaauuucuauuuu

SEQ ID NO: 1470901 - RNA, 15 nt, Human
aacucuuauaaauuu

SEQ ID NO: 1470902 - RNA, 16 nt, Human
aacuggggcuccucca

SEQ ID NO: 1470903 - RNA, 16 nt, Human
aacugggggaaaagau

SEQ ID NO: 1470904 - RNA, 17 nt, Human
aacugggacaggggaga

SEQ ID NO: 1470905 - RNA, 22 nt, Human
aacuggcaggcaggcucccagg

SEQ ID NO: 1470906 - RNA, 14 nt, Human
aacuggcaggcagg

SEQ ID NO: 1470907 - RNA, 19 nt, Human
aacugcuaaucuacuuucu

SEQ ID NO: 1470908 - RNA, 13 nt, Human
aacuggaaagaag

SEQ ID NO: 1470909 - RNA, 12 nt, Human
aacuggaaagaa

SEQ ID NO: 1470910 - RNA, 16 nt, Human
aacuggaaucagcuca

SEQ ID NO: 1470911 - RNA, 19 nt, Human
aacuggaaucagcucagga

SEQ ID NO: 1470912 - RNA, 18 nt, Human
aacuuccagauccuggaa

SEQ ID NO: 1470913 - RNA, 20 nt, Human
aacuucauauaugaggacuu

SEQ ID NO: 1470914 - RNA, 18 nt, Human
aacuggguaaugaaacaa

SEQ ID NO: 1470915 - RNA, 13 nt, Human
aacuguaauacaa

SEQ ID NO: 1470916 - RNA, 14 nt, Human
gugcauucuccagc

SEQ ID NO: 1470917 - RNA, 21 nt, Human
gugccaauuucaaguuccaag

SEQ ID NO: 1470918 - RNA, 14 nt, Human
gugccaauuucaag

SEQ ID NO: 1470919 - RNA, 20 nt, Human
gugcacaaauauuuauuuuc

SEQ ID NO: 1470920 - RNA, 15 nt, Human
gugcacaaauauuua

SEQ ID NO: 1470921 - RNA, 22 nt, Human
gugcacauauccaggcaccagg

SEQ ID NO: 1470922 - RNA, 15 nt, Human
gugcaaggaccuaaa

SEQ ID NO: 1470923 - RNA, 19 nt, Human
gugcaaggaccuaaaacau

SEQ ID NO: 1470924 - RNA, 13 nt, Human
gugcaauguaaau

SEQ ID NO: 1470925 - RNA, 17 nt, Human
gugcaauguaaauauuu

SEQ ID NO: 1470926 - RNA, 22 nt, Human
gugcaauguaaauauuuuaaag

SEQ ID NO: 1470927 - RNA, 20 nt, Human
gugcaauguaaauauuuuaa

SEQ ID NO: 1470928 - RNA, 15 nt, Human
accaucucuccaacu

SEQ ID NO: 1470929 - RNA, 23 nt, Human
accaucagaaacacccucacacu

SEQ ID NO: 1470930 - RNA, 20 nt, Human
accaucagaaacacccucac

SEQ ID NO: 1470931 - RNA, 13 nt, Human
accaucacugagu

SEQ ID NO: 1470932 - RNA, 22 nt, Human
accaucaccagaauuaauuuua

SEQ ID NO: 1470933 - RNA, 22 nt, Human
accauagcacaggcuaauuuuu

SEQ ID NO: 1470934 - RNA, 15 nt, Human
acccacccagaauga

SEQ ID NO: 1470935 - RNA, 12 nt, Human
acccacccagaa

SEQ ID NO: 1470936 - RNA, 16 nt, Human
acccaccaguugaauu

SEQ ID NO: 1470937 - RNA, 23 nt, Human
acccacacucagauccuccucau

SEQ ID NO: 1470938 - RNA, 22 nt, Human
acccacacucagauccuccuca

SEQ ID NO: 1470939 - RNA, 20 nt, Human
accaugaagagauuuuucau

SEQ ID NO: 1470940 - RNA, 18 nt, Human
acccacaggcccacagua

SEQ ID NO: 1470941 - RNA, 19 nt, Human
accaugaagagauuuuuca

SEQ ID NO: 1470942 - RNA, 16 nt, Human
acccauauuguaaaac

SEQ ID NO: 1470943 - RNA, 20 nt, Human
acccauauuguaaaacaggu

SEQ ID NO: 1470944 - RNA, 17 nt, Human
acauuuccuaaauauau

SEQ ID NO: 1470945 - RNA, 16 nt, Human
acauuuccuaaauaua

SEQ ID NO: 1470946 - RNA, 18 nt, Human
acauuuccuuacagaacu

SEQ ID NO: 1470947 - RNA, 20 nt, Human
acauuucuauagccaaaaau

SEQ ID NO: 1470948 - RNA, 21 nt, Human
accaagauacuuaagugcugc

SEQ ID NO: 1470949 - RNA, 15 nt, Human
accaagauacuuaag

SEQ ID NO: 1470950 - RNA, 20 nt, Human
accaagauacuuaagugcug

SEQ ID NO: 1470951 - RNA, 15 nt, Human
acaguggggaaugaa

SEQ ID NO: 1470952 - RNA, 19 nt, Human
acaguggggaaugaagaua

SEQ ID NO: 1470953 - RNA, 14 nt, Human
acagugcagugcgc

SEQ ID NO: 1470954 - RNA, 21 nt, Human
acagggccuuuggcaggugca

SEQ ID NO: 1470955 - RNA, 16 nt, Human
acagggcggggguggc

SEQ ID NO: 1470956 - RNA, 15 nt, Human
acagcugccucuucc

SEQ ID NO: 1470957 - RNA, 16 nt, Human
acagggcugccuucug

SEQ ID NO: 1470958 - RNA, 18 nt, Human
acagugagccugaauuuu

SEQ ID NO: 1470959 - RNA, 21 nt, Human
acagugagccugaauuuuguu

SEQ ID NO: 1470960 - RNA, 17 nt, Human
acagugagccugaauuu

SEQ ID NO: 1470961 - RNA, 14 nt, Human
acagcugccucuuc

SEQ ID NO: 1470962 - RNA, 18 nt, Human
acauaauucacucugagu

SEQ ID NO: 1470963 - RNA, 20 nt, Human
acauaauucacucugagugu

SEQ ID NO: 1470964 - RNA, 21 nt, Human
acauaauuuaguuucauauaa

SEQ ID NO: 1470965 - RNA, 15 nt, Human
acauaagccauuauu

SEQ ID NO: 1470966 - RNA, 18 nt, Human
acauaagccauuauucac

SEQ ID NO: 1470967 - RNA, 17 nt, Human
acauaauuauccaggaa

SEQ ID NO: 1470968 - RNA, 23 nt, Human
acauaauuauccaggaagggaau

SEQ ID NO: 1470969 - RNA, 16 nt, Human
acauaauucacucuga

SEQ ID NO: 1470970 - RNA, 17 nt, Human
acauaauucacucugag

SEQ ID NO: 1470971 - RNA, 15 nt, Human
acaucauuacuauaa

SEQ ID NO: 1470972 - RNA, 18 nt, Human
acaucauuacuauaagaa

SEQ ID NO: 1470973 - RNA, 21 nt, Human
acaucauuacuauaagaacuu

SEQ ID NO: 1470974 - RNA, 15 nt, Human
acaucauucauuuuu

SEQ ID NO: 1470975 - RNA, 18 nt, Human
aauuuccugggagcuuuu

SEQ ID NO: 1470976 - RNA, 21 nt, Human
aauuuccugggagcuuuugua

SEQ ID NO: 1470977 - RNA, 19 nt, Human
aauuucaccuguaaaccug

SEQ ID NO: 1470978 - RNA, 20 nt, Human
aauuucaccuguaaaccuga

SEQ ID NO: 1470979 - RNA, 13 nt, Human
aauuuauuuucuu

SEQ ID NO: 1470980 - RNA, 16 nt, Human
aauuucaccuguaaac

SEQ ID NO: 1470981 - RNA, 13 nt, Human
aauuuauuauuaa

SEQ ID NO: 1470982 - RNA, 21 nt, Human
aauugugcaguacuuugugca

SEQ ID NO: 1470983 - RNA, 21 nt, Human
aauuguggggaugaugaaaua

SEQ ID NO: 1470984 - RNA, 16 nt, Human
aauuguauuuuaguaa

SEQ ID NO: 1470985 - RNA, 21 nt, Human
acaaggaugaauuaaguuuuu

SEQ ID NO: 1470986 - RNA, 15 nt, Human
acaaccucaacugcc

SEQ ID NO: 1470987 - RNA, 16 nt, Human
acaaccucaacugccu

SEQ ID NO: 1470988 - RNA, 16 nt, Human
acaaagaaauuaugug

SEQ ID NO: 1470989 - RNA, 14 nt, Human
acaaagaaauuaug

SEQ ID NO: 1470990 - RNA, 12 nt, Human
acaaagaaauua

SEQ ID NO: 1470991 - RNA, 13 nt, Human
acaaaauggaaua

SEQ ID NO: 1470992 - RNA, 14 nt, Human
acaaaauggaauac

SEQ ID NO: 1470993 - RNA, 15 nt, Human
acaaaauggaauacu

SEQ ID NO: 1470994 - RNA, 18 nt, Human
aauuuucaucuaggauuu

SEQ ID NO: 1470995 - RNA, 17 nt, Human
aauuuugugaagcaaaa

SEQ ID NO: 1470996 - RNA, 18 nt, Human
aauuuugugaagcaaaau

SEQ ID NO: 1470997 - RNA, 14 nt, Human
aauuuugaugaaca

SEQ ID NO: 1470998 - RNA, 16 nt, Human
aauuuugaugaacaaa

SEQ ID NO: 1470999 - RNA, 16 nt, Human
acagaagcuccaggua

SEQ ID NO: 1471000 - RNA, 12 nt, Human
acagaagaaaca

SEQ ID NO: 1471001 - RNA, 20 nt, Human
acacugggagaaaugaaaaa

SEQ ID NO: 1471002 - RNA, 19 nt, Human
acacugggacuugcaaaaa

SEQ ID NO: 1471003 - RNA, 18 nt, Human
acacugggacuugcaaaa

SEQ ID NO: 1471004 - RNA, 13 nt, Human
acacugggacuug

SEQ ID NO: 1471005 - RNA, 18 nt, Human
acacuguguacugcaguu

SEQ ID NO: 1471006 - RNA, 17 nt, Human
acagaaccccuacauga

SEQ ID NO: 1471007 - RNA, 16 nt, Human
acagaacauagacaga

SEQ ID NO: 1471008 - RNA, 18 nt, Human
acaauuuaugaauugaau

SEQ ID NO: 1471009 - RNA, 12 nt, Human
acaauucuaaaa

SEQ ID NO: 1471010 - RNA, 14 nt, Human
acaauucuaaaaug

SEQ ID NO: 1471011 - RNA, 17 nt, Human
acaauucuaaaaugauu

SEQ ID NO: 1471012 - RNA, 23 nt, Human
acaauucuaaaaugauuguagua

SEQ ID NO: 1471013 - RNA, 24 nt, Human
acaauucuaaaaugauuguaguaa

SEQ ID NO: 1471014 - RNA, 21 nt, Human
acaauuaggcagacucuuuau

SEQ ID NO: 1471015 - RNA, 16 nt, Human
acaauuuuuuaucaug

SEQ ID NO: 1471016 - RNA, 22 nt, Human
acaauuuuuuaucaugcauguc

SEQ ID NO: 1471017 - RNA, 19 nt, Human
acuaguauuucuaugaaau

SEQ ID NO: 1471018 - RNA, 17 nt, Human
acuauucuugauguaaa

SEQ ID NO: 1471019 - RNA, 19 nt, Human
acuauucuugauguaaaau

SEQ ID NO: 1471020 - RNA, 18 nt, Human
acuaguauuucuaugaaa

SEQ ID NO: 1471021 - RNA, 15 nt, Human
acuauugcauuuaua

SEQ ID NO: 1471022 - RNA, 23 nt, Human
acuauucuugauguaaaaucuug

SEQ ID NO: 1471023 - RNA, 20 nt, Human
acuauucuugauguaaaauc

SEQ ID NO: 1471024 - RNA, 22 nt, Human
acuauucuugauguaaaaucuu

SEQ ID NO: 1471025 - RNA, 14 nt, Human
acuagggagccaug

SEQ ID NO: 1471026 - RNA, 15 nt, Human
acuagggagccaugu

SEQ ID NO: 1471027 - RNA, 18 nt, Human
acuagggagccauguuuc

SEQ ID NO: 1471028 - RNA, 19 nt, Human
acuagggagccauguuuca

SEQ ID NO: 1471029 - RNA, 22 nt, Human
acuagggagccauguuucacaa

SEQ ID NO: 1471030 - RNA, 23 nt, Human
acuaggccuugcggcuccucagg

SEQ ID NO: 1471031 - RNA, 22 nt, Human
acuaggccuugcggcuccucag

SEQ ID NO: 1471032 - RNA, 14 nt, Human
acuaggcugagcaa

SEQ ID NO: 1471033 - RNA, 23 nt, Human
acuaggcugagcaaucugacccu

SEQ ID NO: 1471034 - RNA, 19 nt, Human
acuaaugccuuacucuucu

SEQ ID NO: 1471035 - RNA, 17 nt, Human
acgcacggcagccacag

SEQ ID NO: 1471036 - RNA, 15 nt, Human
acgcacggcagccac

SEQ ID NO: 1471037 - RNA, 22 nt, Human
acggaagaagagaucaggaaga

SEQ ID NO: 1471038 - RNA, 20 nt, Human
acuaacuccuaggaaaauac

SEQ ID NO: 1471039 - RNA, 17 nt, Human
acgucuggguggcccuu

SEQ ID NO: 1471040 - RNA, 17 nt, Human
accucugccucagaaaa

SEQ ID NO: 1471041 - RNA, 18 nt, Human
accucugccucagaaaac

SEQ ID NO: 1471042 - RNA, 20 nt, Human
accugucugucugucugucc

SEQ ID NO: 1471043 - RNA, 18 nt, Human
accugucugucugucugu

SEQ ID NO: 1471044 - RNA, 14 nt, Human
accugucugucugu

SEQ ID NO: 1471045 - RNA, 23 nt, Human
accugcccugcccugccaccugu

SEQ ID NO: 1471046 - RNA, 22 nt, Human
accugcccugcccugccaccug

SEQ ID NO: 1471047 - RNA, 21 nt, Human
accugcccugcccugccaccu

SEQ ID NO: 1471048 - RNA, 20 nt, Human
accugcccugcccugccacc

SEQ ID NO: 1471049 - RNA, 18 nt, Human
accugcccugcccugcca

SEQ ID NO: 1471050 - RNA, 17 nt, Human
accugcccugcccugcc

SEQ ID NO: 1471051 - RNA, 16 nt, Human
accugcccugcccugc

SEQ ID NO: 1471052 - RNA, 13 nt, Human
accugcccugccc

SEQ ID NO: 1471053 - RNA, 12 nt, Human
accugcccugcc

SEQ ID NO: 1471054 - RNA, 20 nt, Human
accucugccucagaaaacaa

SEQ ID NO: 1471055 - RNA, 23 nt, Human
accggcggaccccagccauccag

SEQ ID NO: 1471056 - RNA, 16 nt, Human
accggccugccaggag

SEQ ID NO: 1471057 - RNA, 13 nt, Human
accggccugccag

SEQ ID NO: 1471058 - RNA, 15 nt, Human
accggccugccagga

SEQ ID NO: 1471059 - RNA, 17 nt, Human
accggccugccaggagg

SEQ ID NO: 1471060 - RNA, 19 nt, Human
accggggccugggcaggag

SEQ ID NO: 1471061 - RNA, 23 nt, Human
accucagugccuuccuguuuuuc

SEQ ID NO: 1471062 - RNA, 20 nt, Human
acuucaaauccuugaagauu

SEQ ID NO: 1471063 - RNA, 19 nt, Human
acuucaagcauggcuauuu

SEQ ID NO: 1471064 - RNA, 23 nt, Human
acuucaagcauggcuauuuuaua

SEQ ID NO: 1471065 - RNA, 18 nt, Human
acuucagcgguuuauaua

SEQ ID NO: 1471066 - RNA, 19 nt, Human
acuucagcgguuuauauaa

SEQ ID NO: 1471067 - RNA, 16 nt, Human
acuuggcugcaggaau

SEQ ID NO: 1471068 - RNA, 21 nt, Human
acuggaccacugggcaaugau

SEQ ID NO: 1471069 - RNA, 21 nt, Human
acuggaaucagcucaggacug

SEQ ID NO: 1471070 - RNA, 12 nt, Human
acuggacagcuu

SEQ ID NO: 1471071 - RNA, 13 nt, Human
acuggacagcuug

SEQ ID NO: 1471072 - RNA, 14 nt, Human
acuggacagcuugu

SEQ ID NO: 1471073 - RNA, 15 nt, Human
acuggacagcuugug

SEQ ID NO: 1471074 - RNA, 16 nt, Human
acuggaccacugggca

SEQ ID NO: 1471075 - RNA, 20 nt, Human
acuggaccacugggcaauga

SEQ ID NO: 1471076 - RNA, 15 nt, Human
acuuuauuuuguguu

SEQ ID NO: 1471077 - RNA, 13 nt, Human
acuuuauguaguu

SEQ ID NO: 1471078 - RNA, 19 nt, Human
acugauucacaucucauuu

SEQ ID NO: 1471079 - RNA, 20 nt, Human
acugauucacaucucauuuu

SEQ ID NO: 1471080 - RNA, 19 nt, Human
acucuguucauuccuccag

SEQ ID NO: 1471081 - RNA, 18 nt, Human
acucuguucauuccucca

SEQ ID NO: 1471082 - RNA, 16 nt, Human
acucuguucauuccuc

SEQ ID NO: 1471083 - RNA, 15 nt, Human
acucuguucauuccu

SEQ ID NO: 1471084 - RNA, 14 nt, Human
acucuuaagaagac

SEQ ID NO: 1471085 - RNA, 15 nt, Human
acucuuaagaagacu

SEQ ID NO: 1471086 - RNA, 20 nt, Human
acucuguucauuccuccagg

SEQ ID NO: 1471087 - RNA, 20 nt, Human
acucuuaagaagacugcauu

SEQ ID NO: 1471088 - RNA, 12 nt, Human
acuauuuucaga

SEQ ID NO: 1471089 - RNA, 22 nt, Human
acuauuuucagaugugaaccau

SEQ ID NO: 1471090 - RNA, 13 nt, Human
acucuaagaaaga

SEQ ID NO: 1471091 - RNA, 14 nt, Human
acucuaagaaagaa

SEQ ID NO: 1471092 - RNA, 15 nt, Human
acucuaagaaagaac

SEQ ID NO: 1471093 - RNA, 13 nt, Human
aagagaaggagca

SEQ ID NO: 1471094 - RNA, 13 nt, Human
aagagaaguagaa

SEQ ID NO: 1471095 - RNA, 23 nt, Human
aagagaaugcccuucuccuuauu

SEQ ID NO: 1471096 - RNA, 15 nt, Human
aagacuuuuaugaua

SEQ ID NO: 1471097 - RNA, 15 nt, Human
aagagaacuuccaga

SEQ ID NO: 1471098 - RNA, 20 nt, Human
aagagaacccacgaacauuc

SEQ ID NO: 1471099 - RNA, 22 nt, Human
aagagaaugcccuucuccuuau

SEQ ID NO: 1471100 - RNA, 19 nt, Human
aagagacaaacaccuccca

SEQ ID NO: 1471101 - RNA, 21 nt, Human
aagagacaaacaccucccagg

SEQ ID NO: 1471102 - RNA, 16 nt, Human
aagagacagcccagga

SEQ ID NO: 1471103 - RNA, 15 nt, Human
aagagacagcccagg

SEQ ID NO: 1471104 - RNA, 18 nt, Human
aagagagccugcaggauc

SEQ ID NO: 1471105 - RNA, 19 nt, Human
aacuguuguagaagacaaa

SEQ ID NO: 1471106 - RNA, 18 nt, Human
aacuguuguagaagacaa

SEQ ID NO: 1471107 - RNA, 21 nt, Human
aacuuaccaggcaccaaaaga

SEQ ID NO: 1471108 - RNA, 22 nt, Human
aagacagcuucucauccugcag

SEQ ID NO: 1471109 - RNA, 23 nt, Human
aagacagugaaagaaaauaacaa

SEQ ID NO: 1471110 - RNA, 14 nt, Human
aagacaguggcccc

SEQ ID NO: 1471111 - RNA, 12 nt, Human
aagacaugucug

SEQ ID NO: 1471112 - RNA, 13 nt, Human
aagacaugucugu

SEQ ID NO: 1471113 - RNA, 16 nt, Human
aagacaugucuguucu

SEQ ID NO: 1471114 - RNA, 17 nt, Human
aagacaugucuguucua

SEQ ID NO: 1471115 - RNA, 19 nt, Human
aagacaugucuguucuaca

SEQ ID NO: 1471116 - RNA, 16 nt, Human
aagauacugaaauaaa

SEQ ID NO: 1471117 - RNA, 20 nt, Human
aagauacugaaauaaacguc

SEQ ID NO: 1471118 - RNA, 14 nt, Human
aagauacuuaagug

SEQ ID NO: 1471119 - RNA, 17 nt, Human
aagauacuuaagugcug

SEQ ID NO: 1471120 - RNA, 20 nt, Human
aagauucaaugccccugaau

SEQ ID NO: 1471121 - RNA, 21 nt, Human
aagauucaaugccccugaauu

SEQ ID NO: 1471122 - RNA, 12 nt, Human
aagauugcugaa

SEQ ID NO: 1471123 - RNA, 15 nt, Human
aagauugcugaaauu

SEQ ID NO: 1471124 - RNA, 12 nt, Human
aaggucugcuuu

SEQ ID NO: 1471125 - RNA, 13 nt, Human
aaggucuuugguu

SEQ ID NO: 1471126 - RNA, 19 nt, Human
aaggucuuugguucagcua

SEQ ID NO: 1471127 - RNA, 19 nt, Human
aaggugaaacauuuucucc

SEQ ID NO: 1471128 - RNA, 17 nt, Human
aaggugaaacauuuucu

SEQ ID NO: 1471129 - RNA, 22 nt, Human
aaggugaaacauuuucucccug

SEQ ID NO: 1471130 - RNA, 15 nt, Human
aaggugguguuucug

SEQ ID NO: 1471131 - RNA, 20 nt, Human
aagguguagccacaccagga

SEQ ID NO: 1471132 - RNA, 15 nt, Human
aaguagaugcauuug

SEQ ID NO: 1471133 - RNA, 17 nt, Human
aagggacugagaaauuu

SEQ ID NO: 1471134 - RNA, 15 nt, Human
aagggacugagaaau

SEQ ID NO: 1471135 - RNA, 13 nt, Human
aagggagggggag

SEQ ID NO: 1471136 - RNA, 21 nt, Human
aagggacugagagaugcagaa

SEQ ID NO: 1471137 - RNA, 16 nt, Human
aagggauccugccugc

SEQ ID NO: 1471138 - RNA, 13 nt, Human
aagggauccugcc

SEQ ID NO: 1471139 - RNA, 17 nt, Human
aagcuggagugcagugg

SEQ ID NO: 1471140 - RNA, 21 nt, Human
aagcugcugagaaucuagccu

SEQ ID NO: 1471141 - RNA, 15 nt, Human
aagcugcccugccca

SEQ ID NO: 1471142 - RNA, 18 nt, Human
aagcugcaucuagaggcu

SEQ ID NO: 1471143 - RNA, 12 nt, Human
aaggaauuuuau

SEQ ID NO: 1471144 - RNA, 12 nt, Human
aaggaccuaaaa

SEQ ID NO: 1471145 - RNA, 23 nt, Human
aagccagauuuuuuaaaauuuau

SEQ ID NO: 1471146 - RNA, 14 nt, Human
aauaauguuucaaa

SEQ ID NO: 1471147 - RNA, 19 nt, Human
aauaauguuucaaacauau

SEQ ID NO: 1471148 - RNA, 12 nt, Human
aauaauguuuca

SEQ ID NO: 1471149 - RNA, 16 nt, Human
aauaauacugcugaga

SEQ ID NO: 1471150 - RNA, 17 nt, Human
aauaauauauuuuaaau

SEQ ID NO: 1471151 - RNA, 12 nt, Human
aauaaaauuuuu

SEQ ID NO: 1471152 - RNA, 13 nt, Human
aauaaacaaauaa

SEQ ID NO: 1471153 - RNA, 22 nt, Human
aauaaaggacuguaaucuuauu

SEQ ID NO: 1471154 - RNA, 18 nt, Human
aauaaaggacuguaaucu

SEQ ID NO: 1471155 - RNA, 11 nt, Human
aauaaaggacu

SEQ ID NO: 1471156 - RNA, 14 nt, Human
aauaaagcugcuga

SEQ ID NO: 1471157 - RNA, 19 nt, Human
aauaaagcuguguggcagu

SEQ ID NO: 1471158 - RNA, 11 nt, Human
aauaaagcugu

SEQ ID NO: 1471159 - RNA, 15 nt, Human
aauaaacgucuuaaa

SEQ ID NO: 1471160 - RNA, 22 nt, Human
aaguugauaugccuuuucccaa

SEQ ID NO: 1471161 - RNA, 23 nt, Human
aaguggggcgggcuucauagaga

SEQ ID NO: 1471162 - RNA, 19 nt, Human
aauacgugggcauucaaau

SEQ ID NO: 1471163 - RNA, 20 nt, Human
aauacgugggcauucaaaug

SEQ ID NO: 1471164 - RNA, 14 nt, Human
aauacuucucauuu

SEQ ID NO: 1471165 - RNA, 16 nt, Human
aauacuucucauuuuu

SEQ ID NO: 1471166 - RNA, 22 nt, Human
aauacuucucauuuuuuaaaaa

SEQ ID NO: 1471167 - RNA, 17 nt, Human
aauagaacaaggcugag

SEQ ID NO: 1471168 - RNA, 14 nt, Human
aauaguuuggauau

SEQ ID NO: 1471169 - RNA, 21 nt, Human
aauaguuuuauuaauaaacau

SEQ ID NO: 1471170 - RNA, 20 nt, Human
aauaguuuuauuaauaaaca

SEQ ID NO: 1471171 - RNA, 22 nt, Human
aauaguuuuauuaauaaacauu

SEQ ID NO: 1471172 - RNA, 19 nt, Human
aauauacuuuuacaaguaa

SEQ ID NO: 1471173 - RNA, 18 nt, Human
aauauacuuuuacaagua

SEQ ID NO: 1471174 - RNA, 21 nt, Human
aauauagaucaguuauaagua

SEQ ID NO: 1471175 - RNA, 13 nt, Human
aaucauuuugcaa

SEQ ID NO: 1471176 - RNA, 16 nt, Human
aauccauacauuugug

SEQ ID NO: 1471177 - RNA, 17 nt, Human
aauccauacauuugugu

SEQ ID NO: 1471178 - RNA, 14 nt, Human
aaugauaacuggaa

SEQ ID NO: 1471179 - RNA, 14 nt, Human
aaugaaauuaacug

SEQ ID NO: 1471180 - RNA, 12 nt, Human
aaugaacaaaug

SEQ ID NO: 1471181 - RNA, 15 nt, Human
aaugauaacuggaaa

SEQ ID NO: 1471182 - RNA, 16 nt, Human
aaugauaacuggaaac

SEQ ID NO: 1471183 - RNA, 21 nt, Human
aaugauagacaauugagguaa

SEQ ID NO: 1471184 - RNA, 12 nt, Human
aaugaacagaac

SEQ ID NO: 1471185 - RNA, 23 nt, Human
aauggucacguuuggugcuucuc

SEQ ID NO: 1471186 - RNA, 22 nt, Human
aauggucacguuuggugcuucu

SEQ ID NO: 1471187 - RNA, 15 nt, Human
aauggguuacuugau

SEQ ID NO: 1471188 - RNA, 22 nt, Human
aaugccugacuagggagccaug

SEQ ID NO: 1471189 - RNA, 15 nt, Human
aaauaaacgucuuaa

SEQ ID NO: 1471190 - RNA, 16 nt, Human
aaauaaacgucuuaaa

SEQ ID NO: 1471191 - RNA, 18 nt, Human
aaauaaacaaauaacaau

SEQ ID NO: 1471192 - RNA, 14 nt, Human
aaauaaaaccagcu

SEQ ID NO: 1471193 - RNA, 18 nt, Human
aaagucaauguuuucagu

SEQ ID NO: 1471194 - RNA, 17 nt, Human
aaagucaauguuuucag

SEQ ID NO: 1471195 - RNA, 19 nt, Human
aaagugccauuaacaaaug

SEQ ID NO: 1471196 - RNA, 17 nt, Human
aaauaaacgucuuaaau

SEQ ID NO: 1471197 - RNA, 15 nt, Human
aaauaaauguaucau

SEQ ID NO: 1471198 - RNA, 21 nt, Human
aaauaaauguaucauagaaau

SEQ ID NO: 1471199 - RNA, 16 nt, Human
aaauaaauguaucaua

SEQ ID NO: 1471200 - RNA, 17 nt, Human
aaagcccauucauucca

SEQ ID NO: 1471201 - RNA, 16 nt, Human
aaagcccauucauucc

SEQ ID NO: 1471202 - RNA, 19 nt, Human
aaaggcuagguacacagcu

SEQ ID NO: 1471203 - RNA, 20 nt, Human
aaaggcuaugauugucuuug

SEQ ID NO: 1471204 - RNA, 15 nt, Human
aaagccaaacauaua

SEQ ID NO: 1471205 - RNA, 19 nt, Human
aaagaacggaagaagagau

SEQ ID NO: 1471206 - RNA, 15 nt, Human
aaagaacggaagaag

SEQ ID NO: 1471207 - RNA, 23 nt, Human
aaagaaccaacaaccucaacugc

SEQ ID NO: 1471208 - RNA, 13 nt, Human
aaagaaacauuug

SEQ ID NO: 1471209 - RNA, 12 nt, Human
aaagaaacuuuc

SEQ ID NO: 1471210 - RNA, 20 nt, Human
aaagaagaaggugggaggau

SEQ ID NO: 1471211 - RNA, 19 nt, Human
aaagaaaauuuuuguagua

SEQ ID NO: 1471212 - RNA, 12 nt, Human
aaagaaaauuuu

SEQ ID NO: 1471213 - RNA, 13 nt, Human
aaacugagugacu

SEQ ID NO: 1471214 - RNA, 13 nt, Human
aaacucuuuuccc

SEQ ID NO: 1471215 - RNA, 19 nt, Human
aaacccuugccaugugcua

SEQ ID NO: 1471216 - RNA, 14 nt, Human
aaaccgcuaaaaga

SEQ ID NO: 1471217 - RNA, 15 nt, Human
aaaccgcuaaaagaa

SEQ ID NO: 1471218 - RNA, 16 nt, Human
aaaccgcuaaaagaaa

SEQ ID NO: 1471219 - RNA, 18 nt, Human
aaaccgcuaaaagaaacu

SEQ ID NO: 1471220 - RNA, 23 nt, Human
aaaccgcuaaaagaaacuuucuu

SEQ ID NO: 1471221 - RNA, 21 nt, Human
aaaccgcuaaaagaaacuuuc

SEQ ID NO: 1471222 - RNA, 22 nt, Human
aaacccauauuguaaaacaggu

SEQ ID NO: 1471223 - RNA, 21 nt, Human
aaagauaaauuauaucaauuu

SEQ ID NO: 1471224 - RNA, 12 nt, Human
aaacaggaucag

SEQ ID NO: 1471225 - RNA, 17 nt, Human
aaacagggccacauaga

SEQ ID NO: 1471226 - RNA, 12 nt, Human
aaaauugaaugc

SEQ ID NO: 1471227 - RNA, 14 nt, Human
aaaauugaaugcaa

SEQ ID NO: 1471228 - RNA, 21 nt, Human
aaaauugaaugcaaaccauag

SEQ ID NO: 1471229 - RNA, 15 nt, Human
aaaauaaaaaacacu

SEQ ID NO: 1471230 - RNA, 21 nt, Human
aaaauaaaaaagaucccaaau

SEQ ID NO: 1471231 - RNA, 20 nt, Human
aaaaguuuuuuauuaugcau

SEQ ID NO: 1471232 - RNA, 21 nt, Human
aaaauccacuuuaucuugaau

SEQ ID NO: 1471233 - RNA, 20 nt, Human
aaaauaaaaagaucacuuuc

SEQ ID NO: 1471234 - RNA, 16 nt, Human
aaaauaaaaaagaucc

SEQ ID NO: 1471235 - RNA, 13 nt, Human
aaaauuaucuaua

SEQ ID NO: 1471236 - RNA, 13 nt, Human
aaaauuauuuaaa

SEQ ID NO: 1471237 - RNA, 14 nt, Human
aaaauuacaacuaa

SEQ ID NO: 1471238 - RNA, 12 nt, Human
aaaauuaagaaa

SEQ ID NO: 1471239 - RNA, 22 nt, Human
aaaauuaacaugaauauuuagu

SEQ ID NO: 1471240 - RNA, 20 nt, Human
aaaauuaaaccggaccaucu

SEQ ID NO: 1471241 - RNA, 19 nt, Human
aaaauccauacauuugugu

SEQ ID NO: 1471242 - RNA, 20 nt, Human
aaaauuaagaaaggauaaag

SEQ ID NO: 1471243 - RNA, 13 nt, Human
aaaauuaagaaag

SEQ ID NO: 1471244 - RNA, 17 nt, Human
aaaauuaaaucaaccuu

SEQ ID NO: 1471245 - RNA, 20 nt, Human
aacaggaucaguuaacuauu

SEQ ID NO: 1471246 - RNA, 15 nt, Human
aacagauuguuugca

SEQ ID NO: 1471247 - RNA, 16 nt, Human
aacagauuguuugcaa

SEQ ID NO: 1471248 - RNA, 18 nt, Human
aacacuagacaagccaga

SEQ ID NO: 1471249 - RNA, 19 nt, Human
aacacuagacaagccagaa

SEQ ID NO: 1471250 - RNA, 18 nt, Human
aaccauaacaacuucaua

SEQ ID NO: 1471251 - RNA, 22 nt, Human
aaccauacaaaaauuccuuuuc

SEQ ID NO: 1471252 - RNA, 22 nt, Human
aaccauagcacaggcuaauuuu

SEQ ID NO: 1471253 - RNA, 21 nt, Human
aacaucugagaaaagcuuuga

SEQ ID NO: 1471254 - RNA, 16 nt, Human
aaccgcuaaaagaaac

SEQ ID NO: 1471255 - RNA, 22 nt, Human
aacucaucuagguaaauuacag

SEQ ID NO: 1471256 - RNA, 15 nt, Human
aacucauauuuucau

SEQ ID NO: 1471257 - RNA, 16 nt, Human
aacucauauuuucaug

SEQ ID NO: 1471258 - RNA, 18 nt, Human
aacucauauuuucaugcu

SEQ ID NO: 1471259 - RNA, 12 nt, Human
aacugaggaauu

SEQ ID NO: 1471260 - RNA, 13 nt, Human
aacugaggaauuu

SEQ ID NO: 1471261 - RNA, 18 nt, Human
aacugaggaauuucaccu

SEQ ID NO: 1471262 - RNA, 16 nt, Human
aacugaggaauuuucu

SEQ ID NO: 1471263 - RNA, 16 nt, Human
aacgcuaucugggaag

SEQ ID NO: 1471264 - RNA, 15 nt, Human
aacguauaaaagccu

SEQ ID NO: 1471265 - RNA, 16 nt, Human
aacucaaaauauuugu

SEQ ID NO: 1471266 - RNA, 22 nt, Human
aacucaaacugaggaauuucac

SEQ ID NO: 1471267 - RNA, 21 nt, Human
aaauguuuuuuuuuaaagacu

SEQ ID NO: 1471268 - RNA, 18 nt, Human
aaauguuuuuuuuuaaag

SEQ ID NO: 1471269 - RNA, 23 nt, Human
aaauguugaaauaugauguuaaa

SEQ ID NO: 1471270 - RNA, 18 nt, Human
aaauugaugggauuuggu

SEQ ID NO: 1471271 - RNA, 23 nt, Human
aaauugagcuggaccucaccaag

SEQ ID NO: 1471272 - RNA, 18 nt, Human
aacaaacauuugcugaau

SEQ ID NO: 1471273 - RNA, 22 nt, Human
aaauguuuuuuuuuaaagacuu

SEQ ID NO: 1471274 - RNA, 20 nt, Human
aaauuaacuggguaaugaaa

SEQ ID NO: 1471275 - RNA, 21 nt, Human
aaauuaacuggguaaugaaac

SEQ ID NO: 1471276 - RNA, 21 nt, Human
aacacccucacacugggacuu

SEQ ID NO: 1471277 - RNA, 17 nt, Human
aacacccucacacuggg

SEQ ID NO: 1471278 - RNA, 13 nt, Human
aacaccucccagg

SEQ ID NO: 1471279 - RNA, 23 nt, Human
aacaccucccaggagacaguuca

SEQ ID NO: 1471280 - RNA, 17 nt, Human
aacacuaacaugauuug

SEQ ID NO: 1471281 - RNA, 20 nt, Human
aacaaacucguuuuuuacaa

SEQ ID NO: 1471282 - RNA, 16 nt, Human
aacaaacucguuuuuu

SEQ ID NO: 1471283 - RNA, 16 nt, Human
aacaaagguugagaug

SEQ ID NO: 1471284 - RNA, 16 nt, Human
aacaaauagucuauca

SEQ ID NO: 1471285 - RNA, 18 nt, Human
agaggaauuacgugcucu

SEQ ID NO: 1471286 - RNA, 10 nt, Human
agagggcugc

SEQ ID NO: 1471287 - RNA, 14 nt, Human
agagggcgcaggcc

SEQ ID NO: 1471288 - RNA, 16 nt, Human
agagggcgcaggccgu

SEQ ID NO: 1471289 - RNA, 16 nt, Human
agacugcuguggccag

SEQ ID NO: 1471290 - RNA, 17 nt, Human
agacugcuguggccagg

SEQ ID NO: 1471291 - RNA, 18 nt, Human
agacugcuguggccagga

SEQ ID NO: 1471292 - RNA, 19 nt, Human
agacugcuguggccaggag

SEQ ID NO: 1471293 - RNA, 20 nt, Human
agacugcuguggccaggagg

SEQ ID NO: 1471294 - RNA, 21 nt, Human
agacugcuguggccaggaggu

SEQ ID NO: 1471295 - RNA, 19 nt, Human
agacugcuuccaauuuucu

SEQ ID NO: 1471296 - RNA, 18 nt, Human
agacuggaacacuagaca

SEQ ID NO: 1471297 - RNA, 13 nt, Human
agacuggaacuug

SEQ ID NO: 1471298 - RNA, 17 nt, Human
agacuggaacuugaacu

SEQ ID NO: 1471299 - RNA, 18 nt, Human
agacuggaacuugaacug

SEQ ID NO: 1471300 - RNA, 15 nt, Human
agacuggaacacuag

SEQ ID NO: 1471301 - RNA, 23 nt, Human
agacuggaacuugaacugauuca

SEQ ID NO: 1471302 - RNA, 11 nt, Human
agacuggacag

SEQ ID NO: 1471303 - RNA, 13 nt, Human
agacuggacagcu

SEQ ID NO: 1471304 - RNA, 14 nt, Human
agacuggacagcuu

SEQ ID NO: 1471305 - RNA, 15 nt, Human
agacuggacagcuug

SEQ ID NO: 1471306 - RNA, 16 nt, Human
agacuggacagcuugu

SEQ ID NO: 1471307 - RNA, 17 nt, Human
agacuggacagcuugug

SEQ ID NO: 1471308 - RNA, 14 nt, Human
agagaggccuuuug

SEQ ID NO: 1471309 - RNA, 20 nt, Human
agagaggccuuuuggaaugu

SEQ ID NO: 1471310 - RNA, 20 nt, Human
agagccuccuuucuggcuuu

SEQ ID NO: 1471311 - RNA, 17 nt, Human
agaagagaucaggaaga

SEQ ID NO: 1471312 - RNA, 14 nt, Human
agaaggugggagga

SEQ ID NO: 1471313 - RNA, 22 nt, Human
agaaggugggaggaugugaauu

SEQ ID NO: 1471314 - RNA, 18 nt, Human
agaagucacauuccugaa

SEQ ID NO: 1471315 - RNA, 20 nt, Human
agaagucacauuccugaaca

SEQ ID NO: 1471316 - RNA, 21 nt, Human
agaagucacauuccugaacag

SEQ ID NO: 1471317 - RNA, 17 nt, Human
agaaguagaaaucauag

SEQ ID NO: 1471318 - RNA, 22 nt, Human
agaaguaaaagcaaaaaagaaa

SEQ ID NO: 1471319 - RNA, 15 nt, Human
agaaguaaaagcaaa

SEQ ID NO: 1471320 - RNA, 16 nt, Human
agaagguugcucuaga

SEQ ID NO: 1471321 - RNA, 20 nt, Human
agaagguugcucuagauuga

SEQ ID NO: 1471322 - RNA, 18 nt, Human
agaagacugcauuauauu

SEQ ID NO: 1471323 - RNA, 15 nt, Human
agaagacaauugaca

SEQ ID NO: 1471324 - RNA, 22 nt, Human
agaagucacauuccugaacagg

SEQ ID NO: 1471325 - RNA, 17 nt, Human
agaaugagagacacacu

SEQ ID NO: 1471326 - RNA, 22 nt, Human
agaaugagagacacacugaaga

SEQ ID NO: 1471327 - RNA, 17 nt, Human
agaaugauuaugaauua

SEQ ID NO: 1471328 - RNA, 14 nt, Human
agaaugagacaucc

SEQ ID NO: 1471329 - RNA, 13 nt, Human
agaaugauuucau

SEQ ID NO: 1471330 - RNA, 14 nt, Human
agaaugauuucaug

SEQ ID NO: 1471331 - RNA, 20 nt, Human
agaaugcuuaaucagauaga

SEQ ID NO: 1471332 - RNA, 14 nt, Human
agaaugcuuaauca

SEQ ID NO: 1471333 - RNA, 16 nt, Human
agaauggcagaaaagu

SEQ ID NO: 1471334 - RNA, 22 nt, Human
agacagccaacuauggccugug

SEQ ID NO: 1471335 - RNA, 19 nt, Human
agacaaacaccucccagga

SEQ ID NO: 1471336 - RNA, 18 nt, Human
agacaaagguuuuccucu

SEQ ID NO: 1471337 - RNA, 21 nt, Human
agauguagccccucuccugga

SEQ ID NO: 1471338 - RNA, 19 nt, Human
agauucucauaacuugaga

SEQ ID NO: 1471339 - RNA, 17 nt, Human
agauucucccuugcucu

SEQ ID NO: 1471340 - RNA, 20 nt, Human
agauucucauaacuugagac

SEQ ID NO: 1471341 - RNA, 17 nt, Human
agauguaaaagguauua

SEQ ID NO: 1471342 - RNA, 11 nt, Human
agaugguggau

SEQ ID NO: 1471343 - RNA, 13 nt, Human
agaucuggcaugu

SEQ ID NO: 1471344 - RNA, 21 nt, Human
agagugcuguccgguggagau

SEQ ID NO: 1471345 - RNA, 24 nt, Human
agcaaaauuuuuucucuaggaaau

SEQ ID NO: 1471346 - RNA, 21 nt, Human
agcaaaauaauuuuaaacaaa

SEQ ID NO: 1471347 - RNA, 14 nt, Human
agcaaaagaagaag

SEQ ID NO: 1471348 - RNA, 17 nt, Human
agcaaaagaauggcaga

SEQ ID NO: 1471349 - RNA, 21 nt, Human
agcaaaagaauggcagaaaag

SEQ ID NO: 1471350 - RNA, 20 nt, Human
agcaaaucgaaugaaauuaa

SEQ ID NO: 1471351 - RNA, 22 nt, Human
agcaaaucgaaugaaauuaacu

SEQ ID NO: 1471352 - RNA, 21 nt, Human
agcaauuacaacggagucaaa

SEQ ID NO: 1471353 - RNA, 17 nt, Human
agcacaaguuauuuaaa

SEQ ID NO: 1471354 - RNA, 18 nt, Human
agcacaaguuauuuaaau

SEQ ID NO: 1471355 - RNA, 19 nt, Human
agcacaaguuauuuaaauc

SEQ ID NO: 1471356 - RNA, 21 nt, Human
agcacaaguuauuuaaaucug

SEQ ID NO: 1471357 - RNA, 15 nt, Human
agcaauccucccacu

SEQ ID NO: 1471358 - RNA, 16 nt, Human
agcaaucugacccuau

SEQ ID NO: 1471359 - RNA, 22 nt, Human
agcacuugcaaccgucuguuau

SEQ ID NO: 1471360 - RNA, 15 nt, Human
agcacuucuuuuucu

SEQ ID NO: 1471361 - RNA, 16 nt, Human
agcccaaugaaaugaa

SEQ ID NO: 1471362 - RNA, 21 nt, Human
agcccaccauuuggcaucccu

SEQ ID NO: 1471363 - RNA, 22 nt, Human
agcccaccauuuggcaucccug

SEQ ID NO: 1471364 - RNA, 19 nt, Human
agccaaggagucacugaga

SEQ ID NO: 1471365 - RNA, 21 nt, Human
agccaaggagucacugagacc

SEQ ID NO: 1471366 - RNA, 20 nt, Human
agccaaggagucacugagac

SEQ ID NO: 1471367 - RNA, 21 nt, Human
agcuuuuaugugaaacauguu

SEQ ID NO: 1471368 - RNA, 15 nt, Human
agcuuuuaugugaaa

SEQ ID NO: 1471369 - RNA, 14 nt, Human
aggaacaaacaggg

SEQ ID NO: 1471370 - RNA, 13 nt, Human
aggaacaaacagg

SEQ ID NO: 1471371 - RNA, 16 nt, Human
aggaaccgaggcaggg

SEQ ID NO: 1471372 - RNA, 23 nt, Human
aggaaguugacuuauaguacaug

SEQ ID NO: 1471373 - RNA, 22 nt, Human
aggaaguugacuuauaguacau

SEQ ID NO: 1471374 - RNA, 18 nt, Human
aggaaguugacuuauagu

SEQ ID NO: 1471375 - RNA, 19 nt, Human
aggaaggcuuguugugcuu

SEQ ID NO: 1471376 - RNA, 22 nt, Human
aggaaggcuuguugugcuuuua

SEQ ID NO: 1471377 - RNA, 21 nt, Human
aggaaggcuuguugugcuuuu

SEQ ID NO: 1471378 - RNA, 18 nt, Human
agcuucacuguaaaauaa

SEQ ID NO: 1471379 - RNA, 20 nt, Human
aggagacuguuuggaaauug

SEQ ID NO: 1471380 - RNA, 23 nt, Human
agcguuuuuuaaauguauacuau

SEQ ID NO: 1471381 - RNA, 20 nt, Human
agcguuuuuuaaauguauac

SEQ ID NO: 1471382 - RNA, 19 nt, Human
agcguuuuuuaaauguaua

SEQ ID NO: 1471383 - RNA, 18 nt, Human
agcguuuuuuaaauguau

SEQ ID NO: 1471384 - RNA, 12 nt, Human
agcuaaaauaaa

SEQ ID NO: 1471385 - RNA, 19 nt, Human
agcuaaaauaaagaaauag

SEQ ID NO: 1471386 - RNA, 17 nt, Human
agcguuuuuuaaaugua

SEQ ID NO: 1471387 - RNA, 14 nt, Human
agcguuuuuuaaau

SEQ ID NO: 1471388 - RNA, 11 nt, Human
agcguuuuuua

SEQ ID NO: 1471389 - RNA, 12 nt, Human
agcuacaaaugc

SEQ ID NO: 1471390 - RNA, 14 nt, Human
agcucaacucucuu

SEQ ID NO: 1471391 - RNA, 22 nt, Human
agcucaacucucuuauugccuc

SEQ ID NO: 1471392 - RNA, 23 nt, Human
agcucaacucucuuauugccuca

SEQ ID NO: 1471393 - RNA, 19 nt, Human
agcucacugcaaccuccac

SEQ ID NO: 1471394 - RNA, 13 nt, Human
agcucacuucugg

SEQ ID NO: 1471395 - RNA, 23 nt, Human
agcucacuucugggcuucaucug

SEQ ID NO: 1471396 - RNA, 18 nt, Human
agcucagaaaauaucccu

SEQ ID NO: 1471397 - RNA, 19 nt, Human
agcucagaaaauaucccuc

SEQ ID NO: 1471398 - RNA, 21 nt, Human
agcucagaaaauaucccuccu

SEQ ID NO: 1471399 - RNA, 18 nt, Human
agccuggcuucaaauugu

SEQ ID NO: 1471400 - RNA, 17 nt, Human
agccuggcuucaaauug

SEQ ID NO: 1471401 - RNA, 17 nt, Human
agccuggggcugaggcu

SEQ ID NO: 1471402 - RNA, 20 nt, Human
agcugguuuaauguuuuggc

SEQ ID NO: 1471403 - RNA, 16 nt, Human
agcuccuuaaggcucu

SEQ ID NO: 1471404 - RNA, 17 nt, Human
agcuccuuaaggcucuu

SEQ ID NO: 1471405 - RNA, 18 nt, Human
agcuccuuaaggcucuuu

SEQ ID NO: 1471406 - RNA, 21 nt, Human
aggccggcuugccacaccccc

SEQ ID NO: 1471407 - RNA, 20 nt, Human
aggccggcuugccacacccc

SEQ ID NO: 1471408 - RNA, 19 nt, Human
aggccggcuugccacaccc

SEQ ID NO: 1471409 - RNA, 14 nt, Human
aggcuaagcugccg

SEQ ID NO: 1471410 - RNA, 14 nt, Human
agggaccggcggac

SEQ ID NO: 1471411 - RNA, 13 nt, Human
agggacugagaga

SEQ ID NO: 1471412 - RNA, 20 nt, Human
agggacugagagaugcagaa

SEQ ID NO: 1471413 - RNA, 22 nt, Human
aggcuggucucaaacuccugac

SEQ ID NO: 1471414 - RNA, 12 nt, Human
aggcuaauuuuu

SEQ ID NO: 1471415 - RNA, 23 nt, Human
aggcuaauuuuuuuguauuuuag

SEQ ID NO: 1471416 - RNA, 22 nt, Human
aggcuaauuuuuuuguauuuua

SEQ ID NO: 1471417 - RNA, 15 nt, Human
aggcagagaagaaag

SEQ ID NO: 1471418 - RNA, 14 nt, Human
aggcagagaagaaa

SEQ ID NO: 1471419 - RNA, 13 nt, Human
aggcagagaagaa

SEQ ID NO: 1471420 - RNA, 22 nt, Human
aggcagacucuuuaugcuugca

SEQ ID NO: 1471421 - RNA, 20 nt, Human
aggagagggcgcuccucucu

SEQ ID NO: 1471422 - RNA, 21 nt, Human
aggccaugggcacugugggua

SEQ ID NO: 1471423 - RNA, 23 nt, Human
aggccaugggcacuguggguaga

SEQ ID NO: 1471424 - RNA, 13 nt, Human
aggcccugugccc

SEQ ID NO: 1471425 - RNA, 12 nt, Human
agguacuauuau

SEQ ID NO: 1471426 - RNA, 21 nt, Human
agguccucaguguccucaggg

SEQ ID NO: 1471427 - RNA, 15 nt, Human
agguccucagagaau

SEQ ID NO: 1471428 - RNA, 21 nt, Human
aggguuugugacagggcgggg

SEQ ID NO: 1471429 - RNA, 18 nt, Human
aggguuugugacagggcg

SEQ ID NO: 1471430 - RNA, 14 nt, Human
agggccugaugggg

SEQ ID NO: 1471431 - RNA, 19 nt, Human
agggccugaugggguggaa

SEQ ID NO: 1471432 - RNA, 21 nt, Human
agggccugaugggguggaagg

SEQ ID NO: 1471433 - RNA, 20 nt, Human
agggacuguaaacacagaca

SEQ ID NO: 1471434 - RNA, 14 nt, Human
aggggccugcccag

SEQ ID NO: 1471435 - RNA, 13 nt, Human
aggggccugccca

SEQ ID NO: 1471436 - RNA, 13 nt, Human
agggcgcaggccg

SEQ ID NO: 1471437 - RNA, 22 nt, Human
augcacaaauucugucucugga

SEQ ID NO: 1471438 - RNA, 15 nt, Human
augcacaaauucugu

SEQ ID NO: 1471439 - RNA, 23 nt, Human
augcacaaauucugucucuggau

SEQ ID NO: 1471440 - RNA, 16 nt, Human
augauggguguuuuua

SEQ ID NO: 1471441 - RNA, 19 nt, Human
augauggcaauuuuguaac

SEQ ID NO: 1471442 - RNA, 18 nt, Human
augccuuguuucauauuu

SEQ ID NO: 1471443 - RNA, 16 nt, Human
augccuuacucuucuu

SEQ ID NO: 1471444 - RNA, 18 nt, Human
augccuuacucuucuuga

SEQ ID NO: 1471445 - RNA, 17 nt, Human
augcauguccuguaaag

SEQ ID NO: 1471446 - RNA, 21 nt, Human
augcauuauaggaucauuugu

SEQ ID NO: 1471447 - RNA, 18 nt, Human
augcauuauaucaaaucu

SEQ ID NO: 1471448 - RNA, 22 nt, Human
augcauuauaggaucauuuguu

SEQ ID NO: 1471449 - RNA, 17 nt, Human
auggcuuugugauucaa

SEQ ID NO: 1471450 - RNA, 17 nt, Human
auggauaggcacaggaa

SEQ ID NO: 1471451 - RNA, 15 nt, Human
auggagucuugcucu

SEQ ID NO: 1471452 - RNA, 18 nt, Human
auggauaggcacaggaaa

SEQ ID NO: 1471453 - RNA, 22 nt, Human
auggauauaguuuuacuuuuaa

SEQ ID NO: 1471454 - RNA, 16 nt, Human
auggauccuggaggau

SEQ ID NO: 1471455 - RNA, 19 nt, Human
auggaggggcagagccagg

SEQ ID NO: 1471456 - RNA, 15 nt, Human
auggaggggcagagc

SEQ ID NO: 1471457 - RNA, 14 nt, Human
auggaggggcagag

SEQ ID NO: 1471458 - RNA, 21 nt, Human
augcugagauuacagguguga

SEQ ID NO: 1471459 - RNA, 13 nt, Human
augcugauggagc

SEQ ID NO: 1471460 - RNA, 17 nt, Human
auguguaagacaaaaag

SEQ ID NO: 1471461 - RNA, 19 nt, Human
auguguaagacaaaaagcu

SEQ ID NO: 1471462 - RNA, 20 nt, Human
auguguaugcacaguaaaaa

SEQ ID NO: 1471463 - RNA, 19 nt, Human
auguguaugcacaguaaaa

SEQ ID NO: 1471464 - RNA, 15 nt, Human
auguguaugcacagu

SEQ ID NO: 1471465 - RNA, 13 nt, Human
auguguauaaaaa

SEQ ID NO: 1471466 - RNA, 23 nt, Human
auguguauaaaaauaaaaaagau

SEQ ID NO: 1471467 - RNA, 18 nt, Human
augugaaaucauucauuu

SEQ ID NO: 1471468 - RNA, 17 nt, Human
augugaaaucauucauu

SEQ ID NO: 1471469 - RNA, 20 nt, Human
augugaaauuuacaucauuu

SEQ ID NO: 1471470 - RNA, 23 nt, Human
augugaaauuuacaucauuucuu

SEQ ID NO: 1471471 - RNA, 15 nt, Human
augugaaacauguuu

SEQ ID NO: 1471472 - RNA, 14 nt, Human
augugaaacauguu

SEQ ID NO: 1471473 - RNA, 14 nt, Human
auguaaauuuguac

SEQ ID NO: 1471474 - RNA, 15 nt, Human
auguaaauuuguacu

SEQ ID NO: 1471475 - RNA, 17 nt, Human
auguaaauuuguacuau

SEQ ID NO: 1471476 - RNA, 21 nt, Human
auguaaauuuguacuauuuaa

SEQ ID NO: 1471477 - RNA, 19 nt, Human
auguaaauuuguacuauuu

SEQ ID NO: 1471478 - RNA, 14 nt, Human
auguaacuagaauu

SEQ ID NO: 1471479 - RNA, 14 nt, Human
auguaacuuuugua

SEQ ID NO: 1471480 - RNA, 13 nt, Human
auguaaauuugua

SEQ ID NO: 1471481 - RNA, 21 nt, Human
augucaaucagccuaguugau

SEQ ID NO: 1471482 - RNA, 22 nt, Human
auggguuagggaaaacauucca

SEQ ID NO: 1471483 - RNA, 14 nt, Human
augguaauuguugc

SEQ ID NO: 1471484 - RNA, 16 nt, Human
augguaccagaugcag

SEQ ID NO: 1471485 - RNA, 19 nt, Human
auccucaguuuuugugaaa

SEQ ID NO: 1471486 - RNA, 21 nt, Human
auccccacgccacagcccuuu

SEQ ID NO: 1471487 - RNA, 20 nt, Human
auccccacgccacagcccuu

SEQ ID NO: 1471488 - RNA, 18 nt, Human
auccccacgccacagccc

SEQ ID NO: 1471489 - RNA, 17 nt, Human
auccccacgccacagcc

SEQ ID NO: 1471490 - RNA, 16 nt, Human
auccccacgccacagc

SEQ ID NO: 1471491 - RNA, 15 nt, Human
auccccacgccacag

SEQ ID NO: 1471492 - RNA, 19 nt, Human
auccagagucccugccugg

SEQ ID NO: 1471493 - RNA, 20 nt, Human
auccagagucccugccugga

SEQ ID NO: 1471494 - RNA, 21 nt, Human
auccagagucccugccuggac

SEQ ID NO: 1471495 - RNA, 17 nt, Human
auccaccugccuuggcu

SEQ ID NO: 1471496 - RNA, 22 nt, Human
auccuucaucuggauuccagag

SEQ ID NO: 1471497 - RNA, 16 nt, Human
auccuugagucaaaaa

SEQ ID NO: 1471498 - RNA, 13 nt, Human
auccuuacaaguu

SEQ ID NO: 1471499 - RNA, 18 nt, Human
auccuuagaucuggcaug

SEQ ID NO: 1471500 - RNA, 14 nt, Human
auccuuagaucugg

SEQ ID NO: 1471501 - RNA, 14 nt, Human
aucaaauauauuca

SEQ ID NO: 1471502 - RNA, 22 nt, Human
aucaaacaccaacauaaaaaug

SEQ ID NO: 1471503 - RNA, 23 nt, Human
aucaaacaccaacauaaaaauga

SEQ ID NO: 1471504 - RNA, 16 nt, Human
aucaccgacugaaaau

SEQ ID NO: 1471505 - RNA, 23 nt, Human
aucaccacaaacuguaauacaau

SEQ ID NO: 1471506 - RNA, 13 nt, Human
aucaccacaguuu

SEQ ID NO: 1471507 - RNA, 22 nt, Human
aucaaauauauucagccuggcu

SEQ ID NO: 1471508 - RNA, 19 nt, Human
aucaggaagagaaggagca

SEQ ID NO: 1471509 - RNA, 17 nt, Human
aucaggaagagaaggag

SEQ ID NO: 1471510 - RNA, 14 nt, Human
aucaggaagagaag

SEQ ID NO: 1471511 - RNA, 18 nt, Human
aucaugaagauauuuuuc

SEQ ID NO: 1471512 - RNA, 13 nt, Human
aucagcuuauugu

SEQ ID NO: 1471513 - RNA, 12 nt, Human
aucaugugaaau

SEQ ID NO: 1471514 - RNA, 14 nt, Human
aucaugugaaauca

SEQ ID NO: 1471515 - RNA, 17 nt, Human
aucaugaauuaguuuua

SEQ ID NO: 1471516 - RNA, 21 nt, Human
aucaugaauuaguuuuauaug

SEQ ID NO: 1471517 - RNA, 16 nt, Human
aucuauagaaagcuau

SEQ ID NO: 1471518 - RNA, 17 nt, Human
aucuauagaaagcuaua

SEQ ID NO: 1471519 - RNA, 15 nt, Human
aucuauauuuaacaa

SEQ ID NO: 1471520 - RNA, 14 nt, Human
aucuauauuuuaca

SEQ ID NO: 1471521 - RNA, 20 nt, Human
aucuccgucaacucauauuu

SEQ ID NO: 1471522 - RNA, 12 nt, Human
aucuccugaaaa

SEQ ID NO: 1471523 - RNA, 15 nt, Human
aucuggauuccagag

SEQ ID NO: 1471524 - RNA, 16 nt, Human
aucuggcaacaucuuu

SEQ ID NO: 1471525 - RNA, 13 nt, Human
aucuuauuuagga

SEQ ID NO: 1471526 - RNA, 13 nt, Human
aucuuauucauuu

SEQ ID NO: 1471527 - RNA, 18 nt, Human
aucuuauucauuuucucu

SEQ ID NO: 1471528 - RNA, 20 nt, Human
aucuuauucauuuucucuaa

SEQ ID NO: 1471529 - RNA, 18 nt, Human
aucugggggccucuucug

SEQ ID NO: 1471530 - RNA, 13 nt, Human
augaccaguaaag

SEQ ID NO: 1471531 - RNA, 15 nt, Human
augaaguuguaggua

SEQ ID NO: 1471532 - RNA, 20 nt, Human
augaaguccaagcauuuaga

SEQ ID NO: 1471533 - RNA, 23 nt, Human
augaaguccaagcauuuagaugu

SEQ ID NO: 1471534 - RNA, 15 nt, Human
augacugccaagacu

SEQ ID NO: 1471535 - RNA, 16 nt, Human
augacugccaagacug

SEQ ID NO: 1471536 - RNA, 21 nt, Human
augacugccaagacugcugug

SEQ ID NO: 1471537 - RNA, 19 nt, Human
augacuguuuuucggacag

SEQ ID NO: 1471538 - RNA, 15 nt, Human
augagggaaaagaaa

SEQ ID NO: 1471539 - RNA, 22 nt, Human
augacuguuuuucggacaguuu

SEQ ID NO: 1471540 - RNA, 21 nt, Human
augacuguuuuucggacaguu

SEQ ID NO: 1471541 - RNA, 17 nt, Human
agugacccugcucucac

SEQ ID NO: 1471542 - RNA, 14 nt, Human
agugacccugcucu

SEQ ID NO: 1471543 - RNA, 14 nt, Human
agugaauuugccug

SEQ ID NO: 1471544 - RNA, 17 nt, Human
agucuguuuacugcaag

SEQ ID NO: 1471545 - RNA, 16 nt, Human
agucugagagaggcca

SEQ ID NO: 1471546 - RNA, 16 nt, Human
agucugaauuuuuaaa

SEQ ID NO: 1471547 - RNA, 23 nt, Human
agucugagagaggccauucuuuc

SEQ ID NO: 1471548 - RNA, 21 nt, Human
agucugugagauucauucaug

SEQ ID NO: 1471549 - RNA, 15 nt, Human
agugacuaauggcau

SEQ ID NO: 1471550 - RNA, 20 nt, Human
agucauguaagcugaaaaua

SEQ ID NO: 1471551 - RNA, 17 nt, Human
aguauuuuguuucagug

SEQ ID NO: 1471552 - RNA, 14 nt, Human
aguauuuuguuuca

SEQ ID NO: 1471553 - RNA, 14 nt, Human
aguauccacuuugc

SEQ ID NO: 1471554 - RNA, 15 nt, Human
agucaaaaauuaaac

SEQ ID NO: 1471555 - RNA, 24 nt, Human
agucaaucaagucuguuuacugca

SEQ ID NO: 1471556 - RNA, 12 nt, Human
agucaaucaagu

SEQ ID NO: 1471557 - RNA, 18 nt, Human
agucaaucaagucuguuu

SEQ ID NO: 1471558 - RNA, 23 nt, Human
agucaauguuuucaguucucuug

SEQ ID NO: 1471559 - RNA, 20 nt, Human
aguaaaucacgcuuuuugaa

SEQ ID NO: 1471560 - RNA, 19 nt, Human
aguaaaucacgcuuuuuga

SEQ ID NO: 1471561 - RNA, 12 nt, Human
aguaacaaaaau

SEQ ID NO: 1471562 - RNA, 15 nt, Human
aguaacaaaaauaaa

SEQ ID NO: 1471563 - RNA, 13 nt, Human
aguaacaaaaaua

SEQ ID NO: 1471564 - RNA, 23 nt, Human
aguacuaacuccuaggaaaauac

SEQ ID NO: 1471565 - RNA, 20 nt, Human
aguacuggcugauggaguaa

SEQ ID NO: 1471566 - RNA, 20 nt, Human
aguacugggauuacaggcgu

SEQ ID NO: 1471567 - RNA, 16 nt, Human
aguacugggauuacag

SEQ ID NO: 1471568 - RNA, 20 nt, Human
agugcuaauuuugaaaaacu

SEQ ID NO: 1471569 - RNA, 18 nt, Human
agugcuaauuuugaaaaa

SEQ ID NO: 1471570 - RNA, 15 nt, Human
agugcuaauuuugaa

SEQ ID NO: 1471571 - RNA, 17 nt, Human
agugaucugcccgccuc

SEQ ID NO: 1471572 - RNA, 16 nt, Human
agugauccuuacaagu

SEQ ID NO: 1471573 - RNA, 22 nt, Human
agugggaggguaccagcagaaa

SEQ ID NO: 1471574 - RNA, 22 nt, Human
aguguccuuggcaggcugauuu

SEQ ID NO: 1471575 - RNA, 16 nt, Human
agugucacucaaggcg

SEQ ID NO: 1471576 - RNA, 14 nt, Human
agugucaggaggaa

SEQ ID NO: 1471577 - RNA, 19 nt, Human
agugggaaaaauguaggag

SEQ ID NO: 1471578 - RNA, 14 nt, Human
agugggaaaaaugu

SEQ ID NO: 1471579 - RNA, 17 nt, Human
agugggaaaaauguagg

SEQ ID NO: 1471580 - RNA, 18 nt, Human
agugggaaaaauguagga

SEQ ID NO: 1471581 - RNA, 21 nt, Human
aguugacuuauaguacaugau

SEQ ID NO: 1471582 - RNA, 18 nt, Human
aguugacuuauaguacau

SEQ ID NO: 1471583 - RNA, 17 nt, Human
aguugacuuauaguaca

SEQ ID NO: 1471584 - RNA, 14 nt, Human
aguugagacaagaa

SEQ ID NO: 1471585 - RNA, 17 nt, Human
aguugagacaagaaaau

SEQ ID NO: 1471586 - RNA, 15 nt, Human
aguugacuuauagua

SEQ ID NO: 1471587 - RNA, 23 nt, Human
aguugaauuuuuuuuaacauucc

SEQ ID NO: 1471588 - RNA, 22 nt, Human
aguugaauuuuuuuuaacauuc

SEQ ID NO: 1471589 - RNA, 13 nt, Human
aguugaauuuuuu

SEQ ID NO: 1471590 - RNA, 18 nt, Human
aguugaauuuuuuuuaac

SEQ ID NO: 1471591 - RNA, 21 nt, Human
aguugaauuuuuuuuaacauu

SEQ ID NO: 1471592 - RNA, 17 nt, Human
aguugauaaagauuuuu

SEQ ID NO: 1471593 - RNA, 21 nt, Human
aguugauaaagauuuuuuaau

SEQ ID NO: 1471594 - RNA, 23 nt, Human
aguugauaaagauuuuuuaauaa

SEQ ID NO: 1471595 - RNA, 14 nt, Human
aguugugcuugagc

SEQ ID NO: 1471596 - RNA, 20 nt, Human
auaguacaugauaaaugaua

SEQ ID NO: 1471597 - RNA, 23 nt, Human
auaguagaacgcuaucugggaag

SEQ ID NO: 1471598 - RNA, 14 nt, Human
auauaaucauuauu

SEQ ID NO: 1471599 - RNA, 24 nt, Human
auagguuuggacaaaauggaauac

SEQ ID NO: 1471600 - RNA, 19 nt, Human
auaguaaaucacgcuuuuu

SEQ ID NO: 1471601 - RNA, 13 nt, Human
auaguaaaucacg

SEQ ID NO: 1471602 - RNA, 15 nt, Human
auauacagcucagaa

SEQ ID NO: 1471603 - RNA, 12 nt, Human
auagaaagcuau

SEQ ID NO: 1471604 - RNA, 19 nt, Human
auagaaaugccaagcacuu

SEQ ID NO: 1471605 - RNA, 12 nt, Human
auagaaaugcca

SEQ ID NO: 1471606 - RNA, 16 nt, Human
auagaaaugccaagca

SEQ ID NO: 1471607 - RNA, 17 nt, Human
auagaaaugccaagcac

SEQ ID NO: 1471608 - RNA, 17 nt, Human
auagcacaggcuaauuu

SEQ ID NO: 1471609 - RNA, 13 nt, Human
auagcaugcaucu

SEQ ID NO: 1471610 - RNA, 14 nt, Human
auagcacaggcuaa

SEQ ID NO: 1471611 - RNA, 18 nt, Human
auauauuuuuuucugaaa

SEQ ID NO: 1471612 - RNA, 22 nt, Human
auauuauuuuauguugcauaga

SEQ ID NO: 1471613 - RNA, 15 nt, Human
auauuauuuuauguu

SEQ ID NO: 1471614 - RNA, 14 nt, Human
auauuauguuaaaa

SEQ ID NO: 1471615 - RNA, 16 nt, Human
auauuauguuaaaacu

SEQ ID NO: 1471616 - RNA, 20 nt, Human
auauucaauaaagcugcuga

SEQ ID NO: 1471617 - RNA, 15 nt, Human
auauucaauaaagcu

SEQ ID NO: 1471618 - RNA, 13 nt, Human
auauucaauaaag

SEQ ID NO: 1471619 - RNA, 13 nt, Human
auauuauguuaaa

SEQ ID NO: 1471620 - RNA, 13 nt, Human
auacagaaaaguu

SEQ ID NO: 1471621 - RNA, 22 nt, Human
auacacuuauuggaacucugcu

SEQ ID NO: 1471622 - RNA, 18 nt, Human
auaauguuucaaacauau

SEQ ID NO: 1471623 - RNA, 13 nt, Human
auaauggucagag

SEQ ID NO: 1471624 - RNA, 18 nt, Human
auaagguaaaaugccaug

SEQ ID NO: 1471625 - RNA, 16 nt, Human
auaagguaaaaugcca

SEQ ID NO: 1471626 - RNA, 13 nt, Human
auaauguuucaaa

SEQ ID NO: 1471627 - RNA, 19 nt, Human
auaaaaaggacaucagcaa

SEQ ID NO: 1471628 - RNA, 14 nt, Human
auaaaaaggacauc

SEQ ID NO: 1471629 - RNA, 11 nt, Human
auaaaaaggac

SEQ ID NO: 1471630 - RNA, 20 nt, Human
aguuuggauauguaaaacau

SEQ ID NO: 1471631 - RNA, 16 nt, Human
aguuuggauauguaaa

SEQ ID NO: 1471632 - RNA, 17 nt, Human
aguuuggauauguaaaa

SEQ ID NO: 1471633 - RNA, 22 nt, Human
aguuuggauauguaaaacauuu

SEQ ID NO: 1471634 - RNA, 14 nt, Human
aguuuggauaugua

SEQ ID NO: 1471635 - RNA, 12 nt, Human
aguugaauuuuu

SEQ ID NO: 1471636 - RNA, 11 nt, Human
auaaagcaauu

SEQ ID NO: 1471637 - RNA, 18 nt, Human
auaaagauuuuuuaauaa

SEQ ID NO: 1471638 - RNA, 13 nt, Human
auaaagauuuuuu

SEQ ID NO: 1471639 - RNA, 16 nt, Human
auaaagauuuuuuaau

SEQ ID NO: 1471640 - RNA, 17 nt, Human
auaaagauuuuuuaaua

SEQ ID NO: 1471641 - RNA, 21 nt, Human
auaaagauuuuuuaauaauuu

SEQ ID NO: 1471642 - RNA, 18 nt, Human
auaaauuucuauuuuuau

SEQ ID NO: 1471643 - RNA, 14 nt, Human
auaacaaugaaagu

SEQ ID NO: 1471644 - RNA, 15 nt, Human
auaacaaugcuguau

SEQ ID NO: 1471645 - RNA, 17 nt, Human
auaacaaugcuguauuu

SEQ ID NO: 1471646 - RNA, 19 nt, Human
auaacaaugcuguauuuua

SEQ ID NO: 1471647 - RNA, 20 nt, Human
auaacaaugcuguauuuuaa

SEQ ID NO: 1471648 - RNA, 21 nt, Human
auaacaaugcuguauuuuaaa

SEQ ID NO: 1471649 - RNA, 16 nt, Human
auaacaaugugcucuc

SEQ ID NO: 1471650 - RNA, 20 nt, Human
caaggaaaaaauaacaauga

SEQ ID NO: 1471651 - RNA, 18 nt, Human
caaggaaaaaauaacaau

SEQ ID NO: 1471652 - RNA, 14 nt, Human
caagcugcuguggc

SEQ ID NO: 1471653 - RNA, 21 nt, Human
caagcgauucucuugccucaa

SEQ ID NO: 1471654 - RNA, 15 nt, Human
caagcgauucucuug

SEQ ID NO: 1471655 - RNA, 14 nt, Human
caagcugcaucuag

SEQ ID NO: 1471656 - RNA, 14 nt, Human
caagccuugauugg

SEQ ID NO: 1471657 - RNA, 17 nt, Human
caauaaauagacacgca

SEQ ID NO: 1471658 - RNA, 16 nt, Human
caauaaauagaccauu

SEQ ID NO: 1471659 - RNA, 13 nt, Human
caauaaauagaca

SEQ ID NO: 1471660 - RNA, 14 nt, Human
caauaaagugaccc

SEQ ID NO: 1471661 - RNA, 21 nt, Human
caauaaagugacccugcucuc

SEQ ID NO: 1471662 - RNA, 15 nt, Human
caaggcuuucucuac

SEQ ID NO: 1471663 - RNA, 15 nt, Human
caagggucaggccuu

SEQ ID NO: 1471664 - RNA, 18 nt, Human
caagggucaggccuuuga

SEQ ID NO: 1471665 - RNA, 16 nt, Human
caagggucaggccuuu

SEQ ID NO: 1471666 - RNA, 12 nt, Human
caauaagcaaaa

SEQ ID NO: 1471667 - RNA, 23 nt, Human
caauaacguuuaagccaaaacaa

SEQ ID NO: 1471668 - RNA, 15 nt, Human
caauaacguuuaagc

SEQ ID NO: 1471669 - RNA, 19 nt, Human
caauagucaaauuguguga

SEQ ID NO: 1471670 - RNA, 13 nt, Human
cacaauaagcaaa

SEQ ID NO: 1471671 - RNA, 15 nt, Human
cacaauaauuuucua

SEQ ID NO: 1471672 - RNA, 14 nt, Human
cacaauagaauuau

SEQ ID NO: 1471673 - RNA, 15 nt, Human
cacaauagaauuaua

SEQ ID NO: 1471674 - RNA, 22 nt, Human
cacaaugcagugccuuucuucu

SEQ ID NO: 1471675 - RNA, 23 nt, Human
cacacaaaagggaacccagcucu

SEQ ID NO: 1471676 - RNA, 16 nt, Human
cacaaguuauuuaaau

SEQ ID NO: 1471677 - RNA, 18 nt, Human
cacaauaaaaauguuuaa

SEQ ID NO: 1471678 - RNA, 12 nt, Human
cacacacguuau

SEQ ID NO: 1471679 - RNA, 17 nt, Human
caauuacugguccaaaa

SEQ ID NO: 1471680 - RNA, 21 nt, Human
caauuagcaauugacugucac

SEQ ID NO: 1471681 - RNA, 21 nt, Human
caauuuuuuaucaugcauguc

SEQ ID NO: 1471682 - RNA, 13 nt, Human
caaugugcucucg

SEQ ID NO: 1471683 - RNA, 14 nt, Human
cacagcugccucuu

SEQ ID NO: 1471684 - RNA, 14 nt, Human
cacagcccuuuugu

SEQ ID NO: 1471685 - RNA, 13 nt, Human
cacacugaagaag

SEQ ID NO: 1471686 - RNA, 14 nt, Human
cacacugaagaagc

SEQ ID NO: 1471687 - RNA, 20 nt, Human
cacacucaugcauuguccuc

SEQ ID NO: 1471688 - RNA, 23 nt, Human
cacagagguagucucacugcuug

SEQ ID NO: 1471689 - RNA, 22 nt, Human
cacagauaacugaaaauuauuu

SEQ ID NO: 1471690 - RNA, 19 nt, Human
cacagauaacugaaaauua

SEQ ID NO: 1471691 - RNA, 19 nt, Human
cacacucaugcauuguccu

SEQ ID NO: 1471692 - RNA, 23 nt, Human
caacauagugggacccugucucu

SEQ ID NO: 1471693 - RNA, 21 nt, Human
caacauaguauucaugacuau

SEQ ID NO: 1471694 - RNA, 17 nt, Human
caaaucaaucuguaaaa

SEQ ID NO: 1471695 - RNA, 20 nt, Human
caaauauuuauuuucuuucu

SEQ ID NO: 1471696 - RNA, 23 nt, Human
caaauauauucagccuggcuuca

SEQ ID NO: 1471697 - RNA, 20 nt, Human
caaaucaaucuguaaaacua

SEQ ID NO: 1471698 - RNA, 16 nt, Human
caaaucaauuacuggu

SEQ ID NO: 1471699 - RNA, 15 nt, Human
caaaguguuuucucu

SEQ ID NO: 1471700 - RNA, 18 nt, Human
caaaguguuuucucugaa

SEQ ID NO: 1471701 - RNA, 14 nt, Human
caaagaaccaaaga

SEQ ID NO: 1471702 - RNA, 17 nt, Human
caaagaaccaaagaaga

SEQ ID NO: 1471703 - RNA, 18 nt, Human
caaagaaccuucucuaug

SEQ ID NO: 1471704 - RNA, 19 nt, Human
caaagaaccaaagaagaaa

SEQ ID NO: 1471705 - RNA, 18 nt, Human
caaagagaaugcccuucu

SEQ ID NO: 1471706 - RNA, 23 nt, Human
caaagagaaugcccuucuccuua

SEQ ID NO: 1471707 - RNA, 14 nt, Human
caacuugcuuauca

SEQ ID NO: 1471708 - RNA, 16 nt, Human
caacuuggcugcagga

SEQ ID NO: 1471709 - RNA, 23 nt, Human
caacguggcuuuuuuuuuuuccc

SEQ ID NO: 1471710 - RNA, 22 nt, Human
caagagcuacguauuuaauagc

SEQ ID NO: 1471711 - RNA, 19 nt, Human
caagagcuacauaauuuag

SEQ ID NO: 1471712 - RNA, 14 nt, Human
caagaggagaucca

SEQ ID NO: 1471713 - RNA, 13 nt, Human
caagagccacagu

SEQ ID NO: 1471714 - RNA, 17 nt, Human
caagaagcauuuuguaa

SEQ ID NO: 1471715 - RNA, 23 nt, Human
caagaagcauuuuguaaguugaa

SEQ ID NO: 1471716 - RNA, 12 nt, Human
caagagacugag

SEQ ID NO: 1471717 - RNA, 15 nt, Human
caagagacugaguca

SEQ ID NO: 1471718 - RNA, 13 nt, Human
caagagacugagu

SEQ ID NO: 1471719 - RNA, 16 nt, Human
caaaaucaauuaaaau

SEQ ID NO: 1471720 - RNA, 17 nt, Human
caaaauauuuguacaua

SEQ ID NO: 1471721 - RNA, 16 nt, Human
caaaauauuuguacau

SEQ ID NO: 1471722 - RNA, 20 nt, Human
caaaauccuugcuuaugaca

SEQ ID NO: 1471723 - RNA, 16 nt, Human
caaaauccuugcuuau

SEQ ID NO: 1471724 - RNA, 18 nt, Human
caaaaguuucauccuuuu

SEQ ID NO: 1471725 - RNA, 15 nt, Human
caaaacugcauuuca

SEQ ID NO: 1471726 - RNA, 18 nt, Human
caaaaguuacauguuugc

SEQ ID NO: 1471727 - RNA, 19 nt, Human
caaaaguuacauguuugca

SEQ ID NO: 1471728 - RNA, 17 nt, Human
caaacugacucuuaaga

SEQ ID NO: 1471729 - RNA, 21 nt, Human
caaacugacucuuaagaagac

SEQ ID NO: 1471730 - RNA, 16 nt, Human
caaacugacucuuaag

SEQ ID NO: 1471731 - RNA, 18 nt, Human
caaacuccugaccucagg

SEQ ID NO: 1471732 - RNA, 19 nt, Human
caaacuccugaccucaggc

SEQ ID NO: 1471733 - RNA, 19 nt, Human
caaaccugaccccugcuca

SEQ ID NO: 1471734 - RNA, 20 nt, Human
caaaccugaccccugcucag

SEQ ID NO: 1471735 - RNA, 14 nt, Human
caaacaccucccag

SEQ ID NO: 1471736 - RNA, 15 nt, Human
caaacaccucccagg

SEQ ID NO: 1471737 - RNA, 18 nt, Human
caaacaccaacauaaaaa

SEQ ID NO: 1471738 - RNA, 17 nt, Human
caaacugaggaauuuca

SEQ ID NO: 1471739 - RNA, 22 nt, Human
cacagcugccucuucccucuuc

SEQ ID NO: 1471740 - RNA, 15 nt, Human
cacagcugccucuuc

SEQ ID NO: 1471741 - RNA, 13 nt, Human
cacaggaaaccag

SEQ ID NO: 1471742 - RNA, 19 nt, Human
cacaggaaccacaagacug

SEQ ID NO: 1471743 - RNA, 22 nt, Human
cacaguggaaagacagcuucuc

SEQ ID NO: 1471744 - RNA, 12 nt, Human
uuuuuuguuauu

SEQ ID NO: 1471745 - RNA, 21 nt, Human
ugugugaaagguacuucaaau

SEQ ID NO: 1471746 - RNA, 22 nt, Human
ugugugaaagguacuucaaauc

SEQ ID NO: 1471747 - RNA, 21 nt, Human
uguguggagagggaaugugaa

SEQ ID NO: 1471748 - RNA, 20 nt, Human
uguguggcuuucagagccuc

SEQ ID NO: 1471749 - RNA, 22 nt, Human
uguguggagagggaaugugaaa

SEQ ID NO: 1471750 - RNA, 18 nt, Human
uguguuuuucauaaagca

SEQ ID NO: 1471751 - RNA, 15 nt, Human
uguguuuuucauaaa

SEQ ID NO: 1471752 - RNA, 15 nt, Human
uguguuuuuaacaug

SEQ ID NO: 1471753 - RNA, 13 nt, Human
uguguuuugcaag

SEQ ID NO: 1471754 - RNA, 19 nt, Human
uguguuuugcaagccagau

SEQ ID NO: 1471755 - RNA, 13 nt, Human
uguguuugaagca

SEQ ID NO: 1471756 - RNA, 17 nt, Human
uguguggcuuucagagc

SEQ ID NO: 1471757 - RNA, 17 nt, Human
uguucauaaauaaaguu

SEQ ID NO: 1471758 - RNA, 14 nt, Human
uguuagugcaaauu

SEQ ID NO: 1471759 - RNA, 16 nt, Human
uguucacuuuuccucc

SEQ ID NO: 1471760 - RNA, 19 nt, Human
uguucacuuuuccucccuc

SEQ ID NO: 1471761 - RNA, 18 nt, Human
uguucagaagguugcucu

SEQ ID NO: 1471762 - RNA, 22 nt, Human
uguucagaagguugcucuagau

SEQ ID NO: 1471763 - RNA, 21 nt, Human
uguuacccaguaacucaucug

SEQ ID NO: 1471764 - RNA, 16 nt, Human
uguuaccuacuuugac

SEQ ID NO: 1471765 - RNA, 19 nt, Human
uguuaaaaaaauaagaaga

SEQ ID NO: 1471766 - RNA, 20 nt, Human
uguuaaaaaaauaagaagaa

SEQ ID NO: 1471767 - RNA, 22 nt, Human
uguuaaaaaaauaagaagaaug

SEQ ID NO: 1471768 - RNA, 23 nt, Human
uguuaaaaaaauaagaagaaugc

SEQ ID NO: 1471769 - RNA, 19 nt, Human
uguuagccucaauuucuga

SEQ ID NO: 1471770 - RNA, 21 nt, Human
uguuagcaugcuggugagcca

SEQ ID NO: 1471771 - RNA, 20 nt, Human
uguugacaugggacauuugc

SEQ ID NO: 1471772 - RNA, 20 nt, Human
uguucuuuuaaaugauugaa

SEQ ID NO: 1471773 - RNA, 20 nt, Human
uguucuuuggaaauacacag

SEQ ID NO: 1471774 - RNA, 13 nt, Human
uguucaugaaaga

SEQ ID NO: 1471775 - RNA, 14 nt, Human
uguucaugaaagau

SEQ ID NO: 1471776 - RNA, 20 nt, Human
uguucaugaaagauucaaug

SEQ ID NO: 1471777 - RNA, 12 nt, Human
uguuuaagagac

SEQ ID NO: 1471778 - RNA, 13 nt, Human
uguuuaaaguuca

SEQ ID NO: 1471779 - RNA, 14 nt, Human
uguuuaaaccuuuu

SEQ ID NO: 1471780 - RNA, 12 nt, Human
uguuuaaaguuc

SEQ ID NO: 1471781 - RNA, 23 nt, Human
uguuuaaaguucaacauguuauu

SEQ ID NO: 1471782 - RNA, 14 nt, Human
uguuggcuagccuc

SEQ ID NO: 1471783 - RNA, 14 nt, Human
uguuggagaagaac

SEQ ID NO: 1471784 - RNA, 12 nt, Human
uguuggaaugaa

SEQ ID NO: 1471785 - RNA, 16 nt, Human
uguuggagaagaacug

SEQ ID NO: 1471786 - RNA, 17 nt, Human
uguuggagaagaacuga

SEQ ID NO: 1471787 - RNA, 19 nt, Human
uguuggagaagaacugaaa

SEQ ID NO: 1471788 - RNA, 20 nt, Human
uguuggagaagaacugaaau

SEQ ID NO: 1471789 - RNA, 11 nt, Human
uguuucuguaa

SEQ ID NO: 1471790 - RNA, 16 nt, Human
uguuucuguaagaaac

SEQ ID NO: 1471791 - RNA, 12 nt, Human
uguuucugacuc

SEQ ID NO: 1471792 - RNA, 19 nt, Human
uguuucugacucugagcua

SEQ ID NO: 1471793 - RNA, 15 nt, Human
uguuuacugcaaggu

SEQ ID NO: 1471794 - RNA, 20 nt, Human
uguuuuuaaugcuuugauau

SEQ ID NO: 1471795 - RNA, 19 nt, Human
uguuuuuaacaugucaauc

SEQ ID NO: 1471796 - RNA, 18 nt, Human
uuaaaucuguuuuucuaa

SEQ ID NO: 1471797 - RNA, 12 nt, Human
uuaaaacuccug

SEQ ID NO: 1471798 - RNA, 15 nt, Human
uuaaaacuuugaagu

SEQ ID NO: 1471799 - RNA, 15 nt, Human
uuaauagcaaagaau

SEQ ID NO: 1471800 - RNA, 16 nt, Human
uuaauagcaaagaauu

SEQ ID NO: 1471801 - RNA, 18 nt, Human
uuaauagcaaagaauuga

SEQ ID NO: 1471802 - RNA, 20 nt, Human
uuaauagcaaagaauugacu

SEQ ID NO: 1471803 - RNA, 16 nt, Human
uuaauaauguuucaaa

SEQ ID NO: 1471804 - RNA, 15 nt, Human
uuaauaccacagcuu

SEQ ID NO: 1471805 - RNA, 16 nt, Human
uuaagccaaaacaaug

SEQ ID NO: 1471806 - RNA, 12 nt, Human
uuaagaguaaaa

SEQ ID NO: 1471807 - RNA, 20 nt, Human
uuaaauguuaugacuaugua

SEQ ID NO: 1471808 - RNA, 16 nt, Human
uuaaauguuaugacua

SEQ ID NO: 1471809 - RNA, 19 nt, Human
uuaaauguauacuauagua

SEQ ID NO: 1471810 - RNA, 14 nt, Human
uuaaauguauacua

SEQ ID NO: 1471811 - RNA, 12 nt, Human
uuaaauguauac

SEQ ID NO: 1471812 - RNA, 23 nt, Human
uuacaacggagucaaaaauuaaa

SEQ ID NO: 1471813 - RNA, 19 nt, Human
uuacaacggagucaaaaau

SEQ ID NO: 1471814 - RNA, 16 nt, Human
uuacaacggagucaaa

SEQ ID NO: 1471815 - RNA, 16 nt, Human
uuaauuaccaaccugu

SEQ ID NO: 1471816 - RNA, 19 nt, Human
uuaauuagccagugaaaaa

SEQ ID NO: 1471817 - RNA, 13 nt, Human
uuacauucugaau

SEQ ID NO: 1471818 - RNA, 22 nt, Human
uuacacuacacacuguguacug

SEQ ID NO: 1471819 - RNA, 19 nt, Human
uguggaacauaaaaaggac

SEQ ID NO: 1471820 - RNA, 21 nt, Human
uguggaacauaaaaaggacau

SEQ ID NO: 1471821 - RNA, 15 nt, Human
uguggccuaaccugc

SEQ ID NO: 1471822 - RNA, 23 nt, Human
ugugggagaccggccugccagga

SEQ ID NO: 1471823 - RNA, 17 nt, Human
ugugggagaccggccug

SEQ ID NO: 1471824 - RNA, 14 nt, Human
uguguagcuuugcu

SEQ ID NO: 1471825 - RNA, 17 nt, Human
uguguagcuuugcucuu

SEQ ID NO: 1471826 - RNA, 15 nt, Human
uguguacauaacuga

SEQ ID NO: 1471827 - RNA, 17 nt, Human
uguguacauaacugaaa

SEQ ID NO: 1471828 - RNA, 13 nt, Human
ugugggauuaugg

SEQ ID NO: 1471829 - RNA, 16 nt, Human
ugugggauuauggguc

SEQ ID NO: 1471830 - RNA, 18 nt, Human
ugugggauuaugggucac

SEQ ID NO: 1471831 - RNA, 23 nt, Human
ugugggauuaugggucacaggaa

SEQ ID NO: 1471832 - RNA, 16 nt, Human
uguggaacauaaaaag

SEQ ID NO: 1471833 - RNA, 19 nt, Human
ugugcuugagccaggaggc

SEQ ID NO: 1471834 - RNA, 16 nt, Human
ugugcucaggagcccu

SEQ ID NO: 1471835 - RNA, 15 nt, Human
ugugcucaggagccc

SEQ ID NO: 1471836 - RNA, 17 nt, Human
ugugcucaggagcccug

SEQ ID NO: 1471837 - RNA, 20 nt, Human
ugugcucaggagcccuggga

SEQ ID NO: 1471838 - RNA, 19 nt, Human
ugugcuaguaauuggaaag

SEQ ID NO: 1471839 - RNA, 13 nt, Human
ugugcuauacugc

SEQ ID NO: 1471840 - RNA, 18 nt, Human
ugugcuauacugcauacu

SEQ ID NO: 1471841 - RNA, 20 nt, Human
ugugcuauacugcauacuuu

SEQ ID NO: 1471842 - RNA, 21 nt, Human
ugugcuauacugcauacuuuu

SEQ ID NO: 1471843 - RNA, 18 nt, Human
ugugcuauggugcucugu

SEQ ID NO: 1471844 - RNA, 17 nt, Human
ugugcacuuauuuauga

SEQ ID NO: 1471845 - RNA, 15 nt, Human
ugugcauucuggauu

SEQ ID NO: 1471846 - RNA, 17 nt, Human
ugugccuugucacgcca

SEQ ID NO: 1471847 - RNA, 19 nt, Human
ugugccuugucacgccaga

SEQ ID NO: 1471848 - RNA, 20 nt, Human
ugugccuugucacgccagac

SEQ ID NO: 1471849 - RNA, 16 nt, Human
ugugauauaagugugu

SEQ ID NO: 1471850 - RNA, 18 nt, Human
ugugacauuuuacauuaa

SEQ ID NO: 1471851 - RNA, 17 nt, Human
ugugacauuuuacauua

SEQ ID NO: 1471852 - RNA, 15 nt, Human
ugugacauuuuacau

SEQ ID NO: 1471853 - RNA, 18 nt, Human
ugugaccaaaaguuacau

SEQ ID NO: 1471854 - RNA, 17 nt, Human
ugugaccaaaaguuaca

SEQ ID NO: 1471855 - RNA, 17 nt, Human
ugucuggcacagccugg

SEQ ID NO: 1471856 - RNA, 18 nt, Human
uguagccccucuccugga

SEQ ID NO: 1471857 - RNA, 16 nt, Human
uguagccacaccagga

SEQ ID NO: 1471858 - RNA, 17 nt, Human
uguagccacaccaggau

SEQ ID NO: 1471859 - RNA, 18 nt, Human
uguagccacaccaggaua

SEQ ID NO: 1471860 - RNA, 16 nt, Human
uguagccccagugaca

SEQ ID NO: 1471861 - RNA, 21 nt, Human
uguagccccagugacagcuag

SEQ ID NO: 1471862 - RNA, 14 nt, Human
uguagcauccugga

SEQ ID NO: 1471863 - RNA, 16 nt, Human
uguagcauccuggaau

SEQ ID NO: 1471864 - RNA, 17 nt, Human
uguagcauccuggaaua

SEQ ID NO: 1471865 - RNA, 18 nt, Human
uguagcauccuggaauau

SEQ ID NO: 1471866 - RNA, 13 nt, Human
uguagccacacca

SEQ ID NO: 1471867 - RNA, 14 nt, Human
uguaauguuaauau

SEQ ID NO: 1471868 - RNA, 15 nt, Human
uguaauguuaauauu

SEQ ID NO: 1471869 - RNA, 18 nt, Human
uguaauguuaauauugau

SEQ ID NO: 1471870 - RNA, 17 nt, Human
uguaauguuaauauuga

SEQ ID NO: 1471871 - RNA, 20 nt, Human
uguaaucuuauuuaggaagu

SEQ ID NO: 1471872 - RNA, 17 nt, Human
uguaauauuucuucaaa

SEQ ID NO: 1471873 - RNA, 20 nt, Human
uguaauagggaaaauucuaa

SEQ ID NO: 1471874 - RNA, 18 nt, Human
uguaauagauguuugaua

SEQ ID NO: 1471875 - RNA, 22 nt, Human
uguaccguaggcuuuguauuca

SEQ ID NO: 1471876 - RNA, 21 nt, Human
uguacaguuaucuaaguuaau

SEQ ID NO: 1471877 - RNA, 22 nt, Human
uguacaguuaucuaaguuaauu

SEQ ID NO: 1471878 - RNA, 17 nt, Human
uguacaguuaucuaagu

SEQ ID NO: 1471879 - RNA, 18 nt, Human
uguacaguuaucuaaguu

SEQ ID NO: 1471880 - RNA, 22 nt, Human
ugucacccagguuggagugcag

SEQ ID NO: 1471881 - RNA, 16 nt, Human
uguauuuuagcagaga

SEQ ID NO: 1471882 - RNA, 23 nt, Human
uguauuuccccaacauguaauaa

SEQ ID NO: 1471883 - RNA, 22 nt, Human
uguauaaaagggacugagaaau

SEQ ID NO: 1471884 - RNA, 15 nt, Human
uguaugauucccagc

SEQ ID NO: 1471885 - RNA, 19 nt, Human
uguaguuuuuauauguugu

SEQ ID NO: 1471886 - RNA, 20 nt, Human
uguaguuuuuauauguugua

SEQ ID NO: 1471887 - RNA, 14 nt, Human
uguauaaaaauaaa

SEQ ID NO: 1471888 - RNA, 22 nt, Human
uguauaaaaauaaaaaagaucc

SEQ ID NO: 1471889 - RNA, 21 nt, Human
uguauuguauauuacaaugau

SEQ ID NO: 1471890 - RNA, 16 nt, Human
uguaugauucccagcc

SEQ ID NO: 1471891 - RNA, 21 nt, Human
uguccucagccccgcguggaa

SEQ ID NO: 1471892 - RNA, 23 nt, Human
ugucauuguuauauaaucauuau

SEQ ID NO: 1471893 - RNA, 14 nt, Human
ugucauuucauuuc

SEQ ID NO: 1471894 - RNA, 16 nt, Human
ugucauuucauuuccu

SEQ ID NO: 1471895 - RNA, 17 nt, Human
ugucauuucauuuccua

SEQ ID NO: 1471896 - RNA, 15 nt, Human
ugucauguguauaaa

SEQ ID NO: 1471897 - RNA, 11 nt, Human
ugucaugugua

SEQ ID NO: 1471898 - RNA, 13 nt, Human
ugucauguguaua

SEQ ID NO: 1471899 - RNA, 14 nt, Human
ugucauguguauaa

SEQ ID NO: 1471900 - RNA, 13 nt, Human
uggggaagacagu

SEQ ID NO: 1471901 - RNA, 14 nt, Human
uggggaagacagug

SEQ ID NO: 1471902 - RNA, 17 nt, Human
uggggaagacaguggcc

SEQ ID NO: 1471903 - RNA, 12 nt, Human
ugggcagcaauu

SEQ ID NO: 1471904 - RNA, 17 nt, Human
ugggcagauuuucagca

SEQ ID NO: 1471905 - RNA, 15 nt, Human
ugggcagauuuucag

SEQ ID NO: 1471906 - RNA, 21 nt, Human
uggguuagggaaaacauucca

SEQ ID NO: 1471907 - RNA, 19 nt, Human
uggguuagggaaaacauuc

SEQ ID NO: 1471908 - RNA, 18 nt, Human
uggguuagggaaaacauu

SEQ ID NO: 1471909 - RNA, 16 nt, Human
uggguuagggaaaaca

SEQ ID NO: 1471910 - RNA, 14 nt, Human
uggguguuaauuuu

SEQ ID NO: 1471911 - RNA, 23 nt, Human
ugguaugaacuugaggacacaug

SEQ ID NO: 1471912 - RNA, 22 nt, Human
ugguaugaacuugaggacacau

SEQ ID NO: 1471913 - RNA, 21 nt, Human
ugguaugaacuugaggacaca

SEQ ID NO: 1471914 - RNA, 19 nt, Human
ugguaugaacuugaggaca

SEQ ID NO: 1471915 - RNA, 22 nt, Human
ugguauauccaaaagcuuuuua

SEQ ID NO: 1471916 - RNA, 16 nt, Human
ugguauauccaaaagc

SEQ ID NO: 1471917 - RNA, 19 nt, Human
ugguauauccaaaagcuuu

SEQ ID NO: 1471918 - RNA, 22 nt, Human
uggccccacccucguggacacc

SEQ ID NO: 1471919 - RNA, 16 nt, Human
uggcuuccuggcaaua

SEQ ID NO: 1471920 - RNA, 13 nt, Human
uggcuucuggcca

SEQ ID NO: 1471921 - RNA, 15 nt, Human
uggcuucuggccagg

SEQ ID NO: 1471922 - RNA, 16 nt, Human
uggcuucuggccagga

SEQ ID NO: 1471923 - RNA, 17 nt, Human
uggcuucuggccaggaa

SEQ ID NO: 1471924 - RNA, 18 nt, Human
uggcuucuggccaggaag

SEQ ID NO: 1471925 - RNA, 19 nt, Human
uggcuucuggccaggaagc

SEQ ID NO: 1471926 - RNA, 21 nt, Human
uggcuucuggccaggaagcuu

SEQ ID NO: 1471927 - RNA, 21 nt, Human
uggcuugaguuuaaauuguaa

SEQ ID NO: 1471928 - RNA, 17 nt, Human
uggcuuuaggagcagug

SEQ ID NO: 1471929 - RNA, 20 nt, Human
uggcuuuaggagcaguggga

SEQ ID NO: 1471930 - RNA, 15 nt, Human
uggcuuucagagccu

SEQ ID NO: 1471931 - RNA, 17 nt, Human
uggcuuucagagccucc

SEQ ID NO: 1471932 - RNA, 11 nt, Human
uggcuuucagg

SEQ ID NO: 1471933 - RNA, 14 nt, Human
uggcuuucagggag

SEQ ID NO: 1471934 - RNA, 13 nt, Human
uggcuuuggaagc

SEQ ID NO: 1471935 - RNA, 12 nt, Human
ugggagagggcg

SEQ ID NO: 1471936 - RNA, 13 nt, Human
ugggagagggcgc

SEQ ID NO: 1471937 - RNA, 14 nt, Human
ugggagagggcgca

SEQ ID NO: 1471938 - RNA, 15 nt, Human
ugggagagggcgcag

SEQ ID NO: 1471939 - RNA, 20 nt, Human
ugggagagggcgcaggccgu

SEQ ID NO: 1471940 - RNA, 20 nt, Human
uggcuuuugcgguucaggaa

SEQ ID NO: 1471941 - RNA, 21 nt, Human
ugggacaccccgacuuuuguu

SEQ ID NO: 1471942 - RNA, 20 nt, Human
ugggauuaugggucacagga

SEQ ID NO: 1471943 - RNA, 15 nt, Human
ugggauuauggguca

SEQ ID NO: 1471944 - RNA, 18 nt, Human
ugggauuaugggucacag

SEQ ID NO: 1471945 - RNA, 19 nt, Human
ugggauuaugggucacagg

SEQ ID NO: 1471946 - RNA, 21 nt, Human
ugggauuaugggucacaggaa

SEQ ID NO: 1471947 - RNA, 16 nt, Human
ugggagcugccaagag

SEQ ID NO: 1471948 - RNA, 18 nt, Human
uggaacucgugucuggca

SEQ ID NO: 1471949 - RNA, 23 nt, Human
uggaacuacauuaguacacagca

SEQ ID NO: 1471950 - RNA, 18 nt, Human
uggaacuagguuuuaaua

SEQ ID NO: 1471951 - RNA, 20 nt, Human
uggaacuagguuuuaauaau

SEQ ID NO: 1471952 - RNA, 16 nt, Human
uggaauaucuccguca

SEQ ID NO: 1471953 - RNA, 14 nt, Human
uggaauauaauugu

SEQ ID NO: 1471954 - RNA, 22 nt, Human
uggaauaauccuaaacauauga

SEQ ID NO: 1471955 - RNA, 15 nt, Human
uggaauaaguucaaa

SEQ ID NO: 1471956 - RNA, 22 nt, Human
uggacuauggagugcaccaaag

SEQ ID NO: 1471957 - RNA, 22 nt, Human
uggaauauaauuguuuuaucug

SEQ ID NO: 1471958 - RNA, 17 nt, Human
uggaaugaauuaaauaa

SEQ ID NO: 1471959 - RNA, 18 nt, Human
uggaaugaauuaaauaaa

SEQ ID NO: 1471960 - RNA, 17 nt, Human
uggaaacaagucaguca

SEQ ID NO: 1471961 - RNA, 23 nt, Human
uggaaacuucagcgguuuauaua

SEQ ID NO: 1471962 - RNA, 19 nt, Human
uggaaagacagcuucucau

SEQ ID NO: 1471963 - RNA, 14 nt, Human
uggaaagaguacuc

SEQ ID NO: 1471964 - RNA, 23 nt, Human
uggaaagacagcuucucauccug

SEQ ID NO: 1471965 - RNA, 14 nt, Human
uggaacauccuugg

SEQ ID NO: 1471966 - RNA, 21 nt, Human
ugcuuugaaacagaaaaauau

SEQ ID NO: 1471967 - RNA, 16 nt, Human
ugcuuugaaacagaaa

SEQ ID NO: 1471968 - RNA, 14 nt, Human
ugcuggacugucau

SEQ ID NO: 1471969 - RNA, 15 nt, Human
ugcuggacugucaua

SEQ ID NO: 1471970 - RNA, 19 nt, Human
ugcuggacugucauagaaa

SEQ ID NO: 1471971 - RNA, 15 nt, Human
uggcaggugcagccc

SEQ ID NO: 1471972 - RNA, 18 nt, Human
uggcaguccuggaagcca

SEQ ID NO: 1471973 - RNA, 16 nt, Human
uggcagucugaauuuu

SEQ ID NO: 1471974 - RNA, 22 nt, Human
uggcagucugaauuuuuaaaac

SEQ ID NO: 1471975 - RNA, 12 nt, Human
uggcaggaaggc

SEQ ID NO: 1471976 - RNA, 17 nt, Human
uggcaggaaggcuuguu

SEQ ID NO: 1471977 - RNA, 15 nt, Human
uggcaggaaggcuug

SEQ ID NO: 1471978 - RNA, 19 nt, Human
uggcagugggaaaaaugua

SEQ ID NO: 1471979 - RNA, 22 nt, Human
uggcagugggaaaaauguagga

SEQ ID NO: 1471980 - RNA, 23 nt, Human
uggcagugggaaaaauguaggag

SEQ ID NO: 1471981 - RNA, 11 nt, Human
uggccaggagg

SEQ ID NO: 1471982 - RNA, 16 nt, Human
uggccaggaggugcca

SEQ ID NO: 1471983 - RNA, 12 nt, Human
uggccaggaggu

SEQ ID NO: 1471984 - RNA, 13 nt, Human
uggccaggccggg

SEQ ID NO: 1471985 - RNA, 15 nt, Human
uggccaggccgggaa

SEQ ID NO: 1471986 - RNA, 11 nt, Human
uggagggaagc

SEQ ID NO: 1471987 - RNA, 16 nt, Human
uggauccuguguggag

SEQ ID NO: 1471988 - RNA, 17 nt, Human
uggauccuguguggaga

SEQ ID NO: 1471989 - RNA, 14 nt, Human
uggauuuuuaccag

SEQ ID NO: 1471990 - RNA, 13 nt, Human
uggauuuuuacca

SEQ ID NO: 1471991 - RNA, 22 nt, Human
uggauuuuuaccagucucacau

SEQ ID NO: 1471992 - RNA, 17 nt, Human
ugccacccucaugcugu

SEQ ID NO: 1471993 - RNA, 16 nt, Human
ugccacccucaugcug

SEQ ID NO: 1471994 - RNA, 20 nt, Human
ugccaggaggacccagggcu

SEQ ID NO: 1471995 - RNA, 21 nt, Human
ugccaggaggacccagggcuc

SEQ ID NO: 1471996 - RNA, 22 nt, Human
ugccaggaggacccagggcucu

SEQ ID NO: 1471997 - RNA, 23 nt, Human
ugccaggaggacccagggcucug

SEQ ID NO: 1471998 - RNA, 21 nt, Human
ugcauauuuauaaaaauaaaa

SEQ ID NO: 1471999 - RNA, 20 nt, Human
ugcauauuuauaaaaauaaa

SEQ ID NO: 1472000 - RNA, 18 nt, Human
ugccaaauauaaauaaaa

SEQ ID NO: 1472001 - RNA, 17 nt, Human
ugccaaauauaaauaaa

SEQ ID NO: 1472002 - RNA, 22 nt, Human
ugccaaauauaaauaaaaauaa

SEQ ID NO: 1472003 - RNA, 19 nt, Human
ugccaaauauaaauaaaaa

SEQ ID NO: 1472004 - RNA, 16 nt, Human
ugcccaugggagcugg

SEQ ID NO: 1472005 - RNA, 13 nt, Human
ugcacugauguug

SEQ ID NO: 1472006 - RNA, 14 nt, Human
ugcacugauguugu

SEQ ID NO: 1472007 - RNA, 15 nt, Human
ugcacugauguugug

SEQ ID NO: 1472008 - RNA, 21 nt, Human
ugcacugauguuguguuuuua

SEQ ID NO: 1472009 - RNA, 12 nt, Human
ugcaccggggcc

SEQ ID NO: 1472010 - RNA, 16 nt, Human
ugcaccggggccuggg

SEQ ID NO: 1472011 - RNA, 22 nt, Human
ugcaccggggccugggcaggag

SEQ ID NO: 1472012 - RNA, 17 nt, Human
ugcacuggccccacccu

SEQ ID NO: 1472013 - RNA, 16 nt, Human
ugcacuggccccaccc

SEQ ID NO: 1472014 - RNA, 15 nt, Human
ugcacuggccccacc

SEQ ID NO: 1472015 - RNA, 12 nt, Human
ugcacuguaaaa

SEQ ID NO: 1472016 - RNA, 13 nt, Human
ugcacuguaaaau

SEQ ID NO: 1472017 - RNA, 14 nt, Human
ugcacuguaaaaug

SEQ ID NO: 1472018 - RNA, 17 nt, Human
ugcacuguaaaaugugg

SEQ ID NO: 1472019 - RNA, 15 nt, Human
ugcacuguaaaaugu

SEQ ID NO: 1472020 - RNA, 15 nt, Human
ugcaguucugaagaa

SEQ ID NO: 1472021 - RNA, 16 nt, Human
ugcaguucugaagaag

SEQ ID NO: 1472022 - RNA, 17 nt, Human
ugcaguucugaagaaga

SEQ ID NO: 1472023 - RNA, 18 nt, Human
ugcaguucugaagaagau

SEQ ID NO: 1472024 - RNA, 22 nt, Human
ugcaguggcgugaucucagcuc

SEQ ID NO: 1472025 - RNA, 22 nt, Human
ugcaguggcgcgaucucagcuc

SEQ ID NO: 1472026 - RNA, 22 nt, Human
ugcaguggcaucaucucagcuc

SEQ ID NO: 1472027 - RNA, 19 nt, Human
ugcaguucugaagaagaug

SEQ ID NO: 1472028 - RNA, 22 nt, Human
ugcaguucugaagaagauggua

SEQ ID NO: 1472029 - RNA, 21 nt, Human
ugcaguucuuuggcugaaagg

SEQ ID NO: 1472030 - RNA, 20 nt, Human
ugcaguucuuuggcugaaag

SEQ ID NO: 1472031 - RNA, 19 nt, Human
ugcaggcaggaacaaacag

SEQ ID NO: 1472032 - RNA, 20 nt, Human
ugcaggcaggaacaaacagg

SEQ ID NO: 1472033 - RNA, 14 nt, Human
ugcaggcaggaaca

SEQ ID NO: 1472034 - RNA, 15 nt, Human
ugcuaagcauuccaa

SEQ ID NO: 1472035 - RNA, 19 nt, Human
ugcuaagcauuccaacuau

SEQ ID NO: 1472036 - RNA, 16 nt, Human
ugcuaagagaaguaga

SEQ ID NO: 1472037 - RNA, 17 nt, Human
ugcucagagcaguguuu

SEQ ID NO: 1472038 - RNA, 13 nt, Human
ugcucagguacuu

SEQ ID NO: 1472039 - RNA, 17 nt, Human
ugcucagguacuuguaa

SEQ ID NO: 1472040 - RNA, 17 nt, Human
ugcucaguaauuugagg

SEQ ID NO: 1472041 - RNA, 13 nt, Human
ugcucagcccugc

SEQ ID NO: 1472042 - RNA, 23 nt, Human
ugcucagggacucaucuuucccu

SEQ ID NO: 1472043 - RNA, 20 nt, Human
ugcucuaugugcuuguaaaa

SEQ ID NO: 1472044 - RNA, 17 nt, Human
ugcugaaauuuuauaug

SEQ ID NO: 1472045 - RNA, 13 nt, Human
ugcugcaaaccug

SEQ ID NO: 1472046 - RNA, 14 nt, Human
ugcugcaaaccuga

SEQ ID NO: 1472047 - RNA, 20 nt, Human
ugcugcaaaccugaccccug

SEQ ID NO: 1472048 - RNA, 17 nt, Human
ugcugauggagccuucc

SEQ ID NO: 1472049 - RNA, 14 nt, Human
ugcugcuggggaag

SEQ ID NO: 1472050 - RNA, 15 nt, Human
ugcugcuggggaaga

SEQ ID NO: 1472051 - RNA, 19 nt, Human
ugcugcuggggaagacagu

SEQ ID NO: 1472052 - RNA, 20 nt, Human
ugcugcuggggaagacagug

SEQ ID NO: 1472053 - RNA, 21 nt, Human
ugcugcuggggaagacagugg

SEQ ID NO: 1472054 - RNA, 22 nt, Human
ugcugcuggggaagacaguggc

SEQ ID NO: 1472055 - RNA, 24 nt, Human
ugcugcuggggaagacaguggccc

SEQ ID NO: 1472056 - RNA, 23 nt, Human
ugcugcuggggaagacaguggcc

SEQ ID NO: 1472057 - RNA, 18 nt, Human
ugcuggaaaauaauacug

SEQ ID NO: 1472058 - RNA, 22 nt, Human
ugcuggaagacgcaagggccug

SEQ ID NO: 1472059 - RNA, 17 nt, Human
ugcuggaauaaguucaa

SEQ ID NO: 1472060 - RNA, 15 nt, Human
ugccuucucaacucc

SEQ ID NO: 1472061 - RNA, 17 nt, Human
ugccuucucaacuccaa

SEQ ID NO: 1472062 - RNA, 20 nt, Human
ugcgagugcucauuucagga

SEQ ID NO: 1472063 - RNA, 13 nt, Human
ugcuaagagaagu

SEQ ID NO: 1472064 - RNA, 22 nt, Human
ugcuaagagaaguagaaaucau

SEQ ID NO: 1472065 - RNA, 9 nt, Human
ugccucucu

SEQ ID NO: 1472066 - RNA, 20 nt, Human
ugccucucgcuccucaaccc

SEQ ID NO: 1472067 - RNA, 18 nt, Human
ugccucucaucaacugaa

SEQ ID NO: 1472068 - RNA, 21 nt, Human
ugccucucaucaacugaauga

SEQ ID NO: 1472069 - RNA, 20 nt, Human
ugccuguagccccagugaca

SEQ ID NO: 1472070 - RNA, 22 nt, Human
ugccuguagccccagugacagc

SEQ ID NO: 1472071 - RNA, 21 nt, Human
ugccuguagccccagugacag

SEQ ID NO: 1472072 - RNA, 23 nt, Human
ugccugacccuacuucuuuugcu

SEQ ID NO: 1472073 - RNA, 21 nt, Human
ugccugacuagggagccaugu

SEQ ID NO: 1472074 - RNA, 20 nt, Human
ugaagagguuuuaaagcuuc

SEQ ID NO: 1472075 - RNA, 21 nt, Human
ugaagagguuuuaaagcuucc

SEQ ID NO: 1472076 - RNA, 16 nt, Human
ugaagagauuuuucau

SEQ ID NO: 1472077 - RNA, 15 nt, Human
ugaagagauuuuuca

SEQ ID NO: 1472078 - RNA, 21 nt, Human
ugaagcuuuuaugugaaacau

SEQ ID NO: 1472079 - RNA, 13 nt, Human
ugaaacauguuuc

SEQ ID NO: 1472080 - RNA, 16 nt, Human
ugaaacacuuugcaua

SEQ ID NO: 1472081 - RNA, 12 nt, Human
ugaaacagaaaa

SEQ ID NO: 1472082 - RNA, 15 nt, Human
ugaaacagaaaaaua

SEQ ID NO: 1472083 - RNA, 13 nt, Human
ugaaacagaaaca

SEQ ID NO: 1472084 - RNA, 14 nt, Human
ugaaacagaaacaa

SEQ ID NO: 1472085 - RNA, 16 nt, Human
ugaaacagaaacaaaa

SEQ ID NO: 1472086 - RNA, 23 nt, Human
ugaaacagaaaaauauguaccaa

SEQ ID NO: 1472087 - RNA, 16 nt, Human
ugaacuugaggacaca

SEQ ID NO: 1472088 - RNA, 21 nt, Human
ugaacuugaaauauccugcuu

SEQ ID NO: 1472089 - RNA, 20 nt, Human
ugaacuugaggacacauguc

SEQ ID NO: 1472090 - RNA, 19 nt, Human
ugaacuugaggacacaugu

SEQ ID NO: 1472091 - RNA, 18 nt, Human
ugaacuugaggacacaug

SEQ ID NO: 1472092 - RNA, 17 nt, Human
ugaacuugaggacacau

SEQ ID NO: 1472093 - RNA, 22 nt, Human
ugaacuugaggacacaugucca

SEQ ID NO: 1472094 - RNA, 21 nt, Human
ugaacuugaggacacaugucc

SEQ ID NO: 1472095 - RNA, 14 nt, Human
ugaaggcuguacac

SEQ ID NO: 1472096 - RNA, 14 nt, Human
ugaauccucucucu

SEQ ID NO: 1472097 - RNA, 16 nt, Human
ugaauccucucucugu

SEQ ID NO: 1472098 - RNA, 21 nt, Human
ugaauccucucucuguguuac

SEQ ID NO: 1472099 - RNA, 15 nt, Human
ugaaugcaaaccaua

SEQ ID NO: 1472100 - RNA, 19 nt, Human
ugaaugcaaaccauagcac

SEQ ID NO: 1472101 - RNA, 16 nt, Human
ugaauuuaaauagcuu

SEQ ID NO: 1472102 - RNA, 23 nt, Human
ugacaacauuucuauagccaaaa

SEQ ID NO: 1472103 - RNA, 16 nt, Human
ugacaacauuucuaua

SEQ ID NO: 1472104 - RNA, 14 nt, Human
ugaauuaaguuuuu

SEQ ID NO: 1472105 - RNA, 17 nt, Human
ugaauuaaauaaacccu

SEQ ID NO: 1472106 - RNA, 13 nt, Human
ugaauuacauuug

SEQ ID NO: 1472107 - RNA, 14 nt, Human
ugaauuacauuugu

SEQ ID NO: 1472108 - RNA, 13 nt, Human
ugacaacuggcag

SEQ ID NO: 1472109 - RNA, 14 nt, Human
ugacaacuggcagg

SEQ ID NO: 1472110 - RNA, 15 nt, Human
ugacaacuggcaggc

SEQ ID NO: 1472111 - RNA, 18 nt, Human
ugacaacuggcaggcagg

SEQ ID NO: 1472112 - RNA, 17 nt, Human
ugacaacuggcaggcag

SEQ ID NO: 1472113 - RNA, 16 nt, Human
ugacaugggacauuug

SEQ ID NO: 1472114 - RNA, 15 nt, Human
ugacaugaagcuguu

SEQ ID NO: 1472115 - RNA, 17 nt, Human
ugacaucaccacaguuu

SEQ ID NO: 1472116 - RNA, 13 nt, Human
ugacaucacuugu

SEQ ID NO: 1472117 - RNA, 16 nt, Human
ugacaucacuuguaca

SEQ ID NO: 1472118 - RNA, 17 nt, Human
ugacaucacuuguacaa

SEQ ID NO: 1472119 - RNA, 18 nt, Human
ugacaucacuuguacaaa

SEQ ID NO: 1472120 - RNA, 19 nt, Human
ugacaucacuuguacaaaa

SEQ ID NO: 1472121 - RNA, 20 nt, Human
ugacaucacuuguacaaaau

SEQ ID NO: 1472122 - RNA, 21 nt, Human
ugacaucacuuguacaaaaua

SEQ ID NO: 1472123 - RNA, 22 nt, Human
ugacaucacuuguacaaaauaa

SEQ ID NO: 1472124 - RNA, 23 nt, Human
ugacaucacuuguacaaaauaaa

SEQ ID NO: 1472125 - RNA, 16 nt, Human
ugacuuuggcugcaug

SEQ ID NO: 1472126 - RNA, 17 nt, Human
ugacuggcuucagcaag

SEQ ID NO: 1472127 - RNA, 14 nt, Human
ugacucuuuccaac

SEQ ID NO: 1472128 - RNA, 16 nt, Human
ugacucuuuccaaccg

SEQ ID NO: 1472129 - RNA, 13 nt, Human
ugacucuuuccaa

SEQ ID NO: 1472130 - RNA, 19 nt, Human
ugacucuuuccaaccggcu

SEQ ID NO: 1472131 - RNA, 14 nt, Human
ugacucuuaagaag

SEQ ID NO: 1472132 - RNA, 15 nt, Human
ugacucuuaagaaga

SEQ ID NO: 1472133 - RNA, 16 nt, Human
ugacucuuaagaagac

SEQ ID NO: 1472134 - RNA, 15 nt, Human
ugacuaauggcauga

SEQ ID NO: 1472135 - RNA, 17 nt, Human
ugaccagccgugagcau

SEQ ID NO: 1472136 - RNA, 14 nt, Human
ugacuaaaauauuu

SEQ ID NO: 1472137 - RNA, 14 nt, Human
ugacuaauggcaug

SEQ ID NO: 1472138 - RNA, 16 nt, Human
ugacuaauggcaugag

SEQ ID NO: 1472139 - RNA, 18 nt, Human
ugagaaaaauauauacua

SEQ ID NO: 1472140 - RNA, 17 nt, Human
ugacuuuuugcauuuaa

SEQ ID NO: 1472141 - RNA, 23 nt, Human
ugacuuuuugcauuuaaaacaga

SEQ ID NO: 1472142 - RNA, 19 nt, Human
ugagaaaagcuuugaaccc

SEQ ID NO: 1472143 - RNA, 14 nt, Human
ugacuuuuugcauu

SEQ ID NO: 1472144 - RNA, 12 nt, Human
ugagacauccag

SEQ ID NO: 1472145 - RNA, 10 nt, Human
ugagacaucc

SEQ ID NO: 1472146 - RNA, 13 nt, Human
ugagaaaucuaaa

SEQ ID NO: 1472147 - RNA, 21 nt, Human
ugagaaagucuuauuuauuca

SEQ ID NO: 1472148 - RNA, 14 nt, Human
ugagaaagccuucu

SEQ ID NO: 1472149 - RNA, 16 nt, Human
ugagaaagccuucuuu

SEQ ID NO: 1472150 - RNA, 13 nt, Human
ugagacauccagc

SEQ ID NO: 1472151 - RNA, 19 nt, Human
ugagaggcugggaauggag

SEQ ID NO: 1472152 - RNA, 19 nt, Human
ugagaccuuccuuuuacuu

SEQ ID NO: 1472153 - RNA, 22 nt, Human
ugagauaaugugauauuauaca

SEQ ID NO: 1472154 - RNA, 14 nt, Human
ugagauacauacag

SEQ ID NO: 1472155 - RNA, 15 nt, Human
ugagauacauacaga

SEQ ID NO: 1472156 - RNA, 21 nt, Human
ugagauacauacagaauuacu

SEQ ID NO: 1472157 - RNA, 15 nt, Human
ugaggcacuggcgag

SEQ ID NO: 1472158 - RNA, 17 nt, Human
ugaggcacaugucagca

SEQ ID NO: 1472159 - RNA, 20 nt, Human
ugaggcacaugucagcaagu

SEQ ID NO: 1472160 - RNA, 17 nt, Human
ugaggaucagaguaauc

SEQ ID NO: 1472161 - RNA, 13 nt, Human
ugaggaucagagu

SEQ ID NO: 1472162 - RNA, 19 nt, Human
ugaggaucagaguaaucca

SEQ ID NO: 1472163 - RNA, 20 nt, Human
ugaggauacgacaguacacu

SEQ ID NO: 1472164 - RNA, 15 nt, Human
ugagcagucaggaaa

SEQ ID NO: 1472165 - RNA, 15 nt, Human
ugagcuauuucaucu

SEQ ID NO: 1472166 - RNA, 23 nt, Human
ugagcucagaaaauaucccuccu

SEQ ID NO: 1472167 - RNA, 15 nt, Human
ugagcugaccagccg

SEQ ID NO: 1472168 - RNA, 18 nt, Human
ugagcugaaggugaaaca

SEQ ID NO: 1472169 - RNA, 24 nt, Human
ugagcugaccagccgugagcaugu

SEQ ID NO: 1472170 - RNA, 14 nt, Human
ucuuauaauuuaaa

SEQ ID NO: 1472171 - RNA, 13 nt, Human
ucuuauaauuuaa

SEQ ID NO: 1472172 - RNA, 14 nt, Human
ucugugugcacaaa

SEQ ID NO: 1472173 - RNA, 21 nt, Human
ucugugugcacaaauauuuau

SEQ ID NO: 1472174 - RNA, 14 nt, Human
ucuuaugcaauuuc

SEQ ID NO: 1472175 - RNA, 16 nt, Human
ucuucauguuucagga

SEQ ID NO: 1472176 - RNA, 19 nt, Human
ucuugccaaauauaaauaa

SEQ ID NO: 1472177 - RNA, 17 nt, Human
ucuugcccgcucaggcu

SEQ ID NO: 1472178 - RNA, 21 nt, Human
ucuucuuuuaaaccauuuucu

SEQ ID NO: 1472179 - RNA, 22 nt, Human
ucuucuuuuaaaccauuuucuu

SEQ ID NO: 1472180 - RNA, 15 nt, Human
ucuucuuuugugaag

SEQ ID NO: 1472181 - RNA, 19 nt, Human
ucuucuuggccaugggagg

SEQ ID NO: 1472182 - RNA, 23 nt, Human
ucuucuuggccaugggaggccuu

SEQ ID NO: 1472183 - RNA, 17 nt, Human
ucuuuccacagaagcuc

SEQ ID NO: 1472184 - RNA, 19 nt, Human
ucuuuccaaccggcuuugu

SEQ ID NO: 1472185 - RNA, 22 nt, Human
ucuuugccacccucaugcugug

SEQ ID NO: 1472186 - RNA, 21 nt, Human
ucuuugccacccucaugcugu

SEQ ID NO: 1472187 - RNA, 21 nt, Human
ucuuugacaauugggagcugc

SEQ ID NO: 1472188 - RNA, 13 nt, Human
ucuuuucauacau

SEQ ID NO: 1472189 - RNA, 23 nt, Human
ucuuuucauacauuuucuaagaa

SEQ ID NO: 1472190 - RNA, 15 nt, Human
ugaaacacuuugcau

SEQ ID NO: 1472191 - RNA, 18 nt, Human
ugaaaaccacauuggaga

SEQ ID NO: 1472192 - RNA, 13 nt, Human
ugaaaauuauuua

SEQ ID NO: 1472193 - RNA, 17 nt, Human
ugaaaauuauuuaaacc

SEQ ID NO: 1472194 - RNA, 14 nt, Human
ugaaaauuauuuaa

SEQ ID NO: 1472195 - RNA, 14 nt, Human
ucuuuucauacauu

SEQ ID NO: 1472196 - RNA, 19 nt, Human
ucuuuucccacuguuuaag

SEQ ID NO: 1472197 - RNA, 22 nt, Human
ucuggagcccacuguacuugcu

SEQ ID NO: 1472198 - RNA, 16 nt, Human
ucuggagcccacugua

SEQ ID NO: 1472199 - RNA, 12 nt, Human
ucuggagcccac

SEQ ID NO: 1472200 - RNA, 15 nt, Human
ucuggcuucuggcca

SEQ ID NO: 1472201 - RNA, 18 nt, Human
ucuggcuucuggccagga

SEQ ID NO: 1472202 - RNA, 19 nt, Human
ucuggcuucuggccaggaa

SEQ ID NO: 1472203 - RNA, 22 nt, Human
ucuguaagaaaccuacugccca

SEQ ID NO: 1472204 - RNA, 14 nt, Human
ucuguaagaaaccu

SEQ ID NO: 1472205 - RNA, 20 nt, Human
ucuguaagaaaccuacugcc

SEQ ID NO: 1472206 - RNA, 19 nt, Human
ucuguaaacuguguauucc

SEQ ID NO: 1472207 - RNA, 22 nt, Human
ucuguaaacuguguauuccaag

SEQ ID NO: 1472208 - RNA, 19 nt, Human
ucuguaaagcuaaaauaaa

SEQ ID NO: 1472209 - RNA, 13 nt, Human
ucuguaaagcuaa

SEQ ID NO: 1472210 - RNA, 12 nt, Human
ucuguaaacugu

SEQ ID NO: 1472211 - RNA, 13 nt, Human
ucuguaaacugug

SEQ ID NO: 1472212 - RNA, 14 nt, Human
ucuguaaacugugu

SEQ ID NO: 1472213 - RNA, 15 nt, Human
ucuguaaacugugua

SEQ ID NO: 1472214 - RNA, 16 nt, Human
ucuguaaacuguguau

SEQ ID NO: 1472215 - RNA, 20 nt, Human
ucuggcuucuggccaggaag

SEQ ID NO: 1472216 - RNA, 17 nt, Human
ucuggugaagcucacuu

SEQ ID NO: 1472217 - RNA, 17 nt, Human
ucugucgcccaugcugg

SEQ ID NO: 1472218 - RNA, 15 nt, Human
ucugucuacuugcuc

SEQ ID NO: 1472219 - RNA, 18 nt, Human
ucugucuacuugcucagg

SEQ ID NO: 1472220 - RNA, 23 nt, Human
ucugucuacuugcucagguacuu

SEQ ID NO: 1472221 - RNA, 14 nt, Human
ucuggaauuugaaa

SEQ ID NO: 1472222 - RNA, 21 nt, Human
ucugcagucucuauaccaaua

SEQ ID NO: 1472223 - RNA, 20 nt, Human
ucugcagucucuauaccaau

SEQ ID NO: 1472224 - RNA, 18 nt, Human
ucugcagucucuauacca

SEQ ID NO: 1472225 - RNA, 14 nt, Human
ucugcagucucuau

SEQ ID NO: 1472226 - RNA, 15 nt, Human
ucucaucaacugaau

SEQ ID NO: 1472227 - RNA, 17 nt, Human
ucucaucaacugaauga

SEQ ID NO: 1472228 - RNA, 21 nt, Human
ucugagcccgguaagagcaaa

SEQ ID NO: 1472229 - RNA, 23 nt, Human
ucugagcccgguaagagcaaaag

SEQ ID NO: 1472230 - RNA, 17 nt, Human
ucugagcuauuucaucu

SEQ ID NO: 1472231 - RNA, 20 nt, Human
ucugagcuauuucaucuauu

SEQ ID NO: 1472232 - RNA, 22 nt, Human
ucugagcuauuucaucuauuuu

SEQ ID NO: 1472233 - RNA, 16 nt, Human
ucugauugugauguga

SEQ ID NO: 1472234 - RNA, 14 nt, Human
ucugcaaacugccu

SEQ ID NO: 1472235 - RNA, 15 nt, Human
ucugcaaacugccuu

SEQ ID NO: 1472236 - RNA, 17 nt, Human
ucugcaaggucuuuggu

SEQ ID NO: 1472237 - RNA, 15 nt, Human
uccuuaccuuuuuau

SEQ ID NO: 1472238 - RNA, 20 nt, Human
uccuuaccuuuuuauuugca

SEQ ID NO: 1472239 - RNA, 17 nt, Human
uccuuaggccucugaga

SEQ ID NO: 1472240 - RNA, 17 nt, Human
uccuuaucgaaacucau

SEQ ID NO: 1472241 - RNA, 20 nt, Human
uccuuugaauccucucucug

SEQ ID NO: 1472242 - RNA, 21 nt, Human
uccuuugaauccucucucugu

SEQ ID NO: 1472243 - RNA, 12 nt, Human
ucgauuagacug

SEQ ID NO: 1472244 - RNA, 13 nt, Human
ucgauuagacugg

SEQ ID NO: 1472245 - RNA, 14 nt, Human
ucgauuagacugga

SEQ ID NO: 1472246 - RNA, 18 nt, Human
ucgauuagacuggacagc

SEQ ID NO: 1472247 - RNA, 22 nt, Human
ucgauuagacuggacagcuugu

SEQ ID NO: 1472248 - RNA, 21 nt, Human
ucgauuagacuggacagcuug

SEQ ID NO: 1472249 - RNA, 19 nt, Human
ucgcuuuauuggcugagau

SEQ ID NO: 1472250 - RNA, 13 nt, Human
ucuauauuuuaca

SEQ ID NO: 1472251 - RNA, 15 nt, Human
ucuagguaaauuaca

SEQ ID NO: 1472252 - RNA, 17 nt, Human
ucuagguaggaaaugug

SEQ ID NO: 1472253 - RNA, 21 nt, Human
ucuaggcaguucaaagcagga

SEQ ID NO: 1472254 - RNA, 13 nt, Human
ucuaauuuauaaa

SEQ ID NO: 1472255 - RNA, 14 nt, Human
ucuaauuuauaaaa

SEQ ID NO: 1472256 - RNA, 18 nt, Human
ucgucuguuuauaaacau

SEQ ID NO: 1472257 - RNA, 18 nt, Human
ucuaaucaugaaacuccc

SEQ ID NO: 1472258 - RNA, 18 nt, Human
ucucagauuucugaggaa

SEQ ID NO: 1472259 - RNA, 17 nt, Human
ucucagauuucugagga

SEQ ID NO: 1472260 - RNA, 21 nt, Human
ucucaguugcagcccugcugc

SEQ ID NO: 1472261 - RNA, 15 nt, Human
ucucaguuuucauaa

SEQ ID NO: 1472262 - RNA, 16 nt, Human
ucucaguuuucauaag

SEQ ID NO: 1472263 - RNA, 18 nt, Human
ucucagaaugucauuuug

SEQ ID NO: 1472264 - RNA, 14 nt, Human
ucucagauuucuga

SEQ ID NO: 1472265 - RNA, 16 nt, Human
ucucacugcuugaacu

SEQ ID NO: 1472266 - RNA, 18 nt, Human
ucucacugcuugaacuag

SEQ ID NO: 1472267 - RNA, 14 nt, Human
ucucacugcuugaa

SEQ ID NO: 1472268 - RNA, 13 nt, Human
ucuaugaaauauu

SEQ ID NO: 1472269 - RNA, 12 nt, Human
ucucaauuucua

SEQ ID NO: 1472270 - RNA, 19 nt, Human
ucccuacccuaaccaaguu

SEQ ID NO: 1472271 - RNA, 23 nt, Human
ucccaugagcuccuuaaggcucu

SEQ ID NO: 1472272 - RNA, 18 nt, Human
ucccuagcugugaccucu

SEQ ID NO: 1472273 - RNA, 16 nt, Human
ucccucugcagucucu

SEQ ID NO: 1472274 - RNA, 22 nt, Human
ucccucugcagucucuauacca

SEQ ID NO: 1472275 - RNA, 19 nt, Human
ucccugggccuugggcucc

SEQ ID NO: 1472276 - RNA, 13 nt, Human
ucccugggccuug

SEQ ID NO: 1472277 - RNA, 14 nt, Human
ucccugggccuugg

SEQ ID NO: 1472278 - RNA, 15 nt, Human
ucccugggccuuggg

SEQ ID NO: 1472279 - RNA, 16 nt, Human
ucccugggccuugggc

SEQ ID NO: 1472280 - RNA, 17 nt, Human
uccgacucuucugagca

SEQ ID NO: 1472281 - RNA, 13 nt, Human
uccuauccuccua

SEQ ID NO: 1472282 - RNA, 13 nt, Human
uccuaugcuuuga

SEQ ID NO: 1472283 - RNA, 14 nt, Human
uccuaugcuuugaa

SEQ ID NO: 1472284 - RNA, 20 nt, Human
uccuaugcuuugaaacagaa

SEQ ID NO: 1472285 - RNA, 21 nt, Human
uccuauugugcaauguaaaua

SEQ ID NO: 1472286 - RNA, 17 nt, Human
uccuccgucaccucaga

SEQ ID NO: 1472287 - RNA, 12 nt, Human
uccuccugcuca

SEQ ID NO: 1472288 - RNA, 16 nt, Human
uccucgagaucccaac

SEQ ID NO: 1472289 - RNA, 23 nt, Human
uccucgagaucccaacacugcca

SEQ ID NO: 1472290 - RNA, 12 nt, Human
uccauacauuug

SEQ ID NO: 1472291 - RNA, 19 nt, Human
uccauauaaauauuagaaa

SEQ ID NO: 1472292 - RNA, 13 nt, Human
uccauauaaauau

SEQ ID NO: 1472293 - RNA, 12 nt, Human
uccauauaaaua

SEQ ID NO: 1472294 - RNA, 16 nt, Human
ucccaacacugccagc

SEQ ID NO: 1472295 - RNA, 14 nt, Human
ucccaacacugcca

SEQ ID NO: 1472296 - RNA, 15 nt, Human
ucccaacacugccag

SEQ ID NO: 1472297 - RNA, 20 nt, Human
uccaugcguguuucugacuc

SEQ ID NO: 1472298 - RNA, 18 nt, Human
uccaugcguguuucugac

SEQ ID NO: 1472299 - RNA, 19 nt, Human
uccaugcguguuucugacu

SEQ ID NO: 1472300 - RNA, 21 nt, Human
uccaugcacccucauacacag

SEQ ID NO: 1472301 - RNA, 20 nt, Human
ucccaagcaccugggauuac

SEQ ID NO: 1472302 - RNA, 21 nt, Human
ucccaagcaccugggauuaca

SEQ ID NO: 1472303 - RNA, 13 nt, Human
ucccaagagcuac

SEQ ID NO: 1472304 - RNA, 17 nt, Human
ucccacucacaacagcu

SEQ ID NO: 1472305 - RNA, 22 nt, Human
ucccacucacaacagcugccug

SEQ ID NO: 1472306 - RNA, 15 nt, Human
ucccacggccuuucu

SEQ ID NO: 1472307 - RNA, 17 nt, Human
ucccacggccuuucuag

SEQ ID NO: 1472308 - RNA, 21 nt, Human
ucccacuucagccucccaagc

SEQ ID NO: 1472309 - RNA, 16 nt, Human
ucccagggacaccugg

SEQ ID NO: 1472310 - RNA, 17 nt, Human
uccagagcacugcucca

SEQ ID NO: 1472311 - RNA, 15 nt, Human
uccagagucccugcc

SEQ ID NO: 1472312 - RNA, 20 nt, Human
uccagaggcuauuauuuuca

SEQ ID NO: 1472313 - RNA, 17 nt, Human
uccacuuuaucuugaau

SEQ ID NO: 1472314 - RNA, 15 nt, Human
uccacuuuaucuuga

SEQ ID NO: 1472315 - RNA, 17 nt, Human
uccaagcaaaugugaau

SEQ ID NO: 1472316 - RNA, 21 nt, Human
uccaagagcuacauaauuuag

SEQ ID NO: 1472317 - RNA, 23 nt, Human
uccacagcugccucuucccucuu

SEQ ID NO: 1472318 - RNA, 23 nt, Human
ucagauaagguaaaaugccauga

SEQ ID NO: 1472319 - RNA, 14 nt, Human
uaucauuccaaagg

SEQ ID NO: 1472320 - RNA, 20 nt, Human
ucagauaagguaaaaugcca

SEQ ID NO: 1472321 - RNA, 17 nt, Human
ucagauagaaugacagu

SEQ ID NO: 1472322 - RNA, 17 nt, Human
ucagauaugauucaaau

SEQ ID NO: 1472323 - RNA, 18 nt, Human
ucagauaugauucaaaug

SEQ ID NO: 1472324 - RNA, 22 nt, Human
ucagauaagguaaaaugccaug

SEQ ID NO: 1472325 - RNA, 13 nt, Human
ucagauccuccuc

SEQ ID NO: 1472326 - RNA, 15 nt, Human
ucagauccuccucau

SEQ ID NO: 1472327 - RNA, 14 nt, Human
ucagauccuccuca

SEQ ID NO: 1472328 - RNA, 17 nt, Human
ucagcagggacuguaaa

SEQ ID NO: 1472329 - RNA, 18 nt, Human
ucagcagggacuguaaac

SEQ ID NO: 1472330 - RNA, 22 nt, Human
ucagcagggacuguaaacacag

SEQ ID NO: 1472331 - RNA, 19 nt, Human
ucagcucucaguugcagcc

SEQ ID NO: 1472332 - RNA, 20 nt, Human
ucaggagagaguugaaccua

SEQ ID NO: 1472333 - RNA, 16 nt, Human
ucaggaggaaggcuua

SEQ ID NO: 1472334 - RNA, 23 nt, Human
ucaggaggaaggcuuacacccac

SEQ ID NO: 1472335 - RNA, 23 nt, Human
ucagccuccauccuacccccugu

SEQ ID NO: 1472336 - RNA, 24 nt, Human
ucauggacuucugccagcauaaua

SEQ ID NO: 1472337 - RNA, 21 nt, Human
ucauggaauuggagcucgugg

SEQ ID NO: 1472338 - RNA, 15 nt, Human
ucaugaaagauucaa

SEQ ID NO: 1472339 - RNA, 13 nt, Human
ucaugaaagauuc

SEQ ID NO: 1472340 - RNA, 11 nt, Human
ucaugaaaauu

SEQ ID NO: 1472341 - RNA, 19 nt, Human
ucauggaauuggagcucgu

SEQ ID NO: 1472342 - RNA, 18 nt, Human
ucaucuggaaccaucaga

SEQ ID NO: 1472343 - RNA, 12 nt, Human
ucaucuggaacc

SEQ ID NO: 1472344 - RNA, 17 nt, Human
ucaucuggauuccagag

SEQ ID NO: 1472345 - RNA, 13 nt, Human
ucaucuggaacca

SEQ ID NO: 1472346 - RNA, 19 nt, Human
ucaucuggcaacaucuuua

SEQ ID NO: 1472347 - RNA, 23 nt, Human
ucaucuggcaacaucuuuauccg

SEQ ID NO: 1472348 - RNA, 14 nt, Human
ucaucuuucuucca

SEQ ID NO: 1472349 - RNA, 17 nt, Human
ucaucuuucuuccaaac

SEQ ID NO: 1472350 - RNA, 22 nt, Human
ucauauuuuucauagcuaaaaa

SEQ ID NO: 1472351 - RNA, 18 nt, Human
ucauauuuucuuucaaaa

SEQ ID NO: 1472352 - RNA, 13 nt, Human
ucauagaaaugua

SEQ ID NO: 1472353 - RNA, 22 nt, Human
ucauagaaauguaacuuuugua

SEQ ID NO: 1472354 - RNA, 23 nt, Human
ucauagaaauguaacuuuuguaa

SEQ ID NO: 1472355 - RNA, 19 nt, Human
ucaguucucuugauuuuca

SEQ ID NO: 1472356 - RNA, 13 nt, Human
ucaucaacugaau

SEQ ID NO: 1472357 - RNA, 15 nt, Human
ucaucaacugaauga

SEQ ID NO: 1472358 - RNA, 22 nt, Human
ucaucaacugaaugaggucagc

SEQ ID NO: 1472359 - RNA, 20 nt, Human
ucaguuaacuauugcauuua

SEQ ID NO: 1472360 - RNA, 16 nt, Human
ucaguuaacuauugca

SEQ ID NO: 1472361 - RNA, 23 nt, Human
ucagucucuauaccaauaaagug

SEQ ID NO: 1472362 - RNA, 22 nt, Human
ucagucucuauaccaauaaagu

SEQ ID NO: 1472363 - RNA, 18 nt, Human
ucaguccccacagauaac

SEQ ID NO: 1472364 - RNA, 24 nt, Human
uauagaaagcuauauaagacaaga

SEQ ID NO: 1472365 - RNA, 13 nt, Human
uauagaaagcuau

SEQ ID NO: 1472366 - RNA, 13 nt, Human
uauacuuuuacaa

SEQ ID NO: 1472367 - RNA, 16 nt, Human
uauaguacaugauaaa

SEQ ID NO: 1472368 - RNA, 14 nt, Human
uauaguacaugaua

SEQ ID NO: 1472369 - RNA, 13 nt, Human
uauaguacaugau

SEQ ID NO: 1472370 - RNA, 12 nt, Human
uauaguacauga

SEQ ID NO: 1472371 - RNA, 13 nt, Human
uauaguccagcuu

SEQ ID NO: 1472372 - RNA, 22 nt, Human
uauaguuuuacuuuuaaacugu

SEQ ID NO: 1472373 - RNA, 23 nt, Human
uauaguuuuacuuuuaaacugug

SEQ ID NO: 1472374 - RNA, 12 nt, Human
uauaucuuguuu

SEQ ID NO: 1472375 - RNA, 17 nt, Human
uauauaacaaugcugua

SEQ ID NO: 1472376 - RNA, 19 nt, Human
uauauaacaaugcuguauu

SEQ ID NO: 1472377 - RNA, 16 nt, Human
uauauuuuuuucugaa

SEQ ID NO: 1472378 - RNA, 19 nt, Human
uauauuuuuuucugaaauu

SEQ ID NO: 1472379 - RNA, 20 nt, Human
uauauuuuuuucugaaauuu

SEQ ID NO: 1472380 - RNA, 14 nt, Human
uauaugcuucuguu

SEQ ID NO: 1472381 - RNA, 18 nt, Human
uauaugaagaaaaucacu

SEQ ID NO: 1472382 - RNA, 16 nt, Human
uauaugcuucuguuuu

SEQ ID NO: 1472383 - RNA, 19 nt, Human
uauaugaagaaaaucacuu

SEQ ID NO: 1472384 - RNA, 17 nt, Human
uauauggaaauucugcu

SEQ ID NO: 1472385 - RNA, 19 nt, Human
uaucaaacaccaacauaaa

SEQ ID NO: 1472386 - RNA, 23 nt, Human
uaucaaacaccaacauaaaaaug

SEQ ID NO: 1472387 - RNA, 14 nt, Human
uaucauagaaaugu

SEQ ID NO: 1472388 - RNA, 15 nt, Human
uaucauagaaaugua

SEQ ID NO: 1472389 - RNA, 17 nt, Human
uaucaugcauguccugu

SEQ ID NO: 1472390 - RNA, 19 nt, Human
uaucaugcauguccuguaa

SEQ ID NO: 1472391 - RNA, 23 nt, Human
uaucauagaaauguaacuuuugu

SEQ ID NO: 1472392 - RNA, 18 nt, Human
uaucauagaaauguaacu

SEQ ID NO: 1472393 - RNA, 21 nt, Human
uaucauauauauacauacaug

SEQ ID NO: 1472394 - RNA, 18 nt, Human
uaucaucagauagcaucu

SEQ ID NO: 1472395 - RNA, 18 nt, Human
uauaaaccgaacugaugu

SEQ ID NO: 1472396 - RNA, 22 nt, Human
uaguugaauuuuuuuuaacauu

SEQ ID NO: 1472397 - RNA, 17 nt, Human
uaguauuguccaggucu

SEQ ID NO: 1472398 - RNA, 16 nt, Human
uaguaggcauuuuuac

SEQ ID NO: 1472399 - RNA, 23 nt, Human
uaguggauuacugccauucacuu

SEQ ID NO: 1472400 - RNA, 17 nt, Human
uaguucuuacugcuuaa

SEQ ID NO: 1472401 - RNA, 17 nt, Human
uaguugaaaauaaagug

SEQ ID NO: 1472402 - RNA, 23 nt, Human
uaguugaauuuuuuuuaacauuc

SEQ ID NO: 1472403 - RNA, 12 nt, Human
uaguugaauuuu

SEQ ID NO: 1472404 - RNA, 23 nt, Human
uaguagcguuuuuuaaauguaua

SEQ ID NO: 1472405 - RNA, 21 nt, Human
uaguagcguuuuuuaaaugua

SEQ ID NO: 1472406 - RNA, 19 nt, Human
uaguagcguuuuuuaaaug

SEQ ID NO: 1472407 - RNA, 20 nt, Human
uaguagcagugauugucuua

SEQ ID NO: 1472408 - RNA, 20 nt, Human
uagguggguugaaagccaag

SEQ ID NO: 1472409 - RNA, 14 nt, Human
uagcugggacuaca

SEQ ID NO: 1472410 - RNA, 21 nt, Human
uagcugucugcucagacagaa

SEQ ID NO: 1472411 - RNA, 21 nt, Human
uaggucuuaauacacacaguu

SEQ ID NO: 1472412 - RNA, 13 nt, Human
uagcauccuggaa

SEQ ID NO: 1472413 - RNA, 15 nt, Human
uagcauccuggaaua

SEQ ID NO: 1472414 - RNA, 16 nt, Human
uagcauccuggaauau

SEQ ID NO: 1472415 - RNA, 18 nt, Human
uagcauccuggaauaucu

SEQ ID NO: 1472416 - RNA, 19 nt, Human
uagauuugugugcaucagg

SEQ ID NO: 1472417 - RNA, 22 nt, Human
uagauuugugugcaucaggcuu

SEQ ID NO: 1472418 - RNA, 20 nt, Human
uagauuugugugcaucaggc

SEQ ID NO: 1472419 - RNA, 14 nt, Human
uagauaggccaugg

SEQ ID NO: 1472420 - RNA, 16 nt, Human
uagccccucuccugga

SEQ ID NO: 1472421 - RNA, 14 nt, Human
uagccccugaaagc

SEQ ID NO: 1472422 - RNA, 14 nt, Human
uagcugaucaguuu

SEQ ID NO: 1472423 - RNA, 11 nt, Human
uagccuggcua

SEQ ID NO: 1472424 - RNA, 13 nt, Human
uagaauaugccuu

SEQ ID NO: 1472425 - RNA, 23 nt, Human
uagaauacaguuuugaguagagu

SEQ ID NO: 1472426 - RNA, 23 nt, Human
uagaauaccacaggaaccacaag

SEQ ID NO: 1472427 - RNA, 14 nt, Human
uacuuguuucagag

SEQ ID NO: 1472428 - RNA, 15 nt, Human
uacuuguuucagagu

SEQ ID NO: 1472429 - RNA, 15 nt, Human
uagaauuaucuaauu

SEQ ID NO: 1472430 - RNA, 16 nt, Human
uagaauuaucuaauuu

SEQ ID NO: 1472431 - RNA, 19 nt, Human
uagaauuaucuaauuuaua

SEQ ID NO: 1472432 - RNA, 21 nt, Human
uagaauuaucuaauuuauaaa

SEQ ID NO: 1472433 - RNA, 22 nt, Human
uagaauuaucuaauuuauaaaa

SEQ ID NO: 1472434 - RNA, 23 nt, Human
uagaauuaucuaauuuauaaaaa

SEQ ID NO: 1472435 - RNA, 21 nt, Human
uagaauuauaacuggaaagaa

SEQ ID NO: 1472436 - RNA, 18 nt, Human
uagaauguaaagcuuguc

SEQ ID NO: 1472437 - RNA, 15 nt, Human
uagaauguaaagcuu

SEQ ID NO: 1472438 - RNA, 17 nt, Human
uagaauguaaagcuugu

SEQ ID NO: 1472439 - RNA, 16 nt, Human
uagaaugauuucaugc

SEQ ID NO: 1472440 - RNA, 12 nt, Human
uagaaugacagu

SEQ ID NO: 1472441 - RNA, 21 nt, Human
uagaaugauuucaugcuaucu

SEQ ID NO: 1472442 - RNA, 22 nt, Human
uagacuucaagcauggcuauuu

SEQ ID NO: 1472443 - RNA, 17 nt, Human
uagacucugucuaccug

SEQ ID NO: 1472444 - RNA, 22 nt, Human
uagacucugucuaccuggucug

SEQ ID NO: 1472445 - RNA, 15 nt, Human
uagaccaccaagccu

SEQ ID NO: 1472446 - RNA, 17 nt, Human
uagaccaccaagccuug

SEQ ID NO: 1472447 - RNA, 16 nt, Human
uagaccaccaagccuu

SEQ ID NO: 1472448 - RNA, 19 nt, Human
uagaccaccaagccuugau

SEQ ID NO: 1472449 - RNA, 16 nt, Human
uagagaagcaaguaaa

SEQ ID NO: 1472450 - RNA, 13 nt, Human
uagagaagcaagu

SEQ ID NO: 1472451 - RNA, 16 nt, Human
uagaggugagaaauuu

SEQ ID NO: 1472452 - RNA, 17 nt, Human
uagaggugagaaauuua

SEQ ID NO: 1472453 - RNA, 21 nt, Human
uacauggcuggagcuagaauu

SEQ ID NO: 1472454 - RNA, 12 nt, Human
uacaugaaacag

SEQ ID NO: 1472455 - RNA, 13 nt, Human
uacaugaaacaga

SEQ ID NO: 1472456 - RNA, 14 nt, Human
uacaugaaacagaa

SEQ ID NO: 1472457 - RNA, 15 nt, Human
uacaugaaacagaaa

SEQ ID NO: 1472458 - RNA, 21 nt, Human
uacaugaaacagaaacaaaaa

SEQ ID NO: 1472459 - RNA, 21 nt, Human
uacaugcacuuggcugcauaa

SEQ ID NO: 1472460 - RNA, 14 nt, Human
uacaugcauacacu

SEQ ID NO: 1472461 - RNA, 20 nt, Human
uacaugcauacacucucaaa

SEQ ID NO: 1472462 - RNA, 21 nt, Human
uacaugcauacacucucaaag

SEQ ID NO: 1472463 - RNA, 20 nt, Human
uacaugcauuacugcaugca

SEQ ID NO: 1472464 - RNA, 17 nt, Human
uacaugcuaagagaagu

SEQ ID NO: 1472465 - RNA, 18 nt, Human
uacaugcuaagagaagua

SEQ ID NO: 1472466 - RNA, 19 nt, Human
uacaugcuaagagaaguag

SEQ ID NO: 1472467 - RNA, 18 nt, Human
uacaguuuugaguagagu

SEQ ID NO: 1472468 - RNA, 13 nt, Human
uacauaacugaaa

SEQ ID NO: 1472469 - RNA, 15 nt, Human
uacauaacugaaaau

SEQ ID NO: 1472470 - RNA, 17 nt, Human
uacauaacugaaaaugu

SEQ ID NO: 1472471 - RNA, 21 nt, Human
uacauaacugaaaaugugcua

SEQ ID NO: 1472472 - RNA, 23 nt, Human
uacaguucggugagcuacaaaug

SEQ ID NO: 1472473 - RNA, 20 nt, Human
uacaggaugaugacuaugga

SEQ ID NO: 1472474 - RNA, 14 nt, Human
uacaggauuugaaa

SEQ ID NO: 1472475 - RNA, 21 nt, Human
uacagcucagaaguuucuucu

SEQ ID NO: 1472476 - RNA, 15 nt, Human
uacaaccuccgccuc

SEQ ID NO: 1472477 - RNA, 16 nt, Human
uacaaccaauggaaug

SEQ ID NO: 1472478 - RNA, 22 nt, Human
uacaacggagucaaaaauuaaa

SEQ ID NO: 1472479 - RNA, 15 nt, Human
uacaacggagucaaa

SEQ ID NO: 1472480 - RNA, 14 nt, Human
uacaagaagcauuu

SEQ ID NO: 1472481 - RNA, 15 nt, Human
uacaagaagcauuuu

SEQ ID NO: 1472482 - RNA, 21 nt, Human
uacacauguaucuaugcauuu

SEQ ID NO: 1472483 - RNA, 21 nt, Human
uacacucucaaagcaaauaau

SEQ ID NO: 1472484 - RNA, 20 nt, Human
uaauuccuucagcacuuuag

SEQ ID NO: 1472485 - RNA, 21 nt, Human
uaauuccuucagcacuuuaga

SEQ ID NO: 1472486 - RNA, 15 nt, Human
uaauucuaugagaua

SEQ ID NO: 1472487 - RNA, 14 nt, Human
uaauuccuucagca

SEQ ID NO: 1472488 - RNA, 18 nt, Human
uaauuuugugaagcaaaa

SEQ ID NO: 1472489 - RNA, 12 nt, Human
uaauuuuuauau

SEQ ID NO: 1472490 - RNA, 16 nt, Human
uaauuuuuauauuuga

SEQ ID NO: 1472491 - RNA, 17 nt, Human
uaauuuuuauauuugaa

SEQ ID NO: 1472492 - RNA, 19 nt, Human
uacaaacucccacuuguca

SEQ ID NO: 1472493 - RNA, 17 nt, Human
uacaaagcccuuuuaua

SEQ ID NO: 1472494 - RNA, 18 nt, Human
uacaaaggcuuauuaauu

SEQ ID NO: 1472495 - RNA, 22 nt, Human
uaccaaaaaucucaauauuuca

SEQ ID NO: 1472496 - RNA, 20 nt, Human
uacauuuuuugggcagcaau

SEQ ID NO: 1472497 - RNA, 20 nt, Human
uaccguaggcuuuguauuca

SEQ ID NO: 1472498 - RNA, 17 nt, Human
uaccuaagaaguacauu

SEQ ID NO: 1472499 - RNA, 13 nt, Human
uaccuacuuugac

SEQ ID NO: 1472500 - RNA, 14 nt, Human
uaccuacuuugacu

SEQ ID NO: 1472501 - RNA, 21 nt, Human
uaccuacuuugacuuuuugca

SEQ ID NO: 1472502 - RNA, 15 nt, Human
uaccuagcuggcucu

SEQ ID NO: 1472503 - RNA, 18 nt, Human
uacuaaagccaaacauau

SEQ ID NO: 1472504 - RNA, 14 nt, Human
uacuaaagccaaac

SEQ ID NO: 1472505 - RNA, 20 nt, Human
uacuaagcauugaauggcua

SEQ ID NO: 1472506 - RNA, 19 nt, Human
uacuaaggaagauuacuca

SEQ ID NO: 1472507 - RNA, 20 nt, Human
uaccuuuuuauuugcaugug

SEQ ID NO: 1472508 - RNA, 23 nt, Human
uaccucuccagccucagcucuca

SEQ ID NO: 1472509 - RNA, 15 nt, Human
uaccucuauauacca

SEQ ID NO: 1472510 - RNA, 16 nt, Human
uaccucuauauaccaa

SEQ ID NO: 1472511 - RNA, 15 nt, Human
uacugcucuccucca

SEQ ID NO: 1472512 - RNA, 20 nt, Human
uacugcuuaauucaaauaau

SEQ ID NO: 1472513 - RNA, 19 nt, Human
uacugcuuaauucaaauaa

SEQ ID NO: 1472514 - RNA, 13 nt, Human
uacugcuuaauuc

SEQ ID NO: 1472515 - RNA, 20 nt, Human
uacugcugagauacauacag

SEQ ID NO: 1472516 - RNA, 21 nt, Human
uacugcugagauacauacaga

SEQ ID NO: 1472517 - RNA, 24 nt, Human
uacugcuuggagcugagcaaauca

SEQ ID NO: 1472518 - RNA, 19 nt, Human
uacugcuuggagcugagca

SEQ ID NO: 1472519 - RNA, 19 nt, Human
uacuugcucuugaugccug

SEQ ID NO: 1472520 - RNA, 18 nt, Human
uacuugcucuugaugccu

SEQ ID NO: 1472521 - RNA, 14 nt, Human
uacuugcucuugau

SEQ ID NO: 1472522 - RNA, 13 nt, Human
uacuugcucuuga

SEQ ID NO: 1472523 - RNA, 20 nt, Human
uacuugcucuugaugccugg

SEQ ID NO: 1472524 - RNA, 21 nt, Human
uacugccuauuuuaauaaaca

SEQ ID NO: 1472525 - RNA, 14 nt, Human
uacugccuauuuua

SEQ ID NO: 1472526 - RNA, 20 nt, Human
uacugccauucacuucauaa

SEQ ID NO: 1472527 - RNA, 22 nt, Human
uacugccgucagugcugugcug

SEQ ID NO: 1472528 - RNA, 13 nt, Human
uacugcaugcacu

SEQ ID NO: 1472529 - RNA, 21 nt, Human
uacugcaagguucaacuuauu

SEQ ID NO: 1472530 - RNA, 12 nt, Human
uacugcagccuc

SEQ ID NO: 1472531 - RNA, 17 nt, Human
uacugcagccuccagag

SEQ ID NO: 1472532 - RNA, 11 nt, Human
uacucauuuuu

SEQ ID NO: 1472533 - RNA, 14 nt, Human
uacucauuuuucau

SEQ ID NO: 1472534 - RNA, 16 nt, Human
uacucauuuuucauga

SEQ ID NO: 1472535 - RNA, 12 nt, Human
uaaguccagugu

SEQ ID NO: 1472536 - RNA, 13 nt, Human
uaagucagaacag

SEQ ID NO: 1472537 - RNA, 22 nt, Human
uaagugauugcugguuuuaguu

SEQ ID NO: 1472538 - RNA, 16 nt, Human
uaagugauuguaugaa

SEQ ID NO: 1472539 - RNA, 20 nt, Human
uaauaaaggacuguaaucuu

SEQ ID NO: 1472540 - RNA, 16 nt, Human
uaauaaaggacuguaa

SEQ ID NO: 1472541 - RNA, 13 nt, Human
uaauaaaggacug

SEQ ID NO: 1472542 - RNA, 12 nt, Human
uaauaaaggacu

SEQ ID NO: 1472543 - RNA, 12 nt, Human
uaauaaagcugu

SEQ ID NO: 1472544 - RNA, 14 nt, Human
uaaggcaaucaugg

SEQ ID NO: 1472545 - RNA, 22 nt, Human
uaagcgcuagaggaagcagcca

SEQ ID NO: 1472546 - RNA, 19 nt, Human
uaaggggaggaaccagagu

SEQ ID NO: 1472547 - RNA, 19 nt, Human
uaagggccagaaauaucuu

SEQ ID NO: 1472548 - RNA, 13 nt, Human
uaagggaagaauu

SEQ ID NO: 1472549 - RNA, 18 nt, Human
uaagguacaagaagcauu

SEQ ID NO: 1472550 - RNA, 19 nt, Human
uaagguacaagaagcauuu

SEQ ID NO: 1472551 - RNA, 13 nt, Human
uaagguguagcca

SEQ ID NO: 1472552 - RNA, 19 nt, Human
uaagguguagccacaccag

SEQ ID NO: 1472553 - RNA, 21 nt, Human
uaagguguagccacaccagga

SEQ ID NO: 1472554 - RNA, 14 nt, Human
uaagucagaacagc

SEQ ID NO: 1472555 - RNA, 14 nt, Human
uaauaauguuucaa

SEQ ID NO: 1472556 - RNA, 23 nt, Human
uaauaucccacugggagaaagga

SEQ ID NO: 1472557 - RNA, 12 nt, Human
uaauauccuaaa

SEQ ID NO: 1472558 - RNA, 14 nt, Human
uaauauccuaaaca

SEQ ID NO: 1472559 - RNA, 17 nt, Human
uaauauccuaaacauca

SEQ ID NO: 1472560 - RNA, 15 nt, Human
uaauauccuaaacau

SEQ ID NO: 1472561 - RNA, 14 nt, Human
uaauccccuucucc

SEQ ID NO: 1472562 - RNA, 15 nt, Human
uaauccccuucuccc

SEQ ID NO: 1472563 - RNA, 17 nt, Human
uaauccccuucuccccu

SEQ ID NO: 1472564 - RNA, 18 nt, Human
uaauccccuucuccccug

SEQ ID NO: 1472565 - RNA, 21 nt, Human
uaauccccuucuccccugcac

SEQ ID NO: 1472566 - RNA, 13 nt, Human
uaaucugccuccc

SEQ ID NO: 1472567 - RNA, 14 nt, Human
uaaucuagaacaca

SEQ ID NO: 1472568 - RNA, 22 nt, Human
uaaucuagaacacaggcaaaau

SEQ ID NO: 1472569 - RNA, 15 nt, Human
uaaucugccucccuc

SEQ ID NO: 1472570 - RNA, 17 nt, Human
uaaugauaacuggaaac

SEQ ID NO: 1472571 - RNA, 22 nt, Human
uaaugauaacuggaaacuucag

SEQ ID NO: 1472572 - RNA, 23 nt, Human
uaaugauaacuggaaacuucagc

SEQ ID NO: 1472573 - RNA, 17 nt, Human
uaauggcaugagaaaua

SEQ ID NO: 1472574 - RNA, 21 nt, Human
uaauggcugauaauuuuaaau

SEQ ID NO: 1472575 - RNA, 15 nt, Human
uaauggcaugagaaa

SEQ ID NO: 1472576 - RNA, 22 nt, Human
uaauggcugauaauuuuaaauu

SEQ ID NO: 1472577 - RNA, 21 nt, Human
uaauguuggguagaaagagau

SEQ ID NO: 1472578 - RNA, 21 nt, Human
uaauguuguaugucuuguuua

SEQ ID NO: 1472579 - RNA, 20 nt, Human
uaauguuguaugucuuguuu

SEQ ID NO: 1472580 - RNA, 22 nt, Human
uaauguuucaaacauauauaac

SEQ ID NO: 1472581 - RNA, 13 nt, Human
uaaauucuuucau

SEQ ID NO: 1472582 - RNA, 15 nt, Human
uaaauuuauuuucuu

SEQ ID NO: 1472583 - RNA, 20 nt, Human
uaaauuucuauuuuuaucug

SEQ ID NO: 1472584 - RNA, 22 nt, Human
uaaauucucucucuugcaggaa

SEQ ID NO: 1472585 - RNA, 13 nt, Human
uaaauguauacua

SEQ ID NO: 1472586 - RNA, 12 nt, Human
uaaauguauacu

SEQ ID NO: 1472587 - RNA, 13 nt, Human
uaaauguaaagau

SEQ ID NO: 1472588 - RNA, 16 nt, Human
uaaauguaaagauauu

SEQ ID NO: 1472589 - RNA, 17 nt, Human
uaaauguaaagauauuu

SEQ ID NO: 1472590 - RNA, 20 nt, Human
uaaauguauacuauaguacc

SEQ ID NO: 1472591 - RNA, 17 nt, Human
uaaauguauacuauagu

SEQ ID NO: 1472592 - RNA, 15 nt, Human
uaaauguauacuaua

SEQ ID NO: 1472593 - RNA, 20 nt, Human
uaaauggcuuccuggcaaua

SEQ ID NO: 1472594 - RNA, 17 nt, Human
uaaauggggcucacaaa

SEQ ID NO: 1472595 - RNA, 17 nt, Human
uaaaguugguaaaccuu

SEQ ID NO: 1472596 - RNA, 16 nt, Human
uaaaguugauaaagau

SEQ ID NO: 1472597 - RNA, 20 nt, Human
uaaaguugauaaagauuuuu

SEQ ID NO: 1472598 - RNA, 16 nt, Human
uaaaguugguaaaccu

SEQ ID NO: 1472599 - RNA, 18 nt, Human
uaaaguuguuugugccuu

SEQ ID NO: 1472600 - RNA, 14 nt, Human
uaagagagaaugag

SEQ ID NO: 1472601 - RNA, 23 nt, Human
uaagagagaaugagagacacacu

SEQ ID NO: 1472602 - RNA, 13 nt, Human
uaagagagaauga

SEQ ID NO: 1472603 - RNA, 18 nt, Human
uaagaaccauugauuuaa

SEQ ID NO: 1472604 - RNA, 16 nt, Human
uaagaacaacuaccug

SEQ ID NO: 1472605 - RNA, 21 nt, Human
uaagaaaauaucacuugucaa

SEQ ID NO: 1472606 - RNA, 20 nt, Human
uaagaaacuuuuuuauuuaa

SEQ ID NO: 1472607 - RNA, 23 nt, Human
uaagaaaccuacugcccaggcac

SEQ ID NO: 1472608 - RNA, 19 nt, Human
uaagaaacuuuuuuauuua

SEQ ID NO: 1472609 - RNA, 21 nt, Human
uaagaaacuuuuuuauuuaaa

SEQ ID NO: 1472610 - RNA, 15 nt, Human
uaacuggaaacuuca

SEQ ID NO: 1472611 - RNA, 13 nt, Human
uaacuggaaagaa

SEQ ID NO: 1472612 - RNA, 15 nt, Human
uaacuggaaagaagu

SEQ ID NO: 1472613 - RNA, 14 nt, Human
uaacuggaaagaag

SEQ ID NO: 1472614 - RNA, 13 nt, Human
uaacuuuuguaag

SEQ ID NO: 1472615 - RNA, 18 nt, Human
uaacuuuuguaagacaaa

SEQ ID NO: 1472616 - RNA, 23 nt, Human
uaacuauugcauuuauauguacc

SEQ ID NO: 1472617 - RNA, 21 nt, Human
uaacuauugcauuuauaugua

SEQ ID NO: 1472618 - RNA, 16 nt, Human
uaacuauugcauuuau

SEQ ID NO: 1472619 - RNA, 15 nt, Human
uaacuauugcauuua

SEQ ID NO: 1472620 - RNA, 14 nt, Human
uaacugacuauucu

SEQ ID NO: 1472621 - RNA, 21 nt, Human
uaacugacuauucuugaugua

SEQ ID NO: 1472622 - RNA, 22 nt, Human
uaacugacuauucuugauguaa

SEQ ID NO: 1472623 - RNA, 14 nt, Human
uaacucucuuuaug

SEQ ID NO: 1472624 - RNA, 14 nt, Human
uaacugaaaaugug

SEQ ID NO: 1472625 - RNA, 20 nt, Human
uaacugaaaaugugcuauac

SEQ ID NO: 1472626 - RNA, 21 nt, Human
uaacugaaaaugugcuauacu

SEQ ID NO: 1472627 - RNA, 20 nt, Human
uaacugaaaauuauuuaaac

SEQ ID NO: 1472628 - RNA, 13 nt, Human
uaaccagaucauu

SEQ ID NO: 1472629 - RNA, 20 nt, Human
uaaccagacacauacucauu

SEQ ID NO: 1472630 - RNA, 22 nt, Human
uaaccagacacauacucauuuu

SEQ ID NO: 1472631 - RNA, 11 nt, Human
uaacauuccuc

SEQ ID NO: 1472632 - RNA, 20 nt, Human
uaacauuccucaugaaugua

SEQ ID NO: 1472633 - RNA, 21 nt, Human
uaacauuccucaugaauguaa

SEQ ID NO: 1472634 - RNA, 22 nt, Human
uaacauuccucaugaauguaaa

SEQ ID NO: 1472635 - RNA, 23 nt, Human
uaacauuccucaugaauguaaau

SEQ ID NO: 1472636 - RNA, 22 nt, Human
guuucauauuuuucauagcuaa

SEQ ID NO: 1472637 - RNA, 16 nt, Human
guuucauccuuuucau

SEQ ID NO: 1472638 - RNA, 18 nt, Human
guuuaugaaaaagaagaa

SEQ ID NO: 1472639 - RNA, 20 nt, Human
guuuagcuggaaaaguaugu

SEQ ID NO: 1472640 - RNA, 21 nt, Human
guuuagcuggaaaaguauguu

SEQ ID NO: 1472641 - RNA, 19 nt, Human
guuuaggaacuacugagga

SEQ ID NO: 1472642 - RNA, 20 nt, Human
guuuauauaagcuuguauuc

SEQ ID NO: 1472643 - RNA, 18 nt, Human
guuuaguggcucaacauu

SEQ ID NO: 1472644 - RNA, 16 nt, Human
guuuagaacacacaca

SEQ ID NO: 1472645 - RNA, 15 nt, Human
guuuaccagaaagca

SEQ ID NO: 1472646 - RNA, 19 nt, Human
guugucugcaacucugaag

SEQ ID NO: 1472647 - RNA, 13 nt, Human
guugugcuugagc

SEQ ID NO: 1472648 - RNA, 18 nt, Human
guuguggguaguggggaa

SEQ ID NO: 1472649 - RNA, 17 nt, Human
guuguccucagccccgc

SEQ ID NO: 1472650 - RNA, 23 nt, Human
guuguccucagccccgcguggaa

SEQ ID NO: 1472651 - RNA, 22 nt, Human
guuguccuccuuccggggaagg

SEQ ID NO: 1472652 - RNA, 20 nt, Human
guuguccuccuuccggggaa

SEQ ID NO: 1472653 - RNA, 17 nt, Human
guuuuaaaaugagaaau

SEQ ID NO: 1472654 - RNA, 20 nt, Human
guuuucaaaauuguuacaaa

SEQ ID NO: 1472655 - RNA, 16 nt, Human
guuuuaaaaugagaaa

SEQ ID NO: 1472656 - RNA, 15 nt, Human
guuuuaaaaugagaa

SEQ ID NO: 1472657 - RNA, 21 nt, Human
guuuuccuaugcuuugaaaca

SEQ ID NO: 1472658 - RNA, 17 nt, Human
guuuuccuaugcuuuga

SEQ ID NO: 1472659 - RNA, 17 nt, Human
guuuuggugguuuuagu

SEQ ID NO: 1472660 - RNA, 17 nt, Human
guuuccuccaagcuauu

SEQ ID NO: 1472661 - RNA, 18 nt, Human
guuucccuacugaagccc

SEQ ID NO: 1472662 - RNA, 22 nt, Human
guuucuuaaauaagaaacuuuu

SEQ ID NO: 1472663 - RNA, 21 nt, Human
guuucuuaaauaagaaacuuu

SEQ ID NO: 1472664 - RNA, 19 nt, Human
guuucuuuguaaugaaaac

SEQ ID NO: 1472665 - RNA, 13 nt, Human
guuuggugcuucu

SEQ ID NO: 1472666 - RNA, 15 nt, Human
uaaaauccauacauu

SEQ ID NO: 1472667 - RNA, 17 nt, Human
uaaaauccauacauuug

SEQ ID NO: 1472668 - RNA, 22 nt, Human
uaaaagguauuaaauugauguu

SEQ ID NO: 1472669 - RNA, 21 nt, Human
uaaaaggaaagaaaacaucuu

SEQ ID NO: 1472670 - RNA, 15 nt, Human
uaaaaggaaagaaaa

SEQ ID NO: 1472671 - RNA, 18 nt, Human
uaaaagcaaaaaagaaaa

SEQ ID NO: 1472672 - RNA, 19 nt, Human
uaaaagcaaaaaagaaaac

SEQ ID NO: 1472673 - RNA, 20 nt, Human
uaaaagcaaaaaagaaaacc

SEQ ID NO: 1472674 - RNA, 22 nt, Human
uaaaagcaaaaaagaaaaccuu

SEQ ID NO: 1472675 - RNA, 23 nt, Human
uaaaagcaaaaaagaaaaccuuu

SEQ ID NO: 1472676 - RNA, 12 nt, Human
uaaaagcaaaaa

SEQ ID NO: 1472677 - RNA, 16 nt, Human
uaaaagcaaaaaagaa

SEQ ID NO: 1472678 - RNA, 17 nt, Human
uaaaagcaaaaaagaaa

SEQ ID NO: 1472679 - RNA, 22 nt, Human
uaaaacagguagaauuaucuaa

SEQ ID NO: 1472680 - RNA, 17 nt, Human
uaaaacaucauuacuau

SEQ ID NO: 1472681 - RNA, 14 nt, Human
uaaaacauuuauuu

SEQ ID NO: 1472682 - RNA, 20 nt, Human
uaaaacauuuauuuugacau

SEQ ID NO: 1472683 - RNA, 21 nt, Human
uaaaaacaaagaaauuaugug

SEQ ID NO: 1472684 - RNA, 18 nt, Human
guuuuuaauguauaguaa

SEQ ID NO: 1472685 - RNA, 12 nt, Human
guuuuuaaugua

SEQ ID NO: 1472686 - RNA, 13 nt, Human
guuuuuaauguau

SEQ ID NO: 1472687 - RNA, 14 nt, Human
uaaaaagaucacuu

SEQ ID NO: 1472688 - RNA, 18 nt, Human
uaaaaagauugaaguauu

SEQ ID NO: 1472689 - RNA, 20 nt, Human
uaaaaagauugaaguauuuu

SEQ ID NO: 1472690 - RNA, 22 nt, Human
uaaaacaagcacuaaacaaaga

SEQ ID NO: 1472691 - RNA, 21 nt, Human
uaaaaauguucuauuuuaauu

SEQ ID NO: 1472692 - RNA, 11 nt, Human
uaaaacacuug

SEQ ID NO: 1472693 - RNA, 13 nt, Human
uaaaacagacacu

SEQ ID NO: 1472694 - RNA, 15 nt, Human
uaaaacagacacugg

SEQ ID NO: 1472695 - RNA, 17 nt, Human
uaaaacagacacuggca

SEQ ID NO: 1472696 - RNA, 18 nt, Human
uaaaacagacacuggcau

SEQ ID NO: 1472697 - RNA, 19 nt, Human
uaaaacagacacuggcaug

SEQ ID NO: 1472698 - RNA, 21 nt, Human
uaaaacagguagaauuaucua

SEQ ID NO: 1472699 - RNA, 14 nt, Human
uaaaggaauuuaaa

SEQ ID NO: 1472700 - RNA, 15 nt, Human
uaaagcugguuuaau

SEQ ID NO: 1472701 - RNA, 19 nt, Human
uaaagcugguuuaauguuu

SEQ ID NO: 1472702 - RNA, 11 nt, Human
uaaagcuuguc

SEQ ID NO: 1472703 - RNA, 14 nt, Human
uaaaguguuugaaa

SEQ ID NO: 1472704 - RNA, 15 nt, Human
uaaaguucaacaugu

SEQ ID NO: 1472705 - RNA, 18 nt, Human
uaaaguucaacauguuau

SEQ ID NO: 1472706 - RNA, 15 nt, Human
uaaagccaugcugga

SEQ ID NO: 1472707 - RNA, 18 nt, Human
uaaagcaggcagaacuca

SEQ ID NO: 1472708 - RNA, 18 nt, Human
uaaacacucuugaaaaau

SEQ ID NO: 1472709 - RNA, 15 nt, Human
uaaacaucauucauu

SEQ ID NO: 1472710 - RNA, 17 nt, Human
uaaacaucauucauuuu

SEQ ID NO: 1472711 - RNA, 17 nt, Human
uaaacacucuugaaaaa

SEQ ID NO: 1472712 - RNA, 15 nt, Human
uaaacacucuugaaa

SEQ ID NO: 1472713 - RNA, 15 nt, Human
uaaaaucuugucaug

SEQ ID NO: 1472714 - RNA, 16 nt, Human
uaaaaucuugucaugu

SEQ ID NO: 1472715 - RNA, 18 nt, Human
uaaaaucuugucaugugu

SEQ ID NO: 1472716 - RNA, 18 nt, Human
uaaaauccauacauuugu

SEQ ID NO: 1472717 - RNA, 11 nt, Human
uaaaaucuugu

SEQ ID NO: 1472718 - RNA, 12 nt, Human
uaaaaucuuguc

SEQ ID NO: 1472719 - RNA, 14 nt, Human
uaaaaucuugucau

SEQ ID NO: 1472720 - RNA, 14 nt, Human
uaaagaaaaacaaa

SEQ ID NO: 1472721 - RNA, 15 nt, Human
uaaagaaaaacaaac

SEQ ID NO: 1472722 - RNA, 15 nt, Human
uaaacuguguacaua

SEQ ID NO: 1472723 - RNA, 18 nt, Human
uaaacuguguacauaacu

SEQ ID NO: 1472724 - RNA, 17 nt, Human
uaaacuguguauuccaa

SEQ ID NO: 1472725 - RNA, 22 nt, Human
uaaacuguguauuccaagacau

SEQ ID NO: 1472726 - RNA, 18 nt, Human
guuccuuggccaugcaga

SEQ ID NO: 1472727 - RNA, 12 nt, Human
guucugaagaag

SEQ ID NO: 1472728 - RNA, 13 nt, Human
guucugaagaaga

SEQ ID NO: 1472729 - RNA, 14 nt, Human
guucugaagaagau

SEQ ID NO: 1472730 - RNA, 15 nt, Human
guucugaagaagaug

SEQ ID NO: 1472731 - RNA, 12 nt, Human
guucugccagga

SEQ ID NO: 1472732 - RNA, 13 nt, Human
guucugccaggag

SEQ ID NO: 1472733 - RNA, 14 nt, Human
guucugccaggaga

SEQ ID NO: 1472734 - RNA, 22 nt, Human
guugaaaauaaaguguauauuu

SEQ ID NO: 1472735 - RNA, 23 nt, Human
guugaagcaaaucgaaugaaauu

SEQ ID NO: 1472736 - RNA, 20 nt, Human
guugauggugguauguuuuc

SEQ ID NO: 1472737 - RNA, 21 nt, Human
guugauggugguauguuuuca

SEQ ID NO: 1472738 - RNA, 16 nt, Human
guugaaauaugauguu

SEQ ID NO: 1472739 - RNA, 18 nt, Human
guugaagagguuuuaaag

SEQ ID NO: 1472740 - RNA, 18 nt, Human
guugaagcaaaucgaaug

SEQ ID NO: 1472741 - RNA, 14 nt, Human
guugcaacuuugua

SEQ ID NO: 1472742 - RNA, 16 nt, Human
guugauuacagugcag

SEQ ID NO: 1472743 - RNA, 16 nt, Human
guugcaacuuuguaua

SEQ ID NO: 1472744 - RNA, 16 nt, Human
guugcacagcuaugaa

SEQ ID NO: 1472745 - RNA, 23 nt, Human
guugcagcccugcugcugccugc

SEQ ID NO: 1472746 - RNA, 16 nt, Human
guugcagacaggaauc

SEQ ID NO: 1472747 - RNA, 20 nt, Human
guugcagacaggaaucuuaa

SEQ ID NO: 1472748 - RNA, 20 nt, Human
guugcauuaaaaaugcauau

SEQ ID NO: 1472749 - RNA, 14 nt, Human
guugcagacaggaa

SEQ ID NO: 1472750 - RNA, 15 nt, Human
guugcagacaggaau

SEQ ID NO: 1472751 - RNA, 15 nt, Human
guuggagugcagugg

SEQ ID NO: 1472752 - RNA, 14 nt, Human
guuggagugcagug

SEQ ID NO: 1472753 - RNA, 16 nt, Human
guugccaguuguccuc

SEQ ID NO: 1472754 - RNA, 23 nt, Human
guuaccucugccucagaaaacaa

SEQ ID NO: 1472755 - RNA, 17 nt, Human
guuaccucuauauacca

SEQ ID NO: 1472756 - RNA, 21 nt, Human
guuaccucuauauaccaaagc

SEQ ID NO: 1472757 - RNA, 20 nt, Human
guuacccaguaacucaucug

SEQ ID NO: 1472758 - RNA, 13 nt, Human
guuaccuacuuug

SEQ ID NO: 1472759 - RNA, 16 nt, Human
guuaccuacuuugacu

SEQ ID NO: 1472760 - RNA, 16 nt, Human
guuacccaaauuaaga

SEQ ID NO: 1472761 - RNA, 14 nt, Human
guuacauguuugca

SEQ ID NO: 1472762 - RNA, 16 nt, Human
guuacauguuugcacc

SEQ ID NO: 1472763 - RNA, 15 nt, Human
guuacuacaugcacu

SEQ ID NO: 1472764 - RNA, 19 nt, Human
guuaucuaauagggcaauu

SEQ ID NO: 1472765 - RNA, 15 nt, Human
guuaucuaaguuaau

SEQ ID NO: 1472766 - RNA, 18 nt, Human
guuaucuaaguuaauuua

SEQ ID NO: 1472767 - RNA, 21 nt, Human
guuaucuaaguuaauuuaaag

SEQ ID NO: 1472768 - RNA, 20 nt, Human
guuauccaccugccuuggcu

SEQ ID NO: 1472769 - RNA, 15 nt, Human
guuaugacuauguaa

SEQ ID NO: 1472770 - RNA, 17 nt, Human
guuaugacuauguaaac

SEQ ID NO: 1472771 - RNA, 13 nt, Human
guuauauaaucau

SEQ ID NO: 1472772 - RNA, 17 nt, Human
guuauuauauuuacaaa

SEQ ID NO: 1472773 - RNA, 20 nt, Human
guuaugauuuuuuuuucaua

SEQ ID NO: 1472774 - RNA, 13 nt, Human
guuaugcugugac

SEQ ID NO: 1472775 - RNA, 21 nt, Human
guucaauauaagcuuuucuuu

SEQ ID NO: 1472776 - RNA, 12 nt, Human
guucacauuuuu

SEQ ID NO: 1472777 - RNA, 12 nt, Human
guucaugagaau

SEQ ID NO: 1472778 - RNA, 19 nt, Human
guucaugagaaucuauauu

SEQ ID NO: 1472779 - RNA, 14 nt, Human
guucaugagaaucu

SEQ ID NO: 1472780 - RNA, 12 nt, Human
guucaugaaaga

SEQ ID NO: 1472781 - RNA, 16 nt, Human
guucauccauucuauu

SEQ ID NO: 1472782 - RNA, 15 nt, Human
guucauuccuccagg

SEQ ID NO: 1472783 - RNA, 13 nt, Human
guucauuuccuca

SEQ ID NO: 1472784 - RNA, 14 nt, Human
guucauuccuccag

SEQ ID NO: 1472785 - RNA, 13 nt, Human
guucauuccucca

SEQ ID NO: 1472786 - RNA, 12 nt, Human
guuccugcaugc

SEQ ID NO: 1472787 - RNA, 12 nt, Human
guguguuuuaaa

SEQ ID NO: 1472788 - RNA, 18 nt, Human
guguggagagggaaugug

SEQ ID NO: 1472789 - RNA, 20 nt, Human
guguggagagggaaugugaa

SEQ ID NO: 1472790 - RNA, 19 nt, Human
guguggcuuucagagccuc

SEQ ID NO: 1472791 - RNA, 11 nt, Human
gugugggagac

SEQ ID NO: 1472792 - RNA, 21 nt, Human
guguggagagggaaugugaaa

SEQ ID NO: 1472793 - RNA, 17 nt, Human
gugugcucaggagcccu

SEQ ID NO: 1472794 - RNA, 16 nt, Human
gugugcucaggagccc

SEQ ID NO: 1472795 - RNA, 19 nt, Human
gugugcucaggagcccugg

SEQ ID NO: 1472796 - RNA, 18 nt, Human
gugugcucaggagcccug

SEQ ID NO: 1472797 - RNA, 21 nt, Human
guguccugcaccggggccugg

SEQ ID NO: 1472798 - RNA, 16 nt, Human
gugucugagagauuca

SEQ ID NO: 1472799 - RNA, 17 nt, Human
gugucuggcacagccug

SEQ ID NO: 1472800 - RNA, 15 nt, Human
gugucugcucaguaa

SEQ ID NO: 1472801 - RNA, 20 nt, Human
gugugcacaaauauuuauuu

SEQ ID NO: 1472802 - RNA, 17 nt, Human
guuaacuauugcauuua

SEQ ID NO: 1472803 - RNA, 18 nt, Human
guguuuuucauaaagcag

SEQ ID NO: 1472804 - RNA, 13 nt, Human
guguucugugaua

SEQ ID NO: 1472805 - RNA, 17 nt, Human
guguucccauuucagcu

SEQ ID NO: 1472806 - RNA, 17 nt, Human
guguuccccacuguauc

SEQ ID NO: 1472807 - RNA, 21 nt, Human
guguucccauuucagcugauc

SEQ ID NO: 1472808 - RNA, 14 nt, Human
guguguuuuucaua

SEQ ID NO: 1472809 - RNA, 19 nt, Human
guguguuuuaaaaugagaa

SEQ ID NO: 1472810 - RNA, 16 nt, Human
guguguuuuaaaauga

SEQ ID NO: 1472811 - RNA, 13 nt, Human
guguguuuuaaaa

SEQ ID NO: 1472812 - RNA, 12 nt, Human
guguuaauuuuu

SEQ ID NO: 1472813 - RNA, 15 nt, Human
guguuaauuuuugau

SEQ ID NO: 1472814 - RNA, 23 nt, Human
guguuacccaguaacucaucugu

SEQ ID NO: 1472815 - RNA, 14 nt, Human
guguaugcacagua

SEQ ID NO: 1472816 - RNA, 19 nt, Human
guguauggaaauaaaugua

SEQ ID NO: 1472817 - RNA, 21 nt, Human
gugucccauucccccagugcg

SEQ ID NO: 1472818 - RNA, 12 nt, Human
guguauauauau

SEQ ID NO: 1472819 - RNA, 14 nt, Human
guguaucucacacu

SEQ ID NO: 1472820 - RNA, 14 nt, Human
guguagcuuugcuc

SEQ ID NO: 1472821 - RNA, 12 nt, Human
guguauaaaaau

SEQ ID NO: 1472822 - RNA, 14 nt, Human
guguauaaaaauaa

SEQ ID NO: 1472823 - RNA, 18 nt, Human
guguauaaaaauaaaaaa

SEQ ID NO: 1472824 - RNA, 16 nt, Human
guguagcaacuacagu

SEQ ID NO: 1472825 - RNA, 17 nt, Human
guguagccacaccagga

SEQ ID NO: 1472826 - RNA, 16 nt, Human
guguacauaacugaaa

SEQ ID NO: 1472827 - RNA, 14 nt, Human
guguacauaacuga

SEQ ID NO: 1472828 - RNA, 18 nt, Human
guguaauugagaaggaaa

SEQ ID NO: 1472829 - RNA, 17 nt, Human
guguaagacaaaaagcu

SEQ ID NO: 1472830 - RNA, 17 nt, Human
guggugcgagugcguga

SEQ ID NO: 1472831 - RNA, 19 nt, Human
guguaagggccagaaauau

SEQ ID NO: 1472832 - RNA, 21 nt, Human
guguaaguagauaggccaugg

SEQ ID NO: 1472833 - RNA, 13 nt, Human
gugguagagaagc

SEQ ID NO: 1472834 - RNA, 15 nt, Human
gugggcauucaaaug

SEQ ID NO: 1472835 - RNA, 12 nt, Human
gugguaaaaagg

SEQ ID NO: 1472836 - RNA, 18 nt, Human
guggguuuuuuaguugaa

SEQ ID NO: 1472837 - RNA, 21 nt, Human
guggggagagacgggcccugg

SEQ ID NO: 1472838 - RNA, 12 nt, Human
guggggaguggg

SEQ ID NO: 1472839 - RNA, 15 nt, Human
gugcuaauuuugaaa

SEQ ID NO: 1472840 - RNA, 13 nt, Human
gugcuaauuuuga

SEQ ID NO: 1472841 - RNA, 13 nt, Human
guggcuggggcau

SEQ ID NO: 1472842 - RNA, 18 nt, Human
gugcacuggccccacccu

SEQ ID NO: 1472843 - RNA, 17 nt, Human
gugcacuggccccaccc

SEQ ID NO: 1472844 - RNA, 16 nt, Human
gugcacuggccccacc

SEQ ID NO: 1472845 - RNA, 13 nt, Human
gugcacuggcccc

SEQ ID NO: 1472846 - RNA, 21 nt, Human
gugauuuuuaugccaccugaa

SEQ ID NO: 1472847 - RNA, 24 nt, Human
gugauccacccgccucagccuccc

SEQ ID NO: 1472848 - RNA, 20 nt, Human
gugauccacccgccucagcc

SEQ ID NO: 1472849 - RNA, 18 nt, Human
gugauuuacgcucauugu

SEQ ID NO: 1472850 - RNA, 19 nt, Human
gugcagcccccacugccuu

SEQ ID NO: 1472851 - RNA, 24 nt, Human
gugcaguggcgugaucucagcuca

SEQ ID NO: 1472852 - RNA, 11 nt, Human
gugcaucaggc

SEQ ID NO: 1472853 - RNA, 20 nt, Human
gugcaucaggcuuucuuuuu

SEQ ID NO: 1472854 - RNA, 13 nt, Human
gugcguggugcga

SEQ ID NO: 1472855 - RNA, 15 nt, Human
gugcguggugguccc

SEQ ID NO: 1472856 - RNA, 19 nt, Human
gugcgugguggucccuggg

SEQ ID NO: 1472857 - RNA, 20 nt, Human
gugcgugguggucccugggu

SEQ ID NO: 1472858 - RNA, 13 nt, Human
gugcgugaauauu

SEQ ID NO: 1472859 - RNA, 23 nt, Human
gugccuuccuguuuuucacauuu

SEQ ID NO: 1472860 - RNA, 11 nt, Human
gugccuucauu

SEQ ID NO: 1472861 - RNA, 12 nt, Human
gugccuucauuu

SEQ ID NO: 1472862 - RNA, 14 nt, Human
gugccuucauuugg

SEQ ID NO: 1472863 - RNA, 19 nt, Human
gugccaugucaaacaaaua

SEQ ID NO: 1472864 - RNA, 18 nt, Human
gugaggagcuugaaaccc

SEQ ID NO: 1472865 - RNA, 14 nt, Human
gugagcuacaaaug

SEQ ID NO: 1472866 - RNA, 15 nt, Human
gugacgucugggugg

SEQ ID NO: 1472867 - RNA, 16 nt, Human
gugacgucuggguggc

SEQ ID NO: 1472868 - RNA, 19 nt, Human
gugacgucuggguggcccu

SEQ ID NO: 1472869 - RNA, 21 nt, Human
gugacgucuggguggcccuua

SEQ ID NO: 1472870 - RNA, 17 nt, Human
gugacuaauggcaugag

SEQ ID NO: 1472871 - RNA, 19 nt, Human
gugauauaaguguguguuu

SEQ ID NO: 1472872 - RNA, 18 nt, Human
gugaauuguuaguuucug

SEQ ID NO: 1472873 - RNA, 13 nt, Human
gugacacaaacac

SEQ ID NO: 1472874 - RNA, 14 nt, Human
gugacacaaacaca

SEQ ID NO: 1472875 - RNA, 18 nt, Human
gugacacaaacacacaca

SEQ ID NO: 1472876 - RNA, 21 nt, Human
gugacacaaacacacacaaaa

SEQ ID NO: 1472877 - RNA, 12 nt, Human
gucuucuuggcc

SEQ ID NO: 1472878 - RNA, 18 nt, Human
gucugugaagugagaccu

SEQ ID NO: 1472879 - RNA, 22 nt, Human
gucugugaagugagaccuuccu

SEQ ID NO: 1472880 - RNA, 13 nt, Human
gucugagagaggc

SEQ ID NO: 1472881 - RNA, 14 nt, Human
gucugagagaggcc

SEQ ID NO: 1472882 - RNA, 15 nt, Human
gucugagagaggcca

SEQ ID NO: 1472883 - RNA, 18 nt, Human
gucugagagaggccauuc

SEQ ID NO: 1472884 - RNA, 16 nt, Human
gucugcuaucauuauu

SEQ ID NO: 1472885 - RNA, 12 nt, Human
gucuguuuacug

SEQ ID NO: 1472886 - RNA, 13 nt, Human
gucuguuuacugc

SEQ ID NO: 1472887 - RNA, 17 nt, Human
gucuguuuauaaacauu

SEQ ID NO: 1472888 - RNA, 16 nt, Human
gucuguuaugcuguga

SEQ ID NO: 1472889 - RNA, 17 nt, Human
gucuguucacuuuuccu

SEQ ID NO: 1472890 - RNA, 16 nt, Human
gucuguggauuuuuuc

SEQ ID NO: 1472891 - RNA, 13 nt, Human
gucuguggauuuu

SEQ ID NO: 1472892 - RNA, 18 nt, Human
gucgucaaagcugaaaug

SEQ ID NO: 1472893 - RNA, 21 nt, Human
gucuaaagcugguuuaauguu

SEQ ID NO: 1472894 - RNA, 23 nt, Human
gucucacaugauuccagccauca

SEQ ID NO: 1472895 - RNA, 13 nt, Human
gucccugccugga

SEQ ID NO: 1472896 - RNA, 20 nt, Human
gucucuauaccaauaaagug

SEQ ID NO: 1472897 - RNA, 19 nt, Human
gucucuauaccaauaaagu

SEQ ID NO: 1472898 - RNA, 18 nt, Human
gucucuauaccaauaaag

SEQ ID NO: 1472899 - RNA, 17 nt, Human
gucucuauaccaauaaa

SEQ ID NO: 1472900 - RNA, 15 nt, Human
gucucucucucucua

SEQ ID NO: 1472901 - RNA, 15 nt, Human
gucucacugcuugaa

SEQ ID NO: 1472902 - RNA, 14 nt, Human
gucucacugcuuga

SEQ ID NO: 1472903 - RNA, 17 nt, Human
gucucuggaauuugaaa

SEQ ID NO: 1472904 - RNA, 17 nt, Human
gucucugcaaacugccu

SEQ ID NO: 1472905 - RNA, 19 nt, Human
gucucugaggggcuaccag

SEQ ID NO: 1472906 - RNA, 19 nt, Human
gucucucucucucuacaaa

SEQ ID NO: 1472907 - RNA, 21 nt, Human
gucucuggauuauauuaugaa

SEQ ID NO: 1472908 - RNA, 23 nt, Human
gucucuucugaauaaagcaauua

SEQ ID NO: 1472909 - RNA, 14 nt, Human
gucucuucugagcu

SEQ ID NO: 1472910 - RNA, 22 nt, Human
gucucuucugagcuauuucauc

SEQ ID NO: 1472911 - RNA, 22 nt, Human
gucucuucugaauaaagcaauu

SEQ ID NO: 1472912 - RNA, 21 nt, Human
gucucuucugaauaaagcaau

SEQ ID NO: 1472913 - RNA, 20 nt, Human
gucucuucugaauaaagcaa

SEQ ID NO: 1472914 - RNA, 19 nt, Human
gucucuucugaauaaagca

SEQ ID NO: 1472915 - RNA, 20 nt, Human
gucccuaauaaagcugugug

SEQ ID NO: 1472916 - RNA, 18 nt, Human
gucccuaauaaagcugug

SEQ ID NO: 1472917 - RNA, 17 nt, Human
gucccuaauaaagcugu

SEQ ID NO: 1472918 - RNA, 16 nt, Human
gucccuaauaaagcug

SEQ ID NO: 1472919 - RNA, 19 nt, Human
gucccauucccccagugcg

SEQ ID NO: 1472920 - RNA, 23 nt, Human
gucccauucccccagugcggcca

SEQ ID NO: 1472921 - RNA, 15 nt, Human
gucccaucccugcgu

SEQ ID NO: 1472922 - RNA, 21 nt, Human
gucauucagauaugauucaaa

SEQ ID NO: 1472923 - RNA, 21 nt, Human
gucauuguuauauaaucauua

SEQ ID NO: 1472924 - RNA, 13 nt, Human
gucaggaaagaga

SEQ ID NO: 1472925 - RNA, 22 nt, Human
gucagcugggacaccccgacuu

SEQ ID NO: 1472926 - RNA, 11 nt, Human
gucauuaaaug

SEQ ID NO: 1472927 - RNA, 20 nt, Human
guauuuuaaaagaaugauua

SEQ ID NO: 1472928 - RNA, 18 nt, Human
guauuacacucuguaauu

SEQ ID NO: 1472929 - RNA, 16 nt, Human
guauuacacucuguaa

SEQ ID NO: 1472930 - RNA, 21 nt, Human
guauuuuaguaagagauuccu

SEQ ID NO: 1472931 - RNA, 19 nt, Human
guauuuuagugaacuugaa

SEQ ID NO: 1472932 - RNA, 20 nt, Human
guauuuuagugaacuugaaa

SEQ ID NO: 1472933 - RNA, 16 nt, Human
gucaccagagacuuua

SEQ ID NO: 1472934 - RNA, 13 nt, Human
gucaccagagacu

SEQ ID NO: 1472935 - RNA, 18 nt, Human
gucaaucaagucuguuua

SEQ ID NO: 1472936 - RNA, 23 nt, Human
gucaauaaaauccauacauuugu

SEQ ID NO: 1472937 - RNA, 22 nt, Human
gucaauaaaauccauacauuug

SEQ ID NO: 1472938 - RNA, 16 nt, Human
gucacuacgccuggcu

SEQ ID NO: 1472939 - RNA, 13 nt, Human
gucacucaaggcg

SEQ ID NO: 1472940 - RNA, 15 nt, Human
guauacuauaguacc

SEQ ID NO: 1472941 - RNA, 15 nt, Human
guauaccugauuuuu

SEQ ID NO: 1472942 - RNA, 13 nt, Human
guauaccucacuu

SEQ ID NO: 1472943 - RNA, 17 nt, Human
guauaauucacauugua

SEQ ID NO: 1472944 - RNA, 14 nt, Human
guaguguuggagaa

SEQ ID NO: 1472945 - RNA, 15 nt, Human
guaguguuggagaag

SEQ ID NO: 1472946 - RNA, 17 nt, Human
guaguguuggagaagaa

SEQ ID NO: 1472947 - RNA, 18 nt, Human
guaguggggaagaggguu

SEQ ID NO: 1472948 - RNA, 19 nt, Human
guagugauuuuuaugccac

SEQ ID NO: 1472949 - RNA, 19 nt, Human
guagucucacugcuugaac

SEQ ID NO: 1472950 - RNA, 20 nt, Human
guagucucacugcuugaacu

SEQ ID NO: 1472951 - RNA, 22 nt, Human
guaguagcguuuuuuaaaugua

SEQ ID NO: 1472952 - RNA, 16 nt, Human
guaguaggcauuuuua

SEQ ID NO: 1472953 - RNA, 13 nt, Human
guaguaugauggg

SEQ ID NO: 1472954 - RNA, 22 nt, Human
guaggggcuuauaauaaaggac

SEQ ID NO: 1472955 - RNA, 19 nt, Human
guagaguugaucaaaauca

SEQ ID NO: 1472956 - RNA, 22 nt, Human
guagauauuggacaaagaaccu

SEQ ID NO: 1472957 - RNA, 15 nt, Human
guagaugcauuuggg

SEQ ID NO: 1472958 - RNA, 20 nt, Human
guagaugcauuuggguccag

SEQ ID NO: 1472959 - RNA, 22 nt, Human
guagaugcauuuggguccagga

SEQ ID NO: 1472960 - RNA, 16 nt, Human
guagcauccuggaaua

SEQ ID NO: 1472961 - RNA, 23 nt, Human
guagcacaaguuauuuaaaucug

SEQ ID NO: 1472962 - RNA, 21 nt, Human
guagcauuuguguugaagagg

SEQ ID NO: 1472963 - RNA, 13 nt, Human
guagccacaccag

SEQ ID NO: 1472964 - RNA, 16 nt, Human
guagccacaccaggau

SEQ ID NO: 1472965 - RNA, 15 nt, Human
guagccacaccagga

SEQ ID NO: 1472966 - RNA, 15 nt, Human
guagccccagugaca

SEQ ID NO: 1472967 - RNA, 19 nt, Human
guagccccagugacagcua

SEQ ID NO: 1472968 - RNA, 16 nt, Human
guagccccagugacag

SEQ ID NO: 1472969 - RNA, 15 nt, Human
guagggaguuguggg

SEQ ID NO: 1472970 - RNA, 17 nt, Human
guauguuagugcaaauu

SEQ ID NO: 1472971 - RNA, 13 nt, Human
guaugugugugug

SEQ ID NO: 1472972 - RNA, 12 nt, Human
guaugugugugu

SEQ ID NO: 1472973 - RNA, 18 nt, Human
guauuaagaaaaucuauu

SEQ ID NO: 1472974 - RNA, 16 nt, Human
guaugaacuugaggac

SEQ ID NO: 1472975 - RNA, 15 nt, Human
guaugaacuugagga

SEQ ID NO: 1472976 - RNA, 17 nt, Human
guaugaaccaccgcgcc

SEQ ID NO: 1472977 - RNA, 23 nt, Human
guaugaacuugaggacacauguc

SEQ ID NO: 1472978 - RNA, 22 nt, Human
guaugaacuugaggacacaugu

SEQ ID NO: 1472979 - RNA, 20 nt, Human
guaugaacuugaggacacau

SEQ ID NO: 1472980 - RNA, 19 nt, Human
guaugaacuugaggacaca

SEQ ID NO: 1472981 - RNA, 18 nt, Human
guauagcaugcaucuguu

SEQ ID NO: 1472982 - RNA, 20 nt, Human
guauagcaugcaucuguuua

SEQ ID NO: 1472983 - RNA, 16 nt, Human
guauagacuccugaaa

SEQ ID NO: 1472984 - RNA, 10 nt, Human
guauauauau

SEQ ID NO: 1472985 - RNA, 23 nt, Human
guauauauauauauauguacagu

SEQ ID NO: 1472986 - RNA, 18 nt, Human
guauauauauauauaugu

SEQ ID NO: 1472987 - RNA, 17 nt, Human
guaucucuucagucucu

SEQ ID NO: 1472988 - RNA, 13 nt, Human
guaucucuucagu

SEQ ID NO: 1472989 - RNA, 12 nt, Human
guaucucuucag

SEQ ID NO: 1472990 - RNA, 17 nt, Human
guaucuaugcauuuucu

SEQ ID NO: 1472991 - RNA, 13 nt, Human
guaucucacacuc

SEQ ID NO: 1472992 - RNA, 18 nt, Human
guaucuaggcaacauagu

SEQ ID NO: 1472993 - RNA, 14 nt, Human
guauauuacaauga

SEQ ID NO: 1472994 - RNA, 13 nt, Human
guauauuacaaug

SEQ ID NO: 1472995 - RNA, 15 nt, Human
uuucucugauacaga

SEQ ID NO: 1472996 - RNA, 16 nt, Human
uuucucugauacagaa

SEQ ID NO: 1472997 - RNA, 17 nt, Human
uuucucugauacagaaa

SEQ ID NO: 1472998 - RNA, 18 nt, Human
uuucucugauacagaaaa

SEQ ID NO: 1472999 - RNA, 21 nt, Human
uuucugaaauuuccugggagc

SEQ ID NO: 1473000 - RNA, 15 nt, Human
uuucucugaacacau

SEQ ID NO: 1473001 - RNA, 14 nt, Human
uuucuaaaguaaaa

SEQ ID NO: 1473002 - RNA, 12 nt, Human
uuucuaaaguaa

SEQ ID NO: 1473003 - RNA, 16 nt, Human
uuucuagagcacugcc

SEQ ID NO: 1473004 - RNA, 21 nt, Human
uuacauuuuuugggcagcaau

SEQ ID NO: 1473005 - RNA, 12 nt, Human
uuaccaaccugu

SEQ ID NO: 1473006 - RNA, 13 nt, Human
uuaccaaccuguu

SEQ ID NO: 1473007 - RNA, 18 nt, Human
uuacauuuuaaacacauu

SEQ ID NO: 1473008 - RNA, 20 nt, Human
uuaccaaccuguuaccuacu

SEQ ID NO: 1473009 - RNA, 15 nt, Human
uuaccaaauaaagua

SEQ ID NO: 1473010 - RNA, 19 nt, Human
uuuccucagacucuaagaa

SEQ ID NO: 1473011 - RNA, 13 nt, Human
uuuccucccucag

SEQ ID NO: 1473012 - RNA, 18 nt, Human
uuugaaucaucaagucuu

SEQ ID NO: 1473013 - RNA, 18 nt, Human
uuugaagcacagugauca

SEQ ID NO: 1473014 - RNA, 19 nt, Human
uuugaauccucucucugug

SEQ ID NO: 1473015 - RNA, 14 nt, Human
uuugaacuuuuuau

SEQ ID NO: 1473016 - RNA, 18 nt, Human
uuucuucaccaaaucuug

SEQ ID NO: 1473017 - RNA, 17 nt, Human
uuucuucuauugccucu

SEQ ID NO: 1473018 - RNA, 19 nt, Human
uuucuucuauugccucuga

SEQ ID NO: 1473019 - RNA, 16 nt, Human
uuucuuaaaccuucag

SEQ ID NO: 1473020 - RNA, 18 nt, Human
uuucuuaaaccuucaguu

SEQ ID NO: 1473021 - RNA, 19 nt, Human
uuuggacaaaauggaauac

SEQ ID NO: 1473022 - RNA, 11 nt, Human
uuuggaaugug

SEQ ID NO: 1473023 - RNA, 15 nt, Human
uuuggauauguaaaa

SEQ ID NO: 1473024 - RNA, 21 nt, Human
uuuggauauguaaaacauuua

SEQ ID NO: 1473025 - RNA, 10 nt, Human
uuuggaugcc

SEQ ID NO: 1473026 - RNA, 19 nt, Human
uuuggauauguaaaacauu

SEQ ID NO: 1473027 - RNA, 18 nt, Human
uuuggugauuacauuuua

SEQ ID NO: 1473028 - RNA, 13 nt, Human
uuuguauaaaaua

SEQ ID NO: 1473029 - RNA, 14 nt, Human
uuuguauaaaauaa

SEQ ID NO: 1473030 - RNA, 16 nt, Human
uuuguauaaaauaauu

SEQ ID NO: 1473031 - RNA, 21 nt, Human
uuuggugcuucucagauuucu

SEQ ID NO: 1473032 - RNA, 14 nt, Human
uuuggugagaaccu

SEQ ID NO: 1473033 - RNA, 19 nt, Human
uuugguuuucacauuggaa

SEQ ID NO: 1473034 - RNA, 21 nt, Human
uuugguuucccaagagcuacg

SEQ ID NO: 1473035 - RNA, 15 nt, Human
uuugcaucugaaaau

SEQ ID NO: 1473036 - RNA, 21 nt, Human
uuuuaaaagaaugauuaugaa

SEQ ID NO: 1473037 - RNA, 18 nt, Human
uuuuaaagacuuuuauga

SEQ ID NO: 1473038 - RNA, 12 nt, Human
uuuuaaagaauu

SEQ ID NO: 1473039 - RNA, 15 nt, Human
uuuguucuucuuaaa

SEQ ID NO: 1473040 - RNA, 16 nt, Human
uuuuaaauguauacua

SEQ ID NO: 1473041 - RNA, 12 nt, Human
uuuuaaauguau

SEQ ID NO: 1473042 - RNA, 19 nt, Human
uuuuaaaugcauaaaugca

SEQ ID NO: 1473043 - RNA, 13 nt, Human
uuuuaaagaauug

SEQ ID NO: 1473044 - RNA, 18 nt, Human
uuuuaaauauuuuuucuu

SEQ ID NO: 1473045 - RNA, 16 nt, Human
uuuuaaugaacaaaug

SEQ ID NO: 1473046 - RNA, 20 nt, Human
uuuuugaaaagcagacauuu

SEQ ID NO: 1473047 - RNA, 23 nt, Human
uuuuugaaaaagcgaaaaaauca

SEQ ID NO: 1473048 - RNA, 17 nt, Human
uuuuugaaaaagcgaaa

SEQ ID NO: 1473049 - RNA, 16 nt, Human
uuuuuugggcagcaau

SEQ ID NO: 1473050 - RNA, 13 nt, Human
uuuuuuguaccaa

SEQ ID NO: 1473051 - RNA, 10 nt, Human
uuuuuugaga

SEQ ID NO: 1473052 - RNA, 15 nt, Human
uuuuugaagcuguau

SEQ ID NO: 1473053 - RNA, 19 nt, Human
uuuuucucuaggaaauauu

SEQ ID NO: 1473054 - RNA, 23 nt, Human
uuuuucucugauacagaaaaguu

SEQ ID NO: 1473055 - RNA, 21 nt, Human
uuuuucucgcuguccuuucua

SEQ ID NO: 1473056 - RNA, 22 nt, Human
uuuuuccuucaaaguuuaauaa

SEQ ID NO: 1473057 - RNA, 18 nt, Human
uuuuuccuucaaaguuua

SEQ ID NO: 1473058 - RNA, 19 nt, Human
uuuuuccuucaaaguuuaa

SEQ ID NO: 1473059 - RNA, 18 nt, Human
uuuuuccuagcccucuca

SEQ ID NO: 1473060 - RNA, 16 nt, Human
uuuuuccguaaaaaug

SEQ ID NO: 1473061 - RNA, 18 nt, Human
uuuuuaaagacuuuuaug

SEQ ID NO: 1473062 - RNA, 13 nt, Human
uuuuuaaagacuu

SEQ ID NO: 1473063 - RNA, 12 nt, Human
uuuuuaaagacu

SEQ ID NO: 1473064 - RNA, 16 nt, Human
uuuuuaaacaaguauu

SEQ ID NO: 1473065 - RNA, 18 nt, Human
uuuuuaaaaaagaaacau

SEQ ID NO: 1473066 - RNA, 15 nt, Human
uuuuuaaaaaagcuu

SEQ ID NO: 1473067 - RNA, 11 nt, Human
uuuugucucug

SEQ ID NO: 1473068 - RNA, 17 nt, Human
uuuuuaaaaaagcuuaa

SEQ ID NO: 1473069 - RNA, 22 nt, Human
uuuuuaaaaaagcuuaaaacuu

SEQ ID NO: 1473070 - RNA, 23 nt, Human
uuuuuaaaaaagcuuaaaacuuu

SEQ ID NO: 1473071 - RNA, 10 nt, Human
uuuugucucu

SEQ ID NO: 1473072 - RNA, 12 nt, Human
uuuugucucugc

SEQ ID NO: 1473073 - RNA, 11 nt, Human
uuuuguaccaa

SEQ ID NO: 1473074 - RNA, 18 nt, Human
uuuuguaaacucaaaaua

SEQ ID NO: 1473075 - RNA, 14 nt, Human
uuuuguaagacaaa

SEQ ID NO: 1473076 - RNA, 19 nt, Human
uuuuguaaguugaagcaaa

SEQ ID NO: 1473077 - RNA, 20 nt, Human
uuuuggugguuuuagugauu

SEQ ID NO: 1473078 - RNA, 18 nt, Human
uuuucuaaaguaaaaaca

SEQ ID NO: 1473079 - RNA, 12 nt, Human
uuuucuaacugg

SEQ ID NO: 1473080 - RNA, 16 nt, Human
uuuucuaagaaacauu

SEQ ID NO: 1473081 - RNA, 18 nt, Human
uuuucuaagaaacauuua

SEQ ID NO: 1473082 - RNA, 12 nt, Human
uuuucuuugugu

SEQ ID NO: 1473083 - RNA, 19 nt, Human
uuuucuuuguguagcuuug

SEQ ID NO: 1473084 - RNA, 16 nt, Human
uuuucuuuguguagcu

SEQ ID NO: 1473085 - RNA, 14 nt, Human
uuuuccugaaaacc

SEQ ID NO: 1473086 - RNA, 16 nt, Human
uuuuccuucaaaguuu

SEQ ID NO: 1473087 - RNA, 18 nt, Human
uuuuggucuggagggaag

SEQ ID NO: 1473088 - RNA, 11 nt, Human
uuuuggaugcc

SEQ ID NO: 1473089 - RNA, 13 nt, Human
uuuugaaaaacug

SEQ ID NO: 1473090 - RNA, 13 nt, Human
uuuucuuuucuau

SEQ ID NO: 1473091 - RNA, 16 nt, Human
gcgcgaucucagcuca

SEQ ID NO: 1473092 - RNA, 15 nt, Human
gcgcgaucucagcuc

SEQ ID NO: 1473093 - RNA, 15 nt, Human
gcgcuaucucccugc

SEQ ID NO: 1473094 - RNA, 20 nt, Human
gcgcuaucucccugccuccu

SEQ ID NO: 1473095 - RNA, 12 nt, Human
gcgcggcuggga

SEQ ID NO: 1473096 - RNA, 18 nt, Human
gcgcggcugggaggaggg

SEQ ID NO: 1473097 - RNA, 17 nt, Human
gcggugcuugauagaaa

SEQ ID NO: 1473098 - RNA, 12 nt, Human
gcgguucaggaa

SEQ ID NO: 1473099 - RNA, 13 nt, Human
gcuaagagaagua

SEQ ID NO: 1473100 - RNA, 14 nt, Human
gcuaagagaaguag

SEQ ID NO: 1473101 - RNA, 21 nt, Human
gcuagaauugaguguuuaaag

SEQ ID NO: 1473102 - RNA, 19 nt, Human
gcuaccugcucagcccugc

SEQ ID NO: 1473103 - RNA, 20 nt, Human
gcuaccugcucagcccugca

SEQ ID NO: 1473104 - RNA, 16 nt, Human
gccuuugaccugccuc

SEQ ID NO: 1473105 - RNA, 18 nt, Human
gccuuuggacuugucccg

SEQ ID NO: 1473106 - RNA, 14 nt, Human
gccuuugagcucag

SEQ ID NO: 1473107 - RNA, 15 nt, Human
gccuuuggcaggugc

SEQ ID NO: 1473108 - RNA, 13 nt, Human
gccuuuggcaggu

SEQ ID NO: 1473109 - RNA, 22 nt, Human
gcgaaaaaaucagguggcuuuu

SEQ ID NO: 1473110 - RNA, 19 nt, Human
gccuuccuguuuuucacau

SEQ ID NO: 1473111 - RNA, 13 nt, Human
gccuguuuaagag

SEQ ID NO: 1473112 - RNA, 12 nt, Human
gccuguuuaaga

SEQ ID NO: 1473113 - RNA, 11 nt, Human
gccugccagga

SEQ ID NO: 1473114 - RNA, 12 nt, Human
gccugccaggag

SEQ ID NO: 1473115 - RNA, 13 nt, Human
gccugccaggagg

SEQ ID NO: 1473116 - RNA, 14 nt, Human
gccugccaggagga

SEQ ID NO: 1473117 - RNA, 18 nt, Human
gccugccaggaggaccca

SEQ ID NO: 1473118 - RNA, 20 nt, Human
gccugccaggaggacccagg

SEQ ID NO: 1473119 - RNA, 21 nt, Human
gccugccaggaggacccaggg

SEQ ID NO: 1473120 - RNA, 23 nt, Human
gccugccaggaggacccagggcu

SEQ ID NO: 1473121 - RNA, 23 nt, Human
gccucccuucaugcauggaaauu

SEQ ID NO: 1473122 - RNA, 22 nt, Human
gccucccuucaugcauggaaau

SEQ ID NO: 1473123 - RNA, 20 nt, Human
gccucccuucaugcauggaa

SEQ ID NO: 1473124 - RNA, 18 nt, Human
gccucccuucaugcaugg

SEQ ID NO: 1473125 - RNA, 15 nt, Human
gccucccuucaugca

SEQ ID NO: 1473126 - RNA, 18 nt, Human
gccucucaucaacugaau

SEQ ID NO: 1473127 - RNA, 19 nt, Human
gccucucaucaacugaaug

SEQ ID NO: 1473128 - RNA, 21 nt, Human
gccuccucacccccagcuuug

SEQ ID NO: 1473129 - RNA, 16 nt, Human
gccucucaucaacuga

SEQ ID NO: 1473130 - RNA, 14 nt, Human
gccuccucaccccc

SEQ ID NO: 1473131 - RNA, 16 nt, Human
gccuccucacccccag

SEQ ID NO: 1473132 - RNA, 17 nt, Human
gccuccucacccccagc

SEQ ID NO: 1473133 - RNA, 18 nt, Human
gccuccucacccccagcu

SEQ ID NO: 1473134 - RNA, 19 nt, Human
gccuccucacccccagcuu

SEQ ID NO: 1473135 - RNA, 14 nt, Human
gccucccagguuca

SEQ ID NO: 1473136 - RNA, 21 nt, Human
gccucugcacacccuccagag

SEQ ID NO: 1473137 - RNA, 20 nt, Human
gccugacuagggagccaugu

SEQ ID NO: 1473138 - RNA, 19 nt, Human
gccugacuagggagccaug

SEQ ID NO: 1473139 - RNA, 20 nt, Human
gccugacugccaagccaugg

SEQ ID NO: 1473140 - RNA, 17 nt, Human
gccugacugccaagcca

SEQ ID NO: 1473141 - RNA, 16 nt, Human
gccugacugccaagcc

SEQ ID NO: 1473142 - RNA, 15 nt, Human
gccugacugccaagc

SEQ ID NO: 1473143 - RNA, 14 nt, Human
gccugacugccaag

SEQ ID NO: 1473144 - RNA, 16 nt, Human
gccucugagagcauca

SEQ ID NO: 1473145 - RNA, 14 nt, Human
gccucugagagcau

SEQ ID NO: 1473146 - RNA, 13 nt, Human
gccucugagagca

SEQ ID NO: 1473147 - RNA, 19 nt, Human
gccucugagaagcucugaa

SEQ ID NO: 1473148 - RNA, 21 nt, Human
gccucuccacucaugugacuc

SEQ ID NO: 1473149 - RNA, 24 nt, Human
gccucuccacucaugugacucuuu

SEQ ID NO: 1473150 - RNA, 17 nt, Human
gccuaaccugccgagag

SEQ ID NO: 1473151 - RNA, 18 nt, Human
gccuauguggucuaaggu

SEQ ID NO: 1473152 - RNA, 17 nt, Human
gccgucagugcugugcu

SEQ ID NO: 1473153 - RNA, 18 nt, Human
gcccugcugcugccugcc

SEQ ID NO: 1473154 - RNA, 23 nt, Human
gcccuugugaaucaagggucagg

SEQ ID NO: 1473155 - RNA, 13 nt, Human
gccggcuccuugg

SEQ ID NO: 1473156 - RNA, 18 nt, Human
gccaugaugccucugucu

SEQ ID NO: 1473157 - RNA, 13 nt, Human
gccaugaugccuc

SEQ ID NO: 1473158 - RNA, 15 nt, Human
gccaugaugccucug

SEQ ID NO: 1473159 - RNA, 19 nt, Human
gccaugaugccucugucuu

SEQ ID NO: 1473160 - RNA, 17 nt, Human
gccaggcugggucgccc

SEQ ID NO: 1473161 - RNA, 23 nt, Human
gccaggcugggucgcccuggacu

SEQ ID NO: 1473162 - RNA, 20 nt, Human
gccaucaccuuagaccacca

SEQ ID NO: 1473163 - RNA, 14 nt, Human
gccaucaccuuaga

SEQ ID NO: 1473164 - RNA, 22 nt, Human
gccaucaccuuagaccaccaag

SEQ ID NO: 1473165 - RNA, 20 nt, Human
gccauggguagccugggugu

SEQ ID NO: 1473166 - RNA, 19 nt, Human
gccauggguagccugggug

SEQ ID NO: 1473167 - RNA, 17 nt, Human
gccauggguagccuggg

SEQ ID NO: 1473168 - RNA, 21 nt, Human
gcccaccauuuggcaucccug

SEQ ID NO: 1473169 - RNA, 21 nt, Human
gccagaugcacaucccuggaa

SEQ ID NO: 1473170 - RNA, 22 nt, Human
gccagaugcacaucccuggaag

SEQ ID NO: 1473171 - RNA, 19 nt, Human
gccagcugcccccagagcc

SEQ ID NO: 1473172 - RNA, 12 nt, Human
gccagcugcccc

SEQ ID NO: 1473173 - RNA, 22 nt, Human
gccaggaagcuuuggugagaac

SEQ ID NO: 1473174 - RNA, 15 nt, Human
gccaggcuaauuuuu

SEQ ID NO: 1473175 - RNA, 20 nt, Human
gccccuggucccucugcagu

SEQ ID NO: 1473176 - RNA, 16 nt, Human
gccccugaacaagaau

SEQ ID NO: 1473177 - RNA, 19 nt, Human
gccccuugacaacuggcag

SEQ ID NO: 1473178 - RNA, 17 nt, Human
gccccuuugcugacccu

SEQ ID NO: 1473179 - RNA, 16 nt, Human
gccccuuugcugaccc

SEQ ID NO: 1473180 - RNA, 20 nt, Human
gccccuuugcugacccuccc

SEQ ID NO: 1473181 - RNA, 18 nt, Human
gccccuuugcugacccuc

SEQ ID NO: 1473182 - RNA, 16 nt, Human
gccccucccccugcca

SEQ ID NO: 1473183 - RNA, 15 nt, Human
gcccgggagcucagg

SEQ ID NO: 1473184 - RNA, 17 nt, Human
gcccgggagcucaggaa

SEQ ID NO: 1473185 - RNA, 19 nt, Human
gcccgggagcucaggaacc

SEQ ID NO: 1473186 - RNA, 14 nt, Human
gccccagugacagc

SEQ ID NO: 1473187 - RNA, 21 nt, Human
gcccccaaccauuuccucaga

SEQ ID NO: 1473188 - RNA, 22 nt, Human
gcccccaaccauuuccucagac

SEQ ID NO: 1473189 - RNA, 19 nt, Human
gcauucaaauguauuacag

SEQ ID NO: 1473190 - RNA, 18 nt, Human
gcauucagaagaaaaaga

SEQ ID NO: 1473191 - RNA, 16 nt, Human
gcauucagaagaaaaa

SEQ ID NO: 1473192 - RNA, 23 nt, Human
gcauuauuggaauauaauuguuu

SEQ ID NO: 1473193 - RNA, 22 nt, Human
gcauuauuggaauauaauuguu

SEQ ID NO: 1473194 - RNA, 16 nt, Human
gcauuuguguugaaga

SEQ ID NO: 1473195 - RNA, 16 nt, Human
gccaaaaaaaaauaca

SEQ ID NO: 1473196 - RNA, 16 nt, Human
gcaucugaaaauugau

SEQ ID NO: 1473197 - RNA, 13 nt, Human
gcaucuguuuauu

SEQ ID NO: 1473198 - RNA, 13 nt, Human
gcauuauauuuau

SEQ ID NO: 1473199 - RNA, 20 nt, Human
gcauggauauaguuuuacuu

SEQ ID NO: 1473200 - RNA, 17 nt, Human
gcaugagaaauacaaaa

SEQ ID NO: 1473201 - RNA, 14 nt, Human
gcaugagaaauaca

SEQ ID NO: 1473202 - RNA, 22 nt, Human
gcaguggcaucaucucagcuca

SEQ ID NO: 1473203 - RNA, 19 nt, Human
gcaggggccgggggcaguc

SEQ ID NO: 1473204 - RNA, 20 nt, Human
gcaggggccgggggcagucu

SEQ ID NO: 1473205 - RNA, 17 nt, Human
gcauagguuuaauaauu

SEQ ID NO: 1473206 - RNA, 13 nt, Human
gcauacuuuuuaa

SEQ ID NO: 1473207 - RNA, 22 nt, Human
gcaguggcgcgaucucagcuca

SEQ ID NO: 1473208 - RNA, 18 nt, Human
gcaguggcgcgaucucag

SEQ ID NO: 1473209 - RNA, 20 nt, Human
gcaguguagggaguuguggg

SEQ ID NO: 1473210 - RNA, 13 nt, Human
gcauagaaguaaa

SEQ ID NO: 1473211 - RNA, 17 nt, Human
gcaguucugaagaagau

SEQ ID NO: 1473212 - RNA, 15 nt, Human
gcaguucugaagaag

SEQ ID NO: 1473213 - RNA, 21 nt, Human
gcagauucucccuugcucugc

SEQ ID NO: 1473214 - RNA, 19 nt, Human
gcagauucucccuugcucu

SEQ ID NO: 1473215 - RNA, 21 nt, Human
gcagauuuucagcaaacucuu

SEQ ID NO: 1473216 - RNA, 17 nt, Human
gcagacauuuuaaaaaa

SEQ ID NO: 1473217 - RNA, 19 nt, Human
gcagacaugugcacuugaa

SEQ ID NO: 1473218 - RNA, 16 nt, Human
gcagcaauuuaaaugu

SEQ ID NO: 1473219 - RNA, 15 nt, Human
gcagcaauuuaaaug

SEQ ID NO: 1473220 - RNA, 12 nt, Human
gcagcaauuuaa

SEQ ID NO: 1473221 - RNA, 17 nt, Human
gcagcaauuuaaauguu

SEQ ID NO: 1473222 - RNA, 21 nt, Human
gcagcccugcugcugccugcc

SEQ ID NO: 1473223 - RNA, 20 nt, Human
gcagcccugcugcugccugc

SEQ ID NO: 1473224 - RNA, 16 nt, Human
gcagcucaagagaucc

SEQ ID NO: 1473225 - RNA, 18 nt, Human
gcagcucaagagauccca

SEQ ID NO: 1473226 - RNA, 11 nt, Human
gcaggaaggcu

SEQ ID NO: 1473227 - RNA, 16 nt, Human
gcacggcagccacagc

SEQ ID NO: 1473228 - RNA, 14 nt, Human
gcacggcagccaca

SEQ ID NO: 1473229 - RNA, 13 nt, Human
gcaccuuucuagu

SEQ ID NO: 1473230 - RNA, 17 nt, Human
gcaccuuucuaguugaa

SEQ ID NO: 1473231 - RNA, 18 nt, Human
gcaccuuucuaguugaaa

SEQ ID NO: 1473232 - RNA, 16 nt, Human
gcaccagaauguauau

SEQ ID NO: 1473233 - RNA, 16 nt, Human
gcaccaugcugcuggg

SEQ ID NO: 1473234 - RNA, 18 nt, Human
gcaccaugcugcugggga

SEQ ID NO: 1473235 - RNA, 20 nt, Human
gcaccaugcugcuggggaag

SEQ ID NO: 1473236 - RNA, 23 nt, Human
gcaccaugcugcuggggaagaca

SEQ ID NO: 1473237 - RNA, 9 nt, Human
gcacuguaa

SEQ ID NO: 1473238 - RNA, 12 nt, Human
gcacuguaaaau

SEQ ID NO: 1473239 - RNA, 13 nt, Human
gcacuguaaaaug

SEQ ID NO: 1473240 - RNA, 14 nt, Human
gcacuguaaaaugu

SEQ ID NO: 1473241 - RNA, 16 nt, Human
gcacuguaaaaugugg

SEQ ID NO: 1473242 - RNA, 23 nt, Human
gcacuguaaaaugugggauuaug

SEQ ID NO: 1473243 - RNA, 23 nt, Human
gcagaauccuaggcuccacccca

SEQ ID NO: 1473244 - RNA, 15 nt, Human
gauuuccagccuucu

SEQ ID NO: 1473245 - RNA, 14 nt, Human
gauuucugaggaaa

SEQ ID NO: 1473246 - RNA, 22 nt, Human
gauuuggucaacacuaacauga

SEQ ID NO: 1473247 - RNA, 15 nt, Human
gauuuuccugaaaac

SEQ ID NO: 1473248 - RNA, 20 nt, Human
gauuuucugcuacuuugcug

SEQ ID NO: 1473249 - RNA, 12 nt, Human
gauuuuuaccag

SEQ ID NO: 1473250 - RNA, 18 nt, Human
gauuuucaaagcuuuuuc

SEQ ID NO: 1473251 - RNA, 19 nt, Human
gauuuucaaagcuuuuucc

SEQ ID NO: 1473252 - RNA, 14 nt, Human
gauuuguacugaaa

SEQ ID NO: 1473253 - RNA, 14 nt, Human
gauuugucccaggu

SEQ ID NO: 1473254 - RNA, 19 nt, Human
gauuccagagcacugcucc

SEQ ID NO: 1473255 - RNA, 14 nt, Human
gauuccagccauca

SEQ ID NO: 1473256 - RNA, 18 nt, Human
gauuccagccaucaccuu

SEQ ID NO: 1473257 - RNA, 18 nt, Human
gauggggguuucaccaua

SEQ ID NO: 1473258 - RNA, 17 nt, Human
gauucgaaugacacugu

SEQ ID NO: 1473259 - RNA, 16 nt, Human
gauucgaaugacacug

SEQ ID NO: 1473260 - RNA, 21 nt, Human
gcaaacaggaucaguuaacua

SEQ ID NO: 1473261 - RNA, 13 nt, Human
gauuuuugccucu

SEQ ID NO: 1473262 - RNA, 16 nt, Human
gauuuuuuaauaauuu

SEQ ID NO: 1473263 - RNA, 17 nt, Human
gauuuuuuaauaauuua

SEQ ID NO: 1473264 - RNA, 21 nt, Human
gcaaaucaccacaaacuguaa

SEQ ID NO: 1473265 - RNA, 21 nt, Human
gcaagaaggcaaaaauaguuu

SEQ ID NO: 1473266 - RNA, 16 nt, Human
gcaagaaggcaaaaau

SEQ ID NO: 1473267 - RNA, 20 nt, Human
gcaagaaggcaaaaauaguu

SEQ ID NO: 1473268 - RNA, 23 nt, Human
gcaagaaggcaaaaauaguuugg

SEQ ID NO: 1473269 - RNA, 22 nt, Human
gcaaaucgaaugaaauuaacug

SEQ ID NO: 1473270 - RNA, 20 nt, Human
gcaaggccugguguuucuug

SEQ ID NO: 1473271 - RNA, 10 nt, Human
gcaagccaga

SEQ ID NO: 1473272 - RNA, 18 nt, Human
gcaagcauucagaagaaa

SEQ ID NO: 1473273 - RNA, 19 nt, Human
gcaagccuaagggauccug

SEQ ID NO: 1473274 - RNA, 17 nt, Human
gcaaggaccuaaaacau

SEQ ID NO: 1473275 - RNA, 19 nt, Human
gaucucagcucacugcaac

SEQ ID NO: 1473276 - RNA, 17 nt, Human
gaucucagcucacugca

SEQ ID NO: 1473277 - RNA, 17 nt, Human
gaucucagcucacuaca

SEQ ID NO: 1473278 - RNA, 12 nt, Human
gaucucagcuca

SEQ ID NO: 1473279 - RNA, 23 nt, Human
gaucucaccaggcagccucuggg

SEQ ID NO: 1473280 - RNA, 20 nt, Human
gaucucaccaggcagccucu

SEQ ID NO: 1473281 - RNA, 14 nt, Human
gaucucaccaggca

SEQ ID NO: 1473282 - RNA, 15 nt, Human
gaucucaccaggcag

SEQ ID NO: 1473283 - RNA, 16 nt, Human
gaucucaccaggcagc

SEQ ID NO: 1473284 - RNA, 19 nt, Human
gaucucaccaggcagccuc

SEQ ID NO: 1473285 - RNA, 16 nt, Human
gaucguucaaagcaug

SEQ ID NO: 1473286 - RNA, 13 nt, Human
gauccuggaaauc

SEQ ID NO: 1473287 - RNA, 19 nt, Human
gaucccuagcugugaccuc

SEQ ID NO: 1473288 - RNA, 21 nt, Human
gaucccuagcugugaccucuc

SEQ ID NO: 1473289 - RNA, 15 nt, Human
gaucccuagcuguga

SEQ ID NO: 1473290 - RNA, 19 nt, Human
gauccccacgccacagccc

SEQ ID NO: 1473291 - RNA, 18 nt, Human
gauccccacgccacagcc

SEQ ID NO: 1473292 - RNA, 21 nt, Human
gauccccacgccacagcccuu

SEQ ID NO: 1473293 - RNA, 18 nt, Human
gaugaaaauaaagaaugg

SEQ ID NO: 1473294 - RNA, 19 nt, Human
gaugaaaauaaagaaugga

SEQ ID NO: 1473295 - RNA, 14 nt, Human
gaucuuuuauuuug

SEQ ID NO: 1473296 - RNA, 15 nt, Human
gaucuuuuauuuugc

SEQ ID NO: 1473297 - RNA, 15 nt, Human
gaugcacaucccugg

SEQ ID NO: 1473298 - RNA, 16 nt, Human
gaugcacaucccugga

SEQ ID NO: 1473299 - RNA, 15 nt, Human
gaugcauuugggucc

SEQ ID NO: 1473300 - RNA, 16 nt, Human
gaugcauuugggucca

SEQ ID NO: 1473301 - RNA, 18 nt, Human
gaugcauuuggguccagg

SEQ ID NO: 1473302 - RNA, 19 nt, Human
gaugcauuuggguccagga

SEQ ID NO: 1473303 - RNA, 20 nt, Human
gaugcauuuggguccaggag

SEQ ID NO: 1473304 - RNA, 21 nt, Human
gaugcauuuggguccaggagg

SEQ ID NO: 1473305 - RNA, 22 nt, Human
gaugcauuuggguccaggagga

SEQ ID NO: 1473306 - RNA, 19 nt, Human
gaugccaaaaaaaaauaca

SEQ ID NO: 1473307 - RNA, 14 nt, Human
gauggcgcaggaac

SEQ ID NO: 1473308 - RNA, 11 nt, Human
gauacagaaaa

SEQ ID NO: 1473309 - RNA, 17 nt, Human
gauaagguaaaaugcca

SEQ ID NO: 1473310 - RNA, 23 nt, Human
gauagauaggucagugcaaauac

SEQ ID NO: 1473311 - RNA, 19 nt, Human
gauaaaguugguaaaccuu

SEQ ID NO: 1473312 - RNA, 19 nt, Human
gauaaagauuuuuuaauaa

SEQ ID NO: 1473313 - RNA, 17 nt, Human
gauaaagauuuuuuaau

SEQ ID NO: 1473314 - RNA, 14 nt, Human
gauaagaucuuuua

SEQ ID NO: 1473315 - RNA, 20 nt, Human
gauaagaucuuuuauuuugc

SEQ ID NO: 1473316 - RNA, 13 nt, Human
gauaaggaaauca

SEQ ID NO: 1473317 - RNA, 20 nt, Human
gauaagguaaaaugccauga

SEQ ID NO: 1473318 - RNA, 12 nt, Human
gaucccccagaa

SEQ ID NO: 1473319 - RNA, 17 nt, Human
gauccccacgccacagc

SEQ ID NO: 1473320 - RNA, 16 nt, Human
gauccccacgccacag

SEQ ID NO: 1473321 - RNA, 17 nt, Human
gaucccaugagcuccuu

SEQ ID NO: 1473322 - RNA, 20 nt, Human
gaucauugugaaauuauuca

SEQ ID NO: 1473323 - RNA, 18 nt, Human
gaucauuuguuggaauga

SEQ ID NO: 1473324 - RNA, 14 nt, Human
gaucauugugaaau

SEQ ID NO: 1473325 - RNA, 14 nt, Human
gaucaguuaacuau

SEQ ID NO: 1473326 - RNA, 18 nt, Human
gaucaguuauaaguagca

SEQ ID NO: 1473327 - RNA, 23 nt, Human
gaucagugggccuccaaggaggg

SEQ ID NO: 1473328 - RNA, 21 nt, Human
gaucaaguuauuuuuaauuug

SEQ ID NO: 1473329 - RNA, 13 nt, Human
gaucaaggccuua

SEQ ID NO: 1473330 - RNA, 23 nt, Human
gaucaaggccuuauuggaaagca

SEQ ID NO: 1473331 - RNA, 22 nt, Human
gaucaaggccuuauuggaaagc

SEQ ID NO: 1473332 - RNA, 18 nt, Human
gaucagccagugaccaac

SEQ ID NO: 1473333 - RNA, 16 nt, Human
gagcucgugggacagu

SEQ ID NO: 1473334 - RNA, 20 nt, Human
gagcuccuuaaggcucuuuu

SEQ ID NO: 1473335 - RNA, 16 nt, Human
gagcugauggagaagg

SEQ ID NO: 1473336 - RNA, 15 nt, Human
gagcugauggagaag

SEQ ID NO: 1473337 - RNA, 14 nt, Human
gagcugaccagccg

SEQ ID NO: 1473338 - RNA, 20 nt, Human
gagcucaggaaccgaggcag

SEQ ID NO: 1473339 - RNA, 23 nt, Human
gagcucagaaaauaucccuccug

SEQ ID NO: 1473340 - RNA, 20 nt, Human
gagcucagaaaauaucccuc

SEQ ID NO: 1473341 - RNA, 21 nt, Human
gagcucaggaaccgaggcagg

SEQ ID NO: 1473342 - RNA, 22 nt, Human
gagcucaggaaccgaggcaggg

SEQ ID NO: 1473343 - RNA, 19 nt, Human
gagcucagaaaauaucccu

SEQ ID NO: 1473344 - RNA, 14 nt, Human
gagcuuuuguagaa

SEQ ID NO: 1473345 - RNA, 13 nt, Human
gagcuugggaaug

SEQ ID NO: 1473346 - RNA, 23 nt, Human
gagcccuucuauacccacccaga

SEQ ID NO: 1473347 - RNA, 23 nt, Human
gagcccacuguacuugcucuuga

SEQ ID NO: 1473348 - RNA, 21 nt, Human
gagcccacuguacuugcucuu

SEQ ID NO: 1473349 - RNA, 18 nt, Human
gagcccacuguacuugcu

SEQ ID NO: 1473350 - RNA, 21 nt, Human
gagccugacccucaucuuucu

SEQ ID NO: 1473351 - RNA, 19 nt, Human
gagccugaauuuuguugcu

SEQ ID NO: 1473352 - RNA, 21 nt, Human
gagccaggaagaucccccaga

SEQ ID NO: 1473353 - RNA, 20 nt, Human
gagccaggaagaucccccag

SEQ ID NO: 1473354 - RNA, 23 nt, Human
gagcagagcugauggagaaggaa

SEQ ID NO: 1473355 - RNA, 20 nt, Human
gagcagagcugauggagaag

SEQ ID NO: 1473356 - RNA, 16 nt, Human
gagauacauacagaau

SEQ ID NO: 1473357 - RNA, 13 nt, Human
gagauacauacag

SEQ ID NO: 1473358 - RNA, 22 nt, Human
gagaagcaaguaaaaaggcuaa

SEQ ID NO: 1473359 - RNA, 14 nt, Human
gagaagaacugaaa

SEQ ID NO: 1473360 - RNA, 16 nt, Human
gagaagaacugaaauc

SEQ ID NO: 1473361 - RNA, 13 nt, Human
gagaaugagccuc

SEQ ID NO: 1473362 - RNA, 16 nt, Human
gagacagccaacuaug

SEQ ID NO: 1473363 - RNA, 9 nt, Human
gagacagag

SEQ ID NO: 1473364 - RNA, 18 nt, Human
gagacacacugaagaagc

SEQ ID NO: 1473365 - RNA, 15 nt, Human
gagacacaccugagg

SEQ ID NO: 1473366 - RNA, 21 nt, Human
gagaauuucuaccauuucaga

SEQ ID NO: 1473367 - RNA, 19 nt, Human
gagacaaacaccucccagg

SEQ ID NO: 1473368 - RNA, 20 nt, Human
gagacaaacaccucccagga

SEQ ID NO: 1473369 - RNA, 22 nt, Human
gagacaaacaccucccaggaga

SEQ ID NO: 1473370 - RNA, 12 nt, Human
gacuugugucug

SEQ ID NO: 1473371 - RNA, 13 nt, Human
gacuugugucucu

SEQ ID NO: 1473372 - RNA, 16 nt, Human
gacuugugucucugug

SEQ ID NO: 1473373 - RNA, 18 nt, Human
gacuugucccgggacacc

SEQ ID NO: 1473374 - RNA, 12 nt, Human
gagaaaugaaaa

SEQ ID NO: 1473375 - RNA, 23 nt, Human
gagaaaucuggcuucuggccagg

SEQ ID NO: 1473376 - RNA, 14 nt, Human
gagaaauacaaaaa

SEQ ID NO: 1473377 - RNA, 15 nt, Human
gagaaauacaaaaau

SEQ ID NO: 1473378 - RNA, 19 nt, Human
gagagagguugaaaaacaa

SEQ ID NO: 1473379 - RNA, 16 nt, Human
gagagaguugaaccua

SEQ ID NO: 1473380 - RNA, 14 nt, Human
gagagcaucaggcc

SEQ ID NO: 1473381 - RNA, 17 nt, Human
gagagagguugaaaaac

SEQ ID NO: 1473382 - RNA, 13 nt, Human
gagagaggccauu

SEQ ID NO: 1473383 - RNA, 21 nt, Human
gagagaggccauucuuuccca

SEQ ID NO: 1473384 - RNA, 19 nt, Human
gagagacacacugaagaag

SEQ ID NO: 1473385 - RNA, 11 nt, Human
gagacuuguuu

SEQ ID NO: 1473386 - RNA, 17 nt, Human
gagauacagaauuuuau

SEQ ID NO: 1473387 - RNA, 17 nt, Human
gagagguugucuguggc

SEQ ID NO: 1473388 - RNA, 15 nt, Human
gagagggcgcaggcc

SEQ ID NO: 1473389 - RNA, 16 nt, Human
gagagggcgcaggccg

SEQ ID NO: 1473390 - RNA, 17 nt, Human
gagagggcgcaggccgu

SEQ ID NO: 1473391 - RNA, 18 nt, Human
gagagggcgcaggccgug

SEQ ID NO: 1473392 - RNA, 12 nt, Human
gagacauccagc

SEQ ID NO: 1473393 - RNA, 11 nt, Human
gagacauccag

SEQ ID NO: 1473394 - RNA, 22 nt, Human
gagacauuaacucauuagacug

SEQ ID NO: 1473395 - RNA, 16 nt, Human
gagacauuaacucauu

SEQ ID NO: 1473396 - RNA, 13 nt, Human
gagacagcccagg

SEQ ID NO: 1473397 - RNA, 12 nt, Human
gagaccaccucu

SEQ ID NO: 1473398 - RNA, 14 nt, Human
gagacuguuuggaa

SEQ ID NO: 1473399 - RNA, 16 nt, Human
gagacuguuuggaaau

SEQ ID NO: 1473400 - RNA, 13 nt, Human
gagacuugggaau

SEQ ID NO: 1473401 - RNA, 16 nt, Human
gacggguuucaccaug

SEQ ID NO: 1473402 - RNA, 17 nt, Human
gacgggguuucaccaug

SEQ ID NO: 1473403 - RNA, 19 nt, Human
gacgcaagggccugauggg

SEQ ID NO: 1473404 - RNA, 12 nt, Human
gaccugccugua

SEQ ID NO: 1473405 - RNA, 19 nt, Human
gacucagguggcccuacug

SEQ ID NO: 1473406 - RNA, 22 nt, Human
gacucaucuuucccuccuuggu

SEQ ID NO: 1473407 - RNA, 21 nt, Human
gacucaucuuucccuccuugg

SEQ ID NO: 1473408 - RNA, 19 nt, Human
gacucaucuuucccuccuu

SEQ ID NO: 1473409 - RNA, 18 nt, Human
gacucaucuuucccuccu

SEQ ID NO: 1473410 - RNA, 17 nt, Human
gacucaucuuucccucc

SEQ ID NO: 1473411 - RNA, 15 nt, Human
gacucaucuuucccu

SEQ ID NO: 1473412 - RNA, 18 nt, Human
gacuacuugggagcaccg

SEQ ID NO: 1473413 - RNA, 20 nt, Human
gacuacuugggagcaccgcc

SEQ ID NO: 1473414 - RNA, 20 nt, Human
gacuagaaaauuuaaaacau

SEQ ID NO: 1473415 - RNA, 22 nt, Human
gacucagcucugacauucugau

SEQ ID NO: 1473416 - RNA, 23 nt, Human
gacucagcucugacauucugauu

SEQ ID NO: 1473417 - RNA, 22 nt, Human
gacucaggcccccaccuggcuc

SEQ ID NO: 1473418 - RNA, 23 nt, Human
gacucaggcccccaccuggcuca

SEQ ID NO: 1473419 - RNA, 20 nt, Human
gaccggcggaccccagccau

SEQ ID NO: 1473420 - RNA, 19 nt, Human
gaccggcggaccccagcca

SEQ ID NO: 1473421 - RNA, 15 nt, Human
gaccggccugccagg

SEQ ID NO: 1473422 - RNA, 16 nt, Human
gaccggccugccagga

SEQ ID NO: 1473423 - RNA, 17 nt, Human
gaccggccugccaggag

SEQ ID NO: 1473424 - RNA, 18 nt, Human
gaccggccugccaggagg

SEQ ID NO: 1473425 - RNA, 19 nt, Human
gaccggccugccaggagga

SEQ ID NO: 1473426 - RNA, 20 nt, Human
gacccuuauugcuguccugg

SEQ ID NO: 1473427 - RNA, 16 nt, Human
gacccuuauugcuguc

SEQ ID NO: 1473428 - RNA, 21 nt, Human
gaccucaccaagcugcugugg

SEQ ID NO: 1473429 - RNA, 22 nt, Human
gaccugccucccuucaugcaug

SEQ ID NO: 1473430 - RNA, 11 nt, Human
gaccugccucc

SEQ ID NO: 1473431 - RNA, 23 nt, Human
gaccugauuucugagcauuuaau

SEQ ID NO: 1473432 - RNA, 18 nt, Human
gaccucaggcaaucugcc

SEQ ID NO: 1473433 - RNA, 22 nt, Human
gacccaggacaggauccaggcc

SEQ ID NO: 1473434 - RNA, 13 nt, Human
gacccaggacagg

SEQ ID NO: 1473435 - RNA, 12 nt, Human
gacccaggacag

SEQ ID NO: 1473436 - RNA, 12 nt, Human
gacaccugcccu

SEQ ID NO: 1473437 - RNA, 11 nt, Human
gacaccugccc

SEQ ID NO: 1473438 - RNA, 10 nt, Human
gacaccugcc

SEQ ID NO: 1473439 - RNA, 9 nt, Human
gacaccugc

SEQ ID NO: 1473440 - RNA, 15 nt, Human
gacaccuaggcuagg

SEQ ID NO: 1473441 - RNA, 16 nt, Human
gacaccuaggcuaggg

SEQ ID NO: 1473442 - RNA, 20 nt, Human
gacaccuaggcuaggguggg

SEQ ID NO: 1473443 - RNA, 13 nt, Human
gacacaguuccug

SEQ ID NO: 1473444 - RNA, 19 nt, Human
gacacauacucauuuuuca

SEQ ID NO: 1473445 - RNA, 15 nt, Human
gacacaguuccuggg

SEQ ID NO: 1473446 - RNA, 14 nt, Human
gacacaguuccugg

SEQ ID NO: 1473447 - RNA, 16 nt, Human
gacacaguuccuggga

SEQ ID NO: 1473448 - RNA, 23 nt, Human
gacaccugcccugcccugccacc

SEQ ID NO: 1473449 - RNA, 18 nt, Human
gacaccugggagaaaucu

SEQ ID NO: 1473450 - RNA, 12 nt, Human
gacaccugggag

SEQ ID NO: 1473451 - RNA, 22 nt, Human
gacaccugcccugcccugccac

SEQ ID NO: 1473452 - RNA, 16 nt, Human
gacaccugcccugccc

SEQ ID NO: 1473453 - RNA, 15 nt, Human
gacaccugcccugcc

SEQ ID NO: 1473454 - RNA, 14 nt, Human
gacaccugcccugc

SEQ ID NO: 1473455 - RNA, 13 nt, Human
gacaccugcccug

SEQ ID NO: 1473456 - RNA, 19 nt, Human
gacaccuuuuuucaacagu

SEQ ID NO: 1473457 - RNA, 15 nt, Human
gacaagcucacagac

SEQ ID NO: 1473458 - RNA, 16 nt, Human
gacaagccagaacuug

SEQ ID NO: 1473459 - RNA, 22 nt, Human
gacaauugagguaaguuuuuug

SEQ ID NO: 1473460 - RNA, 22 nt, Human
gacaugggacauuugcucaugg

SEQ ID NO: 1473461 - RNA, 16 nt, Human
gacaugaagcuguugu

SEQ ID NO: 1473462 - RNA, 14 nt, Human
gaccaaaaguuaca

SEQ ID NO: 1473463 - RNA, 19 nt, Human
gaccaaaaguuacauguuu

SEQ ID NO: 1473464 - RNA, 15 nt, Human
gacaugucuguucua

SEQ ID NO: 1473465 - RNA, 17 nt, Human
gacaugucuguucuaca

SEQ ID NO: 1473466 - RNA, 15 nt, Human
gacaggauccaggcc

SEQ ID NO: 1473467 - RNA, 13 nt, Human
gacaggauccagg

SEQ ID NO: 1473468 - RNA, 18 nt, Human
gacaggauccaggccggc

SEQ ID NO: 1473469 - RNA, 21 nt, Human
gacagcuucucauccugcagg

SEQ ID NO: 1473470 - RNA, 22 nt, Human
gacagcuucucauccugcaggc

SEQ ID NO: 1473471 - RNA, 19 nt, Human
gacagccaacuauggccug

SEQ ID NO: 1473472 - RNA, 16 nt, Human
gacagaugaggcuuuc

SEQ ID NO: 1473473 - RNA, 15 nt, Human
gacagaugaggcuuu

SEQ ID NO: 1473474 - RNA, 20 nt, Human
gacagaugaggcuuuccaug

SEQ ID NO: 1473475 - RNA, 22 nt, Human
gacagccaacuauggccugugg

SEQ ID NO: 1473476 - RNA, 18 nt, Human
gaagaucccccagaaaag

SEQ ID NO: 1473477 - RNA, 15 nt, Human
gaagaucccccagaa

SEQ ID NO: 1473478 - RNA, 14 nt, Human
gaagaucccccaga

SEQ ID NO: 1473479 - RNA, 14 nt, Human
gaagauauuuuucc

SEQ ID NO: 1473480 - RNA, 22 nt, Human
gaagauugagauguguucacaa

SEQ ID NO: 1473481 - RNA, 17 nt, Human
gaagauugagauguguu

SEQ ID NO: 1473482 - RNA, 19 nt, Human
gaagaaguuucaucauuuu

SEQ ID NO: 1473483 - RNA, 16 nt, Human
gaagaaggugggagga

SEQ ID NO: 1473484 - RNA, 10 nt, Human
gaagaggacu

SEQ ID NO: 1473485 - RNA, 22 nt, Human
gaacuugaaauauccugcuuga

SEQ ID NO: 1473486 - RNA, 15 nt, Human
gaacuugaacugauu

SEQ ID NO: 1473487 - RNA, 16 nt, Human
gaacuugaacugauuc

SEQ ID NO: 1473488 - RNA, 14 nt, Human
gaaccacaagacug

SEQ ID NO: 1473489 - RNA, 15 nt, Human
gaaccacaagacugc

SEQ ID NO: 1473490 - RNA, 19 nt, Human
gaaccaauaaaauaauuuu

SEQ ID NO: 1473491 - RNA, 24 nt, Human
gaacuuuccacauucagagcuuac

SEQ ID NO: 1473492 - RNA, 20 nt, Human
gaagaaagaacggaagaaga

SEQ ID NO: 1473493 - RNA, 23 nt, Human
gaaguccaagcauuuagauguau

SEQ ID NO: 1473494 - RNA, 21 nt, Human
gaagucacauuccugaacagg

SEQ ID NO: 1473495 - RNA, 16 nt, Human
gaagucacauuccuga

SEQ ID NO: 1473496 - RNA, 20 nt, Human
gaagucacauuccugaacag

SEQ ID NO: 1473497 - RNA, 14 nt, Human
gaaguaacuacagu

SEQ ID NO: 1473498 - RNA, 21 nt, Human
gaaggugaggagcuugaaacc

SEQ ID NO: 1473499 - RNA, 19 nt, Human
gaaguauuuugcuggaaua

SEQ ID NO: 1473500 - RNA, 20 nt, Human
gaaggugaaacauuuucucc

SEQ ID NO: 1473501 - RNA, 13 nt, Human
gaaggcauggcgg

SEQ ID NO: 1473502 - RNA, 21 nt, Human
gaaggaucccaugagcuccuu

SEQ ID NO: 1473503 - RNA, 22 nt, Human
gaaggaaggcuccaucuccagu

SEQ ID NO: 1473504 - RNA, 20 nt, Human
gaaggaaggcagggaggagg

SEQ ID NO: 1473505 - RNA, 19 nt, Human
gaaggaaggcagggaggag

SEQ ID NO: 1473506 - RNA, 18 nt, Human
gaaggaaggcagggagga

SEQ ID NO: 1473507 - RNA, 19 nt, Human
gaaggaggacccaggacag

SEQ ID NO: 1473508 - RNA, 18 nt, Human
gaaggaggacccaggaca

SEQ ID NO: 1473509 - RNA, 17 nt, Human
gaaggaggacccaggac

SEQ ID NO: 1473510 - RNA, 16 nt, Human
gaaggaggacccagga

SEQ ID NO: 1473511 - RNA, 15 nt, Human
gaaggaggacccagg

SEQ ID NO: 1473512 - RNA, 14 nt, Human
gaaggaggacccag

SEQ ID NO: 1473513 - RNA, 13 nt, Human
gaaggaggaccca

SEQ ID NO: 1473514 - RNA, 19 nt, Human
gaagcauuuguuucuacuu

SEQ ID NO: 1473515 - RNA, 13 nt, Human
gaagcauuuguuu

SEQ ID NO: 1473516 - RNA, 16 nt, Human
gaagcuguugugugag

SEQ ID NO: 1473517 - RNA, 14 nt, Human
gaaauaaacgucuu

SEQ ID NO: 1473518 - RNA, 16 nt, Human
gaaauaaacgucuuaa

SEQ ID NO: 1473519 - RNA, 17 nt, Human
gaaauaaacgucuuaaa

SEQ ID NO: 1473520 - RNA, 18 nt, Human
gaaauaaacgucuuaaau

SEQ ID NO: 1473521 - RNA, 21 nt, Human
gaaauaaacgucuuaaauauu

SEQ ID NO: 1473522 - RNA, 15 nt, Human
gaaauauuuauuuua

SEQ ID NO: 1473523 - RNA, 16 nt, Human
gaaauauuuauuuuaa

SEQ ID NO: 1473524 - RNA, 15 nt, Human
gaaauauccugcuug

SEQ ID NO: 1473525 - RNA, 15 nt, Human
gaaaugaauuaaagu

SEQ ID NO: 1473526 - RNA, 13 nt, Human
gaaauauuuauuu

SEQ ID NO: 1473527 - RNA, 23 nt, Human
gaaaugugguagccucacuuuua

SEQ ID NO: 1473528 - RNA, 22 nt, Human
gaaauucccuucaucuggaacc

SEQ ID NO: 1473529 - RNA, 21 nt, Human
gaaauucccuucaucuggaac

SEQ ID NO: 1473530 - RNA, 17 nt, Human
gaaauucccuucaucug

SEQ ID NO: 1473531 - RNA, 23 nt, Human
gaaauuaugugacauuuuacauu

SEQ ID NO: 1473532 - RNA, 22 nt, Human
gaaauuaugugacauuuuacau

SEQ ID NO: 1473533 - RNA, 23 nt, Human
gaaauuaguacuccccuccuuga

SEQ ID NO: 1473534 - RNA, 21 nt, Human
gaaauuuccugggagcuuuug

SEQ ID NO: 1473535 - RNA, 22 nt, Human
gaacaguuguguuugaagcaca

SEQ ID NO: 1473536 - RNA, 24 nt, Human
gaaccaacaaccucaacugccuac

SEQ ID NO: 1473537 - RNA, 24 nt, Human
gaacaguuaccucugccucagaaa

SEQ ID NO: 1473538 - RNA, 20 nt, Human
gaacaguuguguuugaagca

SEQ ID NO: 1473539 - RNA, 17 nt, Human
gaacaggauauucucac

SEQ ID NO: 1473540 - RNA, 20 nt, Human
gaaagucagccauaucucca

SEQ ID NO: 1473541 - RNA, 16 nt, Human
gaaaggaagcugugcg

SEQ ID NO: 1473542 - RNA, 23 nt, Human
gaaagccaaggagucacugagac

SEQ ID NO: 1473543 - RNA, 20 nt, Human
gaaacuaggugcauauuuau

SEQ ID NO: 1473544 - RNA, 18 nt, Human
gaaacucauagacacuga

SEQ ID NO: 1473545 - RNA, 17 nt, Human
gaaaccuuccacccagu

SEQ ID NO: 1473546 - RNA, 15 nt, Human
gaaaccuuccaccca

SEQ ID NO: 1473547 - RNA, 12 nt, Human
gaaaaauguagg

SEQ ID NO: 1473548 - RNA, 14 nt, Human
gaaaaauguaggag

SEQ ID NO: 1473549 - RNA, 17 nt, Human
gaaaaauguaggagacu

SEQ ID NO: 1473550 - RNA, 14 nt, Human
gaaaaagaagaauc

SEQ ID NO: 1473551 - RNA, 12 nt, Human
gaaaaagaagca

SEQ ID NO: 1473552 - RNA, 16 nt, Human
gaaagagauacagagg

SEQ ID NO: 1473553 - RNA, 18 nt, Human
gaaacugaggaauuuucu

SEQ ID NO: 1473554 - RNA, 22 nt, Human
gaaacugaggaauuuucuuugu

SEQ ID NO: 1473555 - RNA, 22 nt, Human
cuuuuaaaugauugaauuauau

SEQ ID NO: 1473556 - RNA, 17 nt, Human
cuuuuaaaccauuuucu

SEQ ID NO: 1473557 - RNA, 12 nt, Human
cuuuuaaacugu

SEQ ID NO: 1473558 - RNA, 13 nt, Human
cuuuuaaacugug

SEQ ID NO: 1473559 - RNA, 15 nt, Human
cuuuuaaacugugua

SEQ ID NO: 1473560 - RNA, 22 nt, Human
cuuuuaacuguuguagaagaca

SEQ ID NO: 1473561 - RNA, 22 nt, Human
cuuuuaacagagucugaaccua

SEQ ID NO: 1473562 - RNA, 12 nt, Human
cuuuggacuugu

SEQ ID NO: 1473563 - RNA, 17 nt, Human
cuuuggaccuaauccaa

SEQ ID NO: 1473564 - RNA, 16 nt, Human
cuuuggaccuaaucca

SEQ ID NO: 1473565 - RNA, 15 nt, Human
cuuuuaaugaacaaa

SEQ ID NO: 1473566 - RNA, 16 nt, Human
cuuuuaaugaacaaau

SEQ ID NO: 1473567 - RNA, 18 nt, Human
cuuuuaaugaacaaaugg

SEQ ID NO: 1473568 - RNA, 16 nt, Human
cuuuuuucaaaagaaa

SEQ ID NO: 1473569 - RNA, 19 nt, Human
cuuuuuuaucaugugaaau

SEQ ID NO: 1473570 - RNA, 13 nt, Human
cuuuuuccagagg

SEQ ID NO: 1473571 - RNA, 17 nt, Human
cuuuuuccaacaagaag

SEQ ID NO: 1473572 - RNA, 23 nt, Human
cuuuuuccaacuuggcugcagga

SEQ ID NO: 1473573 - RNA, 20 nt, Human
cuuuuuaccaaguuucaggu

SEQ ID NO: 1473574 - RNA, 20 nt, Human
cuuuuuaaauguaaagauau

SEQ ID NO: 1473575 - RNA, 21 nt, Human
cuuuuuaaauguaaagauauu

SEQ ID NO: 1473576 - RNA, 21 nt, Human
cuuucuuucaauaaaacgcag

SEQ ID NO: 1473577 - RNA, 13 nt, Human
cuuucuuucuuua

SEQ ID NO: 1473578 - RNA, 15 nt, Human
cuuucuuuauuuuga

SEQ ID NO: 1473579 - RNA, 13 nt, Human
cuuucuuccaaac

SEQ ID NO: 1473580 - RNA, 19 nt, Human
cuuucuuccaaacaggcuc

SEQ ID NO: 1473581 - RNA, 22 nt, Human
cuuucuuccaaacaggcucaga

SEQ ID NO: 1473582 - RNA, 21 nt, Human
cuuugccacccucaugcugug

SEQ ID NO: 1473583 - RNA, 15 nt, Human
cuuugcccagaaaga

SEQ ID NO: 1473584 - RNA, 22 nt, Human
cuuugcccugcugcccuccccc

SEQ ID NO: 1473585 - RNA, 20 nt, Human
cuuugcccugcugcccuccc

SEQ ID NO: 1473586 - RNA, 18 nt, Human
cuuugcccugcugcccuc

SEQ ID NO: 1473587 - RNA, 21 nt, Human
cuuugaaguuagcuuuaacuu

SEQ ID NO: 1473588 - RNA, 18 nt, Human
cuuugaauccucucucug

SEQ ID NO: 1473589 - RNA, 19 nt, Human
cuuugaauccucucucugu

SEQ ID NO: 1473590 - RNA, 23 nt, Human
cuuugaauccucucucuguguua

SEQ ID NO: 1473591 - RNA, 19 nt, Human
cuuuauuuuguguuuagga

SEQ ID NO: 1473592 - RNA, 13 nt, Human
cuuuauuuugaga

SEQ ID NO: 1473593 - RNA, 14 nt, Human
cuugucaugugaca

SEQ ID NO: 1473594 - RNA, 15 nt, Human
cuugugucucugugc

SEQ ID NO: 1473595 - RNA, 17 nt, Human
cuugugucucugugcuu

SEQ ID NO: 1473596 - RNA, 18 nt, Human
cuugugucucugugcuuu

SEQ ID NO: 1473597 - RNA, 21 nt, Human
cuugugucucugugcuuuuaa

SEQ ID NO: 1473598 - RNA, 10 nt, Human
cuugugucug

SEQ ID NO: 1473599 - RNA, 11 nt, Human
cuuuauuuuga

SEQ ID NO: 1473600 - RNA, 13 nt, Human
cuuguauuaugug

SEQ ID NO: 1473601 - RNA, 23 nt, Human
cuuguaaauuauuaauuuaugca

SEQ ID NO: 1473602 - RNA, 14 nt, Human
cuuguaagacccuu

SEQ ID NO: 1473603 - RNA, 18 nt, Human
cuuguauuauguguguuu

SEQ ID NO: 1473604 - RNA, 23 nt, Human
cuugucacgccagacuucccacg

SEQ ID NO: 1473605 - RNA, 15 nt, Human
cuugucacugguaga

SEQ ID NO: 1473606 - RNA, 23 nt, Human
cuugucacugguagaccaaaaua

SEQ ID NO: 1473607 - RNA, 22 nt, Human
cuugucacugguagaccaaaau

SEQ ID NO: 1473608 - RNA, 18 nt, Human
cuuguaaaggaauuuaaa

SEQ ID NO: 1473609 - RNA, 21 nt, Human
cuugguuuugcuacauaauua

SEQ ID NO: 1473610 - RNA, 20 nt, Human
cuuggggaguuuaggguggg

SEQ ID NO: 1473611 - RNA, 21 nt, Human
cuuggggaguuuagggugggg

SEQ ID NO: 1473612 - RNA, 19 nt, Human
cuuggggauucuuccaucu

SEQ ID NO: 1473613 - RNA, 21 nt, Human
cuuggggauucuuccaucuga

SEQ ID NO: 1473614 - RNA, 13 nt, Human
cuuggcugcagga

SEQ ID NO: 1473615 - RNA, 17 nt, Human
cuugccaaauauaaaua

SEQ ID NO: 1473616 - RNA, 13 nt, Human
cuugcuggaagac

SEQ ID NO: 1473617 - RNA, 15 nt, Human
cuugcuuuuaaaauc

SEQ ID NO: 1473618 - RNA, 17 nt, Human
cuuggauuccugauagu

SEQ ID NO: 1473619 - RNA, 14 nt, Human
cuugaacugauuca

SEQ ID NO: 1473620 - RNA, 13 nt, Human
cuugaaauuuuaa

SEQ ID NO: 1473621 - RNA, 14 nt, Human
cuugaaauuuuaac

SEQ ID NO: 1473622 - RNA, 13 nt, Human
cuucuuuccacag

SEQ ID NO: 1473623 - RNA, 19 nt, Human
cuucuuuccacagaagcuc

SEQ ID NO: 1473624 - RNA, 20 nt, Human
cuucuuuuuucaaaagaaag

SEQ ID NO: 1473625 - RNA, 19 nt, Human
cuucuuuuuucaaaagaaa

SEQ ID NO: 1473626 - RNA, 18 nt, Human
cuugaaauauccugcuug

SEQ ID NO: 1473627 - RNA, 19 nt, Human
cuugaaauauccugcuuga

SEQ ID NO: 1473628 - RNA, 19 nt, Human
cuucuuuuaaaccauuuuc

SEQ ID NO: 1473629 - RNA, 13 nt, Human
cuucuuuugcucu

SEQ ID NO: 1473630 - RNA, 14 nt, Human
cuucuuuugcucuu

SEQ ID NO: 1473631 - RNA, 13 nt, Human
cuucuuuugugaa

SEQ ID NO: 1473632 - RNA, 18 nt, Human
cuugaggacacaugucca

SEQ ID NO: 1473633 - RNA, 17 nt, Human
cuugaggacacaugucc

SEQ ID NO: 1473634 - RNA, 18 nt, Human
cuugagccaggaggccug

SEQ ID NO: 1473635 - RNA, 18 nt, Human
cuugagggcaagagccac

SEQ ID NO: 1473636 - RNA, 16 nt, Human
cuugaggacacauguc

SEQ ID NO: 1473637 - RNA, 15 nt, Human
cuugaggacacaugu

SEQ ID NO: 1473638 - RNA, 14 nt, Human
cuugaggacacaug

SEQ ID NO: 1473639 - RNA, 13 nt, Human
cuugaggacacau

SEQ ID NO: 1473640 - RNA, 12 nt, Human
cuugaggacaca

SEQ ID NO: 1473641 - RNA, 23 nt, Human
cuugcaggaaggacuaugaaaag

SEQ ID NO: 1473642 - RNA, 13 nt, Human
cuugcaugcuugc

SEQ ID NO: 1473643 - RNA, 15 nt, Human
cuguaugauucccag

SEQ ID NO: 1473644 - RNA, 18 nt, Human
cuguauuugaaucagccu

SEQ ID NO: 1473645 - RNA, 13 nt, Human
cuguauuuuaaaa

SEQ ID NO: 1473646 - RNA, 16 nt, Human
cuguauuuuaaaagaa

SEQ ID NO: 1473647 - RNA, 19 nt, Human
cuguauuuuaaaagaauga

SEQ ID NO: 1473648 - RNA, 13 nt, Human
cugucucucauga

SEQ ID NO: 1473649 - RNA, 17 nt, Human
cugucucucaugaaccu

SEQ ID NO: 1473650 - RNA, 22 nt, Human
cugggucgcccuggacugugug

SEQ ID NO: 1473651 - RNA, 18 nt, Human
cugggucgcccuggacug

SEQ ID NO: 1473652 - RNA, 17 nt, Human
cugggucgcccuggacu

SEQ ID NO: 1473653 - RNA, 15 nt, Human
cugguccaaaagauu

SEQ ID NO: 1473654 - RNA, 22 nt, Human
cugguccaaaagauugcugaaa

SEQ ID NO: 1473655 - RNA, 18 nt, Human
cuguaaggcaaucauggu

SEQ ID NO: 1473656 - RNA, 20 nt, Human
cugguucacacugaccaaga

SEQ ID NO: 1473657 - RNA, 14 nt, Human
cugguguuucuuga

SEQ ID NO: 1473658 - RNA, 13 nt, Human
cugguguuucuug

SEQ ID NO: 1473659 - RNA, 23 nt, Human
cuggucucaaacuccugaccuca

SEQ ID NO: 1473660 - RNA, 19 nt, Human
cuggucucaaacuccugac

SEQ ID NO: 1473661 - RNA, 20 nt, Human
cuguaaguagaugcauuugg

SEQ ID NO: 1473662 - RNA, 21 nt, Human
cugggaggcucuggagcccac

SEQ ID NO: 1473663 - RNA, 20 nt, Human
cugggaggcucuggagccca

SEQ ID NO: 1473664 - RNA, 18 nt, Human
cugggaggcucuggagcc

SEQ ID NO: 1473665 - RNA, 22 nt, Human
cugggaggcucuggagcccacu

SEQ ID NO: 1473666 - RNA, 17 nt, Human
cugggaggcucuggagc

SEQ ID NO: 1473667 - RNA, 19 nt, Human
cugggaggagggcaggcau

SEQ ID NO: 1473668 - RNA, 23 nt, Human
cugggauuacaggugugagccac

SEQ ID NO: 1473669 - RNA, 10 nt, Human
cugggccccu

SEQ ID NO: 1473670 - RNA, 16 nt, Human
cuggcuugggcagcau

SEQ ID NO: 1473671 - RNA, 18 nt, Human
cuggcuguggccuaaccu

SEQ ID NO: 1473672 - RNA, 18 nt, Human
cuggaauacaugaaauau

SEQ ID NO: 1473673 - RNA, 20 nt, Human
cuggaaucagcucaggacug

SEQ ID NO: 1473674 - RNA, 20 nt, Human
cuggaagugcuaauuuugaa

SEQ ID NO: 1473675 - RNA, 14 nt, Human
cuggcaacaucuuu

SEQ ID NO: 1473676 - RNA, 17 nt, Human
cuggcaacaucuuuauc

SEQ ID NO: 1473677 - RNA, 22 nt, Human
cuggaagcauuuguuucuacuu

SEQ ID NO: 1473678 - RNA, 23 nt, Human
cuggcacagccuggcuguggccu

SEQ ID NO: 1473679 - RNA, 16 nt, Human
cuggcacagccuggcu

SEQ ID NO: 1473680 - RNA, 21 nt, Human
cuggcacagccuggcuguggc

SEQ ID NO: 1473681 - RNA, 15 nt, Human
cuggcacagccuggc

SEQ ID NO: 1473682 - RNA, 23 nt, Human
cuggcauuacaggugugagccac

SEQ ID NO: 1473683 - RNA, 15 nt, Human
cuggcauuacagcug

SEQ ID NO: 1473684 - RNA, 16 nt, Human
cuggcauuacagcugg

SEQ ID NO: 1473685 - RNA, 13 nt, Human
cuggcccccuccc

SEQ ID NO: 1473686 - RNA, 15 nt, Human
cuggcccccucccug

SEQ ID NO: 1473687 - RNA, 16 nt, Human
cuggcccccucccugg

SEQ ID NO: 1473688 - RNA, 17 nt, Human
cuggcccccucccugga

SEQ ID NO: 1473689 - RNA, 18 nt, Human
cuggcccccucccuggau

SEQ ID NO: 1473690 - RNA, 19 nt, Human
cuggcccccucccuggaug

SEQ ID NO: 1473691 - RNA, 23 nt, Human
cugcaggucccuaauaaagcugu

SEQ ID NO: 1473692 - RNA, 17 nt, Human
cugcaguaugaaaauaa

SEQ ID NO: 1473693 - RNA, 16 nt, Human
cugcaguaugaaaaua

SEQ ID NO: 1473694 - RNA, 22 nt, Human
cugcaggucccuaauaaagcug

SEQ ID NO: 1473695 - RNA, 21 nt, Human
cugcaggucccuaauaaagcu

SEQ ID NO: 1473696 - RNA, 20 nt, Human
cugcaggucccuaauaaagc

SEQ ID NO: 1473697 - RNA, 19 nt, Human
cugcaggucccuaauaaag

SEQ ID NO: 1473698 - RNA, 23 nt, Human
cugcagucucuauaccaauaaag

SEQ ID NO: 1473699 - RNA, 21 nt, Human
cugcagucucuauaccaauaa

SEQ ID NO: 1473700 - RNA, 17 nt, Human
cugcagucucuauacca

SEQ ID NO: 1473701 - RNA, 22 nt, Human
cugcaguuuugcuaucugggcu

SEQ ID NO: 1473702 - RNA, 18 nt, Human
cugcaggucccuaauaaa

SEQ ID NO: 1473703 - RNA, 17 nt, Human
cugcaggucccuaauaa

SEQ ID NO: 1473704 - RNA, 16 nt, Human
cugcaggucccuaaua

SEQ ID NO: 1473705 - RNA, 15 nt, Human
cugcaggucccuaau

SEQ ID NO: 1473706 - RNA, 14 nt, Human
cugcaggucccuaa

SEQ ID NO: 1473707 - RNA, 13 nt, Human
cugcaggucccua

SEQ ID NO: 1473708 - RNA, 12 nt, Human
cugcaggucccu

SEQ ID NO: 1473709 - RNA, 11 nt, Human
cugcagguccc

SEQ ID NO: 1473710 - RNA, 17 nt, Human
cugcagggggugugucu

SEQ ID NO: 1473711 - RNA, 20 nt, Human
cugcagggggugugucugcu

SEQ ID NO: 1473712 - RNA, 23 nt, Human
cugcagggggugugucugcucag

SEQ ID NO: 1473713 - RNA, 11 nt, Human
cugcacuguaa

SEQ ID NO: 1473714 - RNA, 13 nt, Human
cugcacuguaaaa

SEQ ID NO: 1473715 - RNA, 14 nt, Human
cugcacuguaaaau

SEQ ID NO: 1473716 - RNA, 15 nt, Human
cugcacuguaaaaug

SEQ ID NO: 1473717 - RNA, 20 nt, Human
cugcacuguaaaauguggga

SEQ ID NO: 1473718 - RNA, 16 nt, Human
cugcacuguaaaaugu

SEQ ID NO: 1473719 - RNA, 18 nt, Human
cugcacuguaaaaugugg

SEQ ID NO: 1473720 - RNA, 15 nt, Human
cugcagacucacugu

SEQ ID NO: 1473721 - RNA, 17 nt, Human
cugccauucacuucaua

SEQ ID NO: 1473722 - RNA, 19 nt, Human
cugcccgggagcucaggaa

SEQ ID NO: 1473723 - RNA, 14 nt, Human
cugcauacuuuuua

SEQ ID NO: 1473724 - RNA, 20 nt, Human
cugcauacuuuuuaaaugua

SEQ ID NO: 1473725 - RNA, 21 nt, Human
cugcaguuuugcuaucugggc

SEQ ID NO: 1473726 - RNA, 16 nt, Human
cugcaguuuugcuauc

SEQ ID NO: 1473727 - RNA, 15 nt, Human
cugcaguuuugcuau

SEQ ID NO: 1473728 - RNA, 11 nt, Human
cugccaggaga

SEQ ID NO: 1473729 - RNA, 23 nt, Human
cugcugccugcuuuuuauggccu

SEQ ID NO: 1473730 - RNA, 14 nt, Human
cugcugccugcuuu

SEQ ID NO: 1473731 - RNA, 11 nt, Human
cugcugccugc

SEQ ID NO: 1473732 - RNA, 22 nt, Human
cugccugcuuuuuauggccugu

SEQ ID NO: 1473733 - RNA, 19 nt, Human
cugccuggaagagcagccc

SEQ ID NO: 1473734 - RNA, 22 nt, Human
cugcgcccuuaacugcauccag

SEQ ID NO: 1473735 - RNA, 22 nt, Human
cugcccucucccaaaaaacuac

SEQ ID NO: 1473736 - RNA, 15 nt, Human
cugcccugcccugcc

SEQ ID NO: 1473737 - RNA, 14 nt, Human
cugcccugcccugc

SEQ ID NO: 1473738 - RNA, 18 nt, Human
cuggaagugacuuuggcu

SEQ ID NO: 1473739 - RNA, 15 nt, Human
cuggaagugacuuug

SEQ ID NO: 1473740 - RNA, 15 nt, Human
cuggaagccagcuuu

SEQ ID NO: 1473741 - RNA, 16 nt, Human
cuggaagccagcuuuc

SEQ ID NO: 1473742 - RNA, 17 nt, Human
cuggaagccagcuuucc

SEQ ID NO: 1473743 - RNA, 20 nt, Human
cuggaagccccugggcccag

SEQ ID NO: 1473744 - RNA, 21 nt, Human
cuggaagccccugggcccagu

SEQ ID NO: 1473745 - RNA, 17 nt, Human
cuggaagccccugggcc

SEQ ID NO: 1473746 - RNA, 21 nt, Human
cugcuugaugggauucuggac

SEQ ID NO: 1473747 - RNA, 23 nt, Human
cugcuugaugggauucuggacag

SEQ ID NO: 1473748 - RNA, 13 nt, Human
cugcuugauuuuu

SEQ ID NO: 1473749 - RNA, 20 nt, Human
cugcuugauuuuugccucuu

SEQ ID NO: 1473750 - RNA, 17 nt, Human
cugcuuggagcugagca

SEQ ID NO: 1473751 - RNA, 16 nt, Human
cugcuuggagcugagc

SEQ ID NO: 1473752 - RNA, 19 nt, Human
cugcuucugacauaaucca

SEQ ID NO: 1473753 - RNA, 13 nt, Human
cugcugccugccu

SEQ ID NO: 1473754 - RNA, 19 nt, Human
cucuuuaaaaggaaagaaa

SEQ ID NO: 1473755 - RNA, 23 nt, Human
cucuuuaaaaggaaagaaaacau

SEQ ID NO: 1473756 - RNA, 20 nt, Human
cucuuuaaaaggaaagaaaa

SEQ ID NO: 1473757 - RNA, 14 nt, Human
cucuucccucuucc

SEQ ID NO: 1473758 - RNA, 20 nt, Human
cucuuccgugacgucacugg

SEQ ID NO: 1473759 - RNA, 15 nt, Human
cucuucuugaaauuu

SEQ ID NO: 1473760 - RNA, 20 nt, Human
cucuucuugaaauuuuaacc

SEQ ID NO: 1473761 - RNA, 23 nt, Human
cucuucuuuuaaaccauuuucuu

SEQ ID NO: 1473762 - RNA, 23 nt, Human
cucuuggggaguuuagggugggg

SEQ ID NO: 1473763 - RNA, 21 nt, Human
cugaaauaaacgucuuaaaua

SEQ ID NO: 1473764 - RNA, 16 nt, Human
cugaaagccauggaga

SEQ ID NO: 1473765 - RNA, 16 nt, Human
cugaaaggaagcugug

SEQ ID NO: 1473766 - RNA, 17 nt, Human
cucuuucuuucaauaaa

SEQ ID NO: 1473767 - RNA, 21 nt, Human
cucuuuaugcuugcaaaaacu

SEQ ID NO: 1473768 - RNA, 13 nt, Human
cugaaauuuccug

SEQ ID NO: 1473769 - RNA, 13 nt, Human
cugaaauuucaga

SEQ ID NO: 1473770 - RNA, 23 nt, Human
cugaaauuuccugggagcuuuug

SEQ ID NO: 1473771 - RNA, 18 nt, Human
cugaaaucaauuaaaagu

SEQ ID NO: 1473772 - RNA, 16 nt, Human
cugaaauuuccuggga

SEQ ID NO: 1473773 - RNA, 14 nt, Human
cugaaauuucagau

SEQ ID NO: 1473774 - RNA, 13 nt, Human
cugaaauuuuaua

SEQ ID NO: 1473775 - RNA, 22 nt, Human
cugaacaccauagguagaaugu

SEQ ID NO: 1473776 - RNA, 18 nt, Human
cugaacaccauugaaggc

SEQ ID NO: 1473777 - RNA, 19 nt, Human
cugaacaccauugaaggcu

SEQ ID NO: 1473778 - RNA, 20 nt, Human
cugaacaccauugaaggcuu

SEQ ID NO: 1473779 - RNA, 23 nt, Human
cugaagaagcaccaaucaugaau

SEQ ID NO: 1473780 - RNA, 13 nt, Human
cugaacugaacac

SEQ ID NO: 1473781 - RNA, 19 nt, Human
cugaacugauggguuucuc

SEQ ID NO: 1473782 - RNA, 23 nt, Human
cugaagacaccguucauucaggc

SEQ ID NO: 1473783 - RNA, 15 nt, Human
cugaacucaaacuga

SEQ ID NO: 1473784 - RNA, 18 nt, Human
cugaacucaaacugagga

SEQ ID NO: 1473785 - RNA, 22 nt, Human
cucugucuccuaagcuggagug

SEQ ID NO: 1473786 - RNA, 13 nt, Human
cucugucuucugg

SEQ ID NO: 1473787 - RNA, 14 nt, Human
cucugucuucugga

SEQ ID NO: 1473788 - RNA, 17 nt, Human
cucugucuucuggacug

SEQ ID NO: 1473789 - RNA, 17 nt, Human
cucugugagggugcuga

SEQ ID NO: 1473790 - RNA, 20 nt, Human
cucugugcacuuauuuauga

SEQ ID NO: 1473791 - RNA, 19 nt, Human
cucuguucauuccuccagg

SEQ ID NO: 1473792 - RNA, 18 nt, Human
cucuguucauuccuccag

SEQ ID NO: 1473793 - RNA, 13 nt, Human
cucuguucauuuc

SEQ ID NO: 1473794 - RNA, 14 nt, Human
cucuguucauuucc

SEQ ID NO: 1473795 - RNA, 17 nt, Human
cucuguucauuccucca

SEQ ID NO: 1473796 - RNA, 15 nt, Human
cucuguucauuccuc

SEQ ID NO: 1473797 - RNA, 22 nt, Human
cucugugcuuuuaaaugcauaa

SEQ ID NO: 1473798 - RNA, 17 nt, Human
cucugugggcuggcagu

SEQ ID NO: 1473799 - RNA, 17 nt, Human
cucuguucauuuccuca

SEQ ID NO: 1473800 - RNA, 16 nt, Human
cucuguucauuuccuc

SEQ ID NO: 1473801 - RNA, 19 nt, Human
cugaggaucagaguaaucc

SEQ ID NO: 1473802 - RNA, 20 nt, Human
cugagcccgguaagagcaaa

SEQ ID NO: 1473803 - RNA, 17 nt, Human
cugaggaucagaguaau

SEQ ID NO: 1473804 - RNA, 15 nt, Human
cugagcugaccagcc

SEQ ID NO: 1473805 - RNA, 15 nt, Human
cugagacaaugccuu

SEQ ID NO: 1473806 - RNA, 16 nt, Human
cugagccagugucagg

SEQ ID NO: 1473807 - RNA, 22 nt, Human
cugagccagugucaggaggaag

SEQ ID NO: 1473808 - RNA, 23 nt, Human
cugagcccgguaagagcaaaaga

SEQ ID NO: 1473809 - RNA, 13 nt, Human
cugagcuauuuca

SEQ ID NO: 1473810 - RNA, 16 nt, Human
cugagcuauuucaucu

SEQ ID NO: 1473811 - RNA, 21 nt, Human
cugagcuauuucaucuauuuu

SEQ ID NO: 1473812 - RNA, 14 nt, Human
cugagaaauuuaua

SEQ ID NO: 1473813 - RNA, 11 nt, Human
cugagaaauuu

SEQ ID NO: 1473814 - RNA, 16 nt, Human
cugagaagcucugaag

SEQ ID NO: 1473815 - RNA, 13 nt, Human
cugagaagcucug

SEQ ID NO: 1473816 - RNA, 17 nt, Human
cugacucuuaagaagac

SEQ ID NO: 1473817 - RNA, 18 nt, Human
cugacuagggagccaugu

SEQ ID NO: 1473818 - RNA, 18 nt, Human
cugacuauucuugaugua

SEQ ID NO: 1473819 - RNA, 19 nt, Human
cugacuauucuugauguaa

SEQ ID NO: 1473820 - RNA, 20 nt, Human
cugacuauucuugauguaaa

SEQ ID NO: 1473821 - RNA, 21 nt, Human
cugacuauucuugauguaaaa

SEQ ID NO: 1473822 - RNA, 22 nt, Human
cugacuauucuugauguaaaau

SEQ ID NO: 1473823 - RNA, 23 nt, Human
cugacuauucuugauguaaaauc

SEQ ID NO: 1473824 - RNA, 22 nt, Human
cugacucacaccugaacugaac

SEQ ID NO: 1473825 - RNA, 23 nt, Human
cugacaugaagcuguugugugag

SEQ ID NO: 1473826 - RNA, 21 nt, Human
cugacuagggagccauguuuc

SEQ ID NO: 1473827 - RNA, 21 nt, Human
cucucucauacccucccuccc

SEQ ID NO: 1473828 - RNA, 15 nt, Human
cucuccugucucccu

SEQ ID NO: 1473829 - RNA, 17 nt, Human
cucuccugucucccucc

SEQ ID NO: 1473830 - RNA, 18 nt, Human
cucuccugucucccuccu

SEQ ID NO: 1473831 - RNA, 18 nt, Human
cucuccagccucagcucu

SEQ ID NO: 1473832 - RNA, 16 nt, Human
cucuccaaaccacuuu

SEQ ID NO: 1473833 - RNA, 15 nt, Human
cucuccaaaccacuu

SEQ ID NO: 1473834 - RNA, 22 nt, Human
cucuccacucaugugacucuuu

SEQ ID NO: 1473835 - RNA, 21 nt, Human
cucuccacucaugugacucuu

SEQ ID NO: 1473836 - RNA, 17 nt, Human
cucuauaccaauaaagu

SEQ ID NO: 1473837 - RNA, 16 nt, Human
cucuauaccaauaaag

SEQ ID NO: 1473838 - RNA, 15 nt, Human
cucuauaccaauaaa

SEQ ID NO: 1473839 - RNA, 15 nt, Human
cucuaggaaauauuu

SEQ ID NO: 1473840 - RNA, 16 nt, Human
cucuagacacugccac

SEQ ID NO: 1473841 - RNA, 21 nt, Human
cucuagacacugccacacagg

SEQ ID NO: 1473842 - RNA, 17 nt, Human
cucuaggaaauauuuau

SEQ ID NO: 1473843 - RNA, 15 nt, Human
cucuaguauuccaga

SEQ ID NO: 1473844 - RNA, 21 nt, Human
cuccuucaacaauucuaaaau

SEQ ID NO: 1473845 - RNA, 18 nt, Human
cucgcuguccuuucuaga

SEQ ID NO: 1473846 - RNA, 16 nt, Human
cucuacaaacucccac

SEQ ID NO: 1473847 - RNA, 17 nt, Human
cucuacaaacucccacu

SEQ ID NO: 1473848 - RNA, 15 nt, Human
cucuacacucuugua

SEQ ID NO: 1473849 - RNA, 12 nt, Human
cucuaagaaaga

SEQ ID NO: 1473850 - RNA, 14 nt, Human
cucuaagaaagaac

SEQ ID NO: 1473851 - RNA, 13 nt, Human
cucuaacauuucc

SEQ ID NO: 1473852 - RNA, 22 nt, Human
cuccuccaggguggcagcaaca

SEQ ID NO: 1473853 - RNA, 21 nt, Human
cuccuccaggguggcagcaac

SEQ ID NO: 1473854 - RNA, 14 nt, Human
cuccuccaccucaa

SEQ ID NO: 1473855 - RNA, 15 nt, Human
cuccuccaccucaac

SEQ ID NO: 1473856 - RNA, 18 nt, Human
cuccucauucacaucgca

SEQ ID NO: 1473857 - RNA, 17 nt, Human
cuccucgagaucccaac

SEQ ID NO: 1473858 - RNA, 21 nt, Human
cuccucgagaucccaacacug

SEQ ID NO: 1473859 - RNA, 24 nt, Human
cuccucgagaucccaacacugcca

SEQ ID NO: 1473860 - RNA, 14 nt, Human
cucccucagugccc

SEQ ID NO: 1473861 - RNA, 23 nt, Human
cucccucagugcccucauuuuau

SEQ ID NO: 1473862 - RNA, 17 nt, Human
cuccucacccccagcuu

SEQ ID NO: 1473863 - RNA, 15 nt, Human
cuccucacccccagc

SEQ ID NO: 1473864 - RNA, 20 nt, Human
cuccucacccccagcuuugc

SEQ ID NO: 1473865 - RNA, 21 nt, Human
cuccucacccccagcuuugcu

SEQ ID NO: 1473866 - RNA, 20 nt, Human
cuccauggcccugccaugcu

SEQ ID NO: 1473867 - RNA, 18 nt, Human
cuccauccuacccccugu

SEQ ID NO: 1473868 - RNA, 23 nt, Human
cuccauccuacccccugugccuu

SEQ ID NO: 1473869 - RNA, 20 nt, Human
cuccauccuacccccugugc

SEQ ID NO: 1473870 - RNA, 22 nt, Human
cuccauccuacccccugugccu

SEQ ID NO: 1473871 - RNA, 22 nt, Human
cucccaagcaccugggauuaca

SEQ ID NO: 1473872 - RNA, 21 nt, Human
cucccaaagugcugggauuaa

SEQ ID NO: 1473873 - RNA, 13 nt, Human
cucccuacccuaa

SEQ ID NO: 1473874 - RNA, 17 nt, Human
cucccuaguuccuucau

SEQ ID NO: 1473875 - RNA, 21 nt, Human
cucccuauacugcuuggagcu

SEQ ID NO: 1473876 - RNA, 18 nt, Human
cucccuauacugcuugga

SEQ ID NO: 1473877 - RNA, 20 nt, Human
cuccccaaaggcuuugcccu

SEQ ID NO: 1473878 - RNA, 19 nt, Human
cuccccaaaggcuuugccc

SEQ ID NO: 1473879 - RNA, 21 nt, Human
cuccccaaaggcuuugcccug

SEQ ID NO: 1473880 - RNA, 12 nt, Human
cuaccaggaaag

SEQ ID NO: 1473881 - RNA, 13 nt, Human
cuacccccugugc

SEQ ID NO: 1473882 - RNA, 14 nt, Human
cuacccccugugcc

SEQ ID NO: 1473883 - RNA, 23 nt, Human
cuacacucuuguaauaaaauguc

SEQ ID NO: 1473884 - RNA, 23 nt, Human
cuaauguggaccuuagaauacag

SEQ ID NO: 1473885 - RNA, 17 nt, Human
cuaaucuuauucauuuu

SEQ ID NO: 1473886 - RNA, 18 nt, Human
cuaaucuuauucauuuuc

SEQ ID NO: 1473887 - RNA, 19 nt, Human
cuaaucuuauucauuuucu

SEQ ID NO: 1473888 - RNA, 21 nt, Human
cuaaucuuauucauuuucucu

SEQ ID NO: 1473889 - RNA, 22 nt, Human
cuaaugacaucaccacaguuua

SEQ ID NO: 1473890 - RNA, 16 nt, Human
cuaaucuacuuucugu

SEQ ID NO: 1473891 - RNA, 14 nt, Human
cuaaucucuguaaa

SEQ ID NO: 1473892 - RNA, 20 nt, Human
cuaaucucuguaaagcuaaa

SEQ ID NO: 1473893 - RNA, 15 nt, Human
cuaauccccuucucc

SEQ ID NO: 1473894 - RNA, 16 nt, Human
cuaauccccuucuccc

SEQ ID NO: 1473895 - RNA, 18 nt, Human
cuaauccccuucuccccu

SEQ ID NO: 1473896 - RNA, 20 nt, Human
cuaauccccuucuccccugc

SEQ ID NO: 1473897 - RNA, 14 nt, Human
cuaauaaagcugug

SEQ ID NO: 1473898 - RNA, 13 nt, Human
cuaauaaagcugu

SEQ ID NO: 1473899 - RNA, 12 nt, Human
cuaauaaagcug

SEQ ID NO: 1473900 - RNA, 17 nt, Human
cuaagcuaggaaugaaa

SEQ ID NO: 1473901 - RNA, 22 nt, Human
cuaagcuaggaaugaaauccug

SEQ ID NO: 1473902 - RNA, 22 nt, Human
cuaagccagcugcccccagagc

SEQ ID NO: 1473903 - RNA, 23 nt, Human
cuaagcgcuagaggaagcagcca

SEQ ID NO: 1473904 - RNA, 14 nt, Human
cuaagcuaggaaug

SEQ ID NO: 1473905 - RNA, 23 nt, Human
cuaaggaguguagcaacuacagu

SEQ ID NO: 1473906 - RNA, 16 nt, Human
cuaagccagcugcccc

SEQ ID NO: 1473907 - RNA, 15 nt, Human
cuaagccagcugccc

SEQ ID NO: 1473908 - RNA, 23 nt, Human
cuacuucuuuuuucaaaagaaag

SEQ ID NO: 1473909 - RNA, 22 nt, Human
cuacuucuuuugcucuuagcug

SEQ ID NO: 1473910 - RNA, 14 nt, Human
cuacuugcucaggu

SEQ ID NO: 1473911 - RNA, 22 nt, Human
cuacuuucugugucuauggauu

SEQ ID NO: 1473912 - RNA, 18 nt, Human
cuacuuugacuuuuugca

SEQ ID NO: 1473913 - RNA, 19 nt, Human
cuacuuugacuuuuugcau

SEQ ID NO: 1473914 - RNA, 20 nt, Human
cuacuuugacuuuuugcauu

SEQ ID NO: 1473915 - RNA, 21 nt, Human
cuacuuugacuuuuugcauuu

SEQ ID NO: 1473916 - RNA, 22 nt, Human
cuacuuauuguagcauccugga

SEQ ID NO: 1473917 - RNA, 16 nt, Human
cuacuuccaaacuaau

SEQ ID NO: 1473918 - RNA, 19 nt, Human
cuacuuccaaacuaauuuu

SEQ ID NO: 1473919 - RNA, 21 nt, Human
cuacuguaaggcaaucauggu

SEQ ID NO: 1473920 - RNA, 13 nt, Human
cuacugaagcccu

SEQ ID NO: 1473921 - RNA, 14 nt, Human
cuacugaagcccuu

SEQ ID NO: 1473922 - RNA, 15 nt, Human
cuacccuaaccaagu

SEQ ID NO: 1473923 - RNA, 16 nt, Human
cuagcaaaagugcaag

SEQ ID NO: 1473924 - RNA, 17 nt, Human
cuagcaaaagugcaaga

SEQ ID NO: 1473925 - RNA, 24 nt, Human
cuagauugagagaagagacaaaca

SEQ ID NO: 1473926 - RNA, 17 nt, Human
cuacuuugauaugacug

SEQ ID NO: 1473927 - RNA, 21 nt, Human
cuacuuugauaugacuguuuu

SEQ ID NO: 1473928 - RNA, 16 nt, Human
cuagaggaagcagcca

SEQ ID NO: 1473929 - RNA, 15 nt, Human
cuagaggugagaaau

SEQ ID NO: 1473930 - RNA, 17 nt, Human
cuagaggugagaaauuu

SEQ ID NO: 1473931 - RNA, 19 nt, Human
cuagaggugagaaauuuaa

SEQ ID NO: 1473932 - RNA, 22 nt, Human
cuaggacugaauuaugaaacuu

SEQ ID NO: 1473933 - RNA, 20 nt, Human
cuaggacacaguuccuggga

SEQ ID NO: 1473934 - RNA, 16 nt, Human
cuaggaaugaaauccu

SEQ ID NO: 1473935 - RNA, 17 nt, Human
cuaggaaugaaauccug

SEQ ID NO: 1473936 - RNA, 19 nt, Human
cuaggacacaguuccuggg

SEQ ID NO: 1473937 - RNA, 15 nt, Human
cuaggacacaguucc

SEQ ID NO: 1473938 - RNA, 22 nt, Human
cuaggaugugcauucuccagcc

SEQ ID NO: 1473939 - RNA, 13 nt, Human
cuaggcaacauag

SEQ ID NO: 1473940 - RNA, 22 nt, Human
cuaguauuucuaugaaauauua

SEQ ID NO: 1473941 - RNA, 19 nt, Human
cuaguauuucuaugaaaua

SEQ ID NO: 1473942 - RNA, 20 nt, Human
cuaguauuucuaugaaauau

SEQ ID NO: 1473943 - RNA, 23 nt, Human
cuaguauuccagaccugaagaau

SEQ ID NO: 1473944 - RNA, 20 nt, Human
cuaggcaguucaaagcagga

SEQ ID NO: 1473945 - RNA, 20 nt, Human
cuaguguagaauugugcaac

SEQ ID NO: 1473946 - RNA, 13 nt, Human
cuaguguagaauu

SEQ ID NO: 1473947 - RNA, 12 nt, Human
cuaguccuuguu

SEQ ID NO: 1473948 - RNA, 12 nt, Human
cuaucuuugcca

SEQ ID NO: 1473949 - RNA, 18 nt, Human
cuaucuuacuauuucaca

SEQ ID NO: 1473950 - RNA, 19 nt, Human
cuaucuuugccacccucau

SEQ ID NO: 1473951 - RNA, 18 nt, Human
cuaucuuugccacccuca

SEQ ID NO: 1473952 - RNA, 15 nt, Human
cuaucuuugccaccc

SEQ ID NO: 1473953 - RNA, 14 nt, Human
cuaucuuugccacc

SEQ ID NO: 1473954 - RNA, 13 nt, Human
cuaugaaauauua

SEQ ID NO: 1473955 - RNA, 21 nt, Human
cuaucuuugccacccucaugc

SEQ ID NO: 1473956 - RNA, 16 nt, Human
cuaugaaaagcuagaa

SEQ ID NO: 1473957 - RNA, 21 nt, Human
cuaugaaaagcuagaauugag

SEQ ID NO: 1473958 - RNA, 18 nt, Human
cuaugaaauauuauguua

SEQ ID NO: 1473959 - RNA, 21 nt, Human
cuaucaaccccagacacuggu

SEQ ID NO: 1473960 - RNA, 17 nt, Human
cuaucaaccccagacac

SEQ ID NO: 1473961 - RNA, 19 nt, Human
cuaucaaccccagacacug

SEQ ID NO: 1473962 - RNA, 20 nt, Human
cuaucaaccccagacacugg

SEQ ID NO: 1473963 - RNA, 19 nt, Human
cuauauuguuugcuaagca

SEQ ID NO: 1473964 - RNA, 13 nt, Human
cucacauuuauau

SEQ ID NO: 1473965 - RNA, 22 nt, Human
cucacaugauuccagccaucac

SEQ ID NO: 1473966 - RNA, 15 nt, Human
cucacccauccuaga

SEQ ID NO: 1473967 - RNA, 14 nt, Human
cucacccauccuag

SEQ ID NO: 1473968 - RNA, 18 nt, Human
cucacaugauuccagcca

SEQ ID NO: 1473969 - RNA, 17 nt, Human
cucacccauccuagagg

SEQ ID NO: 1473970 - RNA, 22 nt, Human
cuauuuuaauaaacacucuuga

SEQ ID NO: 1473971 - RNA, 18 nt, Human
cuauuuuaauaaacacuc

SEQ ID NO: 1473972 - RNA, 22 nt, Human
cuauuuguugaugcuuguguca

SEQ ID NO: 1473973 - RNA, 12 nt, Human
cuauuuucagau

SEQ ID NO: 1473974 - RNA, 18 nt, Human
cuauuuucagaugugaac

SEQ ID NO: 1473975 - RNA, 22 nt, Human
cuauuuucagaugugaaccauu

SEQ ID NO: 1473976 - RNA, 12 nt, Human
cuauuuuguaaa

SEQ ID NO: 1473977 - RNA, 19 nt, Human
cuauuuuguaaacucaaaa

SEQ ID NO: 1473978 - RNA, 13 nt, Human
cucaacugccuac

SEQ ID NO: 1473979 - RNA, 15 nt, Human
cucaacugccuacuc

SEQ ID NO: 1473980 - RNA, 23 nt, Human
cucaacugccuacuccaaaaugu

SEQ ID NO: 1473981 - RNA, 19 nt, Human
cucaagagaucccaaguag

SEQ ID NO: 1473982 - RNA, 17 nt, Human
cucaagcugcaucuaga

SEQ ID NO: 1473983 - RNA, 21 nt, Human
cuaugaccucgcccuccacaa

SEQ ID NO: 1473984 - RNA, 15 nt, Human
cuaacaugauuuggg

SEQ ID NO: 1473985 - RNA, 23 nt, Human
cuaacacggugcucauuuuuucu

SEQ ID NO: 1473986 - RNA, 20 nt, Human
cuaaauauuaugagaugcug

SEQ ID NO: 1473987 - RNA, 20 nt, Human
cuaaauauauuuuaagacga

SEQ ID NO: 1473988 - RNA, 18 nt, Human
cuaaauauauuuuaagac

SEQ ID NO: 1473989 - RNA, 16 nt, Human
cguuguccucagcccc

SEQ ID NO: 1473990 - RNA, 17 nt, Human
cguuuaagccaaaacaa

SEQ ID NO: 1473991 - RNA, 18 nt, Human
cguuuaagccaaaacaau

SEQ ID NO: 1473992 - RNA, 22 nt, Human
cguuuaagccaaaacaauguuu

SEQ ID NO: 1473993 - RNA, 13 nt, Human
cuaaacaucauuc

SEQ ID NO: 1473994 - RNA, 18 nt, Human
cuaaacacgugacacaaa

SEQ ID NO: 1473995 - RNA, 17 nt, Human
cuaaacacgugacacaa

SEQ ID NO: 1473996 - RNA, 23 nt, Human
cuaaacaucauucauuuuuguug

SEQ ID NO: 1473997 - RNA, 13 nt, Human
cuaaaagaaacuu

SEQ ID NO: 1473998 - RNA, 14 nt, Human
cuaaaagaaacuuu

SEQ ID NO: 1473999 - RNA, 19 nt, Human
cguggacaccugcccugcc

SEQ ID NO: 1474000 - RNA, 18 nt, Human
cguggacaccugcccugc

SEQ ID NO: 1474001 - RNA, 17 nt, Human
cguggacaccugcccug

SEQ ID NO: 1474002 - RNA, 15 nt, Human
cguggacaccugccc

SEQ ID NO: 1474003 - RNA, 14 nt, Human
cguggacaccugcc

SEQ ID NO: 1474004 - RNA, 13 nt, Human
cguggacaccugc

SEQ ID NO: 1474005 - RNA, 12 nt, Human
cguggacaccug

SEQ ID NO: 1474006 - RNA, 14 nt, Human
cgugggcauugucu

SEQ ID NO: 1474007 - RNA, 23 nt, Human
cguggcuguggcauccagagucc

SEQ ID NO: 1474008 - RNA, 17 nt, Human
cggugagcuacaaaugc

SEQ ID NO: 1474009 - RNA, 16 nt, Human
cggguugugugucugu

SEQ ID NO: 1474010 - RNA, 17 nt, Human
cggguugugugucuguu

SEQ ID NO: 1474011 - RNA, 14 nt, Human
cggggacucagccc

SEQ ID NO: 1474012 - RNA, 17 nt, Human
cggggccugggcaggag

SEQ ID NO: 1474013 - RNA, 19 nt, Human
cggggccugggcaggaggg

SEQ ID NO: 1474014 - RNA, 19 nt, Human
cgggggaggguaggcagga

SEQ ID NO: 1474015 - RNA, 17 nt, Human
cgggggcagucugagag

SEQ ID NO: 1474016 - RNA, 18 nt, Human
cgggggcagucugagaga

SEQ ID NO: 1474017 - RNA, 21 nt, Human
cgggggcagucugagagaggc

SEQ ID NO: 1474018 - RNA, 17 nt, Human
cggggguggcggcggcc

SEQ ID NO: 1474019 - RNA, 21 nt, Human
cggggguggcggcggccccua

SEQ ID NO: 1474020 - RNA, 13 nt, Human
cgggacugcggag

SEQ ID NO: 1474021 - RNA, 17 nt, Human
cgggagccugacccuca

SEQ ID NO: 1474022 - RNA, 12 nt, Human
cggcugggagga

SEQ ID NO: 1474023 - RNA, 17 nt, Human
cggcccacaauuaauuu

SEQ ID NO: 1474024 - RNA, 11 nt, Human
cgcuuuuugaa

SEQ ID NO: 1474025 - RNA, 16 nt, Human
cgcuuuuugaaaaagc

SEQ ID NO: 1474026 - RNA, 16 nt, Human
cgcccuggacugugug

SEQ ID NO: 1474027 - RNA, 17 nt, Human
cgcuguccuuucuagag

SEQ ID NO: 1474028 - RNA, 16 nt, Human
cgcuguccuuucuaga

SEQ ID NO: 1474029 - RNA, 16 nt, Human
cgcgccaggauggcgc

SEQ ID NO: 1474030 - RNA, 21 nt, Human
caguggcgugaucucagcuca

SEQ ID NO: 1474031 - RNA, 21 nt, Human
caguggcgcgaucucagcuca

SEQ ID NO: 1474032 - RNA, 21 nt, Human
caguggcaucaucucagcuca

SEQ ID NO: 1474033 - RNA, 18 nt, Human
cagugggaaaaauguagg

SEQ ID NO: 1474034 - RNA, 19 nt, Human
cagugggaaaaauguagga

SEQ ID NO: 1474035 - RNA, 17 nt, Human
caguguauggaaauaaa

SEQ ID NO: 1474036 - RNA, 20 nt, Human
caguguccuuggcaggcuga

SEQ ID NO: 1474037 - RNA, 21 nt, Human
caguguguggcuuucagagcc

SEQ ID NO: 1474038 - RNA, 22 nt, Human
caguguguggcuuucagagccu

SEQ ID NO: 1474039 - RNA, 24 nt, Human
caguuaacuauugcauuuauaugu

SEQ ID NO: 1474040 - RNA, 21 nt, Human
caguuaacuauugcauuuaua

SEQ ID NO: 1474041 - RNA, 21 nt, Human
caguuaccucugccucagaaa

SEQ ID NO: 1474042 - RNA, 22 nt, Human
caguuacauaauucacucugag

SEQ ID NO: 1474043 - RNA, 15 nt, Human
caguuccugggaaca

SEQ ID NO: 1474044 - RNA, 15 nt, Human
caguucugaagaaga

SEQ ID NO: 1474045 - RNA, 16 nt, Human
caguucugaagaagau

SEQ ID NO: 1474046 - RNA, 22 nt, Human
caguucugaagaagaugguacc

SEQ ID NO: 1474047 - RNA, 13 nt, Human
caguucugaagaa

SEQ ID NO: 1474048 - RNA, 14 nt, Human
caguucugaagaag

SEQ ID NO: 1474049 - RNA, 12 nt, Human
caguucugaaga

SEQ ID NO: 1474050 - RNA, 22 nt, Human
caguucggugagcuacaaaugc

SEQ ID NO: 1474051 - RNA, 15 nt, Human
cauaauacuugcuuu

SEQ ID NO: 1474052 - RNA, 18 nt, Human
cauaauccaguaaaauaa

SEQ ID NO: 1474053 - RNA, 17 nt, Human
cauaauccaguaaaaua

SEQ ID NO: 1474054 - RNA, 14 nt, Human
cauacauuuucuaa

SEQ ID NO: 1474055 - RNA, 16 nt, Human
cauacauuuucuaaga

SEQ ID NO: 1474056 - RNA, 18 nt, Human
cauacauuuucuaagaaa

SEQ ID NO: 1474057 - RNA, 18 nt, Human
cauaagcuuaugcuuaaa

SEQ ID NO: 1474058 - RNA, 19 nt, Human
cauaaguauuaugucucuu

SEQ ID NO: 1474059 - RNA, 11 nt, Human
cauaacugaaa

SEQ ID NO: 1474060 - RNA, 14 nt, Human
cauaacugaaaaug

SEQ ID NO: 1474061 - RNA, 17 nt, Human
cauaagauauuuuucau

SEQ ID NO: 1474062 - RNA, 11 nt, Human
cauaaauuauu

SEQ ID NO: 1474063 - RNA, 12 nt, Human
cauaaauuauug

SEQ ID NO: 1474064 - RNA, 21 nt, Human
cauaaaguugauaaagauuuu

SEQ ID NO: 1474065 - RNA, 19 nt, Human
cauaaauuuaguauuuugu

SEQ ID NO: 1474066 - RNA, 20 nt, Human
cauaaauuuaguauuuuguu

SEQ ID NO: 1474067 - RNA, 15 nt, Human
cauaacaacuucaua

SEQ ID NO: 1474068 - RNA, 18 nt, Human
cauaaccuuaccagauuu

SEQ ID NO: 1474069 - RNA, 16 nt, Human
cauaaagcaggcagaa

SEQ ID NO: 1474070 - RNA, 14 nt, Human
cauaaagcaggcag

SEQ ID NO: 1474071 - RNA, 21 nt, Human
cauaaaaaggacaucagcaaa

SEQ ID NO: 1474072 - RNA, 20 nt, Human
cauaaaaaggacaucagcaa

SEQ ID NO: 1474073 - RNA, 19 nt, Human
cauaaaaaggacaucagca

SEQ ID NO: 1474074 - RNA, 13 nt, Human
cauaaaaaggaca

SEQ ID NO: 1474075 - RNA, 22 nt, Human
cauaaaaaggacaucagcaaac

SEQ ID NO: 1474076 - RNA, 15 nt, Human
cauaaaaaugaucua

SEQ ID NO: 1474077 - RNA, 11 nt, Human
caguugcagcc

SEQ ID NO: 1474078 - RNA, 18 nt, Human
caguugagacaagaaaau

SEQ ID NO: 1474079 - RNA, 16 nt, Human
caguugagacaagaaa

SEQ ID NO: 1474080 - RNA, 16 nt, Human
caguugauuuucugga

SEQ ID NO: 1474081 - RNA, 17 nt, Human
caguugauuuucuggau

SEQ ID NO: 1474082 - RNA, 14 nt, Human
caguugaauuucau

SEQ ID NO: 1474083 - RNA, 19 nt, Human
caguuuuuucaccuggaag

SEQ ID NO: 1474084 - RNA, 12 nt, Human
caguuguccucc

SEQ ID NO: 1474085 - RNA, 15 nt, Human
caguuguccuccuuc

SEQ ID NO: 1474086 - RNA, 22 nt, Human
caguuggaguuuuuuguaccaa

SEQ ID NO: 1474087 - RNA, 12 nt, Human
cauauuuucaug

SEQ ID NO: 1474088 - RNA, 22 nt, Human
caucaagucuuucacauuuaaa

SEQ ID NO: 1474089 - RNA, 17 nt, Human
caucaagagacugaguc

SEQ ID NO: 1474090 - RNA, 16 nt, Human
caucaauuaaaggcaa

SEQ ID NO: 1474091 - RNA, 12 nt, Human
caucacagaaug

SEQ ID NO: 1474092 - RNA, 17 nt, Human
cauauuuauaaaaauaa

SEQ ID NO: 1474093 - RNA, 12 nt, Human
cauauuuauaaa

SEQ ID NO: 1474094 - RNA, 20 nt, Human
cauagaauaaaauuuuuaau

SEQ ID NO: 1474095 - RNA, 15 nt, Human
cauagacagaagaaa

SEQ ID NO: 1474096 - RNA, 20 nt, Human
cauagacagaagaaacaagg

SEQ ID NO: 1474097 - RNA, 14 nt, Human
cauagaauaaaauu

SEQ ID NO: 1474098 - RNA, 23 nt, Human
cauagaaauguaacuuuuguaag

SEQ ID NO: 1474099 - RNA, 19 nt, Human
cauagacagaagaaacaag

SEQ ID NO: 1474100 - RNA, 18 nt, Human
cauagagacuugggaaug

SEQ ID NO: 1474101 - RNA, 22 nt, Human
cauacuuuuuaaauguaaagau

SEQ ID NO: 1474102 - RNA, 16 nt, Human
cauacuuuuuaaaugu

SEQ ID NO: 1474103 - RNA, 20 nt, Human
cauacuuuuuaaauguaaag

SEQ ID NO: 1474104 - RNA, 22 nt, Human
cauacucauuuuucaugauaau

SEQ ID NO: 1474105 - RNA, 21 nt, Human
cauaugauguacauguacuga

SEQ ID NO: 1474106 - RNA, 17 nt, Human
cauaugauguacaugua

SEQ ID NO: 1474107 - RNA, 15 nt, Human
cauaugauguacaug

SEQ ID NO: 1474108 - RNA, 18 nt, Human
cauauccaguauuguucc

SEQ ID NO: 1474109 - RNA, 14 nt, Human
cauauauauacuau

SEQ ID NO: 1474110 - RNA, 17 nt, Human
cauauacagcucagaag

SEQ ID NO: 1474111 - RNA, 17 nt, Human
cauauauauacuauuaa

SEQ ID NO: 1474112 - RNA, 12 nt, Human
cauauaaaguau

SEQ ID NO: 1474113 - RNA, 16 nt, Human
caucucuuguuuaaau

SEQ ID NO: 1474114 - RNA, 14 nt, Human
caucugagaaaagc

SEQ ID NO: 1474115 - RNA, 23 nt, Human
caucugagaaaagcuuugaaccc

SEQ ID NO: 1474116 - RNA, 18 nt, Human
caucuugcccgcucaggc

SEQ ID NO: 1474117 - RNA, 20 nt, Human
caucuugcccgcucaggcug

SEQ ID NO: 1474118 - RNA, 19 nt, Human
caucuugcccgcucaggcu

SEQ ID NO: 1474119 - RNA, 17 nt, Human
caucuagguaaauuaca

SEQ ID NO: 1474120 - RNA, 18 nt, Human
caucuagguaaauuacag

SEQ ID NO: 1474121 - RNA, 14 nt, Human
caucuagugagcag

SEQ ID NO: 1474122 - RNA, 12 nt, Human
caucuaggauuu

SEQ ID NO: 1474123 - RNA, 20 nt, Human
caucuagaggcuuccuucau

SEQ ID NO: 1474124 - RNA, 21 nt, Human
caucuagaggcuuccuucauu

SEQ ID NO: 1474125 - RNA, 22 nt, Human
caucuagaggcuuccuucauuu

SEQ ID NO: 1474126 - RNA, 23 nt, Human
caucuagaggcuuccuucauuuc

SEQ ID NO: 1474127 - RNA, 19 nt, Human
caucuagaggcuuccuuca

SEQ ID NO: 1474128 - RNA, 11 nt, Human
cauccucucca

SEQ ID NO: 1474129 - RNA, 17 nt, Human
caucuauagaaagcuau

SEQ ID NO: 1474130 - RNA, 22 nt, Human
caucuagugagcagucaggaaa

SEQ ID NO: 1474131 - RNA, 20 nt, Human
caucucagcucacugcaacc

SEQ ID NO: 1474132 - RNA, 19 nt, Human
caucucagcucacugcaac

SEQ ID NO: 1474133 - RNA, 14 nt, Human
caucucaggccaga

SEQ ID NO: 1474134 - RNA, 17 nt, Human
caucucaggccagagcc

SEQ ID NO: 1474135 - RNA, 18 nt, Human
caucucaggccagagcca

SEQ ID NO: 1474136 - RNA, 21 nt, Human
caucucagugaagaauacuuc

SEQ ID NO: 1474137 - RNA, 22 nt, Human
caucucagugaagaauacuucu

SEQ ID NO: 1474138 - RNA, 19 nt, Human
cauccuacccccugugccu

SEQ ID NO: 1474139 - RNA, 13 nt, Human
cauccagggggca

SEQ ID NO: 1474140 - RNA, 23 nt, Human
cauccagcagauuuccagccuuc

SEQ ID NO: 1474141 - RNA, 20 nt, Human
caucccucacccauccuaga

SEQ ID NO: 1474142 - RNA, 14 nt, Human
caucccucacccau

SEQ ID NO: 1474143 - RNA, 13 nt, Human
caucccucaccca

SEQ ID NO: 1474144 - RNA, 20 nt, Human
caucauuucuuuuugggaga

SEQ ID NO: 1474145 - RNA, 14 nt, Human
caucauuuuuuacu

SEQ ID NO: 1474146 - RNA, 15 nt, Human
cauuacuauaagaac

SEQ ID NO: 1474147 - RNA, 16 nt, Human
cauuagacuggaacuu

SEQ ID NO: 1474148 - RNA, 20 nt, Human
cauuagacuggaacuugaac

SEQ ID NO: 1474149 - RNA, 12 nt, Human
cauuaaucugcc

SEQ ID NO: 1474150 - RNA, 18 nt, Human
cauuaaucugccucccuc

SEQ ID NO: 1474151 - RNA, 17 nt, Human
caugugaaaucauucau

SEQ ID NO: 1474152 - RNA, 16 nt, Human
caugugaaaucauuca

SEQ ID NO: 1474153 - RNA, 15 nt, Human
caugugaaaucauuc

SEQ ID NO: 1474154 - RNA, 17 nt, Human
cauguccuucugagccc

SEQ ID NO: 1474155 - RNA, 17 nt, Human
cauguaagcugaaaaua

SEQ ID NO: 1474156 - RNA, 23 nt, Human
cauguaagcugaaaauauggcaa

SEQ ID NO: 1474157 - RNA, 18 nt, Human
cauguaagcugaaaauau

SEQ ID NO: 1474158 - RNA, 21 nt, Human
cauguuucuuuguaaugaaaa

SEQ ID NO: 1474159 - RNA, 21 nt, Human
caugugugguacaugguguuu

SEQ ID NO: 1474160 - RNA, 22 nt, Human
cauguuucuuuguaaugaaaac

SEQ ID NO: 1474161 - RNA, 23 nt, Human
cauggacacuacacccagcaaua

SEQ ID NO: 1474162 - RNA, 22 nt, Human
cauggacacuacacccagcaau

SEQ ID NO: 1474163 - RNA, 23 nt, Human
cauggaaggcaagauuguguccc

SEQ ID NO: 1474164 - RNA, 14 nt, Human
cauggaaggcaaga

SEQ ID NO: 1474165 - RNA, 13 nt, Human
cauggaaggcaag

SEQ ID NO: 1474166 - RNA, 21 nt, Human
cauggacacuacacccagcaa

SEQ ID NO: 1474167 - RNA, 15 nt, Human
caugcuucccuuucc

SEQ ID NO: 1474168 - RNA, 20 nt, Human
caugcuucccuuuccugagu

SEQ ID NO: 1474169 - RNA, 23 nt, Human
caugcugucuacacuaagagaga

SEQ ID NO: 1474170 - RNA, 19 nt, Human
caugcuaagagaaguagaa

SEQ ID NO: 1474171 - RNA, 16 nt, Human
caugcguguuucugac

SEQ ID NO: 1474172 - RNA, 17 nt, Human
caugcguguuucugacu

SEQ ID NO: 1474173 - RNA, 13 nt, Human
caugcuaagagaa

SEQ ID NO: 1474174 - RNA, 16 nt, Human
caugcuaagagaagua

SEQ ID NO: 1474175 - RNA, 17 nt, Human
caugcuaagagaaguag

SEQ ID NO: 1474176 - RNA, 21 nt, Human
caugcuaagagaaguagaaau

SEQ ID NO: 1474177 - RNA, 17 nt, Human
cauggagauucucauaa

SEQ ID NO: 1474178 - RNA, 18 nt, Human
cauggauauaguuuuacu

SEQ ID NO: 1474179 - RNA, 17 nt, Human
caugcauggaaauuccc

SEQ ID NO: 1474180 - RNA, 16 nt, Human
caugcauguccuguaa

SEQ ID NO: 1474181 - RNA, 15 nt, Human
caugcauggaaauuc

SEQ ID NO: 1474182 - RNA, 17 nt, Human
caugcauguccuguaaa

SEQ ID NO: 1474183 - RNA, 18 nt, Human
caugcauguccuguaaag

SEQ ID NO: 1474184 - RNA, 21 nt, Human
caugcauguccuguaaagguu

SEQ ID NO: 1474185 - RNA, 15 nt, Human
caugcauuacugcau

SEQ ID NO: 1474186 - RNA, 17 nt, Human
caugcauuacugcaugc

SEQ ID NO: 1474187 - RNA, 20 nt, Human
caugcauuacugcaugcacu

SEQ ID NO: 1474188 - RNA, 15 nt, Human
caugcauuguccucu

SEQ ID NO: 1474189 - RNA, 16 nt, Human
caugccaggcuaauuu

SEQ ID NO: 1474190 - RNA, 18 nt, Human
caugccaggcuaauuuuu

SEQ ID NO: 1474191 - RNA, 15 nt, Human
caugcauacacucuc

SEQ ID NO: 1474192 - RNA, 13 nt, Human
caugcaucuguuu

SEQ ID NO: 1474193 - RNA, 15 nt, Human
caugcaucuguuuau

SEQ ID NO: 1474194 - RNA, 22 nt, Human
caugcaucuguuuauucuauag

SEQ ID NO: 1474195 - RNA, 21 nt, Human
cauugaccuauuuccagaaau

SEQ ID NO: 1474196 - RNA, 15 nt, Human
cauugaccuauuucc

SEQ ID NO: 1474197 - RNA, 15 nt, Human
cauuuccuaaauaua

SEQ ID NO: 1474198 - RNA, 15 nt, Human
cauuugcucauggaa

SEQ ID NO: 1474199 - RNA, 16 nt, Human
cauuugcucauggaau

SEQ ID NO: 1474200 - RNA, 18 nt, Human
cauuugcucauggaauug

SEQ ID NO: 1474201 - RNA, 16 nt, Human
cauuuuaacaucugag

SEQ ID NO: 1474202 - RNA, 16 nt, Human
cauuuugguacuuugg

SEQ ID NO: 1474203 - RNA, 14 nt, Human
cauuuugguacuuu

SEQ ID NO: 1474204 - RNA, 20 nt, Human
ccaaaaguuacauguuugca

SEQ ID NO: 1474205 - RNA, 20 nt, Human
ccaaaaucauaagauauuuu

SEQ ID NO: 1474206 - RNA, 14 nt, Human
ccaaacuaauuuuu

SEQ ID NO: 1474207 - RNA, 19 nt, Human
ccaaagaaccaaagaagaa

SEQ ID NO: 1474208 - RNA, 15 nt, Human
ccaaagaaccaaaga

SEQ ID NO: 1474209 - RNA, 17 nt, Human
ccacaacuauuuucaga

SEQ ID NO: 1474210 - RNA, 22 nt, Human
ccacaaaugggaaaaccagacu

SEQ ID NO: 1474211 - RNA, 15 nt, Human
ccacaacuauuuuca

SEQ ID NO: 1474212 - RNA, 19 nt, Human
ccaauuucaaguuccaagu

SEQ ID NO: 1474213 - RNA, 14 nt, Human
ccacaaacuguaau

SEQ ID NO: 1474214 - RNA, 22 nt, Human
ccaagagcuacguauuuaauag

SEQ ID NO: 1474215 - RNA, 23 nt, Human
ccaacaugcacugauguuguguu

SEQ ID NO: 1474216 - RNA, 13 nt, Human
ccaacaugcacug

SEQ ID NO: 1474217 - RNA, 17 nt, Human
ccaacaugcacugaugu

SEQ ID NO: 1474218 - RNA, 21 nt, Human
ccaacaugcacugauguugug

SEQ ID NO: 1474219 - RNA, 21 nt, Human
ccaagacaugucuguucuaca

SEQ ID NO: 1474220 - RNA, 23 nt, Human
ccaagacaugucuguucuacaua

SEQ ID NO: 1474221 - RNA, 15 nt, Human
ccaaccuguuaccua

SEQ ID NO: 1474222 - RNA, 13 nt, Human
ccaaagcacauuu

SEQ ID NO: 1474223 - RNA, 15 nt, Human
ccaacauaaaaauga

SEQ ID NO: 1474224 - RNA, 18 nt, Human
ccaucagaaacacccuca

SEQ ID NO: 1474225 - RNA, 20 nt, Human
ccaucagaaacacccucaca

SEQ ID NO: 1474226 - RNA, 11 nt, Human
ccaucucaggc

SEQ ID NO: 1474227 - RNA, 18 nt, Human
ccaucucaggccagagcc

SEQ ID NO: 1474228 - RNA, 14 nt, Human
ccaucucaggccag

SEQ ID NO: 1474229 - RNA, 13 nt, Human
ccaucaaccucug

SEQ ID NO: 1474230 - RNA, 18 nt, Human
ccaucaccuuagaccacc

SEQ ID NO: 1474231 - RNA, 23 nt, Human
ccaucaccuuagaccaccaagcc

SEQ ID NO: 1474232 - RNA, 18 nt, Human
ccaucacugaguuuucca

SEQ ID NO: 1474233 - RNA, 19 nt, Human
ccaucaccuuagaccacca

SEQ ID NO: 1474234 - RNA, 23 nt, Human
ccagugggaggugagaccaccuc

SEQ ID NO: 1474235 - RNA, 20 nt, Human
ccagugggaggugagaccac

SEQ ID NO: 1474236 - RNA, 22 nt, Human
ccagugcugaauuucccucucu

SEQ ID NO: 1474237 - RNA, 12 nt, Human
ccagugcugaau

SEQ ID NO: 1474238 - RNA, 14 nt, Human
ccagggaccggcgg

SEQ ID NO: 1474239 - RNA, 15 nt, Human
ccagggacucugccg

SEQ ID NO: 1474240 - RNA, 20 nt, Human
ccagggacaccugggagaaa

SEQ ID NO: 1474241 - RNA, 18 nt, Human
ccagggacaccugggaga

SEQ ID NO: 1474242 - RNA, 14 nt, Human
ccagcugugcuuau

SEQ ID NO: 1474243 - RNA, 15 nt, Human
ccagcugugcuuaug

SEQ ID NO: 1474244 - RNA, 21 nt, Human
ccagcugugcuuaugguacca

SEQ ID NO: 1474245 - RNA, 11 nt, Human
ccaggacccca

SEQ ID NO: 1474246 - RNA, 10 nt, Human
cccaggacag

SEQ ID NO: 1474247 - RNA, 17 nt, Human
cccaggacaggauccag

SEQ ID NO: 1474248 - RNA, 12 nt, Human
cccaggacccca

SEQ ID NO: 1474249 - RNA, 20 nt, Human
cccaggaccccauggcagug

SEQ ID NO: 1474250 - RNA, 15 nt, Human
cccaggagacaguuc

SEQ ID NO: 1474251 - RNA, 17 nt, Human
cccaggagacaguucaa

SEQ ID NO: 1474252 - RNA, 14 nt, Human
cccagagccacagu

SEQ ID NO: 1474253 - RNA, 13 nt, Human
cccagagccacag

SEQ ID NO: 1474254 - RNA, 20 nt, Human
ccauucauuccauucuggaa

SEQ ID NO: 1474255 - RNA, 20 nt, Human
ccauguuggccaggaugguc

SEQ ID NO: 1474256 - RNA, 18 nt, Human
ccauucauuccauucugg

SEQ ID NO: 1474257 - RNA, 15 nt, Human
ccauucccccagugc

SEQ ID NO: 1474258 - RNA, 16 nt, Human
ccauucccccagugcg

SEQ ID NO: 1474259 - RNA, 13 nt, Human
cccacgccacagc

SEQ ID NO: 1474260 - RNA, 17 nt, Human
cccacgccacagcccuu

SEQ ID NO: 1474261 - RNA, 16 nt, Human
cccacgccacagcccu

SEQ ID NO: 1474262 - RNA, 15 nt, Human
cccacgccacagccc

SEQ ID NO: 1474263 - RNA, 14 nt, Human
cccacgccacagcc

SEQ ID NO: 1474264 - RNA, 16 nt, Human
cccagacacugguuug

SEQ ID NO: 1474265 - RNA, 23 nt, Human
ccauggacacuacacccagcaau

SEQ ID NO: 1474266 - RNA, 22 nt, Human
ccauggacacuacacccagcaa

SEQ ID NO: 1474267 - RNA, 21 nt, Human
ccauggacacuacacccagca

SEQ ID NO: 1474268 - RNA, 20 nt, Human
ccauggacacuacacccagc

SEQ ID NO: 1474269 - RNA, 19 nt, Human
ccauggacacuacacccag

SEQ ID NO: 1474270 - RNA, 14 nt, Human
ccauggcaggaagg

SEQ ID NO: 1474271 - RNA, 14 nt, Human
ccaugcugcugggg

SEQ ID NO: 1474272 - RNA, 19 nt, Human
ccaugcugcuggggaagac

SEQ ID NO: 1474273 - RNA, 20 nt, Human
ccaugcugcuggggaagaca

SEQ ID NO: 1474274 - RNA, 17 nt, Human
cccaugucuacacagau

SEQ ID NO: 1474275 - RNA, 22 nt, Human
ccccaaaggcuuugcccugcug

SEQ ID NO: 1474276 - RNA, 20 nt, Human
ccccaacuacccccagcugu

SEQ ID NO: 1474277 - RNA, 11 nt, Human
cccaucucagg

SEQ ID NO: 1474278 - RNA, 16 nt, Human
cccaucucaggccaga

SEQ ID NO: 1474279 - RNA, 23 nt, Human
cccaucucaggccagagccaagg

SEQ ID NO: 1474280 - RNA, 15 nt, Human
cccaguaacucaucu

SEQ ID NO: 1474281 - RNA, 21 nt, Human
cccaguaccuagcuggcucug

SEQ ID NO: 1474282 - RNA, 21 nt, Human
ccuccaggguggcagcaacaa

SEQ ID NO: 1474283 - RNA, 20 nt, Human
ccuccaggguggcagcaaca

SEQ ID NO: 1474284 - RNA, 17 nt, Human
ccuccauccuacccccu

SEQ ID NO: 1474285 - RNA, 12 nt, Human
ccuccaucccug

SEQ ID NO: 1474286 - RNA, 22 nt, Human
ccuccauccuacccccugugcc

SEQ ID NO: 1474287 - RNA, 23 nt, Human
ccuccauccuacccccugugccu

SEQ ID NO: 1474288 - RNA, 14 nt, Human
ccuccaucccuggc

SEQ ID NO: 1474289 - RNA, 16 nt, Human
ccuccaucccuggccc

SEQ ID NO: 1474290 - RNA, 17 nt, Human
ccuccaucccuggcccc

SEQ ID NO: 1474291 - RNA, 15 nt, Human
ccuccacucuuucuu

SEQ ID NO: 1474292 - RNA, 20 nt, Human
ccuccacucuuucuuucaau

SEQ ID NO: 1474293 - RNA, 14 nt, Human
ccuccccuccaucc

SEQ ID NO: 1474294 - RNA, 20 nt, Human
ccuccccuccaucccuggcc

SEQ ID NO: 1474295 - RNA, 16 nt, Human
ccuccccuccaucccu

SEQ ID NO: 1474296 - RNA, 15 nt, Human
ccucccccuccucuc

SEQ ID NO: 1474297 - RNA, 13 nt, Human
ccucccccugcca

SEQ ID NO: 1474298 - RNA, 14 nt, Human
ccucccccugccag

SEQ ID NO: 1474299 - RNA, 16 nt, Human
ccucccccugccagga

SEQ ID NO: 1474300 - RNA, 14 nt, Human
ccucccccuguccc

SEQ ID NO: 1474301 - RNA, 15 nt, Human
ccuccccgcaccccc

SEQ ID NO: 1474302 - RNA, 21 nt, Human
ccuccccgcaccccccaagcu

SEQ ID NO: 1474303 - RNA, 22 nt, Human
ccucccucucguaagauuuccu

SEQ ID NO: 1474304 - RNA, 22 nt, Human
ccucguggacaccugcccugcc

SEQ ID NO: 1474305 - RNA, 21 nt, Human
ccucguggacaccugcccugc

SEQ ID NO: 1474306 - RNA, 20 nt, Human
ccucguggacaccugcccug

SEQ ID NO: 1474307 - RNA, 18 nt, Human
ccucguggacaccugccc

SEQ ID NO: 1474308 - RNA, 17 nt, Human
ccucguggacaccugcc

SEQ ID NO: 1474309 - RNA, 16 nt, Human
ccucguggacaccugc

SEQ ID NO: 1474310 - RNA, 15 nt, Human
ccucguggacaccug

SEQ ID NO: 1474311 - RNA, 16 nt, Human
ccuccuuggugauucc

SEQ ID NO: 1474312 - RNA, 14 nt, Human
ccuccucuccacca

SEQ ID NO: 1474313 - RNA, 15 nt, Human
ccuccucuccaccau

SEQ ID NO: 1474314 - RNA, 20 nt, Human
ccucugagaagcucugaaga

SEQ ID NO: 1474315 - RNA, 18 nt, Human
ccucaccagcccuggcaa

SEQ ID NO: 1474316 - RNA, 15 nt, Human
ccucagggacucagg

SEQ ID NO: 1474317 - RNA, 16 nt, Human
ccucagggacucaggu

SEQ ID NO: 1474318 - RNA, 18 nt, Human
ccucagccccgcguggaa

SEQ ID NO: 1474319 - RNA, 23 nt, Human
ccuauucaacacacacaugcuuc

SEQ ID NO: 1474320 - RNA, 21 nt, Human
ccuauucaacacacacaugcu

SEQ ID NO: 1474321 - RNA, 15 nt, Human
ccucacacugggacu

SEQ ID NO: 1474322 - RNA, 13 nt, Human
ccucacacuggga

SEQ ID NO: 1474323 - RNA, 12 nt, Human
ccucacacuggg

SEQ ID NO: 1474324 - RNA, 20 nt, Human
ccuagacucugucuaccugg

SEQ ID NO: 1474325 - RNA, 16 nt, Human
ccggaucugagggaga

SEQ ID NO: 1474326 - RNA, 16 nt, Human
ccggcuuuguggcacu

SEQ ID NO: 1474327 - RNA, 17 nt, Human
ccggcuuuguggcacug

SEQ ID NO: 1474328 - RNA, 19 nt, Human
ccggcuuuguggcacuggg

SEQ ID NO: 1474329 - RNA, 20 nt, Human
ccggacucaagccccggacu

SEQ ID NO: 1474330 - RNA, 13 nt, Human
ccgggagcucagg

SEQ ID NO: 1474331 - RNA, 15 nt, Human
ccgggagcucaggaa

SEQ ID NO: 1474332 - RNA, 15 nt, Human
ccggggccugggcag

SEQ ID NO: 1474333 - RNA, 19 nt, Human
ccggggccugggcaggagg

SEQ ID NO: 1474334 - RNA, 16 nt, Human
cccuucaucuggaacc

SEQ ID NO: 1474335 - RNA, 14 nt, Human
cccuucaucuggaa

SEQ ID NO: 1474336 - RNA, 16 nt, Human
cccuucaugcauggaa

SEQ ID NO: 1474337 - RNA, 19 nt, Human
cccuugacaacuggcaggc

SEQ ID NO: 1474338 - RNA, 12 nt, Human
cccuugaacucu

SEQ ID NO: 1474339 - RNA, 17 nt, Human
cccuugacaacuggcag

SEQ ID NO: 1474340 - RNA, 18 nt, Human
cccuugacaacuggcagg

SEQ ID NO: 1474341 - RNA, 21 nt, Human
cccuugacaacuggcaggcag

SEQ ID NO: 1474342 - RNA, 21 nt, Human
cccuugugaaucaagggucag

SEQ ID NO: 1474343 - RNA, 13 nt, Human
ccuaaacauauga

SEQ ID NO: 1474344 - RNA, 20 nt, Human
ccgugugggagaccggccug

SEQ ID NO: 1474345 - RNA, 22 nt, Human
ccuagguauaauucacauugua

SEQ ID NO: 1474346 - RNA, 19 nt, Human
ccuacaugaaacagaaaca

SEQ ID NO: 1474347 - RNA, 13 nt, Human
ccuacugcccagg

SEQ ID NO: 1474348 - RNA, 20 nt, Human
ccuacugcccaggcacugca

SEQ ID NO: 1474349 - RNA, 16 nt, Human
ccuacugcccaggcac

SEQ ID NO: 1474350 - RNA, 18 nt, Human
cccugccucucugcaggu

SEQ ID NO: 1474351 - RNA, 11 nt, Human
cccugccucuc

SEQ ID NO: 1474352 - RNA, 18 nt, Human
cccugccaccuccugccu

SEQ ID NO: 1474353 - RNA, 22 nt, Human
cccugccaggagcuuuggaccu

SEQ ID NO: 1474354 - RNA, 17 nt, Human
cccugccaccuccugcc

SEQ ID NO: 1474355 - RNA, 14 nt, Human
cccugccaccuccu

SEQ ID NO: 1474356 - RNA, 22 nt, Human
cccugccucucugcaggucccu

SEQ ID NO: 1474357 - RNA, 21 nt, Human
cccugccucucugcagguccc

SEQ ID NO: 1474358 - RNA, 12 nt, Human
cccugccucuca

SEQ ID NO: 1474359 - RNA, 12 nt, Human
cccugccuggac

SEQ ID NO: 1474360 - RNA, 13 nt, Human
cccugccuggacc

SEQ ID NO: 1474361 - RNA, 18 nt, Human
cccugccuggaccagccu

SEQ ID NO: 1474362 - RNA, 22 nt, Human
cccuggaaaccuuccacccagu

SEQ ID NO: 1474363 - RNA, 15 nt, Human
cccuggaacugucuc

SEQ ID NO: 1474364 - RNA, 18 nt, Human
cccuggaacugucucuca

SEQ ID NO: 1474365 - RNA, 21 nt, Human
cccuggaaaccuuccacccag

SEQ ID NO: 1474366 - RNA, 19 nt, Human
cccuggaaaccuuccaccc

SEQ ID NO: 1474367 - RNA, 16 nt, Human
cccuggaaaccuucca

SEQ ID NO: 1474368 - RNA, 15 nt, Human
cccuggaaaccuucc

SEQ ID NO: 1474369 - RNA, 17 nt, Human
cccuggacuugccucug

SEQ ID NO: 1474370 - RNA, 18 nt, Human
cccugggaggcucuggag

SEQ ID NO: 1474371 - RNA, 17 nt, Human
cccugggaggcucugga

SEQ ID NO: 1474372 - RNA, 16 nt, Human
cccugggaggcucugg

SEQ ID NO: 1474373 - RNA, 23 nt, Human
cccuggguagcgggggaggguag

SEQ ID NO: 1474374 - RNA, 12 nt, Human
cccucaugcugu

SEQ ID NO: 1474375 - RNA, 14 nt, Human
cccucaucuuucuu

SEQ ID NO: 1474376 - RNA, 12 nt, Human
cccuccaucccu

SEQ ID NO: 1474377 - RNA, 13 nt, Human
cccuccaucccug

SEQ ID NO: 1474378 - RNA, 14 nt, Human
cccuccaucccugg

SEQ ID NO: 1474379 - RNA, 17 nt, Human
cccuccaucccuggccc

SEQ ID NO: 1474380 - RNA, 22 nt, Human
cccuccaucccuggcccccucc

SEQ ID NO: 1474381 - RNA, 14 nt, Human
cccucccccugcca

SEQ ID NO: 1474382 - RNA, 16 nt, Human
cccuccccgcaccccc

SEQ ID NO: 1474383 - RNA, 17 nt, Human
cccuccccgcacccccc

SEQ ID NO: 1474384 - RNA, 18 nt, Human
cccuccccuccaucccug

SEQ ID NO: 1474385 - RNA, 18 nt, Human
cccuaauaaagcugugug

SEQ ID NO: 1474386 - RNA, 15 nt, Human
cccuaauaaagcugu

SEQ ID NO: 1474387 - RNA, 19 nt, Human
cccuacuucuuuugcucuu

SEQ ID NO: 1474388 - RNA, 18 nt, Human
cccuacuucuuuugcucu

SEQ ID NO: 1474389 - RNA, 17 nt, Human
cccuaagccagcugccc

SEQ ID NO: 1474390 - RNA, 18 nt, Human
cccuaagccagcugcccc

SEQ ID NO: 1474391 - RNA, 12 nt, Human
cccuaagccagc

SEQ ID NO: 1474392 - RNA, 14 nt, Human
cccuaauaaagcug

SEQ ID NO: 1474393 - RNA, 13 nt, Human
cccuaauaaagcu

SEQ ID NO: 1474394 - RNA, 12 nt, Human
cccuaauaaagc

SEQ ID NO: 1474395 - RNA, 15 nt, Human
cccuaaccaaguucc

SEQ ID NO: 1474396 - RNA, 19 nt, Human
cccuaaauaauaaaaauaa

SEQ ID NO: 1474397 - RNA, 20 nt, Human
cccuaaaagaaacccugcac

SEQ ID NO: 1474398 - RNA, 20 nt, Human
cccggacgcccaggacccca

SEQ ID NO: 1474399 - RNA, 22 nt, Human
ccccagcuggggccaggcuggg

SEQ ID NO: 1474400 - RNA, 21 nt, Human
ccccagcuggggccaggcugg

SEQ ID NO: 1474401 - RNA, 13 nt, Human
cccgcucaggcug

SEQ ID NO: 1474402 - RNA, 19 nt, Human
cccgcaccccccaagcugu

SEQ ID NO: 1474403 - RNA, 23 nt, Human
ggcaucaucucagcucacugcaa

SEQ ID NO: 1474404 - RNA, 17 nt, Human
ggcaucaucucagcuca

SEQ ID NO: 1474405 - RNA, 20 nt, Human
ggcaucaguguccuuggcag

SEQ ID NO: 1474406 - RNA, 16 nt, Human
ggcauccagagucccu

SEQ ID NO: 1474407 - RNA, 18 nt, Human
ggcauccagagucccugc

SEQ ID NO: 1474408 - RNA, 22 nt, Human
ggcaucggggagccgggagccu

SEQ ID NO: 1474409 - RNA, 23 nt, Human
ggcaucggggagccgggagccug

SEQ ID NO: 1474410 - RNA, 16 nt, Human
ggccagaccauggaca

SEQ ID NO: 1474411 - RNA, 18 nt, Human
ggcauuuuacuguacaga

SEQ ID NO: 1474412 - RNA, 14 nt, Human
ggauuuauuuaaaa

SEQ ID NO: 1474413 - RNA, 19 nt, Human
ggauuuauuuaaaauagca

SEQ ID NO: 1474414 - RNA, 14 nt, Human
ggauuuauuuuucc

SEQ ID NO: 1474415 - RNA, 12 nt, Human
ggauuuuuacca

SEQ ID NO: 1474416 - RNA, 13 nt, Human
ggcagccucuggg

SEQ ID NO: 1474417 - RNA, 16 nt, Human
ggcagccucugggggg

SEQ ID NO: 1474418 - RNA, 19 nt, Human
ggcagccucuggggggugg

SEQ ID NO: 1474419 - RNA, 20 nt, Human
ggcagccucugggggguggc

SEQ ID NO: 1474420 - RNA, 23 nt, Human
ggcagccucugggggguggccag

SEQ ID NO: 1474421 - RNA, 17 nt, Human
ggcagcauccccuugaa

SEQ ID NO: 1474422 - RNA, 13 nt, Human
ggcagccagacca

SEQ ID NO: 1474423 - RNA, 11 nt, Human
ggcagccagac

SEQ ID NO: 1474424 - RNA, 15 nt, Human
ggcagccagaccagc

SEQ ID NO: 1474425 - RNA, 14 nt, Human
ggcagccagaccag

SEQ ID NO: 1474426 - RNA, 14 nt, Human
ggcaggagggaggu

SEQ ID NO: 1474427 - RNA, 15 nt, Human
ggcaggauuggggaa

SEQ ID NO: 1474428 - RNA, 22 nt, Human
ggcaggauuggggaagagagcc

SEQ ID NO: 1474429 - RNA, 17 nt, Human
ggcaggauuggggaaga

SEQ ID NO: 1474430 - RNA, 12 nt, Human
ggcaggggccgg

SEQ ID NO: 1474431 - RNA, 16 nt, Human
ggagugugcguggugg

SEQ ID NO: 1474432 - RNA, 14 nt, Human
ggagugggugggga

SEQ ID NO: 1474433 - RNA, 15 nt, Human
ggaguggguggggag

SEQ ID NO: 1474434 - RNA, 14 nt, Human
ggauuguaguccca

SEQ ID NO: 1474435 - RNA, 21 nt, Human
ggaugggguauggauucuaaa

SEQ ID NO: 1474436 - RNA, 16 nt, Human
ggauccuguguggaga

SEQ ID NO: 1474437 - RNA, 15 nt, Human
ggaucucaccaggca

SEQ ID NO: 1474438 - RNA, 16 nt, Human
ggaucucaccaggcag

SEQ ID NO: 1474439 - RNA, 17 nt, Human
ggaucucaccaggcagc

SEQ ID NO: 1474440 - RNA, 22 nt, Human
ggaucucaccaggcagccucug

SEQ ID NO: 1474441 - RNA, 21 nt, Human
ggaggguuucauugucuguga

SEQ ID NO: 1474442 - RNA, 20 nt, Human
ggaggguuucauugucugug

SEQ ID NO: 1474443 - RNA, 15 nt, Human
ggaggcucuggagcc

SEQ ID NO: 1474444 - RNA, 15 nt, Human
ggaggguaggcagga

SEQ ID NO: 1474445 - RNA, 14 nt, Human
ggagggggagaggg

SEQ ID NO: 1474446 - RNA, 10 nt, Human
aaaaaacuac

SEQ ID NO: 1474447 - RNA, 14 nt, Human
aaaaauaaaaaaca

SEQ ID NO: 1474448 - RNA, 16 nt, Human
aaaaaggacaucagca

SEQ ID NO: 1474449 - RNA, 17 nt, Human
aaaaagcccaccauuug

SEQ ID NO: 1474450 - RNA, 14 nt, Human
aaaaauacucagau

SEQ ID NO: 1474451 - RNA, 13 nt, Human
aaaaauacucaga

SEQ ID NO: 1474452 - RNA, 23 nt, Human
ggcucacugcaaccuccaccucc

SEQ ID NO: 1474453 - RNA, 13 nt, Human
ggcugaaagacag

SEQ ID NO: 1474454 - RNA, 21 nt, Human
ggccccugccucucugcaggu

SEQ ID NO: 1474455 - RNA, 19 nt, Human
ggccccugccucucugcag

SEQ ID NO: 1474456 - RNA, 18 nt, Human
ggccccugccucucugca

SEQ ID NO: 1474457 - RNA, 17 nt, Human
ggccccugccucucugc

SEQ ID NO: 1474458 - RNA, 20 nt, Human
ggccagaugcacaucccugg

SEQ ID NO: 1474459 - RNA, 21 nt, Human
ggccagaugcacaucccugga

SEQ ID NO: 1474460 - RNA, 23 nt, Human
ggccagaugcacaucccuggaag

SEQ ID NO: 1474461 - RNA, 19 nt, Human
ggccugaugggguggaagg

SEQ ID NO: 1474462 - RNA, 12 nt, Human
ggccugccagga

SEQ ID NO: 1474463 - RNA, 13 nt, Human
ggccugccaggag

SEQ ID NO: 1474464 - RNA, 14 nt, Human
ggccugccaggagg

SEQ ID NO: 1474465 - RNA, 17 nt, Human
ggccugcccagugcacu

SEQ ID NO: 1474466 - RNA, 17 nt, Human
ggcuagacuagucucaa

SEQ ID NO: 1474467 - RNA, 14 nt, Human
ggcuaccaggaaag

SEQ ID NO: 1474468 - RNA, 23 nt, Human
ggcgugaucucagcucacugcaa

SEQ ID NO: 1474469 - RNA, 17 nt, Human
ggcgugagccaccucgc

SEQ ID NO: 1474470 - RNA, 20 nt, Human
ggcuaagcuucacuguaaaa

SEQ ID NO: 1474471 - RNA, 17 nt, Human
gguuuucacauuggaaa

SEQ ID NO: 1474472 - RNA, 19 nt, Human
gguuucccuacugaagccc

SEQ ID NO: 1474473 - RNA, 17 nt, Human
aaaguauguuagugcaa

SEQ ID NO: 1474474 - RNA, 22 nt, Human
aaaguggguuuuuuaguugaau

SEQ ID NO: 1474475 - RNA, 17 nt, Human
aaaguggguuuuuuagu

SEQ ID NO: 1474476 - RNA, 22 nt, Human
gguggggggggggcgcggcugg

SEQ ID NO: 1474477 - RNA, 21 nt, Human
gguggggagagacgggcccug

SEQ ID NO: 1474478 - RNA, 12 nt, Human
ggugugucugcu

SEQ ID NO: 1474479 - RNA, 14 nt, Human
gguguuaauuuuug

SEQ ID NO: 1474480 - RNA, 17 nt, Human
gguguugccaguugucc

SEQ ID NO: 1474481 - RNA, 21 nt, Human
aaaguaaaaacaaagaaauua

SEQ ID NO: 1474482 - RNA, 15 nt, Human
aaagguuuacagaau

SEQ ID NO: 1474483 - RNA, 16 nt, Human
aaagguuuacagaauu

SEQ ID NO: 1474484 - RNA, 16 nt, Human
aaagguuuaugaaaaa

SEQ ID NO: 1474485 - RNA, 18 nt, Human
aaagguuuaugaaaaaga

SEQ ID NO: 1474486 - RNA, 22 nt, Human
aaagguuuaugaaaaagaagaa

SEQ ID NO: 1474487 - RNA, 19 nt, Human
aaagguuuaugaaaaagaa

SEQ ID NO: 1474488 - RNA, 14 nt, Human
aaagguuuuccucu

SEQ ID NO: 1474489 - RNA, 23 nt, Human
gguggcuuuugcgguucaggaaa

SEQ ID NO: 1474490 - RNA, 14 nt, Human
gguggcuuuugcgg

SEQ ID NO: 1474491 - RNA, 18 nt, Human
aaagguucaugcaaacuu

SEQ ID NO: 1474492 - RNA, 20 nt, Human
aaagggcuguuauaaucuuu

SEQ ID NO: 1474493 - RNA, 22 nt, Human
aaagggcuguuauaaucuuuca

SEQ ID NO: 1474494 - RNA, 16 nt, Human
aaagcuuaaaacuuug

SEQ ID NO: 1474495 - RNA, 14 nt, Human
aaagcuuaaaacuu

SEQ ID NO: 1474496 - RNA, 15 nt, Human
aaagcuuaaaacuuu

SEQ ID NO: 1474497 - RNA, 19 nt, Human
aaagcuuaaaacuuugaag

SEQ ID NO: 1474498 - RNA, 13 nt, Human
gguggcagcaaca

SEQ ID NO: 1474499 - RNA, 14 nt, Human
gguggcagcaacaa

SEQ ID NO: 1474500 - RNA, 14 nt, Human
aaagcuguguggca

SEQ ID NO: 1474501 - RNA, 18 nt, Human
aaagcuguguguuuggaa

SEQ ID NO: 1474502 - RNA, 16 nt, Human
aaagcugguuuaaugu

SEQ ID NO: 1474503 - RNA, 18 nt, Human
aaagcugguuuaauguuu

SEQ ID NO: 1474504 - RNA, 13 nt, Human
aaagcuagaauug

SEQ ID NO: 1474505 - RNA, 14 nt, Human
aaagcuagaauuga

SEQ ID NO: 1474506 - RNA, 20 nt, Human
aaagcuagaauugaguguuu

SEQ ID NO: 1474507 - RNA, 17 nt, Human
aaagcagccuggccaac

SEQ ID NO: 1474508 - RNA, 14 nt, Human
aaauauauaucaaa

SEQ ID NO: 1474509 - RNA, 18 nt, Human
aaauauaugcuaagucuu

SEQ ID NO: 1474510 - RNA, 22 nt, Human
aaauauauuuuaagacgaaaca

SEQ ID NO: 1474511 - RNA, 16 nt, Human
aaauauauuuuaagac

SEQ ID NO: 1474512 - RNA, 22 nt, Human
aaauaucacuugucaauaaaau

SEQ ID NO: 1474513 - RNA, 20 nt, Human
aaauaucccuccuguuggga

SEQ ID NO: 1474514 - RNA, 23 nt, Human
aaauaucccuccuguugggagag

SEQ ID NO: 1474515 - RNA, 20 nt, Human
aaauacgugggcauucaaau

SEQ ID NO: 1474516 - RNA, 21 nt, Human
aaauacgugggcauucaaaug

SEQ ID NO: 1474517 - RNA, 22 nt, Human
aaauacgugggcauucaaaugu

SEQ ID NO: 1474518 - RNA, 13 nt, Human
aaauauacuuuua

SEQ ID NO: 1474519 - RNA, 23 nt, Human
aaauauacuuuuacaaguaacaa

SEQ ID NO: 1474520 - RNA, 18 nt, Human
aaauauagaucaguuaua

SEQ ID NO: 1474521 - RNA, 22 nt, Human
aaauauacuuuuacaaguaaca

SEQ ID NO: 1474522 - RNA, 12 nt, Human
aaauauauacua

SEQ ID NO: 1474523 - RNA, 16 nt, Human
aaauauauacuaaaca

SEQ ID NO: 1474524 - RNA, 20 nt, Human
guacacaauaagcaaaaaca

SEQ ID NO: 1474525 - RNA, 18 nt, Human
guacacaauaagcaaaaa

SEQ ID NO: 1474526 - RNA, 16 nt, Human
guacacagcaccagaa

SEQ ID NO: 1474527 - RNA, 13 nt, Human
aaauauguaccaa

SEQ ID NO: 1474528 - RNA, 15 nt, Human
aaauaucuugaaagg

SEQ ID NO: 1474529 - RNA, 17 nt, Human
aaauaugaagaacugag

SEQ ID NO: 1474530 - RNA, 15 nt, Human
aaauaugauguuaaa

SEQ ID NO: 1474531 - RNA, 21 nt, Human
aaauaugauguuaaaaaaaua

SEQ ID NO: 1474532 - RNA, 21 nt, Human
guaaagcccauuuuuaaaaua

SEQ ID NO: 1474533 - RNA, 12 nt, Human
guaaagccaugc

SEQ ID NO: 1474534 - RNA, 20 nt, Human
guaaagcuaaaauaaagaaa

SEQ ID NO: 1474535 - RNA, 16 nt, Human
guaaagcuugucugau

SEQ ID NO: 1474536 - RNA, 22 nt, Human
guaaacuaucuuggugaauuuu

SEQ ID NO: 1474537 - RNA, 16 nt, Human
guaaacucaaaauauu

SEQ ID NO: 1474538 - RNA, 23 nt, Human
guaaacucaaaauauuuguacau

SEQ ID NO: 1474539 - RNA, 15 nt, Human
guaaagcuaaaauaa

SEQ ID NO: 1474540 - RNA, 22 nt, Human
guaaaguaucaggauacuauau

SEQ ID NO: 1474541 - RNA, 13 nt, Human
guaaauuuguacu

SEQ ID NO: 1474542 - RNA, 15 nt, Human
guaaauuuguacuau

SEQ ID NO: 1474543 - RNA, 20 nt, Human
guaaauuuguacuauuuaac

SEQ ID NO: 1474544 - RNA, 22 nt, Human
guaaauuuguacuauuuaacug

SEQ ID NO: 1474545 - RNA, 13 nt, Human
guaacaaaaauaa

SEQ ID NO: 1474546 - RNA, 13 nt, Human
guaacaagccaga

SEQ ID NO: 1474547 - RNA, 14 nt, Human
guaacaagccagau

SEQ ID NO: 1474548 - RNA, 15 nt, Human
guaacaagccagauu

SEQ ID NO: 1474549 - RNA, 16 nt, Human
guaacaagccagauuu

SEQ ID NO: 1474550 - RNA, 23 nt, Human
guaacaagccagauuuuuuaaaa

SEQ ID NO: 1474551 - RNA, 15 nt, Human
aaaguguauuuguua

SEQ ID NO: 1474552 - RNA, 21 nt, Human
aaaguggguuuuuuaguugaa

SEQ ID NO: 1474553 - RNA, 14 nt, Human
aaaguguuuucucu

SEQ ID NO: 1474554 - RNA, 23 nt, Human
aaaguguuuucucugaacacauu

SEQ ID NO: 1474555 - RNA, 17 nt, Human
aaaguguuuucucugaa

SEQ ID NO: 1474556 - RNA, 21 nt, Human
aaaguguuuucucugaacaca

SEQ ID NO: 1474557 - RNA, 23 nt, Human
guaaaaugugggauuauggguca

SEQ ID NO: 1474558 - RNA, 13 nt, Human
guaaaccuuuuau

SEQ ID NO: 1474559 - RNA, 13 nt, Human
guaaguuuuuuga

SEQ ID NO: 1474560 - RNA, 21 nt, Human
guaauaaaauucaacaaacau

SEQ ID NO: 1474561 - RNA, 20 nt, Human
guaauaaaauucaacaaaca

SEQ ID NO: 1474562 - RNA, 12 nt, Human
guacaaaauaaa

SEQ ID NO: 1474563 - RNA, 14 nt, Human
guacaaaauaaaca

SEQ ID NO: 1474564 - RNA, 16 nt, Human
guacaaaauaaacaaa

SEQ ID NO: 1474565 - RNA, 15 nt, Human
guaauuuuuuucacc

SEQ ID NO: 1474566 - RNA, 23 nt, Human
guacaaccacacccacacucaga

SEQ ID NO: 1474567 - RNA, 15 nt, Human
guacaagaagcauuu

SEQ ID NO: 1474568 - RNA, 21 nt, Human
guacaagaagcauuuuguaag

SEQ ID NO: 1474569 - RNA, 18 nt, Human
gguaaguuuuuugaaauu

SEQ ID NO: 1474570 - RNA, 14 nt, Human
gguauaccucacuu

SEQ ID NO: 1474571 - RNA, 23 nt, Human
gguauaguucaugucugcuauca

SEQ ID NO: 1474572 - RNA, 16 nt, Human
gguauauccaaaagcu

SEQ ID NO: 1474573 - RNA, 14 nt, Human
ggucagugcaaaua

SEQ ID NO: 1474574 - RNA, 20 nt, Human
gguaugaacuugaggacaca

SEQ ID NO: 1474575 - RNA, 19 nt, Human
gguaugaacuugaggacac

SEQ ID NO: 1474576 - RNA, 16 nt, Human
gguaugaacuugagga

SEQ ID NO: 1474577 - RNA, 22 nt, Human
gguaaaucagacuaugaaguuu

SEQ ID NO: 1474578 - RNA, 22 nt, Human
ggguuuuuuaguugaauuuuuu

SEQ ID NO: 1474579 - RNA, 13 nt, Human
gguaaaacacuug

SEQ ID NO: 1474580 - RNA, 18 nt, Human
gguaaaacagggccacau

SEQ ID NO: 1474581 - RNA, 13 nt, Human
gguaaaaugccau

SEQ ID NO: 1474582 - RNA, 17 nt, Human
ggguguccugcaccggg

SEQ ID NO: 1474583 - RNA, 21 nt, Human
ggguguccugcaccggggccu

SEQ ID NO: 1474584 - RNA, 18 nt, Human
ggguguaaaaccuggaga

SEQ ID NO: 1474585 - RNA, 14 nt, Human
aaacuaaaaacuag

SEQ ID NO: 1474586 - RNA, 10 nt, Human
aaaccacuuu

SEQ ID NO: 1474587 - RNA, 16 nt, Human
aaaccaggacccuguc

SEQ ID NO: 1474588 - RNA, 19 nt, Human
aaaccuggagaugguggau

SEQ ID NO: 1474589 - RNA, 11 nt, Human
aaaccuggaga

SEQ ID NO: 1474590 - RNA, 20 nt, Human
aaaccacuuuuugcagcuuu

SEQ ID NO: 1474591 - RNA, 13 nt, Human
aaacauuuucucc

SEQ ID NO: 1474592 - RNA, 23 nt, Human
aaaccuuccacccagugcugaau

SEQ ID NO: 1474593 - RNA, 16 nt, Human
aaaccuuccacccagu

SEQ ID NO: 1474594 - RNA, 14 nt, Human
aaacauuugcugaa

SEQ ID NO: 1474595 - RNA, 12 nt, Human
gggucacaggaa

SEQ ID NO: 1474596 - RNA, 19 nt, Human
gggucaggccuuugagcuc

SEQ ID NO: 1474597 - RNA, 21 nt, Human
gggucaggccuuugagcucag

SEQ ID NO: 1474598 - RNA, 14 nt, Human
aaaauguaaagcca

SEQ ID NO: 1474599 - RNA, 15 nt, Human
ggggacagguccuca

SEQ ID NO: 1474600 - RNA, 20 nt, Human
gggguauuucaauuaccuuc

SEQ ID NO: 1474601 - RNA, 23 nt, Human
ggggcccggacgcccaggacccc

SEQ ID NO: 1474602 - RNA, 22 nt, Human
gggggcagucugagagaggcca

SEQ ID NO: 1474603 - RNA, 15 nt, Human
aaaauauuuguacau

SEQ ID NO: 1474604 - RNA, 19 nt, Human
aaaauauuguuuuacaaua

SEQ ID NO: 1474605 - RNA, 20 nt, Human
aaaauauuguuuuacaauag

SEQ ID NO: 1474606 - RNA, 12 nt, Human
aaaaugagaaau

SEQ ID NO: 1474607 - RNA, 11 nt, Human
aaaaugagaaa

SEQ ID NO: 1474608 - RNA, 23 nt, Human
aaaaugccaugaugccucugucu

SEQ ID NO: 1474609 - RNA, 11 nt, Human
aaaauaauuuu

SEQ ID NO: 1474610 - RNA, 19 nt, Human
aaaauaauuuuaaacaaag

SEQ ID NO: 1474611 - RNA, 20 nt, Human
aaaauaauuuuaaacaaagg

SEQ ID NO: 1474612 - RNA, 16 nt, Human
aaaauaauacugcuga

SEQ ID NO: 1474613 - RNA, 23 nt, Human
aaaauaauacugcugagauacau

SEQ ID NO: 1474614 - RNA, 16 nt, Human
aaaauaauuuuuauau

SEQ ID NO: 1474615 - RNA, 17 nt, Human
aaaauaauuuuuauauu

SEQ ID NO: 1474616 - RNA, 20 nt, Human
aaaauaauuuuuauauuuga

SEQ ID NO: 1474617 - RNA, 12 nt, Human
aaaauacauugu

SEQ ID NO: 1474618 - RNA, 10 nt, Human
aaaauacaug

SEQ ID NO: 1474619 - RNA, 19 nt, Human
aaaaggacaucagcaaaca

SEQ ID NO: 1474620 - RNA, 17 nt, Human
aaaaggacaucagcaaa

SEQ ID NO: 1474621 - RNA, 13 nt, Human
ggcuggucucaaa

SEQ ID NO: 1474622 - RNA, 15 nt, Human
aaaagguauuaaauu

SEQ ID NO: 1474623 - RNA, 15 nt, Human
aaaauggucucuaac

SEQ ID NO: 1474624 - RNA, 23 nt, Human
aaaauggccauuugcuuuuucac

SEQ ID NO: 1474625 - RNA, 17 nt, Human
gggcugccuucuggccu

SEQ ID NO: 1474626 - RNA, 13 nt, Human
gggccaggcuggg

SEQ ID NO: 1474627 - RNA, 14 nt, Human
gggccugcccagug

SEQ ID NO: 1474628 - RNA, 14 nt, Human
gcuuuggaagccau

SEQ ID NO: 1474629 - RNA, 23 nt, Human
gcuuugcccugcugcccuccccc

SEQ ID NO: 1474630 - RNA, 19 nt, Human
gcuuugcccugcugcccuc

SEQ ID NO: 1474631 - RNA, 18 nt, Human
gcuuugcccugcugcccu

SEQ ID NO: 1474632 - RNA, 16 nt, Human
gcuuugcuaccaaagc

SEQ ID NO: 1474633 - RNA, 17 nt, Human
gcuuaaucagauagaua

SEQ ID NO: 1474634 - RNA, 11 nt, Human
gcuuuccugaa

SEQ ID NO: 1474635 - RNA, 12 nt, Human
gcuuuccugaau

SEQ ID NO: 1474636 - RNA, 22 nt, Human
gcuuuccugaauccaaacuaau

SEQ ID NO: 1474637 - RNA, 20 nt, Human
gcuuuucccuuuuuuuaagu

SEQ ID NO: 1474638 - RNA, 21 nt, Human
gcuuuucccuuuuuuuaagua

SEQ ID NO: 1474639 - RNA, 23 nt, Human
gcuuuugcgguucaggaaaauug

SEQ ID NO: 1474640 - RNA, 19 nt, Human
ggaaagcgccuccaacccu

SEQ ID NO: 1474641 - RNA, 23 nt, Human
ggaaagcgccuccaacccuagca

SEQ ID NO: 1474642 - RNA, 19 nt, Human
ggaaagcagccuggccaac

SEQ ID NO: 1474643 - RNA, 21 nt, Human
ggaaagaagaaggugggagga

SEQ ID NO: 1474644 - RNA, 16 nt, Human
ggaaaaaauaacaaug

SEQ ID NO: 1474645 - RNA, 15 nt, Human
ggacaucagcaaaca

SEQ ID NO: 1474646 - RNA, 14 nt, Human
ggacaucagcaaac

SEQ ID NO: 1474647 - RNA, 12 nt, Human
ggacaucagcaa

SEQ ID NO: 1474648 - RNA, 17 nt, Human
ggacagucaccucaugg

SEQ ID NO: 1474649 - RNA, 18 nt, Human
ggacagucaccucaugga

SEQ ID NO: 1474650 - RNA, 21 nt, Human
ggacagucaccucauggaauu

SEQ ID NO: 1474651 - RNA, 20 nt, Human
ggacagguccucaguguccu

SEQ ID NO: 1474652 - RNA, 12 nt, Human
ggacaccugccc

SEQ ID NO: 1474653 - RNA, 11 nt, Human
ggacaccugcc

SEQ ID NO: 1474654 - RNA, 10 nt, Human
ggacaccugc

SEQ ID NO: 1474655 - RNA, 16 nt, Human
ggacaccuaggcuagg

SEQ ID NO: 1474656 - RNA, 13 nt, Human
ggacaccugcccu

SEQ ID NO: 1474657 - RNA, 15 nt, Human
ggacaccugcccugc

SEQ ID NO: 1474658 - RNA, 14 nt, Human
ggacaccugcccug

SEQ ID NO: 1474659 - RNA, 19 nt, Human
ggacacauguccaguggga

SEQ ID NO: 1474660 - RNA, 21 nt, Human
ggacacaguuccugggaacau

SEQ ID NO: 1474661 - RNA, 16 nt, Human
ggacaccccgacuuuu

SEQ ID NO: 1474662 - RNA, 13 nt, Human
ggacacaugucca

SEQ ID NO: 1474663 - RNA, 12 nt, Human
ggacacaugucc

SEQ ID NO: 1474664 - RNA, 19 nt, Human
ggacacaguuccugggaac

SEQ ID NO: 1474665 - RNA, 18 nt, Human
ggacacaguuccugggaa

SEQ ID NO: 1474666 - RNA, 17 nt, Human
ggacacaguuccuggga

SEQ ID NO: 1474667 - RNA, 16 nt, Human
ggacacaguuccuggg

SEQ ID NO: 1474668 - RNA, 14 nt, Human
ggacacaguuccug

SEQ ID NO: 1474669 - RNA, 17 nt, Human
ggaaugagcugaaggug

SEQ ID NO: 1474670 - RNA, 19 nt, Human
ggaauacucuuauaucuau

SEQ ID NO: 1474671 - RNA, 15 nt, Human
ggaauauaauuguuu

SEQ ID NO: 1474672 - RNA, 19 nt, Human
ggaaaucaggguuaguauu

SEQ ID NO: 1474673 - RNA, 16 nt, Human
ggaagccagcuuuccc

SEQ ID NO: 1474674 - RNA, 19 nt, Human
gcuggcucugugagggugc

SEQ ID NO: 1474675 - RNA, 21 nt, Human
gcugggaauggaggggcagag

SEQ ID NO: 1474676 - RNA, 15 nt, Human
gcuggcuugggcagc

SEQ ID NO: 1474677 - RNA, 14 nt, Human
gcugggccccugcc

SEQ ID NO: 1474678 - RNA, 13 nt, Human
gcugggccccugc

SEQ ID NO: 1474679 - RNA, 12 nt, Human
gcugggccccug

SEQ ID NO: 1474680 - RNA, 20 nt, Human
gcugggccccugccucucug

SEQ ID NO: 1474681 - RNA, 18 nt, Human
gcugggccccugccucuc

SEQ ID NO: 1474682 - RNA, 20 nt, Human
gcuguauuuuaaaagaauga

SEQ ID NO: 1474683 - RNA, 18 nt, Human
gcuguauuuuaaaagaau

SEQ ID NO: 1474684 - RNA, 21 nt, Human
gcuguauuuuaaaagaaugau

SEQ ID NO: 1474685 - RNA, 16 nt, Human
gcuguaguaggcauuu

SEQ ID NO: 1474686 - RNA, 23 nt, Human
gcuguaguaggcauuuuuaccau

SEQ ID NO: 1474687 - RNA, 16 nt, Human
gcugugcgugugugug

SEQ ID NO: 1474688 - RNA, 16 nt, Human
gcugugcuauggugcu

SEQ ID NO: 1474689 - RNA, 17 nt, Human
gcugugcuauggugcuc

SEQ ID NO: 1474690 - RNA, 18 nt, Human
gcugagcaaaucaccaca

SEQ ID NO: 1474691 - RNA, 20 nt, Human
gcugccccuggugcacuggc

SEQ ID NO: 1474692 - RNA, 20 nt, Human
gcugcccccagagccacagu

SEQ ID NO: 1474693 - RNA, 15 nt, Human
gcugcccccagagcc

SEQ ID NO: 1474694 - RNA, 21 nt, Human
gcugcccccagagccacaguu

SEQ ID NO: 1474695 - RNA, 14 nt, Human
gcugccucuucccu

SEQ ID NO: 1474696 - RNA, 18 nt, Human
gcugccucuucccucuuc

SEQ ID NO: 1474697 - RNA, 19 nt, Human
gcgcaggccgugacgucug

SEQ ID NO: 1474698 - RNA, 19 nt, Human
gccuucucuaaacauuuca

SEQ ID NO: 1474699 - RNA, 14 nt, Human
gccuucucuguuca

SEQ ID NO: 1474700 - RNA, 16 nt, Human
gccuucucuguucauu

SEQ ID NO: 1474701 - RNA, 14 nt, Human
gccuucuggccuug

SEQ ID NO: 1474702 - RNA, 23 nt, Human
gccuucuuuugggggucaacagu

SEQ ID NO: 1474703 - RNA, 17 nt, Human
gccuucucaugauccaa

SEQ ID NO: 1474704 - RNA, 17 nt, Human
gccucugggggguggcc

SEQ ID NO: 1474705 - RNA, 20 nt, Human
gccucugggggguggccagg

SEQ ID NO: 1474706 - RNA, 23 nt, Human
gccucugggggguggccaggccg

SEQ ID NO: 1474707 - RNA, 21 nt, Human
gccucugggggguggccaggc

SEQ ID NO: 1474708 - RNA, 16 nt, Human
gccuggcuccguccag

SEQ ID NO: 1474709 - RNA, 22 nt, Human
gcguuauuggucggcagccuuc

SEQ ID NO: 1474710 - RNA, 21 nt, Human
gcguggaacucgugucuggca

SEQ ID NO: 1474711 - RNA, 12 nt, Human
gcggcuccucag

SEQ ID NO: 1474712 - RNA, 14 nt, Human
gcggcuccucaggg

SEQ ID NO: 1474713 - RNA, 13 nt, Human
gcggcaucaggcu

SEQ ID NO: 1474714 - RNA, 22 nt, Human
gcuaaguacacaauaagcaaaa

SEQ ID NO: 1474715 - RNA, 21 nt, Human
gcuaaguacacaauaagcaaa

SEQ ID NO: 1474716 - RNA, 20 nt, Human
gcuaaguacacaauaagcaa

SEQ ID NO: 1474717 - RNA, 17 nt, Human
gcuaggguggggagaga

SEQ ID NO: 1474718 - RNA, 18 nt, Human
gcuaggguggggagagac

SEQ ID NO: 1474719 - RNA, 16 nt, Human
gcuauguuuuuaaugu

SEQ ID NO: 1474720 - RNA, 19 nt, Human
gcuauguuuugacauuuuu

SEQ ID NO: 1474721 - RNA, 18 nt, Human
gcuauguuuuuaauguau

SEQ ID NO: 1474722 - RNA, 18 nt, Human
gcuauuauuuucacugua

SEQ ID NO: 1474723 - RNA, 21 nt, Human
gcuauuauuuucacuguagaa

SEQ ID NO: 1474724 - RNA, 17 nt, Human
gcuauuauuuucacugu

SEQ ID NO: 1474725 - RNA, 21 nt, Human
gcuaggaauuguguuuauaau

SEQ ID NO: 1474726 - RNA, 12 nt, Human
gcuaggaaugaa

SEQ ID NO: 1474727 - RNA, 13 nt, Human
gcuaggaaugaaa

SEQ ID NO: 1474728 - RNA, 18 nt, Human
gcuaggaaugaaauccug

SEQ ID NO: 1474729 - RNA, 16 nt, Human
gcucagagcaguguuu

SEQ ID NO: 1474730 - RNA, 17 nt, Human
gcucagaaaauaucccu

SEQ ID NO: 1474731 - RNA, 18 nt, Human
gcucagaaguuucuucuu

SEQ ID NO: 1474732 - RNA, 15 nt, Human
gcucacuucugggcu

SEQ ID NO: 1474733 - RNA, 23 nt, Human
gcucacuucugggcuucaucugg

SEQ ID NO: 1474734 - RNA, 23 nt, Human
gcucaacucucuuauugccucac

SEQ ID NO: 1474735 - RNA, 23 nt, Human
gcucaggagcccugggaggcucu

SEQ ID NO: 1474736 - RNA, 22 nt, Human
gcucaggagcccugggaggcuc

SEQ ID NO: 1474737 - RNA, 18 nt, Human
gcucagaggguguccugc

SEQ ID NO: 1474738 - RNA, 19 nt, Human
gcucagaggguguccugca

SEQ ID NO: 1474739 - RNA, 20 nt, Human
gcccugccaccugucugucu

SEQ ID NO: 1474740 - RNA, 17 nt, Human
gccggaucugagggaga

SEQ ID NO: 1474741 - RNA, 15 nt, Human
gccggaucugaggga

SEQ ID NO: 1474742 - RNA, 22 nt, Human
gcccugugccccuugacaacug

SEQ ID NO: 1474743 - RNA, 18 nt, Human
gcccugccaccugucugu

SEQ ID NO: 1474744 - RNA, 19 nt, Human
gcccuuaugacugccaaga

SEQ ID NO: 1474745 - RNA, 17 nt, Human
gcccuuauuuucaagaa

SEQ ID NO: 1474746 - RNA, 18 nt, Human
gcccuuauuuucaagaaa

SEQ ID NO: 1474747 - RNA, 20 nt, Human
gcccuuauuuucaagaaacu

SEQ ID NO: 1474748 - RNA, 13 nt, Human
gccuagacucugu

SEQ ID NO: 1474749 - RNA, 13 nt, Human
gccuagaggccug

SEQ ID NO: 1474750 - RNA, 17 nt, Human
gcccccagagccacagu

SEQ ID NO: 1474751 - RNA, 16 nt, Human
gcccccagagccacag

SEQ ID NO: 1474752 - RNA, 15 nt, Human
gcccccagagccaca

SEQ ID NO: 1474753 - RNA, 14 nt, Human
gccauuaacaaaug

SEQ ID NO: 1474754 - RNA, 13 nt, Human
gcauuuagaugua

SEQ ID NO: 1474755 - RNA, 12 nt, Human
gcauuuagaugu

SEQ ID NO: 1474756 - RNA, 19 nt, Human
gccauucuuucccaacacc

SEQ ID NO: 1474757 - RNA, 12 nt, Human
gccauucuuucc

SEQ ID NO: 1474758 - RNA, 22 nt, Human
gcccacuguacuugcucuugau

SEQ ID NO: 1474759 - RNA, 20 nt, Human
gcccacuguacuugcucuug

SEQ ID NO: 1474760 - RNA, 15 nt, Human
gcccacuguacuugc

SEQ ID NO: 1474761 - RNA, 15 nt, Human
gcccaggcacugcaa

SEQ ID NO: 1474762 - RNA, 22 nt, Human
gcccaggauacuggcacagagg

SEQ ID NO: 1474763 - RNA, 23 nt, Human
gcccaggauacuggcacagaggu

SEQ ID NO: 1474764 - RNA, 20 nt, Human
gcccaggauacuggcacaga

SEQ ID NO: 1474765 - RNA, 17 nt, Human
gcccaggauacuggcac

SEQ ID NO: 1474766 - RNA, 15 nt, Human
gcccaggauacuggc

SEQ ID NO: 1474767 - RNA, 21 nt, Human
gcccaggaccccauggcagug

SEQ ID NO: 1474768 - RNA, 13 nt, Human
gcccaggacccca

SEQ ID NO: 1474769 - RNA, 16 nt, Human
gcccaggcacugcaaa

SEQ ID NO: 1474770 - RNA, 21 nt, Human
gacauuuuacauuaaauuuuu

SEQ ID NO: 1474771 - RNA, 15 nt, Human
gacauuuuacauuaa

SEQ ID NO: 1474772 - RNA, 14 nt, Human
gacauuuuacauua

SEQ ID NO: 1474773 - RNA, 13 nt, Human
gacauuuuacauu

SEQ ID NO: 1474774 - RNA, 20 nt, Human
gacauuuuaaaaaaugguca

SEQ ID NO: 1474775 - RNA, 22 nt, Human
gacagcccaggauacuggcaca

SEQ ID NO: 1474776 - RNA, 18 nt, Human
gacagucaccucauggaa

SEQ ID NO: 1474777 - RNA, 21 nt, Human
gacaguccgucaaaacagauu

SEQ ID NO: 1474778 - RNA, 23 nt, Human
gacagcccaggauacuggcacag

SEQ ID NO: 1474779 - RNA, 23 nt, Human
gacacuuuaauuaccaaccuguu

SEQ ID NO: 1474780 - RNA, 12 nt, Human
gacacuggcaug

SEQ ID NO: 1474781 - RNA, 16 nt, Human
gacccugagcugacca

SEQ ID NO: 1474782 - RNA, 20 nt, Human
gacccugagcugaccagccg

SEQ ID NO: 1474783 - RNA, 14 nt, Human
gaaugauuaugaau

SEQ ID NO: 1474784 - RNA, 22 nt, Human
gaaugauuaugaauuacauuug

SEQ ID NO: 1474785 - RNA, 14 nt, Human
gaaugauuucaugc

SEQ ID NO: 1474786 - RNA, 13 nt, Human
gaauuacauuugu

SEQ ID NO: 1474787 - RNA, 15 nt, Human
gaauuacauuuguau

SEQ ID NO: 1474788 - RNA, 18 nt, Human
gaauuacauuuguauaaa

SEQ ID NO: 1474789 - RNA, 19 nt, Human
gaauuacgugcucuguggg

SEQ ID NO: 1474790 - RNA, 15 nt, Human
gaauuacgugcucug

SEQ ID NO: 1474791 - RNA, 20 nt, Human
gaauuacauuuguauaaaau

SEQ ID NO: 1474792 - RNA, 22 nt, Human
gaauuaaaguggaccaauaggg

SEQ ID NO: 1474793 - RNA, 12 nt, Human
gaauuaaauaaa

SEQ ID NO: 1474794 - RNA, 20 nt, Human
gaauuaaauaaacccuuccu

SEQ ID NO: 1474795 - RNA, 14 nt, Human
gacaaaaagcuacu

SEQ ID NO: 1474796 - RNA, 19 nt, Human
gacaaacaccucccaggag

SEQ ID NO: 1474797 - RNA, 17 nt, Human
gacaaacaccucccagg

SEQ ID NO: 1474798 - RNA, 22 nt, Human
gacaaacaccucccaggagaca

SEQ ID NO: 1474799 - RNA, 15 nt, Human
gaauuuuuuuuaaca

SEQ ID NO: 1474800 - RNA, 16 nt, Human
gaauuuuuuuuaacau

SEQ ID NO: 1474801 - RNA, 17 nt, Human
gaauuuuuuuuaacauu

SEQ ID NO: 1474802 - RNA, 19 nt, Human
gaauuuuuuuuaacauucc

SEQ ID NO: 1474803 - RNA, 20 nt, Human
gaauuuuuuuuaacauuccu

SEQ ID NO: 1474804 - RNA, 21 nt, Human
gaauuuuuuuuaacauuccuc

SEQ ID NO: 1474805 - RNA, 22 nt, Human
gaauuuuuuuuuccuagcccuc

SEQ ID NO: 1474806 - RNA, 18 nt, Human
gacaaaaaauuaaagcau

SEQ ID NO: 1474807 - RNA, 13 nt, Human
gacaaagaaccuu

SEQ ID NO: 1474808 - RNA, 12 nt, Human
gaauuauuuugu

SEQ ID NO: 1474809 - RNA, 14 nt, Human
gaauuaugaaacuu

SEQ ID NO: 1474810 - RNA, 18 nt, Human
gacaaagguuuuccucuu

SEQ ID NO: 1474811 - RNA, 11 nt, Human
gaauaugccuu

SEQ ID NO: 1474812 - RNA, 22 nt, Human
gaauaucuccgucaacucauau

SEQ ID NO: 1474813 - RNA, 16 nt, Human
gaauauccaugaccua

SEQ ID NO: 1474814 - RNA, 21 nt, Human
gagcuggagaugaggccagac

SEQ ID NO: 1474815 - RNA, 23 nt, Human
gagcuggagaugaggccagacca

SEQ ID NO: 1474816 - RNA, 22 nt, Human
gagcuggagaugaggccagacc

SEQ ID NO: 1474817 - RNA, 20 nt, Human
gagcccugggaggcucugga

SEQ ID NO: 1474818 - RNA, 19 nt, Human
gagcccugggaggcucugg

SEQ ID NO: 1474819 - RNA, 18 nt, Human
gagcccugggaggcucug

SEQ ID NO: 1474820 - RNA, 16 nt, Human
gagcccugggaggcuc

SEQ ID NO: 1474821 - RNA, 12 nt, Human
gagcccugggag

SEQ ID NO: 1474822 - RNA, 17 nt, Human
gagcccugaggccuaga

SEQ ID NO: 1474823 - RNA, 14 nt, Human
gagcagucaggaaa

SEQ ID NO: 1474824 - RNA, 15 nt, Human
gaggacccaggacag

SEQ ID NO: 1474825 - RNA, 14 nt, Human
gaggacccaggaca

SEQ ID NO: 1474826 - RNA, 16 nt, Human
gaggacccagggcucu

SEQ ID NO: 1474827 - RNA, 14 nt, Human
gaggacuugugucu

SEQ ID NO: 1474828 - RNA, 16 nt, Human
gaggacuugugucucu

SEQ ID NO: 1474829 - RNA, 17 nt, Human
gaggacuugugucucug

SEQ ID NO: 1474830 - RNA, 14 nt, Human
gaggacccagggcu

SEQ ID NO: 1474831 - RNA, 15 nt, Human
gaggacccagggcuc

SEQ ID NO: 1474832 - RNA, 18 nt, Human
gaggacuugugucucugu

SEQ ID NO: 1474833 - RNA, 22 nt, Human
gaggacuugugucucugugcuu

SEQ ID NO: 1474834 - RNA, 16 nt, Human
gaggggcagagccagg

SEQ ID NO: 1474835 - RNA, 16 nt, Human
gaggggaccaggagug

SEQ ID NO: 1474836 - RNA, 20 nt, Human
gaggggcagagccaggaaga

SEQ ID NO: 1474837 - RNA, 13 nt, Human
gaggggcagagcc

SEQ ID NO: 1474838 - RNA, 21 nt, Human
gaggggaccaggagugggugg

SEQ ID NO: 1474839 - RNA, 17 nt, Human
gaggggaccaggagugg

SEQ ID NO: 1474840 - RNA, 15 nt, Human
gagaggccuuuugga

SEQ ID NO: 1474841 - RNA, 18 nt, Human
gagaggccuuuuggaaug

SEQ ID NO: 1474842 - RNA, 15 nt, Human
gagagggaaugugaa

SEQ ID NO: 1474843 - RNA, 14 nt, Human
gagagggaauguga

SEQ ID NO: 1474844 - RNA, 16 nt, Human
gagacgggcccuggug

SEQ ID NO: 1474845 - RNA, 22 nt, Human
gacuuuuuauggcacuaguauu

SEQ ID NO: 1474846 - RNA, 16 nt, Human
gacuuuuugcauuuaa

SEQ ID NO: 1474847 - RNA, 13 nt, Human
gagaaggagcaga

SEQ ID NO: 1474848 - RNA, 23 nt, Human
gagacgggacugcggaggaagga

SEQ ID NO: 1474849 - RNA, 21 nt, Human
gagaccggccugccaggagga

SEQ ID NO: 1474850 - RNA, 20 nt, Human
gagaccggccugccaggagg

SEQ ID NO: 1474851 - RNA, 15 nt, Human
gagaccggccugcca

SEQ ID NO: 1474852 - RNA, 17 nt, Human
gagaccggccugccagg

SEQ ID NO: 1474853 - RNA, 18 nt, Human
gagaccggccugccagga

SEQ ID NO: 1474854 - RNA, 19 nt, Human
gagaccggccugccaggag

SEQ ID NO: 1474855 - RNA, 15 nt, Human
gagaaucuauauuua

SEQ ID NO: 1474856 - RNA, 22 nt, Human
gagaaucuauauuuaacaagau

SEQ ID NO: 1474857 - RNA, 23 nt, Human
gcagagcugauggagaaggaagg

SEQ ID NO: 1474858 - RNA, 22 nt, Human
gcagagcugauggagaaggaag

SEQ ID NO: 1474859 - RNA, 21 nt, Human
gcagagcugauggagaaggaa

SEQ ID NO: 1474860 - RNA, 19 nt, Human
gcagagcugauggagaagg

SEQ ID NO: 1474861 - RNA, 15 nt, Human
gcaguuuauauuuaa

SEQ ID NO: 1474862 - RNA, 18 nt, Human
gcaguuuauauuuaacuc

SEQ ID NO: 1474863 - RNA, 22 nt, Human
gcaguuguugcccacagcugua

SEQ ID NO: 1474864 - RNA, 23 nt, Human
gcagucucuauaccaauaaagug

SEQ ID NO: 1474865 - RNA, 22 nt, Human
gcagucucuauaccaauaaagu

SEQ ID NO: 1474866 - RNA, 21 nt, Human
gcagucucuauaccaauaaag

SEQ ID NO: 1474867 - RNA, 20 nt, Human
gcagucucuauaccaauaaa

SEQ ID NO: 1474868 - RNA, 18 nt, Human
gcagucucuauaccaaua

SEQ ID NO: 1474869 - RNA, 23 nt, Human
gcagugagagaguggcuggggca

SEQ ID NO: 1474870 - RNA, 22 nt, Human
gcagugagagaguggcuggggc

SEQ ID NO: 1474871 - RNA, 17 nt, Human
gcagucucuauaccaau

SEQ ID NO: 1474872 - RNA, 21 nt, Human
gcaucccucacccauccuaga

SEQ ID NO: 1474873 - RNA, 16 nt, Human
gcauccauucuccuga

SEQ ID NO: 1474874 - RNA, 17 nt, Human
gcauccauucuccugag

SEQ ID NO: 1474875 - RNA, 12 nt, Human
gcaucccugggc

SEQ ID NO: 1474876 - RNA, 15 nt, Human
gcaucccugggccuu

SEQ ID NO: 1474877 - RNA, 17 nt, Human
gcaucccugggccuugg

SEQ ID NO: 1474878 - RNA, 18 nt, Human
gcaucccugggccuuggg

SEQ ID NO: 1474879 - RNA, 20 nt, Human
gcaucccugggccuugggcu

SEQ ID NO: 1474880 - RNA, 19 nt, Human
gcaucccugggccuugggc

SEQ ID NO: 1474881 - RNA, 11 nt, Human
gcauccagccu

SEQ ID NO: 1474882 - RNA, 19 nt, Human
gcauccauucuccugagga

SEQ ID NO: 1474883 - RNA, 22 nt, Human
gcauccagagucccugccugga

SEQ ID NO: 1474884 - RNA, 23 nt, Human
gcauccagagucccugccuggac

SEQ ID NO: 1474885 - RNA, 21 nt, Human
gcauccagagucccugccugg

SEQ ID NO: 1474886 - RNA, 20 nt, Human
gcaucuagcaugucgucaaa

SEQ ID NO: 1474887 - RNA, 21 nt, Human
gcaucuagaggcuuccuucau

SEQ ID NO: 1474888 - RNA, 22 nt, Human
gcaucuagaggcuuccuucauu

SEQ ID NO: 1474889 - RNA, 23 nt, Human
gcaucuagaggcuuccuucauuu

SEQ ID NO: 1474890 - RNA, 15 nt, Human
gcauggcuauuuuau

SEQ ID NO: 1474891 - RNA, 17 nt, Human
gcaucggggagccggga

SEQ ID NO: 1474892 - RNA, 20 nt, Human
gaugauccccacgccacagc

SEQ ID NO: 1474893 - RNA, 16 nt, Human
gaugauccccacgcca

SEQ ID NO: 1474894 - RNA, 15 nt, Human
gaugauccccacgcc

SEQ ID NO: 1474895 - RNA, 21 nt, Human
gaugauccccacgccacagcc

SEQ ID NO: 1474896 - RNA, 23 nt, Human
gaucugauaggguuugugacagg

SEQ ID NO: 1474897 - RNA, 20 nt, Human
gaucugcagggggugugucu

SEQ ID NO: 1474898 - RNA, 21 nt, Human
gauccacccgccucagccucc

SEQ ID NO: 1474899 - RNA, 18 nt, Human
gauccacucgccucagcc

SEQ ID NO: 1474900 - RNA, 17 nt, Human
gaucccaacacugccag

SEQ ID NO: 1474901 - RNA, 18 nt, Human
gaucccaacacugccagc

SEQ ID NO: 1474902 - RNA, 19 nt, Human
gaucccaacacugccagca

SEQ ID NO: 1474903 - RNA, 21 nt, Human
gaucccaaguagaaucucagu

SEQ ID NO: 1474904 - RNA, 15 nt, Human
gaucccaugagcucc

SEQ ID NO: 1474905 - RNA, 13 nt, Human
gaucugagggaga

SEQ ID NO: 1474906 - RNA, 19 nt, Human
gaucugauaggguuuguga

SEQ ID NO: 1474907 - RNA, 12 nt, Human
gauacugaaaua

SEQ ID NO: 1474908 - RNA, 18 nt, Human
gauaccauauacagcuca

SEQ ID NO: 1474909 - RNA, 16 nt, Human
gauacuggcacagagg

SEQ ID NO: 1474910 - RNA, 13 nt, Human
gauacuggcacag

SEQ ID NO: 1474911 - RNA, 14 nt, Human
gauacauacagaau

SEQ ID NO: 1474912 - RNA, 12 nt, Human
gauccacccgcc

SEQ ID NO: 1474913 - RNA, 19 nt, Human
gauccaacuaaugccuuac

SEQ ID NO: 1474914 - RNA, 20 nt, Human
gauccaacuaaugccuuacu

SEQ ID NO: 1474915 - RNA, 15 nt, Human
gauauuuucugugcc

SEQ ID NO: 1474916 - RNA, 21 nt, Human
gauauuuucugugccugaaua

SEQ ID NO: 1474917 - RNA, 14 nt, Human
gauauuuucucuag

SEQ ID NO: 1474918 - RNA, 13 nt, Human
gauagaaaugcca

SEQ ID NO: 1474919 - RNA, 14 nt, Human
gauagaaaugccaa

SEQ ID NO: 1474920 - RNA, 19 nt, Human
gauagaaaugccaagcacu

SEQ ID NO: 1474921 - RNA, 15 nt, Human
gauauuucuagcuua

SEQ ID NO: 1474922 - RNA, 20 nt, Human
gcaaaauaauuuuaaacaaa

SEQ ID NO: 1474923 - RNA, 13 nt, Human
gcaaaauaauuuu

SEQ ID NO: 1474924 - RNA, 15 nt, Human
gcaaaauaauuuuaa

SEQ ID NO: 1474925 - RNA, 21 nt, Human
gcaaaaacaaaaagaaaagaa

SEQ ID NO: 1474926 - RNA, 20 nt, Human
gcaaaaacaaaaagaaaaga

SEQ ID NO: 1474927 - RNA, 23 nt, Human
gcaaaaauaguuuggauauguaa

SEQ ID NO: 1474928 - RNA, 15 nt, Human
gcaaaaacaaaaaga

SEQ ID NO: 1474929 - RNA, 17 nt, Human
gcaaaaaagaaaaccuu

SEQ ID NO: 1474930 - RNA, 15 nt, Human
gcaaaaaagaaaacc

SEQ ID NO: 1474931 - RNA, 18 nt, Human
gcaaaaaagaaaaccuuu

SEQ ID NO: 1474932 - RNA, 18 nt, Human
gauuuauuuaaaauagca

SEQ ID NO: 1474933 - RNA, 21 nt, Human
gauuuauuaauauauauuauc

SEQ ID NO: 1474934 - RNA, 12 nt, Human
gauuuauuuaaa

SEQ ID NO: 1474935 - RNA, 22 nt, Human
cugccuccugccggcuccuugg

SEQ ID NO: 1474936 - RNA, 15 nt, Human
cugccuccugccggc

SEQ ID NO: 1474937 - RNA, 23 nt, Human
cugccuccugccggcuccuuggu

SEQ ID NO: 1474938 - RNA, 22 nt, Human
cugccucucaucaacugaauga

SEQ ID NO: 1474939 - RNA, 14 nt, Human
cugcuauuugaagu

SEQ ID NO: 1474940 - RNA, 15 nt, Human
cugcuaucauuauuc

SEQ ID NO: 1474941 - RNA, 21 nt, Human
cugcuaugguuuucuccaaga

SEQ ID NO: 1474942 - RNA, 20 nt, Human
cugcugagauacauacagaa

SEQ ID NO: 1474943 - RNA, 19 nt, Human
cugcugagauacauacaga

SEQ ID NO: 1474944 - RNA, 12 nt, Human
cuggcucuguga

SEQ ID NO: 1474945 - RNA, 20 nt, Human
cuggaaaccuuccacccagu

SEQ ID NO: 1474946 - RNA, 17 nt, Human
cuggaaaccuuccaccc

SEQ ID NO: 1474947 - RNA, 17 nt, Human
cuggaaaauaauacugc

SEQ ID NO: 1474948 - RNA, 20 nt, Human
cuggaaaauaauacugcuga

SEQ ID NO: 1474949 - RNA, 23 nt, Human
cuggaaaauaauacugcugagau

SEQ ID NO: 1474950 - RNA, 23 nt, Human
cuggaaaaguauguuagugcaaa

SEQ ID NO: 1474951 - RNA, 24 nt, Human
cugcuuccaauuuucuggaauaca

SEQ ID NO: 1474952 - RNA, 19 nt, Human
cugcuucaguguauggaaa

SEQ ID NO: 1474953 - RNA, 21 nt, Human
cugcuucaguguauggaaaua

SEQ ID NO: 1474954 - RNA, 11 nt, Human
cuggaaagaag

SEQ ID NO: 1474955 - RNA, 19 nt, Human
cuggagaagacccuccccg

SEQ ID NO: 1474956 - RNA, 20 nt, Human
cugucuacacuaagagagaa

SEQ ID NO: 1474957 - RNA, 13 nt, Human
cuguccuuucuag

SEQ ID NO: 1474958 - RNA, 20 nt, Human
cuguccuuucuagagcacug

SEQ ID NO: 1474959 - RNA, 21 nt, Human
cuguccuuucuagagcacugc

SEQ ID NO: 1474960 - RNA, 22 nt, Human
cuguccuuucuagagcacugcc

SEQ ID NO: 1474961 - RNA, 23 nt, Human
cuguccuuucuagagcacugcca

SEQ ID NO: 1474962 - RNA, 17 nt, Human
cuguagccccagugaca

SEQ ID NO: 1474963 - RNA, 18 nt, Human
cuguagccccagugacag

SEQ ID NO: 1474964 - RNA, 20 nt, Human
cuguagccccagugacagcu

SEQ ID NO: 1474965 - RNA, 21 nt, Human
cuguagccccagugacagcua

SEQ ID NO: 1474966 - RNA, 20 nt, Human
cuguaagaaaauaucacuug

SEQ ID NO: 1474967 - RNA, 13 nt, Human
cuguaagaaaccu

SEQ ID NO: 1474968 - RNA, 21 nt, Human
cuguaagaaaccuacugccca

SEQ ID NO: 1474969 - RNA, 22 nt, Human
cuguaagaaaccuacugcccag

SEQ ID NO: 1474970 - RNA, 23 nt, Human
cuguaaagcuaaaauaaagaaau

SEQ ID NO: 1474971 - RNA, 18 nt, Human
cuguaaagcuaaaauaaa

SEQ ID NO: 1474972 - RNA, 16 nt, Human
cuguaacaagccagau

SEQ ID NO: 1474973 - RNA, 20 nt, Human
cuguacuugcucuugaugcc

SEQ ID NO: 1474974 - RNA, 19 nt, Human
cuguacuugcucuugaugc

SEQ ID NO: 1474975 - RNA, 16 nt, Human
cuguacuugcucuuga

SEQ ID NO: 1474976 - RNA, 21 nt, Human
cuguacuugcucuugaugccu

SEQ ID NO: 1474977 - RNA, 17 nt, Human
cugguuuucacauuaga

SEQ ID NO: 1474978 - RNA, 21 nt, Human
cuggucugguugggcagccag

SEQ ID NO: 1474979 - RNA, 14 nt, Human
cuggucucuccuug

SEQ ID NO: 1474980 - RNA, 22 nt, Human
cuuaaaauaaugaauacauuuc

SEQ ID NO: 1474981 - RNA, 12 nt, Human
cuuaaaacuccu

SEQ ID NO: 1474982 - RNA, 12 nt, Human
cuuaaaacuuug

SEQ ID NO: 1474983 - RNA, 15 nt, Human
cuuaaaccuucaguu

SEQ ID NO: 1474984 - RNA, 23 nt, Human
cuuaaaccuucaguuaugauuuu

SEQ ID NO: 1474985 - RNA, 15 nt, Human
cuguguauuccaaga

SEQ ID NO: 1474986 - RNA, 19 nt, Human
cuguguauuccaagacaug

SEQ ID NO: 1474987 - RNA, 14 nt, Human
cuguuaugcuguga

SEQ ID NO: 1474988 - RNA, 23 nt, Human
cuguuaucaaacaccaacauaaa

SEQ ID NO: 1474989 - RNA, 19 nt, Human
cuguuaugcugugacacau

SEQ ID NO: 1474990 - RNA, 16 nt, Human
gaaagaacggaagaag

SEQ ID NO: 1474991 - RNA, 15 nt, Human
gaaagaagaaggugg

SEQ ID NO: 1474992 - RNA, 23 nt, Human
gaaacuucagcgguuuauauaag

SEQ ID NO: 1474993 - RNA, 16 nt, Human
gaaagacagcuucuca

SEQ ID NO: 1474994 - RNA, 17 nt, Human
gaaagacagcuucucau

SEQ ID NO: 1474995 - RNA, 16 nt, Human
gaaagaccauuuuucc

SEQ ID NO: 1474996 - RNA, 19 nt, Human
gaaauauuugugacaaaaa

SEQ ID NO: 1474997 - RNA, 15 nt, Human
gaaaucaacuugcuu

SEQ ID NO: 1474998 - RNA, 19 nt, Human
cuuuuaugugaaacauguu

SEQ ID NO: 1474999 - RNA, 18 nt, Human
cuuuugggggucaacagu

SEQ ID NO: 1475000 - RNA, 23 nt, Human
cuuuugcgguucaggaaaauuga

SEQ ID NO: 1475001 - RNA, 22 nt, Human
cuuuugcucuuagcugucugcu

SEQ ID NO: 1475002 - RNA, 14 nt, Human
gaaaaaauauauau

SEQ ID NO: 1475003 - RNA, 21 nt, Human
cuuuuuuuuuuuuuaauaaau

SEQ ID NO: 1475004 - RNA, 16 nt, Human
gaaaagcagacauuuu

SEQ ID NO: 1475005 - RNA, 15 nt, Human
gaaaagcagacauuu

SEQ ID NO: 1475006 - RNA, 14 nt, Human
gaaaauuaacauga

SEQ ID NO: 1475007 - RNA, 18 nt, Human
gaaaacuuguauuaugug

SEQ ID NO: 1475008 - RNA, 16 nt, Human
gaaaauuuuuguagua

SEQ ID NO: 1475009 - RNA, 13 nt, Human
gaaaauuuuugua

SEQ ID NO: 1475010 - RNA, 14 nt, Human
gaaacaaaaacacu

SEQ ID NO: 1475011 - RNA, 19 nt, Human
gaaacaaaaacacuaaaaa

SEQ ID NO: 1475012 - RNA, 23 nt, Human
gaaacaaaaacacuaaaaauaaa

SEQ ID NO: 1475013 - RNA, 23 nt, Human
cuugauguaaaaucuugucaugu

SEQ ID NO: 1475014 - RNA, 17 nt, Human
cuugaugggauucugga

SEQ ID NO: 1475015 - RNA, 18 nt, Human
cuugaugggauucuggac

SEQ ID NO: 1475016 - RNA, 19 nt, Human
cuugaugggauucuggaca

SEQ ID NO: 1475017 - RNA, 13 nt, Human
cuugauguaaaau

SEQ ID NO: 1475018 - RNA, 14 nt, Human
cuugauguaaaauc

SEQ ID NO: 1475019 - RNA, 15 nt, Human
cuugauguaaaaucu

SEQ ID NO: 1475020 - RNA, 17 nt, Human
cuugauguaaaaucuug

SEQ ID NO: 1475021 - RNA, 18 nt, Human
cuugauguaaaaucuugu

SEQ ID NO: 1475022 - RNA, 20 nt, Human
cuugauguaaaaucuuguca

SEQ ID NO: 1475023 - RNA, 21 nt, Human
cuugauguaaaaucuugucau

SEQ ID NO: 1475024 - RNA, 22 nt, Human
cuugauguaaaaucuugucaug

SEQ ID NO: 1475025 - RNA, 19 nt, Human
cuugauugguguugccagu

SEQ ID NO: 1475026 - RNA, 24 nt, Human
cuugccucugcacacccuccagag

SEQ ID NO: 1475027 - RNA, 15 nt, Human
cuugccucugcacac

SEQ ID NO: 1475028 - RNA, 14 nt, Human
cuugccucugcaca

SEQ ID NO: 1475029 - RNA, 15 nt, Human
cuuuaacuuaaauag

SEQ ID NO: 1475030 - RNA, 19 nt, Human
cuuuaacuuaauugcuaug

SEQ ID NO: 1475031 - RNA, 19 nt, Human
cuugguucuugaggggacc

SEQ ID NO: 1475032 - RNA, 22 nt, Human
cuugguucuugaggggaccagg

SEQ ID NO: 1475033 - RNA, 23 nt, Human
cuugguucuugaggggaccagga

SEQ ID NO: 1475034 - RNA, 22 nt, Human
cuucuugaaauuuuaaccuaug

SEQ ID NO: 1475035 - RNA, 15 nt, Human
cuuccucuccugucu

SEQ ID NO: 1475036 - RNA, 19 nt, Human
cuuccucuccugucucccu

SEQ ID NO: 1475037 - RNA, 17 nt, Human
cuucuauacccacccag

SEQ ID NO: 1475038 - RNA, 21 nt, Human
cuucuauucuagccugcauug

SEQ ID NO: 1475039 - RNA, 20 nt, Human
cuucuauucuagccugcauu

SEQ ID NO: 1475040 - RNA, 13 nt, Human
cuucuauucuagc

SEQ ID NO: 1475041 - RNA, 24 nt, Human
cuucuauugccucugagagcauca

SEQ ID NO: 1475042 - RNA, 22 nt, Human
cuucuauugccucugagagcau

SEQ ID NO: 1475043 - RNA, 19 nt, Human
cuucuauugccucugagag

SEQ ID NO: 1475044 - RNA, 14 nt, Human
cuucuauuggucuc

SEQ ID NO: 1475045 - RNA, 18 nt, Human
cuucuauugccucugaga

SEQ ID NO: 1475046 - RNA, 16 nt, Human
cuucuauugccucuga

SEQ ID NO: 1475047 - RNA, 14 nt, Human
cuucuauugccucu

SEQ ID NO: 1475048 - RNA, 13 nt, Human
cuucuauugccuc

SEQ ID NO: 1475049 - RNA, 18 nt, Human
cuucuauacccacccaga

SEQ ID NO: 1475050 - RNA, 15 nt, Human
cuucuauacccaccc

SEQ ID NO: 1475051 - RNA, 17 nt, Human
cuucugaacucaaacug

SEQ ID NO: 1475052 - RNA, 18 nt, Human
cuucugaacucaaacuga

SEQ ID NO: 1475053 - RNA, 22 nt, Human
cuucugaacucaaacugaggaa

SEQ ID NO: 1475054 - RNA, 23 nt, Human
cuucccaaaguccugggauuaca

SEQ ID NO: 1475055 - RNA, 12 nt, Human
cuuacaugauuc

SEQ ID NO: 1475056 - RNA, 18 nt, Human
cuuacaugcauuacugca

SEQ ID NO: 1475057 - RNA, 19 nt, Human
cuuacaugcauuacugcau

SEQ ID NO: 1475058 - RNA, 16 nt, Human
caggcacacaccacca

SEQ ID NO: 1475059 - RNA, 15 nt, Human
caggcaccaaaagaa

SEQ ID NO: 1475060 - RNA, 16 nt, Human
caggcaccaaaagaag

SEQ ID NO: 1475061 - RNA, 19 nt, Human
caggcaccaaaagaaguaa

SEQ ID NO: 1475062 - RNA, 20 nt, Human
caggcaccaggacuagggcu

SEQ ID NO: 1475063 - RNA, 13 nt, Human
caggccagagcca

SEQ ID NO: 1475064 - RNA, 15 nt, Human
cagggcucuguaagu

SEQ ID NO: 1475065 - RNA, 20 nt, Human
cagucugacuguuuccauca

SEQ ID NO: 1475066 - RNA, 17 nt, Human
cagucugagagaggcca

SEQ ID NO: 1475067 - RNA, 22 nt, Human
cagugggaggugagaccaccuc

SEQ ID NO: 1475068 - RNA, 22 nt, Human
cagugggaggguaccagcagaa

SEQ ID NO: 1475069 - RNA, 14 nt, Human
caguggggaaugaa

SEQ ID NO: 1475070 - RNA, 21 nt, Human
cagugggaggugagaccaccu

SEQ ID NO: 1475071 - RNA, 16 nt, Human
cagucaccucauggaa

SEQ ID NO: 1475072 - RNA, 19 nt, Human
cagucaccucauggaauug

SEQ ID NO: 1475073 - RNA, 15 nt, Human
caguaaagcacuugc

SEQ ID NO: 1475074 - RNA, 23 nt, Human
caguaaagaacaucccuccuggg

SEQ ID NO: 1475075 - RNA, 13 nt, Human
cagauccuggaaa

SEQ ID NO: 1475076 - RNA, 12 nt, Human
cagauccuggaa

SEQ ID NO: 1475077 - RNA, 13 nt, Human
cagauccuccuca

SEQ ID NO: 1475078 - RNA, 14 nt, Human
cagauccuccucau

SEQ ID NO: 1475079 - RNA, 16 nt, Human
cagauccuccucauuc

SEQ ID NO: 1475080 - RNA, 21 nt, Human
cagaguaauccaagcaaaugu

SEQ ID NO: 1475081 - RNA, 22 nt, Human
cagagguagucucacugcuuga

SEQ ID NO: 1475082 - RNA, 17 nt, Human
cagaggguguccugcac

SEQ ID NO: 1475083 - RNA, 13 nt, Human
cagcauaauacuu

SEQ ID NO: 1475084 - RNA, 20 nt, Human
cagcauccccuugaacucuu

SEQ ID NO: 1475085 - RNA, 19 nt, Human
cagcauccccuugaacucu

SEQ ID NO: 1475086 - RNA, 22 nt, Human
cagcugccuggaagagcagccc

SEQ ID NO: 1475087 - RNA, 11 nt, Human
cagcugugcuu

SEQ ID NO: 1475088 - RNA, 14 nt, Human
cagcugugcuuaug

SEQ ID NO: 1475089 - RNA, 13 nt, Human
cagccucuggggg

SEQ ID NO: 1475090 - RNA, 16 nt, Human
cagcccuuuugucucu

SEQ ID NO: 1475091 - RNA, 14 nt, Human
cagcccuuuugucu

SEQ ID NO: 1475092 - RNA, 20 nt, Human
caugcucuccaaaccacuuu

SEQ ID NO: 1475093 - RNA, 16 nt, Human
caugcuaucucugugu

SEQ ID NO: 1475094 - RNA, 14 nt, Human
caugcuaauuauau

SEQ ID NO: 1475095 - RNA, 12 nt, Human
caugcuccuuac

SEQ ID NO: 1475096 - RNA, 19 nt, Human
caugcugaaggcugaaaga

SEQ ID NO: 1475097 - RNA, 16 nt, Human
caugcugcuggggaag

SEQ ID NO: 1475098 - RNA, 22 nt, Human
caugcugcuggggaagacagug

SEQ ID NO: 1475099 - RNA, 17 nt, Human
caugcugcuggggaaga

SEQ ID NO: 1475100 - RNA, 21 nt, Human
caugcugcuggggaagacagu

SEQ ID NO: 1475101 - RNA, 17 nt, Human
caugcuggaaaauaaua

SEQ ID NO: 1475102 - RNA, 22 nt, Human
caugcuggaaaauaauacugcu

SEQ ID NO: 1475103 - RNA, 23 nt, Human
caugcuggaaaauaauacugcug

SEQ ID NO: 1475104 - RNA, 12 nt, Human
cauggcuaucug

SEQ ID NO: 1475105 - RNA, 14 nt, Human
cauggcuauuuuau

SEQ ID NO: 1475106 - RNA, 15 nt, Human
cauggcuauuuuaua

SEQ ID NO: 1475107 - RNA, 17 nt, Human
cauggcuauuuuauauu

SEQ ID NO: 1475108 - RNA, 14 nt, Human
caugauguuuagaa

SEQ ID NO: 1475109 - RNA, 24 nt, Human
caugauuuugaaaucaugaagaua

SEQ ID NO: 1475110 - RNA, 13 nt, Human
cauuauaaaaaga

SEQ ID NO: 1475111 - RNA, 16 nt, Human
cauuauaaccuuaauu

SEQ ID NO: 1475112 - RNA, 18 nt, Human
cauuauaaccuuaauuua

SEQ ID NO: 1475113 - RNA, 19 nt, Human
cauuauauuuauuacugua

SEQ ID NO: 1475114 - RNA, 20 nt, Human
cauguauuuggugauuacau

SEQ ID NO: 1475115 - RNA, 15 nt, Human
cauguauuuggugau

SEQ ID NO: 1475116 - RNA, 14 nt, Human
caugucaaacaaau

SEQ ID NO: 1475117 - RNA, 15 nt, Human
caugucaaacaaaua

SEQ ID NO: 1475118 - RNA, 14 nt, Human
cauguccuguaaag

SEQ ID NO: 1475119 - RNA, 15 nt, Human
cauguccuguaaagg

SEQ ID NO: 1475120 - RNA, 13 nt, Human
cauguuagccagg

SEQ ID NO: 1475121 - RNA, 16 nt, Human
cauguuagcccuuccu

SEQ ID NO: 1475122 - RNA, 19 nt, Human
caucuggaaccaucagaaa

SEQ ID NO: 1475123 - RNA, 17 nt, Human
caucuggaaccaucaga

SEQ ID NO: 1475124 - RNA, 12 nt, Human
caucuggaacca

SEQ ID NO: 1475125 - RNA, 12 nt, Human
cauccuggaaua

SEQ ID NO: 1475126 - RNA, 17 nt, Human
caucgucuucuuggcca

SEQ ID NO: 1475127 - RNA, 14 nt, Human
caucacuuguacaa

SEQ ID NO: 1475128 - RNA, 15 nt, Human
caucacuuguacaaa

SEQ ID NO: 1475129 - RNA, 19 nt, Human
cauccccuugaacucuuca

SEQ ID NO: 1475130 - RNA, 16 nt, Human
ccaccgcagaaggaag

SEQ ID NO: 1475131 - RNA, 15 nt, Human
ccaccgcagaaggaa

SEQ ID NO: 1475132 - RNA, 14 nt, Human
ccacagcugccucu

SEQ ID NO: 1475133 - RNA, 19 nt, Human
cauuuguauaaaauaauuu

SEQ ID NO: 1475134 - RNA, 20 nt, Human
cauuuguauaaaauaauuuu

SEQ ID NO: 1475135 - RNA, 16 nt, Human
cauuuguguugaagag

SEQ ID NO: 1475136 - RNA, 22 nt, Human
cauuuuuugggcagcaauuuaa

SEQ ID NO: 1475137 - RNA, 19 nt, Human
cauuuuuugggcagcaauu

SEQ ID NO: 1475138 - RNA, 18 nt, Human
cauuuuuugggcagcaau

SEQ ID NO: 1475139 - RNA, 20 nt, Human
cauuuguguugaagagguuu

SEQ ID NO: 1475140 - RNA, 16 nt, Human
ccaaaagauugcugaa

SEQ ID NO: 1475141 - RNA, 19 nt, Human
ccaaaagauugcugaaauu

SEQ ID NO: 1475142 - RNA, 22 nt, Human
ccaaaagauugcugaaauuuua

SEQ ID NO: 1475143 - RNA, 12 nt, Human
ccaaugaaauga

SEQ ID NO: 1475144 - RNA, 18 nt, Human
ccaaugcaccuaaagaaa

SEQ ID NO: 1475145 - RNA, 17 nt, Human
auugauccagaaagaaa

SEQ ID NO: 1475146 - RNA, 16 nt, Human
auugauccagaaagaa

SEQ ID NO: 1475147 - RNA, 11 nt, Human
auugagagaau

SEQ ID NO: 1475148 - RNA, 20 nt, Human
auugagaaaaauauauacua

SEQ ID NO: 1475149 - RNA, 13 nt, Human
auuccugaacagg

SEQ ID NO: 1475150 - RNA, 20 nt, Human
auucugauucgaaugacacu

SEQ ID NO: 1475151 - RNA, 21 nt, Human
auucugauucgaaugacacug

SEQ ID NO: 1475152 - RNA, 17 nt, Human
auucuugccaaauauaa

SEQ ID NO: 1475153 - RNA, 22 nt, Human
auucugauucgaaugacacugu

SEQ ID NO: 1475154 - RNA, 21 nt, Human
auuauguguguuuuaaaauga

SEQ ID NO: 1475155 - RNA, 20 nt, Human
auuauguguguuuuaaaaug

SEQ ID NO: 1475156 - RNA, 15 nt, Human
auuauguguguuuua

SEQ ID NO: 1475157 - RNA, 20 nt, Human
auucauauuuucuuucaaaa

SEQ ID NO: 1475158 - RNA, 16 nt, Human
auucauauuuucuuuc

SEQ ID NO: 1475159 - RNA, 18 nt, Human
auucauuuuaacaucuga

SEQ ID NO: 1475160 - RNA, 13 nt, Human
auucaugacuaug

SEQ ID NO: 1475161 - RNA, 21 nt, Human
auucauuuuaacaucugagaa

SEQ ID NO: 1475162 - RNA, 14 nt, Human
auucauuuucucua

SEQ ID NO: 1475163 - RNA, 16 nt, Human
auucauuuucucuaau

SEQ ID NO: 1475164 - RNA, 15 nt, Human
auucauuuucucuaa

SEQ ID NO: 1475165 - RNA, 22 nt, Human
auugauccagaaagaaaacuug

SEQ ID NO: 1475166 - RNA, 19 nt, Human
auugauccagaaagaaaac

SEQ ID NO: 1475167 - RNA, 18 nt, Human
auugauccagaaagaaaa

SEQ ID NO: 1475168 - RNA, 18 nt, Human
auugaugggauuugguca

SEQ ID NO: 1475169 - RNA, 14 nt, Human
auuguaaaacaggu

SEQ ID NO: 1475170 - RNA, 23 nt, Human
auuguaauaggcguaacuaauuu

SEQ ID NO: 1475171 - RNA, 14 nt, Human
auuguaaauauugu

SEQ ID NO: 1475172 - RNA, 15 nt, Human
auuucuaugaaauau

SEQ ID NO: 1475173 - RNA, 18 nt, Human
auuucuaugaaauauuau

SEQ ID NO: 1475174 - RNA, 14 nt, Human
auuucaucuauuuu

SEQ ID NO: 1475175 - RNA, 20 nt, Human
auuucuaugaaauauuaugu

SEQ ID NO: 1475176 - RNA, 16 nt, Human
auuucagcagcugcag

SEQ ID NO: 1475177 - RNA, 18 nt, Human
auuucagauucccagagc

SEQ ID NO: 1475178 - RNA, 13 nt, Human
auuucaucuauuu

SEQ ID NO: 1475179 - RNA, 11 nt, Human
auuucaaguuc

SEQ ID NO: 1475180 - RNA, 16 nt, Human
auuucaaguuccaagu

SEQ ID NO: 1475181 - RNA, 22 nt, Human
auuucaaguuccaaguugcuaa

SEQ ID NO: 1475182 - RNA, 23 nt, Human
auuucaaguuccaaguugcuaau

SEQ ID NO: 1475183 - RNA, 16 nt, Human
auuucagagaggccuu

SEQ ID NO: 1475184 - RNA, 22 nt, Human
auuucagagaggccuuuuggaa

SEQ ID NO: 1475185 - RNA, 18 nt, Human
auuuauauuguaaauauu

SEQ ID NO: 1475186 - RNA, 21 nt, Human
auuuauauuguaaauauugug

SEQ ID NO: 1475187 - RNA, 20 nt, Human
auuuauauuguaaauauugu

SEQ ID NO: 1475188 - RNA, 22 nt, Human
caaauccagccugcugccugcu

SEQ ID NO: 1475189 - RNA, 14 nt, Human
caacaauuuaugaa

SEQ ID NO: 1475190 - RNA, 16 nt, Human
caacaauuuaugaauu

SEQ ID NO: 1475191 - RNA, 17 nt, Human
caacaauuuaugaauug

SEQ ID NO: 1475192 - RNA, 18 nt, Human
caacaauuuaugaauuga

SEQ ID NO: 1475193 - RNA, 14 nt, Human
caaaucgaaugaaa

SEQ ID NO: 1475194 - RNA, 18 nt, Human
caaaucuaccacuguaug

SEQ ID NO: 1475195 - RNA, 14 nt, Human
caaaucuaccacug

SEQ ID NO: 1475196 - RNA, 18 nt, Human
caacaccucuuggggagu

SEQ ID NO: 1475197 - RNA, 23 nt, Human
caagaauuucuaggacugaauua

SEQ ID NO: 1475198 - RNA, 13 nt, Human
caagaagggacug

SEQ ID NO: 1475199 - RNA, 18 nt, Human
caagaagggacugagaga

SEQ ID NO: 1475200 - RNA, 16 nt, Human
caagaagggacugaga

SEQ ID NO: 1475201 - RNA, 17 nt, Human
caagaauaaucacgcuu

SEQ ID NO: 1475202 - RNA, 18 nt, Human
caagaauaaucacgcuuu

SEQ ID NO: 1475203 - RNA, 20 nt, Human
caagaauaaucacgcuuucc

SEQ ID NO: 1475204 - RNA, 16 nt, Human
caagaaggcaaaaaua

SEQ ID NO: 1475205 - RNA, 16 nt, Human
caaccccagacacugg

SEQ ID NO: 1475206 - RNA, 21 nt, Human
caacuaucucauuuccaagca

SEQ ID NO: 1475207 - RNA, 13 nt, Human
caaccauuuccuc

SEQ ID NO: 1475208 - RNA, 16 nt, Human
caaccauuuccucaga

SEQ ID NO: 1475209 - RNA, 17 nt, Human
caaccauuuccucagac

SEQ ID NO: 1475210 - RNA, 18 nt, Human
caaccauuauaaccuuaa

SEQ ID NO: 1475211 - RNA, 22 nt, Human
caaccauuauaaccuuaauuua

SEQ ID NO: 1475212 - RNA, 13 nt, Human
caaccauuccaga

SEQ ID NO: 1475213 - RNA, 14 nt, Human
caaccauuccagac

SEQ ID NO: 1475214 - RNA, 16 nt, Human
caaccauuccagacug

SEQ ID NO: 1475215 - RNA, 22 nt, Human
caaccauuccagacugcuucca

SEQ ID NO: 1475216 - RNA, 17 nt, Human
caaaccacuuuuugcag

SEQ ID NO: 1475217 - RNA, 16 nt, Human
caaaaguuacauguuu

SEQ ID NO: 1475218 - RNA, 19 nt, Human
caaaccacuuuuugcagcu

SEQ ID NO: 1475219 - RNA, 17 nt, Human
caaaccaaaucacugaa

SEQ ID NO: 1475220 - RNA, 22 nt, Human
caaaagcccauucauuccauuc

SEQ ID NO: 1475221 - RNA, 20 nt, Human
caaaagcccauucauuccau

SEQ ID NO: 1475222 - RNA, 17 nt, Human
auuuuuuuuuccuagcc

SEQ ID NO: 1475223 - RNA, 14 nt, Human
caaaaaaaaauaca

SEQ ID NO: 1475224 - RNA, 16 nt, Human
auuuuuacauucugaa

SEQ ID NO: 1475225 - RNA, 12 nt, Human
auuuuuaccagu

SEQ ID NO: 1475226 - RNA, 11 nt, Human
auuuuuaccag

SEQ ID NO: 1475227 - RNA, 17 nt, Human
auuuuuacauucugaau

SEQ ID NO: 1475228 - RNA, 17 nt, Human
auuuuauagcuacuaau

SEQ ID NO: 1475229 - RNA, 23 nt, Human
auuuuauaugcuuacugauauau

SEQ ID NO: 1475230 - RNA, 18 nt, Human
auuuuauauuacacuaca

SEQ ID NO: 1475231 - RNA, 15 nt, Human
auuuuauauuacacu

SEQ ID NO: 1475232 - RNA, 16 nt, Human
auuuucuuucuguaac

SEQ ID NO: 1475233 - RNA, 14 nt, Human
auuuucuuucaaaa

SEQ ID NO: 1475234 - RNA, 23 nt, Human
auuuucuuuguguagcuuugcuc

SEQ ID NO: 1475235 - RNA, 24 nt, Human
auuuugacauaaaguugauaaaga

SEQ ID NO: 1475236 - RNA, 17 nt, Human
auuuugacauaaaguug

SEQ ID NO: 1475237 - RNA, 22 nt, Human
auuuugagaaagucuuauuuau

SEQ ID NO: 1475238 - RNA, 20 nt, Human
cacugaacuuugcugagccu

SEQ ID NO: 1475239 - RNA, 11 nt, Human
cacugaagaag

SEQ ID NO: 1475240 - RNA, 17 nt, Human
cacucuugaaaaaugca

SEQ ID NO: 1475241 - RNA, 23 nt, Human
cacuagcccaaugaaaugaauua

SEQ ID NO: 1475242 - RNA, 13 nt, Human
cacggcagccaca

SEQ ID NO: 1475243 - RNA, 12 nt, Human
cacuacacccag

SEQ ID NO: 1475244 - RNA, 13 nt, Human
cacuacaaccucc

SEQ ID NO: 1475245 - RNA, 14 nt, Human
cacuacaaccuccg

SEQ ID NO: 1475246 - RNA, 22 nt, Human
cacuaauucauuaaucugccuc

SEQ ID NO: 1475247 - RNA, 20 nt, Human
cacggcagccacagcuuggg

SEQ ID NO: 1475248 - RNA, 23 nt, Human
cacuacgccuggcugauuuuugu

SEQ ID NO: 1475249 - RNA, 18 nt, Human
cacuacacccagcaauag

SEQ ID NO: 1475250 - RNA, 17 nt, Human
cacuacacccagcaaua

SEQ ID NO: 1475251 - RNA, 16 nt, Human
cacuacacccagcaau

SEQ ID NO: 1475252 - RNA, 15 nt, Human
cacuacacccagcaa

SEQ ID NO: 1475253 - RNA, 14 nt, Human
cacuacacccagca

SEQ ID NO: 1475254 - RNA, 19 nt, Human
caccuaugucauuucauuu

SEQ ID NO: 1475255 - RNA, 20 nt, Human
caccuaugucauuucauuuc

SEQ ID NO: 1475256 - RNA, 23 nt, Human
caccuaugucauuucauuuccua

SEQ ID NO: 1475257 - RNA, 12 nt, Human
caccuaaagaaa

SEQ ID NO: 1475258 - RNA, 13 nt, Human
caccuaaagaaaa

SEQ ID NO: 1475259 - RNA, 17 nt, Human
caccuaaagaaaaacaa

SEQ ID NO: 1475260 - RNA, 14 nt, Human
caccguucauucag

SEQ ID NO: 1475261 - RNA, 14 nt, Human
caccuuuaaagugu

SEQ ID NO: 1475262 - RNA, 23 nt, Human
caccuugugcuggggacaggucc

SEQ ID NO: 1475263 - RNA, 16 nt, Human
cagaaguuugcacuau

SEQ ID NO: 1475264 - RNA, 18 nt, Human
cagaaguuugcacuaucu

SEQ ID NO: 1475265 - RNA, 22 nt, Human
cagaaguuugcacuaucuuuca

SEQ ID NO: 1475266 - RNA, 20 nt, Human
cacuguuuagaacacacaca

SEQ ID NO: 1475267 - RNA, 11 nt, Human
cacuguuuaag

SEQ ID NO: 1475268 - RNA, 21 nt, Human
cacuuacuuuuucuggucucu

SEQ ID NO: 1475269 - RNA, 12 nt, Human
cacuuguacaaa

SEQ ID NO: 1475270 - RNA, 17 nt, Human
cacuuguacaaaauaaa

SEQ ID NO: 1475271 - RNA, 13 nt, Human
cacuggggcaggg

SEQ ID NO: 1475272 - RNA, 15 nt, Human
cacuggggcaggggc

SEQ ID NO: 1475273 - RNA, 21 nt, Human
cacagggccuuuggcaggugc

SEQ ID NO: 1475274 - RNA, 20 nt, Human
cacagggagugcacauaucc

SEQ ID NO: 1475275 - RNA, 12 nt, Human
cacagcuaugaa

SEQ ID NO: 1475276 - RNA, 22 nt, Human
cacagcuaugaaggcuguacac

SEQ ID NO: 1475277 - RNA, 19 nt, Human
cacagacagggucaaagug

SEQ ID NO: 1475278 - RNA, 19 nt, Human
cacagaagugcuuucuucu

SEQ ID NO: 1475279 - RNA, 19 nt, Human
cacaucgcagauucucccu

SEQ ID NO: 1475280 - RNA, 18 nt, Human
cacauuuuccuuuucaaa

SEQ ID NO: 1475281 - RNA, 15 nt, Human
cacauuuuaaaagug

SEQ ID NO: 1475282 - RNA, 14 nt, Human
caccaggcagccuc

SEQ ID NO: 1475283 - RNA, 15 nt, Human
caccaggcagccucu

SEQ ID NO: 1475284 - RNA, 18 nt, Human
caccaggcagccucuggg

SEQ ID NO: 1475285 - RNA, 13 nt, Human
caauaaaaauguu

SEQ ID NO: 1475286 - RNA, 14 nt, Human
caaguauuagaaua

SEQ ID NO: 1475287 - RNA, 16 nt, Human
caaguagaaucucagu

SEQ ID NO: 1475288 - RNA, 24 nt, Human
caaguacaaccacacccacacuca

SEQ ID NO: 1475289 - RNA, 19 nt, Human
caaguacaaccacacccac

SEQ ID NO: 1475290 - RNA, 13 nt, Human
caaguagaaucuc

SEQ ID NO: 1475291 - RNA, 23 nt, Human
caaguagaaucucaguugauuuu

SEQ ID NO: 1475292 - RNA, 20 nt, Human
caaguauuagaauaccacag

SEQ ID NO: 1475293 - RNA, 15 nt, Human
caaguugcuaauaca

SEQ ID NO: 1475294 - RNA, 18 nt, Human
caaguugugcuugagcca

SEQ ID NO: 1475295 - RNA, 21 nt, Human
caaguuguuccuuaagucaga

SEQ ID NO: 1475296 - RNA, 22 nt, Human
caaguuguuccuuaagucagaa

SEQ ID NO: 1475297 - RNA, 16 nt, Human
cacaagacugcacauc

SEQ ID NO: 1475298 - RNA, 18 nt, Human
cacaagacugcacaucaa

SEQ ID NO: 1475299 - RNA, 12 nt, Human
caauauuucaga

SEQ ID NO: 1475300 - RNA, 20 nt, Human
caauauuucagauaaucaca

SEQ ID NO: 1475301 - RNA, 21 nt, Human
caauauuucagauaaucacaa

SEQ ID NO: 1475302 - RNA, 14 nt, Human
caaugcuguauuuu

SEQ ID NO: 1475303 - RNA, 23 nt, Human
caaugcuguauuuuaaaagaaug

SEQ ID NO: 1475304 - RNA, 17 nt, Human
caauucuucccuaucuu

SEQ ID NO: 1475305 - RNA, 20 nt, Human
caauucuucccuaucuuugc

SEQ ID NO: 1475306 - RNA, 12 nt, Human
ccaucccugcgu

SEQ ID NO: 1475307 - RNA, 13 nt, Human
ccaucccuggccc

SEQ ID NO: 1475308 - RNA, 16 nt, Human
ccaucccuggcccccu

SEQ ID NO: 1475309 - RNA, 19 nt, Human
ccaucccuggcccccuccc

SEQ ID NO: 1475310 - RNA, 23 nt, Human
ccaucccuggcccccucccugga

SEQ ID NO: 1475311 - RNA, 22 nt, Human
ccaucccuggcccccucccugg

SEQ ID NO: 1475312 - RNA, 17 nt, Human
ccauccuacccccugug

SEQ ID NO: 1475313 - RNA, 13 nt, Human
ccauacauuugug

SEQ ID NO: 1475314 - RNA, 14 nt, Human
ccauacauuugugu

SEQ ID NO: 1475315 - RNA, 11 nt, Human
ccauugaaggc

SEQ ID NO: 1475316 - RNA, 12 nt, Human
ccauugaaggcu

SEQ ID NO: 1475317 - RNA, 17 nt, Human
ccauugaaggcuuaaac

SEQ ID NO: 1475318 - RNA, 21 nt, Human
ccauugaaggcuuaaacccau

SEQ ID NO: 1475319 - RNA, 19 nt, Human
ccauuuaaauuuuuuuccu

SEQ ID NO: 1475320 - RNA, 16 nt, Human
ccauuuagguuucuga

SEQ ID NO: 1475321 - RNA, 21 nt, Human
ccauuuagguuucugaguucc

SEQ ID NO: 1475322 - RNA, 15 nt, Human
ccagggggcaagagg

SEQ ID NO: 1475323 - RNA, 19 nt, Human
ccaggaguggguggggagu

SEQ ID NO: 1475324 - RNA, 17 nt, Human
ccaggauggcgcaggaa

SEQ ID NO: 1475325 - RNA, 16 nt, Human
ccaggauggcgcagga

SEQ ID NO: 1475326 - RNA, 18 nt, Human
ccaggaggugccacugga

SEQ ID NO: 1475327 - RNA, 21 nt, Human
ccaggaggugccacuggagug

SEQ ID NO: 1475328 - RNA, 19 nt, Human
ccaggaggugccacuggag

SEQ ID NO: 1475329 - RNA, 15 nt, Human
ccagcuaauuuuugu

SEQ ID NO: 1475330 - RNA, 22 nt, Human
cccagcugugcuuaugguacca

SEQ ID NO: 1475331 - RNA, 15 nt, Human
cccaggaacugggcc

SEQ ID NO: 1475332 - RNA, 18 nt, Human
cccagcacuuguguuguc

SEQ ID NO: 1475333 - RNA, 12 nt, Human
cccauuucagcu

SEQ ID NO: 1475334 - RNA, 13 nt, Human
cccauuucagcug

SEQ ID NO: 1475335 - RNA, 13 nt, Human
cccagggcucugu

SEQ ID NO: 1475336 - RNA, 16 nt, Human
cccagggcucuguaag

SEQ ID NO: 1475337 - RNA, 14 nt, Human
cccucacacuggga

SEQ ID NO: 1475338 - RNA, 13 nt, Human
cccucacacuggg

SEQ ID NO: 1475339 - RNA, 12 nt, Human
cccucacacugg

SEQ ID NO: 1475340 - RNA, 10 nt, Human
cccucacacu

SEQ ID NO: 1475341 - RNA, 21 nt, Human
cccuaucuuugccacccucau

SEQ ID NO: 1475342 - RNA, 19 nt, Human
cccuaucuuugccacccuc

SEQ ID NO: 1475343 - RNA, 16 nt, Human
cccuaucuuugccacc

SEQ ID NO: 1475344 - RNA, 14 nt, Human
cccuaucuuugcca

SEQ ID NO: 1475345 - RNA, 18 nt, Human
ccccuucuccccugcacu

SEQ ID NO: 1475346 - RNA, 18 nt, Human
ccccuugacaacuggcag

SEQ ID NO: 1475347 - RNA, 23 nt, Human
ccccuugacaacuggcaggcagg

SEQ ID NO: 1475348 - RNA, 12 nt, Human
ccccuucucccc

SEQ ID NO: 1475349 - RNA, 19 nt, Human
ccccuucuccccugcacug

SEQ ID NO: 1475350 - RNA, 11 nt, Human
ccccugcacug

SEQ ID NO: 1475351 - RNA, 18 nt, Human
ccccugcacuguaaaaug

SEQ ID NO: 1475352 - RNA, 14 nt, Human
ccccugcacuguaa

SEQ ID NO: 1475353 - RNA, 16 nt, Human
ccccugcacuguaaaa

SEQ ID NO: 1475354 - RNA, 17 nt, Human
ccccugcacuguaaaau

SEQ ID NO: 1475355 - RNA, 23 nt, Human
ccucauggaauuggagcucgugg

SEQ ID NO: 1475356 - RNA, 20 nt, Human
ccucaaaaagauuuccccau

SEQ ID NO: 1475357 - RNA, 21 nt, Human
ccucaaagcaagcauucagaa

SEQ ID NO: 1475358 - RNA, 18 nt, Human
ccucccauguucaagcga

SEQ ID NO: 1475359 - RNA, 18 nt, Human
ccuccaacccuagcaaaa

SEQ ID NO: 1475360 - RNA, 19 nt, Human
ccuccaaagcuucccacgg

SEQ ID NO: 1475361 - RNA, 19 nt, Human
ccuccaacccuagcaaaag

SEQ ID NO: 1475362 - RNA, 14 nt, Human
ccggccugccagga

SEQ ID NO: 1475363 - RNA, 15 nt, Human
ccggccugccaggag

SEQ ID NO: 1475364 - RNA, 18 nt, Human
ccggccugccaggaggac

SEQ ID NO: 1475365 - RNA, 16 nt, Human
ccggccugccaggagg

SEQ ID NO: 1475366 - RNA, 22 nt, Human
ccugucugucugucugucccaa

SEQ ID NO: 1475367 - RNA, 21 nt, Human
ccugucugucugucuguccca

SEQ ID NO: 1475368 - RNA, 20 nt, Human
ccugucugucugucuguccc

SEQ ID NO: 1475369 - RNA, 22 nt, Human
ccugucgauuagacuggacagc

SEQ ID NO: 1475370 - RNA, 13 nt, Human
ccugggccuuggg

SEQ ID NO: 1475371 - RNA, 16 nt, Human
ccugucgauuagacug

SEQ ID NO: 1475372 - RNA, 16 nt, Human
ccugccucccuucaug

SEQ ID NO: 1475373 - RNA, 11 nt, Human
ccugccuccug

SEQ ID NO: 1475374 - RNA, 16 nt, Human
ccugccuccccugccu

SEQ ID NO: 1475375 - RNA, 16 nt, Human
ccugagucccaucccu

SEQ ID NO: 1475376 - RNA, 19 nt, Human
ccugagucguacagaaagc

SEQ ID NO: 1475377 - RNA, 21 nt, Human
ccugagucguacagaaagcug

SEQ ID NO: 1475378 - RNA, 22 nt, Human
ccugagucguacagaaagcugc

SEQ ID NO: 1475379 - RNA, 11 nt, Human
ccugaguccca

SEQ ID NO: 1475380 - RNA, 23 nt, Human
ccugagucacccuaccugugccu

SEQ ID NO: 1475381 - RNA, 14 nt, Human
cuaauucuaaugug

SEQ ID NO: 1475382 - RNA, 13 nt, Human
cuaauuuauaaaa

SEQ ID NO: 1475383 - RNA, 14 nt, Human
cuaauuuauaaaaa

SEQ ID NO: 1475384 - RNA, 17 nt, Human
cuaaguguuucauaaau

SEQ ID NO: 1475385 - RNA, 15 nt, Human
cuaaguuaauuuaaa

SEQ ID NO: 1475386 - RNA, 17 nt, Human
cuaaguuaauuuaaagu

SEQ ID NO: 1475387 - RNA, 21 nt, Human
cuaaguuaauuuaaaguuguu

SEQ ID NO: 1475388 - RNA, 23 nt, Human
cgugugggagaccggccugccag

SEQ ID NO: 1475389 - RNA, 21 nt, Human
cuaccuguugagcaucacaga

SEQ ID NO: 1475390 - RNA, 12 nt, Human
cuaccugugccu

SEQ ID NO: 1475391 - RNA, 13 nt, Human
cuaccugugccug

SEQ ID NO: 1475392 - RNA, 22 nt, Human
cuaccuguugagcaucacagaa

SEQ ID NO: 1475393 - RNA, 14 nt, Human
cuacguauuuaaua

SEQ ID NO: 1475394 - RNA, 14 nt, Human
cuacaugaaacaga

SEQ ID NO: 1475395 - RNA, 10 nt, Human
cuacaugaaa

SEQ ID NO: 1475396 - RNA, 13 nt, Human
cuacaugaaacag

SEQ ID NO: 1475397 - RNA, 22 nt, Human
cuacaugaucuagagccaguua

SEQ ID NO: 1475398 - RNA, 19 nt, Human
cuaccugcucagcccugca

SEQ ID NO: 1475399 - RNA, 16 nt, Human
cuaccuggucucuccu

SEQ ID NO: 1475400 - RNA, 17 nt, Human
cuaauuuauaaaaaggu

SEQ ID NO: 1475401 - RNA, 21 nt, Human
cuaauuuauccugaaauuuca

SEQ ID NO: 1475402 - RNA, 23 nt, Human
cuaauuuauccugaaauuucaga

SEQ ID NO: 1475403 - RNA, 23 nt, Human
cuagaauuugauaugugaacagu

SEQ ID NO: 1475404 - RNA, 14 nt, Human
cuagaauuucuuua

SEQ ID NO: 1475405 - RNA, 13 nt, Human
cuagacaagccag

SEQ ID NO: 1475406 - RNA, 14 nt, Human
cuagacaagccaga

SEQ ID NO: 1475407 - RNA, 16 nt, Human
cuagacaagccagaac

SEQ ID NO: 1475408 - RNA, 17 nt, Human
cuagacaagccagaacu

SEQ ID NO: 1475409 - RNA, 18 nt, Human
cuaucguaaaauuaagaa

SEQ ID NO: 1475410 - RNA, 17 nt, Human
cuaucguaaaauuaaga

SEQ ID NO: 1475411 - RNA, 18 nt, Human
cuaguuuucuccucccag

SEQ ID NO: 1475412 - RNA, 19 nt, Human
cuaguuuucuccucccagg

SEQ ID NO: 1475413 - RNA, 16 nt, Human
cuaguuuucuccuccc

SEQ ID NO: 1475414 - RNA, 17 nt, Human
cuaguuuucuccuccca

SEQ ID NO: 1475415 - RNA, 22 nt, Human
cucaaaccaaaucacugaacuu

SEQ ID NO: 1475416 - RNA, 19 nt, Human
cucaaaccaaaucacugaa

SEQ ID NO: 1475417 - RNA, 18 nt, Human
cucaaaccaaaucacuga

SEQ ID NO: 1475418 - RNA, 13 nt, Human
cucaaaauauuug

SEQ ID NO: 1475419 - RNA, 18 nt, Human
cucaaaauauuuguacau

SEQ ID NO: 1475420 - RNA, 19 nt, Human
cucaauauucaauaaagcu

SEQ ID NO: 1475421 - RNA, 18 nt, Human
cucaauauucaauaaagc

SEQ ID NO: 1475422 - RNA, 17 nt, Human
cucaauauucaauaaag

SEQ ID NO: 1475423 - RNA, 16 nt, Human
cucaauauucaauaaa

SEQ ID NO: 1475424 - RNA, 19 nt, Human
cucaaacuccugaccucag

SEQ ID NO: 1475425 - RNA, 14 nt, Human
cucaaacuccugac

SEQ ID NO: 1475426 - RNA, 19 nt, Human
cucaauucuucccuaucuu

SEQ ID NO: 1475427 - RNA, 14 nt, Human
cucaauucuucccu

SEQ ID NO: 1475428 - RNA, 16 nt, Human
cucaauuucugaacac

SEQ ID NO: 1475429 - RNA, 22 nt, Human
cucacaaaccaugcaaaugcua

SEQ ID NO: 1475430 - RNA, 18 nt, Human
ccuuuuuauuugcaugug

SEQ ID NO: 1475431 - RNA, 17 nt, Human
ccuuuuuauuugcaugu

SEQ ID NO: 1475432 - RNA, 17 nt, Human
cgacugaaaauauuguu

SEQ ID NO: 1475433 - RNA, 18 nt, Human
cgacugaaaauauuguuu

SEQ ID NO: 1475434 - RNA, 18 nt, Human
ccuugcuuaugacaucac

SEQ ID NO: 1475435 - RNA, 17 nt, Human
cgccuccaacccuagca

SEQ ID NO: 1475436 - RNA, 16 nt, Human
cgccuccaacccuagc

SEQ ID NO: 1475437 - RNA, 23 nt, Human
cggaggaaggaggacccaggaca

SEQ ID NO: 1475438 - RNA, 21 nt, Human
cggaggaaggaggacccagga

SEQ ID NO: 1475439 - RNA, 20 nt, Human
cggaggaaggaggacccagg

SEQ ID NO: 1475440 - RNA, 19 nt, Human
cggaggaaggaggacccag

SEQ ID NO: 1475441 - RNA, 13 nt, Human
cggggaaggauuu

SEQ ID NO: 1475442 - RNA, 15 nt, Human
cgugaucucagcuca

SEQ ID NO: 1475443 - RNA, 14 nt, Human
cgugaucucagcuc

SEQ ID NO: 1475444 - RNA, 24 nt, Human
cgugauccacccgccucagccucc

SEQ ID NO: 1475445 - RNA, 17 nt, Human
cgugauccacccgccuc

SEQ ID NO: 1475446 - RNA, 13 nt, Human
cgugauccacccg

SEQ ID NO: 1475447 - RNA, 18 nt, Human
cguggugcgagugcguga

SEQ ID NO: 1475448 - RNA, 13 nt, Human
cgugguggucccu

SEQ ID NO: 1475449 - RNA, 15 nt, Human
cgugguggucccugg

SEQ ID NO: 1475450 - RNA, 17 nt, Human
cgugguggucccugggu

SEQ ID NO: 1475451 - RNA, 14 nt, Human
cguaaaauuaagaa

SEQ ID NO: 1475452 - RNA, 16 nt, Human
cguaaaaaugauuuca

SEQ ID NO: 1475453 - RNA, 21 nt, Human
cugagauaugaacauauuguu

SEQ ID NO: 1475454 - RNA, 23 nt, Human
cugagauaugaacauauuguuga

SEQ ID NO: 1475455 - RNA, 15 nt, Human
cugagucaaguuguu

SEQ ID NO: 1475456 - RNA, 16 nt, Human
cugagucaaguuguuc

SEQ ID NO: 1475457 - RNA, 18 nt, Human
cugagacuaaucuuauuc

SEQ ID NO: 1475458 - RNA, 22 nt, Human
cugagaccaaggcuuucucuac

SEQ ID NO: 1475459 - RNA, 21 nt, Human
cugagaccaaggcuuucucua

SEQ ID NO: 1475460 - RNA, 13 nt, Human
cugagagaggcca

SEQ ID NO: 1475461 - RNA, 14 nt, Human
cugagagaaaauaa

SEQ ID NO: 1475462 - RNA, 14 nt, Human
cugagagaggccau

SEQ ID NO: 1475463 - RNA, 21 nt, Human
cugagagaggccauucuuucc

SEQ ID NO: 1475464 - RNA, 22 nt, Human
cugagagaggccauucuuuccc

SEQ ID NO: 1475465 - RNA, 19 nt, Human
cugagagaugcagaaauau

SEQ ID NO: 1475466 - RNA, 22 nt, Human
cugagagcaucaggccuagagg

SEQ ID NO: 1475467 - RNA, 17 nt, Human
cugagauacauacagaa

SEQ ID NO: 1475468 - RNA, 19 nt, Human
cugagauacauacagaauu

SEQ ID NO: 1475469 - RNA, 12 nt, Human
cugagauaugaa

SEQ ID NO: 1475470 - RNA, 15 nt, Human
cugagauaugaacau

SEQ ID NO: 1475471 - RNA, 16 nt, Human
cugagauaugaacaua

SEQ ID NO: 1475472 - RNA, 22 nt, Human
cugacaacauuucuauagccaa

SEQ ID NO: 1475473 - RNA, 14 nt, Human
cugacaacauuucu

SEQ ID NO: 1475474 - RNA, 21 nt, Human
cucuugaugccuggcggggug

SEQ ID NO: 1475475 - RNA, 16 nt, Human
cucuugaugccuggcg

SEQ ID NO: 1475476 - RNA, 15 nt, Human
cucuugaugccuggc

SEQ ID NO: 1475477 - RNA, 13 nt, Human
cucuugaugccug

SEQ ID NO: 1475478 - RNA, 22 nt, Human
cucuuuuccuuugguccuucaa

SEQ ID NO: 1475479 - RNA, 21 nt, Human
cucuuuuuccaacuuggcugc

SEQ ID NO: 1475480 - RNA, 12 nt, Human
cucuuuuuccaa

SEQ ID NO: 1475481 - RNA, 22 nt, Human
cugaaaauugaugggauuuggu

SEQ ID NO: 1475482 - RNA, 19 nt, Human
cugaaacucauagacacug

SEQ ID NO: 1475483 - RNA, 22 nt, Human
cugaagcuaucguaaaauuaag

SEQ ID NO: 1475484 - RNA, 21 nt, Human
cugaagcuaucguaaaauuaa

SEQ ID NO: 1475485 - RNA, 15 nt, Human
cugaaagacaauaua

SEQ ID NO: 1475486 - RNA, 13 nt, Human
cugaagcccuugu

SEQ ID NO: 1475487 - RNA, 22 nt, Human
cugaauuuuuaaacaaguauuu

SEQ ID NO: 1475488 - RNA, 21 nt, Human
cugaauuuuuaaacaaguauu

SEQ ID NO: 1475489 - RNA, 22 nt, Human
cucuuagaugcaguucugaaga

SEQ ID NO: 1475490 - RNA, 18 nt, Human
cucuucacucuucaaaug

SEQ ID NO: 1475491 - RNA, 15 nt, Human
cucuucaaaugccug

SEQ ID NO: 1475492 - RNA, 22 nt, Human
cucuuauugccucacuucaggu

SEQ ID NO: 1475493 - RNA, 17 nt, Human
cucuuauugccucacuu

SEQ ID NO: 1475494 - RNA, 20 nt, Human
cucuuauugccucacuucag

SEQ ID NO: 1475495 - RNA, 14 nt, Human
cucuuauugccuca

SEQ ID NO: 1475496 - RNA, 17 nt, Human
cucugcaggucccuaau

SEQ ID NO: 1475497 - RNA, 16 nt, Human
cucugcaggucccuaa

SEQ ID NO: 1475498 - RNA, 15 nt, Human
cucugcaggucccua

SEQ ID NO: 1475499 - RNA, 14 nt, Human
cucugcaggucccu

SEQ ID NO: 1475500 - RNA, 18 nt, Human
cucugcaggucccuaaua

SEQ ID NO: 1475501 - RNA, 21 nt, Human
cucuccccuggaacugucucu

SEQ ID NO: 1475502 - RNA, 20 nt, Human
cucugucacuccucaugccu

SEQ ID NO: 1475503 - RNA, 15 nt, Human
cucugguaaccucuu

SEQ ID NO: 1475504 - RNA, 16 nt, Human
cucugggggguggcca

SEQ ID NO: 1475505 - RNA, 19 nt, Human
cucugggggguggccaggc

SEQ ID NO: 1475506 - RNA, 21 nt, Human
cucugggggguggccaggccg

SEQ ID NO: 1475507 - RNA, 20 nt, Human
cucugggggguggccaggcc

SEQ ID NO: 1475508 - RNA, 13 nt, Human
cuccaagaauuuc

SEQ ID NO: 1475509 - RNA, 18 nt, Human
cucaugugacucuuucca

SEQ ID NO: 1475510 - RNA, 14 nt, Human
cuccaagaauuucu

SEQ ID NO: 1475511 - RNA, 14 nt, Human
cuccaagagcuaca

SEQ ID NO: 1475512 - RNA, 20 nt, Human
cuccaagagcuacauaauuu

SEQ ID NO: 1475513 - RNA, 13 nt, Human
cucaguaauuuag

SEQ ID NO: 1475514 - RNA, 18 nt, Human
cucaguaauuuagaaauc

SEQ ID NO: 1475515 - RNA, 19 nt, Human
cucaguaauuuagaaauca

SEQ ID NO: 1475516 - RNA, 22 nt, Human
cucaguaauuuagaaaucauuu

SEQ ID NO: 1475517 - RNA, 13 nt, Human
cucaguaauuugu

SEQ ID NO: 1475518 - RNA, 16 nt, Human
cucaguaaagcacuug

SEQ ID NO: 1475519 - RNA, 12 nt, Human
cucaucugucac

SEQ ID NO: 1475520 - RNA, 14 nt, Human
cucaucugucacca

SEQ ID NO: 1475521 - RNA, 16 nt, Human
cucaugcauuguccuc

SEQ ID NO: 1475522 - RNA, 18 nt, Human
cucuauaccaauaaagug

SEQ ID NO: 1475523 - RNA, 19 nt, Human
cucuauaccaauaaaguga

SEQ ID NO: 1475524 - RNA, 21 nt, Human
cucuauauaccaaagcacauu

SEQ ID NO: 1475525 - RNA, 21 nt, Human
cucucaauauucaauaaagcu

SEQ ID NO: 1475526 - RNA, 23 nt, Human
cucucaccauuuggauccugugu

SEQ ID NO: 1475527 - RNA, 16 nt, Human
cucucaccauuuggau

SEQ ID NO: 1475528 - RNA, 14 nt, Human
cucguguguuucua

SEQ ID NO: 1475529 - RNA, 14 nt, Human
cucguuaauuugua

SEQ ID NO: 1475530 - RNA, 15 nt, Human
cucgugucuggcaca

SEQ ID NO: 1475531 - RNA, 19 nt, Human
cuccuggguucaagcgauu

SEQ ID NO: 1475532 - RNA, 18 nt, Human
cuccuggcugucugaggc

SEQ ID NO: 1475533 - RNA, 19 nt, Human
cuccuggcugucugaggcu

SEQ ID NO: 1475534 - RNA, 17 nt, Human
cuccuaaaguacuggga

SEQ ID NO: 1475535 - RNA, 22 nt, Human
auugguguugccaguuguccuc

SEQ ID NO: 1475536 - RNA, 21 nt, Human
auugguguugccaguuguccu

SEQ ID NO: 1475537 - RNA, 16 nt, Human
auugguguugccaguu

SEQ ID NO: 1475538 - RNA, 13 nt, Human
auugguguugcca

SEQ ID NO: 1475539 - RNA, 13 nt, Human
auuguauucagag

SEQ ID NO: 1475540 - RNA, 18 nt, Human
auugugauucugccuuug

SEQ ID NO: 1475541 - RNA, 17 nt, Human
auugugucagacuguuu

SEQ ID NO: 1475542 - RNA, 17 nt, Human
auugugucccauucccc

SEQ ID NO: 1475543 - RNA, 20 nt, Human
auugugcaguacuuugugca

SEQ ID NO: 1475544 - RNA, 20 nt, Human
auugugcaauguaaauauuu

SEQ ID NO: 1475545 - RNA, 15 nt, Human
auugugcaauguaaa

SEQ ID NO: 1475546 - RNA, 17 nt, Human
auugugcaauguaaaua

SEQ ID NO: 1475547 - RNA, 18 nt, Human
auugugcaauguaaauau

SEQ ID NO: 1475548 - RNA, 14 nt, Human
auuuaaaacagaca

SEQ ID NO: 1475549 - RNA, 24 nt, Human
auucugucucuggauuauauuaug

SEQ ID NO: 1475550 - RNA, 14 nt, Human
auucugucuugaag

SEQ ID NO: 1475551 - RNA, 22 nt, Human
auucuggacaggauguguuugc

SEQ ID NO: 1475552 - RNA, 15 nt, Human
auucuggacaggaug

SEQ ID NO: 1475553 - RNA, 17 nt, Human
auucuuauuucaugaaa

SEQ ID NO: 1475554 - RNA, 15 nt, Human
auuggguaucaccac

SEQ ID NO: 1475555 - RNA, 14 nt, Human
auuugaaccaauaa

SEQ ID NO: 1475556 - RNA, 20 nt, Human
auuugaacuuuuuauugauu

SEQ ID NO: 1475557 - RNA, 14 nt, Human
auuugaaauauuga

SEQ ID NO: 1475558 - RNA, 21 nt, Human
auuucuuuuuuaaaugaagaa

SEQ ID NO: 1475559 - RNA, 23 nt, Human
auuucuuuuugggagagacuugu

SEQ ID NO: 1475560 - RNA, 20 nt, Human
auuucuuuuugggagagacu

SEQ ID NO: 1475561 - RNA, 21 nt, Human
auuucuuuuugggagagacuu

SEQ ID NO: 1475562 - RNA, 18 nt, Human
auuucuuuuuuaaaugaa

SEQ ID NO: 1475563 - RNA, 22 nt, Human
auuucuuuuuuaaaugaagaaa

SEQ ID NO: 1475564 - RNA, 17 nt, Human
auuucuaccauuucaga

SEQ ID NO: 1475565 - RNA, 18 nt, Human
auuucuaccauuucagag

SEQ ID NO: 1475566 - RNA, 16 nt, Human
auuucuagcuuaucua

SEQ ID NO: 1475567 - RNA, 18 nt, Human
auuucuagcuuaucuacu

SEQ ID NO: 1475568 - RNA, 21 nt, Human
auuucuagcuuaucuacuucc

SEQ ID NO: 1475569 - RNA, 19 nt, Human
auuuauuuuaauaauguuu

SEQ ID NO: 1475570 - RNA, 20 nt, Human
auuuauuuuaauaauguuuc

SEQ ID NO: 1475571 - RNA, 22 nt, Human
auuuccauauaaauauuagaaa

SEQ ID NO: 1475572 - RNA, 17 nt, Human
auuuauucauauuuucu

SEQ ID NO: 1475573 - RNA, 23 nt, Human
auuuauaaaaauaaaaaacacug

SEQ ID NO: 1475574 - RNA, 12 nt, Human
auuuauuaauau

SEQ ID NO: 1475575 - RNA, 20 nt, Human
auuuauuaauauauauuauc

SEQ ID NO: 1475576 - RNA, 22 nt, Human
auuuauaaaaauaaaaaacacu

SEQ ID NO: 1475577 - RNA, 17 nt, Human
auuuauaaaaauaaaaa

SEQ ID NO: 1475578 - RNA, 16 nt, Human
auuuauaaaaaggugu

SEQ ID NO: 1475579 - RNA, 13 nt, Human
auuuagauguaua

SEQ ID NO: 1475580 - RNA, 17 nt, Human
auuuagaaaacuuuaaa

SEQ ID NO: 1475581 - RNA, 14 nt, Human
auuuagauuugugu

SEQ ID NO: 1475582 - RNA, 13 nt, Human
auuuaguguucau

SEQ ID NO: 1475583 - RNA, 21 nt, Human
auuuagugaucaaauugugca

SEQ ID NO: 1475584 - RNA, 20 nt, Human
auuuaguaucuuuuuauuca

SEQ ID NO: 1475585 - RNA, 18 nt, Human
auuuaguauuuuguuuca

SEQ ID NO: 1475586 - RNA, 23 nt, Human
auuuaaauguuaugacuauguaa

SEQ ID NO: 1475587 - RNA, 17 nt, Human
auuuaaauuuuuuuccu

SEQ ID NO: 1475588 - RNA, 13 nt, Human
auuuaacaagauc

SEQ ID NO: 1475589 - RNA, 13 nt, Human
auuuaaaaaacua

SEQ ID NO: 1475590 - RNA, 17 nt, Human
auuuaaaaaacuaaaaa

SEQ ID NO: 1475591 - RNA, 22 nt, Human
auuuaaaaaacuaaaaacuaga

SEQ ID NO: 1475592 - RNA, 18 nt, Human
auuuagaaaacuuuaaag

SEQ ID NO: 1475593 - RNA, 21 nt, Human
auuuuauuuuuuucugaauua

SEQ ID NO: 1475594 - RNA, 13 nt, Human
auuuuagcagaga

SEQ ID NO: 1475595 - RNA, 17 nt, Human
auuuuagccuucucugu

SEQ ID NO: 1475596 - RNA, 18 nt, Human
auuuuagccuucucuguu

SEQ ID NO: 1475597 - RNA, 21 nt, Human
auuuuagccuucucuguucau

SEQ ID NO: 1475598 - RNA, 22 nt, Human
auuuucaaagcuuuuuccagag

SEQ ID NO: 1475599 - RNA, 13 nt, Human
auuuucaagaaac

SEQ ID NO: 1475600 - RNA, 14 nt, Human
auuuucaagaaacu

SEQ ID NO: 1475601 - RNA, 16 nt, Human
auuuucaagaaacuga

SEQ ID NO: 1475602 - RNA, 17 nt, Human
auuuucaagaaacugag

SEQ ID NO: 1475603 - RNA, 22 nt, Human
auuuucaagaaacugaggaauu

SEQ ID NO: 1475604 - RNA, 23 nt, Human
auuuucaagaaacugaggaauuu

SEQ ID NO: 1475605 - RNA, 24 nt, Human
auuuucaagaauaaucacgcuuuc

SEQ ID NO: 1475606 - RNA, 13 nt, Human
auuuucacuguag

SEQ ID NO: 1475607 - RNA, 15 nt, Human
auuuucauuauuccu

SEQ ID NO: 1475608 - RNA, 22 nt, Human
auuuucaguuauuauauuuaca

SEQ ID NO: 1475609 - RNA, 17 nt, Human
auuuucagcaaacucuu

SEQ ID NO: 1475610 - RNA, 18 nt, Human
auuuucagcaaacucuuu

SEQ ID NO: 1475611 - RNA, 19 nt, Human
auuuucagcaaacucuuuu

SEQ ID NO: 1475612 - RNA, 17 nt, Human
auuuuaaaaaaugguca

SEQ ID NO: 1475613 - RNA, 16 nt, Human
auuuuaaaaaaugguc

SEQ ID NO: 1475614 - RNA, 18 nt, Human
auuuuaaaagaaugauua

SEQ ID NO: 1475615 - RNA, 22 nt, Human
auuuuaaaagaaugauuaugaa

SEQ ID NO: 1475616 - RNA, 13 nt, Human
auuuuaaacaaag

SEQ ID NO: 1475617 - RNA, 22 nt, Human
auuuuaaacaaagguugagaug

SEQ ID NO: 1475618 - RNA, 13 nt, Human
auuuuaaacacau

SEQ ID NO: 1475619 - RNA, 14 nt, Human
auuuuaaacacauu

SEQ ID NO: 1475620 - RNA, 23 nt, Human
auuuuaaacacauuaggaaaagu

SEQ ID NO: 1475621 - RNA, 12 nt, Human
auuuuaaagaau

SEQ ID NO: 1475622 - RNA, 13 nt, Human
auuuuaaagaauu

SEQ ID NO: 1475623 - RNA, 17 nt, Human
auuuuaaagaauugugu

SEQ ID NO: 1475624 - RNA, 17 nt, Human
auuuuaccuuugacaaa

SEQ ID NO: 1475625 - RNA, 15 nt, Human
auuuuacauuaaauu

SEQ ID NO: 1475626 - RNA, 12 nt, Human
auuuuacauuaa

SEQ ID NO: 1475627 - RNA, 16 nt, Human
auuuuacauaaauuua

SEQ ID NO: 1475628 - RNA, 17 nt, Human
auuuuacauaaauuuag

SEQ ID NO: 1475629 - RNA, 18 nt, Human
auuuguauaaaauaauuu

SEQ ID NO: 1475630 - RNA, 19 nt, Human
auuuguauaaaauaauuuu

SEQ ID NO: 1475631 - RNA, 21 nt, Human
auuuguauaaaauaauuuuua

SEQ ID NO: 1475632 - RNA, 13 nt, Human
auuugaaguguaa

SEQ ID NO: 1475633 - RNA, 14 nt, Human
auuugaaucagccu

SEQ ID NO: 1475634 - RNA, 23 nt, Human
auuugaaucagccuacaggccuc

SEQ ID NO: 1475635 - RNA, 17 nt, Human
auuuuaaaagaaugauu

SEQ ID NO: 1475636 - RNA, 14 nt, Human
auuugugacaaaaa

SEQ ID NO: 1475637 - RNA, 15 nt, Human
auuugugacaaaaaa

SEQ ID NO: 1475638 - RNA, 17 nt, Human
auuugugacaaaaaauu

SEQ ID NO: 1475639 - RNA, 23 nt, Human
auguguguuuuaaaaugagaaau

SEQ ID NO: 1475640 - RNA, 16 nt, Human
auguguguguguguau

SEQ ID NO: 1475641 - RNA, 20 nt, Human
auguggccccugaacaagaa

SEQ ID NO: 1475642 - RNA, 22 nt, Human
auguggccccugaacaagaauu

SEQ ID NO: 1475643 - RNA, 20 nt, Human
augugcuaguaauuggaaag

SEQ ID NO: 1475644 - RNA, 18 nt, Human
auguggaccuuagaauac

SEQ ID NO: 1475645 - RNA, 18 nt, Human
auguggccccugaacaag

SEQ ID NO: 1475646 - RNA, 19 nt, Human
augugcuaguaauuggaaa

SEQ ID NO: 1475647 - RNA, 20 nt, Human
uuuuaauaauguuucaaaca

SEQ ID NO: 1475648 - RNA, 16 nt, Human
uuuuaauaauguuuca

SEQ ID NO: 1475649 - RNA, 12 nt, Human
uuuuaauaaugu

SEQ ID NO: 1475650 - RNA, 12 nt, Human
uuuuaauaaauu

SEQ ID NO: 1475651 - RNA, 14 nt, Human
uuuuaauaaauuuc

SEQ ID NO: 1475652 - RNA, 13 nt, Human
uuuuaauaauguu

SEQ ID NO: 1475653 - RNA, 14 nt, Human
uuuuaauaauguuu

SEQ ID NO: 1475654 - RNA, 14 nt, Human
uuuuaauaaacacu

SEQ ID NO: 1475655 - RNA, 16 nt, Human
auguucagauuauugg

SEQ ID NO: 1475656 - RNA, 23 nt, Human
auguucagaagguugcucuagau

SEQ ID NO: 1475657 - RNA, 12 nt, Human
auguuagccagg

SEQ ID NO: 1475658 - RNA, 20 nt, Human
auguuaagggaagaauucca

SEQ ID NO: 1475659 - RNA, 15 nt, Human
auguuaauauugauu

SEQ ID NO: 1475660 - RNA, 17 nt, Human
auguuacuacaugcacu

SEQ ID NO: 1475661 - RNA, 17 nt, Human
auguguuuacuuuaugu

SEQ ID NO: 1475662 - RNA, 19 nt, Human
auguuaaaaaaauaagaag

SEQ ID NO: 1475663 - RNA, 22 nt, Human
auguuaaaaaaauaagaagaau

SEQ ID NO: 1475664 - RNA, 21 nt, Human
auguuaaaaaaauaagaagaa

SEQ ID NO: 1475665 - RNA, 20 nt, Human
auguugcccuguugcugccu

SEQ ID NO: 1475666 - RNA, 17 nt, Human
uuuuacuuuuaaacugu

SEQ ID NO: 1475667 - RNA, 18 nt, Human
uuuuacuuuuaaacugug

SEQ ID NO: 1475668 - RNA, 20 nt, Human
uuuuacuuuuaaacugugua

SEQ ID NO: 1475669 - RNA, 18 nt, Human
uuuuaggaagcaagcuua

SEQ ID NO: 1475670 - RNA, 18 nt, Human
auguugcauagaauaaaa

SEQ ID NO: 1475671 - RNA, 17 nt, Human
auguugcauagaauaaa

SEQ ID NO: 1475672 - RNA, 14 nt, Human
uuuucucuaggaaa

SEQ ID NO: 1475673 - RNA, 13 nt, Human
uuuucuccuccca

SEQ ID NO: 1475674 - RNA, 14 nt, Human
uuuucuccucccag

SEQ ID NO: 1475675 - RNA, 19 nt, Human
uuuucuccucccaggaacu

SEQ ID NO: 1475676 - RNA, 21 nt, Human
uuuucucgcuguccuuucuag

SEQ ID NO: 1475677 - RNA, 16 nt, Human
uuuucucuaggaaaua

SEQ ID NO: 1475678 - RNA, 23 nt, Human
uuuucucccuggauuuuuaccag

SEQ ID NO: 1475679 - RNA, 21 nt, Human
uuuucaugauuuugaaaccau

SEQ ID NO: 1475680 - RNA, 21 nt, Human
uuuucaugauuuugaaaucau

SEQ ID NO: 1475681 - RNA, 22 nt, Human
uuuucucccuggauuuuuacca

SEQ ID NO: 1475682 - RNA, 13 nt, Human
uuuuauuuaaaaa

SEQ ID NO: 1475683 - RNA, 22 nt, Human
uuuucaguuuauuugaaccaau

SEQ ID NO: 1475684 - RNA, 16 nt, Human
uuuucauacauuuucu

SEQ ID NO: 1475685 - RNA, 18 nt, Human
uuuucauacauuuucuaa

SEQ ID NO: 1475686 - RNA, 21 nt, Human
uuuucauacauuuucuaagaa

SEQ ID NO: 1475687 - RNA, 15 nt, Human
uuuuauuugcaugug

SEQ ID NO: 1475688 - RNA, 17 nt, Human
auguuuucaggcuagau

SEQ ID NO: 1475689 - RNA, 21 nt, Human
auguuuucaggcuagauguau

SEQ ID NO: 1475690 - RNA, 23 nt, Human
auguuuuggccaaugcaccuaaa

SEQ ID NO: 1475691 - RNA, 17 nt, Human
uuuucugugccugaaua

SEQ ID NO: 1475692 - RNA, 18 nt, Human
uuuucugugccugaauau

SEQ ID NO: 1475693 - RNA, 15 nt, Human
auguuguguuuuuaa

SEQ ID NO: 1475694 - RNA, 17 nt, Human
auguuuaguaaucauau

SEQ ID NO: 1475695 - RNA, 17 nt, Human
auuaaaccggaccaucu

SEQ ID NO: 1475696 - RNA, 16 nt, Human
uuuuguuuaccagaga

SEQ ID NO: 1475697 - RNA, 15 nt, Human
uuuuguuauuaaaca

SEQ ID NO: 1475698 - RNA, 20 nt, Human
uuuugugaugcaaauaaaua

SEQ ID NO: 1475699 - RNA, 13 nt, Human
uuuugcugagacu

SEQ ID NO: 1475700 - RNA, 22 nt, Human
uuuugcuguaauguuaauauug

SEQ ID NO: 1475701 - RNA, 21 nt, Human
uuuugcgguucaggaaaauug

SEQ ID NO: 1475702 - RNA, 19 nt, Human
uuuugcugagacuaaucuu

SEQ ID NO: 1475703 - RNA, 13 nt, Human
uuuugcuggaaua

SEQ ID NO: 1475704 - RNA, 12 nt, Human
uuuuuaucaugu

SEQ ID NO: 1475705 - RNA, 17 nt, Human
uuuuuaucaugcauguc

SEQ ID NO: 1475706 - RNA, 19 nt, Human
uuuuuauauuugaaauauu

SEQ ID NO: 1475707 - RNA, 20 nt, Human
uuuuuaggaagcaagcuuaa

SEQ ID NO: 1475708 - RNA, 12 nt, Human
uuuuuaguugaa

SEQ ID NO: 1475709 - RNA, 15 nt, Human
uuuuuaguugaauuu

SEQ ID NO: 1475710 - RNA, 12 nt, Human
uuuuuacauuuu

SEQ ID NO: 1475711 - RNA, 12 nt, Human
uuuugcagcuuu

SEQ ID NO: 1475712 - RNA, 18 nt, Human
uuuugcauuuaaaacaga

SEQ ID NO: 1475713 - RNA, 16 nt, Human
uuuugauauuucuagc

SEQ ID NO: 1475714 - RNA, 23 nt, Human
uuuugaugaacaaaauuuccuaa

SEQ ID NO: 1475715 - RNA, 20 nt, Human
uuuugauuuguacugaaaaa

SEQ ID NO: 1475716 - RNA, 21 nt, Human
uuuugauuuguacugaaaaau

SEQ ID NO: 1475717 - RNA, 18 nt, Human
uuuugcaaucccuuaaua

SEQ ID NO: 1475718 - RNA, 15 nt, Human
auuaaagcauuuaga

SEQ ID NO: 1475719 - RNA, 20 nt, Human
auuaaagaaggguugagcug

SEQ ID NO: 1475720 - RNA, 21 nt, Human
auuaaagaaggguugagcugg

SEQ ID NO: 1475721 - RNA, 11 nt, Human
uuuugagaaag

SEQ ID NO: 1475722 - RNA, 18 nt, Human
uuuugauacuaagcauug

SEQ ID NO: 1475723 - RNA, 17 nt, Human
auuacauuuguauaaaa

SEQ ID NO: 1475724 - RNA, 18 nt, Human
auuacauuuguauaaaau

SEQ ID NO: 1475725 - RNA, 20 nt, Human
auuacauuuguauaaaauaa

SEQ ID NO: 1475726 - RNA, 21 nt, Human
auuacaguggggaaugaagau

SEQ ID NO: 1475727 - RNA, 16 nt, Human
uuuuuguuauuaaaca

SEQ ID NO: 1475728 - RNA, 23 nt, Human
auuaaguaaugauaacuggaaac

SEQ ID NO: 1475729 - RNA, 19 nt, Human
uuuuugugaaaagcuccau

SEQ ID NO: 1475730 - RNA, 14 nt, Human
uuuuuaucuuuaua

SEQ ID NO: 1475731 - RNA, 14 nt, Human
uuuuuauuaugcau

SEQ ID NO: 1475732 - RNA, 15 nt, Human
uuuuuauuaugcauu

SEQ ID NO: 1475733 - RNA, 12 nt, Human
uuuuuguaccaa

SEQ ID NO: 1475734 - RNA, 13 nt, Human
auuacgugcucug

SEQ ID NO: 1475735 - RNA, 15 nt, Human
auuacuuauuuuuga

SEQ ID NO: 1475736 - RNA, 16 nt, Human
auuacuuauuuuugac

SEQ ID NO: 1475737 - RNA, 17 nt, Human
auuacuuauuuuugaca

SEQ ID NO: 1475738 - RNA, 18 nt, Human
auuacuuauuuuugacag

SEQ ID NO: 1475739 - RNA, 19 nt, Human
auuacuuauuuuugacagu

SEQ ID NO: 1475740 - RNA, 17 nt, Human
auuacucaguaauuugu

SEQ ID NO: 1475741 - RNA, 20 nt, Human
auucagauaugauucaaaug

SEQ ID NO: 1475742 - RNA, 18 nt, Human
auucagauaugauucaaa

SEQ ID NO: 1475743 - RNA, 17 nt, Human
auucagaguugaugguu

SEQ ID NO: 1475744 - RNA, 11 nt, Human
auuccauccuu

SEQ ID NO: 1475745 - RNA, 23 nt, Human
auuccaacucguauagcaugcau

SEQ ID NO: 1475746 - RNA, 19 nt, Human
auuccaacucguauagcau

SEQ ID NO: 1475747 - RNA, 22 nt, Human
auuccaagacaugucuguucua

SEQ ID NO: 1475748 - RNA, 14 nt, Human
auucuaaaaugauu

SEQ ID NO: 1475749 - RNA, 16 nt, Human
auucuaaaaugauugu

SEQ ID NO: 1475750 - RNA, 20 nt, Human
auucuccugccucagccucc

SEQ ID NO: 1475751 - RNA, 23 nt, Human
auucuccagccaucaagagacug

SEQ ID NO: 1475752 - RNA, 15 nt, Human
auucucccuugcucu

SEQ ID NO: 1475753 - RNA, 20 nt, Human
auucuaaaaugauuguagua

SEQ ID NO: 1475754 - RNA, 14 nt, Human
auucuaaaaugccu

SEQ ID NO: 1475755 - RNA, 15 nt, Human
auucuaaaaugccuu

SEQ ID NO: 1475756 - RNA, 15 nt, Human
auucuaucuauuccu

SEQ ID NO: 1475757 - RNA, 11 nt, Human
uugcucaugga

SEQ ID NO: 1475758 - RNA, 12 nt, Human
uugcucauggaa

SEQ ID NO: 1475759 - RNA, 19 nt, Human
uugcugaaauuuuauaugc

SEQ ID NO: 1475760 - RNA, 17 nt, Human
uugcuccuaauguugaa

SEQ ID NO: 1475761 - RNA, 11 nt, Human
uugcugaaauu

SEQ ID NO: 1475762 - RNA, 16 nt, Human
uugcugaaauuuuaua

SEQ ID NO: 1475763 - RNA, 18 nt, Human
aucuaaguuaauuuaaag

SEQ ID NO: 1475764 - RNA, 16 nt, Human
uugcuacauaauuauc

SEQ ID NO: 1475765 - RNA, 13 nt, Human
uugcuacauaauu

SEQ ID NO: 1475766 - RNA, 11 nt, Human
uugcugagccu

SEQ ID NO: 1475767 - RNA, 11 nt, Human
uugcugagacu

SEQ ID NO: 1475768 - RNA, 15 nt, Human
uugcugacccucccc

SEQ ID NO: 1475769 - RNA, 14 nt, Human
uugcugacccuccc

SEQ ID NO: 1475770 - RNA, 15 nt, Human
uugcuuuuucaccag

SEQ ID NO: 1475771 - RNA, 15 nt, Human
uugcuuuucacaaau

SEQ ID NO: 1475772 - RNA, 21 nt, Human
augaaauauuauguuaaaacu

SEQ ID NO: 1475773 - RNA, 14 nt, Human
aucuuuuauuuugc

SEQ ID NO: 1475774 - RNA, 17 nt, Human
aucuuucccuccuuggu

SEQ ID NO: 1475775 - RNA, 19 nt, Human
aucuuucccuccuugguga

SEQ ID NO: 1475776 - RNA, 16 nt, Human
aucuuucccuccuugg

SEQ ID NO: 1475777 - RNA, 14 nt, Human
aucuuucccuccuu

SEQ ID NO: 1475778 - RNA, 13 nt, Human
aucuuucccuccu

SEQ ID NO: 1475779 - RNA, 12 nt, Human
aucuuucccucc

SEQ ID NO: 1475780 - RNA, 17 nt, Human
uuggaccuaauccaagc

SEQ ID NO: 1475781 - RNA, 12 nt, Human
uuggacuaugga

SEQ ID NO: 1475782 - RNA, 13 nt, Human
uuguauaaaauaa

SEQ ID NO: 1475783 - RNA, 15 nt, Human
uuguauaaaauaauu

SEQ ID NO: 1475784 - RNA, 13 nt, Human
uuguaaugaaaac

SEQ ID NO: 1475785 - RNA, 16 nt, Human
uuguauauuacaauga

SEQ ID NO: 1475786 - RNA, 15 nt, Human
uuguauauuacaaug

SEQ ID NO: 1475787 - RNA, 14 nt, Human
uuguauauuacaau

SEQ ID NO: 1475788 - RNA, 13 nt, Human
uuguauauuacaa

SEQ ID NO: 1475789 - RNA, 21 nt, Human
augaauuaguuuuauaugcuu

SEQ ID NO: 1475790 - RNA, 23 nt, Human
augaauuaguuuuauaugcuucu

SEQ ID NO: 1475791 - RNA, 19 nt, Human
augacaguccgucaaaaca

SEQ ID NO: 1475792 - RNA, 17 nt, Human
augacaggauguuugcu

SEQ ID NO: 1475793 - RNA, 16 nt, Human
augacacuguucagga

SEQ ID NO: 1475794 - RNA, 19 nt, Human
uugggcagcaauuuaaaug

SEQ ID NO: 1475795 - RNA, 23 nt, Human
uugggcagccagaccagcaggcu

SEQ ID NO: 1475796 - RNA, 18 nt, Human
uugggcagcaauuuaaau

SEQ ID NO: 1475797 - RNA, 18 nt, Human
augaauuacauuuguaua

SEQ ID NO: 1475798 - RNA, 19 nt, Human
augaauuacauuuguauaa

SEQ ID NO: 1475799 - RNA, 22 nt, Human
augaauuacauuuguauaaaau

SEQ ID NO: 1475800 - RNA, 21 nt, Human
augaacagaacauagacagaa

SEQ ID NO: 1475801 - RNA, 21 nt, Human
augaacauauuguugaaaggu

SEQ ID NO: 1475802 - RNA, 16 nt, Human
uugguuuugcuacaua

SEQ ID NO: 1475803 - RNA, 21 nt, Human
uugguuuugcuacauaauuau

SEQ ID NO: 1475804 - RNA, 18 nt, Human
uugugaagguggaaauaa

SEQ ID NO: 1475805 - RNA, 17 nt, Human
uugugaagguggaaaua

SEQ ID NO: 1475806 - RNA, 22 nt, Human
uugugaaguacccguucacauu

SEQ ID NO: 1475807 - RNA, 18 nt, Human
uugugaagcaaaauuuuu

SEQ ID NO: 1475808 - RNA, 11 nt, Human
uugugaagagg

SEQ ID NO: 1475809 - RNA, 18 nt, Human
augaucaccgacugaaaa

SEQ ID NO: 1475810 - RNA, 20 nt, Human
augauccuguauucagacag

SEQ ID NO: 1475811 - RNA, 13 nt, Human
uuguuggaaugaa

SEQ ID NO: 1475812 - RNA, 22 nt, Human
augcaaacuuuauuuuguguuu

SEQ ID NO: 1475813 - RNA, 14 nt, Human
augcaaaccauagc

SEQ ID NO: 1475814 - RNA, 16 nt, Human
uuuaaaaaauggucac

SEQ ID NO: 1475815 - RNA, 15 nt, Human
uuuaaacuguguaca

SEQ ID NO: 1475816 - RNA, 19 nt, Human
uuuaaacuguguacauaac

SEQ ID NO: 1475817 - RNA, 21 nt, Human
uuuaaacuguguacauaacug

SEQ ID NO: 1475818 - RNA, 22 nt, Human
uuuaaacuguguacauaacuga

SEQ ID NO: 1475819 - RNA, 19 nt, Human
uuuaaaaaauagcagcuuu

SEQ ID NO: 1475820 - RNA, 23 nt, Human
uuuaaaaaagcuuaaaacuuuga

SEQ ID NO: 1475821 - RNA, 21 nt, Human
uuuaaaaaagcuuaaaacuuu

SEQ ID NO: 1475822 - RNA, 13 nt, Human
uuuaaaaaagcuu

SEQ ID NO: 1475823 - RNA, 14 nt, Human
uuuaaaaaagcuua

SEQ ID NO: 1475824 - RNA, 17 nt, Human
uuuaaaaaagcuuaaaa

SEQ ID NO: 1475825 - RNA, 20 nt, Human
uuuaaaaaagcuuaaaacuu

SEQ ID NO: 1475826 - RNA, 16 nt, Human
uuguuuugugcagaga

SEQ ID NO: 1475827 - RNA, 14 nt, Human
augauaacuggaaa

SEQ ID NO: 1475828 - RNA, 22 nt, Human
augagugcguggugcgagugcg

SEQ ID NO: 1475829 - RNA, 19 nt, Human
augagugcguggugcgagu

SEQ ID NO: 1475830 - RNA, 21 nt, Human
augaguggaaauuaagacuuu

SEQ ID NO: 1475831 - RNA, 13 nt, Human
uugucacgccaga

SEQ ID NO: 1475832 - RNA, 20 nt, Human
uugucacgccagacuuccca

SEQ ID NO: 1475833 - RNA, 13 nt, Human
uugucauguguau

SEQ ID NO: 1475834 - RNA, 22 nt, Human
uugucauguguauaaaaauaaa

SEQ ID NO: 1475835 - RNA, 14 nt, Human
uugucauguguaua

SEQ ID NO: 1475836 - RNA, 22 nt, Human
uuguccucagccccgcguggaa

SEQ ID NO: 1475837 - RNA, 22 nt, Human
augacauuaaagaaggguugag

SEQ ID NO: 1475838 - RNA, 20 nt, Human
augacaguccgucaaaacag

SEQ ID NO: 1475839 - RNA, 21 nt, Human
augacaguccgucaaaacaga

SEQ ID NO: 1475840 - RNA, 22 nt, Human
augacaguccgucaaaacagau

SEQ ID NO: 1475841 - RNA, 14 nt, Human
augacaucacuugu

SEQ ID NO: 1475842 - RNA, 18 nt, Human
augacaucacuuguacaa

SEQ ID NO: 1475843 - RNA, 18 nt, Human
augacaucaccacaguuu

SEQ ID NO: 1475844 - RNA, 19 nt, Human
augacaucacuuguacaaa

SEQ ID NO: 1475845 - RNA, 20 nt, Human
augacaucacuuguacaaaa

SEQ ID NO: 1475846 - RNA, 16 nt, Human
augagauauuaaacca

SEQ ID NO: 1475847 - RNA, 14 nt, Human
augagaugcuggcu

SEQ ID NO: 1475848 - RNA, 15 nt, Human
augagaugcuggcuu

SEQ ID NO: 1475849 - RNA, 22 nt, Human
augagaugcuggcuugggcagc

SEQ ID NO: 1475850 - RNA, 19 nt, Human
augagaugcuggcuugggc

SEQ ID NO: 1475851 - RNA, 16 nt, Human
uuuaaagcuuccauug

SEQ ID NO: 1475852 - RNA, 17 nt, Human
uuuaaagcguuugcaca

SEQ ID NO: 1475853 - RNA, 18 nt, Human
augcuacaggauuugaaa

SEQ ID NO: 1475854 - RNA, 17 nt, Human
uuuauaugcuucuguuu

SEQ ID NO: 1475855 - RNA, 14 nt, Human
uuuauaugaagaaa

SEQ ID NO: 1475856 - RNA, 21 nt, Human
uuuauaugaagaaaaucacuu

SEQ ID NO: 1475857 - RNA, 19 nt, Human
uuuauaugcuucuguuuua

SEQ ID NO: 1475858 - RNA, 20 nt, Human
uuuauaugcuuacugauaua

SEQ ID NO: 1475859 - RNA, 15 nt, Human
uuuaugugaaacaug

SEQ ID NO: 1475860 - RNA, 19 nt, Human
uuuaugucuguggauuuuu

SEQ ID NO: 1475861 - RNA, 14 nt, Human
uuuaugugaaacau

SEQ ID NO: 1475862 - RNA, 20 nt, Human
uuuagcuggaaaaguauguu

SEQ ID NO: 1475863 - RNA, 16 nt, Human
uuuagccuucucuguu

SEQ ID NO: 1475864 - RNA, 22 nt, Human
uuuagguuuuuguuuguuuccu

SEQ ID NO: 1475865 - RNA, 23 nt, Human
auggaauuggagcucgugggaca

SEQ ID NO: 1475866 - RNA, 21 nt, Human
uuucccacuguuuaaggaguu

SEQ ID NO: 1475867 - RNA, 21 nt, Human
uuucaguuuauuugaaccaau

SEQ ID NO: 1475868 - RNA, 14 nt, Human
uuucauaaauuuga

SEQ ID NO: 1475869 - RNA, 14 nt, Human
uuucauacacuuau

SEQ ID NO: 1475870 - RNA, 16 nt, Human
uuucauacauuuucua

SEQ ID NO: 1475871 - RNA, 20 nt, Human
uuucauacauuuucuaagaa

SEQ ID NO: 1475872 - RNA, 18 nt, Human
uuucauauaaauggaauu

SEQ ID NO: 1475873 - RNA, 15 nt, Human
uuucauagcuaaaaa

SEQ ID NO: 1475874 - RNA, 14 nt, Human
uuucauagcuaaaa

SEQ ID NO: 1475875 - RNA, 13 nt, Human
uuucauauaaagu

SEQ ID NO: 1475876 - RNA, 12 nt, Human
uuucauaaagca

SEQ ID NO: 1475877 - RNA, 16 nt, Human
uuucaccuagauuuuu

SEQ ID NO: 1475878 - RNA, 24 nt, Human
uuucacuguagaaugauuucaugc

SEQ ID NO: 1475879 - RNA, 17 nt, Human
uuuauuuuuuucugaau

SEQ ID NO: 1475880 - RNA, 13 nt, Human
uuucacauuuucc

SEQ ID NO: 1475881 - RNA, 14 nt, Human
uuucacauuuuccu

SEQ ID NO: 1475882 - RNA, 17 nt, Human
uuucaccagauuugcua

SEQ ID NO: 1475883 - RNA, 14 nt, Human
uuuauuuugacaua

SEQ ID NO: 1475884 - RNA, 16 nt, Human
uuuauuuuaauaaugu

SEQ ID NO: 1475885 - RNA, 23 nt, Human
augcuuagucccucaugcaaauc

SEQ ID NO: 1475886 - RNA, 15 nt, Human
augcuuagucccuca

SEQ ID NO: 1475887 - RNA, 21 nt, Human
augcuuagucccucaugcaaa

SEQ ID NO: 1475888 - RNA, 19 nt, Human
uuuauuacuguaagaaaau

SEQ ID NO: 1475889 - RNA, 14 nt, Human
augcuggugagcca

SEQ ID NO: 1475890 - RNA, 14 nt, Human
augcuguauuuuaa

SEQ ID NO: 1475891 - RNA, 19 nt, Human
augcuguauuuuaaaagaa

SEQ ID NO: 1475892 - RNA, 23 nt, Human
augcugugacacauggccccucc

SEQ ID NO: 1475893 - RNA, 13 nt, Human
augcuuacugaua

SEQ ID NO: 1475894 - RNA, 22 nt, Human
augcuuacugauauauuuuaca

SEQ ID NO: 1475895 - RNA, 23 nt, Human
augcuuacugauauauuuuacaa

SEQ ID NO: 1475896 - RNA, 18 nt, Human
uuucuauagccaaaaaua

SEQ ID NO: 1475897 - RNA, 13 nt, Human
uuucuaguugaaa

SEQ ID NO: 1475898 - RNA, 21 nt, Human
uuucuaggacugaauuaugaa

SEQ ID NO: 1475899 - RNA, 17 nt, Human
uuucuaggacugaauua

SEQ ID NO: 1475900 - RNA, 22 nt, Human
uuucuaggacugaauuaugaaa

SEQ ID NO: 1475901 - RNA, 17 nt, Human
uuucuagguaggaaaug

SEQ ID NO: 1475902 - RNA, 21 nt, Human
uuucuagguaggaaauguggu

SEQ ID NO: 1475903 - RNA, 13 nt, Human
uuucuaugaaaua

SEQ ID NO: 1475904 - RNA, 22 nt, Human
uuucuauagccaaaaauagcua

SEQ ID NO: 1475905 - RNA, 14 nt, Human
uuucuaugaaauau

SEQ ID NO: 1475906 - RNA, 20 nt, Human
uuucuaugaaauauuauguu

SEQ ID NO: 1475907 - RNA, 21 nt, Human
uuucuccaagagcuacauaau

SEQ ID NO: 1475908 - RNA, 15 nt, Human
uuucuccaagagcua

SEQ ID NO: 1475909 - RNA, 15 nt, Human
uuucuauuuuuaucu

SEQ ID NO: 1475910 - RNA, 13 nt, Human
uuucuauuuuuau

SEQ ID NO: 1475911 - RNA, 16 nt, Human
uuucucacuaaaucuu

SEQ ID NO: 1475912 - RNA, 16 nt, Human
uuucucaguuuucaua

SEQ ID NO: 1475913 - RNA, 19 nt, Human
uuugaaacacuuugcauaa

SEQ ID NO: 1475914 - RNA, 17 nt, Human
uuugaaacacuuugcau

SEQ ID NO: 1475915 - RNA, 14 nt, Human
uuugaaauauugac

SEQ ID NO: 1475916 - RNA, 15 nt, Human
uuugaaauauugacu

SEQ ID NO: 1475917 - RNA, 18 nt, Human
uuugaaaagcagacauuu

SEQ ID NO: 1475918 - RNA, 16 nt, Human
uuugaaaagcagacau

SEQ ID NO: 1475919 - RNA, 13 nt, Human
uuugaaaagcaga

SEQ ID NO: 1475920 - RNA, 13 nt, Human
uuucuuuucuuug

SEQ ID NO: 1475921 - RNA, 15 nt, Human
uuucuuuguguagcu

SEQ ID NO: 1475922 - RNA, 18 nt, Human
uuucuuuguuucuuucuu

SEQ ID NO: 1475923 - RNA, 19 nt, Human
uuucuuuguuucuuucuuu

SEQ ID NO: 1475924 - RNA, 14 nt, Human
uuucuuucaaaauu

SEQ ID NO: 1475925 - RNA, 18 nt, Human
uuucuggaauacaugaaa

SEQ ID NO: 1475926 - RNA, 20 nt, Human
uuucuggaauacaugaaaua

SEQ ID NO: 1475927 - RNA, 21 nt, Human
uuucuggaauacaugaaauau

SEQ ID NO: 1475928 - RNA, 23 nt, Human
uuucuggauuccccaucucaggc

SEQ ID NO: 1475929 - RNA, 22 nt, Human
augggacauuugcucauggaau

SEQ ID NO: 1475930 - RNA, 21 nt, Human
augggacauuugcucauggaa

SEQ ID NO: 1475931 - RNA, 12 nt, Human
augggaccacaa

SEQ ID NO: 1475932 - RNA, 13 nt, Human
augggacauuuuu

SEQ ID NO: 1475933 - RNA, 18 nt, Human
uuucggacaguuuauuug

SEQ ID NO: 1475934 - RNA, 21 nt, Human
uuucgucuguuuauaaacauu

SEQ ID NO: 1475935 - RNA, 16 nt, Human
uuuccuuuuuuguuau

SEQ ID NO: 1475936 - RNA, 17 nt, Human
uuuccuuuuuuguuauu

SEQ ID NO: 1475937 - RNA, 18 nt, Human
uuuccuucaaaguuuaau

SEQ ID NO: 1475938 - RNA, 16 nt, Human
uucagauaugauucaa

SEQ ID NO: 1475939 - RNA, 17 nt, Human
uucagauaugauucaaa

SEQ ID NO: 1475940 - RNA, 18 nt, Human
uucagauaugauucaaau

SEQ ID NO: 1475941 - RNA, 14 nt, Human
uucagaagaaaaag

SEQ ID NO: 1475942 - RNA, 12 nt, Human
uucagaagaaaa

SEQ ID NO: 1475943 - RNA, 19 nt, Human
uucagauaugauucaaaug

SEQ ID NO: 1475944 - RNA, 14 nt, Human
uucagauucccaga

SEQ ID NO: 1475945 - RNA, 21 nt, Human
uucagauucccagagcaaaau

SEQ ID NO: 1475946 - RNA, 22 nt, Human
uucagauucccagagcaaaaua

SEQ ID NO: 1475947 - RNA, 19 nt, Human
uucacuucauaauccagua

SEQ ID NO: 1475948 - RNA, 23 nt, Human
uucagcacuuuagaauaugccuu

SEQ ID NO: 1475949 - RNA, 22 nt, Human
uucagcacuuuagaauaugccu

SEQ ID NO: 1475950 - RNA, 17 nt, Human
uucagcgguuuauauaa

SEQ ID NO: 1475951 - RNA, 14 nt, Human
uucagcuaagcuag

SEQ ID NO: 1475952 - RNA, 20 nt, Human
uucagcuaagcuaggaauga

SEQ ID NO: 1475953 - RNA, 13 nt, Human
auauaugcuaagu

SEQ ID NO: 1475954 - RNA, 16 nt, Human
auauauuuuacaauuu

SEQ ID NO: 1475955 - RNA, 21 nt, Human
uucauauuuuucauagcuaaa

SEQ ID NO: 1475956 - RNA, 14 nt, Human
uucauauaaaguau

SEQ ID NO: 1475957 - RNA, 16 nt, Human
uucauauaaaguauca

SEQ ID NO: 1475958 - RNA, 18 nt, Human
uucauauaugaggacuug

SEQ ID NO: 1475959 - RNA, 21 nt, Human
uucauauaugaggacuugugu

SEQ ID NO: 1475960 - RNA, 24 nt, Human
uucagucucuauaccaauaaagug

SEQ ID NO: 1475961 - RNA, 23 nt, Human
uucagucucuauaccaauaaagu

SEQ ID NO: 1475962 - RNA, 22 nt, Human
uucagucucuauaccaauaaag

SEQ ID NO: 1475963 - RNA, 21 nt, Human
uucagucucuauaccaauaaa

SEQ ID NO: 1475964 - RNA, 18 nt, Human
uucagucucuauaccaau

SEQ ID NO: 1475965 - RNA, 14 nt, Human
uucagguccaggcu

SEQ ID NO: 1475966 - RNA, 18 nt, Human
auauauuuuacaauuuuu

SEQ ID NO: 1475967 - RNA, 15 nt, Human
auaugaacauauugu

SEQ ID NO: 1475968 - RNA, 20 nt, Human
auaugaacauauuguugaaa

SEQ ID NO: 1475969 - RNA, 19 nt, Human
auaugaacauauuguugaa

SEQ ID NO: 1475970 - RNA, 15 nt, Human
auaugggacauuuuu

SEQ ID NO: 1475971 - RNA, 21 nt, Human
auaugacuguuuuucggacag

SEQ ID NO: 1475972 - RNA, 22 nt, Human
auaugacuguuuuucggacagu

SEQ ID NO: 1475973 - RNA, 22 nt, Human
auauguguaugcacaguaaaaa

SEQ ID NO: 1475974 - RNA, 22 nt, Human
uucaugcuguucaugaaagauu

SEQ ID NO: 1475975 - RNA, 17 nt, Human
auaugggacauuuuuga

SEQ ID NO: 1475976 - RNA, 21 nt, Human
uuccaauuuucuggaauacau

SEQ ID NO: 1475977 - RNA, 22 nt, Human
uuccaacucguauagcaugcau

SEQ ID NO: 1475978 - RNA, 19 nt, Human
uuccaacucguauagcaug

SEQ ID NO: 1475979 - RNA, 17 nt, Human
uuccaacuuggcugcag

SEQ ID NO: 1475980 - RNA, 22 nt, Human
uuccaacuuggcugcaggaauc

SEQ ID NO: 1475981 - RNA, 16 nt, Human
uuccaagacaugucug

SEQ ID NO: 1475982 - RNA, 21 nt, Human
uuccaagacaugucuguucua

SEQ ID NO: 1475983 - RNA, 19 nt, Human
uuccacguacugcagccuc

SEQ ID NO: 1475984 - RNA, 18 nt, Human
auauucucacagcuccaa

SEQ ID NO: 1475985 - RNA, 15 nt, Human
auauuacacuacaca

SEQ ID NO: 1475986 - RNA, 21 nt, Human
auauucucacagcuccaagaa

SEQ ID NO: 1475987 - RNA, 19 nt, Human
auauugauaagaucuuuua

SEQ ID NO: 1475988 - RNA, 18 nt, Human
auauugauaagaucuuuu

SEQ ID NO: 1475989 - RNA, 19 nt, Human
auauuggacaaagaaccuu

SEQ ID NO: 1475990 - RNA, 16 nt, Human
auauuguaaaacaggu

SEQ ID NO: 1475991 - RNA, 17 nt, Human
auauuguaaaacaggua

SEQ ID NO: 1475992 - RNA, 12 nt, Human
auauuguaaaua

SEQ ID NO: 1475993 - RNA, 19 nt, Human
auauuguuuuacaauaguu

SEQ ID NO: 1475994 - RNA, 19 nt, Human
auauuuaacucucuuuaug

SEQ ID NO: 1475995 - RNA, 13 nt, Human
auauuuacaaaug

SEQ ID NO: 1475996 - RNA, 14 nt, Human
auauuguuugcuaa

SEQ ID NO: 1475997 - RNA, 14 nt, Human
auauugugauucug

SEQ ID NO: 1475998 - RNA, 17 nt, Human
auauugugauucugccu

SEQ ID NO: 1475999 - RNA, 19 nt, Human
auauugugauucugccuuu

SEQ ID NO: 1476000 - RNA, 12 nt, Human
auauuacaauga

SEQ ID NO: 1476001 - RNA, 16 nt, Human
auauuacaaugaucac

SEQ ID NO: 1476002 - RNA, 15 nt, Human
auauuacaaugauca

SEQ ID NO: 1476003 - RNA, 13 nt, Human
auauuacaaugau

SEQ ID NO: 1476004 - RNA, 16 nt, Human
auauguuguaauauuu

SEQ ID NO: 1476005 - RNA, 21 nt, Human
auauguuguaauauuucuuca

SEQ ID NO: 1476006 - RNA, 16 nt, Human
auauguucugacauaa

SEQ ID NO: 1476007 - RNA, 17 nt, Human
uuccagucuuccugaca

SEQ ID NO: 1476008 - RNA, 20 nt, Human
uuccagucuuccugacacuu

SEQ ID NO: 1476009 - RNA, 15 nt, Human
uucccuuuuuuuaag

SEQ ID NO: 1476010 - RNA, 17 nt, Human
uucccuacugaagcccu

SEQ ID NO: 1476011 - RNA, 12 nt, Human
uucccuaagcca

SEQ ID NO: 1476012 - RNA, 21 nt, Human
uuccuaaauauauuuuaagac

SEQ ID NO: 1476013 - RNA, 18 nt, Human
uuccuaaauauuaugaga

SEQ ID NO: 1476014 - RNA, 16 nt, Human
uuccuaaauauuauga

SEQ ID NO: 1476015 - RNA, 13 nt, Human
uuccuaagugauu

SEQ ID NO: 1476016 - RNA, 12 nt, Human
uuccugaacagg

SEQ ID NO: 1476017 - RNA, 21 nt, Human
aucaaggguacacugccuucu

SEQ ID NO: 1476018 - RNA, 15 nt, Human
aucaagggucaggcc

SEQ ID NO: 1476019 - RNA, 17 nt, Human
aucaagggucaggccuu

SEQ ID NO: 1476020 - RNA, 16 nt, Human
aucaagggucaggccu

SEQ ID NO: 1476021 - RNA, 19 nt, Human
aucacucuguucauuccuc

SEQ ID NO: 1476022 - RNA, 13 nt, Human
aucacgcuuuccu

SEQ ID NO: 1476023 - RNA, 18 nt, Human
uuccuuacagaacuacuu

SEQ ID NO: 1476024 - RNA, 19 nt, Human
uuccuuaagucagaacagc

SEQ ID NO: 1476025 - RNA, 20 nt, Human
uuccuuaagucagaacagca

SEQ ID NO: 1476026 - RNA, 19 nt, Human
uuccuguuuuucacauuuu

SEQ ID NO: 1476027 - RNA, 23 nt, Human
uuccuguuuuucacauuuuccuu

SEQ ID NO: 1476028 - RNA, 13 nt, Human
uuccuuaccuuuu

SEQ ID NO: 1476029 - RNA, 21 nt, Human
auauuuuucaugauuuugaaa

SEQ ID NO: 1476030 - RNA, 11 nt, Human
aucaacugaau

SEQ ID NO: 1476031 - RNA, 13 nt, Human
aucaacugaauga

SEQ ID NO: 1476032 - RNA, 14 nt, Human
aucaacugaaugag

SEQ ID NO: 1476033 - RNA, 21 nt, Human
aucaacuuaccaggcaccaaa

SEQ ID NO: 1476034 - RNA, 15 nt, Human
aucaacuugcuuauc

SEQ ID NO: 1476035 - RNA, 16 nt, Human
aucaaggguacacugc

SEQ ID NO: 1476036 - RNA, 21 nt, Human
aucacugaacuuugcugagcc

SEQ ID NO: 1476037 - RNA, 14 nt, Human
aucacugaacuuug

SEQ ID NO: 1476038 - RNA, 23 nt, Human
aucacucuguucauuccuccagg

SEQ ID NO: 1476039 - RNA, 22 nt, Human
aucacucuguucauuccuccag

SEQ ID NO: 1476040 - RNA, 21 nt, Human
aucacucuguucauuccucca

SEQ ID NO: 1476041 - RNA, 20 nt, Human
aucacuuaggaaauggcuuu

SEQ ID NO: 1476042 - RNA, 18 nt, Human
aucaguuaacuauugcau

SEQ ID NO: 1476043 - RNA, 12 nt, Human
aucaguuaacua

SEQ ID NO: 1476044 - RNA, 16 nt, Human
aucagucucagaaugu

SEQ ID NO: 1476045 - RNA, 21 nt, Human
aucaguuuuuucaccuggaag

SEQ ID NO: 1476046 - RNA, 20 nt, Human
aucauauauauacauacaug

SEQ ID NO: 1476047 - RNA, 15 nt, Human
aucaucaguguagaa

SEQ ID NO: 1476048 - RNA, 16 nt, Human
aucaucaguguagaac

SEQ ID NO: 1476049 - RNA, 13 nt, Human
aucauuacuauaa

SEQ ID NO: 1476050 - RNA, 19 nt, Human
aucauugugaaauuauuca

SEQ ID NO: 1476051 - RNA, 18 nt, Human
uucuccccugcacuguaa

SEQ ID NO: 1476052 - RNA, 19 nt, Human
uucuccccugcacuguaaa

SEQ ID NO: 1476053 - RNA, 20 nt, Human
uucuccccugcacuguaaaa

SEQ ID NO: 1476054 - RNA, 15 nt, Human
aucauugugaaauua

SEQ ID NO: 1476055 - RNA, 13 nt, Human
aucauugugaaau

SEQ ID NO: 1476056 - RNA, 20 nt, Human
aucauucuuauuucaugaaa

SEQ ID NO: 1476057 - RNA, 19 nt, Human
aucauucuuauuucaugaa

SEQ ID NO: 1476058 - RNA, 23 nt, Human
aucauucuuauuucaugaaaauu

SEQ ID NO: 1476059 - RNA, 21 nt, Human
uucuccccugcacuguaaaau

SEQ ID NO: 1476060 - RNA, 19 nt, Human
uucucccuggauuuuuacc

SEQ ID NO: 1476061 - RNA, 20 nt, Human
uucucccuggauuuuuacca

SEQ ID NO: 1476062 - RNA, 17 nt, Human
uucugaauaaagcaauu

SEQ ID NO: 1476063 - RNA, 16 nt, Human
uucugaauaaagcaau

SEQ ID NO: 1476064 - RNA, 15 nt, Human
uucugaauaaagcaa

SEQ ID NO: 1476065 - RNA, 14 nt, Human
uucugaauaaagca

SEQ ID NO: 1476066 - RNA, 19 nt, Human
uucucgcuguccuuucuag

SEQ ID NO: 1476067 - RNA, 16 nt, Human
auccaagcaaauguga

SEQ ID NO: 1476068 - RNA, 16 nt, Human
auccaacuaaugccuu

SEQ ID NO: 1476069 - RNA, 18 nt, Human
auccaacuaaugccuuac

SEQ ID NO: 1476070 - RNA, 20 nt, Human
auccaacuaaugccuuacuc

SEQ ID NO: 1476071 - RNA, 18 nt, Human
auccaagcaaaugugaau

SEQ ID NO: 1476072 - RNA, 15 nt, Human
auccaguaaaauaau

SEQ ID NO: 1476073 - RNA, 16 nt, Human
auccaguaggauccag

SEQ ID NO: 1476074 - RNA, 18 nt, Human
auccaugaccuaguuuuc

SEQ ID NO: 1476075 - RNA, 20 nt, Human
auccaugaccuaguuuucca

SEQ ID NO: 1476076 - RNA, 21 nt, Human
auccaugaccuaguuuuccau

SEQ ID NO: 1476077 - RNA, 22 nt, Human
auccaugaccuaguuuuccaug

SEQ ID NO: 1476078 - RNA, 18 nt, Human
aucccacucacaacagcu

SEQ ID NO: 1476079 - RNA, 14 nt, Human
uucuuacugcuuaa

SEQ ID NO: 1476080 - RNA, 15 nt, Human
uucuuaccuguaugu

SEQ ID NO: 1476081 - RNA, 23 nt, Human
uucuuaaccagaucauugugaaa

SEQ ID NO: 1476082 - RNA, 22 nt, Human
uucuuaaccagaucauugugaa

SEQ ID NO: 1476083 - RNA, 11 nt, Human
uucuuaaauaa

SEQ ID NO: 1476084 - RNA, 18 nt, Human
uucuuaaauaagaaacuu

SEQ ID NO: 1476085 - RNA, 19 nt, Human
uucuuaaauaagaaacuuu

SEQ ID NO: 1476086 - RNA, 16 nt, Human
uucuguuuuauaauuu

SEQ ID NO: 1476087 - RNA, 17 nt, Human
uucuguuuuauaauuuu

SEQ ID NO: 1476088 - RNA, 18 nt, Human
uucuucuauugccucuga

SEQ ID NO: 1476089 - RNA, 20 nt, Human
uucuucuauugccucugaga

SEQ ID NO: 1476090 - RNA, 15 nt, Human
uucuuucucacuaaa

SEQ ID NO: 1476091 - RNA, 17 nt, Human
aucguaaaauuaagaaa

SEQ ID NO: 1476092 - RNA, 14 nt, Human
aucguaaaauuaag

SEQ ID NO: 1476093 - RNA, 13 nt, Human
aucguaaaauuaa

SEQ ID NO: 1476094 - RNA, 12 nt, Human
aucguaaaauua

SEQ ID NO: 1476095 - RNA, 18 nt, Human
aucggggagccgggagcc

SEQ ID NO: 1476096 - RNA, 16 nt, Human
aucggggagccgggag

SEQ ID NO: 1476097 - RNA, 16 nt, Human
auccuguauucagaca

SEQ ID NO: 1476098 - RNA, 18 nt, Human
auccuguauucagacaga

SEQ ID NO: 1476099 - RNA, 20 nt, Human
auccuguauucagacagaug

SEQ ID NO: 1476100 - RNA, 21 nt, Human
auccuguauucagacagauga

SEQ ID NO: 1476101 - RNA, 21 nt, Human
auccugucgauuagacuggac

SEQ ID NO: 1476102 - RNA, 19 nt, Human
auccugucgauuagacugg

SEQ ID NO: 1476103 - RNA, 14 nt, Human
auccuguguggaga

SEQ ID NO: 1476104 - RNA, 16 nt, Human
auccuguguggagagg

SEQ ID NO: 1476105 - RNA, 18 nt, Human
auccuguguggagaggga

SEQ ID NO: 1476106 - RNA, 19 nt, Human
auccuguguggagagggaa

SEQ ID NO: 1476107 - RNA, 21 nt, Human
auccuguguggagagggaaug

SEQ ID NO: 1476108 - RNA, 23 nt, Human
auccuguguggagagggaaugug

SEQ ID NO: 1476109 - RNA, 22 nt, Human
auccuguguggagagggaaugu

SEQ ID NO: 1476110 - RNA, 14 nt, Human
auccugcuucagug

SEQ ID NO: 1476111 - RNA, 12 nt, Human
auccugcuugau

SEQ ID NO: 1476112 - RNA, 14 nt, Human
auccucuuuuucca

SEQ ID NO: 1476113 - RNA, 15 nt, Human
auccucuuuuuccaa

SEQ ID NO: 1476114 - RNA, 14 nt, Human
auccugaaauuuca

SEQ ID NO: 1476115 - RNA, 16 nt, Human
auccugaaauuucaga

SEQ ID NO: 1476116 - RNA, 17 nt, Human
auccugaaauuucagau

SEQ ID NO: 1476117 - RNA, 13 nt, Human
auccugcuaaguu

SEQ ID NO: 1476118 - RNA, 12 nt, Human
auccugccugcc

SEQ ID NO: 1476119 - RNA, 19 nt, Human
auccugaugagguuucuac

SEQ ID NO: 1476120 - RNA, 15 nt, Human
uugacauaaaguuga

SEQ ID NO: 1476121 - RNA, 19 nt, Human
uugacaguguugaaaaugu

SEQ ID NO: 1476122 - RNA, 19 nt, Human
uugacauaaaguugauaaa

SEQ ID NO: 1476123 - RNA, 19 nt, Human
uugagaaggaaaauuuuag

SEQ ID NO: 1476124 - RNA, 20 nt, Human
uugagaaggaaaauuuuagc

SEQ ID NO: 1476125 - RNA, 17 nt, Human
uugagagaagagacaaa

SEQ ID NO: 1476126 - RNA, 16 nt, Human
uugagagaauuugugc

SEQ ID NO: 1476127 - RNA, 15 nt, Human
uugagagugugacca

SEQ ID NO: 1476128 - RNA, 13 nt, Human
uugagagugugac

SEQ ID NO: 1476129 - RNA, 17 nt, Human
uugauaaagauuuuuua

SEQ ID NO: 1476130 - RNA, 20 nt, Human
uugauaaagauuuuuuaaua

SEQ ID NO: 1476131 - RNA, 22 nt, Human
uugauaaagauuuuuuaauaau

SEQ ID NO: 1476132 - RNA, 14 nt, Human
uugauaaagauuuu

SEQ ID NO: 1476133 - RNA, 18 nt, Human
uugauaagaucuuuuauu

SEQ ID NO: 1476134 - RNA, 16 nt, Human
uugauaagaucuuuua

SEQ ID NO: 1476135 - RNA, 16 nt, Human
aucuaaguuaauuuaa

SEQ ID NO: 1476136 - RNA, 17 nt, Human
aucuaaguuaauuuaaa

SEQ ID NO: 1476137 - RNA, 22 nt, Human
aucuaaacuggauucacagcuc

SEQ ID NO: 1476138 - RNA, 19 nt, Human
uugaaguuagcuuuaacuu

SEQ ID NO: 1476139 - RNA, 23 nt, Human
uugaaguuagcuuuaacuuaaau

SEQ ID NO: 1476140 - RNA, 18 nt, Human
uugaaguauuuugcugga

SEQ ID NO: 1476141 - RNA, 20 nt, Human
uguugggagagggcgcaggc

SEQ ID NO: 1476142 - RNA, 17 nt, Human
uguugggagagggcgca

SEQ ID NO: 1476143 - RNA, 19 nt, Human
uguugggagagggcgcagg

SEQ ID NO: 1476144 - RNA, 14 nt, Human
uguugggagagggc

SEQ ID NO: 1476145 - RNA, 12 nt, Human
aguuauuuaaau

SEQ ID NO: 1476146 - RNA, 21 nt, Human
aguuauuuauuuauuggagau

SEQ ID NO: 1476147 - RNA, 18 nt, Human
aguucaaauucuucugaa

SEQ ID NO: 1476148 - RNA, 13 nt, Human
aguucaacauguu

SEQ ID NO: 1476149 - RNA, 19 nt, Human
aguucaagaaauaaguuuu

SEQ ID NO: 1476150 - RNA, 13 nt, Human
aguucaagaaaua

SEQ ID NO: 1476151 - RNA, 13 nt, Human
aguuccugggaac

SEQ ID NO: 1476152 - RNA, 20 nt, Human
aguuauuauauuuacaaaug

SEQ ID NO: 1476153 - RNA, 21 nt, Human
aguuauaaguagcaggccaag

SEQ ID NO: 1476154 - RNA, 15 nt, Human
aguuaucuaaguuaa

SEQ ID NO: 1476155 - RNA, 22 nt, Human
aguuaucuaaguuaauuuaaag

SEQ ID NO: 1476156 - RNA, 20 nt, Human
aguuaugauuuuuuuuucau

SEQ ID NO: 1476157 - RNA, 19 nt, Human
aguuaugccgcuagauaca

SEQ ID NO: 1476158 - RNA, 18 nt, Human
aguuauuaaguucuuuaa

SEQ ID NO: 1476159 - RNA, 19 nt, Human
aguuauuaaguucuuuaaa

SEQ ID NO: 1476160 - RNA, 17 nt, Human
aguuacccaaauuaaga

SEQ ID NO: 1476161 - RNA, 18 nt, Human
aguuacccaaauuaagag

SEQ ID NO: 1476162 - RNA, 15 nt, Human
aguuacauguuugca

SEQ ID NO: 1476163 - RNA, 17 nt, Human
aguuaguggauuacugc

SEQ ID NO: 1476164 - RNA, 20 nt, Human
aguuaguggauuacugccau

SEQ ID NO: 1476165 - RNA, 15 nt, Human
aguggcaucaucuca

SEQ ID NO: 1476166 - RNA, 14 nt, Human
aguguaauugagaa

SEQ ID NO: 1476167 - RNA, 11 nt, Human
agugggugggg

SEQ ID NO: 1476168 - RNA, 14 nt, Human
aguggguggggagu

SEQ ID NO: 1476169 - RNA, 12 nt, Human
aguggguuuuuu

SEQ ID NO: 1476170 - RNA, 15 nt, Human
aguggguuuuuuagu

SEQ ID NO: 1476171 - RNA, 21 nt, Human
aguggguuuuuuaguugaauu

SEQ ID NO: 1476172 - RNA, 14 nt, Human
uguuauuaaacaaa

SEQ ID NO: 1476173 - RNA, 17 nt, Human
uguuauuuguaauagau

SEQ ID NO: 1476174 - RNA, 15 nt, Human
uguuaugcugugaca

SEQ ID NO: 1476175 - RNA, 17 nt, Human
uguuauguagauaacaa

SEQ ID NO: 1476176 - RNA, 16 nt, Human
uguucccauuucagcu

SEQ ID NO: 1476177 - RNA, 17 nt, Human
uguucccauuucagcug

SEQ ID NO: 1476178 - RNA, 17 nt, Human
uguucuuaccuguaugu

SEQ ID NO: 1476179 - RNA, 22 nt, Human
uguucuuaccuguaugucucca

SEQ ID NO: 1476180 - RNA, 13 nt, Human
uguuuuauaauuu

SEQ ID NO: 1476181 - RNA, 20 nt, Human
uguuuuauaauuuugugaag

SEQ ID NO: 1476182 - RNA, 12 nt, Human
uguuuucucuga

SEQ ID NO: 1476183 - RNA, 17 nt, Human
uguuuucucugaacaca

SEQ ID NO: 1476184 - RNA, 19 nt, Human
uguuugcuaagcauuccaa

SEQ ID NO: 1476185 - RNA, 20 nt, Human
uguuugcucagcuucuccaa

SEQ ID NO: 1476186 - RNA, 21 nt, Human
uguuuuacaauaguucugugg

SEQ ID NO: 1476187 - RNA, 22 nt, Human
uguuuuacaauaguucuguggg

SEQ ID NO: 1476188 - RNA, 17 nt, Human
uguuuuacaauaguucu

SEQ ID NO: 1476189 - RNA, 13 nt, Human
uguuuuacaauag

SEQ ID NO: 1476190 - RNA, 13 nt, Human
uguuuggcuuuca

SEQ ID NO: 1476191 - RNA, 14 nt, Human
uguuuggcuuucag

SEQ ID NO: 1476192 - RNA, 15 nt, Human
uguuugcuaagcauu

SEQ ID NO: 1476193 - RNA, 15 nt, Human
uguuugcaucugaaa

SEQ ID NO: 1476194 - RNA, 19 nt, Human
aguugcaacuuuguauaaa

SEQ ID NO: 1476195 - RNA, 16 nt, Human
aguugauuuucuggau

SEQ ID NO: 1476196 - RNA, 21 nt, Human
aguugauaugccuuuucccaa

SEQ ID NO: 1476197 - RNA, 13 nt, Human
aguucugaagaag

SEQ ID NO: 1476198 - RNA, 14 nt, Human
aguucugaagaaga

SEQ ID NO: 1476199 - RNA, 15 nt, Human
aguucugaagaagau

SEQ ID NO: 1476200 - RNA, 16 nt, Human
aguucugaagaagaug

SEQ ID NO: 1476201 - RNA, 17 nt, Human
aguucuuuaaaauguaa

SEQ ID NO: 1476202 - RNA, 17 nt, Human
aguucuuuggcugaaag

SEQ ID NO: 1476203 - RNA, 23 nt, Human
aguuuuauuaauaaacauucuau

SEQ ID NO: 1476204 - RNA, 20 nt, Human
aguuuuccauggcaggaagg

SEQ ID NO: 1476205 - RNA, 22 nt, Human
aguuuuccauggcaggaaggcu

SEQ ID NO: 1476206 - RNA, 16 nt, Human
aguuucguuuucaaaa

SEQ ID NO: 1476207 - RNA, 15 nt, Human
aguuucguuuucaaa

SEQ ID NO: 1476208 - RNA, 23 nt, Human
uuaaauucucucucuugcaggaa

SEQ ID NO: 1476209 - RNA, 16 nt, Human
aguuuauuuguugaga

SEQ ID NO: 1476210 - RNA, 18 nt, Human
aguuuauuuguugagagu

SEQ ID NO: 1476211 - RNA, 19 nt, Human
aguuuauuuguugagagug

SEQ ID NO: 1476212 - RNA, 23 nt, Human
aguuuauuuguugagagugugac

SEQ ID NO: 1476213 - RNA, 20 nt, Human
aguuuauuuguugagagugu

SEQ ID NO: 1476214 - RNA, 19 nt, Human
uuaaaaaagaaacauuugg

SEQ ID NO: 1476215 - RNA, 13 nt, Human
uuaaaaaacuaaa

SEQ ID NO: 1476216 - RNA, 15 nt, Human
uuaaaaaagaaacau

SEQ ID NO: 1476217 - RNA, 18 nt, Human
uuaaaaaagaaacauuug

SEQ ID NO: 1476218 - RNA, 17 nt, Human
aguugcacagcuaugaa

SEQ ID NO: 1476219 - RNA, 16 nt, Human
aguugcacagcuauga

SEQ ID NO: 1476220 - RNA, 16 nt, Human
uuaaaccgcuaaaaga

SEQ ID NO: 1476221 - RNA, 17 nt, Human
uuaaaccuauacucacu

SEQ ID NO: 1476222 - RNA, 14 nt, Human
uuaaaccuauacuc

SEQ ID NO: 1476223 - RNA, 14 nt, Human
uuaaaccuuuuuug

SEQ ID NO: 1476224 - RNA, 19 nt, Human
uuaaaccgcuaaaagaaac

SEQ ID NO: 1476225 - RNA, 22 nt, Human
uuaucaugugaaaucauucauu

SEQ ID NO: 1476226 - RNA, 20 nt, Human
uuaucaugugaaaucauuca

SEQ ID NO: 1476227 - RNA, 18 nt, Human
uuaucaugugaaaucauu

SEQ ID NO: 1476228 - RNA, 17 nt, Human
uuaucaugugaaaucau

SEQ ID NO: 1476229 - RNA, 15 nt, Human
uuaucaacuuccuaa

SEQ ID NO: 1476230 - RNA, 21 nt, Human
uuaucaacuuccuaaauauua

SEQ ID NO: 1476231 - RNA, 21 nt, Human
auaccaauaaagugacccugc

SEQ ID NO: 1476232 - RNA, 15 nt, Human
auaccaauaaaguga

SEQ ID NO: 1476233 - RNA, 14 nt, Human
auaccaauaaagug

SEQ ID NO: 1476234 - RNA, 22 nt, Human
auaccacaggaaccacaagacu

SEQ ID NO: 1476235 - RNA, 17 nt, Human
auacuaagcauugaaug

SEQ ID NO: 1476236 - RNA, 21 nt, Human
auacuaagcauugaauggcua

SEQ ID NO: 1476237 - RNA, 20 nt, Human
auacaucccuuaccugggaa

SEQ ID NO: 1476238 - RNA, 20 nt, Human
auacauuguauauaugugua

SEQ ID NO: 1476239 - RNA, 13 nt, Human
auaccaauaaagu

SEQ ID NO: 1476240 - RNA, 12 nt, Human
auaccaauaaag

SEQ ID NO: 1476241 - RNA, 17 nt, Human
auaccaaagcacauuuu

SEQ ID NO: 1476242 - RNA, 18 nt, Human
auaccaaagcacauuuua

SEQ ID NO: 1476243 - RNA, 16 nt, Human
auacauuuucuaagaa

SEQ ID NO: 1476244 - RNA, 21 nt, Human
auacaguucggugagcuacaa

SEQ ID NO: 1476245 - RNA, 18 nt, Human
auacaaaaauacucagau

SEQ ID NO: 1476246 - RNA, 19 nt, Human
auacaaaggcuuauuaauu

SEQ ID NO: 1476247 - RNA, 16 nt, Human
auacagcaacaauuua

SEQ ID NO: 1476248 - RNA, 13 nt, Human
auacagcucagaa

SEQ ID NO: 1476249 - RNA, 17 nt, Human
uuauaguacaugauaaa

SEQ ID NO: 1476250 - RNA, 16 nt, Human
uuauaguacaugauaa

SEQ ID NO: 1476251 - RNA, 13 nt, Human
uuauaguacauga

SEQ ID NO: 1476252 - RNA, 24 nt, Human
uuauaggauuuauuuaaaauagca

SEQ ID NO: 1476253 - RNA, 18 nt, Human
uuauaggauuuauuuaaa

SEQ ID NO: 1476254 - RNA, 16 nt, Human
uuauaggaucauuugu

SEQ ID NO: 1476255 - RNA, 20 nt, Human
uuauacgaguaauaugccug

SEQ ID NO: 1476256 - RNA, 15 nt, Human
uuagccccugaaagc

SEQ ID NO: 1476257 - RNA, 16 nt, Human
uuagccccugaaagcc

SEQ ID NO: 1476258 - RNA, 20 nt, Human
uuagccucaauuucugaaca

SEQ ID NO: 1476259 - RNA, 17 nt, Human
uuauaaauuucuauuuu

SEQ ID NO: 1476260 - RNA, 16 nt, Human
uuauaaccuuaauuua

SEQ ID NO: 1476261 - RNA, 19 nt, Human
uuauaaccuuaauuuauua

SEQ ID NO: 1476262 - RNA, 21 nt, Human
uuauaaccuuaauuuauuauu

SEQ ID NO: 1476263 - RNA, 16 nt, Human
uuauaacuggaaagaa

SEQ ID NO: 1476264 - RNA, 17 nt, Human
uuauaacuggaaagaag

SEQ ID NO: 1476265 - RNA, 18 nt, Human
uuauauaagcuuguauuc

SEQ ID NO: 1476266 - RNA, 15 nt, Human
uuauaguuguaacua

SEQ ID NO: 1476267 - RNA, 20 nt, Human
uuauauaaucauuauuacuu

SEQ ID NO: 1476268 - RNA, 16 nt, Human
uuauauaaucauuauu

SEQ ID NO: 1476269 - RNA, 22 nt, Human
uuauauauauuuuuuucugaaa

SEQ ID NO: 1476270 - RNA, 13 nt, Human
auaauuuugugaa

SEQ ID NO: 1476271 - RNA, 14 nt, Human
auaauuuugugaag

SEQ ID NO: 1476272 - RNA, 15 nt, Human
auaauuuugugaagc

SEQ ID NO: 1476273 - RNA, 20 nt, Human
auaauuuugugaagcaaaau

SEQ ID NO: 1476274 - RNA, 14 nt, Human
auaauuuuuauauu

SEQ ID NO: 1476275 - RNA, 16 nt, Human
auaauuuuuauauuug

SEQ ID NO: 1476276 - RNA, 19 nt, Human
auaauuuuuauauuugaaa

SEQ ID NO: 1476277 - RNA, 21 nt, Human
auaauuuuuauauuugaaaua

SEQ ID NO: 1476278 - RNA, 22 nt, Human
auaauuuuuauauuugaaauau

SEQ ID NO: 1476279 - RNA, 23 nt, Human
auaaacacucuugaaaaaugcau

SEQ ID NO: 1476280 - RNA, 17 nt, Human
aguuuucuccucccagg

SEQ ID NO: 1476281 - RNA, 16 nt, Human
aguuuuccuaugcuuu

SEQ ID NO: 1476282 - RNA, 18 nt, Human
aguuuuccuaugcuuuga

SEQ ID NO: 1476283 - RNA, 22 nt, Human
aguuuuccuaagugauuguaug

SEQ ID NO: 1476284 - RNA, 16 nt, Human
auaaaccgaacugaug

SEQ ID NO: 1476285 - RNA, 13 nt, Human
auaaacauuguau

SEQ ID NO: 1476286 - RNA, 15 nt, Human
auaaacgucuuaaau

SEQ ID NO: 1476287 - RNA, 16 nt, Human
auaaacgucuuaaaua

SEQ ID NO: 1476288 - RNA, 18 nt, Human
auaaacgucuuaaauauu

SEQ ID NO: 1476289 - RNA, 20 nt, Human
auaaagugacccugcucuca

SEQ ID NO: 1476290 - RNA, 18 nt, Human
auaaagugacccugcucu

SEQ ID NO: 1476291 - RNA, 14 nt, Human
auaaaguaucauca

SEQ ID NO: 1476292 - RNA, 15 nt, Human
auaaaguaucaucag

SEQ ID NO: 1476293 - RNA, 19 nt, Human
auaaauaaaguuuguugaa

SEQ ID NO: 1476294 - RNA, 13 nt, Human
auaaauaaaguuu

SEQ ID NO: 1476295 - RNA, 12 nt, Human
auaacuggaaac

SEQ ID NO: 1476296 - RNA, 15 nt, Human
auaacuggaaagaag

SEQ ID NO: 1476297 - RNA, 13 nt, Human
auaacugaaaaug

SEQ ID NO: 1476298 - RNA, 15 nt, Human
auaacugaaaaugug

SEQ ID NO: 1476299 - RNA, 14 nt, Human
auaacugaaaauua

SEQ ID NO: 1476300 - RNA, 17 nt, Human
auaacugaaaauuauuu

SEQ ID NO: 1476301 - RNA, 20 nt, Human
auaacugaaaauuauuuaaa

SEQ ID NO: 1476302 - RNA, 21 nt, Human
auaacugaaaauuauuuaaac

SEQ ID NO: 1476303 - RNA, 16 nt, Human
uuacaugauucauuuu

SEQ ID NO: 1476304 - RNA, 17 nt, Human
uuacaugauucauuuua

SEQ ID NO: 1476305 - RNA, 22 nt, Human
uuacaugcauuacugcaugcac

SEQ ID NO: 1476306 - RNA, 22 nt, Human
auaaguuuauuucuuaaaucua

SEQ ID NO: 1476307 - RNA, 18 nt, Human
auaaguuuauuucuuaaa

SEQ ID NO: 1476308 - RNA, 14 nt, Human
auaaguuuauuucu

SEQ ID NO: 1476309 - RNA, 12 nt, Human
auaaguuuauuu

SEQ ID NO: 1476310 - RNA, 14 nt, Human
auaauaauuaguaa

SEQ ID NO: 1476311 - RNA, 18 nt, Human
auaaguucaaauucuucu

SEQ ID NO: 1476312 - RNA, 20 nt, Human
auaaguucaaauucuucuga

SEQ ID NO: 1476313 - RNA, 21 nt, Human
auaaguucaaauucuucugaa

SEQ ID NO: 1476314 - RNA, 24 nt, Human
auaaguucaaauucuucugaacuc

SEQ ID NO: 1476315 - RNA, 20 nt, Human
auaagcaaaaacaaaaagaa

SEQ ID NO: 1476316 - RNA, 20 nt, Human
auaagaagaaugcuuaauca

SEQ ID NO: 1476317 - RNA, 19 nt, Human
auaagaagaaugcuuaauc

SEQ ID NO: 1476318 - RNA, 16 nt, Human
auaagaacuuugagcu

SEQ ID NO: 1476319 - RNA, 11 nt, Human
auaagaagaau

SEQ ID NO: 1476320 - RNA, 13 nt, Human
auaagaagaaugc

SEQ ID NO: 1476321 - RNA, 15 nt, Human
auaagaagaaugcuu

SEQ ID NO: 1476322 - RNA, 16 nt, Human
auaagcaagaaggcaa

SEQ ID NO: 1476323 - RNA, 21 nt, Human
auaagcaagaaggcaaaaaua

SEQ ID NO: 1476324 - RNA, 23 nt, Human
auaagcaagaaggcaaaaauagu

SEQ ID NO: 1476325 - RNA, 12 nt, Human
uuaccugggaaa

SEQ ID NO: 1476326 - RNA, 23 nt, Human
uuagaugcaguucugaagaagau

SEQ ID NO: 1476327 - RNA, 22 nt, Human
uuagaugcaguucugaagaaga

SEQ ID NO: 1476328 - RNA, 13 nt, Human
uuagauuugugug

SEQ ID NO: 1476329 - RNA, 17 nt, Human
auaauccaguaaaauaa

SEQ ID NO: 1476330 - RNA, 17 nt, Human
auaaugaacagaacaua

SEQ ID NO: 1476331 - RNA, 21 nt, Human
auaaucuuucacaggggacag

SEQ ID NO: 1476332 - RNA, 21 nt, Human
auaaucauuauuacuuuugcu

SEQ ID NO: 1476333 - RNA, 22 nt, Human
auaaucauuauuacuuuugcug

SEQ ID NO: 1476334 - RNA, 16 nt, Human
auaaucacgcuuuccu

SEQ ID NO: 1476335 - RNA, 18 nt, Human
auaaucacgcuuuccuga

SEQ ID NO: 1476336 - RNA, 14 nt, Human
auaaugaauacuuu

SEQ ID NO: 1476337 - RNA, 13 nt, Human
auaaugaacagaa

SEQ ID NO: 1476338 - RNA, 21 nt, Human
aggggcuuauaauaaaggacu

SEQ ID NO: 1476339 - RNA, 12 nt, Human
aggggcuucagg

SEQ ID NO: 1476340 - RNA, 15 nt, Human
aggggcuucaggucc

SEQ ID NO: 1476341 - RNA, 21 nt, Human
aggggcuggggacuugugucu

SEQ ID NO: 1476342 - RNA, 18 nt, Human
aggggcuggggacuugug

SEQ ID NO: 1476343 - RNA, 16 nt, Human
aggggcuucaggucca

SEQ ID NO: 1476344 - RNA, 14 nt, Human
aggggcuggggacu

SEQ ID NO: 1476345 - RNA, 12 nt, Human
aggggaccagga

SEQ ID NO: 1476346 - RNA, 13 nt, Human
aggggaccaggag

SEQ ID NO: 1476347 - RNA, 14 nt, Human
aggggaccaggagu

SEQ ID NO: 1476348 - RNA, 15 nt, Human
aggggaccaggagug

SEQ ID NO: 1476349 - RNA, 16 nt, Human
aggggaccaggagugg

SEQ ID NO: 1476350 - RNA, 22 nt, Human
aggggaccaggagugggugggg

SEQ ID NO: 1476351 - RNA, 17 nt, Human
aggggaccaggaguggg

SEQ ID NO: 1476352 - RNA, 20 nt, Human
aggggaccaggagugggugg

SEQ ID NO: 1476353 - RNA, 17 nt, Human
aggggaggcaucagugu

SEQ ID NO: 1476354 - RNA, 15 nt, Human
aggguaccagcagaa

SEQ ID NO: 1476355 - RNA, 14 nt, Human
aggguaccagcaga

SEQ ID NO: 1476356 - RNA, 13 nt, Human
aggguaggcagga

SEQ ID NO: 1476357 - RNA, 15 nt, Human
aggguaggcaggauu

SEQ ID NO: 1476358 - RNA, 16 nt, Human
aggguaggcaggauug

SEQ ID NO: 1476359 - RNA, 18 nt, Human
aggguaggcaggauuggg

SEQ ID NO: 1476360 - RNA, 23 nt, Human
agggggggguauuucaauuaccu

SEQ ID NO: 1476361 - RNA, 19 nt, Human
uggucacguuuggugcuuc

SEQ ID NO: 1476362 - RNA, 18 nt, Human
uggucauuuuauguuaag

SEQ ID NO: 1476363 - RNA, 21 nt, Human
ugguccaaaagauugcugaaa

SEQ ID NO: 1476364 - RNA, 23 nt, Human
ugguccaaaagauugcugaaauu

SEQ ID NO: 1476365 - RNA, 15 nt, Human
ugguacaugguguuu

SEQ ID NO: 1476366 - RNA, 18 nt, Human
ugguacaugguguuugug

SEQ ID NO: 1476367 - RNA, 14 nt, Human
ugguaauuguacua

SEQ ID NO: 1476368 - RNA, 13 nt, Human
ugguaauuguugc

SEQ ID NO: 1476369 - RNA, 14 nt, Human
ugguaaaacacuug

SEQ ID NO: 1476370 - RNA, 14 nt, Human
agggugcugacugg

SEQ ID NO: 1476371 - RNA, 22 nt, Human
ugguccaugggccauaugaaaa

SEQ ID NO: 1476372 - RNA, 17 nt, Human
uggucugguugggcagc

SEQ ID NO: 1476373 - RNA, 16 nt, Human
uggucugguugggcag

SEQ ID NO: 1476374 - RNA, 15 nt, Human
aggucagugcaaaua

SEQ ID NO: 1476375 - RNA, 16 nt, Human
aggugaaacauuuucu

SEQ ID NO: 1476376 - RNA, 15 nt, Human
aggguuucaccaugu

SEQ ID NO: 1476377 - RNA, 22 nt, Human
aggguuucccuacugaagcccu

SEQ ID NO: 1476378 - RNA, 15 nt, Human
aggguuucauugucu

SEQ ID NO: 1476379 - RNA, 21 nt, Human
aggguuucccuacugaagccc

SEQ ID NO: 1476380 - RNA, 22 nt, Human
agguagaauuaucuaauuuaua

SEQ ID NO: 1476381 - RNA, 15 nt, Human
aggguuugugacagg

SEQ ID NO: 1476382 - RNA, 14 nt, Human
agguauuuaucuuu

SEQ ID NO: 1476383 - RNA, 15 nt, Human
agguauaccucacuu

SEQ ID NO: 1476384 - RNA, 18 nt, Human
ugguuuuaguugcaacuu

SEQ ID NO: 1476385 - RNA, 19 nt, Human
ugguuuucuccaagagcua

SEQ ID NO: 1476386 - RNA, 20 nt, Human
ugguuuucuccaagagcuac

SEQ ID NO: 1476387 - RNA, 23 nt, Human
ugguuugaagaauguuaagacuu

SEQ ID NO: 1476388 - RNA, 16 nt, Human
uguaaaggaauuuaaa

SEQ ID NO: 1476389 - RNA, 13 nt, Human
uguaaagccaugc

SEQ ID NO: 1476390 - RNA, 12 nt, Human
uguaaagcuaaa

SEQ ID NO: 1476391 - RNA, 16 nt, Human
uguaaagcuaaaauaa

SEQ ID NO: 1476392 - RNA, 17 nt, Human
uguaaagcuaaaauaaa

SEQ ID NO: 1476393 - RNA, 20 nt, Human
uguaaagcuaaaauaaagaa

SEQ ID NO: 1476394 - RNA, 21 nt, Human
uguaaagcuaaaauaaagaaa

SEQ ID NO: 1476395 - RNA, 18 nt, Human
uguaaagauauuuuuauc

SEQ ID NO: 1476396 - RNA, 13 nt, Human
uguaaagcuuguc

SEQ ID NO: 1476397 - RNA, 18 nt, Human
uguaaauauuuuaaagaa

SEQ ID NO: 1476398 - RNA, 20 nt, Human
uguaaauauuuuaaagaauu

SEQ ID NO: 1476399 - RNA, 22 nt, Human
uguaaauauuuuaaagaauugu

SEQ ID NO: 1476400 - RNA, 14 nt, Human
uguaaauauugugu

SEQ ID NO: 1476401 - RNA, 15 nt, Human
uguaaauauugugug

SEQ ID NO: 1476402 - RNA, 14 nt, Human
uguaaauauuuuaa

SEQ ID NO: 1476403 - RNA, 17 nt, Human
uguaaauauuuuaaaga

SEQ ID NO: 1476404 - RNA, 16 nt, Human
ugguucagcuaagcua

SEQ ID NO: 1476405 - RNA, 15 nt, Human
ugguucacacugacc

SEQ ID NO: 1476406 - RNA, 22 nt, Human
ugguguugccaguuguccuccu

SEQ ID NO: 1476407 - RNA, 20 nt, Human
ugguguugccaguuguccuc

SEQ ID NO: 1476408 - RNA, 17 nt, Human
aggugaaacauuuucuc

SEQ ID NO: 1476409 - RNA, 19 nt, Human
uguacuugcucuugaugcc

SEQ ID NO: 1476410 - RNA, 17 nt, Human
uguagaaccuaauucaa

SEQ ID NO: 1476411 - RNA, 15 nt, Human
uguacuugcucuuga

SEQ ID NO: 1476412 - RNA, 21 nt, Human
uguagaagucacauuccugaa

SEQ ID NO: 1476413 - RNA, 16 nt, Human
uguagaaugauuucau

SEQ ID NO: 1476414 - RNA, 17 nt, Human
uguagaaugauuucaug

SEQ ID NO: 1476415 - RNA, 18 nt, Human
uguagaaugauuucaugc

SEQ ID NO: 1476416 - RNA, 15 nt, Human
uguaaggcaaucaug

SEQ ID NO: 1476417 - RNA, 22 nt, Human
uguacaaaauaaacaaauaaca

SEQ ID NO: 1476418 - RNA, 18 nt, Human
uguaagaaaauaucacuu

SEQ ID NO: 1476419 - RNA, 12 nt, Human
uguaagaaaccu

SEQ ID NO: 1476420 - RNA, 16 nt, Human
uguaagcugaaaauau

SEQ ID NO: 1476421 - RNA, 14 nt, Human
uguaagcugaaaau

SEQ ID NO: 1476422 - RNA, 21 nt, Human
uguaagaacaacuaccugagc

SEQ ID NO: 1476423 - RNA, 12 nt, Human
agguugucugug

SEQ ID NO: 1476424 - RNA, 18 nt, Human
agguggguugaaagccaa

SEQ ID NO: 1476425 - RNA, 21 nt, Human
agugagcagucaggaaagaga

SEQ ID NO: 1476426 - RNA, 22 nt, Human
agugagagacauuaacucauua

SEQ ID NO: 1476427 - RNA, 13 nt, Human
agugagagacauu

SEQ ID NO: 1476428 - RNA, 21 nt, Human
agugagagacauuaacucauu

SEQ ID NO: 1476429 - RNA, 21 nt, Human
agugagagaguggcuggggca

SEQ ID NO: 1476430 - RNA, 14 nt, Human
ugugauucaaucug

SEQ ID NO: 1476431 - RNA, 20 nt, Human
agugaaacucguuaauuugu

SEQ ID NO: 1476432 - RNA, 20 nt, Human
agugagaccuuccuuuuacu

SEQ ID NO: 1476433 - RNA, 18 nt, Human
agucuuacucuguugcca

SEQ ID NO: 1476434 - RNA, 22 nt, Human
agucuuaauauauauauccaga

SEQ ID NO: 1476435 - RNA, 12 nt, Human
agucuuccugac

SEQ ID NO: 1476436 - RNA, 15 nt, Human
agucuuccugacacu

SEQ ID NO: 1476437 - RNA, 16 nt, Human
agucuuccugacacuu

SEQ ID NO: 1476438 - RNA, 17 nt, Human
agucuuccugacacuuu

SEQ ID NO: 1476439 - RNA, 18 nt, Human
agucuuccugacacuuua

SEQ ID NO: 1476440 - RNA, 19 nt, Human
agucuuccugacacuuuaa

SEQ ID NO: 1476441 - RNA, 19 nt, Human
agucuccaaagucucugga

SEQ ID NO: 1476442 - RNA, 23 nt, Human
agucucugaggggcuaccaggaa

SEQ ID NO: 1476443 - RNA, 22 nt, Human
agucucugaggggcuaccagga

SEQ ID NO: 1476444 - RNA, 16 nt, Human
agucucugaggggcua

SEQ ID NO: 1476445 - RNA, 14 nt, Human
ugugaagcaaaauu

SEQ ID NO: 1476446 - RNA, 22 nt, Human
ugucucuggauuauauuaugaa

SEQ ID NO: 1476447 - RNA, 12 nt, Human
ugucucucauga

SEQ ID NO: 1476448 - RNA, 13 nt, Human
agucccugccugg

SEQ ID NO: 1476449 - RNA, 18 nt, Human
ugucucugcaaacugccu

SEQ ID NO: 1476450 - RNA, 13 nt, Human
ugucucuucugag

SEQ ID NO: 1476451 - RNA, 16 nt, Human
ugucucuucugagcua

SEQ ID NO: 1476452 - RNA, 22 nt, Human
ugugaacaguuguguuugaagc

SEQ ID NO: 1476453 - RNA, 23 nt, Human
agguuuggacaaaauggaauacu

SEQ ID NO: 1476454 - RNA, 22 nt, Human
aguagcguuuuuuaaauguaua

SEQ ID NO: 1476455 - RNA, 21 nt, Human
aguagcguuuuuuaaauguau

SEQ ID NO: 1476456 - RNA, 11 nt, Human
uguauuaugug

SEQ ID NO: 1476457 - RNA, 21 nt, Human
aguauuuaauucauguugccu

SEQ ID NO: 1476458 - RNA, 15 nt, Human
aguauuguccagguc

SEQ ID NO: 1476459 - RNA, 16 nt, Human
aguauuguccaggucu

SEQ ID NO: 1476460 - RNA, 18 nt, Human
agucacauuccugaacag

SEQ ID NO: 1476461 - RNA, 18 nt, Human
aguauguuagugcaaauu

SEQ ID NO: 1476462 - RNA, 21 nt, Human
aguauguuagugcaaauuguc

SEQ ID NO: 1476463 - RNA, 15 nt, Human
agucagucauucaga

SEQ ID NO: 1476464 - RNA, 21 nt, Human
agucagucauucagauaugau

SEQ ID NO: 1476465 - RNA, 18 nt, Human
agucccaucccugcguga

SEQ ID NO: 1476466 - RNA, 22 nt, Human
aguccccacagauaacugaaaa

SEQ ID NO: 1476467 - RNA, 16 nt, Human
aguccaucagccucca

SEQ ID NO: 1476468 - RNA, 13 nt, Human
aguccaucagccu

SEQ ID NO: 1476469 - RNA, 14 nt, Human
aguccaucagccuc

SEQ ID NO: 1476470 - RNA, 15 nt, Human
uguccuguaaagguu

SEQ ID NO: 1476471 - RNA, 22 nt, Human
uguccuguaaagguuacaagcc

SEQ ID NO: 1476472 - RNA, 23 nt, Human
agcuggagaugaggccagaccau

SEQ ID NO: 1476473 - RNA, 22 nt, Human
agcuggagaugaggccagacca

SEQ ID NO: 1476474 - RNA, 21 nt, Human
agcuggagaugaggccagacc

SEQ ID NO: 1476475 - RNA, 20 nt, Human
agcuggagaugaggccagac

SEQ ID NO: 1476476 - RNA, 19 nt, Human
agcuggagaugaggccaga

SEQ ID NO: 1476477 - RNA, 14 nt, Human
agcuggagugcagu

SEQ ID NO: 1476478 - RNA, 18 nt, Human
agcuggagaugaggccag

SEQ ID NO: 1476479 - RNA, 13 nt, Human
agcuggaaaagua

SEQ ID NO: 1476480 - RNA, 23 nt, Human
ugccucucugcaggucccuaaua

SEQ ID NO: 1476481 - RNA, 15 nt, Human
ugccucucugcaggu

SEQ ID NO: 1476482 - RNA, 17 nt, Human
ugccugcuauuugaagu

SEQ ID NO: 1476483 - RNA, 12 nt, Human
ugccucucugca

SEQ ID NO: 1476484 - RNA, 11 nt, Human
ugccucucugc

SEQ ID NO: 1476485 - RNA, 18 nt, Human
ugccucagaaaacaagga

SEQ ID NO: 1476486 - RNA, 14 nt, Human
ugccucacuucagg

SEQ ID NO: 1476487 - RNA, 14 nt, Human
ugcccuucuccuua

SEQ ID NO: 1476488 - RNA, 22 nt, Human
ugcccugccaccugucugucug

SEQ ID NO: 1476489 - RNA, 21 nt, Human
ugcccugccaccugucugucu

SEQ ID NO: 1476490 - RNA, 20 nt, Human
ugcccugccaccugucuguc

SEQ ID NO: 1476491 - RNA, 19 nt, Human
ugcccugccaccugucugu

SEQ ID NO: 1476492 - RNA, 17 nt, Human
ugcccugccaccugucu

SEQ ID NO: 1476493 - RNA, 16 nt, Human
ugcccugccaccuguc

SEQ ID NO: 1476494 - RNA, 15 nt, Human
ugcccugccaccugu

SEQ ID NO: 1476495 - RNA, 14 nt, Human
ugcccugccaccug

SEQ ID NO: 1476496 - RNA, 22 nt, Human
ugcccucccccuccucuccacc

SEQ ID NO: 1476497 - RNA, 21 nt, Human
agcuccuugagggcaagagcc

SEQ ID NO: 1476498 - RNA, 22 nt, Human
agcuccuugagggcaagagcca

SEQ ID NO: 1476499 - RNA, 13 nt, Human
agcucuucauguu

SEQ ID NO: 1476500 - RNA, 16 nt, Human
agcucuucauguuuca

SEQ ID NO: 1476501 - RNA, 16 nt, Human
ugcauuuauauguacc

SEQ ID NO: 1476502 - RNA, 19 nt, Human
ugcauuuaugagcucuuca

SEQ ID NO: 1476503 - RNA, 14 nt, Human
ugcauuuauaugua

SEQ ID NO: 1476504 - RNA, 13 nt, Human
ugcauuuauaugu

SEQ ID NO: 1476505 - RNA, 12 nt, Human
agccuucucugu

SEQ ID NO: 1476506 - RNA, 20 nt, Human
agccuugauugguguugcca

SEQ ID NO: 1476507 - RNA, 19 nt, Human
agccuugauugguguugcc

SEQ ID NO: 1476508 - RNA, 20 nt, Human
ugcauuuaugagcucuucau

SEQ ID NO: 1476509 - RNA, 15 nt, Human
agcuccaagaauuuc

SEQ ID NO: 1476510 - RNA, 18 nt, Human
agcuccaagaauuucuag

SEQ ID NO: 1476511 - RNA, 18 nt, Human
agcucaggaugagggaaa

SEQ ID NO: 1476512 - RNA, 22 nt, Human
agcucaggaugagggaaaagaa

SEQ ID NO: 1476513 - RNA, 17 nt, Human
agcuaucguaaaauuaa

SEQ ID NO: 1476514 - RNA, 15 nt, Human
agcuacauaauuuag

SEQ ID NO: 1476515 - RNA, 16 nt, Human
ugccccauucaacauc

SEQ ID NO: 1476516 - RNA, 21 nt, Human
ugcccccaaccauuuccucag

SEQ ID NO: 1476517 - RNA, 16 nt, Human
ugcccccaaccauuuc

SEQ ID NO: 1476518 - RNA, 21 nt, Human
ugcccccuaauccccuucucc

SEQ ID NO: 1476519 - RNA, 23 nt, Human
ugcccccuaauccccuucucccc

SEQ ID NO: 1476520 - RNA, 20 nt, Human
ugcccaaauccuuagaucug

SEQ ID NO: 1476521 - RNA, 23 nt, Human
agccucagcucucaguugcagcc

SEQ ID NO: 1476522 - RNA, 23 nt, Human
agccucacuuuuaaugaacaaau

SEQ ID NO: 1476523 - RNA, 22 nt, Human
agccucacuuuuaaugaacaaa

SEQ ID NO: 1476524 - RNA, 15 nt, Human
agcccuuuugucucu

SEQ ID NO: 1476525 - RNA, 14 nt, Human
agcccuuuugucuc

SEQ ID NO: 1476526 - RNA, 15 nt, Human
agccucaauuucuga

SEQ ID NO: 1476527 - RNA, 22 nt, Human
agccucugcagcggaaucuguu

SEQ ID NO: 1476528 - RNA, 13 nt, Human
agccucugggggg

SEQ ID NO: 1476529 - RNA, 20 nt, Human
agccucugggggguggccag

SEQ ID NO: 1476530 - RNA, 21 nt, Human
agccucugggggguggccagg

SEQ ID NO: 1476531 - RNA, 22 nt, Human
agccucugggggguggccaggc

SEQ ID NO: 1476532 - RNA, 14 nt, Human
ugcagacucacugu

SEQ ID NO: 1476533 - RNA, 21 nt, Human
agcccuugugaaucaaggguc

SEQ ID NO: 1476534 - RNA, 23 nt, Human
agcccauucauuccauucuggaa

SEQ ID NO: 1476535 - RNA, 22 nt, Human
agcccauucauuccauucugga

SEQ ID NO: 1476536 - RNA, 17 nt, Human
agcccauucauuccauu

SEQ ID NO: 1476537 - RNA, 14 nt, Human
agcccauucauucc

SEQ ID NO: 1476538 - RNA, 21 nt, Human
agcccaggauacuggcacaga

SEQ ID NO: 1476539 - RNA, 23 nt, Human
agcccaggauacuggcacagagg

SEQ ID NO: 1476540 - RNA, 19 nt, Human
agcccaggauacuggcaca

SEQ ID NO: 1476541 - RNA, 15 nt, Human
ugauuuguacugaaa

SEQ ID NO: 1476542 - RNA, 18 nt, Human
ugauuuguacugaaaaau

SEQ ID NO: 1476543 - RNA, 22 nt, Human
ugcaaaccugaccccugcucag

SEQ ID NO: 1476544 - RNA, 23 nt, Human
ugcaaaccugaccccugcucagu

SEQ ID NO: 1476545 - RNA, 17 nt, Human
agcccugggaggcucug

SEQ ID NO: 1476546 - RNA, 19 nt, Human
agcccugcugcugccugcc

SEQ ID NO: 1476547 - RNA, 18 nt, Human
agcccugcugcugccugc

SEQ ID NO: 1476548 - RNA, 20 nt, Human
agcccugcugcugccugccu

SEQ ID NO: 1476549 - RNA, 16 nt, Human
agccccugaaagccau

SEQ ID NO: 1476550 - RNA, 14 nt, Human
agccccugaaagcc

SEQ ID NO: 1476551 - RNA, 16 nt, Human
agcccacuguacuugc

SEQ ID NO: 1476552 - RNA, 20 nt, Human
agccauggagauucucauaa

SEQ ID NO: 1476553 - RNA, 14 nt, Human
agcccacuguacuu

SEQ ID NO: 1476554 - RNA, 18 nt, Human
agccaugcuggaaaauaa

SEQ ID NO: 1476555 - RNA, 19 nt, Human
agccauggagauucucaua

SEQ ID NO: 1476556 - RNA, 22 nt, Human
agccauggagauucucauaacu

SEQ ID NO: 1476557 - RNA, 17 nt, Human
agccaucaagagacuga

SEQ ID NO: 1476558 - RNA, 14 nt, Human
agccaucaccuuag

SEQ ID NO: 1476559 - RNA, 18 nt, Human
agccaucaccuuagacca

SEQ ID NO: 1476560 - RNA, 11 nt, Human
ugauuucuagg

SEQ ID NO: 1476561 - RNA, 22 nt, Human
ugauuucaguagcacaaguuau

SEQ ID NO: 1476562 - RNA, 16 nt, Human
ugauuuacgcucauug

SEQ ID NO: 1476563 - RNA, 19 nt, Human
ugauucaugccaauuagca

SEQ ID NO: 1476564 - RNA, 17 nt, Human
ugauucauuuuaacauc

SEQ ID NO: 1476565 - RNA, 17 nt, Human
ugauggagaaggaaggc

SEQ ID NO: 1476566 - RNA, 14 nt, Human
ugaugggauuuggu

SEQ ID NO: 1476567 - RNA, 16 nt, Human
ugaugggauucuggac

SEQ ID NO: 1476568 - RNA, 17 nt, Human
ugaugggauucuggaca

SEQ ID NO: 1476569 - RNA, 16 nt, Human
ugauggagaaggaagg

SEQ ID NO: 1476570 - RNA, 15 nt, Human
ugauggagaaggaag

SEQ ID NO: 1476571 - RNA, 14 nt, Human
ugauggagaaggaa

SEQ ID NO: 1476572 - RNA, 13 nt, Human
ugauggagaagga

SEQ ID NO: 1476573 - RNA, 12 nt, Human
ugauggagaagg

SEQ ID NO: 1476574 - RNA, 11 nt, Human
ugaugaagaag

SEQ ID NO: 1476575 - RNA, 12 nt, Human
ugaugaagaagu

SEQ ID NO: 1476576 - RNA, 23 nt, Human
ugauuaaguaaugauaacuggaa

SEQ ID NO: 1476577 - RNA, 18 nt, Human
ugauuaaguaaugauaac

SEQ ID NO: 1476578 - RNA, 24 nt, Human
ugaugggauucuggacaggaugug

SEQ ID NO: 1476579 - RNA, 12 nt, Human
uggcugcaugcg

SEQ ID NO: 1476580 - RNA, 19 nt, Human
uggcugcaggaaucuuuaa

SEQ ID NO: 1476581 - RNA, 14 nt, Human
uggcugauaauuuu

SEQ ID NO: 1476582 - RNA, 19 nt, Human
uggcugauaauuuuaaauu

SEQ ID NO: 1476583 - RNA, 19 nt, Human
uggcugcauaaauguggua

SEQ ID NO: 1476584 - RNA, 22 nt, Human
aggcugggaauggaggggcaga

SEQ ID NO: 1476585 - RNA, 15 nt, Human
uggcuaguccuuguu

SEQ ID NO: 1476586 - RNA, 13 nt, Human
uggcuauguuuuu

SEQ ID NO: 1476587 - RNA, 17 nt, Human
uggcuauguuuuuaaug

SEQ ID NO: 1476588 - RNA, 18 nt, Human
uggcuauguuuuuaaugu

SEQ ID NO: 1476589 - RNA, 12 nt, Human
uggcuauuuuau

SEQ ID NO: 1476590 - RNA, 19 nt, Human
aggcucuggagcccacugu

SEQ ID NO: 1476591 - RNA, 18 nt, Human
aggcucuggagcccacug

SEQ ID NO: 1476592 - RNA, 15 nt, Human
aggcucuggagccca

SEQ ID NO: 1476593 - RNA, 14 nt, Human
aggcucuggagccc

SEQ ID NO: 1476594 - RNA, 13 nt, Human
aggcucuggagcc

SEQ ID NO: 1476595 - RNA, 21 nt, Human
aggcuggccuauguggucuaa

SEQ ID NO: 1476596 - RNA, 17 nt, Human
aggccugguguuucuug

SEQ ID NO: 1476597 - RNA, 18 nt, Human
uggacgagaaaacaauaa

SEQ ID NO: 1476598 - RNA, 15 nt, Human
aggcauuuuuaccau

SEQ ID NO: 1476599 - RNA, 18 nt, Human
aggccaagucaggcccuu

SEQ ID NO: 1476600 - RNA, 18 nt, Human
aggccagaccauggacac

SEQ ID NO: 1476601 - RNA, 17 nt, Human
aggccagaccauggaca

SEQ ID NO: 1476602 - RNA, 16 nt, Human
aggccagaccauggac

SEQ ID NO: 1476603 - RNA, 20 nt, Human
uggccagucuggucucgaac

SEQ ID NO: 1476604 - RNA, 20 nt, Human
uggccaggcuugucucgaac

SEQ ID NO: 1476605 - RNA, 22 nt, Human
uggccaaugcaccuaaagaaaa

SEQ ID NO: 1476606 - RNA, 17 nt, Human
aggccauucuuucccaa

SEQ ID NO: 1476607 - RNA, 18 nt, Human
aggccauucuuucccaac

SEQ ID NO: 1476608 - RNA, 19 nt, Human
aggccauucuuucccaaca

SEQ ID NO: 1476609 - RNA, 14 nt, Human
aggccuccuggcug

SEQ ID NO: 1476610 - RNA, 23 nt, Human
aggccuccuggcugucugaggcu

SEQ ID NO: 1476611 - RNA, 18 nt, Human
uggaauuggagcucgugg

SEQ ID NO: 1476612 - RNA, 17 nt, Human
uggaauugggagcuugg

SEQ ID NO: 1476613 - RNA, 17 nt, Human
aggcaaaauccuugcuu

SEQ ID NO: 1476614 - RNA, 19 nt, Human
aggcaaaauccuugcuuau

SEQ ID NO: 1476615 - RNA, 21 nt, Human
aggauuuuuuuuaauguuuaa

SEQ ID NO: 1476616 - RNA, 22 nt, Human
aggaugagggaaaagaaaaaga

SEQ ID NO: 1476617 - RNA, 14 nt, Human
uggaccuaauccaa

SEQ ID NO: 1476618 - RNA, 22 nt, Human
uggaccuaauccaagcaucccu

SEQ ID NO: 1476619 - RNA, 15 nt, Human
uggaccucaccaagc

SEQ ID NO: 1476620 - RNA, 16 nt, Human
uggaccagccucucca

SEQ ID NO: 1476621 - RNA, 22 nt, Human
uggaccagccucuccacucaug

SEQ ID NO: 1476622 - RNA, 14 nt, Human
aggaggcagagaag

SEQ ID NO: 1476623 - RNA, 18 nt, Human
uggaaauucccuucaucu

SEQ ID NO: 1476624 - RNA, 17 nt, Human
uggaaauugauuuugaa

SEQ ID NO: 1476625 - RNA, 22 nt, Human
uggaaauucccuucaucuggaa

SEQ ID NO: 1476626 - RNA, 17 nt, Human
uggaaauucccuucauc

SEQ ID NO: 1476627 - RNA, 15 nt, Human
aggaguuuugcaaag

SEQ ID NO: 1476628 - RNA, 13 nt, Human
aggacuugugucu

SEQ ID NO: 1476629 - RNA, 16 nt, Human
aggacuugugucucug

SEQ ID NO: 1476630 - RNA, 19 nt, Human
aggacugaauuaugaaacu

SEQ ID NO: 1476631 - RNA, 20 nt, Human
aggacugaauuaugaaacuu

SEQ ID NO: 1476632 - RNA, 18 nt, Human
aggagcccugggaggcuc

SEQ ID NO: 1476633 - RNA, 20 nt, Human
aggacuuuauagaucagcca

SEQ ID NO: 1476634 - RNA, 21 nt, Human
aggacuuuauagaucagccag

SEQ ID NO: 1476635 - RNA, 23 nt, Human
aggagcccugggaggcucuggag

SEQ ID NO: 1476636 - RNA, 19 nt, Human
aggagcccugggaggcucu

SEQ ID NO: 1476637 - RNA, 11 nt, Human
aggagccuggc

SEQ ID NO: 1476638 - RNA, 13 nt, Human
uggaaaggcagcu

SEQ ID NO: 1476639 - RNA, 14 nt, Human
uggaaauacacagu

SEQ ID NO: 1476640 - RNA, 15 nt, Human
uggaaauacacagug

SEQ ID NO: 1476641 - RNA, 14 nt, Human
ugcuuuucauccuu

SEQ ID NO: 1476642 - RNA, 24 nt, Human
ugcuuuuaguauuuuagugaacuu

SEQ ID NO: 1476643 - RNA, 12 nt, Human
ugcuuuguauug

SEQ ID NO: 1476644 - RNA, 20 nt, Human
aggaauuuuauuuuuuucug

SEQ ID NO: 1476645 - RNA, 18 nt, Human
ugcuguccgguggagauc

SEQ ID NO: 1476646 - RNA, 14 nt, Human
ugcuucaucccuuu

SEQ ID NO: 1476647 - RNA, 14 nt, Human
aggacacugauaug

SEQ ID NO: 1476648 - RNA, 22 nt, Human
aggacaucagcaaacaggauca

SEQ ID NO: 1476649 - RNA, 16 nt, Human
aggacaucagcaaaca

SEQ ID NO: 1476650 - RNA, 15 nt, Human
aggacaucagcaaac

SEQ ID NO: 1476651 - RNA, 14 nt, Human
aggacaucagcaaa

SEQ ID NO: 1476652 - RNA, 13 nt, Human
aggacaucagcaa

SEQ ID NO: 1476653 - RNA, 12 nt, Human
aggacaucagca

SEQ ID NO: 1476654 - RNA, 17 nt, Human
aggacacugauaugggu

SEQ ID NO: 1476655 - RNA, 20 nt, Human
aggacaggauccaggccggc

SEQ ID NO: 1476656 - RNA, 14 nt, Human
aggacaggauccag

SEQ ID NO: 1476657 - RNA, 21 nt, Human
ugcuuaugacaucacuuguac

SEQ ID NO: 1476658 - RNA, 21 nt, Human
ugcuuaugguaccagaugcag

SEQ ID NO: 1476659 - RNA, 14 nt, Human
ugcuuaugguacca

SEQ ID NO: 1476660 - RNA, 19 nt, Human
agcuggagugcaguggcau

SEQ ID NO: 1476661 - RNA, 15 nt, Human
agcuggagugcagug

SEQ ID NO: 1476662 - RNA, 13 nt, Human
ugcugacccuccc

SEQ ID NO: 1476663 - RNA, 17 nt, Human
ugcugacccuccccaaa

SEQ ID NO: 1476664 - RNA, 13 nt, Human
ugcuccccacguc

SEQ ID NO: 1476665 - RNA, 20 nt, Human
aggaaggaggacccaggaca

SEQ ID NO: 1476666 - RNA, 19 nt, Human
aggaaggaggacccaggac

SEQ ID NO: 1476667 - RNA, 18 nt, Human
aggaauuucaccuguaaa

SEQ ID NO: 1476668 - RNA, 23 nt, Human
aggaauuguguuuauaauuuuaa

SEQ ID NO: 1476669 - RNA, 22 nt, Human
aggaauuucaccuguaaaccug

SEQ ID NO: 1476670 - RNA, 21 nt, Human
aggaaggaggacccaggacag

SEQ ID NO: 1476671 - RNA, 18 nt, Human
aggaaggaggacccagga

SEQ ID NO: 1476672 - RNA, 11 nt, Human
aggaauuuaaa

SEQ ID NO: 1476673 - RNA, 22 nt, Human
aggaagcuuuggugagaaccug

SEQ ID NO: 1476674 - RNA, 23 nt, Human
aggaagcuuuggugagaaccugg

SEQ ID NO: 1476675 - RNA, 18 nt, Human
ugcugacuggcuucagca

SEQ ID NO: 1476676 - RNA, 21 nt, Human
ugagagacacacugaagaagc

SEQ ID NO: 1476677 - RNA, 22 nt, Human
ugagagacacacugaagaagca

SEQ ID NO: 1476678 - RNA, 19 nt, Human
ugagagacauuaacucauu

SEQ ID NO: 1476679 - RNA, 18 nt, Human
ugagagacauuaacucau

SEQ ID NO: 1476680 - RNA, 13 nt, Human
ugagagaggccau

SEQ ID NO: 1476681 - RNA, 22 nt, Human
ugagagaguggcuggggcaugg

SEQ ID NO: 1476682 - RNA, 15 nt, Human
ugagagaguggcugg

SEQ ID NO: 1476683 - RNA, 21 nt, Human
ugagagaugcagaaauauuug

SEQ ID NO: 1476684 - RNA, 20 nt, Human
ugagagcaucaggccuagag

SEQ ID NO: 1476685 - RNA, 21 nt, Human
ugagagcaucaggccuagagg

SEQ ID NO: 1476686 - RNA, 20 nt, Human
ugagagcccugaggccuaga

SEQ ID NO: 1476687 - RNA, 14 nt, Human
ugagauguguucac

SEQ ID NO: 1476688 - RNA, 23 nt, Human
ugagauguagccccucuccugga

SEQ ID NO: 1476689 - RNA, 17 nt, Human
ugagaugcuggcuuggg

SEQ ID NO: 1476690 - RNA, 12 nt, Human
ugagaugcuggc

SEQ ID NO: 1476691 - RNA, 15 nt, Human
ugagaugcuggcuug

SEQ ID NO: 1476692 - RNA, 18 nt, Human
ugagauggagucuugcuc

SEQ ID NO: 1476693 - RNA, 17 nt, Human
ugagauggagucuugcu

SEQ ID NO: 1476694 - RNA, 19 nt, Human
ugagacagaaucucagucu

SEQ ID NO: 1476695 - RNA, 13 nt, Human
ugagagaaaauaa

SEQ ID NO: 1476696 - RNA, 16 nt, Human
ugagagacacacugaa

SEQ ID NO: 1476697 - RNA, 17 nt, Human
ugagagacacacugaag

SEQ ID NO: 1476698 - RNA, 19 nt, Human
ugagagacacacugaagaa

SEQ ID NO: 1476699 - RNA, 20 nt, Human
ugagagacacacugaagaag

SEQ ID NO: 1476700 - RNA, 15 nt, Human
agauuuuccugaaaa

SEQ ID NO: 1476701 - RNA, 16 nt, Human
agauuuuccugaaaac

SEQ ID NO: 1476702 - RNA, 16 nt, Human
agauuuucugcuacuu

SEQ ID NO: 1476703 - RNA, 12 nt, Human
ugagaagcucug

SEQ ID NO: 1476704 - RNA, 18 nt, Human
ugagaaucuauauuuaac

SEQ ID NO: 1476705 - RNA, 23 nt, Human
ugagaaucuauauuuaacaagau

SEQ ID NO: 1476706 - RNA, 12 nt, Human
agcacaggcuaa

SEQ ID NO: 1476707 - RNA, 17 nt, Human
agcacaggcuaauuuuu

SEQ ID NO: 1476708 - RNA, 16 nt, Human
agcacaggcuaauuuu

SEQ ID NO: 1476709 - RNA, 15 nt, Human
agcaccuacuuacau

SEQ ID NO: 1476710 - RNA, 15 nt, Human
agcaagucagaauag

SEQ ID NO: 1476711 - RNA, 13 nt, Human
agcaaguaaaaag

SEQ ID NO: 1476712 - RNA, 18 nt, Human
agcaaguaaaaaggcuaa

SEQ ID NO: 1476713 - RNA, 17 nt, Human
agcaagcuuaauggcug

SEQ ID NO: 1476714 - RNA, 16 nt, Human
ugagcaaaucaccaca

SEQ ID NO: 1476715 - RNA, 15 nt, Human
agcaagcauucagaa

SEQ ID NO: 1476716 - RNA, 18 nt, Human
agcaagcauucagaagaa

SEQ ID NO: 1476717 - RNA, 21 nt, Human
agcaagcauucagaagaaaaa

SEQ ID NO: 1476718 - RNA, 22 nt, Human
agcaagcauucagaagaaaaag

SEQ ID NO: 1476719 - RNA, 21 nt, Human
agaugcaguucugaagaagau

SEQ ID NO: 1476720 - RNA, 18 nt, Human
agaugcauuuggguccag

SEQ ID NO: 1476721 - RNA, 19 nt, Human
agaugcauuuggguccagg

SEQ ID NO: 1476722 - RNA, 20 nt, Human
agaugcauuuggguccagga

SEQ ID NO: 1476723 - RNA, 21 nt, Human
agaugcauuuggguccaggag

SEQ ID NO: 1476724 - RNA, 23 nt, Human
agaugcauuuggguccaggagga

SEQ ID NO: 1476725 - RNA, 22 nt, Human
agaugcauuuggguccaggagg

SEQ ID NO: 1476726 - RNA, 22 nt, Human
agauguagccccucuccuggaa

SEQ ID NO: 1476727 - RNA, 15 nt, Human
agaucccccagaaaa

SEQ ID NO: 1476728 - RNA, 19 nt, Human
agaucccccagaaaagaaa

SEQ ID NO: 1476729 - RNA, 13 nt, Human
agaucccccagaa

SEQ ID NO: 1476730 - RNA, 22 nt, Human
ugaccaaccuuuucccaaccau

SEQ ID NO: 1476731 - RNA, 15 nt, Human
ugaccaagauacuua

SEQ ID NO: 1476732 - RNA, 13 nt, Human
agauccuggaaau

SEQ ID NO: 1476733 - RNA, 12 nt, Human
agauccuccuca

SEQ ID NO: 1476734 - RNA, 13 nt, Human
agauccuccucau

SEQ ID NO: 1476735 - RNA, 14 nt, Human
agauccuggaaauc

SEQ ID NO: 1476736 - RNA, 15 nt, Human
agauccuccucauuc

SEQ ID NO: 1476737 - RNA, 15 nt, Human
ugacagguaaacuau

SEQ ID NO: 1476738 - RNA, 21 nt, Human
ugacagggcggggguggcggc

SEQ ID NO: 1476739 - RNA, 19 nt, Human
ugacuuauaguacaugaua

SEQ ID NO: 1476740 - RNA, 17 nt, Human
ugacuuauaguacauga

SEQ ID NO: 1476741 - RNA, 15 nt, Human
ugacuuauaguacau

SEQ ID NO: 1476742 - RNA, 14 nt, Human
ugacuuauaguaca

SEQ ID NO: 1476743 - RNA, 13 nt, Human
ugacuuauaguac

SEQ ID NO: 1476744 - RNA, 13 nt, Human
agauucccagagc

SEQ ID NO: 1476745 - RNA, 16 nt, Human
agauucccagagcaaa

SEQ ID NO: 1476746 - RNA, 12 nt, Human
agauuguuugca

SEQ ID NO: 1476747 - RNA, 19 nt, Human
agauuugugugcaucaggc

SEQ ID NO: 1476748 - RNA, 16 nt, Human
ugaccugccucccuuc

SEQ ID NO: 1476749 - RNA, 22 nt, Human
agauguauguacuucaugcugu

SEQ ID NO: 1476750 - RNA, 21 nt, Human
ugaccugccucccuucaugca

SEQ ID NO: 1476751 - RNA, 23 nt, Human
ugaccugccucccuucaugcaug

SEQ ID NO: 1476752 - RNA, 19 nt, Human
ugaccugccucccuucaug

SEQ ID NO: 1476753 - RNA, 17 nt, Human
ugaccugccucccuuca

SEQ ID NO: 1476754 - RNA, 12 nt, Human
ugacuauguaaa

SEQ ID NO: 1476755 - RNA, 17 nt, Human
ugacuauucuugaugua

SEQ ID NO: 1476756 - RNA, 19 nt, Human
ugacuauucuugauguaaa

SEQ ID NO: 1476757 - RNA, 20 nt, Human
ugacuauucuugauguaaaa

SEQ ID NO: 1476758 - RNA, 22 nt, Human
ugacuauucuugauguaaaauc

SEQ ID NO: 1476759 - RNA, 13 nt, Human
ugacuauguaaac

SEQ ID NO: 1476760 - RNA, 21 nt, Human
ugacuauucuugauguaaaau

SEQ ID NO: 1476761 - RNA, 19 nt, Human
ugacuguuuuucggacagu

SEQ ID NO: 1476762 - RNA, 20 nt, Human
ugacuguuuuucggacaguu

SEQ ID NO: 1476763 - RNA, 17 nt, Human
ucuuuuuucaaaagaaa

SEQ ID NO: 1476764 - RNA, 16 nt, Human
ucuuuuuucaaaagaa

SEQ ID NO: 1476765 - RNA, 15 nt, Human
ucuuuuuuucuugaa

SEQ ID NO: 1476766 - RNA, 22 nt, Human
ucuuuuuucuaaaguaaaaaca

SEQ ID NO: 1476767 - RNA, 21 nt, Human
ucuuuuuucuaaaguaaaaac

SEQ ID NO: 1476768 - RNA, 16 nt, Human
agagacacacugaaga

SEQ ID NO: 1476769 - RNA, 16 nt, Human
ucuuuguaaugaaaac

SEQ ID NO: 1476770 - RNA, 15 nt, Human
agacuuuuaugauac

SEQ ID NO: 1476771 - RNA, 12 nt, Human
agacuuuuauga

SEQ ID NO: 1476772 - RNA, 17 nt, Human
agacucugucuaccugg

SEQ ID NO: 1476773 - RNA, 13 nt, Human
ucuuucccuccuu

SEQ ID NO: 1476774 - RNA, 12 nt, Human
ucuuucccuccu

SEQ ID NO: 1476775 - RNA, 16 nt, Human
ucuuucccuccuuggu

SEQ ID NO: 1476776 - RNA, 14 nt, Human
ucuuucccuccuug

SEQ ID NO: 1476777 - RNA, 17 nt, Human
ucuuucucacuaaaucu

SEQ ID NO: 1476778 - RNA, 18 nt, Human
ucuuucucacuaaaucuu

SEQ ID NO: 1476779 - RNA, 14 nt, Human
ugaaaauuaacaug

SEQ ID NO: 1476780 - RNA, 20 nt, Human
ugaaaaugugcuauacugca

SEQ ID NO: 1476781 - RNA, 21 nt, Human
ugaaaaugugcuauacugcau

SEQ ID NO: 1476782 - RNA, 22 nt, Human
ugaaaaugugcuauacugcaua

SEQ ID NO: 1476783 - RNA, 13 nt, Human
ugaaagaaaauaa

SEQ ID NO: 1476784 - RNA, 17 nt, Human
ugaaaaugugcuauacu

SEQ ID NO: 1476785 - RNA, 19 nt, Human
ugaaaaugugcuauacugc

SEQ ID NO: 1476786 - RNA, 23 nt, Human
ucuuuuuuuuuuuuuaauaaauu

SEQ ID NO: 1476787 - RNA, 22 nt, Human
ucuuuuuuuuuuuuuaauaaau

SEQ ID NO: 1476788 - RNA, 20 nt, Human
ugaaaauaaaaagaucacuu

SEQ ID NO: 1476789 - RNA, 21 nt, Human
ugaaaauaaaaagaucacuuu

SEQ ID NO: 1476790 - RNA, 13 nt, Human
ugaaaauaaagaa

SEQ ID NO: 1476791 - RNA, 14 nt, Human
ugaaaauaaagaau

SEQ ID NO: 1476792 - RNA, 15 nt, Human
ugaaaauaaagaaug

SEQ ID NO: 1476793 - RNA, 16 nt, Human
ugaaaauaaagaaugg

SEQ ID NO: 1476794 - RNA, 17 nt, Human
ugaaaauaaaguguaua

SEQ ID NO: 1476795 - RNA, 17 nt, Human
ugaaaauaaagaaugga

SEQ ID NO: 1476796 - RNA, 15 nt, Human
agagaguugaaccua

SEQ ID NO: 1476797 - RNA, 17 nt, Human
agagaguggcuggggca

SEQ ID NO: 1476798 - RNA, 13 nt, Human
agagauacagagg

SEQ ID NO: 1476799 - RNA, 16 nt, Human
agagaguggcuggggc

SEQ ID NO: 1476800 - RNA, 14 nt, Human
agagaguggcuggg

SEQ ID NO: 1476801 - RNA, 13 nt, Human
agagaguggcugg

SEQ ID NO: 1476802 - RNA, 21 nt, Human
agagaucccaaguagaaucuc

SEQ ID NO: 1476803 - RNA, 13 nt, Human
agagaugcagaaa

SEQ ID NO: 1476804 - RNA, 17 nt, Human
agagaugcagaaauauu

SEQ ID NO: 1476805 - RNA, 16 nt, Human
agagaugcagaaauau

SEQ ID NO: 1476806 - RNA, 12 nt, Human
agagacuuguuu

SEQ ID NO: 1476807 - RNA, 15 nt, Human
agagacuugggaaug

SEQ ID NO: 1476808 - RNA, 18 nt, Human
agagacuuguuuuggaug

SEQ ID NO: 1476809 - RNA, 16 nt, Human
agagacuuguuuugga

SEQ ID NO: 1476810 - RNA, 14 nt, Human
ugaaagagaaacac

SEQ ID NO: 1476811 - RNA, 12 nt, Human
ugaaauuucaga

SEQ ID NO: 1476812 - RNA, 15 nt, Human
ugaaauuuccuggga

SEQ ID NO: 1476813 - RNA, 22 nt, Human
ugaaauuucagauucccagagc

SEQ ID NO: 1476814 - RNA, 21 nt, Human
ugaaauuuccugggagcuuuu

SEQ ID NO: 1476815 - RNA, 23 nt, Human
ugaacaaaguuuaccagaaagca

SEQ ID NO: 1476816 - RNA, 15 nt, Human
ugaacaaauggccuu

SEQ ID NO: 1476817 - RNA, 13 nt, Human
ugaaauaaacguc

SEQ ID NO: 1476818 - RNA, 18 nt, Human
ugaaauaaacgucuuaaa

SEQ ID NO: 1476819 - RNA, 22 nt, Human
ugaaauaaacgucuuaaauauu

SEQ ID NO: 1476820 - RNA, 23 nt, Human
ugaaauaaacgucuuaaauauuc

SEQ ID NO: 1476821 - RNA, 21 nt, Human
ugaaauaccaaccugaagaca

SEQ ID NO: 1476822 - RNA, 23 nt, Human
ugaacuagaguuuagcuggaaaa

SEQ ID NO: 1476823 - RNA, 12 nt, Human
ugaaccaccgcg

SEQ ID NO: 1476824 - RNA, 17 nt, Human
ugaaccauuaaccagau

SEQ ID NO: 1476825 - RNA, 13 nt, Human
ugaagaacugagg

SEQ ID NO: 1476826 - RNA, 19 nt, Human
ugaagaacugaggaggaaa

SEQ ID NO: 1476827 - RNA, 13 nt, Human
ugaagacagaagu

SEQ ID NO: 1476828 - RNA, 16 nt, Human
ugaagaauacuucuca

SEQ ID NO: 1476829 - RNA, 19 nt, Human
ugaagaauacuucucauuu

SEQ ID NO: 1476830 - RNA, 21 nt, Human
ugaagaauacuucucauuuuu

SEQ ID NO: 1476831 - RNA, 20 nt, Human
ugaagaauacuucucauuuu

SEQ ID NO: 1476832 - RNA, 13 nt, Human
ugaagaauguuaa

SEQ ID NO: 1476833 - RNA, 22 nt, Human
agaguaauccaagcaaauguga

SEQ ID NO: 1476834 - RNA, 20 nt, Human
agaguaauccaagcaaaugu

SEQ ID NO: 1476835 - RNA, 18 nt, Human
agaguaauccaagcaaau

SEQ ID NO: 1476836 - RNA, 23 nt, Human
agaggccaggcaggagcccuucu

SEQ ID NO: 1476837 - RNA, 15 nt, Human
ugaauacauuuccaa

SEQ ID NO: 1476838 - RNA, 21 nt, Human
ugaauauuuguuauguagaua

SEQ ID NO: 1476839 - RNA, 18 nt, Human
ugaaucaagggucaggcc

SEQ ID NO: 1476840 - RNA, 20 nt, Human
ugaaucaagggucaggccuu

SEQ ID NO: 1476841 - RNA, 23 nt, Human
ugaauaauguaagacaaauaugu

SEQ ID NO: 1476842 - RNA, 20 nt, Human
ugaaguauuuugcuggaaua

SEQ ID NO: 1476843 - RNA, 23 nt, Human
ugaaguacccguucacauuuuug

SEQ ID NO: 1476844 - RNA, 18 nt, Human
ugaaguacccguucacau

SEQ ID NO: 1476845 - RNA, 17 nt, Human
ugaagauuuaccacuug

SEQ ID NO: 1476846 - RNA, 20 nt, Human
ugaagauuuaccacuugugu

SEQ ID NO: 1476847 - RNA, 15 nt, Human
ugaagggaagagaca

SEQ ID NO: 1476848 - RNA, 15 nt, Human
ugaagggcaggugcu

SEQ ID NO: 1476849 - RNA, 19 nt, Human
ugaagggcaggugcuucag

SEQ ID NO: 1476850 - RNA, 13 nt, Human
agaauguaaagcu

SEQ ID NO: 1476851 - RNA, 16 nt, Human
agaauguaaagcuugu

SEQ ID NO: 1476852 - RNA, 17 nt, Human
agaauguaaagcuuguc

SEQ ID NO: 1476853 - RNA, 12 nt, Human
agaauguaaagc

SEQ ID NO: 1476854 - RNA, 23 nt, Human
agaauguauauuaagguguggcu

SEQ ID NO: 1476855 - RNA, 14 nt, Human
agaauuaucuaauu

SEQ ID NO: 1476856 - RNA, 15 nt, Human
agaauuaucuaauuu

SEQ ID NO: 1476857 - RNA, 17 nt, Human
agaauuaucuaauuuau

SEQ ID NO: 1476858 - RNA, 15 nt, Human
agaauuauuuuguga

SEQ ID NO: 1476859 - RNA, 13 nt, Human
agaauuauuuugu

SEQ ID NO: 1476860 - RNA, 18 nt, Human
agaauuaucuaauuuaua

SEQ ID NO: 1476861 - RNA, 20 nt, Human
agaauuaucuaauuuauaaa

SEQ ID NO: 1476862 - RNA, 21 nt, Human
agaauuaucuaauuuauaaaa

SEQ ID NO: 1476863 - RNA, 17 nt, Human
agaauaaaauuuuuaau

SEQ ID NO: 1476864 - RNA, 14 nt, Human
agaauaaaauuuuu

SEQ ID NO: 1476865 - RNA, 12 nt, Human
agaauaaaauuu

SEQ ID NO: 1476866 - RNA, 12 nt, Human
agaauaugccuu

SEQ ID NO: 1476867 - RNA, 17 nt, Human
agaauauccaugaccua

SEQ ID NO: 1476868 - RNA, 19 nt, Human
agaauacuucucauuuuuu

SEQ ID NO: 1476869 - RNA, 15 nt, Human
agaauacuucucauu

SEQ ID NO: 1476870 - RNA, 19 nt, Human
agaaguucaauauaagcuu

SEQ ID NO: 1476871 - RNA, 19 nt, Human
agaaguuucaucauuuuuu

SEQ ID NO: 1476872 - RNA, 21 nt, Human
agaaguuucaucauuuuuuac

SEQ ID NO: 1476873 - RNA, 23 nt, Human
agaaguuucaucauuuuuuacuu

SEQ ID NO: 1476874 - RNA, 19 nt, Human
agaaggcaaaaauaguuug

SEQ ID NO: 1476875 - RNA, 16 nt, Human
agaaggcaaaaauagu

SEQ ID NO: 1476876 - RNA, 23 nt, Human
ucuguauuugaaucagccuacag

SEQ ID NO: 1476877 - RNA, 13 nt, Human
ucugucacuuaau

SEQ ID NO: 1476878 - RNA, 19 nt, Human
ucugugagauucauucaug

SEQ ID NO: 1476879 - RNA, 17 nt, Human
ucugugagauucauuca

SEQ ID NO: 1476880 - RNA, 21 nt, Human
ucugugagggugcugacuggc

SEQ ID NO: 1476881 - RNA, 22 nt, Human
agaauuugauaugugaacaguu

SEQ ID NO: 1476882 - RNA, 21 nt, Human
agaauuugauaugugaacagu

SEQ ID NO: 1476883 - RNA, 14 nt, Human
agaauugaguguuu

SEQ ID NO: 1476884 - RNA, 17 nt, Human
agaauugaguguuuaaa

SEQ ID NO: 1476885 - RNA, 12 nt, Human
agacacacauga

SEQ ID NO: 1476886 - RNA, 15 nt, Human
agacacacaugaagu

SEQ ID NO: 1476887 - RNA, 12 nt, Human
agacacagacug

SEQ ID NO: 1476888 - RNA, 16 nt, Human
agacacauacucauuu

SEQ ID NO: 1476889 - RNA, 19 nt, Human
agacaccguucauucaggc

SEQ ID NO: 1476890 - RNA, 18 nt, Human
agacacugaucuggcugc

SEQ ID NO: 1476891 - RNA, 20 nt, Human
agacacugccacacaggguc

SEQ ID NO: 1476892 - RNA, 12 nt, Human
agacacugguuu

SEQ ID NO: 1476893 - RNA, 12 nt, Human
agaagacaaaau

SEQ ID NO: 1476894 - RNA, 18 nt, Human
agaagaugguaccaccag

SEQ ID NO: 1476895 - RNA, 22 nt, Human
agaagaaucucaucucagugaa

SEQ ID NO: 1476896 - RNA, 19 nt, Human
agaagaaugcuuaaucaga

SEQ ID NO: 1476897 - RNA, 13 nt, Human
agaagaacugaaa

SEQ ID NO: 1476898 - RNA, 14 nt, Human
agaagaacugaaau

SEQ ID NO: 1476899 - RNA, 22 nt, Human
agaagaaguuucaucauuuuuu

SEQ ID NO: 1476900 - RNA, 19 nt, Human
agaagcauuuuguaaguug

SEQ ID NO: 1476901 - RNA, 22 nt, Human
ucugcucagacagaaccccuac

SEQ ID NO: 1476902 - RNA, 18 nt, Human
ucugcucagauagaauga

SEQ ID NO: 1476903 - RNA, 14 nt, Human
ucugcaggucccua

SEQ ID NO: 1476904 - RNA, 19 nt, Human
ucugcagggggugugucug

SEQ ID NO: 1476905 - RNA, 13 nt, Human
ucugcaggucccu

SEQ ID NO: 1476906 - RNA, 12 nt, Human
ucugcagguccc

SEQ ID NO: 1476907 - RNA, 11 nt, Human
ucugcaggucc

SEQ ID NO: 1476908 - RNA, 14 nt, Human
ucugacucugagcu

SEQ ID NO: 1476909 - RNA, 16 nt, Human
ucugagaagcucugaa

SEQ ID NO: 1476910 - RNA, 24 nt, Human
ucugagaagcucugaagaacucuc

SEQ ID NO: 1476911 - RNA, 16 nt, Human
ucugagucaacuccuu

SEQ ID NO: 1476912 - RNA, 15 nt, Human
ucugaauuauuuucu

SEQ ID NO: 1476913 - RNA, 10 nt, Human
ucugaauuau

SEQ ID NO: 1476914 - RNA, 22 nt, Human
agaaaugccaagcacuucuuuu

SEQ ID NO: 1476915 - RNA, 14 nt, Human
agaaaugccaagca

SEQ ID NO: 1476916 - RNA, 21 nt, Human
agaaaugccaagcacuucuuu

SEQ ID NO: 1476917 - RNA, 12 nt, Human
agaaaugcagaa

SEQ ID NO: 1476918 - RNA, 11 nt, Human
agaaaugccaa

SEQ ID NO: 1476919 - RNA, 17 nt, Human
ucugaagcucaacucuc

SEQ ID NO: 1476920 - RNA, 21 nt, Human
ucugaagcucaacucucuuau

SEQ ID NO: 1476921 - RNA, 18 nt, Human
ucuccuuguucugauaau

SEQ ID NO: 1476922 - RNA, 13 nt, Human
ucuccuuguucug

SEQ ID NO: 1476923 - RNA, 14 nt, Human
ucuccuuguucuga

SEQ ID NO: 1476924 - RNA, 16 nt, Human
ucuccuuguucugaua

SEQ ID NO: 1476925 - RNA, 13 nt, Human
agaaauaucuuca

SEQ ID NO: 1476926 - RNA, 20 nt, Human
agaaauaucuucacuuguca

SEQ ID NO: 1476927 - RNA, 20 nt, Human
agaaauauuugugacaaaaa

SEQ ID NO: 1476928 - RNA, 17 nt, Human
ucuaggaaauauuuauu

SEQ ID NO: 1476929 - RNA, 16 nt, Human
ucuaggaaauauuuau

SEQ ID NO: 1476930 - RNA, 15 nt, Human
ucuaguucugccagg

SEQ ID NO: 1476931 - RNA, 16 nt, Human
ucuaguucugccagga

SEQ ID NO: 1476932 - RNA, 17 nt, Human
ucuaguucugccaggag

SEQ ID NO: 1476933 - RNA, 19 nt, Human
ucuaguugaaaauaaagug

SEQ ID NO: 1476934 - RNA, 22 nt, Human
ucuaguuuaauuaaucuguaau

SEQ ID NO: 1476935 - RNA, 18 nt, Human
acuucauauaugaggacu

SEQ ID NO: 1476936 - RNA, 14 nt, Human
ucuagacacugcca

SEQ ID NO: 1476937 - RNA, 14 nt, Human
ucuagagcacugcc

SEQ ID NO: 1476938 - RNA, 15 nt, Human
ucuagagcacugcca

SEQ ID NO: 1476939 - RNA, 16 nt, Human
ucuagaggcuuccuuc

SEQ ID NO: 1476940 - RNA, 21 nt, Human
ucuagaggcuuccuucauuuc

SEQ ID NO: 1476941 - RNA, 16 nt, Human
ucuauacccacccaga

SEQ ID NO: 1476942 - RNA, 17 nt, Human
ucuauacccacccagaa

SEQ ID NO: 1476943 - RNA, 15 nt, Human
ucuauacccacccag

SEQ ID NO: 1476944 - RNA, 18 nt, Human
ucuauaccaauaaaguga

SEQ ID NO: 1476945 - RNA, 17 nt, Human
ucuauaccaauaaagug

SEQ ID NO: 1476946 - RNA, 16 nt, Human
ucuauaccaauaaagu

SEQ ID NO: 1476947 - RNA, 15 nt, Human
ucuauaccaauaaag

SEQ ID NO: 1476948 - RNA, 14 nt, Human
ucuauaccaauaaa

SEQ ID NO: 1476949 - RNA, 17 nt, Human
ucuaugugcuuguaaaa

SEQ ID NO: 1476950 - RNA, 12 nt, Human
ucuauucagcuu

SEQ ID NO: 1476951 - RNA, 12 nt, Human
ucuauugccucu

SEQ ID NO: 1476952 - RNA, 17 nt, Human
ucuauuuuguaaacuca

SEQ ID NO: 1476953 - RNA, 24 nt, Human
ucuauuuuguaacuuucucuauga

SEQ ID NO: 1476954 - RNA, 15 nt, Human
ucucaccauuuggau

SEQ ID NO: 1476955 - RNA, 16 nt, Human
ucucaccauuuggauc

SEQ ID NO: 1476956 - RNA, 18 nt, Human
ucucaccauuuggauccu

SEQ ID NO: 1476957 - RNA, 21 nt, Human
ucuauugccucugagagcauc

SEQ ID NO: 1476958 - RNA, 19 nt, Human
ucuauugccucugagagca

SEQ ID NO: 1476959 - RNA, 22 nt, Human
ucuauugccucugagagcauca

SEQ ID NO: 1476960 - RNA, 12 nt, Human
ucuauuuuaauu

SEQ ID NO: 1476961 - RNA, 13 nt, Human
acuuaaauuuuag

SEQ ID NO: 1476962 - RNA, 16 nt, Human
acuuaaauaguauuuc

SEQ ID NO: 1476963 - RNA, 14 nt, Human
acuuaauugcuaca

SEQ ID NO: 1476964 - RNA, 12 nt, Human
acuuacaugauu

SEQ ID NO: 1476965 - RNA, 14 nt, Human
acuuacaugauuca

SEQ ID NO: 1476966 - RNA, 21 nt, Human
acuuauuaacaauuaggcaga

SEQ ID NO: 1476967 - RNA, 12 nt, Human
acuuauuaacaa

SEQ ID NO: 1476968 - RNA, 16 nt, Human
acuuauuaucuucagg

SEQ ID NO: 1476969 - RNA, 18 nt, Human
acuucagguauaccucac

SEQ ID NO: 1476970 - RNA, 20 nt, Human
acuucagguauaccucacuu

SEQ ID NO: 1476971 - RNA, 22 nt, Human
acuuuuuauggcacuaguauuu

SEQ ID NO: 1476972 - RNA, 18 nt, Human
acuuuuuaaauguaaaga

SEQ ID NO: 1476973 - RNA, 13 nt, Human
acuuuggcugcau

SEQ ID NO: 1476974 - RNA, 21 nt, Human
ucucauuuuuccguaaaaaug

SEQ ID NO: 1476975 - RNA, 23 nt, Human
ucuccaccaucgucuucuuggcc

SEQ ID NO: 1476976 - RNA, 20 nt, Human
acuuuaauuaccaaccuguu

SEQ ID NO: 1476977 - RNA, 22 nt, Human
acuuuaauuaccaaccuguuac

SEQ ID NO: 1476978 - RNA, 20 nt, Human
acuuuacacaauagaauuau

SEQ ID NO: 1476979 - RNA, 18 nt, Human
acuuuacacaauagaauu

SEQ ID NO: 1476980 - RNA, 17 nt, Human
acuuugaaguuagcuuu

SEQ ID NO: 1476981 - RNA, 14 nt, Human
acuugcuuuuaaaa

SEQ ID NO: 1476982 - RNA, 19 nt, Human
acuugcuuaucaacuuccu

SEQ ID NO: 1476983 - RNA, 22 nt, Human
acuugcugcaguaugaaaauaa

SEQ ID NO: 1476984 - RNA, 19 nt, Human
acuuguauuauguguguuu

SEQ ID NO: 1476985 - RNA, 18 nt, Human
acuuguauuauguguguu

SEQ ID NO: 1476986 - RNA, 15 nt, Human
acuugucaauaaaau

SEQ ID NO: 1476987 - RNA, 21 nt, Human
acuugcuuaucaacuuccuaa

SEQ ID NO: 1476988 - RNA, 20 nt, Human
acuugcucuugaugccuggc

SEQ ID NO: 1476989 - RNA, 21 nt, Human
acuugcugcaguaugaaaaua

SEQ ID NO: 1476990 - RNA, 18 nt, Human
acuugcucuugaugccug

SEQ ID NO: 1476991 - RNA, 17 nt, Human
acuugcucuugaugccu

SEQ ID NO: 1476992 - RNA, 16 nt, Human
acuugcucuugaugcc

SEQ ID NO: 1476993 - RNA, 17 nt, Human
acuugcaaaaaggguca

SEQ ID NO: 1476994 - RNA, 23 nt, Human
acuugcaaaaagggucaguaugg

SEQ ID NO: 1476995 - RNA, 21 nt, Human
acuugcaaccgucuguuaugc

SEQ ID NO: 1476996 - RNA, 15 nt, Human
ucucauuuccaagca

SEQ ID NO: 1476997 - RNA, 17 nt, Human
ucucauuuuuccguaaa

SEQ ID NO: 1476998 - RNA, 20 nt, Human
ucucauuuuuuaaaaaagcu

SEQ ID NO: 1476999 - RNA, 17 nt, Human
ucucaggccagagccaa

SEQ ID NO: 1477000 - RNA, 23 nt, Human
uccuggaagugcuaauuuugaaa

SEQ ID NO: 1477001 - RNA, 22 nt, Human
uccuggaauaucuccgucaacu

SEQ ID NO: 1477002 - RNA, 14 nt, Human
uccuggaagccagc

SEQ ID NO: 1477003 - RNA, 18 nt, Human
uccuggaagccagcuuuc

SEQ ID NO: 1477004 - RNA, 20 nt, Human
uccuggaagccagcuuuccc

SEQ ID NO: 1477005 - RNA, 16 nt, Human
uccuggaaaucagggu

SEQ ID NO: 1477006 - RNA, 23 nt, Human
uccugcuugaugggauucuggac

SEQ ID NO: 1477007 - RNA, 15 nt, Human
uccugggagcuuuug

SEQ ID NO: 1477008 - RNA, 22 nt, Human
uccugcuugaugggauucugga

SEQ ID NO: 1477009 - RNA, 17 nt, Human
acugauauauuuuacaa

SEQ ID NO: 1477010 - RNA, 16 nt, Human
acugauauauuuuaca

SEQ ID NO: 1477011 - RNA, 18 nt, Human
uccugcaccggggccugg

SEQ ID NO: 1477012 - RNA, 19 nt, Human
uccugcaccggggccuggg

SEQ ID NO: 1477013 - RNA, 21 nt, Human
acugaacuuugcugagccugu

SEQ ID NO: 1477014 - RNA, 12 nt, Human
acugaagaagca

SEQ ID NO: 1477015 - RNA, 18 nt, Human
acugacuauucuugaugu

SEQ ID NO: 1477016 - RNA, 20 nt, Human
acugacuauucuugauguaa

SEQ ID NO: 1477017 - RNA, 13 nt, Human
acugacucuuaag

SEQ ID NO: 1477018 - RNA, 14 nt, Human
acugacucuuaaga

SEQ ID NO: 1477019 - RNA, 15 nt, Human
acugacucuuaagaa

SEQ ID NO: 1477020 - RNA, 16 nt, Human
acugacucuuaagaag

SEQ ID NO: 1477021 - RNA, 17 nt, Human
acugacucuuaagaaga

SEQ ID NO: 1477022 - RNA, 18 nt, Human
acugacucuuaagaagac

SEQ ID NO: 1477023 - RNA, 20 nt, Human
acugacucuuaagaagacug

SEQ ID NO: 1477024 - RNA, 22 nt, Human
acugacuauucuugauguaaaa

SEQ ID NO: 1477025 - RNA, 23 nt, Human
acugacuauucuugauguaaaau

SEQ ID NO: 1477026 - RNA, 24 nt, Human
acugacuauucuugauguaaaauc

SEQ ID NO: 1477027 - RNA, 21 nt, Human
acugagaaauuuauaaacuuu

SEQ ID NO: 1477028 - RNA, 17 nt, Human
acugagaaauuuauaaa

SEQ ID NO: 1477029 - RNA, 12 nt, Human
acugagaaauuu

SEQ ID NO: 1477030 - RNA, 16 nt, Human
acugagacaaugccuu

SEQ ID NO: 1477031 - RNA, 23 nt, Human
acugagaccaaggcuuucucuac

SEQ ID NO: 1477032 - RNA, 16 nt, Human
acugagaccaaggcuu

SEQ ID NO: 1477033 - RNA, 20 nt, Human
acugagagaugcagaaauau

SEQ ID NO: 1477034 - RNA, 19 nt, Human
acugaacuuugcugagccu

SEQ ID NO: 1477035 - RNA, 16 nt, Human
acugaacuuugcugag

SEQ ID NO: 1477036 - RNA, 20 nt, Human
acugaacaccauugaaggcu

SEQ ID NO: 1477037 - RNA, 21 nt, Human
acugaacaccauugaaggcuu

SEQ ID NO: 1477038 - RNA, 22 nt, Human
acugaacaccauugaaggcuua

SEQ ID NO: 1477039 - RNA, 15 nt, Human
acucuuguuuccuua

SEQ ID NO: 1477040 - RNA, 13 nt, Human
uccugacacuuua

SEQ ID NO: 1477041 - RNA, 14 nt, Human
acucuuuaugcuug

SEQ ID NO: 1477042 - RNA, 15 nt, Human
acucuuuaugcuugc

SEQ ID NO: 1477043 - RNA, 17 nt, Human
acucuuuaugcuugcaa

SEQ ID NO: 1477044 - RNA, 18 nt, Human
acucuuuaugcuugcaaa

SEQ ID NO: 1477045 - RNA, 21 nt, Human
uccugaaaagguuuaugaaaa

SEQ ID NO: 1477046 - RNA, 23 nt, Human
uccugaaaagguuuaugaaaaag

SEQ ID NO: 1477047 - RNA, 16 nt, Human
uccugaaagacaauau

SEQ ID NO: 1477048 - RNA, 15 nt, Human
uccugaaauuucaga

SEQ ID NO: 1477049 - RNA, 14 nt, Human
uccugaaauuucag

SEQ ID NO: 1477050 - RNA, 13 nt, Human
ucccuuuuuuuaa

SEQ ID NO: 1477051 - RNA, 21 nt, Human
ucccuuuuuuuaaguaaggaa

SEQ ID NO: 1477052 - RNA, 16 nt, Human
ucccuuuuuuuaagua

SEQ ID NO: 1477053 - RNA, 15 nt, Human
uccguaaaaaugauu

SEQ ID NO: 1477054 - RNA, 13 nt, Human
uccguaaaaauga

SEQ ID NO: 1477055 - RNA, 14 nt, Human
uccuaggaaaauac

SEQ ID NO: 1477056 - RNA, 21 nt, Human
acucacaccugaacugaacac

SEQ ID NO: 1477057 - RNA, 21 nt, Human
acucuuaagaagacugcauua

SEQ ID NO: 1477058 - RNA, 16 nt, Human
acucuuauaucuauau

SEQ ID NO: 1477059 - RNA, 17 nt, Human
acucuuauaucuauauu

SEQ ID NO: 1477060 - RNA, 18 nt, Human
acucuuauaucuauauuu

SEQ ID NO: 1477061 - RNA, 22 nt, Human
acucuuauaucuauauuuuaca

SEQ ID NO: 1477062 - RNA, 19 nt, Human
acucuuauaucuauauuuu

SEQ ID NO: 1477063 - RNA, 16 nt, Human
acucuuauaaauuucu

SEQ ID NO: 1477064 - RNA, 20 nt, Human
uccucccacuucagccuccc

SEQ ID NO: 1477065 - RNA, 15 nt, Human
uccucccucagugcc

SEQ ID NO: 1477066 - RNA, 21 nt, Human
acucugaguguuuuaugagaa

SEQ ID NO: 1477067 - RNA, 20 nt, Human
acucugaguguuuuaugaga

SEQ ID NO: 1477068 - RNA, 20 nt, Human
acucucuuauugccucacuu

SEQ ID NO: 1477069 - RNA, 14 nt, Human
acucugaguguuuu

SEQ ID NO: 1477070 - RNA, 22 nt, Human
acucucuggaagccccugggcc

SEQ ID NO: 1477071 - RNA, 20 nt, Human
uccagccugcugccugcuuu

SEQ ID NO: 1477072 - RNA, 14 nt, Human
uccagccucagcuc

SEQ ID NO: 1477073 - RNA, 13 nt, Human
uccaggagccugg

SEQ ID NO: 1477074 - RNA, 14 nt, Human
uccaggagccuggc

SEQ ID NO: 1477075 - RNA, 23 nt, Human
uccaggagccuggcuccguccag

SEQ ID NO: 1477076 - RNA, 15 nt, Human
uccaggagccugugc

SEQ ID NO: 1477077 - RNA, 18 nt, Human
uccaggagccugugccuc

SEQ ID NO: 1477078 - RNA, 23 nt, Human
accuuuuuucaacagugaagaca

SEQ ID NO: 1477079 - RNA, 18 nt, Human
accuuuuuucaacaguga

SEQ ID NO: 1477080 - RNA, 22 nt, Human
accuuuguuugcaucugaaaau

SEQ ID NO: 1477081 - RNA, 18 nt, Human
accuuugacaaagguaaa

SEQ ID NO: 1477082 - RNA, 17 nt, Human
accuuugacaaagguaa

SEQ ID NO: 1477083 - RNA, 20 nt, Human
accuuucuucaccaaaucuu

SEQ ID NO: 1477084 - RNA, 14 nt, Human
ucauuccuccaggu

SEQ ID NO: 1477085 - RNA, 13 nt, Human
ucauuccuccagg

SEQ ID NO: 1477086 - RNA, 12 nt, Human
ucauuccuccag

SEQ ID NO: 1477087 - RNA, 15 nt, Human
uccacucguguguuu

SEQ ID NO: 1477088 - RNA, 14 nt, Human
uccacucguguguu

SEQ ID NO: 1477089 - RNA, 19 nt, Human
accuuuuuauuugcaugug

SEQ ID NO: 1477090 - RNA, 20 nt, Human
accuuuuggucuggagggaa

SEQ ID NO: 1477091 - RNA, 18 nt, Human
uccacucguguguuucua

SEQ ID NO: 1477092 - RNA, 16 nt, Human
uccacucguguguuuc

SEQ ID NO: 1477093 - RNA, 23 nt, Human
uccagugggaggugagaccaccu

SEQ ID NO: 1477094 - RNA, 16 nt, Human
uccaguaggauccagu

SEQ ID NO: 1477095 - RNA, 20 nt, Human
uccagucaggccuaucuaaa

SEQ ID NO: 1477096 - RNA, 23 nt, Human
acgcgccucgccggaucugaggg

SEQ ID NO: 1477097 - RNA, 21 nt, Human
acggagucucacucugucacc

SEQ ID NO: 1477098 - RNA, 21 nt, Human
acguauuuaauagcaaagaau

SEQ ID NO: 1477099 - RNA, 16 nt, Human
acguauuuaauagcaa

SEQ ID NO: 1477100 - RNA, 21 nt, Human
acgucacuggaccacugggca

SEQ ID NO: 1477101 - RNA, 15 nt, Human
acuacacccagcaau

SEQ ID NO: 1477102 - RNA, 16 nt, Human
acuacacccagcaaua

SEQ ID NO: 1477103 - RNA, 14 nt, Human
acuacacccagcaa

SEQ ID NO: 1477104 - RNA, 13 nt, Human
acuacacccagca

SEQ ID NO: 1477105 - RNA, 12 nt, Human
ucccacuuguca

SEQ ID NO: 1477106 - RNA, 16 nt, Human
ucccagagcaaaauaa

SEQ ID NO: 1477107 - RNA, 15 nt, Human
acuaauuuuaaaaug

SEQ ID NO: 1477108 - RNA, 18 nt, Human
acuaacaaccaaagacua

SEQ ID NO: 1477109 - RNA, 15 nt, Human
acuaauuuuuauuuu

SEQ ID NO: 1477110 - RNA, 13 nt, Human
acuaaaucuuuua

SEQ ID NO: 1477111 - RNA, 15 nt, Human
acuaaaucuuuuaua

SEQ ID NO: 1477112 - RNA, 17 nt, Human
acucacaacagcugccu

SEQ ID NO: 1477113 - RNA, 18 nt, Human
acucaaggcggugcuuga

SEQ ID NO: 1477114 - RNA, 20 nt, Human
acuauggagugcaccaaaga

SEQ ID NO: 1477115 - RNA, 22 nt, Human
acuauggagugcaccaaagaga

SEQ ID NO: 1477116 - RNA, 23 nt, Human
acuauggagugcaccaaagagaa

SEQ ID NO: 1477117 - RNA, 21 nt, Human
acuauggauaaacuaaacacg

SEQ ID NO: 1477118 - RNA, 24 nt, Human
acuauggauaaacuaaacacguga

SEQ ID NO: 1477119 - RNA, 16 nt, Human
acuaucucauuuccaa

SEQ ID NO: 1477120 - RNA, 17 nt, Human
acuaucucauuuccaag

SEQ ID NO: 1477121 - RNA, 15 nt, Human
acuaucucauuucca

SEQ ID NO: 1477122 - RNA, 20 nt, Human
acuauaggcaugcgccacca

SEQ ID NO: 1477123 - RNA, 17 nt, Human
acuauauuguuugcuaa

SEQ ID NO: 1477124 - RNA, 22 nt, Human
acuauaggcaugcgccaccaug

SEQ ID NO: 1477125 - RNA, 21 nt, Human
acuauaguccagcuuuguucu

SEQ ID NO: 1477126 - RNA, 22 nt, Human
acuauauuguuugcuaagcauu

SEQ ID NO: 1477127 - RNA, 16 nt, Human
acuagagcaagcagga

SEQ ID NO: 1477128 - RNA, 16 nt, Human
ucccauuuaucgcaga

SEQ ID NO: 1477129 - RNA, 13 nt, Human
ucccauuucagcu

SEQ ID NO: 1477130 - RNA, 11 nt, Human
ucacacuggga

SEQ ID NO: 1477131 - RNA, 14 nt, Human
ucacaacagccuga

SEQ ID NO: 1477132 - RNA, 22 nt, Human
ucacaacagccugacaacauuu

SEQ ID NO: 1477133 - RNA, 16 nt, Human
ucaauucuugccaaau

SEQ ID NO: 1477134 - RNA, 20 nt, Human
accaaagcaccuuagcuggc

SEQ ID NO: 1477135 - RNA, 11 nt, Human
accaaagcaca

SEQ ID NO: 1477136 - RNA, 15 nt, Human
ucaauuucugaacac

SEQ ID NO: 1477137 - RNA, 16 nt, Human
accaccacgccuggcu

SEQ ID NO: 1477138 - RNA, 12 nt, Human
accaccaagccu

SEQ ID NO: 1477139 - RNA, 19 nt, Human
accaccaagccuugauugg

SEQ ID NO: 1477140 - RNA, 15 nt, Human
accaccaagccuuga

SEQ ID NO: 1477141 - RNA, 14 nt, Human
accaccaagccuug

SEQ ID NO: 1477142 - RNA, 24 nt, Human
accacauuggagauguuuaguaau

SEQ ID NO: 1477143 - RNA, 17 nt, Human
ucaccauguuagccagg

SEQ ID NO: 1477144 - RNA, 16 nt, Human
ucaccauuuggauccu

SEQ ID NO: 1477145 - RNA, 20 nt, Human
ucaccauuuggauccugugu

SEQ ID NO: 1477146 - RNA, 13 nt, Human
ucacccccagcuu

SEQ ID NO: 1477147 - RNA, 18 nt, Human
ucacccccagcuuugcua

SEQ ID NO: 1477148 - RNA, 21 nt, Human
ucaccauguuagccaggcugg

SEQ ID NO: 1477149 - RNA, 17 nt, Human
ucacguuuggugcuucu

SEQ ID NO: 1477150 - RNA, 21 nt, Human
ucacguuuggugcuucucaga

SEQ ID NO: 1477151 - RNA, 17 nt, Human
ucacuaaaucuuuuaua

SEQ ID NO: 1477152 - RNA, 12 nt, Human
ucacuaaaucuu

SEQ ID NO: 1477153 - RNA, 14 nt, Human
ucacuaauucauua

SEQ ID NO: 1477154 - RNA, 15 nt, Human
ucacuaauucauuaa

SEQ ID NO: 1477155 - RNA, 18 nt, Human
ucacuaauucauuaaucu

SEQ ID NO: 1477156 - RNA, 16 nt, Human
ucaccuguaaaccuga

SEQ ID NO: 1477157 - RNA, 17 nt, Human
ucaccuguaaaccugag

SEQ ID NO: 1477158 - RNA, 19 nt, Human
ucaccuguaaaccugaguc

SEQ ID NO: 1477159 - RNA, 12 nt, Human
ucaccucaugga

SEQ ID NO: 1477160 - RNA, 13 nt, Human
ucaccucauggaa

SEQ ID NO: 1477161 - RNA, 14 nt, Human
ucaccucauggaau

SEQ ID NO: 1477162 - RNA, 22 nt, Human
accaggacuagggcuggaguga

SEQ ID NO: 1477163 - RNA, 12 nt, Human
accaggacccug

SEQ ID NO: 1477164 - RNA, 14 nt, Human
accagucugacugu

SEQ ID NO: 1477165 - RNA, 20 nt, Human
accaguaggggcuuauaaua

SEQ ID NO: 1477166 - RNA, 20 nt, Human
ucacuguuuagaacacacac

SEQ ID NO: 1477167 - RNA, 17 nt, Human
ucacuguuuagaacaca

SEQ ID NO: 1477168 - RNA, 18 nt, Human
ucaaauugugugaaaggu

SEQ ID NO: 1477169 - RNA, 23 nt, Human
acauucugauucgaaugacacug

SEQ ID NO: 1477170 - RNA, 14 nt, Human
acauuccugaacag

SEQ ID NO: 1477171 - RNA, 15 nt, Human
acauuccugaacagg

SEQ ID NO: 1477172 - RNA, 22 nt, Human
acauuccucaugaauguaaauu

SEQ ID NO: 1477173 - RNA, 20 nt, Human
acauuccucaugaauguaaa

SEQ ID NO: 1477174 - RNA, 21 nt, Human
acauuccucaugaauguaaau

SEQ ID NO: 1477175 - RNA, 12 nt, Human
acaugucaaucu

SEQ ID NO: 1477176 - RNA, 15 nt, Human
acaugucaaucuguc

SEQ ID NO: 1477177 - RNA, 17 nt, Human
acauuccucaugaaugu

SEQ ID NO: 1477178 - RNA, 18 nt, Human
acauuccucaugaaugua

SEQ ID NO: 1477179 - RNA, 19 nt, Human
acauuccucaugaauguaa

SEQ ID NO: 1477180 - RNA, 16 nt, Human
ucaaccaucgcuuuau

SEQ ID NO: 1477181 - RNA, 16 nt, Human
ucaaccccagacacug

SEQ ID NO: 1477182 - RNA, 17 nt, Human
ucaaccccagacacugg

SEQ ID NO: 1477183 - RNA, 18 nt, Human
ucaaccccagacacuggu

SEQ ID NO: 1477184 - RNA, 15 nt, Human
ucaaccccuccccuc

SEQ ID NO: 1477185 - RNA, 14 nt, Human
ucaacugccuacuc

SEQ ID NO: 1477186 - RNA, 18 nt, Human
ucaacugccuacuccaaa

SEQ ID NO: 1477187 - RNA, 20 nt, Human
ucaacugccuacuccaaaau

SEQ ID NO: 1477188 - RNA, 12 nt, Human
ucaacaaacauu

SEQ ID NO: 1477189 - RNA, 15 nt, Human
acaugggacauuugc

SEQ ID NO: 1477190 - RNA, 20 nt, Human
acaugggacauuugcucaug

SEQ ID NO: 1477191 - RNA, 21 nt, Human
acaugggacauuugcucaugg

SEQ ID NO: 1477192 - RNA, 11 nt, Human
acaugggacau

SEQ ID NO: 1477193 - RNA, 14 nt, Human
acaugggacauuug

SEQ ID NO: 1477194 - RNA, 19 nt, Human
acaugcuucccuuuccuga

SEQ ID NO: 1477195 - RNA, 18 nt, Human
acaugcuucccuuuccug

SEQ ID NO: 1477196 - RNA, 16 nt, Human
acaugcuucccuuucc

SEQ ID NO: 1477197 - RNA, 13 nt, Human
acaugcuucccuu

SEQ ID NO: 1477198 - RNA, 17 nt, Human
acaugcuaagagaagua

SEQ ID NO: 1477199 - RNA, 18 nt, Human
acaugcuaagagaaguag

SEQ ID NO: 1477200 - RNA, 19 nt, Human
acaugcuaagagaaguaga

SEQ ID NO: 1477201 - RNA, 24 nt, Human
acaugcuaagagaaguagaaauca

SEQ ID NO: 1477202 - RNA, 20 nt, Human
acaugaauauuuaguguuca

SEQ ID NO: 1477203 - RNA, 15 nt, Human
ucaauauuucagaua

SEQ ID NO: 1477204 - RNA, 19 nt, Human
ucaauauuucagauaauca

SEQ ID NO: 1477205 - RNA, 17 nt, Human
ucaaucuguaaacugug

SEQ ID NO: 1477206 - RNA, 13 nt, Human
ucaaucuguaaac

SEQ ID NO: 1477207 - RNA, 14 nt, Human
ucaaucuguaaacu

SEQ ID NO: 1477208 - RNA, 16 nt, Human
ucaaucuguaaacugu

SEQ ID NO: 1477209 - RNA, 17 nt, Human
ucaauauucaauaaagc

SEQ ID NO: 1477210 - RNA, 16 nt, Human
ucaauauucaauaaag

SEQ ID NO: 1477211 - RNA, 15 nt, Human
ucaauauucaauaaa

SEQ ID NO: 1477212 - RNA, 19 nt, Human
ucaagucuguuuacugcaa

SEQ ID NO: 1477213 - RNA, 18 nt, Human
ucaauauaagcuuuucuu

SEQ ID NO: 1477214 - RNA, 19 nt, Human
ucaaguccugccucuuaaa

SEQ ID NO: 1477215 - RNA, 20 nt, Human
ucaaguccugccucuuaaau

SEQ ID NO: 1477216 - RNA, 21 nt, Human
ucaacuuuuccuuugaauccu

SEQ ID NO: 1477217 - RNA, 15 nt, Human
ucaacuuuuccuuug

SEQ ID NO: 1477218 - RNA, 14 nt, Human
ucaacuugcuuauc

SEQ ID NO: 1477219 - RNA, 19 nt, Human
ucaacuuauuaacaauuag

SEQ ID NO: 1477220 - RNA, 12 nt, Human
acauuuuccuuu

SEQ ID NO: 1477221 - RNA, 19 nt, Human
acauuuuccuuuucaaaua

SEQ ID NO: 1477222 - RNA, 18 nt, Human
acauuuucuaagaaacau

SEQ ID NO: 1477223 - RNA, 19 nt, Human
acauuuucuaagaaacauu

SEQ ID NO: 1477224 - RNA, 11 nt, Human
acauuuucucc

SEQ ID NO: 1477225 - RNA, 17 nt, Human
acauuuucucccuggau

SEQ ID NO: 1477226 - RNA, 11 nt, Human
acauugugcca

SEQ ID NO: 1477227 - RNA, 13 nt, Human
accaaaagaagua

SEQ ID NO: 1477228 - RNA, 21 nt, Human
accaaaagaaguaaaagcaaa

SEQ ID NO: 1477229 - RNA, 14 nt, Human
accaaaagaaguaa

SEQ ID NO: 1477230 - RNA, 14 nt, Human
accaaaaguuacau

SEQ ID NO: 1477231 - RNA, 21 nt, Human
accaaaaguuacauguuugca

SEQ ID NO: 1477232 - RNA, 23 nt, Human
accaaaaguuacauguuugcacc

SEQ ID NO: 1477233 - RNA, 15 nt, Human
accaaagaagaaagu

SEQ ID NO: 1477234 - RNA, 16 nt, Human
ucagauuucugaggaa

SEQ ID NO: 1477235 - RNA, 23 nt, Human
accaguguguggcuuucagagcc

SEQ ID NO: 1477236 - RNA, 17 nt, Human
accccauccaguucaug

SEQ ID NO: 1477237 - RNA, 23 nt, Human
acccucguggacaccugcccugc

SEQ ID NO: 1477238 - RNA, 22 nt, Human
acccucguggacaccugcccug

SEQ ID NO: 1477239 - RNA, 20 nt, Human
acccucguggacaccugccc

SEQ ID NO: 1477240 - RNA, 19 nt, Human
acccucguggacaccugcc

SEQ ID NO: 1477241 - RNA, 18 nt, Human
acccucguggacaccugc

SEQ ID NO: 1477242 - RNA, 17 nt, Human
acccucguggacaccug

SEQ ID NO: 1477243 - RNA, 15 nt, Human
acccucguggacacc

SEQ ID NO: 1477244 - RNA, 17 nt, Human
acccuuucuucagcucu

SEQ ID NO: 1477245 - RNA, 19 nt, Human
accuauuuccagaaauaca

SEQ ID NO: 1477246 - RNA, 23 nt, Human
accuauuucuuaaacacuugcaa

SEQ ID NO: 1477247 - RNA, 18 nt, Human
accuauuucuuaaacacu

SEQ ID NO: 1477248 - RNA, 17 nt, Human
accuauuuccagaaaua

SEQ ID NO: 1477249 - RNA, 16 nt, Human
accuauuuccagaaau

SEQ ID NO: 1477250 - RNA, 22 nt, Human
accuaugucauuucauuuccua

SEQ ID NO: 1477251 - RNA, 16 nt, Human
accuagggugauauua

SEQ ID NO: 1477252 - RNA, 15 nt, Human
accgcagaaggaagg

SEQ ID NO: 1477253 - RNA, 15 nt, Human
accuaccuguugagc

SEQ ID NO: 1477254 - RNA, 17 nt, Human
accuaccuguugagcau

SEQ ID NO: 1477255 - RNA, 24 nt, Human
accuaccuguugagcaucacagaa

SEQ ID NO: 1477256 - RNA, 12 nt, Human
accuaggcuagg

SEQ ID NO: 1477257 - RNA, 17 nt, Human
accuaggcuaggguggg

SEQ ID NO: 1477258 - RNA, 19 nt, Human
accuacugcccaggcacug

SEQ ID NO: 1477259 - RNA, 23 nt, Human
accuacugcccaggcacugcaaa

SEQ ID NO: 1477260 - RNA, 20 nt, Human
accuacuuugacuuuuugca

SEQ ID NO: 1477261 - RNA, 21 nt, Human
accuacuuugacuuuuugcau

SEQ ID NO: 1477262 - RNA, 17 nt, Human
accucccucaaccucau

SEQ ID NO: 1477263 - RNA, 17 nt, Human
accucccuauacugcuu

SEQ ID NO: 1477264 - RNA, 15 nt, Human
accuccaccuccugg

SEQ ID NO: 1477265 - RNA, 17 nt, Human
accuccaccuccugggu

SEQ ID NO: 1477266 - RNA, 23 nt, Human
ucaugcaaacuuuauuuuguguu

SEQ ID NO: 1477267 - RNA, 16 nt, Human
ucaugugaaaucauuc

SEQ ID NO: 1477268 - RNA, 17 nt, Human
ucaugugaaaucauuca

SEQ ID NO: 1477269 - RNA, 14 nt, Human
ucaugcauggaaau

SEQ ID NO: 1477270 - RNA, 14 nt, Human
ucaugugacucuuu

SEQ ID NO: 1477271 - RNA, 17 nt, Human
ucaugugacucuuucca

SEQ ID NO: 1477272 - RNA, 15 nt, Human
ucauguguauaaaaa

SEQ ID NO: 1477273 - RNA, 18 nt, Human
ucaugugacucuuuccaa

SEQ ID NO: 1477274 - RNA, 19 nt, Human
ucaugugacucuuuccaac

SEQ ID NO: 1477275 - RNA, 10 nt, Human
ucauguguau

SEQ ID NO: 1477276 - RNA, 14 nt, Human
ucauguguauaaaa

SEQ ID NO: 1477277 - RNA, 20 nt, Human
ucauguguacaaaaguuuca

SEQ ID NO: 1477278 - RNA, 14 nt, Human
ucaugcaaacuuua

SEQ ID NO: 1477279 - RNA, 21 nt, Human
ucaugauuuugaaaucaugaa

SEQ ID NO: 1477280 - RNA, 14 nt, Human
ucaugauuuugaaa

SEQ ID NO: 1477281 - RNA, 19 nt, Human
ucaugaagauauuuuucca

SEQ ID NO: 1477282 - RNA, 16 nt, Human
ucaugaaagauucaau

SEQ ID NO: 1477283 - RNA, 17 nt, Human
ucaugaaagauucaaug

SEQ ID NO: 1477284 - RNA, 11 nt, Human
ucaugaaccuc

SEQ ID NO: 1477285 - RNA, 22 nt, Human
ucaugaaccucaagcugcaucu

SEQ ID NO: 1477286 - RNA, 13 nt, Human
ucaucuaggauuu

SEQ ID NO: 1477287 - RNA, 14 nt, Human
ucauccauucuauu

SEQ ID NO: 1477288 - RNA, 19 nt, Human
ucauccauucuauuguuaa

SEQ ID NO: 1477289 - RNA, 15 nt, Human
ucaguuuuugugaaa

SEQ ID NO: 1477290 - RNA, 17 nt, Human
ucaguuuuugugaaaag

SEQ ID NO: 1477291 - RNA, 14 nt, Human
accgcagaaggaag

SEQ ID NO: 1477292 - RNA, 13 nt, Human
accgcagaaggaa

SEQ ID NO: 1477293 - RNA, 12 nt, Human
accgcagaagga

SEQ ID NO: 1477294 - RNA, 15 nt, Human
ucauauuuucaugcu

SEQ ID NO: 1477295 - RNA, 13 nt, Human
accgaggcaggga

SEQ ID NO: 1477296 - RNA, 15 nt, Human
ucauauuuucuuuca

SEQ ID NO: 1477297 - RNA, 21 nt, Human
ucauauugugauucugccuuu

SEQ ID NO: 1477298 - RNA, 14 nt, Human
ucauauauauacau

SEQ ID NO: 1477299 - RNA, 18 nt, Human
ucauauaaaguaucauca

SEQ ID NO: 1477300 - RNA, 13 nt, Human
ucauauaaaguau

SEQ ID NO: 1477301 - RNA, 16 nt, Human
ucauauaaaguaucau

SEQ ID NO: 1477302 - RNA, 20 nt, Human
uaacgauaaaagacagugaa

SEQ ID NO: 1477303 - RNA, 16 nt, Human
uaaccuuaauuuauua

SEQ ID NO: 1477304 - RNA, 21 nt, Human
uaaccuuaccagauuuuuaca

SEQ ID NO: 1477305 - RNA, 14 nt, Human
uaacuuaaauagua

SEQ ID NO: 1477306 - RNA, 16 nt, Human
uaacuuaaauaguauu

SEQ ID NO: 1477307 - RNA, 17 nt, Human
uaacuuaaauaguauuu

SEQ ID NO: 1477308 - RNA, 15 nt, Human
uaacuuucucuauga

SEQ ID NO: 1477309 - RNA, 18 nt, Human
aauauauuuuaagacgaa

SEQ ID NO: 1477310 - RNA, 22 nt, Human
aauaucacuugucaauaaaauc

SEQ ID NO: 1477311 - RNA, 13 nt, Human
uaacaucugagaa

SEQ ID NO: 1477312 - RNA, 14 nt, Human
uaacaugaauauuu

SEQ ID NO: 1477313 - RNA, 16 nt, Human
aauagucaaauugugu

SEQ ID NO: 1477314 - RNA, 14 nt, Human
uaaaauuuauauug

SEQ ID NO: 1477315 - RNA, 17 nt, Human
uaaaauuuauauuguaa

SEQ ID NO: 1477316 - RNA, 16 nt, Human
uaaaauuuauauugua

SEQ ID NO: 1477317 - RNA, 19 nt, Human
aauagucaaauugugugaa

SEQ ID NO: 1477318 - RNA, 15 nt, Human
aauauauuuuaagac

SEQ ID NO: 1477319 - RNA, 14 nt, Human
aauauauuuuaaga

SEQ ID NO: 1477320 - RNA, 12 nt, Human
aauauuuagugu

SEQ ID NO: 1477321 - RNA, 18 nt, Human
aauauuuauuuuaauaau

SEQ ID NO: 1477322 - RNA, 19 nt, Human
aauauuuauuuuaauaaug

SEQ ID NO: 1477323 - RNA, 14 nt, Human
aauauuucagauaa

SEQ ID NO: 1477324 - RNA, 9 nt, Human
aauauugug

SEQ ID NO: 1477325 - RNA, 21 nt, Human
aauaugccccauucaacaucu

SEQ ID NO: 1477326 - RNA, 24 nt, Human
aauaugccccauucaacaucuagu

SEQ ID NO: 1477327 - RNA, 21 nt, Human
aauaugccugcuauuugaagu

SEQ ID NO: 1477328 - RNA, 12 nt, Human
uaagagaaguag

SEQ ID NO: 1477329 - RNA, 14 nt, Human
uaagagaaguagaa

SEQ ID NO: 1477330 - RNA, 18 nt, Human
uaagagaaguagaaauca

SEQ ID NO: 1477331 - RNA, 20 nt, Human
uaagagaaguagaaaucaua

SEQ ID NO: 1477332 - RNA, 14 nt, Human
uaagacuugacagu

SEQ ID NO: 1477333 - RNA, 17 nt, Human
uaagacuugacagugga

SEQ ID NO: 1477334 - RNA, 22 nt, Human
aaucaggguuaguauuguccag

SEQ ID NO: 1477335 - RNA, 18 nt, Human
aauauuuuuucuuuucua

SEQ ID NO: 1477336 - RNA, 16 nt, Human
aaucaggguuaguauu

SEQ ID NO: 1477337 - RNA, 21 nt, Human
aaucaggguuaguauugucca

SEQ ID NO: 1477338 - RNA, 17 nt, Human
aauauuuuuaauauaua

SEQ ID NO: 1477339 - RNA, 13 nt, Human
aauauuuuucuua

SEQ ID NO: 1477340 - RNA, 12 nt, Human
aauauuuguaca

SEQ ID NO: 1477341 - RNA, 14 nt, Human
aauauuuguacaua

SEQ ID NO: 1477342 - RNA, 17 nt, Human
aauauuugugacaaaaa

SEQ ID NO: 1477343 - RNA, 11 nt, Human
aauauuuuaaa

SEQ ID NO: 1477344 - RNA, 13 nt, Human
aauauuuuaaaga

SEQ ID NO: 1477345 - RNA, 15 nt, Human
aauauuuuaaagaau

SEQ ID NO: 1477346 - RNA, 20 nt, Human
aauauuuugcuaguuuuuga

SEQ ID NO: 1477347 - RNA, 16 nt, Human
uaagcuggagugcagu

SEQ ID NO: 1477348 - RNA, 14 nt, Human
uaagcugaaaauau

SEQ ID NO: 1477349 - RNA, 14 nt, Human
uaagcaagaaggca

SEQ ID NO: 1477350 - RNA, 23 nt, Human
uaagcaaaaacaaaaagaaaaga

SEQ ID NO: 1477351 - RNA, 15 nt, Human
uaagauuuccuucuu

SEQ ID NO: 1477352 - RNA, 16 nt, Human
uaagauuuccuucuuu

SEQ ID NO: 1477353 - RNA, 16 nt, Human
aaucuuuaauuuuaca

SEQ ID NO: 1477354 - RNA, 15 nt, Human
aaucuuuaauuuuac

SEQ ID NO: 1477355 - RNA, 19 nt, Human
uaauguguauuacaaauau

SEQ ID NO: 1477356 - RNA, 13 nt, Human
uaauguuaauauu

SEQ ID NO: 1477357 - RNA, 17 nt, Human
uaauguuaauauugauu

SEQ ID NO: 1477358 - RNA, 16 nt, Human
uaauguuaauauugau

SEQ ID NO: 1477359 - RNA, 21 nt, Human
aaucuuuaaaagaugcuuuua

SEQ ID NO: 1477360 - RNA, 17 nt, Human
aaugaauuaaauaaacc

SEQ ID NO: 1477361 - RNA, 23 nt, Human
aaugaaacaaagaguucaagaaa

SEQ ID NO: 1477362 - RNA, 16 nt, Human
aaugaaacaaagaguu

SEQ ID NO: 1477363 - RNA, 12 nt, Human
uaauccaguaaa

SEQ ID NO: 1477364 - RNA, 21 nt, Human
uaaucccagcaugcugagauu

SEQ ID NO: 1477365 - RNA, 18 nt, Human
uaaucacgcuuuccugaa

SEQ ID NO: 1477366 - RNA, 13 nt, Human
uaaugaaacaaag

SEQ ID NO: 1477367 - RNA, 16 nt, Human
uaaugaaacaaagagu

SEQ ID NO: 1477368 - RNA, 14 nt, Human
uaauagauguuuga

SEQ ID NO: 1477369 - RNA, 16 nt, Human
uaauagauguuugaua

SEQ ID NO: 1477370 - RNA, 21 nt, Human
uaauagauguuugauagauuu

SEQ ID NO: 1477371 - RNA, 22 nt, Human
uaauagauguuugauagauuuu

SEQ ID NO: 1477372 - RNA, 15 nt, Human
uaauagcaaagaauu

SEQ ID NO: 1477373 - RNA, 13 nt, Human
uaauagcaaagaa

SEQ ID NO: 1477374 - RNA, 18 nt, Human
uaauaaacacucuugaaa

SEQ ID NO: 1477375 - RNA, 12 nt, Human
uaauaaacacuc

SEQ ID NO: 1477376 - RNA, 15 nt, Human
uaauaaaauucaaca

SEQ ID NO: 1477377 - RNA, 13 nt, Human
uaauaaacauucu

SEQ ID NO: 1477378 - RNA, 12 nt, Human
aaucaugaauua

SEQ ID NO: 1477379 - RNA, 15 nt, Human
aaucaugaauuaguu

SEQ ID NO: 1477380 - RNA, 20 nt, Human
aaucaugaagauauuuuucc

SEQ ID NO: 1477381 - RNA, 20 nt, Human
aaucauagcugguucacacu

SEQ ID NO: 1477382 - RNA, 15 nt, Human
uaagcuuaugcuuaa

SEQ ID NO: 1477383 - RNA, 16 nt, Human
uaagcuuguauuccuu

SEQ ID NO: 1477384 - RNA, 20 nt, Human
uaagcuuuucuuuucuuugu

SEQ ID NO: 1477385 - RNA, 16 nt, Human
uaagcuuuucuuuucu

SEQ ID NO: 1477386 - RNA, 19 nt, Human
uaaguaaugauaacuggaa

SEQ ID NO: 1477387 - RNA, 17 nt, Human
uaaguauuaugucucuu

SEQ ID NO: 1477388 - RNA, 21 nt, Human
uaaguauuaugucucuucuga

SEQ ID NO: 1477389 - RNA, 21 nt, Human
aaucuggcuucuggccaggaa

SEQ ID NO: 1477390 - RNA, 23 nt, Human
aaucuggcuucuggccaggaagc

SEQ ID NO: 1477391 - RNA, 19 nt, Human
aaucuuauaauuuaaaaua

SEQ ID NO: 1477392 - RNA, 15 nt, Human
aaucuguuuuucuaa

SEQ ID NO: 1477393 - RNA, 16 nt, Human
aaucuguuuuucuaac

SEQ ID NO: 1477394 - RNA, 19 nt, Human
aaucuuaagguguagccac

SEQ ID NO: 1477395 - RNA, 20 nt, Human
aaucuuaagguguagccaca

SEQ ID NO: 1477396 - RNA, 12 nt, Human
aauccgcccauc

SEQ ID NO: 1477397 - RNA, 21 nt, Human
aaucccuuaauauccuaaaca

SEQ ID NO: 1477398 - RNA, 19 nt, Human
aauccugucgauuagacug

SEQ ID NO: 1477399 - RNA, 21 nt, Human
aauccugucgauuagacugga

SEQ ID NO: 1477400 - RNA, 20 nt, Human
aauccugucgauuagacugg

SEQ ID NO: 1477401 - RNA, 19 nt, Human
aauguauacuauaguacca

SEQ ID NO: 1477402 - RNA, 13 nt, Human
aauguauaguaaa

SEQ ID NO: 1477403 - RNA, 22 nt, Human
aauguauuacaguggggaauga

SEQ ID NO: 1477404 - RNA, 18 nt, Human
aaugugcuauacugcaua

SEQ ID NO: 1477405 - RNA, 20 nt, Human
aaugugauuuacgcucauug

SEQ ID NO: 1477406 - RNA, 20 nt, Human
uacaucccuuaccugggaaa

SEQ ID NO: 1477407 - RNA, 12 nt, Human
uacaucauuucu

SEQ ID NO: 1477408 - RNA, 13 nt, Human
uacaucauuucuu

SEQ ID NO: 1477409 - RNA, 14 nt, Human
uacaucauuucuuu

SEQ ID NO: 1477410 - RNA, 20 nt, Human
uacaucauuucuuuuuggga

SEQ ID NO: 1477411 - RNA, 15 nt, Human
uacauaauucacucu

SEQ ID NO: 1477412 - RNA, 17 nt, Human
uacauaauucacucuga

SEQ ID NO: 1477413 - RNA, 16 nt, Human
uacauaauucacucug

SEQ ID NO: 1477414 - RNA, 17 nt, Human
aauuaauuccuucagca

SEQ ID NO: 1477415 - RNA, 21 nt, Human
aauuaagaaaggauaaaguug

SEQ ID NO: 1477416 - RNA, 22 nt, Human
aauuaacuggguaaugaaacaa

SEQ ID NO: 1477417 - RNA, 15 nt, Human
aauuaagagagucua

SEQ ID NO: 1477418 - RNA, 15 nt, Human
aauguugaaauauga

SEQ ID NO: 1477419 - RNA, 22 nt, Human
aauguugaaauaugauguuaaa

SEQ ID NO: 1477420 - RNA, 18 nt, Human
aauuaacuggguaaugaa

SEQ ID NO: 1477421 - RNA, 21 nt, Human
aauuaacuggguaaugaaaca

SEQ ID NO: 1477422 - RNA, 19 nt, Human
aauguuaagacuugacagu

SEQ ID NO: 1477423 - RNA, 14 nt, Human
uacacuaagagaga

SEQ ID NO: 1477424 - RNA, 18 nt, Human
uacacuaagagagaauga

SEQ ID NO: 1477425 - RNA, 15 nt, Human
aauguaacuuuugua

SEQ ID NO: 1477426 - RNA, 16 nt, Human
aauguaacuuuuguaa

SEQ ID NO: 1477427 - RNA, 22 nt, Human
aauguaacuuuuguaagacaaa

SEQ ID NO: 1477428 - RNA, 23 nt, Human
aauggcaugagaaauacaaaaau

SEQ ID NO: 1477429 - RNA, 12 nt, Human
aauguaaauuug

SEQ ID NO: 1477430 - RNA, 13 nt, Human
aauguaaauuugu

SEQ ID NO: 1477431 - RNA, 14 nt, Human
aauguaaauuugua

SEQ ID NO: 1477432 - RNA, 15 nt, Human
aauguaaauuuguac

SEQ ID NO: 1477433 - RNA, 16 nt, Human
aauguaaauuuguacu

SEQ ID NO: 1477434 - RNA, 18 nt, Human
aauguaaauuuguacuau

SEQ ID NO: 1477435 - RNA, 17 nt, Human
aauguaaauuuguacua

SEQ ID NO: 1477436 - RNA, 22 nt, Human
aauguaaauauuuuaaagaauu

SEQ ID NO: 1477437 - RNA, 20 nt, Human
aauggcuauguuuuuaaugu

SEQ ID NO: 1477438 - RNA, 16 nt, Human
aauggcuauguuuuua

SEQ ID NO: 1477439 - RNA, 20 nt, Human
aauggcaugagaaauacaaa

SEQ ID NO: 1477440 - RNA, 17 nt, Human
aauggccauuugcuuuu

SEQ ID NO: 1477441 - RNA, 13 nt, Human
aauggccuuuauu

SEQ ID NO: 1477442 - RNA, 14 nt, Human
aauggcuauguuuu

SEQ ID NO: 1477443 - RNA, 22 nt, Human
aaugccaugaugccucugucuu

SEQ ID NO: 1477444 - RNA, 16 nt, Human
aaugcuucaucccuuu

SEQ ID NO: 1477445 - RNA, 22 nt, Human
aaugcuuaaucagauagauauu

SEQ ID NO: 1477446 - RNA, 14 nt, Human
aaugcuuaaucaga

SEQ ID NO: 1477447 - RNA, 20 nt, Human
aaugcuguauuuuaaaagaa

SEQ ID NO: 1477448 - RNA, 16 nt, Human
aaugcuguauuuuaaa

SEQ ID NO: 1477449 - RNA, 14 nt, Human
aauuacgugcucug

SEQ ID NO: 1477450 - RNA, 14 nt, Human
aauuaccuucuauu

SEQ ID NO: 1477451 - RNA, 14 nt, Human
aauuacacccaaag

SEQ ID NO: 1477452 - RNA, 18 nt, Human
aauuacaacggagucaaa

SEQ ID NO: 1477453 - RNA, 16 nt, Human
aauuacaacuaaguga

SEQ ID NO: 1477454 - RNA, 14 nt, Human
aauuacaacuaagu

SEQ ID NO: 1477455 - RNA, 14 nt, Human
aauuacugguccaa

SEQ ID NO: 1477456 - RNA, 12 nt, Human
aauuagcaauug

SEQ ID NO: 1477457 - RNA, 17 nt, Human
uaccugcucagcccugc

SEQ ID NO: 1477458 - RNA, 16 nt, Human
aauuauuauuuggccc

SEQ ID NO: 1477459 - RNA, 11 nt, Human
aauuauuuugu

SEQ ID NO: 1477460 - RNA, 22 nt, Human
aauucaaagcuguguguuugga

SEQ ID NO: 1477461 - RNA, 18 nt, Human
aauuccaagugauugaaa

SEQ ID NO: 1477462 - RNA, 12 nt, Human
aauucacucuga

SEQ ID NO: 1477463 - RNA, 23 nt, Human
aauucacucugaguguuuuauga

SEQ ID NO: 1477464 - RNA, 15 nt, Human
aauucaacaaacauu

SEQ ID NO: 1477465 - RNA, 19 nt, Human
aauugaugggauuugguca

SEQ ID NO: 1477466 - RNA, 18 nt, Human
aauugaguguuuaaaguu

SEQ ID NO: 1477467 - RNA, 17 nt, Human
aauugaucgacuugcca

SEQ ID NO: 1477468 - RNA, 15 nt, Human
aauugccugacgaac

SEQ ID NO: 1477469 - RNA, 23 nt, Human
aauugccugacgaacuccuugau

SEQ ID NO: 1477470 - RNA, 14 nt, Human
aauugacugucacu

SEQ ID NO: 1477471 - RNA, 18 nt, Human
uacuguaaggcaaucaug

SEQ ID NO: 1477472 - RNA, 14 nt, Human
uacuguaagaaaau

SEQ ID NO: 1477473 - RNA, 19 nt, Human
uacuguaaggcaaucaugg

SEQ ID NO: 1477474 - RNA, 21 nt, Human
uacucugaaauuguaacuaaa

SEQ ID NO: 1477475 - RNA, 16 nt, Human
uacuauaguaccagua

SEQ ID NO: 1477476 - RNA, 13 nt, Human
uacuauaguacca

SEQ ID NO: 1477477 - RNA, 12 nt, Human
uacuauaguacc

SEQ ID NO: 1477478 - RNA, 14 nt, Human
uacuacuguguaag

SEQ ID NO: 1477479 - RNA, 17 nt, Human
uacuacugaaucucuaa

SEQ ID NO: 1477480 - RNA, 16 nt, Human
uacuacugaaucucua

SEQ ID NO: 1477481 - RNA, 16 nt, Human
acagccucuuagaugc

SEQ ID NO: 1477482 - RNA, 16 nt, Human
uaugguaccagaugca

SEQ ID NO: 1477483 - RNA, 17 nt, Human
uaugguaccagaugcag

SEQ ID NO: 1477484 - RNA, 17 nt, Human
acagccugacaacauuu

SEQ ID NO: 1477485 - RNA, 20 nt, Human
acagccugacaacauuucua

SEQ ID NO: 1477486 - RNA, 21 nt, Human
acagccugacaacauuucuau

SEQ ID NO: 1477487 - RNA, 11 nt, Human
uaugggucaca

SEQ ID NO: 1477488 - RNA, 13 nt, Human
uaugggucacagg

SEQ ID NO: 1477489 - RNA, 14 nt, Human
uaugggucacagga

SEQ ID NO: 1477490 - RNA, 15 nt, Human
uaugggucacaggaa

SEQ ID NO: 1477491 - RNA, 14 nt, Human
uaugggucuaggac

SEQ ID NO: 1477492 - RNA, 15 nt, Human
uaugcuuacugauau

SEQ ID NO: 1477493 - RNA, 16 nt, Human
uaugcuuacugauaua

SEQ ID NO: 1477494 - RNA, 21 nt, Human
uaugcuuacugauauauuuua

SEQ ID NO: 1477495 - RNA, 19 nt, Human
uaugccccauucaacaucu

SEQ ID NO: 1477496 - RNA, 14 nt, Human
uaugccugcuauuu

SEQ ID NO: 1477497 - RNA, 16 nt, Human
uaugccuuguuucaua

SEQ ID NO: 1477498 - RNA, 18 nt, Human
uaugccugcuauuugaag

SEQ ID NO: 1477499 - RNA, 18 nt, Human
uaugaacuugaggacaca

SEQ ID NO: 1477500 - RNA, 16 nt, Human
uaugaacuugaggaca

SEQ ID NO: 1477501 - RNA, 19 nt, Human
uaugaacauauuguugaaa

SEQ ID NO: 1477502 - RNA, 17 nt, Human
uaugaacauauuguuga

SEQ ID NO: 1477503 - RNA, 16 nt, Human
uaugauuaaguaauga

SEQ ID NO: 1477504 - RNA, 20 nt, Human
uaugauuaaguaaugauaac

SEQ ID NO: 1477505 - RNA, 21 nt, Human
uaugauuaaguaaugauaacu

SEQ ID NO: 1477506 - RNA, 22 nt, Human
uaucuuugccacccucaugcug

SEQ ID NO: 1477507 - RNA, 23 nt, Human
uaucuuuucauacauuuucuaag

SEQ ID NO: 1477508 - RNA, 21 nt, Human
uaucuuuucauacauuuucua

SEQ ID NO: 1477509 - RNA, 14 nt, Human
uaugaacauauugu

SEQ ID NO: 1477510 - RNA, 16 nt, Human
uaucuuugccacccuc

SEQ ID NO: 1477511 - RNA, 14 nt, Human
uaucuuugccaccc

SEQ ID NO: 1477512 - RNA, 11 nt, Human
uaucuuugcca

SEQ ID NO: 1477513 - RNA, 14 nt, Human
acagauuguuugca

SEQ ID NO: 1477514 - RNA, 15 nt, Human
acagauuguuugcaa

SEQ ID NO: 1477515 - RNA, 23 nt, Human
uaucuauauuuuacauaaauuua

SEQ ID NO: 1477516 - RNA, 11 nt, Human
uaucucaucuc

SEQ ID NO: 1477517 - RNA, 17 nt, Human
uaucaaccccagacacu

SEQ ID NO: 1477518 - RNA, 18 nt, Human
uaucaaccccagacacug

SEQ ID NO: 1477519 - RNA, 21 nt, Human
uaucaaccccagacacugguu

SEQ ID NO: 1477520 - RNA, 19 nt, Human
uaucaaccccagacacugg

SEQ ID NO: 1477521 - RNA, 14 nt, Human
uaucaacuuccuaa

SEQ ID NO: 1477522 - RNA, 19 nt, Human
uaucaacuuccuaaauauu

SEQ ID NO: 1477523 - RNA, 13 nt, Human
uauccaaaagcuu

SEQ ID NO: 1477524 - RNA, 15 nt, Human
uauccacuuugcaca

SEQ ID NO: 1477525 - RNA, 18 nt, Human
uauccacuuugcacagcu

SEQ ID NO: 1477526 - RNA, 17 nt, Human
uauccaggcaccaggac

SEQ ID NO: 1477527 - RNA, 15 nt, Human
uauccaggcaccagg

SEQ ID NO: 1477528 - RNA, 18 nt, Human
uauccaggcaccaggacu

SEQ ID NO: 1477529 - RNA, 16 nt, Human
uauccuaaacaucauu

SEQ ID NO: 1477530 - RNA, 23 nt, Human
uauaaguguguguuuuucauaaa

SEQ ID NO: 1477531 - RNA, 17 nt, Human
uauaaguguguguuuuu

SEQ ID NO: 1477532 - RNA, 16 nt, Human
uauauuuaguaucuuu

SEQ ID NO: 1477533 - RNA, 15 nt, Human
uauauuguuugcuaa

SEQ ID NO: 1477534 - RNA, 17 nt, Human
uauauuacaaugaucac

SEQ ID NO: 1477535 - RNA, 22 nt, Human
uauauuacacuacacacugugu

SEQ ID NO: 1477536 - RNA, 13 nt, Human
uauauuacaauga

SEQ ID NO: 1477537 - RNA, 12 nt, Human
uauauuacaaug

SEQ ID NO: 1477538 - RNA, 20 nt, Human
uauguguaugcacaguaaaa

SEQ ID NO: 1477539 - RNA, 17 nt, Human
uaugugggcagauuuuc

SEQ ID NO: 1477540 - RNA, 23 nt, Human
uaugugggcagauuuucagcaaa

SEQ ID NO: 1477541 - RNA, 17 nt, Human
uauguguaucucacacu

SEQ ID NO: 1477542 - RNA, 22 nt, Human
uauguuuugacauuuuuaguuu

SEQ ID NO: 1477543 - RNA, 13 nt, Human
uauguuuuuaaug

SEQ ID NO: 1477544 - RNA, 20 nt, Human
uauuaaaaagguuuacagaa

SEQ ID NO: 1477545 - RNA, 18 nt, Human
uaugugacauuuuacauu

SEQ ID NO: 1477546 - RNA, 14 nt, Human
uaugugacauuuua

SEQ ID NO: 1477547 - RNA, 17 nt, Human
uaugugaaacauguuuc

SEQ ID NO: 1477548 - RNA, 12 nt, Human
uaugugaacagu

SEQ ID NO: 1477549 - RNA, 22 nt, Human
uaugugaacaguuguguuugaa

SEQ ID NO: 1477550 - RNA, 19 nt, Human
uaugugacauuuuacauua

SEQ ID NO: 1477551 - RNA, 21 nt, Human
uaugugacauuuuacauuaaa

SEQ ID NO: 1477552 - RNA, 14 nt, Human
uaugugaaacaugu

SEQ ID NO: 1477553 - RNA, 19 nt, Human
acaggcaugugucaccaug

SEQ ID NO: 1477554 - RNA, 16 nt, Human
acaggcaugugucacc

SEQ ID NO: 1477555 - RNA, 12 nt, Human
acaggaaaaagu

SEQ ID NO: 1477556 - RNA, 16 nt, Human
acagucaccucaugga

SEQ ID NO: 1477557 - RNA, 17 nt, Human
acagucaccucauggaa

SEQ ID NO: 1477558 - RNA, 18 nt, Human
acagucaccucauggaau

SEQ ID NO: 1477559 - RNA, 14 nt, Human
acaguacacuguca

SEQ ID NO: 1477560 - RNA, 21 nt, Human
uauucagcucauggacuucug

SEQ ID NO: 1477561 - RNA, 16 nt, Human
uauucaauucuuuuaa

SEQ ID NO: 1477562 - RNA, 14 nt, Human
uauucaauaaagcu

SEQ ID NO: 1477563 - RNA, 13 nt, Human
uauucaauaaagc

SEQ ID NO: 1477564 - RNA, 12 nt, Human
uauucaauaaag

SEQ ID NO: 1477565 - RNA, 14 nt, Human
uauucauaauuauu

SEQ ID NO: 1477566 - RNA, 19 nt, Human
acaggcgugagccaccucg

SEQ ID NO: 1477567 - RNA, 20 nt, Human
acaggcgugagccaccucgc

SEQ ID NO: 1477568 - RNA, 19 nt, Human
uauucagcuuuaguagaua

SEQ ID NO: 1477569 - RNA, 23 nt, Human
uauucaaaaauuaucuauagcua

SEQ ID NO: 1477570 - RNA, 15 nt, Human
uauuagaauaccaca

SEQ ID NO: 1477571 - RNA, 14 nt, Human
uauuacuguaagaa

SEQ ID NO: 1477572 - RNA, 23 nt, Human
uauuacuuauuuuugacaguguu

SEQ ID NO: 1477573 - RNA, 15 nt, Human
uauaaguguguguuu

SEQ ID NO: 1477574 - RNA, 13 nt, Human
acacuaagagaga

SEQ ID NO: 1477575 - RNA, 14 nt, Human
acacuaagagagaa

SEQ ID NO: 1477576 - RNA, 23 nt, Human
acaccugcccugcccugccaccu

SEQ ID NO: 1477577 - RNA, 16 nt, Human
acaccucuuggggagu

SEQ ID NO: 1477578 - RNA, 13 nt, Human
acacccucacacu

SEQ ID NO: 1477579 - RNA, 14 nt, Human
acacccuccagaga

SEQ ID NO: 1477580 - RNA, 16 nt, Human
acacccucacacuggg

SEQ ID NO: 1477581 - RNA, 20 nt, Human
acacccaaagagguauuuau

SEQ ID NO: 1477582 - RNA, 19 nt, Human
acacccaaagagguauuua

SEQ ID NO: 1477583 - RNA, 17 nt, Human
acaccauugaaggcuua

SEQ ID NO: 1477584 - RNA, 17 nt, Human
acaccauagguagaaug

SEQ ID NO: 1477585 - RNA, 21 nt, Human
acaccauagguagaauguaaa

SEQ ID NO: 1477586 - RNA, 15 nt, Human
acacaugaaguccaa

SEQ ID NO: 1477587 - RNA, 22 nt, Human
uauaaaagggacugagaaauuu

SEQ ID NO: 1477588 - RNA, 20 nt, Human
uauaaaagccuguuuaagag

SEQ ID NO: 1477589 - RNA, 19 nt, Human
uauaaaaauaaaaaacacu

SEQ ID NO: 1477590 - RNA, 22 nt, Human
acacauacucauuuuucaugau

SEQ ID NO: 1477591 - RNA, 19 nt, Human
acacauacucauuuuucau

SEQ ID NO: 1477592 - RNA, 17 nt, Human
uaguucaugucugcuau

SEQ ID NO: 1477593 - RNA, 20 nt, Human
acacaccaccacgccuggcu

SEQ ID NO: 1477594 - RNA, 17 nt, Human
acacaccaccacgccug

SEQ ID NO: 1477595 - RNA, 22 nt, Human
acaauguccuaacugaaagaug

SEQ ID NO: 1477596 - RNA, 22 nt, Human
acacacaaauuaucuuaaaacu

SEQ ID NO: 1477597 - RNA, 14 nt, Human
acacaaugugucug

SEQ ID NO: 1477598 - RNA, 19 nt, Human
acaauggauaggcacagga

SEQ ID NO: 1477599 - RNA, 22 nt, Human
acaaugcuguauuuuaaaagaa

SEQ ID NO: 1477600 - RNA, 12 nt, Human
uagggagccaug

SEQ ID NO: 1477601 - RNA, 22 nt, Human
uagugaaacucguuaauuugua

SEQ ID NO: 1477602 - RNA, 14 nt, Human
uagugaacuugaaa

SEQ ID NO: 1477603 - RNA, 14 nt, Human
uaguacuaacuccu

SEQ ID NO: 1477604 - RNA, 23 nt, Human
uaguccagcuuuguucuucuuaa

SEQ ID NO: 1477605 - RNA, 22 nt, Human
uaguccagcuuuguucuucuua

SEQ ID NO: 1477606 - RNA, 18 nt, Human
uagucccucaugcaaauc

SEQ ID NO: 1477607 - RNA, 23 nt, Human
uaguguuggagaagaacugaaau

SEQ ID NO: 1477608 - RNA, 14 nt, Human
acacacuuacuuuu

SEQ ID NO: 1477609 - RNA, 22 nt, Human
acacagugcugaccagacagcc

SEQ ID NO: 1477610 - RNA, 16 nt, Human
acacaguuccugggaa

SEQ ID NO: 1477611 - RNA, 15 nt, Human
acacaguuccuggga

SEQ ID NO: 1477612 - RNA, 18 nt, Human
acacaguuccugggaaca

SEQ ID NO: 1477613 - RNA, 18 nt, Human
uaguaaaucacgcuuuuu

SEQ ID NO: 1477614 - RNA, 21 nt, Human
uaguaaaucacgcuuuuugaa

SEQ ID NO: 1477615 - RNA, 22 nt, Human
uaguaaaucacgcuuuuugaaa

SEQ ID NO: 1477616 - RNA, 19 nt, Human
uaggaaauauuuauuuuaa

SEQ ID NO: 1477617 - RNA, 18 nt, Human
uaggaaauauuuauuuua

SEQ ID NO: 1477618 - RNA, 22 nt, Human
uaggcagacucuuuaugcuugc

SEQ ID NO: 1477619 - RNA, 19 nt, Human
uaggcauuuuuaccaucac

SEQ ID NO: 1477620 - RNA, 21 nt, Human
uaggcauuuuuaccaucacug

SEQ ID NO: 1477621 - RNA, 13 nt, Human
acaagacugcaca

SEQ ID NO: 1477622 - RNA, 14 nt, Human
acaagacugcacau

SEQ ID NO: 1477623 - RNA, 16 nt, Human
acaauaagcaaaaaca

SEQ ID NO: 1477624 - RNA, 15 nt, Human
acaauaagcaaaaac

SEQ ID NO: 1477625 - RNA, 13 nt, Human
acaauaaauagac

SEQ ID NO: 1477626 - RNA, 23 nt, Human
acaauacaucccuuaccugggaa

SEQ ID NO: 1477627 - RNA, 14 nt, Human
acaauaauuuucua

SEQ ID NO: 1477628 - RNA, 16 nt, Human
uagcugugaccucucc

SEQ ID NO: 1477629 - RNA, 22 nt, Human
uagcuaaguacacaauaagcaa

SEQ ID NO: 1477630 - RNA, 15 nt, Human
uagcuaaguacacaa

SEQ ID NO: 1477631 - RNA, 11 nt, Human
uagagcacugc

SEQ ID NO: 1477632 - RNA, 20 nt, Human
uagauaucaugcaaauuuca

SEQ ID NO: 1477633 - RNA, 19 nt, Human
uagauauccacuugagaca

SEQ ID NO: 1477634 - RNA, 16 nt, Human
aauuguuacaaauugu

SEQ ID NO: 1477635 - RNA, 21 nt, Human
aauuguguuuauaauuuuaaa

SEQ ID NO: 1477636 - RNA, 18 nt, Human
acaaaaggauaaugaaua

SEQ ID NO: 1477637 - RNA, 18 nt, Human
acaaagaguucaagaaau

SEQ ID NO: 1477638 - RNA, 18 nt, Human
acaaaggcuuauuaauuu

SEQ ID NO: 1477639 - RNA, 23 nt, Human
aauuguugcuaaucuucuuaugc

SEQ ID NO: 1477640 - RNA, 19 nt, Human
acaaagaguucaagaaaua

SEQ ID NO: 1477641 - RNA, 22 nt, Human
acaaagaguucaagaaauaagu

SEQ ID NO: 1477642 - RNA, 21 nt, Human
acaaagaguucaagaaauaag

SEQ ID NO: 1477643 - RNA, 14 nt, Human
uagccaagugcagg

SEQ ID NO: 1477644 - RNA, 18 nt, Human
uagccaauauuuuucuua

SEQ ID NO: 1477645 - RNA, 14 nt, Human
uagccacaccagga

SEQ ID NO: 1477646 - RNA, 15 nt, Human
uagccacaccaggau

SEQ ID NO: 1477647 - RNA, 17 nt, Human
uagccacaccaggauag

SEQ ID NO: 1477648 - RNA, 18 nt, Human
uagcaugucgucaaagcu

SEQ ID NO: 1477649 - RNA, 16 nt, Human
uagccaaaaauagcua

SEQ ID NO: 1477650 - RNA, 21 nt, Human
uagccaaaaauagcuaaauac

SEQ ID NO: 1477651 - RNA, 16 nt, Human
uagaugcaguucugaa

SEQ ID NO: 1477652 - RNA, 15 nt, Human
uagaugcaguucuga

SEQ ID NO: 1477653 - RNA, 15 nt, Human
aagaggcaccugucc

SEQ ID NO: 1477654 - RNA, 18 nt, Human
aagaggcaccugucccag

SEQ ID NO: 1477655 - RNA, 21 nt, Human
aagagguauuuaucuuuacuu

SEQ ID NO: 1477656 - RNA, 15 nt, Human
aagcaaccucaguaa

SEQ ID NO: 1477657 - RNA, 16 nt, Human
guguaugugugugugu

SEQ ID NO: 1477658 - RNA, 13 nt, Human
guguauuccaaga

SEQ ID NO: 1477659 - RNA, 20 nt, Human
guguauuccaagacaugucu

SEQ ID NO: 1477660 - RNA, 15 nt, Human
gugucacucaaggcg

SEQ ID NO: 1477661 - RNA, 17 nt, Human
aagauauuuuuaucuuu

SEQ ID NO: 1477662 - RNA, 19 nt, Human
aagauauuuuuaucuuuau

SEQ ID NO: 1477663 - RNA, 17 nt, Human
aagauauuuuucaugau

SEQ ID NO: 1477664 - RNA, 15 nt, Human
aagauauuuuucaug

SEQ ID NO: 1477665 - RNA, 13 nt, Human
aagauauuuuucc

SEQ ID NO: 1477666 - RNA, 13 nt, Human
aagauuuuuuaau

SEQ ID NO: 1477667 - RNA, 17 nt, Human
aagauuuuuuaauaauu

SEQ ID NO: 1477668 - RNA, 14 nt, Human
aagauuuuuuaaua

SEQ ID NO: 1477669 - RNA, 16 nt, Human
aagauuuuuuaauaau

SEQ ID NO: 1477670 - RNA, 15 nt, Human
aagcaaaaaagaaaa

SEQ ID NO: 1477671 - RNA, 12 nt, Human
guguuugaagca

SEQ ID NO: 1477672 - RNA, 13 nt, Human
guguuucugacuc

SEQ ID NO: 1477673 - RNA, 18 nt, Human
guguuucuguaagaaacc

SEQ ID NO: 1477674 - RNA, 16 nt, Human
aagcacuaaacaaaga

SEQ ID NO: 1477675 - RNA, 16 nt, Human
aagcaccuuagcuggc

SEQ ID NO: 1477676 - RNA, 19 nt, Human
aagcaccuuagcuggcauu

SEQ ID NO: 1477677 - RNA, 21 nt, Human
aagcacgugguaaaacacuug

SEQ ID NO: 1477678 - RNA, 18 nt, Human
aagcacauuuuaaaagug

SEQ ID NO: 1477679 - RNA, 19 nt, Human
aagcauuuguuucuacuuu

SEQ ID NO: 1477680 - RNA, 23 nt, Human
aagcauuuguuucuacuuugaua

SEQ ID NO: 1477681 - RNA, 13 nt, Human
aagcauuuuguaa

SEQ ID NO: 1477682 - RNA, 19 nt, Human
aagcauuuuguaaguugaa

SEQ ID NO: 1477683 - RNA, 12 nt, Human
aagcaugaaaug

SEQ ID NO: 1477684 - RNA, 23 nt, Human
aagcaugcacaaauucugucucu

SEQ ID NO: 1477685 - RNA, 15 nt, Human
aagcauggcuauuuu

SEQ ID NO: 1477686 - RNA, 18 nt, Human
aagcauguauucagcuuu

SEQ ID NO: 1477687 - RNA, 21 nt, Human
aagccuuggggcugaugcagu

SEQ ID NO: 1477688 - RNA, 23 nt, Human
aagccuugauugguguugccagu

SEQ ID NO: 1477689 - RNA, 20 nt, Human
aagccuugauugguguugcc

SEQ ID NO: 1477690 - RNA, 18 nt, Human
aagccuguuuaagagaca

SEQ ID NO: 1477691 - RNA, 15 nt, Human
aagccuguuuaagag

SEQ ID NO: 1477692 - RNA, 14 nt, Human
guucaguaccacau

SEQ ID NO: 1477693 - RNA, 20 nt, Human
guuauuauauuuacaaaugg

SEQ ID NO: 1477694 - RNA, 19 nt, Human
guuauuauauuuacaaaug

SEQ ID NO: 1477695 - RNA, 19 nt, Human
guuacugugccauguguuu

SEQ ID NO: 1477696 - RNA, 22 nt, Human
aagccauucuccugccucagcc

SEQ ID NO: 1477697 - RNA, 18 nt, Human
guuaauauugauuuauua

SEQ ID NO: 1477698 - RNA, 16 nt, Human
aagcccaccauuuggc

SEQ ID NO: 1477699 - RNA, 21 nt, Human
guuaauauugauuuauuaaua

SEQ ID NO: 1477700 - RNA, 12 nt, Human
guuaauuuaaag

SEQ ID NO: 1477701 - RNA, 23 nt, Human
guuaauuuaaaguuguuugugcc

SEQ ID NO: 1477702 - RNA, 19 nt, Human
guuaauuuagaaaacuuua

SEQ ID NO: 1477703 - RNA, 12 nt, Human
guuaauuuuuga

SEQ ID NO: 1477704 - RNA, 14 nt, Human
guuaauuuuugaua

SEQ ID NO: 1477705 - RNA, 18 nt, Human
aagcuuaugcuuaaauuc

SEQ ID NO: 1477706 - RNA, 23 nt, Human
aagcuucccacggccuuucuagc

SEQ ID NO: 1477707 - RNA, 23 nt, Human
aagcuuguauuccuuuuucucuc

SEQ ID NO: 1477708 - RNA, 13 nt, Human
aagcuuaaaacuu

SEQ ID NO: 1477709 - RNA, 14 nt, Human
aagcuuaaaacuuu

SEQ ID NO: 1477710 - RNA, 15 nt, Human
aagcuuaaaacuuug

SEQ ID NO: 1477711 - RNA, 17 nt, Human
aagcuuaaaacuuugaa

SEQ ID NO: 1477712 - RNA, 19 nt, Human
aagcuuaauggcugauaau

SEQ ID NO: 1477713 - RNA, 21 nt, Human
aagcuuaauggcugauaauuu

SEQ ID NO: 1477714 - RNA, 14 nt, Human
aagcucacuucugg

SEQ ID NO: 1477715 - RNA, 23 nt, Human
aagcucacuucugggcuucaucu

SEQ ID NO: 1477716 - RNA, 12 nt, Human
aagcugaaaaua

SEQ ID NO: 1477717 - RNA, 21 nt, Human
aagcuuuuaugugaaacaugu

SEQ ID NO: 1477718 - RNA, 19 nt, Human
aagcuuuuaugugaaacau

SEQ ID NO: 1477719 - RNA, 23 nt, Human
aagcuuuuuauuccuccugcuca

SEQ ID NO: 1477720 - RNA, 20 nt, Human
guuccccacuguaucuaggc

SEQ ID NO: 1477721 - RNA, 18 nt, Human
guucccuugaugaagaag

SEQ ID NO: 1477722 - RNA, 24 nt, Human
guugacuuauaguacaugauaaau

SEQ ID NO: 1477723 - RNA, 19 nt, Human
guugacuuauaguacauga

SEQ ID NO: 1477724 - RNA, 23 nt, Human
guucuugaggggaccaggagugg

SEQ ID NO: 1477725 - RNA, 22 nt, Human
guucuugaggggaccaggagug

SEQ ID NO: 1477726 - RNA, 19 nt, Human
guucuucuaccacccacca

SEQ ID NO: 1477727 - RNA, 16 nt, Human
guucuugaggggacca

SEQ ID NO: 1477728 - RNA, 20 nt, Human
guucuugaggggaccaggag

SEQ ID NO: 1477729 - RNA, 21 nt, Human
guucuugaggggaccaggagu

SEQ ID NO: 1477730 - RNA, 18 nt, Human
aagucagaacagcagacu

SEQ ID NO: 1477731 - RNA, 15 nt, Human
aaguauuaugucucu

SEQ ID NO: 1477732 - RNA, 15 nt, Human
aaguauuuugcugga

SEQ ID NO: 1477733 - RNA, 18 nt, Human
aaguauguuagugcaaau

SEQ ID NO: 1477734 - RNA, 19 nt, Human
aaguauguuagugcaaauu

SEQ ID NO: 1477735 - RNA, 21 nt, Human
aaguauguuagugcaaauugu

SEQ ID NO: 1477736 - RNA, 19 nt, Human
aaguacuaagcgcuagagg

SEQ ID NO: 1477737 - RNA, 18 nt, Human
aaguacacaauaagcaaa

SEQ ID NO: 1477738 - RNA, 17 nt, Human
aaguacacaauaagcaa

SEQ ID NO: 1477739 - RNA, 16 nt, Human
aaguacacaauaagca

SEQ ID NO: 1477740 - RNA, 19 nt, Human
guuuugauuuguacugaaa

SEQ ID NO: 1477741 - RNA, 19 nt, Human
aaguacacaauaagcaaaa

SEQ ID NO: 1477742 - RNA, 19 nt, Human
guuuggacaaaauggaaua

SEQ ID NO: 1477743 - RNA, 11 nt, Human
guuugcuuucu

SEQ ID NO: 1477744 - RNA, 21 nt, Human
guuugcuuucugaucaaggcc

SEQ ID NO: 1477745 - RNA, 21 nt, Human
guuuggaaauugauuuugaac

SEQ ID NO: 1477746 - RNA, 15 nt, Human
guuuuaaagcuucca

SEQ ID NO: 1477747 - RNA, 20 nt, Human
guuuggauauguaaaacauu

SEQ ID NO: 1477748 - RNA, 21 nt, Human
guuuggauauguaaaacauuu

SEQ ID NO: 1477749 - RNA, 21 nt, Human
guuuuaugagaaagccuucuu

SEQ ID NO: 1477750 - RNA, 17 nt, Human
guuuugacauuuuuagu

SEQ ID NO: 1477751 - RNA, 14 nt, Human
guuuugacauuuuu

SEQ ID NO: 1477752 - RNA, 23 nt, Human
aaguaacugggauuacaggcaug

SEQ ID NO: 1477753 - RNA, 12 nt, Human
aaguaacaaaaa

SEQ ID NO: 1477754 - RNA, 13 nt, Human
aaguaacaaaaau

SEQ ID NO: 1477755 - RNA, 16 nt, Human
aaguaacaaaaauaaa

SEQ ID NO: 1477756 - RNA, 18 nt, Human
aagguauuaaauugaugu

SEQ ID NO: 1477757 - RNA, 22 nt, Human
aagguauuaaauugauguugcu

SEQ ID NO: 1477758 - RNA, 17 nt, Human
aagguuuaugaaaaaga

SEQ ID NO: 1477759 - RNA, 22 nt, Human
aaggggcuucagguccaggcug

SEQ ID NO: 1477760 - RNA, 13 nt, Human
aaggggcuucagg

SEQ ID NO: 1477761 - RNA, 15 nt, Human
aagggcuguuauaau

SEQ ID NO: 1477762 - RNA, 15 nt, Human
aaggcuuaaacccau

SEQ ID NO: 1477763 - RNA, 17 nt, Human
aagggcuguuauaaucu

SEQ ID NO: 1477764 - RNA, 19 nt, Human
guuucacaaggucuuuaaa

SEQ ID NO: 1477765 - RNA, 23 nt, Human
guuucacagccuauaaccagaca

SEQ ID NO: 1477766 - RNA, 13 nt, Human
guuguuugugccu

SEQ ID NO: 1477767 - RNA, 21 nt, Human
aaguguguguuuuucauaaag

SEQ ID NO: 1477768 - RNA, 16 nt, Human
aaguguguguuuuuca

SEQ ID NO: 1477769 - RNA, 12 nt, Human
aaguuaauuuaa

SEQ ID NO: 1477770 - RNA, 15 nt, Human
aaguuaauuuaaagu

SEQ ID NO: 1477771 - RNA, 16 nt, Human
aaguuaauuuaaaguu

SEQ ID NO: 1477772 - RNA, 17 nt, Human
aaguuaauuuaaaguug

SEQ ID NO: 1477773 - RNA, 16 nt, Human
aaguuagcuuuaacuu

SEQ ID NO: 1477774 - RNA, 16 nt, Human
aaguuauuuaaaucug

SEQ ID NO: 1477775 - RNA, 12 nt, Human
aaguguguguuu

SEQ ID NO: 1477776 - RNA, 17 nt, Human
aagugccauuaacaaau

SEQ ID NO: 1477777 - RNA, 16 nt, Human
aagugccauuaacaaa

SEQ ID NO: 1477778 - RNA, 16 nt, Human
aaguuuccaucaucua

SEQ ID NO: 1477779 - RNA, 20 nt, Human
aaguuccuuggccaugcaga

SEQ ID NO: 1477780 - RNA, 21 nt, Human
aaguucaccagacucuauaaa

SEQ ID NO: 1477781 - RNA, 22 nt, Human
aaguucaauauaagcuuuucuu

SEQ ID NO: 1477782 - RNA, 19 nt, Human
aaguuccaaguugcuaaua

SEQ ID NO: 1477783 - RNA, 19 nt, Human
aaguuauuuuuaauuuggu

SEQ ID NO: 1477784 - RNA, 23 nt, Human
aaguucaaauucuucugaacuca

SEQ ID NO: 1477785 - RNA, 16 nt, Human
aaguucaacauguuau

SEQ ID NO: 1477786 - RNA, 15 nt, Human
uaaaauguaaagcca

SEQ ID NO: 1477787 - RNA, 18 nt, Human
uaaaauguaaagccaugc

SEQ ID NO: 1477788 - RNA, 23 nt, Human
uaaaauguaaagccaugcuggaa

SEQ ID NO: 1477789 - RNA, 18 nt, Human
uaaaaugugggauuaugg

SEQ ID NO: 1477790 - RNA, 20 nt, Human
uaaaaugugggauuaugggu

SEQ ID NO: 1477791 - RNA, 23 nt, Human
uaaaaugugggauuaugggucac

SEQ ID NO: 1477792 - RNA, 22 nt, Human
uaaaauaauuuuuauauuugaa

SEQ ID NO: 1477793 - RNA, 17 nt, Human
uaaaagugccauuaaca

SEQ ID NO: 1477794 - RNA, 17 nt, Human
uaaaauaaagaaauaga

SEQ ID NO: 1477795 - RNA, 13 nt, Human
uaaaauaaagaaa

SEQ ID NO: 1477796 - RNA, 17 nt, Human
uaaaagaaacccugcac

SEQ ID NO: 1477797 - RNA, 13 nt, Human
uaaaagaaacuuu

SEQ ID NO: 1477798 - RNA, 14 nt, Human
uaaaagaaacuuuc

SEQ ID NO: 1477799 - RNA, 17 nt, Human
uaaaagaaacuuucuuu

SEQ ID NO: 1477800 - RNA, 16 nt, Human
uaaaagaaacccugca

SEQ ID NO: 1477801 - RNA, 18 nt, Human
uaaaauagucucuuuaaa

SEQ ID NO: 1477802 - RNA, 17 nt, Human
uaaaauagcaaaagaag

SEQ ID NO: 1477803 - RNA, 21 nt, Human
uaaaauagcaaaagaagaagu

SEQ ID NO: 1477804 - RNA, 22 nt, Human
uaaaauagcaaaagaagaaguu

SEQ ID NO: 1477805 - RNA, 13 nt, Human
uaaaauagcaaaa

SEQ ID NO: 1477806 - RNA, 16 nt, Human
uaaaauagcaaaagaa

SEQ ID NO: 1477807 - RNA, 18 nt, Human
aagugauuguaugaauuu

SEQ ID NO: 1477808 - RNA, 13 nt, Human
aagugauuguaug

SEQ ID NO: 1477809 - RNA, 17 nt, Human
uaaaaaggcuaaaugga

SEQ ID NO: 1477810 - RNA, 21 nt, Human
uaaaaaggacaucagcaaaca

SEQ ID NO: 1477811 - RNA, 19 nt, Human
uaaaaaggacaucagcaaa

SEQ ID NO: 1477812 - RNA, 18 nt, Human
uaaaaaggacaucagcaa

SEQ ID NO: 1477813 - RNA, 11 nt, Human
uaaaaaggaca

SEQ ID NO: 1477814 - RNA, 16 nt, Human
uaaaaaggccuccugg

SEQ ID NO: 1477815 - RNA, 19 nt, Human
uaaaaaguaauaaaauuca

SEQ ID NO: 1477816 - RNA, 16 nt, Human
uaaaaagucaauguuu

SEQ ID NO: 1477817 - RNA, 18 nt, Human
aagucagcucuucuccau

SEQ ID NO: 1477818 - RNA, 21 nt, Human
aagucaggcccuuauuuucaa

SEQ ID NO: 1477819 - RNA, 21 nt, Human
uaaaacuuugaaguuagcuuu

SEQ ID NO: 1477820 - RNA, 14 nt, Human
gugaucucagcuca

SEQ ID NO: 1477821 - RNA, 15 nt, Human
gugaugugaguugca

SEQ ID NO: 1477822 - RNA, 15 nt, Human
gugauguucaugggu

SEQ ID NO: 1477823 - RNA, 21 nt, Human
gugauucaaucuguaaacugu

SEQ ID NO: 1477824 - RNA, 23 nt, Human
gugauucaaucuguaaacugugu

SEQ ID NO: 1477825 - RNA, 22 nt, Human
gugauuagagggaggagaauga

SEQ ID NO: 1477826 - RNA, 14 nt, Human
gugauucaaucugu

SEQ ID NO: 1477827 - RNA, 16 nt, Human
gugauucaaucuguaa

SEQ ID NO: 1477828 - RNA, 13 nt, Human
gugcaccugcccc

SEQ ID NO: 1477829 - RNA, 17 nt, Human
gugcauuuaugagcucu

SEQ ID NO: 1477830 - RNA, 20 nt, Human
aacuugaggacacaugucca

SEQ ID NO: 1477831 - RNA, 19 nt, Human
aacuugaggacacaugucc

SEQ ID NO: 1477832 - RNA, 18 nt, Human
aacuugaggacacauguc

SEQ ID NO: 1477833 - RNA, 17 nt, Human
aacuugaggacacaugu

SEQ ID NO: 1477834 - RNA, 16 nt, Human
aacuugaggacacaug

SEQ ID NO: 1477835 - RNA, 15 nt, Human
aacuugaggacacau

SEQ ID NO: 1477836 - RNA, 14 nt, Human
aacuugaggacaca

SEQ ID NO: 1477837 - RNA, 13 nt, Human
aacuugaggacac

SEQ ID NO: 1477838 - RNA, 12 nt, Human
aacuugaggaca

SEQ ID NO: 1477839 - RNA, 15 nt, Human
aacuugacccugagc

SEQ ID NO: 1477840 - RNA, 19 nt, Human
aacuugacccugagcugac

SEQ ID NO: 1477841 - RNA, 18 nt, Human
aacuugacccugagcuga

SEQ ID NO: 1477842 - RNA, 21 nt, Human
aacuugaacugauucacaucu

SEQ ID NO: 1477843 - RNA, 14 nt, Human
aacuugaacugauu

SEQ ID NO: 1477844 - RNA, 21 nt, Human
aacuugaaauauccugcuuga

SEQ ID NO: 1477845 - RNA, 18 nt, Human
aacuucagcgguuuauau

SEQ ID NO: 1477846 - RNA, 21 nt, Human
aacuucagcgguuuauauaag

SEQ ID NO: 1477847 - RNA, 19 nt, Human
aacugucucucaugaaccu

SEQ ID NO: 1477848 - RNA, 20 nt, Human
aacuguguacauaacugaaa

SEQ ID NO: 1477849 - RNA, 21 nt, Human
aacuguguacauaacugaaaa

SEQ ID NO: 1477850 - RNA, 23 nt, Human
aacuguguacauaacugaaaaug

SEQ ID NO: 1477851 - RNA, 16 nt, Human
aacugccuacuccaaa

SEQ ID NO: 1477852 - RNA, 20 nt, Human
aacugccuacuccaaaaugu

SEQ ID NO: 1477853 - RNA, 16 nt, Human
gugcucauuucaggau

SEQ ID NO: 1477854 - RNA, 19 nt, Human
gugcucaggagcccuggga

SEQ ID NO: 1477855 - RNA, 18 nt, Human
gugcucaggagcccuggg

SEQ ID NO: 1477856 - RNA, 22 nt, Human
aagaagcaccaaucaugaauua

SEQ ID NO: 1477857 - RNA, 21 nt, Human
aagaagcaaccucaguaauuu

SEQ ID NO: 1477858 - RNA, 15 nt, Human
aagaaguuucaucau

SEQ ID NO: 1477859 - RNA, 18 nt, Human
aagaaguuucaucauuuu

SEQ ID NO: 1477860 - RNA, 16 nt, Human
aagaauaaucacgcuu

SEQ ID NO: 1477861 - RNA, 22 nt, Human
aagaauaaucacgcuuuccuga

SEQ ID NO: 1477862 - RNA, 21 nt, Human
gugcuauacugcauacuuuuu

SEQ ID NO: 1477863 - RNA, 23 nt, Human
aagaauaaucacgcuuuccugaa

SEQ ID NO: 1477864 - RNA, 22 nt, Human
aagaaagcuucaaacugcauga

SEQ ID NO: 1477865 - RNA, 11 nt, Human
aagaaacauuu

SEQ ID NO: 1477866 - RNA, 14 nt, Human
aagaaacauuuaua

SEQ ID NO: 1477867 - RNA, 22 nt, Human
aagaaaauuuuuguaguagcgu

SEQ ID NO: 1477868 - RNA, 16 nt, Human
aagaaacaagguuuuc

SEQ ID NO: 1477869 - RNA, 19 nt, Human
gugccagauuuaugcauau

SEQ ID NO: 1477870 - RNA, 20 nt, Human
aagaaaaacaaacucguuuu

SEQ ID NO: 1477871 - RNA, 15 nt, Human
aaccuuccacccagu

SEQ ID NO: 1477872 - RNA, 13 nt, Human
aaccuuccaccca

SEQ ID NO: 1477873 - RNA, 12 nt, Human
aacgucuuaaau

SEQ ID NO: 1477874 - RNA, 14 nt, Human
aacgucuuaaauau

SEQ ID NO: 1477875 - RNA, 13 nt, Human
aaccuucucuaug

SEQ ID NO: 1477876 - RNA, 15 nt, Human
aacgucuuaaauauu

SEQ ID NO: 1477877 - RNA, 19 nt, Human
aaccuggguugcagacagg

SEQ ID NO: 1477878 - RNA, 20 nt, Human
aaccuggguugcagacagga

SEQ ID NO: 1477879 - RNA, 17 nt, Human
aaccuggguugcagaca

SEQ ID NO: 1477880 - RNA, 12 nt, Human
aacuauggccug

SEQ ID NO: 1477881 - RNA, 15 nt, Human
aacuaggcugagcaa

SEQ ID NO: 1477882 - RNA, 21 nt, Human
aacuaggugcauauuuauaaa

SEQ ID NO: 1477883 - RNA, 20 nt, Human
gugagaccaccucucaauau

SEQ ID NO: 1477884 - RNA, 14 nt, Human
gugagaccaccucu

SEQ ID NO: 1477885 - RNA, 13 nt, Human
gugagaccaccuc

SEQ ID NO: 1477886 - RNA, 20 nt, Human
gugacuuuggcugcaugcga

SEQ ID NO: 1477887 - RNA, 18 nt, Human
gugacuuuggcugcaugc

SEQ ID NO: 1477888 - RNA, 18 nt, Human
aacuccugaccucaggca

SEQ ID NO: 1477889 - RNA, 17 nt, Human
aacuccugaccucaggc

SEQ ID NO: 1477890 - RNA, 19 nt, Human
gugacagggcggggguggc

SEQ ID NO: 1477891 - RNA, 22 nt, Human
gugacagggcggggguggcggc

SEQ ID NO: 1477892 - RNA, 20 nt, Human
aacucucuggaagccccugg

SEQ ID NO: 1477893 - RNA, 18 nt, Human
aacucucuuauugccuca

SEQ ID NO: 1477894 - RNA, 19 nt, Human
aacucucuuauugccucac

SEQ ID NO: 1477895 - RNA, 21 nt, Human
aacucucuuauugccucacuu

SEQ ID NO: 1477896 - RNA, 15 nt, Human
aacucuucacucuuc

SEQ ID NO: 1477897 - RNA, 17 nt, Human
aacucuucacucuucaa

SEQ ID NO: 1477898 - RNA, 23 nt, Human
aacucuucacucuucaaaugccu

SEQ ID NO: 1477899 - RNA, 23 nt, Human
gugagagacauuaacucauuaga

SEQ ID NO: 1477900 - RNA, 19 nt, Human
gugagagacauuaacucau

SEQ ID NO: 1477901 - RNA, 15 nt, Human
gugagagaguggcug

SEQ ID NO: 1477902 - RNA, 18 nt, Human
gugagagaguggcugggg

SEQ ID NO: 1477903 - RNA, 16 nt, Human
gugagagaguggcugg

SEQ ID NO: 1477904 - RNA, 20 nt, Human
gugagagaguggcuggggca

SEQ ID NO: 1477905 - RNA, 19 nt, Human
gugagagaguggcuggggc

SEQ ID NO: 1477906 - RNA, 12 nt, Human
gucccuaauaaa

SEQ ID NO: 1477907 - RNA, 22 nt, Human
gucccgggacaccuaggcuagg

SEQ ID NO: 1477908 - RNA, 15 nt, Human
gucccuaauaaagcu

SEQ ID NO: 1477909 - RNA, 18 nt, Human
guccaaaagauugcugaa

SEQ ID NO: 1477910 - RNA, 15 nt, Human
guccaucagccucca

SEQ ID NO: 1477911 - RNA, 21 nt, Human
aacacugggagaaaugaaaaa

SEQ ID NO: 1477912 - RNA, 12 nt, Human
aacacucaccau

SEQ ID NO: 1477913 - RNA, 15 nt, Human
aacacaggcaaaauc

SEQ ID NO: 1477914 - RNA, 22 nt, Human
aacacaggcaaaauccuugcuu

SEQ ID NO: 1477915 - RNA, 15 nt, Human
gucauuucauuuccu

SEQ ID NO: 1477916 - RNA, 14 nt, Human
aacacacacaaaag

SEQ ID NO: 1477917 - RNA, 18 nt, Human
aacacagcaauuccucag

SEQ ID NO: 1477918 - RNA, 20 nt, Human
gucuauuuacggaacucaaa

SEQ ID NO: 1477919 - RNA, 13 nt, Human
gucuauucagcuu

SEQ ID NO: 1477920 - RNA, 13 nt, Human
gucuauucuaguc

SEQ ID NO: 1477921 - RNA, 19 nt, Human
aacauagacagaagaaaca

SEQ ID NO: 1477922 - RNA, 14 nt, Human
gucuaggacacagu

SEQ ID NO: 1477923 - RNA, 13 nt, Human
gucgauuagacug

SEQ ID NO: 1477924 - RNA, 14 nt, Human
gucgauuagacugg

SEQ ID NO: 1477925 - RNA, 20 nt, Human
guccuggaggggcuggggac

SEQ ID NO: 1477926 - RNA, 14 nt, Human
guccuggaggggcu

SEQ ID NO: 1477927 - RNA, 13 nt, Human
guccuggaggggc

SEQ ID NO: 1477928 - RNA, 22 nt, Human
guccuuucuagagcacugccac

SEQ ID NO: 1477929 - RNA, 23 nt, Human
aacauuccauccuugagucaaaa

SEQ ID NO: 1477930 - RNA, 19 nt, Human
aacauuccucaugaaugua

SEQ ID NO: 1477931 - RNA, 20 nt, Human
aacauuccucaugaauguaa

SEQ ID NO: 1477932 - RNA, 14 nt, Human
aacauuccauccuu

SEQ ID NO: 1477933 - RNA, 13 nt, Human
aacauuccauccu

SEQ ID NO: 1477934 - RNA, 10 nt, Human
aacauuccau

SEQ ID NO: 1477935 - RNA, 22 nt, Human
aacauuccucaugaauguaaau

SEQ ID NO: 1477936 - RNA, 21 nt, Human
aacauuccucaugaauguaaa

SEQ ID NO: 1477937 - RNA, 22 nt, Human
aacauaaaaaggacaucagcaa

SEQ ID NO: 1477938 - RNA, 20 nt, Human
aacauaaaaaggacaucagc

SEQ ID NO: 1477939 - RNA, 19 nt, Human
aacauaaaaaggacaucag

SEQ ID NO: 1477940 - RNA, 15 nt, Human
aacauaaaaaggaca

SEQ ID NO: 1477941 - RNA, 18 nt, Human
aacaguuuuccuaugcuu

SEQ ID NO: 1477942 - RNA, 20 nt, Human
aacaguuuuccuaugcuuug

SEQ ID NO: 1477943 - RNA, 12 nt, Human
aacaguuuuccu

SEQ ID NO: 1477944 - RNA, 21 nt, Human
aacaguuuuccuaugcuuuga

SEQ ID NO: 1477945 - RNA, 12 nt, Human
aacauauauaac

SEQ ID NO: 1477946 - RNA, 13 nt, Human
aacauaaaaauga

SEQ ID NO: 1477947 - RNA, 14 nt, Human
aacauaaaaaugau

SEQ ID NO: 1477948 - RNA, 21 nt, Human
aacauagacagaagaaacaag

SEQ ID NO: 1477949 - RNA, 18 nt, Human
gucacauuccugaacagg

SEQ ID NO: 1477950 - RNA, 15 nt, Human
gucacaggaaaaagu

SEQ ID NO: 1477951 - RNA, 19 nt, Human
aaauuuaaacuauaagcaa

SEQ ID NO: 1477952 - RNA, 16 nt, Human
gucacugacacacacg

SEQ ID NO: 1477953 - RNA, 12 nt, Human
gucacugagacc

SEQ ID NO: 1477954 - RNA, 14 nt, Human
gucaggaaagagaa

SEQ ID NO: 1477955 - RNA, 19 nt, Human
gucagaacagcagacucag

SEQ ID NO: 1477956 - RNA, 19 nt, Human
gucacuggaccacugggca

SEQ ID NO: 1477957 - RNA, 21 nt, Human
gucacugguagaccaaaauaa

SEQ ID NO: 1477958 - RNA, 17 nt, Human
gucacuguuccuuguca

SEQ ID NO: 1477959 - RNA, 16 nt, Human
gucagaacagcagacu

SEQ ID NO: 1477960 - RNA, 23 nt, Human
gucagugcugugcugugcuaugg

SEQ ID NO: 1477961 - RNA, 23 nt, Human
aaauuaugugccagauuuaugca

SEQ ID NO: 1477962 - RNA, 22 nt, Human
aaauuaugugacauuuuacauu

SEQ ID NO: 1477963 - RNA, 20 nt, Human
aaauuaugugacauuuuaca

SEQ ID NO: 1477964 - RNA, 17 nt, Human
aaauuaugugacauuuu

SEQ ID NO: 1477965 - RNA, 16 nt, Human
aaauucaacaaacauu

SEQ ID NO: 1477966 - RNA, 14 nt, Human
aaauucaacaaaca

SEQ ID NO: 1477967 - RNA, 16 nt, Human
aaauuaucuauagcua

SEQ ID NO: 1477968 - RNA, 13 nt, Human
aaauuacaacuaa

SEQ ID NO: 1477969 - RNA, 12 nt, Human
aaauuacaacua

SEQ ID NO: 1477970 - RNA, 16 nt, Human
aaauuacacccaaaga

SEQ ID NO: 1477971 - RNA, 22 nt, Human
aaauuacacccaaagagguauu

SEQ ID NO: 1477972 - RNA, 19 nt, Human
aaaugugggauuauggguc

SEQ ID NO: 1477973 - RNA, 17 nt, Human
aaauuguauuacaaauc

SEQ ID NO: 1477974 - RNA, 14 nt, Human
aaauuuaaacuaua

SEQ ID NO: 1477975 - RNA, 17 nt, Human
aaauuccaagugauuga

SEQ ID NO: 1477976 - RNA, 16 nt, Human
aaaucauucauuuucu

SEQ ID NO: 1477977 - RNA, 21 nt, Human
aaaucaugaagauauuuuucc

SEQ ID NO: 1477978 - RNA, 11 nt, Human
aaauguauacu

SEQ ID NO: 1477979 - RNA, 20 nt, Human
aaauguaucauagaaaugua

SEQ ID NO: 1477980 - RNA, 17 nt, Human
aaauguaucauagaaau

SEQ ID NO: 1477981 - RNA, 13 nt, Human
guauuuaucuuua

SEQ ID NO: 1477982 - RNA, 16 nt, Human
guauugugauuaucaa

SEQ ID NO: 1477983 - RNA, 14 nt, Human
aaaacaaggaugaa

SEQ ID NO: 1477984 - RNA, 15 nt, Human
aaaacaaaacugcau

SEQ ID NO: 1477985 - RNA, 17 nt, Human
aaaacaaggaugaauua

SEQ ID NO: 1477986 - RNA, 11 nt, Human
aaaaagauccc

SEQ ID NO: 1477987 - RNA, 14 nt, Human
aaaaagaucccaaa

SEQ ID NO: 1477988 - RNA, 14 nt, Human
aaaaagaagaaucu

SEQ ID NO: 1477989 - RNA, 17 nt, Human
aaaaagaaugaagccuc

SEQ ID NO: 1477990 - RNA, 18 nt, Human
aaaaagaagcaaccucag

SEQ ID NO: 1477991 - RNA, 15 nt, Human
aaaaacugagugacu

SEQ ID NO: 1477992 - RNA, 15 nt, Human
aguugaauuuuacau

SEQ ID NO: 1477993 - RNA, 10 nt, Human
aguugaauuu

SEQ ID NO: 1477994 - RNA, 22 nt, Human
aguuacauaauucacucugagu

SEQ ID NO: 1477995 - RNA, 16 nt, Human
aguccaagcauuuaga

SEQ ID NO: 1477996 - RNA, 21 nt, Human
aguccaagcauuuagauguau

SEQ ID NO: 1477997 - RNA, 15 nt, Human
agucauucagauaug

SEQ ID NO: 1477998 - RNA, 20 nt, Human
agucauucagauaugauuca

SEQ ID NO: 1477999 - RNA, 23 nt, Human
agucauucagauaugauucaaau

SEQ ID NO: 1478000 - RNA, 15 nt, Human
agucaaauuguguga

SEQ ID NO: 1478001 - RNA, 17 nt, Human
agucaaauugugugaaa

SEQ ID NO: 1478002 - RNA, 13 nt, Human
agucaaauugugu

SEQ ID NO: 1478003 - RNA, 14 nt, Human
agugaucaaacuac

SEQ ID NO: 1478004 - RNA, 14 nt, Human
aguccuggaagcca

SEQ ID NO: 1478005 - RNA, 20 nt, Human
aguccuggaagccagcuuuc

SEQ ID NO: 1478006 - RNA, 22 nt, Human
aguccuggaagccagcuuuccc

SEQ ID NO: 1478007 - RNA, 23 nt, Human
aguccuggaagccagcuuucccu

SEQ ID NO: 1478008 - RNA, 18 nt, Human
aguccacccuugguuccu

SEQ ID NO: 1478009 - RNA, 18 nt, Human
auaucacuugucaauaaa

SEQ ID NO: 1478010 - RNA, 21 nt, Human
auauccaugaccuaguuuucc

SEQ ID NO: 1478011 - RNA, 13 nt, Human
auaucccacuggg

SEQ ID NO: 1478012 - RNA, 14 nt, Human
auaugcuuacugau

SEQ ID NO: 1478013 - RNA, 20 nt, Human
auaucccuccuguugggaga

SEQ ID NO: 1478014 - RNA, 13 nt, Human
auauccugcuuga

SEQ ID NO: 1478015 - RNA, 23 nt, Human
auauuucagauaaucacaauaca

SEQ ID NO: 1478016 - RNA, 19 nt, Human
auauuuauuuuuuuuaagu

SEQ ID NO: 1478017 - RNA, 16 nt, Human
auauuuauaaaaauaa

SEQ ID NO: 1478018 - RNA, 18 nt, Human
auauuuaguguucauaaa

SEQ ID NO: 1478019 - RNA, 14 nt, Human
auauuuauuacugu

SEQ ID NO: 1478020 - RNA, 19 nt, Human
auauuuauuacuguaagaa

SEQ ID NO: 1478021 - RNA, 18 nt, Human
auauuuauuuuaauaaug

SEQ ID NO: 1478022 - RNA, 22 nt, Human
auauuuauuacuguaagaaaau

SEQ ID NO: 1478023 - RNA, 21 nt, Human
auauuuauuuucuuucuguaa

SEQ ID NO: 1478024 - RNA, 12 nt, Human
auauaauucuua

SEQ ID NO: 1478025 - RNA, 18 nt, Human
auauaauuguuuuaucug

SEQ ID NO: 1478026 - RNA, 17 nt, Human
auauaccaaagcacauu

SEQ ID NO: 1478027 - RNA, 22 nt, Human
auauacuauuaaaaagguuuac

SEQ ID NO: 1478028 - RNA, 19 nt, Human
auauacucacuuucuagau

SEQ ID NO: 1478029 - RNA, 12 nt, Human
auauaccaaagc

SEQ ID NO: 1478030 - RNA, 17 nt, Human
auauagcugaucaguuu

SEQ ID NO: 1478031 - RNA, 18 nt, Human
auauagcugaucaguuuu

SEQ ID NO: 1478032 - RNA, 15 nt, Human
auauaaguguguguu

SEQ ID NO: 1478033 - RNA, 15 nt, Human
auauaagugauugcu

SEQ ID NO: 1478034 - RNA, 16 nt, Human
auacuugaaaauuaac

SEQ ID NO: 1478035 - RNA, 15 nt, Human
auacuugaaaauuaa

SEQ ID NO: 1478036 - RNA, 19 nt, Human
auacuugaaaauuaacaug

SEQ ID NO: 1478037 - RNA, 16 nt, Human
auacuucucauuuuuu

SEQ ID NO: 1478038 - RNA, 19 nt, Human
auaaguauuuaauucaugu

SEQ ID NO: 1478039 - RNA, 22 nt, Human
auaaguguguguuuuucauaaa

SEQ ID NO: 1478040 - RNA, 19 nt, Human
auaaguguguguuuuucau

SEQ ID NO: 1478041 - RNA, 22 nt, Human
auacccucccucccuacccuaa

SEQ ID NO: 1478042 - RNA, 16 nt, Human
auacccucccucccua

SEQ ID NO: 1478043 - RNA, 14 nt, Human
auacccucccuccc

SEQ ID NO: 1478044 - RNA, 20 nt, Human
auaccugauuuuuuuuccuu

SEQ ID NO: 1478045 - RNA, 21 nt, Human
auaccuaagaaguacauuguu

SEQ ID NO: 1478046 - RNA, 15 nt, Human
auaccuaagaaguac

SEQ ID NO: 1478047 - RNA, 19 nt, Human
auacuuauauggaaauucu

SEQ ID NO: 1478048 - RNA, 18 nt, Human
auguuucuuuguaaugaa

SEQ ID NO: 1478049 - RNA, 18 nt, Human
auguguauuacaaauauu

SEQ ID NO: 1478050 - RNA, 22 nt, Human
auguguacaaaaguuucauccu

SEQ ID NO: 1478051 - RNA, 21 nt, Human
auguuugcaccuuucuaguug

SEQ ID NO: 1478052 - RNA, 21 nt, Human
auguuugauagauuuucugcu

SEQ ID NO: 1478053 - RNA, 17 nt, Human
auguuugcaccuuucua

SEQ ID NO: 1478054 - RNA, 19 nt, Human
auguuugcaccuuucuagu

SEQ ID NO: 1478055 - RNA, 22 nt, Human
auguuugcaccuuucuaguuga

SEQ ID NO: 1478056 - RNA, 16 nt, Human
auguaaguaaacgguc

SEQ ID NO: 1478057 - RNA, 22 nt, Human
auguaauaagguugaacacuuu

SEQ ID NO: 1478058 - RNA, 16 nt, Human
auguaagcugaaaaua

SEQ ID NO: 1478059 - RNA, 16 nt, Human
auguaacuuuuguaag

SEQ ID NO: 1478060 - RNA, 17 nt, Human
auguaacuuuuguaaga

SEQ ID NO: 1478061 - RNA, 18 nt, Human
auguaacuuuuguaagac

SEQ ID NO: 1478062 - RNA, 17 nt, Human
auguacauguacugauu

SEQ ID NO: 1478063 - RNA, 16 nt, Human
augucaaucagccuag

SEQ ID NO: 1478064 - RNA, 22 nt, Human
augucaaggguucaagauuguu

SEQ ID NO: 1478065 - RNA, 14 nt, Human
augucaaacaaaua

SEQ ID NO: 1478066 - RNA, 18 nt, Human
auggcuggagcuagaauu

SEQ ID NO: 1478067 - RNA, 20 nt, Human
auggcugauaauuuuaaauu

SEQ ID NO: 1478068 - RNA, 12 nt, Human
auggauucuaaa

SEQ ID NO: 1478069 - RNA, 20 nt, Human
auggaaauucccuucaucug

SEQ ID NO: 1478070 - RNA, 18 nt, Human
auggaaauucugcucaga

SEQ ID NO: 1478071 - RNA, 16 nt, Human
augcuugcaaaaacua

SEQ ID NO: 1478072 - RNA, 19 nt, Human
augcuugcaaaaacuacaa

SEQ ID NO: 1478073 - RNA, 17 nt, Human
augcuugcauaagagcu

SEQ ID NO: 1478074 - RNA, 18 nt, Human
augcuugcauaagagcuu

SEQ ID NO: 1478075 - RNA, 21 nt, Human
augccuuuguacuuuagggaa

SEQ ID NO: 1478076 - RNA, 14 nt, Human
augccuuuucccaa

SEQ ID NO: 1478077 - RNA, 14 nt, Human
augcauuguccucu

SEQ ID NO: 1478078 - RNA, 12 nt, Human
augcauggaaau

SEQ ID NO: 1478079 - RNA, 17 nt, Human
augcacaguaaaaaugg

SEQ ID NO: 1478080 - RNA, 23 nt, Human
augaaaaaauauauaucaaauau

SEQ ID NO: 1478081 - RNA, 22 nt, Human
augaaaaaauauauaucaaaua

SEQ ID NO: 1478082 - RNA, 17 nt, Human
augaaaaaauauauauc

SEQ ID NO: 1478083 - RNA, 14 nt, Human
augaaaaaauauau

SEQ ID NO: 1478084 - RNA, 14 nt, Human
augaaaauaaagaa

SEQ ID NO: 1478085 - RNA, 17 nt, Human
augaaaauaaagaaugg

SEQ ID NO: 1478086 - RNA, 15 nt, Human
augaaaauaaagaau

SEQ ID NO: 1478087 - RNA, 13 nt, Human
augaaaagcuaga

SEQ ID NO: 1478088 - RNA, 18 nt, Human
augaaaagcuagaauuga

SEQ ID NO: 1478089 - RNA, 18 nt, Human
augaaacagaaacaaaaa

SEQ ID NO: 1478090 - RNA, 22 nt, Human
augaaacagaaacaaaaacacu

SEQ ID NO: 1478091 - RNA, 13 nt, Human
augaaacagaaac

SEQ ID NO: 1478092 - RNA, 16 nt, Human
augacuauguaaacua

SEQ ID NO: 1478093 - RNA, 15 nt, Human
augacuauguaaacu

SEQ ID NO: 1478094 - RNA, 21 nt, Human
augaagcuuuuaugugaaaca

SEQ ID NO: 1478095 - RNA, 20 nt, Human
augaagcuuuuaugugaaac

SEQ ID NO: 1478096 - RNA, 19 nt, Human
augaagcuuuuaugugaaa

SEQ ID NO: 1478097 - RNA, 18 nt, Human
augaagcuuuuaugugaa

SEQ ID NO: 1478098 - RNA, 18 nt, Human
augaccuaguuuuccaug

SEQ ID NO: 1478099 - RNA, 22 nt, Human
aucuuauaauuuaaaauaugcu

SEQ ID NO: 1478100 - RNA, 17 nt, Human
aucugggcugugggcaa

SEQ ID NO: 1478101 - RNA, 19 nt, Human
aucaucucagcucacugca

SEQ ID NO: 1478102 - RNA, 14 nt, Human
aucaucucagcuca

SEQ ID NO: 1478103 - RNA, 13 nt, Human
aucaucucagcuc

SEQ ID NO: 1478104 - RNA, 19 nt, Human
aucaucuauagaaagcuau

SEQ ID NO: 1478105 - RNA, 15 nt, Human
aucaucuauagaaag

SEQ ID NO: 1478106 - RNA, 15 nt, Human
aucauggcuaucugu

SEQ ID NO: 1478107 - RNA, 13 nt, Human
aucagccagugac

SEQ ID NO: 1478108 - RNA, 16 nt, Human
aucagccuacaggccu

SEQ ID NO: 1478109 - RNA, 20 nt, Human
auccacccgccucagccucc

SEQ ID NO: 1478110 - RNA, 13 nt, Human
auccccuucuccc

SEQ ID NO: 1478111 - RNA, 15 nt, Human
auccccuucuccccu

SEQ ID NO: 1478112 - RNA, 20 nt, Human
auccccuucuccccugcacu

SEQ ID NO: 1478113 - RNA, 21 nt, Human
auccccuucuccccugcacug

SEQ ID NO: 1478114 - RNA, 22 nt, Human
auccccuucuccccugcacugu

SEQ ID NO: 1478115 - RNA, 23 nt, Human
auccccuucuccccugcacugua

SEQ ID NO: 1478116 - RNA, 12 nt, Human
auccccuugaac

SEQ ID NO: 1478117 - RNA, 16 nt, Human
auccccuugaacucuu

SEQ ID NO: 1478118 - RNA, 19 nt, Human
aucccucacccauccuaga

SEQ ID NO: 1478119 - RNA, 12 nt, Human
aucccucaccca

SEQ ID NO: 1478120 - RNA, 14 nt, Human
aucccuagcuguga

SEQ ID NO: 1478121 - RNA, 20 nt, Human
auccuccuaccuccaaagcu

SEQ ID NO: 1478122 - RNA, 20 nt, Human
aucgauuuuuaaaaauuaaa

SEQ ID NO: 1478123 - RNA, 20 nt, Human
aucgcagaccuuuuuuagga

SEQ ID NO: 1478124 - RNA, 15 nt, Human
aggaacuacugagga

SEQ ID NO: 1478125 - RNA, 16 nt, Human
aggaggggcuguaaaa

SEQ ID NO: 1478126 - RNA, 19 nt, Human
aggcacugcaaaccgccac

SEQ ID NO: 1478127 - RNA, 14 nt, Human
agcuguaugauucc

SEQ ID NO: 1478128 - RNA, 18 nt, Human
agcuuuucccaaaagccc

SEQ ID NO: 1478129 - RNA, 23 nt, Human
aggaaaugugguagccucacuuu

SEQ ID NO: 1478130 - RNA, 15 nt, Human
agcuuuucccuuuuu

SEQ ID NO: 1478131 - RNA, 19 nt, Human
agcuucucauccugcaggc

SEQ ID NO: 1478132 - RNA, 12 nt, Human
agcuucuccaac

SEQ ID NO: 1478133 - RNA, 20 nt, Human
agcuucguuuauuuucaaga

SEQ ID NO: 1478134 - RNA, 17 nt, Human
agcuucagugcugccga

SEQ ID NO: 1478135 - RNA, 16 nt, Human
agcugaccagccguga

SEQ ID NO: 1478136 - RNA, 19 nt, Human
agcugaccagccgugagca

SEQ ID NO: 1478137 - RNA, 22 nt, Human
agcugaccagccgugagcaugu

SEQ ID NO: 1478138 - RNA, 13 nt, Human
agcugaucaguuu

SEQ ID NO: 1478139 - RNA, 17 nt, Human
aggggcagagccaggaa

SEQ ID NO: 1478140 - RNA, 16 nt, Human
aggggcagagccagga

SEQ ID NO: 1478141 - RNA, 15 nt, Human
aggggcagagccagg

SEQ ID NO: 1478142 - RNA, 14 nt, Human
aggggcagagccag

SEQ ID NO: 1478143 - RNA, 13 nt, Human
aggggcagagcca

SEQ ID NO: 1478144 - RNA, 14 nt, Human
agggcgcaggccgu

SEQ ID NO: 1478145 - RNA, 17 nt, Human
agggcggggguggcggc

SEQ ID NO: 1478146 - RNA, 18 nt, Human
agggcaauuaauuccuuc

SEQ ID NO: 1478147 - RNA, 22 nt, Human
agggcaauuaauuccuucagca

SEQ ID NO: 1478148 - RNA, 19 nt, Human
agggcaauuaauuccuuca

SEQ ID NO: 1478149 - RNA, 17 nt, Human
agggacucaucuuuccc

SEQ ID NO: 1478150 - RNA, 22 nt, Human
agggacucaucuuucccuccuu

SEQ ID NO: 1478151 - RNA, 21 nt, Human
agggacucaucuuucccuccu

SEQ ID NO: 1478152 - RNA, 19 nt, Human
agggacucaucuuucccuc

SEQ ID NO: 1478153 - RNA, 18 nt, Human
agggacucaucuuucccu

SEQ ID NO: 1478154 - RNA, 23 nt, Human
agggacucaucuuucccuccuug

SEQ ID NO: 1478155 - RNA, 18 nt, Human
aggcuguguuuggcuuuc

SEQ ID NO: 1478156 - RNA, 20 nt, Human
aggcuguguuuggcuuucag

SEQ ID NO: 1478157 - RNA, 21 nt, Human
aggcuguguuuggcuuucagg

SEQ ID NO: 1478158 - RNA, 22 nt, Human
aggcuguguuuggcuuucaggg

SEQ ID NO: 1478159 - RNA, 15 nt, Human
aggcugauuucuagg

SEQ ID NO: 1478160 - RNA, 21 nt, Human
aggcagacucuuuaugcuugc

SEQ ID NO: 1478161 - RNA, 20 nt, Human
aggcagacucuuuaugcuug

SEQ ID NO: 1478162 - RNA, 15 nt, Human
agguggaaauaaacu

SEQ ID NO: 1478163 - RNA, 21 nt, Human
aggugcuucuaguucugccag

SEQ ID NO: 1478164 - RNA, 22 nt, Human
aggugcuucuaguucugccagg

SEQ ID NO: 1478165 - RNA, 21 nt, Human
aggugcuucaggauaccauau

SEQ ID NO: 1478166 - RNA, 23 nt, Human
aggugcuucuaguucugccagga

SEQ ID NO: 1478167 - RNA, 20 nt, Human
agguccuuaggccucugaga

SEQ ID NO: 1478168 - RNA, 17 nt, Human
agguucaugcaaacuuu

SEQ ID NO: 1478169 - RNA, 19 nt, Human
agguucaagcaauccuccc

SEQ ID NO: 1478170 - RNA, 14 nt, Human
agguucaacuuauu

SEQ ID NO: 1478171 - RNA, 17 nt, Human
aggucccuaauaaagcu

SEQ ID NO: 1478172 - RNA, 19 nt, Human
aggucccuaauaaagcugu

SEQ ID NO: 1478173 - RNA, 18 nt, Human
aggucccuaauaaagcug

SEQ ID NO: 1478174 - RNA, 20 nt, Human
aggucccuaauaaagcugug

SEQ ID NO: 1478175 - RNA, 23 nt, Human
aggucccuaauaaagcugugugg

SEQ ID NO: 1478176 - RNA, 13 nt, Human
agguaaguuuuuu

SEQ ID NO: 1478177 - RNA, 17 nt, Human
aggggccgggggcaguc

SEQ ID NO: 1478178 - RNA, 18 nt, Human
agccagauuuuuuaaaau

SEQ ID NO: 1478179 - RNA, 23 nt, Human
agccagauuuuuuaaaauuuaua

SEQ ID NO: 1478180 - RNA, 22 nt, Human
agccagauuuuuuaaaauuuau

SEQ ID NO: 1478181 - RNA, 15 nt, Human
agccagauuuuccug

SEQ ID NO: 1478182 - RNA, 19 nt, Human
agccagauuuuccugaaaa

SEQ ID NO: 1478183 - RNA, 15 nt, Human
agccauguuucacaa

SEQ ID NO: 1478184 - RNA, 15 nt, Human
agcaugcaucuguuu

SEQ ID NO: 1478185 - RNA, 14 nt, Human
agcaugcacaaauu

SEQ ID NO: 1478186 - RNA, 19 nt, Human
agcaguugagacaagaaaa

SEQ ID NO: 1478187 - RNA, 22 nt, Human
agcaguugagacaagaaaauaa

SEQ ID NO: 1478188 - RNA, 20 nt, Human
agcaguugagacaagaaaau

SEQ ID NO: 1478189 - RNA, 12 nt, Human
agcacugcucca

SEQ ID NO: 1478190 - RNA, 17 nt, Human
agcacgugguaaaacac

SEQ ID NO: 1478191 - RNA, 17 nt, Human
agccucccugaagacca

SEQ ID NO: 1478192 - RNA, 23 nt, Human
agacuacaggcacacaccaccac

SEQ ID NO: 1478193 - RNA, 14 nt, Human
agacgggcccuggu

SEQ ID NO: 1478194 - RNA, 19 nt, Human
agaccaaggcuuucucuac

SEQ ID NO: 1478195 - RNA, 13 nt, Human
agaccaccaagcc

SEQ ID NO: 1478196 - RNA, 14 nt, Human
agaccaccaagccu

SEQ ID NO: 1478197 - RNA, 13 nt, Human
agagaaggagcag

SEQ ID NO: 1478198 - RNA, 15 nt, Human
agagaagcaaguaaa

SEQ ID NO: 1478199 - RNA, 17 nt, Human
agacugcauuauauuua

SEQ ID NO: 1478200 - RNA, 21 nt, Human
agacugcauuauauuuauuac

SEQ ID NO: 1478201 - RNA, 14 nt, Human
agagcccugaggcc

SEQ ID NO: 1478202 - RNA, 18 nt, Human
agagcccugaggccuaga

SEQ ID NO: 1478203 - RNA, 22 nt, Human
agagcccugaggccuagacucu

SEQ ID NO: 1478204 - RNA, 16 nt, Human
agaggguguccugcac

SEQ ID NO: 1478205 - RNA, 16 nt, Human
agauacuuaagugcug

SEQ ID NO: 1478206 - RNA, 21 nt, Human
agauaggucagugcaaauacu

SEQ ID NO: 1478207 - RNA, 21 nt, Human
agaugaggccagaccauggac

SEQ ID NO: 1478208 - RNA, 16 nt, Human
agaugaggccagacca

SEQ ID NO: 1478209 - RNA, 14 nt, Human
agaugaggccagac

SEQ ID NO: 1478210 - RNA, 13 nt, Human
agaugaggccaga

SEQ ID NO: 1478211 - RNA, 22 nt, Human
agaugaggccagaccauggaca

SEQ ID NO: 1478212 - RNA, 16 nt, Human
aauggcugauaauuuu

SEQ ID NO: 1478213 - RNA, 15 nt, Human
aauggcugauaauuu

SEQ ID NO: 1478214 - RNA, 17 nt, Human
aauggcugauaauuuua

SEQ ID NO: 1478215 - RNA, 18 nt, Human
aauggcugauaauuuuaa

SEQ ID NO: 1478216 - RNA, 19 nt, Human
aauggcugauaauuuuaaa

SEQ ID NO: 1478217 - RNA, 16 nt, Human
aauggugccuucauuu

SEQ ID NO: 1478218 - RNA, 15 nt, Human
aauuaaagcuguuau

SEQ ID NO: 1478219 - RNA, 14 nt, Human
aauuaguuuuauau

SEQ ID NO: 1478220 - RNA, 17 nt, Human
aauuaguuuuauaugcu

SEQ ID NO: 1478221 - RNA, 20 nt, Human
aauuaguuuuauaugcuucu

SEQ ID NO: 1478222 - RNA, 12 nt, Human
aaugaagauacu

SEQ ID NO: 1478223 - RNA, 17 nt, Human
aaugauaacuggaaacu

SEQ ID NO: 1478224 - RNA, 22 nt, Human
aaugaacagaacauagacagaa

SEQ ID NO: 1478225 - RNA, 20 nt, Human
aaugauaacuggaaacuuca

SEQ ID NO: 1478226 - RNA, 17 nt, Human
aaugaagauacugaaau

SEQ ID NO: 1478227 - RNA, 18 nt, Human
aaucugcauuauuggaau

SEQ ID NO: 1478228 - RNA, 17 nt, Human
aaucucaucucagugaa

SEQ ID NO: 1478229 - RNA, 16 nt, Human
aaucugcauuauugga

SEQ ID NO: 1478230 - RNA, 17 nt, Human
aaucugcauuauuggaa

SEQ ID NO: 1478231 - RNA, 14 nt, Human
aaugaacagaacau

SEQ ID NO: 1478232 - RNA, 15 nt, Human
aaugaacagaacaua

SEQ ID NO: 1478233 - RNA, 13 nt, Human
aauccauacauuu

SEQ ID NO: 1478234 - RNA, 14 nt, Human
aauccauacauuug

SEQ ID NO: 1478235 - RNA, 13 nt, Human
aaucacaauacau

SEQ ID NO: 1478236 - RNA, 21 nt, Human
aaucaacuugcuuaucaacuu

SEQ ID NO: 1478237 - RNA, 14 nt, Human
aaucaauuaaaagu

SEQ ID NO: 1478238 - RNA, 15 nt, Human
aaucaacuugcuuau

SEQ ID NO: 1478239 - RNA, 17 nt, Human
aaucaacuugcuuauca

SEQ ID NO: 1478240 - RNA, 13 nt, Human
aaucaacuugcuu

SEQ ID NO: 1478241 - RNA, 20 nt, Human
aaucaauuacugguccaaaa

SEQ ID NO: 1478242 - RNA, 18 nt, Human
aaucaacuugcuuaucaa

SEQ ID NO: 1478243 - RNA, 16 nt, Human
aauauucaauaaagcu

SEQ ID NO: 1478244 - RNA, 15 nt, Human
aauauucaauaaagc

SEQ ID NO: 1478245 - RNA, 14 nt, Human
aauauucaauaaag

SEQ ID NO: 1478246 - RNA, 18 nt, Human
aauauuaugagaugcugg

SEQ ID NO: 1478247 - RNA, 16 nt, Human
aauauuauguuaaaac

SEQ ID NO: 1478248 - RNA, 14 nt, Human
aauauuaugagaug

SEQ ID NO: 1478249 - RNA, 16 nt, Human
aauauuaugagaugcu

SEQ ID NO: 1478250 - RNA, 16 nt, Human
aauauuauuccucaaa

SEQ ID NO: 1478251 - RNA, 12 nt, Human
aauauguaccaa

SEQ ID NO: 1478252 - RNA, 19 nt, Human
aauauguaccaagaaucuu

SEQ ID NO: 1478253 - RNA, 15 nt, Human
aauauguaccaagaa

SEQ ID NO: 1478254 - RNA, 22 nt, Human
aauauuaugagaugcuggcuug

SEQ ID NO: 1478255 - RNA, 15 nt, Human
aauauaauuguuuua

SEQ ID NO: 1478256 - RNA, 17 nt, Human
aauaaacgucuuaaaua

SEQ ID NO: 1478257 - RNA, 19 nt, Human
aauaaaauucaacaaacau

SEQ ID NO: 1478258 - RNA, 16 nt, Human
aauaaacgucuuaaau

SEQ ID NO: 1478259 - RNA, 18 nt, Human
aauaaaauucaacaaaca

SEQ ID NO: 1478260 - RNA, 22 nt, Human
aauaaaauucaacaaacauuug

SEQ ID NO: 1478261 - RNA, 19 nt, Human
aauaaacuauuuguaaagu

SEQ ID NO: 1478262 - RNA, 20 nt, Human
aaguuguuccuuaagucaga

SEQ ID NO: 1478263 - RNA, 20 nt, Human
aaguugugcuugagccagga

SEQ ID NO: 1478264 - RNA, 21 nt, Human
aaguggguuuuuuaguugaau

SEQ ID NO: 1478265 - RNA, 17 nt, Human
aaguggguuuuuuaguu

SEQ ID NO: 1478266 - RNA, 21 nt, Human
aauaauccuaaacauaugaau

SEQ ID NO: 1478267 - RNA, 20 nt, Human
aauaaucacgcuuuccugaa

SEQ ID NO: 1478268 - RNA, 21 nt, Human
aauaaucacgcuuuccugaau

SEQ ID NO: 1478269 - RNA, 21 nt, Human
aauaaguucaaauucuucuga

SEQ ID NO: 1478270 - RNA, 22 nt, Human
aauaaguucaaauucuucugaa

SEQ ID NO: 1478271 - RNA, 20 nt, Human
aauaaguuuuuguuucacag

SEQ ID NO: 1478272 - RNA, 19 nt, Human
aauaauguaagacaaauau

SEQ ID NO: 1478273 - RNA, 12 nt, Human
aauaauguaaga

SEQ ID NO: 1478274 - RNA, 20 nt, Human
aaguccaguguuucuuuuuu

SEQ ID NO: 1478275 - RNA, 23 nt, Human
aaguccaggcuuuuuuaucaugu

SEQ ID NO: 1478276 - RNA, 15 nt, Human
aaguacuuuuggcau

SEQ ID NO: 1478277 - RNA, 14 nt, Human
aaguacuuuuggca

SEQ ID NO: 1478278 - RNA, 15 nt, Human
aaguagaaaucauag

SEQ ID NO: 1478279 - RNA, 13 nt, Human
aaguagaaaucau

SEQ ID NO: 1478280 - RNA, 19 nt, Human
aaguaucaucaguguagaa

SEQ ID NO: 1478281 - RNA, 20 nt, Human
aaggugggaggaugugaauu

SEQ ID NO: 1478282 - RNA, 22 nt, Human
aaggugggaggaugugaauugu

SEQ ID NO: 1478283 - RNA, 19 nt, Human
aagucucuggaauuugaaa

SEQ ID NO: 1478284 - RNA, 14 nt, Human
aaggacuguaaucu

SEQ ID NO: 1478285 - RNA, 13 nt, Human
aaggcaaaaauag

SEQ ID NO: 1478286 - RNA, 21 nt, Human
aaggcaaaaauaguuuggaua

SEQ ID NO: 1478287 - RNA, 14 nt, Human
aaggauuuugcagu

SEQ ID NO: 1478288 - RNA, 15 nt, Human
aaggauuuugcaguu

SEQ ID NO: 1478289 - RNA, 21 nt, Human
aaggacuaugaaaagcuagaa

SEQ ID NO: 1478290 - RNA, 20 nt, Human
aagcuggagugcaguggcau

SEQ ID NO: 1478291 - RNA, 13 nt, Human
aagcuaaaauaaa

SEQ ID NO: 1478292 - RNA, 16 nt, Human
aagcuaaaauaaagaa

SEQ ID NO: 1478293 - RNA, 15 nt, Human
aagcuaaaauaaaga

SEQ ID NO: 1478294 - RNA, 15 nt, Human
aagcugccugguaua

SEQ ID NO: 1478295 - RNA, 20 nt, Human
aagcugccugguauauccaa

SEQ ID NO: 1478296 - RNA, 13 nt, Human
aagccaugcugga

SEQ ID NO: 1478297 - RNA, 15 nt, Human
aagccaugcuggaaa

SEQ ID NO: 1478298 - RNA, 21 nt, Human
aagccaugcuggaaaauaaua

SEQ ID NO: 1478299 - RNA, 20 nt, Human
aagccauggagauucucaua

SEQ ID NO: 1478300 - RNA, 22 nt, Human
aagccauggguagccugggugu

SEQ ID NO: 1478301 - RNA, 21 nt, Human
aagccauggguagccugggug

SEQ ID NO: 1478302 - RNA, 18 nt, Human
aagccauggguagccugg

SEQ ID NO: 1478303 - RNA, 22 nt, Human
aagaaauuaugugccagauuua

SEQ ID NO: 1478304 - RNA, 13 nt, Human
aagaaauuaugug

SEQ ID NO: 1478305 - RNA, 19 nt, Human
aagauugcuuaauaaauug

SEQ ID NO: 1478306 - RNA, 16 nt, Human
aagauugcugaaauuu

SEQ ID NO: 1478307 - RNA, 16 nt, Human
aagauuuaccacuugu

SEQ ID NO: 1478308 - RNA, 21 nt, Human
aagauugugucccauuccccc

SEQ ID NO: 1478309 - RNA, 15 nt, Human
aagauuguuccugcu

SEQ ID NO: 1478310 - RNA, 22 nt, Human
aagauuuccuucuuuuuuucuu

SEQ ID NO: 1478311 - RNA, 16 nt, Human
aagauuuccauauaaa

SEQ ID NO: 1478312 - RNA, 13 nt, Human
aagccagauuuuc

SEQ ID NO: 1478313 - RNA, 19 nt, Human
aagccagauuuuccugaaa

SEQ ID NO: 1478314 - RNA, 19 nt, Human
aagccagcugcccccagag

SEQ ID NO: 1478315 - RNA, 22 nt, Human
aagccagcugcccccagagcca

SEQ ID NO: 1478316 - RNA, 21 nt, Human
aagccagcugcccccagagcc

SEQ ID NO: 1478317 - RNA, 20 nt, Human
aagccagcugcccccagagc

SEQ ID NO: 1478318 - RNA, 12 nt, Human
aagccagcuuuc

SEQ ID NO: 1478319 - RNA, 14 nt, Human
aagccagcuuuccc

SEQ ID NO: 1478320 - RNA, 15 nt, Human
aagccagcuuucccu

SEQ ID NO: 1478321 - RNA, 17 nt, Human
aagccagcuuucccugc

SEQ ID NO: 1478322 - RNA, 23 nt, Human
aagccagcuuucccugccucuca

SEQ ID NO: 1478323 - RNA, 16 nt, Human
aagcagacauuuuaaa

SEQ ID NO: 1478324 - RNA, 22 nt, Human
aaagucucuggaauuugaaaca

SEQ ID NO: 1478325 - RNA, 20 nt, Human
aaagucucuggaauuugaaa

SEQ ID NO: 1478326 - RNA, 19 nt, Human
aaagucucuggaauuugaa

SEQ ID NO: 1478327 - RNA, 16 nt, Human
aaagggacugagaaau

SEQ ID NO: 1478328 - RNA, 20 nt, Human
aaagggacugagaaauuuau

SEQ ID NO: 1478329 - RNA, 12 nt, Human
aaauaacaauga

SEQ ID NO: 1478330 - RNA, 14 nt, Human
aaauaaagaaugga

SEQ ID NO: 1478331 - RNA, 13 nt, Human
aaauaaagaaaua

SEQ ID NO: 1478332 - RNA, 13 nt, Human
aaauaaagaaugg

SEQ ID NO: 1478333 - RNA, 16 nt, Human
aaauaaagaauggaaa

SEQ ID NO: 1478334 - RNA, 14 nt, Human
aaagugacccuguu

SEQ ID NO: 1478335 - RNA, 19 nt, Human
aaagugacuaauggcauga

SEQ ID NO: 1478336 - RNA, 14 nt, Human
aaagugagagcacg

SEQ ID NO: 1478337 - RNA, 23 nt, Human
aaauaacaaaucucaagcaaaca

SEQ ID NO: 1478338 - RNA, 14 nt, Human
aaauaacaaugugc

SEQ ID NO: 1478339 - RNA, 17 nt, Human
aaauaacaaugugcucu

SEQ ID NO: 1478340 - RNA, 19 nt, Human
aaauggccauuugcuuuuu

SEQ ID NO: 1478341 - RNA, 18 nt, Human
aaauauuuuaaagaauug

SEQ ID NO: 1478342 - RNA, 22 nt, Human
aaauggccauuugcuuuuucac

SEQ ID NO: 1478343 - RNA, 23 nt, Human
aaauggccauuugcuuuuucacc

SEQ ID NO: 1478344 - RNA, 18 nt, Human
aaauggcuuccuggcaau

SEQ ID NO: 1478345 - RNA, 17 nt, Human
aaauggaauacucuuau

SEQ ID NO: 1478346 - RNA, 13 nt, Human
aaauggaaacuau

SEQ ID NO: 1478347 - RNA, 19 nt, Human
aaaucuugucauguguaua

SEQ ID NO: 1478348 - RNA, 20 nt, Human
aaaucuugucauguguauaa

SEQ ID NO: 1478349 - RNA, 21 nt, Human
aaaucuugucauguguauaaa

SEQ ID NO: 1478350 - RNA, 20 nt, Human
aaaucuugguugaugccaaa

SEQ ID NO: 1478351 - RNA, 22 nt, Human
aaaucuugguugaugccaaaaa

SEQ ID NO: 1478352 - RNA, 14 nt, Human
aaaucuugucaugu

SEQ ID NO: 1478353 - RNA, 16 nt, Human
aaaucuugucaugugu

SEQ ID NO: 1478354 - RNA, 17 nt, Human
aaaucuugucaugugua

SEQ ID NO: 1478355 - RNA, 18 nt, Human
aaaucuugucauguguau

SEQ ID NO: 1478356 - RNA, 18 nt, Human
aaaucaacuugcuuauca

SEQ ID NO: 1478357 - RNA, 16 nt, Human
aaauagaagagagagg

SEQ ID NO: 1478358 - RNA, 12 nt, Human
aaauaguauuuc

SEQ ID NO: 1478359 - RNA, 23 nt, Human
aaauauuuuaaagaauuguguca

SEQ ID NO: 1478360 - RNA, 19 nt, Human
aaauauuuuaaagaauugu

SEQ ID NO: 1478361 - RNA, 23 nt, Human
aaauagucucuuuaaaaggaaag

SEQ ID NO: 1478362 - RNA, 16 nt, Human
aaauagggucuaacuc

SEQ ID NO: 1478363 - RNA, 20 nt, Human
aaauaguuuggauauguaaa

SEQ ID NO: 1478364 - RNA, 14 nt, Human
aaauaguuuggaua

SEQ ID NO: 1478365 - RNA, 21 nt, Human
aaauaguuuggauauguaaaa

SEQ ID NO: 1478366 - RNA, 13 nt, Human
aaacacucuugaa

SEQ ID NO: 1478367 - RNA, 17 nt, Human
aaacacucuugaaaaau

SEQ ID NO: 1478368 - RNA, 14 nt, Human
aaacacucuugaaa

SEQ ID NO: 1478369 - RNA, 18 nt, Human
aaaauucaacaaacauuu

SEQ ID NO: 1478370 - RNA, 24 nt, Human
aaacacuugcggauauucuggacu

SEQ ID NO: 1478371 - RNA, 15 nt, Human
aaacacuugcaaccu

SEQ ID NO: 1478372 - RNA, 16 nt, Human
aaacagauuguuugca

SEQ ID NO: 1478373 - RNA, 20 nt, Human
aaagaaaacuuguauuaugu

SEQ ID NO: 1478374 - RNA, 12 nt, Human
aaagaaaacuug

SEQ ID NO: 1478375 - RNA, 13 nt, Human
aaagaaaaacaaa

SEQ ID NO: 1478376 - RNA, 16 nt, Human
aaagaaaagaaaauuu

SEQ ID NO: 1478377 - RNA, 13 nt, Human
aaagaaaaccuuu

SEQ ID NO: 1478378 - RNA, 16 nt, Human
aaacugacucuuaaga

SEQ ID NO: 1478379 - RNA, 17 nt, Human
aaacugacucuuaagaa

SEQ ID NO: 1478380 - RNA, 11 nt, Human
aaagaacaucc

SEQ ID NO: 1478381 - RNA, 15 nt, Human
aaagaaauauaccua

SEQ ID NO: 1478382 - RNA, 15 nt, Human
aaagaaauuaugugc

SEQ ID NO: 1478383 - RNA, 13 nt, Human
aaagaaauuaugu

SEQ ID NO: 1478384 - RNA, 12 nt, Human
aaagaguacucu

SEQ ID NO: 1478385 - RNA, 17 nt, Human
aaagaguacucuuguuu

SEQ ID NO: 1478386 - RNA, 20 nt, Human
aaagauaucucaucucuucu

SEQ ID NO: 1478387 - RNA, 15 nt, Human
aacuuugcugagccu

SEQ ID NO: 1478388 - RNA, 15 nt, Human
aacuuugaaguuagc

SEQ ID NO: 1478389 - RNA, 11 nt, Human
aacuuuuguaa

SEQ ID NO: 1478390 - RNA, 21 nt, Human
aacuuuuguaagacaaagguu

SEQ ID NO: 1478391 - RNA, 20 nt, Human
aacuuuuuauugauuuuugg

SEQ ID NO: 1478392 - RNA, 23 nt, Human
aacuuuuuuauuuaaaaaacuaa

SEQ ID NO: 1478393 - RNA, 17 nt, Human
aacugauccagcaauua

SEQ ID NO: 1478394 - RNA, 17 nt, Human
aacugauucacaucuca

SEQ ID NO: 1478395 - RNA, 19 nt, Human
aacugauucacaucucauu

SEQ ID NO: 1478396 - RNA, 23 nt, Human
aaccagaucuagucaaucaaguc

SEQ ID NO: 1478397 - RNA, 14 nt, Human
aaccagaucauugu

SEQ ID NO: 1478398 - RNA, 22 nt, Human
aaccacuggaaaguuuaugguu

SEQ ID NO: 1478399 - RNA, 13 nt, Human
aacaugauuuggg

SEQ ID NO: 1478400 - RNA, 19 nt, Human
aacaucauuacuauaagaa

SEQ ID NO: 1478401 - RNA, 16 nt, Human
aacaugcacugauguu

SEQ ID NO: 1478402 - RNA, 19 nt, Human
aacaugcacugauguugug

SEQ ID NO: 1478403 - RNA, 14 nt, Human
aacaugcacugaug

SEQ ID NO: 1478404 - RNA, 22 nt, Human
aacccugucuggauccuauccu

SEQ ID NO: 1478405 - RNA, 17 nt, Human
aacaaagaaauuaugug

SEQ ID NO: 1478406 - RNA, 15 nt, Human
aacaaagaaauuaug

SEQ ID NO: 1478407 - RNA, 17 nt, Human
aacaaaacugcauuuca

SEQ ID NO: 1478408 - RNA, 18 nt, Human
aaauugcuuuguauugua

SEQ ID NO: 1478409 - RNA, 15 nt, Human
aaauugauuuugaac

SEQ ID NO: 1478410 - RNA, 14 nt, Human
aaauugauuuugaa

SEQ ID NO: 1478411 - RNA, 19 nt, Human
aacaagaagggacugagag

SEQ ID NO: 1478412 - RNA, 12 nt, Human
aacaagaauugg

SEQ ID NO: 1478413 - RNA, 15 nt, Human
aacaccaacauaaaa

SEQ ID NO: 1478414 - RNA, 17 nt, Human
aacaaagaguucaagaa

SEQ ID NO: 1478415 - RNA, 23 nt, Human
aacaaagaguucaagaaauaagu

SEQ ID NO: 1478416 - RNA, 19 nt, Human
aacaaagaguucaagaaau

SEQ ID NO: 1478417 - RNA, 14 nt, Human
acuagcuauggugu

SEQ ID NO: 1478418 - RNA, 15 nt, Human
acuagcccaaugaaa

SEQ ID NO: 1478419 - RNA, 17 nt, Human
acuagcccaaugaaaug

SEQ ID NO: 1478420 - RNA, 18 nt, Human
acuagcccuccuuuuucc

SEQ ID NO: 1478421 - RNA, 12 nt, Human
acuccccuccuu

SEQ ID NO: 1478422 - RNA, 11 nt, Human
acucagcucug

SEQ ID NO: 1478423 - RNA, 22 nt, Human
acucaggcccccaccuggcuca

SEQ ID NO: 1478424 - RNA, 23 nt, Human
acucaggcccccaccuggcucac

SEQ ID NO: 1478425 - RNA, 19 nt, Human
acucagcucugacauucug

SEQ ID NO: 1478426 - RNA, 20 nt, Human
acucaaaccaaaucacugaa

SEQ ID NO: 1478427 - RNA, 19 nt, Human
acucaaaccaaaucacuga

SEQ ID NO: 1478428 - RNA, 14 nt, Human
acucaaacugagga

SEQ ID NO: 1478429 - RNA, 21 nt, Human
acucaaacugaggaauuucac

SEQ ID NO: 1478430 - RNA, 17 nt, Human
acucaaaauauuuguac

SEQ ID NO: 1478431 - RNA, 19 nt, Human
acucaaaauauuuguacau

SEQ ID NO: 1478432 - RNA, 20 nt, Human
acucaaaauauuuguacaua

SEQ ID NO: 1478433 - RNA, 20 nt, Human
acuauaagcaagaaggcaaa

SEQ ID NO: 1478434 - RNA, 18 nt, Human
acuauaagaacuuugagc

SEQ ID NO: 1478435 - RNA, 19 nt, Human
acuauaagaacuuugagcu

SEQ ID NO: 1478436 - RNA, 15 nt, Human
acucaaaauauuugu

SEQ ID NO: 1478437 - RNA, 20 nt, Human
acuaguugugucuggcaguu

SEQ ID NO: 1478438 - RNA, 13 nt, Human
acuauaagaacuu

SEQ ID NO: 1478439 - RNA, 14 nt, Human
acuauaagaacuuu

SEQ ID NO: 1478440 - RNA, 23 nt, Human
acucaaacugaggaauuucaccu

SEQ ID NO: 1478441 - RNA, 16 nt, Human
acucagauccuccuca

SEQ ID NO: 1478442 - RNA, 17 nt, Human
acucagauccuccucau

SEQ ID NO: 1478443 - RNA, 21 nt, Human
acucuguucauuccuccaggu

SEQ ID NO: 1478444 - RNA, 22 nt, Human
acucuauauagcugaucaguuu

SEQ ID NO: 1478445 - RNA, 16 nt, Human
acuaagagagaaugag

SEQ ID NO: 1478446 - RNA, 16 nt, Human
acgccagacuucccac

SEQ ID NO: 1478447 - RNA, 22 nt, Human
acgccagacuucccacggcucc

SEQ ID NO: 1478448 - RNA, 17 nt, Human
accuguaugucuccagu

SEQ ID NO: 1478449 - RNA, 20 nt, Human
acuuauuguagcauccugga

SEQ ID NO: 1478450 - RNA, 20 nt, Human
acuuauuggaacucugcuug

SEQ ID NO: 1478451 - RNA, 23 nt, Human
acuuauuguagcauccuggaaua

SEQ ID NO: 1478452 - RNA, 21 nt, Human
acuuauuggaacucugcuuga

SEQ ID NO: 1478453 - RNA, 20 nt, Human
acuuguaaaggaauuuaaaa

SEQ ID NO: 1478454 - RNA, 19 nt, Human
acuuguaaaggaauuuaaa

SEQ ID NO: 1478455 - RNA, 20 nt, Human
acuucuuuugcucuuagcug

SEQ ID NO: 1478456 - RNA, 22 nt, Human
acuucugccagcauaauacuug

SEQ ID NO: 1478457 - RNA, 19 nt, Human
acuucuuuugcucuuagcu

SEQ ID NO: 1478458 - RNA, 15 nt, Human
acuggguaggaaaga

SEQ ID NO: 1478459 - RNA, 17 nt, Human
acuggaacuugaacuga

SEQ ID NO: 1478460 - RNA, 18 nt, Human
acuggaacuugaacugau

SEQ ID NO: 1478461 - RNA, 16 nt, Human
acugccaagacugcug

SEQ ID NO: 1478462 - RNA, 18 nt, Human
acugccaagacugcugug

SEQ ID NO: 1478463 - RNA, 19 nt, Human
acugccaagacugcugugg

SEQ ID NO: 1478464 - RNA, 20 nt, Human
acugccaagacugcuguggc

SEQ ID NO: 1478465 - RNA, 12 nt, Human
acugccaagcca

SEQ ID NO: 1478466 - RNA, 18 nt, Human
acugccaagccaugggua

SEQ ID NO: 1478467 - RNA, 15 nt, Human
acugccaagccaugg

SEQ ID NO: 1478468 - RNA, 18 nt, Human
agaaaaguugaauuuuac

SEQ ID NO: 1478469 - RNA, 21 nt, Human
agaaaaguugaauuuuacaug

SEQ ID NO: 1478470 - RNA, 16 nt, Human
acuuuucuuaaaccuu

SEQ ID NO: 1478471 - RNA, 24 nt, Human
acuuuucuuaaaccuucaguuaug

SEQ ID NO: 1478472 - RNA, 12 nt, Human
acuuuucuucua

SEQ ID NO: 1478473 - RNA, 18 nt, Human
acuuuucuucuauugccu

SEQ ID NO: 1478474 - RNA, 18 nt, Human
acuuuuccuuugaauccu

SEQ ID NO: 1478475 - RNA, 19 nt, Human
acuuuuccuuugaauccuc

SEQ ID NO: 1478476 - RNA, 17 nt, Human
acuuuuccucccucagu

SEQ ID NO: 1478477 - RNA, 14 nt, Human
acuuuuaaacugug

SEQ ID NO: 1478478 - RNA, 15 nt, Human
acuuuuaaacugugu

SEQ ID NO: 1478479 - RNA, 17 nt, Human
acuuuuaaacuguguac

SEQ ID NO: 1478480 - RNA, 22 nt, Human
agaaaauuuuuguaguagcguu

SEQ ID NO: 1478481 - RNA, 20 nt, Human
agaaaauuuuuguaguagcg

SEQ ID NO: 1478482 - RNA, 16 nt, Human
agaaaauuuuuguagu

SEQ ID NO: 1478483 - RNA, 14 nt, Human
agaaaauaacaaua

SEQ ID NO: 1478484 - RNA, 19 nt, Human
acuuuagggggugggauuc

SEQ ID NO: 1478485 - RNA, 23 nt, Human
acuuuagggaaguacuuuuggca

SEQ ID NO: 1478486 - RNA, 15 nt, Human
acuuucuagauuaag

SEQ ID NO: 1478487 - RNA, 12 nt, Human
acuuuuaaacag

SEQ ID NO: 1478488 - RNA, 15 nt, Human
acuuuuaaacaguga

SEQ ID NO: 1478489 - RNA, 13 nt, Human
acuuuuaaacugu

SEQ ID NO: 1478490 - RNA, 16 nt, Human
agaaaggauaaaguug

SEQ ID NO: 1478491 - RNA, 22 nt, Human
accccuaaaagaaacccugcac

SEQ ID NO: 1478492 - RNA, 21 nt, Human
accccuaaaagaaacccugca

SEQ ID NO: 1478493 - RNA, 12 nt, Human
accccuaggacu

SEQ ID NO: 1478494 - RNA, 12 nt, Human
accccgacuuuu

SEQ ID NO: 1478495 - RNA, 15 nt, Human
accccgacuuuuguu

SEQ ID NO: 1478496 - RNA, 16 nt, Human
accccuacaugaaaca

SEQ ID NO: 1478497 - RNA, 15 nt, Human
acauaaaaaggacau

SEQ ID NO: 1478498 - RNA, 22 nt, Human
acauaaaaaggacaucagcaaa

SEQ ID NO: 1478499 - RNA, 21 nt, Human
acauaaaaaggacaucagcaa

SEQ ID NO: 1478500 - RNA, 20 nt, Human
acauaaaaaggacaucagca

SEQ ID NO: 1478501 - RNA, 19 nt, Human
acauaaaaaugaucuaaac

SEQ ID NO: 1478502 - RNA, 15 nt, Human
acagguuagcugcuc

SEQ ID NO: 1478503 - RNA, 12 nt, Human
acauccagcaga

SEQ ID NO: 1478504 - RNA, 20 nt, Human
acaucccacucacaacagcu

SEQ ID NO: 1478505 - RNA, 12 nt, Human
acauaaaguuga

SEQ ID NO: 1478506 - RNA, 15 nt, Human
acauaaaguugauaa

SEQ ID NO: 1478507 - RNA, 20 nt, Human
acauaaauuuaguauuuugu

SEQ ID NO: 1478508 - RNA, 14 nt, Human
acauguuauuugua

SEQ ID NO: 1478509 - RNA, 22 nt, Human
acauuaaagaaggguugagcug

SEQ ID NO: 1478510 - RNA, 18 nt, Human
acauuugcucauggaauu

SEQ ID NO: 1478511 - RNA, 14 nt, Human
acauuuguauaaaa

SEQ ID NO: 1478512 - RNA, 20 nt, Human
accacgccuggcuaauuuuu

SEQ ID NO: 1478513 - RNA, 13 nt, Human
accacgccuggcu

SEQ ID NO: 1478514 - RNA, 14 nt, Human
accaagcugcugug

SEQ ID NO: 1478515 - RNA, 12 nt, Human
accaagccuuga

SEQ ID NO: 1478516 - RNA, 20 nt, Human
acaagucagucauucagaua

SEQ ID NO: 1478517 - RNA, 14 nt, Human
acaaguauuuguua

SEQ ID NO: 1478518 - RNA, 17 nt, Human
acaaguauuuguuaauu

SEQ ID NO: 1478519 - RNA, 20 nt, Human
acaaguauuuguuaauuuag

SEQ ID NO: 1478520 - RNA, 22 nt, Human
acaaguauuuguuaauuuagaa

SEQ ID NO: 1478521 - RNA, 13 nt, Human
acaacuauuuuca

SEQ ID NO: 1478522 - RNA, 15 nt, Human
acaacuauuuucaga

SEQ ID NO: 1478523 - RNA, 20 nt, Human
acaacuauuuucagauguga

SEQ ID NO: 1478524 - RNA, 16 nt, Human
acaacuauuuucagau

SEQ ID NO: 1478525 - RNA, 22 nt, Human
acaacuugucuauuaccuguua

SEQ ID NO: 1478526 - RNA, 13 nt, Human
acaaguaacaaaa

SEQ ID NO: 1478527 - RNA, 14 nt, Human
acaaguaacaaaaa

SEQ ID NO: 1478528 - RNA, 15 nt, Human
acaaguaacaaaaau

SEQ ID NO: 1478529 - RNA, 13 nt, Human
aauuuugaaaaac

SEQ ID NO: 1478530 - RNA, 18 nt, Human
aauuauaacuggaaagaa

SEQ ID NO: 1478531 - RNA, 19 nt, Human
aauuauaacuggaaagaag

SEQ ID NO: 1478532 - RNA, 19 nt, Human
acaaaauggaauacucuua

SEQ ID NO: 1478533 - RNA, 20 nt, Human
acaaaauggaauacucuuau

SEQ ID NO: 1478534 - RNA, 14 nt, Human
acaaaccaugcaaa

SEQ ID NO: 1478535 - RNA, 13 nt, Human
acaacuauauugu

SEQ ID NO: 1478536 - RNA, 16 nt, Human
acaaagaguucaagaa

SEQ ID NO: 1478537 - RNA, 12 nt, Human
acaaagaaccuu

SEQ ID NO: 1478538 - RNA, 14 nt, Human
acacaaacacacac

SEQ ID NO: 1478539 - RNA, 17 nt, Human
acaauguuuaaaccuuu

SEQ ID NO: 1478540 - RNA, 16 nt, Human
acaauuaaagcuguua

SEQ ID NO: 1478541 - RNA, 19 nt, Human
acaauuaaagcuguuauuu

SEQ ID NO: 1478542 - RNA, 14 nt, Human
acaaugugucugag

SEQ ID NO: 1478543 - RNA, 14 nt, Human
acacagaaaccaau

SEQ ID NO: 1478544 - RNA, 23 nt, Human
acacagacugcgauuugucccag

SEQ ID NO: 1478545 - RNA, 14 nt, Human
acacuaaaaauaaa

SEQ ID NO: 1478546 - RNA, 15 nt, Human
acagaagaaacuggg

SEQ ID NO: 1478547 - RNA, 14 nt, Human
acagaagaaacaag

SEQ ID NO: 1478548 - RNA, 15 nt, Human
acagaaguuugcacu

SEQ ID NO: 1478549 - RNA, 17 nt, Human
acagaaguuugcacuau

SEQ ID NO: 1478550 - RNA, 24 nt, Human
acagagguagucucacugcuugaa

SEQ ID NO: 1478551 - RNA, 13 nt, Human
acagcucuagaca

SEQ ID NO: 1478552 - RNA, 22 nt, Human
acagguaaaacagggccacaua

SEQ ID NO: 1478553 - RNA, 18 nt, Human
acagguaaacuaucuugg

SEQ ID NO: 1478554 - RNA, 22 nt, Human
acagguagaauuaucuaauuua

SEQ ID NO: 1478555 - RNA, 20 nt, Human
caaccucugccucccagguu

SEQ ID NO: 1478556 - RNA, 13 nt, Human
caaccggcuuugu

SEQ ID NO: 1478557 - RNA, 22 nt, Human
caaccggcuuuguggcacuggg

SEQ ID NO: 1478558 - RNA, 13 nt, Human
caacggagucaaa

SEQ ID NO: 1478559 - RNA, 20 nt, Human
caaccuguuaccuacuuuga

SEQ ID NO: 1478560 - RNA, 22 nt, Human
caaccuguuaccuacuuugacu

SEQ ID NO: 1478561 - RNA, 23 nt, Human
caaccuguuaccuacuuugacuu

SEQ ID NO: 1478562 - RNA, 17 nt, Human
caaauuucaugaccagu

SEQ ID NO: 1478563 - RNA, 12 nt, Human
caacacugccag

SEQ ID NO: 1478564 - RNA, 13 nt, Human
caacacugccagc

SEQ ID NO: 1478565 - RNA, 14 nt, Human
caacacugccagca

SEQ ID NO: 1478566 - RNA, 19 nt, Human
caagacugcacaucaaaau

SEQ ID NO: 1478567 - RNA, 20 nt, Human
caagaacacagcccugcuuc

SEQ ID NO: 1478568 - RNA, 20 nt, Human
caacuuuuccuuugaauccu

SEQ ID NO: 1478569 - RNA, 21 nt, Human
caagccagauuuuccugaaaa

SEQ ID NO: 1478570 - RNA, 15 nt, Human
caagccagauuuuuu

SEQ ID NO: 1478571 - RNA, 13 nt, Human
caagccagaacuu

SEQ ID NO: 1478572 - RNA, 18 nt, Human
caagccuaagggauccug

SEQ ID NO: 1478573 - RNA, 23 nt, Human
caagccugcacaauaaaaauguu

SEQ ID NO: 1478574 - RNA, 18 nt, Human
caaggaggggcuguaaaa

SEQ ID NO: 1478575 - RNA, 13 nt, Human
caaggucugcuuu

SEQ ID NO: 1478576 - RNA, 22 nt, Human
caaggggcuucagguccaggcu

SEQ ID NO: 1478577 - RNA, 14 nt, Human
caauuaauuuuaga

SEQ ID NO: 1478578 - RNA, 15 nt, Human
caauuaauuccuuca

SEQ ID NO: 1478579 - RNA, 18 nt, Human
caauuaauuccuucagca

SEQ ID NO: 1478580 - RNA, 15 nt, Human
caauguuagccucaa

SEQ ID NO: 1478581 - RNA, 13 nt, Human
caauguucaucau

SEQ ID NO: 1478582 - RNA, 22 nt, Human
caauguuagccucaauuucuga

SEQ ID NO: 1478583 - RNA, 19 nt, Human
caauuacaacggagucaaa

SEQ ID NO: 1478584 - RNA, 18 nt, Human
caaucuguaaaacuaaga

SEQ ID NO: 1478585 - RNA, 12 nt, Human
caaucuguaaac

SEQ ID NO: 1478586 - RNA, 15 nt, Human
caaucuguaaacugu

SEQ ID NO: 1478587 - RNA, 16 nt, Human
caaucuguaaacugug

SEQ ID NO: 1478588 - RNA, 17 nt, Human
caaucuguaaacugugu

SEQ ID NO: 1478589 - RNA, 18 nt, Human
caaucuguaaacugugua

SEQ ID NO: 1478590 - RNA, 16 nt, Human
caauauaagcuuuucu

SEQ ID NO: 1478591 - RNA, 23 nt, Human
caauacaucccuuaccugggaaa

SEQ ID NO: 1478592 - RNA, 13 nt, Human
caauaauuuucua

SEQ ID NO: 1478593 - RNA, 14 nt, Human
caauaauuuucuac

SEQ ID NO: 1478594 - RNA, 16 nt, Human
caaguuagaaaacaua

SEQ ID NO: 1478595 - RNA, 17 nt, Human
caaaaauuaucuauagc

SEQ ID NO: 1478596 - RNA, 21 nt, Human
caaauacgugggcauucaaau

SEQ ID NO: 1478597 - RNA, 22 nt, Human
caaauacgugggcauucaaaug

SEQ ID NO: 1478598 - RNA, 20 nt, Human
caaauacgugggcauucaaa

SEQ ID NO: 1478599 - RNA, 15 nt, Human
caaaugucuauaaac

SEQ ID NO: 1478600 - RNA, 14 nt, Human
caaaugucuauaaa

SEQ ID NO: 1478601 - RNA, 14 nt, Human
caaauuaucuuaaa

SEQ ID NO: 1478602 - RNA, 21 nt, Human
caaauuguaagcaugcacaaa

SEQ ID NO: 1478603 - RNA, 15 nt, Human
caaauugugugaaag

SEQ ID NO: 1478604 - RNA, 18 nt, Human
caaauugugcaguacuuu

SEQ ID NO: 1478605 - RNA, 21 nt, Human
caaaggcauuauaaaaagaau

SEQ ID NO: 1478606 - RNA, 14 nt, Human
caaacuguaauaca

SEQ ID NO: 1478607 - RNA, 15 nt, Human
caaagcccuuuuaua

SEQ ID NO: 1478608 - RNA, 16 nt, Human
caaaauuuuuucucua

SEQ ID NO: 1478609 - RNA, 21 nt, Human
caaaauuuuuucucuaggaaa

SEQ ID NO: 1478610 - RNA, 22 nt, Human
caaaauuuuuucucuaggaaau

SEQ ID NO: 1478611 - RNA, 16 nt, Human
caaacacacacaaaag

SEQ ID NO: 1478612 - RNA, 16 nt, Human
caaacaccaacauaaa

SEQ ID NO: 1478613 - RNA, 16 nt, Human
caaaauuguuacaaau

SEQ ID NO: 1478614 - RNA, 22 nt, Human
caaaauguugaaauaugauguu

SEQ ID NO: 1478615 - RNA, 17 nt, Human
caaaauguuggucauuu

SEQ ID NO: 1478616 - RNA, 18 nt, Human
caaaauguuggucauuuu

SEQ ID NO: 1478617 - RNA, 21 nt, Human
caaaauguuggucauuuuaug

SEQ ID NO: 1478618 - RNA, 19 nt, Human
caaaaaucucaauauuuca

SEQ ID NO: 1478619 - RNA, 14 nt, Human
caaaaauagcuaaa

SEQ ID NO: 1478620 - RNA, 19 nt, Human
caaaaauuaucuauagcua

SEQ ID NO: 1478621 - RNA, 14 nt, Human
caaaagaagaaguu

SEQ ID NO: 1478622 - RNA, 15 nt, Human
caaaagaagaaguuu

SEQ ID NO: 1478623 - RNA, 14 nt, Human
caaaacaauguuua

SEQ ID NO: 1478624 - RNA, 18 nt, Human
caaaacaauguuuaaacc

SEQ ID NO: 1478625 - RNA, 16 nt, Human
caaaacaauguuuaaa

SEQ ID NO: 1478626 - RNA, 13 nt, Human
caaaacagauugu

SEQ ID NO: 1478627 - RNA, 18 nt, Human
caaaacagauuguuugca

SEQ ID NO: 1478628 - RNA, 21 nt, Human
caaaacaguauugacuuguau

SEQ ID NO: 1478629 - RNA, 20 nt, Human
caaaaagaaaagaaaauuuu

SEQ ID NO: 1478630 - RNA, 14 nt, Human
caaaaacaaaaaga

SEQ ID NO: 1478631 - RNA, 10 nt, Human
auuuuguaaa

SEQ ID NO: 1478632 - RNA, 17 nt, Human
auuuuguaaacucaaaa

SEQ ID NO: 1478633 - RNA, 19 nt, Human
caaaaaauuaaagcauuua

SEQ ID NO: 1478634 - RNA, 15 nt, Human
caaaaaauuaaagca

SEQ ID NO: 1478635 - RNA, 18 nt, Human
caaaaaauuaaagcauuu

SEQ ID NO: 1478636 - RNA, 13 nt, Human
auuuuccugaaaa

SEQ ID NO: 1478637 - RNA, 14 nt, Human
auuuuccuuuucaa

SEQ ID NO: 1478638 - RNA, 16 nt, Human
auuuucuaagaaacau

SEQ ID NO: 1478639 - RNA, 17 nt, Human
auuuucuaagaaacauu

SEQ ID NO: 1478640 - RNA, 22 nt, Human
auuuucuaagaaacauuuauau

SEQ ID NO: 1478641 - RNA, 21 nt, Human
auuuucuaccuggucucuccu

SEQ ID NO: 1478642 - RNA, 19 nt, Human
cacagugaucaaguuauuu

SEQ ID NO: 1478643 - RNA, 14 nt, Human
cacaguuccuggga

SEQ ID NO: 1478644 - RNA, 13 nt, Human
cacaguuccccua

SEQ ID NO: 1478645 - RNA, 18 nt, Human
cacauacucauuuuucau

SEQ ID NO: 1478646 - RNA, 19 nt, Human
cacauacucauuuuucaug

SEQ ID NO: 1478647 - RNA, 14 nt, Human
uuuucaaaagaaag

SEQ ID NO: 1478648 - RNA, 14 nt, Human
uuuuauuuugccaa

SEQ ID NO: 1478649 - RNA, 19 nt, Human
uuuuaucugaaaucaauua

SEQ ID NO: 1478650 - RNA, 20 nt, Human
uuuuaucugaaaucaauuaa

SEQ ID NO: 1478651 - RNA, 21 nt, Human
uuuuaucugaaaucaauuaaa

SEQ ID NO: 1478652 - RNA, 23 nt, Human
uuuuaucugaauuuuuaaacaag

SEQ ID NO: 1478653 - RNA, 20 nt, Human
uuuuaucugaguuacagaaa

SEQ ID NO: 1478654 - RNA, 19 nt, Human
uuuuaugagaaagccuucu

SEQ ID NO: 1478655 - RNA, 13 nt, Human
uuuuauauuugaa

SEQ ID NO: 1478656 - RNA, 18 nt, Human
uuuuauauuugaaauauu

SEQ ID NO: 1478657 - RNA, 21 nt, Human
uuuuaaaguaacccuacaaaa

SEQ ID NO: 1478658 - RNA, 13 nt, Human
uuuuaaacugugu

SEQ ID NO: 1478659 - RNA, 20 nt, Human
uuuuaaacuguguacauaac

SEQ ID NO: 1478660 - RNA, 23 nt, Human
uuuuaaacuguguacauaacuga

SEQ ID NO: 1478661 - RNA, 12 nt, Human
uuuuacaaagcc

SEQ ID NO: 1478662 - RNA, 17 nt, Human
uuuuacaaguaacaaaa

SEQ ID NO: 1478663 - RNA, 12 nt, Human
uuuuacaaguaa

SEQ ID NO: 1478664 - RNA, 18 nt, Human
uuuuacaaguaacaaaaa

SEQ ID NO: 1478665 - RNA, 19 nt, Human
uuuuacguccaucucuugu

SEQ ID NO: 1478666 - RNA, 23 nt, Human
uuuuauaauuuugugaagcaaaa

SEQ ID NO: 1478667 - RNA, 21 nt, Human
uuuuauaauuuugugaagcaa

SEQ ID NO: 1478668 - RNA, 21 nt, Human
uuuucaaaauuguuacaaauu

SEQ ID NO: 1478669 - RNA, 18 nt, Human
uuuucaacagugaagaca

SEQ ID NO: 1478670 - RNA, 22 nt, Human
uuuucaacagugaagacagaag

SEQ ID NO: 1478671 - RNA, 16 nt, Human
uuuucacauuggaaac

SEQ ID NO: 1478672 - RNA, 18 nt, Human
uuuucacauuagaagaca

SEQ ID NO: 1478673 - RNA, 12 nt, Human
uuuucacauuuu

SEQ ID NO: 1478674 - RNA, 19 nt, Human
uuuucaccagauuugcuaa

SEQ ID NO: 1478675 - RNA, 23 nt, Human
uuuucaccuggaagcauuuguuu

SEQ ID NO: 1478676 - RNA, 20 nt, Human
uuuugaaauuaugugacauu

SEQ ID NO: 1478677 - RNA, 20 nt, Human
uuuuccuaagugauuguaug

SEQ ID NO: 1478678 - RNA, 13 nt, Human
uuuuccuaaguga

SEQ ID NO: 1478679 - RNA, 17 nt, Human
uuuuccuagcccucuca

SEQ ID NO: 1478680 - RNA, 18 nt, Human
uuugcauaacguauaaaa

SEQ ID NO: 1478681 - RNA, 17 nt, Human
uuugcaguucuuuggcu

SEQ ID NO: 1478682 - RNA, 16 nt, Human
uuugcauuuaaaacag

SEQ ID NO: 1478683 - RNA, 17 nt, Human
uuugcauuuaaaacaga

SEQ ID NO: 1478684 - RNA, 19 nt, Human
uuugcauuuaaaacagaca

SEQ ID NO: 1478685 - RNA, 21 nt, Human
uuugcauuuaaaacagacacu

SEQ ID NO: 1478686 - RNA, 23 nt, Human
uuugcauuuaaaacagacacugg

SEQ ID NO: 1478687 - RNA, 15 nt, Human
uuuccacagaagcuc

SEQ ID NO: 1478688 - RNA, 20 nt, Human
uuuccuaaauauauuuuaag

SEQ ID NO: 1478689 - RNA, 22 nt, Human
uuuccguaaaaaugauuucagu

SEQ ID NO: 1478690 - RNA, 16 nt, Human
uuugcaccuuucuagu

SEQ ID NO: 1478691 - RNA, 17 nt, Human
uuugcaccuuucuaguu

SEQ ID NO: 1478692 - RNA, 20 nt, Human
uuugcaccuuucuaguugaa

SEQ ID NO: 1478693 - RNA, 21 nt, Human
uuugcaccuuucuaguugaaa

SEQ ID NO: 1478694 - RNA, 23 nt, Human
uuuuaaaauccacuuuaucuuga

SEQ ID NO: 1478695 - RNA, 13 nt, Human
uuuuaaacacauu

SEQ ID NO: 1478696 - RNA, 13 nt, Human
uuuuaaacaguga

SEQ ID NO: 1478697 - RNA, 19 nt, Human
uuuuaaacagugagccuga

SEQ ID NO: 1478698 - RNA, 18 nt, Human
uuuuaaacacauuaggaa

SEQ ID NO: 1478699 - RNA, 14 nt, Human
uuuuaaaauccacu

SEQ ID NO: 1478700 - RNA, 21 nt, Human
uuuguuaauuuagaaaacuuu

SEQ ID NO: 1478701 - RNA, 23 nt, Human
uuuguuaauuuagaaaacuuuaa

SEQ ID NO: 1478702 - RNA, 22 nt, Human
uuuguuaauuuagaaaacuuua

SEQ ID NO: 1478703 - RNA, 14 nt, Human
uuuguugcuguuuu

SEQ ID NO: 1478704 - RNA, 14 nt, Human
uuuguauuguauau

SEQ ID NO: 1478705 - RNA, 17 nt, Human
uuuguauuuuguuuaaa

SEQ ID NO: 1478706 - RNA, 21 nt, Human
uuugugucauguuuaagaaau

SEQ ID NO: 1478707 - RNA, 14 nt, Human
uuuguguguagucu

SEQ ID NO: 1478708 - RNA, 15 nt, Human
uuuggucaacacuaa

SEQ ID NO: 1478709 - RNA, 21 nt, Human
uuugguccuucaaaggcuugu

SEQ ID NO: 1478710 - RNA, 18 nt, Human
uuuguauaaaauaauuuu

SEQ ID NO: 1478711 - RNA, 19 nt, Human
uuuguauaaaauaauuuuu

SEQ ID NO: 1478712 - RNA, 17 nt, Human
uuuguauaaaauaauuu

SEQ ID NO: 1478713 - RNA, 11 nt, Human
uuuuuccaaca

SEQ ID NO: 1478714 - RNA, 16 nt, Human
uuuuucaugauaauga

SEQ ID NO: 1478715 - RNA, 18 nt, Human
uuuuucaugauuuugaaa

SEQ ID NO: 1478716 - RNA, 11 nt, Human
uuuuucaugau

SEQ ID NO: 1478717 - RNA, 13 nt, Human
uuuuuaaucuuua

SEQ ID NO: 1478718 - RNA, 16 nt, Human
uuuuuaauaaauuuca

SEQ ID NO: 1478719 - RNA, 14 nt, Human
uuuuuaauaauuua

SEQ ID NO: 1478720 - RNA, 18 nt, Human
uuuuuaauguauaguaaa

SEQ ID NO: 1478721 - RNA, 13 nt, Human
uuuuucacauuuu

SEQ ID NO: 1478722 - RNA, 23 nt, Human
uuuuuaaauguauacuauaguac

SEQ ID NO: 1478723 - RNA, 15 nt, Human
uuuuuaaauguauac

SEQ ID NO: 1478724 - RNA, 20 nt, Human
uuuuuaaauguaaagauauu

SEQ ID NO: 1478725 - RNA, 24 nt, Human
uuuugacaguguugaaaauguuca

SEQ ID NO: 1478726 - RNA, 15 nt, Human
uuuugacauaaaguu

SEQ ID NO: 1478727 - RNA, 19 nt, Human
uuuugacaguguugaaaau

SEQ ID NO: 1478728 - RNA, 23 nt, Human
uuuugacaguguugaaaauguuc

SEQ ID NO: 1478729 - RNA, 12 nt, Human
uuuuuuacauuu

SEQ ID NO: 1478730 - RNA, 11 nt, Human
uuuuuuacauu

SEQ ID NO: 1478731 - RNA, 15 nt, Human
uuuuuuaauaaauuu

SEQ ID NO: 1478732 - RNA, 12 nt, Human
uuuuuuaauuga

SEQ ID NO: 1478733 - RNA, 14 nt, Human
uuuuuccguaaaaa

SEQ ID NO: 1478734 - RNA, 15 nt, Human
uuuuuccguaaaaau

SEQ ID NO: 1478735 - RNA, 12 nt, Human
uuuuuuaacauu

SEQ ID NO: 1478736 - RNA, 12 nt, Human
uuuuuuuacauu

SEQ ID NO: 1478737 - RNA, 14 nt, Human
uuuuuuuguuauua

SEQ ID NO: 1478738 - RNA, 22 nt, Human
uuccugagucccaucccugcgu

SEQ ID NO: 1478739 - RNA, 21 nt, Human
uuccugcaggcaggaacaaac

SEQ ID NO: 1478740 - RNA, 19 nt, Human
uuccauggcaggaaggcuu

SEQ ID NO: 1478741 - RNA, 17 nt, Human
uuccauggcaggaaggc

SEQ ID NO: 1478742 - RNA, 22 nt, Human
uuccaugggaccacaacuauuu

SEQ ID NO: 1478743 - RNA, 13 nt, Human
uuccugaauccaa

SEQ ID NO: 1478744 - RNA, 18 nt, Human
uuccugaauccaaacuaa

SEQ ID NO: 1478745 - RNA, 13 nt, Human
uuccugacacuuu

SEQ ID NO: 1478746 - RNA, 22 nt, Human
uuccugacacuuuaauuaccaa

SEQ ID NO: 1478747 - RNA, 18 nt, Human
uucggugagcuacaaaug

SEQ ID NO: 1478748 - RNA, 16 nt, Human
uuccuugucacuggua

SEQ ID NO: 1478749 - RNA, 15 nt, Human
uuccugcuuuucccc

SEQ ID NO: 1478750 - RNA, 14 nt, Human
uucuauagcuuuuc

SEQ ID NO: 1478751 - RNA, 14 nt, Human
uucuauagccaaaa

SEQ ID NO: 1478752 - RNA, 15 nt, Human
uucuauagccaaaaa

SEQ ID NO: 1478753 - RNA, 17 nt, Human
uucuauagccaaaaaua

SEQ ID NO: 1478754 - RNA, 21 nt, Human
uucuauagccaaaaauagcua

SEQ ID NO: 1478755 - RNA, 23 nt, Human
uucuauagccaaaaauagcuaaa

SEQ ID NO: 1478756 - RNA, 16 nt, Human
uucuauaguuauuaag

SEQ ID NO: 1478757 - RNA, 13 nt, Human
uucuacugcucuc

SEQ ID NO: 1478758 - RNA, 19 nt, Human
uucuacuuugauaugacug

SEQ ID NO: 1478759 - RNA, 20 nt, Human
uucuacugcucuccuccacc

SEQ ID NO: 1478760 - RNA, 15 nt, Human
uucuaccauuucaga

SEQ ID NO: 1478761 - RNA, 18 nt, Human
uucuaccauuucagagag

SEQ ID NO: 1478762 - RNA, 13 nt, Human
uucguuaucuaau

SEQ ID NO: 1478763 - RNA, 17 nt, Human
uucuaauuggcaugaag

SEQ ID NO: 1478764 - RNA, 15 nt, Human
uucguagauauugga

SEQ ID NO: 1478765 - RNA, 19 nt, Human
uucgucuguuuauaaacau

SEQ ID NO: 1478766 - RNA, 19 nt, Human
uucuaccaaggucuucuua

SEQ ID NO: 1478767 - RNA, 14 nt, Human
uucuaccauuucag

SEQ ID NO: 1478768 - RNA, 15 nt, Human
uucuacauagaugcu

SEQ ID NO: 1478769 - RNA, 18 nt, Human
uucuacaaaauccugaug

SEQ ID NO: 1478770 - RNA, 16 nt, Human
uucugauaaugaaaau

SEQ ID NO: 1478771 - RNA, 16 nt, Human
uucugaguuuuaccaa

SEQ ID NO: 1478772 - RNA, 15 nt, Human
uucugaguuuuacca

SEQ ID NO: 1478773 - RNA, 12 nt, Human
uucugaguuccu

SEQ ID NO: 1478774 - RNA, 15 nt, Human
uucugaguuccugca

SEQ ID NO: 1478775 - RNA, 14 nt, Human
uucugaucaaggcc

SEQ ID NO: 1478776 - RNA, 15 nt, Human
uucugaucaaggccu

SEQ ID NO: 1478777 - RNA, 22 nt, Human
uucugaucaaggccuuauugga

SEQ ID NO: 1478778 - RNA, 21 nt, Human
uucugauucgaaugacacugu

SEQ ID NO: 1478779 - RNA, 14 nt, Human
uucugccuucucau

SEQ ID NO: 1478780 - RNA, 16 nt, Human
uucugccuucucauga

SEQ ID NO: 1478781 - RNA, 22 nt, Human
uucugccuuuggggacuuuucu

SEQ ID NO: 1478782 - RNA, 21 nt, Human
uucugcuacuuugcugcuaug

SEQ ID NO: 1478783 - RNA, 19 nt, Human
uucuccagccucagccucc

SEQ ID NO: 1478784 - RNA, 14 nt, Human
uucuaugaaauauu

SEQ ID NO: 1478785 - RNA, 21 nt, Human
uucuaugaaauauuauguuaa

SEQ ID NO: 1478786 - RNA, 17 nt, Human
uucucauuuuuuaaaaa

SEQ ID NO: 1478787 - RNA, 23 nt, Human
uucucauuuuuuaaaaaagcuua

SEQ ID NO: 1478788 - RNA, 22 nt, Human
uucucauuuuuuaaaaaagcuu

SEQ ID NO: 1478789 - RNA, 15 nt, Human
uugaaaagcagacau

SEQ ID NO: 1478790 - RNA, 17 nt, Human
uugaaaagcagacauuu

SEQ ID NO: 1478791 - RNA, 15 nt, Human
uugaaaaaugcaugu

SEQ ID NO: 1478792 - RNA, 13 nt, Human
uugaaaaagcgaa

SEQ ID NO: 1478793 - RNA, 18 nt, Human
uucuuuccacagaagcuc

SEQ ID NO: 1478794 - RNA, 15 nt, Human
uucuuuaaaauuaca

SEQ ID NO: 1478795 - RNA, 20 nt, Human
uucuuuaaaauguaaagcca

SEQ ID NO: 1478796 - RNA, 13 nt, Human
uucuuccaucuga

SEQ ID NO: 1478797 - RNA, 14 nt, Human
uucuuccaucugau

SEQ ID NO: 1478798 - RNA, 17 nt, Human
uucuggaauacaugaaa

SEQ ID NO: 1478799 - RNA, 19 nt, Human
uucuggaauacaugaaaua

SEQ ID NO: 1478800 - RNA, 19 nt, Human
uucuggacccguucaacuu

SEQ ID NO: 1478801 - RNA, 21 nt, Human
uucuggauuccccaucucagg

SEQ ID NO: 1478802 - RNA, 12 nt, Human
uugaauuuuaca

SEQ ID NO: 1478803 - RNA, 18 nt, Human
uugaauuuugaugaacaa

SEQ ID NO: 1478804 - RNA, 18 nt, Human
uugacaacuggcaggcag

SEQ ID NO: 1478805 - RNA, 19 nt, Human
uugaauuuuuuuuaacauu

SEQ ID NO: 1478806 - RNA, 22 nt, Human
uugaauuuuuuuuaacauuccu

SEQ ID NO: 1478807 - RNA, 13 nt, Human
uugaacugauuca

SEQ ID NO: 1478808 - RNA, 14 nt, Human
uugaugaagaaguu

SEQ ID NO: 1478809 - RNA, 23 nt, Human
uugaugaagaaguugauaugccu

SEQ ID NO: 1478810 - RNA, 15 nt, Human
uugcaccuuucuagu

SEQ ID NO: 1478811 - RNA, 20 nt, Human
uugauuuuagccuucucugu

SEQ ID NO: 1478812 - RNA, 16 nt, Human
uuauauuaugaagcuu

SEQ ID NO: 1478813 - RNA, 16 nt, Human
uuauauguaccguagg

SEQ ID NO: 1478814 - RNA, 14 nt, Human
uuauauguaccgua

SEQ ID NO: 1478815 - RNA, 14 nt, Human
uuauauggaaauuc

SEQ ID NO: 1478816 - RNA, 13 nt, Human
uuauauggaaauu

SEQ ID NO: 1478817 - RNA, 18 nt, Human
uuauauguuguaauauuu

SEQ ID NO: 1478818 - RNA, 13 nt, Human
uuauaugcuuacu

SEQ ID NO: 1478819 - RNA, 19 nt, Human
uuauaugcuuacugauaua

SEQ ID NO: 1478820 - RNA, 15 nt, Human
uuauaugaagaaaau

SEQ ID NO: 1478821 - RNA, 19 nt, Human
uuauaugaagaaaaucacu

SEQ ID NO: 1478822 - RNA, 16 nt, Human
uuauaauuuugugaag

SEQ ID NO: 1478823 - RNA, 17 nt, Human
uuauaauuuugugaagc

SEQ ID NO: 1478824 - RNA, 18 nt, Human
uuauaauuuugugaagca

SEQ ID NO: 1478825 - RNA, 19 nt, Human
uuauaucuauauuuuacau

SEQ ID NO: 1478826 - RNA, 23 nt, Human
uuauaucuauauuuuacauaaau

SEQ ID NO: 1478827 - RNA, 12 nt, Human
uuauaauuuuaa

SEQ ID NO: 1478828 - RNA, 12 nt, Human
uuauaauuuaaa

SEQ ID NO: 1478829 - RNA, 21 nt, Human
uuauaauuuuaaauguuuuuu

SEQ ID NO: 1478830 - RNA, 17 nt, Human
uuauaauuuuaaauguu

SEQ ID NO: 1478831 - RNA, 14 nt, Human
uuauaauuuuguga

SEQ ID NO: 1478832 - RNA, 15 nt, Human
uuauaauuuugugaa

SEQ ID NO: 1478833 - RNA, 11 nt, Human
uuauaaucuuu

SEQ ID NO: 1478834 - RNA, 21 nt, Human
uuauaauaaaggacuguaauc

SEQ ID NO: 1478835 - RNA, 19 nt, Human
uuauaauaaaggacuguaa

SEQ ID NO: 1478836 - RNA, 18 nt, Human
uuauaauaaaggacugua

SEQ ID NO: 1478837 - RNA, 18 nt, Human
uuauaaguagcaggccaa

SEQ ID NO: 1478838 - RNA, 16 nt, Human
uuaguggcucaacauu

SEQ ID NO: 1478839 - RNA, 20 nt, Human
uuaguggcucaacauugugu

SEQ ID NO: 1478840 - RNA, 23 nt, Human
uuaguggcucaacauuguguucc

SEQ ID NO: 1478841 - RNA, 20 nt, Human
uuauuaauauauauuaucuu

SEQ ID NO: 1478842 - RNA, 19 nt, Human
uuauuaauauauauuaucu

SEQ ID NO: 1478843 - RNA, 15 nt, Human
uuauuaauaaacauu

SEQ ID NO: 1478844 - RNA, 14 nt, Human
uuauuaauaaacau

SEQ ID NO: 1478845 - RNA, 14 nt, Human
uuauuacuuuugcu

SEQ ID NO: 1478846 - RNA, 16 nt, Human
uuauuaacaauuaggc

SEQ ID NO: 1478847 - RNA, 19 nt, Human
uuauuaacaauuaggcaga

SEQ ID NO: 1478848 - RNA, 18 nt, Human
uuaugauuuuuuuuucau

SEQ ID NO: 1478849 - RNA, 19 nt, Human
uuaugauuuuuuuuucaua

SEQ ID NO: 1478850 - RNA, 17 nt, Human
uuauguugcauagaaua

SEQ ID NO: 1478851 - RNA, 16 nt, Human
uuauauuuacaaaugg

SEQ ID NO: 1478852 - RNA, 17 nt, Human
uuauauugauaagaucu

SEQ ID NO: 1478853 - RNA, 20 nt, Human
uuauauuuauuacuguaaga

SEQ ID NO: 1478854 - RNA, 13 nt, Human
uuauauuuaacuc

SEQ ID NO: 1478855 - RNA, 12 nt, Human
uuauauuugaaa

SEQ ID NO: 1478856 - RNA, 13 nt, Human
uuauauuugaaau

SEQ ID NO: 1478857 - RNA, 15 nt, Human
uuauauuugaaauau

SEQ ID NO: 1478858 - RNA, 17 nt, Human
uuauccugaaauuucag

SEQ ID NO: 1478859 - RNA, 16 nt, Human
uuauccugaaauuuca

SEQ ID NO: 1478860 - RNA, 14 nt, Human
uuaucgaaacucau

SEQ ID NO: 1478861 - RNA, 14 nt, Human
uuaucuugaauaau

SEQ ID NO: 1478862 - RNA, 20 nt, Human
uuaucuucaggacacucacu

SEQ ID NO: 1478863 - RNA, 16 nt, Human
uuaucuugaauaaugu

SEQ ID NO: 1478864 - RNA, 16 nt, Human
uuaucuuaaaacuccu

SEQ ID NO: 1478865 - RNA, 18 nt, Human
uuaucuauagcuaaguac

SEQ ID NO: 1478866 - RNA, 19 nt, Human
uuaucuacuuccaaacuaa

SEQ ID NO: 1478867 - RNA, 20 nt, Human
uuaucuacuuccaaacuaau

SEQ ID NO: 1478868 - RNA, 18 nt, Human
uuaucuaaucaugaaacu

SEQ ID NO: 1478869 - RNA, 22 nt, Human
uuaucuaaucaugaaacucccu

SEQ ID NO: 1478870 - RNA, 11 nt, Human
uuaucuaauuu

SEQ ID NO: 1478871 - RNA, 16 nt, Human
uuaucuaauuuauaaa

SEQ ID NO: 1478872 - RNA, 17 nt, Human
uuaucuaauuuauaaaa

SEQ ID NO: 1478873 - RNA, 21 nt, Human
uuaucuaaguuaauuuaaagu

SEQ ID NO: 1478874 - RNA, 23 nt, Human
uucaaauuguaagcaugcacaaa

SEQ ID NO: 1478875 - RNA, 18 nt, Human
uucaaauguauuacagug

SEQ ID NO: 1478876 - RNA, 16 nt, Human
uucaaauucuucugaa

SEQ ID NO: 1478877 - RNA, 19 nt, Human
uucaaauucuucugaacuc

SEQ ID NO: 1478878 - RNA, 16 nt, Human
uucaacagugaagaca

SEQ ID NO: 1478879 - RNA, 18 nt, Human
uucaacagugaagacaga

SEQ ID NO: 1478880 - RNA, 19 nt, Human
uucaacagugaagacagaa

SEQ ID NO: 1478881 - RNA, 17 nt, Human
uucaacauguuauuugu

SEQ ID NO: 1478882 - RNA, 21 nt, Human
uucaacauguuauuuguaaua

SEQ ID NO: 1478883 - RNA, 18 nt, Human
uuauuuucaagaaacuga

SEQ ID NO: 1478884 - RNA, 13 nt, Human
uuauuuucaagaa

SEQ ID NO: 1478885 - RNA, 22 nt, Human
uuauuuugccaagggcauaaau

SEQ ID NO: 1478886 - RNA, 22 nt, Human
uuauuuugugaugcaaauaaau

SEQ ID NO: 1478887 - RNA, 19 nt, Human
uuauuuuaauaauguuuca

SEQ ID NO: 1478888 - RNA, 19 nt, Human
uuauuuguugagaguguga

SEQ ID NO: 1478889 - RNA, 12 nt, Human
uuauuuguugag

SEQ ID NO: 1478890 - RNA, 14 nt, Human
uuauuuguugagag

SEQ ID NO: 1478891 - RNA, 20 nt, Human
uuauuuuaauaauguuucaa

SEQ ID NO: 1478892 - RNA, 13 nt, Human
uuauuugcaugug

SEQ ID NO: 1478893 - RNA, 12 nt, Human
uuauuuguaaua

SEQ ID NO: 1478894 - RNA, 16 nt, Human
uuauuuguaauagaug

SEQ ID NO: 1478895 - RNA, 17 nt, Human
uuauuuguaauagaugu

SEQ ID NO: 1478896 - RNA, 18 nt, Human
uuauuuguaauagauguu

SEQ ID NO: 1478897 - RNA, 18 nt, Human
uucaauauaagcuuuucu

SEQ ID NO: 1478898 - RNA, 19 nt, Human
uucaauauaagcuuuucuu

SEQ ID NO: 1478899 - RNA, 22 nt, Human
uucacaacagccugacaacauu

SEQ ID NO: 1478900 - RNA, 16 nt, Human
uucaugcauggaaauu

SEQ ID NO: 1478901 - RNA, 15 nt, Human
uucaugcauggaaau

SEQ ID NO: 1478902 - RNA, 21 nt, Human
uucaugccaauuagcaauuga

SEQ ID NO: 1478903 - RNA, 14 nt, Human
uucaugcauggaaa

SEQ ID NO: 1478904 - RNA, 17 nt, Human
uucaucuggaaccauca

SEQ ID NO: 1478905 - RNA, 19 nt, Human
uucaucuggcaacaucuuu

SEQ ID NO: 1478906 - RNA, 23 nt, Human
uucaucuggaaccaucagaaaca

SEQ ID NO: 1478907 - RNA, 12 nt, Human
uucaucuggaac

SEQ ID NO: 1478908 - RNA, 20 nt, Human
uucaugcuguucaugaaaga

SEQ ID NO: 1478909 - RNA, 17 nt, Human
uucaugcuaucucugug

SEQ ID NO: 1478910 - RNA, 18 nt, Human
uucaugcuaucucugugu

SEQ ID NO: 1478911 - RNA, 20 nt, Human
uuccaacaagaagggacuga

SEQ ID NO: 1478912 - RNA, 18 nt, Human
uuccagauccuggaaauc

SEQ ID NO: 1478913 - RNA, 19 nt, Human
uuccagaggcuauuauuuu

SEQ ID NO: 1478914 - RNA, 20 nt, Human
uuccagaggcuauuauuuuc

SEQ ID NO: 1478915 - RNA, 18 nt, Human
uuccagagcacugcucca

SEQ ID NO: 1478916 - RNA, 16 nt, Human
uuccagaccugaagaa

SEQ ID NO: 1478917 - RNA, 17 nt, Human
uuccagaccugaagaau

SEQ ID NO: 1478918 - RNA, 23 nt, Human
uuccagacugcuuccaauuuucu

SEQ ID NO: 1478919 - RNA, 14 nt, Human
uuccagaccugaag

SEQ ID NO: 1478920 - RNA, 19 nt, Human
uuccagauccuggaaauca

SEQ ID NO: 1478921 - RNA, 18 nt, Human
uuccaugcguguuucuga

SEQ ID NO: 1478922 - RNA, 21 nt, Human
uuccaugcguguuucugacuc

SEQ ID NO: 1478923 - RNA, 20 nt, Human
uucauaaauaaaguuuguug

SEQ ID NO: 1478924 - RNA, 16 nt, Human
uucaguuuugauauuu

SEQ ID NO: 1478925 - RNA, 23 nt, Human
uucaguuauuauauuuacaaaug

SEQ ID NO: 1478926 - RNA, 20 nt, Human
uucaguguauggaaauaaau

SEQ ID NO: 1478927 - RNA, 22 nt, Human
uucagcuucguuuauuuucaag

SEQ ID NO: 1478928 - RNA, 14 nt, Human
uuucacaaggucuu

SEQ ID NO: 1478929 - RNA, 23 nt, Human
uuucacaacagccugacaacauu

SEQ ID NO: 1478930 - RNA, 22 nt, Human
uuucaaguuccaaguugcuaau

SEQ ID NO: 1478931 - RNA, 11 nt, Human
uuucagaugug

SEQ ID NO: 1478932 - RNA, 18 nt, Human
uuucagaugugaaccauu

SEQ ID NO: 1478933 - RNA, 20 nt, Human
uuucagauucccagagcaaa

SEQ ID NO: 1478934 - RNA, 16 nt, Human
uuucauugucugugaa

SEQ ID NO: 1478935 - RNA, 15 nt, Human
uuucauugucuguga

SEQ ID NO: 1478936 - RNA, 14 nt, Human
uuucauugucugug

SEQ ID NO: 1478937 - RNA, 19 nt, Human
uuuccaaccggcuuugugg

SEQ ID NO: 1478938 - RNA, 22 nt, Human
uuuauaauuuugugaagcaaaa

SEQ ID NO: 1478939 - RNA, 22 nt, Human
uuuauuuaaaaaacuaaaaacu

SEQ ID NO: 1478940 - RNA, 17 nt, Human
uuuauuaugcauuauau

SEQ ID NO: 1478941 - RNA, 16 nt, Human
uuuauuaugcauuaua

SEQ ID NO: 1478942 - RNA, 19 nt, Human
uuucaagaaacugaggaau

SEQ ID NO: 1478943 - RNA, 17 nt, Human
uuucaagaaacugagga

SEQ ID NO: 1478944 - RNA, 23 nt, Human
uuucaagaauaaucacgcuuucc

SEQ ID NO: 1478945 - RNA, 13 nt, Human
uuuaccacuugug

SEQ ID NO: 1478946 - RNA, 12 nt, Human
uuuaccaaguuu

SEQ ID NO: 1478947 - RNA, 13 nt, Human
uuuacagaauuuu

SEQ ID NO: 1478948 - RNA, 11 nt, Human
uuuaauaauuu

SEQ ID NO: 1478949 - RNA, 14 nt, Human
uuuaauaauguuuc

SEQ ID NO: 1478950 - RNA, 21 nt, Human
uuuaauagguuuggacaaaau

SEQ ID NO: 1478951 - RNA, 18 nt, Human
uuuaauagcaaagaauug

SEQ ID NO: 1478952 - RNA, 18 nt, Human
uuuacacaauagaauuau

SEQ ID NO: 1478953 - RNA, 17 nt, Human
uuuaauagcaaagaauu

SEQ ID NO: 1478954 - RNA, 19 nt, Human
uuuacacaauagaauuaua

SEQ ID NO: 1478955 - RNA, 23 nt, Human
uuuauaaaaauaaaaaacacugg

SEQ ID NO: 1478956 - RNA, 21 nt, Human
uuuauaaaaauaaaaaacacu

SEQ ID NO: 1478957 - RNA, 17 nt, Human
uuuacuuguuucagagu

SEQ ID NO: 1478958 - RNA, 15 nt, Human
uuuacuuguuucaga

SEQ ID NO: 1478959 - RNA, 13 nt, Human
uuuagaaaucauu

SEQ ID NO: 1478960 - RNA, 16 nt, Human
uuuagaaaucauuuug

SEQ ID NO: 1478961 - RNA, 18 nt, Human
uuuaaauuuuuuuccuua

SEQ ID NO: 1478962 - RNA, 19 nt, Human
uuuaacucuauaauguguu

SEQ ID NO: 1478963 - RNA, 23 nt, Human
uuuaacugacuauucuugaugua

SEQ ID NO: 1478964 - RNA, 11 nt, Human
uuuaacugacu

SEQ ID NO: 1478965 - RNA, 20 nt, Human
uuuaagacgaaacauuuguu

SEQ ID NO: 1478966 - RNA, 14 nt, Human
uuuaauaaauuuau

SEQ ID NO: 1478967 - RNA, 13 nt, Human
uuuaauaauguuu

SEQ ID NO: 1478968 - RNA, 14 nt, Human
uuuaacuuaaauag

SEQ ID NO: 1478969 - RNA, 13 nt, Human
uuuaacuuaaaua

SEQ ID NO: 1478970 - RNA, 20 nt, Human
uuguguugaagagguuuuaa

SEQ ID NO: 1478971 - RNA, 16 nt, Human
uuguggcaagugaauu

SEQ ID NO: 1478972 - RNA, 22 nt, Human
uuguggcaagugaauuugccug

SEQ ID NO: 1478973 - RNA, 20 nt, Human
uuguguucccauuucagcug

SEQ ID NO: 1478974 - RNA, 18 nt, Human
uuguggcaagugaauuug

SEQ ID NO: 1478975 - RNA, 21 nt, Human
uuguggaauugggagcuuggg

SEQ ID NO: 1478976 - RNA, 22 nt, Human
uugugcccccaaccauuuccuc

SEQ ID NO: 1478977 - RNA, 21 nt, Human
uugugccaugucaaacaaaua

SEQ ID NO: 1478978 - RNA, 17 nt, Human
uugugcaauguaaauau

SEQ ID NO: 1478979 - RNA, 18 nt, Human
uugugcaauguaaauauu

SEQ ID NO: 1478980 - RNA, 22 nt, Human
uugugcaauguaaauauuuuaa

SEQ ID NO: 1478981 - RNA, 23 nt, Human
uugugcaauguaaauauuuuaaa

SEQ ID NO: 1478982 - RNA, 11 nt, Human
uugugcagaga

SEQ ID NO: 1478983 - RNA, 14 nt, Human
uugugcauucugga

SEQ ID NO: 1478984 - RNA, 18 nt, Human
uuguuaaucuucaauagu

SEQ ID NO: 1478985 - RNA, 18 nt, Human
uuguguuuugcaagccag

SEQ ID NO: 1478986 - RNA, 19 nt, Human
uuguuaauuuagaaaacuu

SEQ ID NO: 1478987 - RNA, 20 nt, Human
uuguuaauuuagaaaacuuu

SEQ ID NO: 1478988 - RNA, 22 nt, Human
uuguuaauuuagaaaacuuuaa

SEQ ID NO: 1478989 - RNA, 21 nt, Human
uuguuaauuuagaaaacuuua

SEQ ID NO: 1478990 - RNA, 18 nt, Human
uuguuauguagauaacaa

SEQ ID NO: 1478991 - RNA, 14 nt, Human
uuguugugcuuuua

SEQ ID NO: 1478992 - RNA, 13 nt, Human
uuguugugcuuuu

SEQ ID NO: 1478993 - RNA, 13 nt, Human
uuguuauauaauc

SEQ ID NO: 1478994 - RNA, 16 nt, Human
uuguuauauaaucauu

SEQ ID NO: 1478995 - RNA, 22 nt, Human
uuguuaguuucugaguuuuacc

SEQ ID NO: 1478996 - RNA, 15 nt, Human
uuguuuaaaaaguaa

SEQ ID NO: 1478997 - RNA, 14 nt, Human
uuguuucuacuuug

SEQ ID NO: 1478998 - RNA, 23 nt, Human
uuguuucuacuuugauaugacug

SEQ ID NO: 1478999 - RNA, 16 nt, Human
uuguacuauuuaacug

SEQ ID NO: 1479000 - RNA, 19 nt, Human
uuguacuauuuaacugacu

SEQ ID NO: 1479001 - RNA, 22 nt, Human
uuguacuauuuaacugacuauu

SEQ ID NO: 1479002 - RNA, 23 nt, Human
uuguacuaaagccaaacauauau

SEQ ID NO: 1479003 - RNA, 16 nt, Human
uuguacuaaagccaaa

SEQ ID NO: 1479004 - RNA, 13 nt, Human
uuguacuauuuaa

SEQ ID NO: 1479005 - RNA, 16 nt, Human
uuguacauaguuauuu

SEQ ID NO: 1479006 - RNA, 14 nt, Human
uuguauuacaaauc

SEQ ID NO: 1479007 - RNA, 13 nt, Human
uugugaaauuauu

SEQ ID NO: 1479008 - RNA, 20 nt, Human
uugucuuuguucuucuacca

SEQ ID NO: 1479009 - RNA, 19 nt, Human
uugucuuuuuagaugccca

SEQ ID NO: 1479010 - RNA, 13 nt, Human
uugucuuuuuaga

SEQ ID NO: 1479011 - RNA, 13 nt, Human
uugucucagagca

SEQ ID NO: 1479012 - RNA, 15 nt, Human
uugucuagugaaacu

SEQ ID NO: 1479013 - RNA, 15 nt, Human
uugcacuaucuuuca

SEQ ID NO: 1479014 - RNA, 13 nt, Human
uuguaaaacaggu

SEQ ID NO: 1479015 - RNA, 15 nt, Human
uuguaaaacagguag

SEQ ID NO: 1479016 - RNA, 14 nt, Human
uuguaaaacaggua

SEQ ID NO: 1479017 - RNA, 16 nt, Human
uuguaaauuauuaauu

SEQ ID NO: 1479018 - RNA, 23 nt, Human
uuguaaauuauuaauuuaugcag

SEQ ID NO: 1479019 - RNA, 11 nt, Human
uguaauacaau

SEQ ID NO: 1479020 - RNA, 17 nt, Human
uguaaugaaaaccacau

SEQ ID NO: 1479021 - RNA, 13 nt, Human
uguaaugaaaacc

SEQ ID NO: 1479022 - RNA, 12 nt, Human
uguaaugaaaac

SEQ ID NO: 1479023 - RNA, 11 nt, Human
uguaaugaaaa

SEQ ID NO: 1479024 - RNA, 18 nt, Human
uguaaauuuguacuauuu

SEQ ID NO: 1479025 - RNA, 14 nt, Human
uguaaauuuguacu

SEQ ID NO: 1479026 - RNA, 14 nt, Human
uguaacaagccaga

SEQ ID NO: 1479027 - RNA, 18 nt, Human
uguaacaagccagauuuu

SEQ ID NO: 1479028 - RNA, 13 nt, Human
uguaaauuuguac

SEQ ID NO: 1479029 - RNA, 23 nt, Human
uguaaacucaaaauauuuguaca

SEQ ID NO: 1479030 - RNA, 13 nt, Human
uguaaacugugua

SEQ ID NO: 1479031 - RNA, 14 nt, Human
uguaaacuguguau

SEQ ID NO: 1479032 - RNA, 18 nt, Human
uguaaacuguguauucca

SEQ ID NO: 1479033 - RNA, 20 nt, Human
ugguuguacauauaagugau

SEQ ID NO: 1479034 - RNA, 14 nt, Human
ugguugaugccaaa

SEQ ID NO: 1479035 - RNA, 18 nt, Human
ugguugaugccaaaaaaa

SEQ ID NO: 1479036 - RNA, 19 nt, Human
uguaaaccugagucguaca

SEQ ID NO: 1479037 - RNA, 15 nt, Human
uguaaacucaaaaua

SEQ ID NO: 1479038 - RNA, 20 nt, Human
uguaaacucaaaauauuugu

SEQ ID NO: 1479039 - RNA, 22 nt, Human
uguaaaaucuugucauguguau

SEQ ID NO: 1479040 - RNA, 12 nt, Human
uguaaaaucuug

SEQ ID NO: 1479041 - RNA, 15 nt, Human
uguaaaaucuuguca

SEQ ID NO: 1479042 - RNA, 16 nt, Human
uguaaaaucuugucau

SEQ ID NO: 1479043 - RNA, 18 nt, Human
uguaaaaucuugucaugu

SEQ ID NO: 1479044 - RNA, 19 nt, Human
uguaaaaucuugucaugug

SEQ ID NO: 1479045 - RNA, 20 nt, Human
uguaaaaucuugucaugugu

SEQ ID NO: 1479046 - RNA, 12 nt, Human
uguaaaacaggu

SEQ ID NO: 1479047 - RNA, 13 nt, Human
uguaaaacaggua

SEQ ID NO: 1479048 - RNA, 14 nt, Human
uguaaaacagguag

SEQ ID NO: 1479049 - RNA, 22 nt, Human
uguaaaacagguagaauuaucu

SEQ ID NO: 1479050 - RNA, 19 nt, Human
uguaaaacauuuauuuuga

SEQ ID NO: 1479051 - RNA, 16 nt, Human
ugguucccuugaugaa

SEQ ID NO: 1479052 - RNA, 17 nt, Human
ugguucccuugaugaag

SEQ ID NO: 1479053 - RNA, 20 nt, Human
ugguucccuugaugaagaag

SEQ ID NO: 1479054 - RNA, 22 nt, Human
ugguucuugaggggaccaggag

SEQ ID NO: 1479055 - RNA, 16 nt, Human
ugguugaaaauaaaaa

SEQ ID NO: 1479056 - RNA, 15 nt, Human
ugguucuugagggga

SEQ ID NO: 1479057 - RNA, 21 nt, Human
ugguucuugaggggaccagga

SEQ ID NO: 1479058 - RNA, 23 nt, Human
ugguucuugaggggaccaggagu

SEQ ID NO: 1479059 - RNA, 14 nt, Human
uggugguagagaag

SEQ ID NO: 1479060 - RNA, 14 nt, Human
ugguggucccuggg

SEQ ID NO: 1479061 - RNA, 15 nt, Human
ugguggucccugggu

SEQ ID NO: 1479062 - RNA, 14 nt, Human
uggguagacacaca

SEQ ID NO: 1479063 - RNA, 21 nt, Human
uggguagaaagagauacagag

SEQ ID NO: 1479064 - RNA, 17 nt, Human
ugucuacacuaagagag

SEQ ID NO: 1479065 - RNA, 23 nt, Human
ugucuacacagauguucacccaa

SEQ ID NO: 1479066 - RNA, 22 nt, Human
ugucuacacuaagagagaauga

SEQ ID NO: 1479067 - RNA, 18 nt, Human
uguccugcaccggggccu

SEQ ID NO: 1479068 - RNA, 13 nt, Human
uguccucagcccc

SEQ ID NO: 1479069 - RNA, 16 nt, Human
ugucugucugucuguc

SEQ ID NO: 1479070 - RNA, 15 nt, Human
ugucugucugucugu

SEQ ID NO: 1479071 - RNA, 19 nt, Human
ugucugugaagugagaccu

SEQ ID NO: 1479072 - RNA, 18 nt, Human
ugucugugaagugagacc

SEQ ID NO: 1479073 - RNA, 15 nt, Human
ugucugucuguccca

SEQ ID NO: 1479074 - RNA, 14 nt, Human
ugucugucuguccc

SEQ ID NO: 1479075 - RNA, 15 nt, Human
ugucuguggauuuuu

SEQ ID NO: 1479076 - RNA, 13 nt, Human
ugucuguucuaca

SEQ ID NO: 1479077 - RNA, 20 nt, Human
ugucugagacagaaucucag

SEQ ID NO: 1479078 - RNA, 21 nt, Human
ugucugaucguucaaagcaug

SEQ ID NO: 1479079 - RNA, 15 nt, Human
ugucuguucuacaua

SEQ ID NO: 1479080 - RNA, 21 nt, Human
ugucuguucuacauagaugcu

SEQ ID NO: 1479081 - RNA, 20 nt, Human
ugucuauggauuugccuucu

SEQ ID NO: 1479082 - RNA, 18 nt, Human
ugucuauuaccuguuagu

SEQ ID NO: 1479083 - RNA, 13 nt, Human
ugucuauucagcu

SEQ ID NO: 1479084 - RNA, 14 nt, Human
ugucuauucagcuu

SEQ ID NO: 1479085 - RNA, 20 nt, Human
ugucuauuuuuaauguuugu

SEQ ID NO: 1479086 - RNA, 18 nt, Human
uguauuuuaaaagaauga

SEQ ID NO: 1479087 - RNA, 19 nt, Human
uguauuuuaaaagaaugau

SEQ ID NO: 1479088 - RNA, 18 nt, Human
uguauggaaauaaaugua

SEQ ID NO: 1479089 - RNA, 23 nt, Human
uguauggaaauaaauguaucaua

SEQ ID NO: 1479090 - RNA, 23 nt, Human
ugucacugguagaccaaaauaaa

SEQ ID NO: 1479091 - RNA, 21 nt, Human
ugucacugguagaccaaaaua

SEQ ID NO: 1479092 - RNA, 20 nt, Human
uguaguguuggagaagaacu

SEQ ID NO: 1479093 - RNA, 21 nt, Human
uguaguguuggagaagaacug

SEQ ID NO: 1479094 - RNA, 14 nt, Human
uguauaaaauaauu

SEQ ID NO: 1479095 - RNA, 13 nt, Human
uguauaaaauaau

SEQ ID NO: 1479096 - RNA, 22 nt, Human
uguaguguuggagaagaacuga

SEQ ID NO: 1479097 - RNA, 12 nt, Human
uguagcuuugcu

SEQ ID NO: 1479098 - RNA, 13 nt, Human
uguagcuuugcuc

SEQ ID NO: 1479099 - RNA, 15 nt, Human
uguagcuuugcucuu

SEQ ID NO: 1479100 - RNA, 15 nt, Human
uguauaguaaaucac

SEQ ID NO: 1479101 - RNA, 19 nt, Human
uguaucuaugcauuuucug

SEQ ID NO: 1479102 - RNA, 18 nt, Human
ugggaggagggcaggcau

SEQ ID NO: 1479103 - RNA, 14 nt, Human
ugggaggagggcag

SEQ ID NO: 1479104 - RNA, 17 nt, Human
ugggaggagggcaggca

SEQ ID NO: 1479105 - RNA, 21 nt, Human
ugggcagcaauuuaaauguua

SEQ ID NO: 1479106 - RNA, 13 nt, Human
ugggcagccagac

SEQ ID NO: 1479107 - RNA, 12 nt, Human
ugggcagccaga

SEQ ID NO: 1479108 - RNA, 21 nt, Human
ugggcagccagaccagcaggc

SEQ ID NO: 1479109 - RNA, 19 nt, Human
ugggcagcaauuuaaaugu

SEQ ID NO: 1479110 - RNA, 18 nt, Human
ugggcagcaauuuaaaug

SEQ ID NO: 1479111 - RNA, 17 nt, Human
ugggcagcaauuuaaau

SEQ ID NO: 1479112 - RNA, 13 nt, Human
uggggggggugcu

SEQ ID NO: 1479113 - RNA, 20 nt, Human
uggggccaggcugggucgcc

SEQ ID NO: 1479114 - RNA, 17 nt, Human
uggggccaggcuggguc

SEQ ID NO: 1479115 - RNA, 14 nt, Human
ugggaaugaagcaa

SEQ ID NO: 1479116 - RNA, 16 nt, Human
uggcuugggcagcauc

SEQ ID NO: 1479117 - RNA, 19 nt, Human
uggccccucccccugccag

SEQ ID NO: 1479118 - RNA, 14 nt, Human
uggccccugaacaa

SEQ ID NO: 1479119 - RNA, 20 nt, Human
uggccccugaacaagaauug

SEQ ID NO: 1479120 - RNA, 23 nt, Human
uggccuaaccugccgagagucca

SEQ ID NO: 1479121 - RNA, 17 nt, Human
ugcuuuggaaaacccag

SEQ ID NO: 1479122 - RNA, 14 nt, Human
ugcuuucugaucaa

SEQ ID NO: 1479123 - RNA, 17 nt, Human
ugcuuugauauuucaau

SEQ ID NO: 1479124 - RNA, 13 nt, Human
ugcuuugauauuu

SEQ ID NO: 1479125 - RNA, 22 nt, Human
ugcuucuguuuuauaauuuugu

SEQ ID NO: 1479126 - RNA, 13 nt, Human
uggaacuugaacu

SEQ ID NO: 1479127 - RNA, 15 nt, Human
uggaacuugaacuga

SEQ ID NO: 1479128 - RNA, 16 nt, Human
uggaacuugaacugau

SEQ ID NO: 1479129 - RNA, 20 nt, Human
uggaacauaaaaaggacauc

SEQ ID NO: 1479130 - RNA, 18 nt, Human
uggaacauaaaaaggaca

SEQ ID NO: 1479131 - RNA, 22 nt, Human
uggaaaaguauguuagugcaaa

SEQ ID NO: 1479132 - RNA, 16 nt, Human
uggaaaccuuccaccc

SEQ ID NO: 1479133 - RNA, 19 nt, Human
uggaaaccuuccacccagu

SEQ ID NO: 1479134 - RNA, 13 nt, Human
ugcuucuccagcc

SEQ ID NO: 1479135 - RNA, 17 nt, Human
ugcuucuguuuuauaau

SEQ ID NO: 1479136 - RNA, 22 nt, Human
ugcuucucagauuucugaggaa

SEQ ID NO: 1479137 - RNA, 21 nt, Human
ugcuucucagauuucugagga

SEQ ID NO: 1479138 - RNA, 16 nt, Human
ugcuucccuuuccuga

SEQ ID NO: 1479139 - RNA, 20 nt, Human
ugcuuaauucaaauaauaau

SEQ ID NO: 1479140 - RNA, 18 nt, Human
ugcuuaauucaaauaaua

SEQ ID NO: 1479141 - RNA, 17 nt, Human
ugcuuaauucaaauaau

SEQ ID NO: 1479142 - RNA, 16 nt, Human
ugcuuaauucaaauaa

SEQ ID NO: 1479143 - RNA, 15 nt, Human
ugcuuaauaaauugu

SEQ ID NO: 1479144 - RNA, 18 nt, Human
ugcuguuuugauuuguac

SEQ ID NO: 1479145 - RNA, 19 nt, Human
uggaucaaauccagccugc

SEQ ID NO: 1479146 - RNA, 17 nt, Human
uggauauaguuuuacuu

SEQ ID NO: 1479147 - RNA, 16 nt, Human
uggauauguaaaacau

SEQ ID NO: 1479148 - RNA, 21 nt, Human
uggauauguaaaacauuuauu

SEQ ID NO: 1479149 - RNA, 17 nt, Human
uggauauguaaaacauu

SEQ ID NO: 1479150 - RNA, 17 nt, Human
uggagaugaggccagac

SEQ ID NO: 1479151 - RNA, 16 nt, Human
uggagaugaggccaga

SEQ ID NO: 1479152 - RNA, 15 nt, Human
uggagaugaggccag

SEQ ID NO: 1479153 - RNA, 14 nt, Human
uggagaugaggcca

SEQ ID NO: 1479154 - RNA, 23 nt, Human
uggagaucaccaguguguggcuu

SEQ ID NO: 1479155 - RNA, 21 nt, Human
uggaggggcagagccaggaag

SEQ ID NO: 1479156 - RNA, 18 nt, Human
uggaggggcagagccagg

SEQ ID NO: 1479157 - RNA, 16 nt, Human
uggaggggcagagcca

SEQ ID NO: 1479158 - RNA, 14 nt, Human
uggaggggcagagc

SEQ ID NO: 1479159 - RNA, 13 nt, Human
uggaggggcagag

SEQ ID NO: 1479160 - RNA, 23 nt, Human
uggaggggcagagccaggaagau

SEQ ID NO: 1479161 - RNA, 16 nt, Human
uggaggggcuggggac

SEQ ID NO: 1479162 - RNA, 16 nt, Human
uggcaaccagaccauu

SEQ ID NO: 1479163 - RNA, 15 nt, Human
uggacugucauagaa

SEQ ID NO: 1479164 - RNA, 21 nt, Human
uggacugucauagaaauuaca

SEQ ID NO: 1479165 - RNA, 14 nt, Human
uggacugguuuuca

SEQ ID NO: 1479166 - RNA, 13 nt, Human
ugauguacaugua

SEQ ID NO: 1479167 - RNA, 21 nt, Human
ugauguaaaaucuugucaugu

SEQ ID NO: 1479168 - RNA, 11 nt, Human
ugauguaaaau

SEQ ID NO: 1479169 - RNA, 15 nt, Human
ugauguaaaaucuug

SEQ ID NO: 1479170 - RNA, 16 nt, Human
ugauguaaaaucuugu

SEQ ID NO: 1479171 - RNA, 19 nt, Human
ugauguaaaaucuugucau

SEQ ID NO: 1479172 - RNA, 23 nt, Human
ugauguaaaaucuugucaugugu

SEQ ID NO: 1479173 - RNA, 20 nt, Human
ugaucugauaggguuuguga

SEQ ID NO: 1479174 - RNA, 22 nt, Human
ugaucugauaggguuugugaca

SEQ ID NO: 1479175 - RNA, 12 nt, Human
ugaugaaaauaa

SEQ ID NO: 1479176 - RNA, 13 nt, Human
ugaugaaaauaaa

SEQ ID NO: 1479177 - RNA, 14 nt, Human
ugaugccaaaaaaa

SEQ ID NO: 1479178 - RNA, 18 nt, Human
ugaugccaaaaaaaaaua

SEQ ID NO: 1479179 - RNA, 21 nt, Human
ugaugccaaaaaaaaauacau

SEQ ID NO: 1479180 - RNA, 15 nt, Human
ugaugaaaauaaaga

SEQ ID NO: 1479181 - RNA, 16 nt, Human
ugaugaaaauaaagaa

SEQ ID NO: 1479182 - RNA, 17 nt, Human
ugaugaaaauaaagaau

SEQ ID NO: 1479183 - RNA, 19 nt, Human
ugaugaaaauaaagaaugg

SEQ ID NO: 1479184 - RNA, 23 nt, Human
ugauauaaguguguguuuuucau

SEQ ID NO: 1479185 - RNA, 17 nt, Human
ugauauaaguguguguu

SEQ ID NO: 1479186 - RNA, 13 nt, Human
ugauauauuuuac

SEQ ID NO: 1479187 - RNA, 14 nt, Human
ugauauauuuuaca

SEQ ID NO: 1479188 - RNA, 15 nt, Human
ugauauauuuuacaa

SEQ ID NO: 1479189 - RNA, 18 nt, Human
ugaucucagcucacugca

SEQ ID NO: 1479190 - RNA, 19 nt, Human
ugaucucagcucacugcaa

SEQ ID NO: 1479191 - RNA, 21 nt, Human
ugaucaguuuuuucaccugga

SEQ ID NO: 1479192 - RNA, 14 nt, Human
ugaggcuuuccaug

SEQ ID NO: 1479193 - RNA, 17 nt, Human
ugagggaaaagaaaaag

SEQ ID NO: 1479194 - RNA, 19 nt, Human
ugaggcuuuccaugggacc

SEQ ID NO: 1479195 - RNA, 19 nt, Human
ugaggagacacaccugagg

SEQ ID NO: 1479196 - RNA, 15 nt, Human
ugaggagacacaccu

SEQ ID NO: 1479197 - RNA, 19 nt, Human
ugauaggguuugugacagg

SEQ ID NO: 1479198 - RNA, 18 nt, Human
ugauaaagauuuuuuaau

SEQ ID NO: 1479199 - RNA, 19 nt, Human
ugauaaagauuuuuuaaua

SEQ ID NO: 1479200 - RNA, 20 nt, Human
ugauaaagauuuuuuaauaa

SEQ ID NO: 1479201 - RNA, 17 nt, Human
ugagcagucaggaaaga

SEQ ID NO: 1479202 - RNA, 20 nt, Human
ugagcagucaggaaagagaa

SEQ ID NO: 1479203 - RNA, 12 nt, Human
ugagcucucugu

SEQ ID NO: 1479204 - RNA, 12 nt, Human
ugagcucuucau

SEQ ID NO: 1479205 - RNA, 15 nt, Human
ugagcucuucauguu

SEQ ID NO: 1479206 - RNA, 16 nt, Human
ugagcucuucauguuu

SEQ ID NO: 1479207 - RNA, 18 nt, Human
ugagcucuucauguuuca

SEQ ID NO: 1479208 - RNA, 18 nt, Human
ugagaccuaaucucugua

SEQ ID NO: 1479209 - RNA, 19 nt, Human
ugagaccuaaucucuguaa

SEQ ID NO: 1479210 - RNA, 20 nt, Human
ugagaccuaaucucuguaaa

SEQ ID NO: 1479211 - RNA, 17 nt, Human
ugagaaaucuaaaaaac

SEQ ID NO: 1479212 - RNA, 13 nt, Human
ugagaaauuuaaa

SEQ ID NO: 1479213 - RNA, 14 nt, Human
ugagaaauuuaaac

SEQ ID NO: 1479214 - RNA, 15 nt, Human
ugagaaauuuaaacu

SEQ ID NO: 1479215 - RNA, 17 nt, Human
ugagaaauuuaaacuau

SEQ ID NO: 1479216 - RNA, 14 nt, Human
ugacugccaagacu

SEQ ID NO: 1479217 - RNA, 21 nt, Human
ugacugccaagacugcugugg

SEQ ID NO: 1479218 - RNA, 22 nt, Human
ugacugccaagacugcuguggc

SEQ ID NO: 1479219 - RNA, 17 nt, Human
ugacugccaagccaugg

SEQ ID NO: 1479220 - RNA, 16 nt, Human
ugacugccaagccaug

SEQ ID NO: 1479221 - RNA, 14 nt, Human
ugacugccaagcca

SEQ ID NO: 1479222 - RNA, 13 nt, Human
ugacugccaagcc

SEQ ID NO: 1479223 - RNA, 13 nt, Human
ugacucuuaagaa

SEQ ID NO: 1479224 - RNA, 12 nt, Human
ugacucuuaaga

SEQ ID NO: 1479225 - RNA, 14 nt, Human
ugacgucugggugg

SEQ ID NO: 1479226 - RNA, 15 nt, Human
ugacgucuggguggc

SEQ ID NO: 1479227 - RNA, 18 nt, Human
ugacgucuggguggcccu

SEQ ID NO: 1479228 - RNA, 16 nt, Human
ucuugaauaauguaag

SEQ ID NO: 1479229 - RNA, 20 nt, Human
ugaccucaagugaucugccc

SEQ ID NO: 1479230 - RNA, 17 nt, Human
ugaccuaguuuuccaug

SEQ ID NO: 1479231 - RNA, 22 nt, Human
ugaccuaguuuuccaugcgugu

SEQ ID NO: 1479232 - RNA, 23 nt, Human
ugacccuccaccgcagaaggaag

SEQ ID NO: 1479233 - RNA, 14 nt, Human
ugacccuccccaaa

SEQ ID NO: 1479234 - RNA, 22 nt, Human
ugacccuccaccgcagaaggaa

SEQ ID NO: 1479235 - RNA, 17 nt, Human
ugacccugagcugacca

SEQ ID NO: 1479236 - RNA, 14 nt, Human
ugacccugagcuga

SEQ ID NO: 1479237 - RNA, 18 nt, Human
ugaccucgugauccaccc

SEQ ID NO: 1479238 - RNA, 22 nt, Human
ugaccuccaugacugcacagua

SEQ ID NO: 1479239 - RNA, 14 nt, Human
ugcauuauauuuau

SEQ ID NO: 1479240 - RNA, 15 nt, Human
ugcauuacugcaugc

SEQ ID NO: 1479241 - RNA, 17 nt, Human
ugcauuacugcaugcac

SEQ ID NO: 1479242 - RNA, 18 nt, Human
ugcauuacugcaugcacu

SEQ ID NO: 1479243 - RNA, 22 nt, Human
ugcauuauaucaaaucuaccac

SEQ ID NO: 1479244 - RNA, 18 nt, Human
ugcagauggugagagaua

SEQ ID NO: 1479245 - RNA, 18 nt, Human
ugcauccauucuccugag

SEQ ID NO: 1479246 - RNA, 19 nt, Human
ugcauccauucuccugagg

SEQ ID NO: 1479247 - RNA, 16 nt, Human
ugccaugaugccucug

SEQ ID NO: 1479248 - RNA, 17 nt, Human
ugccaugaugccucugu

SEQ ID NO: 1479249 - RNA, 19 nt, Human
ugccaugaugccucugucu

SEQ ID NO: 1479250 - RNA, 20 nt, Human
ugccauguaggguucccuua

SEQ ID NO: 1479251 - RNA, 18 nt, Human
ugccaugucaaacaaaua

SEQ ID NO: 1479252 - RNA, 17 nt, Human
ugccaugucaaacaaau

SEQ ID NO: 1479253 - RNA, 18 nt, Human
ugcccugcccugccaccu

SEQ ID NO: 1479254 - RNA, 15 nt, Human
ugcccugcccugcca

SEQ ID NO: 1479255 - RNA, 14 nt, Human
ugcccugcccugcc

SEQ ID NO: 1479256 - RNA, 18 nt, Human
ugcccgggagcucaggaa

SEQ ID NO: 1479257 - RNA, 17 nt, Human
ugcccgggagcucagga

SEQ ID NO: 1479258 - RNA, 17 nt, Human
ugcccugcugcccuccc

SEQ ID NO: 1479259 - RNA, 14 nt, Human
ugcccugcugcccu

SEQ ID NO: 1479260 - RNA, 16 nt, Human
ugcccugcugcccucc

SEQ ID NO: 1479261 - RNA, 19 nt, Human
ugccgucagugcugugcug

SEQ ID NO: 1479262 - RNA, 14 nt, Human
ugccucuucccucu

SEQ ID NO: 1479263 - RNA, 21 nt, Human
ugccucuuccagucuuccuga

SEQ ID NO: 1479264 - RNA, 23 nt, Human
ugccucuuccagucuuccugaca

SEQ ID NO: 1479265 - RNA, 20 nt, Human
ugccugguauauccaaaagc

SEQ ID NO: 1479266 - RNA, 23 nt, Human
ugccugguauauccaaaagcuuu

SEQ ID NO: 1479267 - RNA, 16 nt, Human
ugccucccuucaugca

SEQ ID NO: 1479268 - RNA, 12 nt, Human
ugccuccucacc

SEQ ID NO: 1479269 - RNA, 22 nt, Human
ugccucccucucguaagauuuc

SEQ ID NO: 1479270 - RNA, 23 nt, Human
ugccucccucucguaagauuucc

SEQ ID NO: 1479271 - RNA, 19 nt, Human
ugccuccucacccccagcu

SEQ ID NO: 1479272 - RNA, 24 nt, Human
ugccuccucacccccagcuuugcu

SEQ ID NO: 1479273 - RNA, 14 nt, Human
ugcaaaaaggguca

SEQ ID NO: 1479274 - RNA, 19 nt, Human
ugcaaaaacuacaaccaau

SEQ ID NO: 1479275 - RNA, 18 nt, Human
ugauuuuuuuuucauaca

SEQ ID NO: 1479276 - RNA, 22 nt, Human
ugauuuuuuuuucauacacuua

SEQ ID NO: 1479277 - RNA, 18 nt, Human
ugauuuuuaugccaccug

SEQ ID NO: 1479278 - RNA, 21 nt, Human
ugauuuuugccucuuccaguc

SEQ ID NO: 1479279 - RNA, 22 nt, Human
ugauuuuugccucuuccagucu

SEQ ID NO: 1479280 - RNA, 16 nt, Human
ugauuuuuuuuccuuu

SEQ ID NO: 1479281 - RNA, 20 nt, Human
ugauuuucaaagcuuuuucc

SEQ ID NO: 1479282 - RNA, 13 nt, Human
ugauuuucuggau

SEQ ID NO: 1479283 - RNA, 15 nt, Human
ugauuuugaaaccau

SEQ ID NO: 1479284 - RNA, 11 nt, Human
ugauuuugaac

SEQ ID NO: 1479285 - RNA, 15 nt, Human
ugauuuugaaaucau

SEQ ID NO: 1479286 - RNA, 23 nt, Human
ugauuuugaaccugaugaaaaua

SEQ ID NO: 1479287 - RNA, 19 nt, Human
ugauuuuaagaauccaaac

SEQ ID NO: 1479288 - RNA, 16 nt, Human
ugauuuuaauaauaua

SEQ ID NO: 1479289 - RNA, 15 nt, Human
ugauuuuagccuucu

SEQ ID NO: 1479290 - RNA, 19 nt, Human
ugauuuuagccuucucugu

SEQ ID NO: 1479291 - RNA, 18 nt, Human
ugcaacuuuguauaaaag

SEQ ID NO: 1479292 - RNA, 22 nt, Human
ugcaacucugaaggguaauuau

SEQ ID NO: 1479293 - RNA, 14 nt, Human
ugcaaccucugccu

SEQ ID NO: 1479294 - RNA, 15 nt, Human
ugcaaccuccaccuc

SEQ ID NO: 1479295 - RNA, 18 nt, Human
ugcaaccuccaccuccug

SEQ ID NO: 1479296 - RNA, 19 nt, Human
ugcaaccuccaccuccugg

SEQ ID NO: 1479297 - RNA, 20 nt, Human
ugcaaccuccaccuccuggg

SEQ ID NO: 1479298 - RNA, 21 nt, Human
ugcaaccuccaccuccugggu

SEQ ID NO: 1479299 - RNA, 13 nt, Human
ugcaaccuccacc

SEQ ID NO: 1479300 - RNA, 16 nt, Human
ugcaaccgucuguuau

SEQ ID NO: 1479301 - RNA, 14 nt, Human
ugcacaguaaaaau

SEQ ID NO: 1479302 - RNA, 21 nt, Human
ugcacaaauauuuauuuucuu

SEQ ID NO: 1479303 - RNA, 14 nt, Human
ugcaccuuucuagu

SEQ ID NO: 1479304 - RNA, 22 nt, Human
ugcacuuauuuaugaaccugcc

SEQ ID NO: 1479305 - RNA, 14 nt, Human
ugcacuucuuacaa

SEQ ID NO: 1479306 - RNA, 18 nt, Human
ugcaccuuucuaguugaa

SEQ ID NO: 1479307 - RNA, 22 nt, Human
ugcaauguaaauauuuuaaaga

SEQ ID NO: 1479308 - RNA, 22 nt, Human
ucugucucuggauuauauuaug

SEQ ID NO: 1479309 - RNA, 14 nt, Human
ucuggaauacauga

SEQ ID NO: 1479310 - RNA, 22 nt, Human
ucuggaauacaugaaauauaga

SEQ ID NO: 1479311 - RNA, 19 nt, Human
ucuggacaggauguguuug

SEQ ID NO: 1479312 - RNA, 15 nt, Human
ucugccaggagacag

SEQ ID NO: 1479313 - RNA, 22 nt, Human
ucuuaaccagaucauugugaaa

SEQ ID NO: 1479314 - RNA, 12 nt, Human
ucuuaagaagac

SEQ ID NO: 1479315 - RNA, 18 nt, Human
ucuuaagaagacugcauu

SEQ ID NO: 1479316 - RNA, 15 nt, Human
ucuuagcugucugcu

SEQ ID NO: 1479317 - RNA, 18 nt, Human
ucuuagcugucugcucag

SEQ ID NO: 1479318 - RNA, 23 nt, Human
ucuuagcugucugcucagacaga

SEQ ID NO: 1479319 - RNA, 15 nt, Human
ucuuaaauaaaccuu

SEQ ID NO: 1479320 - RNA, 15 nt, Human
ucuuaaauaagaaac

SEQ ID NO: 1479321 - RNA, 16 nt, Human
ucuuaaauaagaaacu

SEQ ID NO: 1479322 - RNA, 18 nt, Human
ucuuaaauaagaaacuuu

SEQ ID NO: 1479323 - RNA, 19 nt, Human
ucuuaaauaagaaacuuuu

SEQ ID NO: 1479324 - RNA, 17 nt, Human
ucuuaaccagaucauug

SEQ ID NO: 1479325 - RNA, 16 nt, Human
ucuuaaccagaucauu

SEQ ID NO: 1479326 - RNA, 18 nt, Human
ucugucugucugucccaa

SEQ ID NO: 1479327 - RNA, 15 nt, Human
ucugucugucugucc

SEQ ID NO: 1479328 - RNA, 16 nt, Human
ucugucugucccaaag

SEQ ID NO: 1479329 - RNA, 15 nt, Human
ucugucugucccaaa

SEQ ID NO: 1479330 - RNA, 14 nt, Human
ucugucugucccaa

SEQ ID NO: 1479331 - RNA, 14 nt, Human
ucugucuucuggac

SEQ ID NO: 1479332 - RNA, 12 nt, Human
ucugucuugaag

SEQ ID NO: 1479333 - RNA, 23 nt, Human
ucuguuuucuuucuaaugagaua

SEQ ID NO: 1479334 - RNA, 16 nt, Human
ucuuaaacacuugcaa

SEQ ID NO: 1479335 - RNA, 16 nt, Human
ucuuaaaccuucaguu

SEQ ID NO: 1479336 - RNA, 18 nt, Human
ucuguuuuucuaacuggg

SEQ ID NO: 1479337 - RNA, 17 nt, Human
ucuuccuucccugcugu

SEQ ID NO: 1479338 - RNA, 15 nt, Human
ucuuccuucccugcu

SEQ ID NO: 1479339 - RNA, 14 nt, Human
ucuuccuucccugc

SEQ ID NO: 1479340 - RNA, 16 nt, Human
ucuucucccaauucau

SEQ ID NO: 1479341 - RNA, 19 nt, Human
ucuucuccauccuaccaca

SEQ ID NO: 1479342 - RNA, 13 nt, Human
ucuugaaaaaugc

SEQ ID NO: 1479343 - RNA, 22 nt, Human
ucuuaggguuaugauuaaguaa

SEQ ID NO: 1479344 - RNA, 23 nt, Human
ucucugaggggcuaccaggaaag

SEQ ID NO: 1479345 - RNA, 18 nt, Human
ucucugcaggucccuaau

SEQ ID NO: 1479346 - RNA, 16 nt, Human
ucucugcaggucccua

SEQ ID NO: 1479347 - RNA, 15 nt, Human
ucucugcaggucccu

SEQ ID NO: 1479348 - RNA, 12 nt, Human
ucucuguaaagc

SEQ ID NO: 1479349 - RNA, 14 nt, Human
ucucuguaaagcua

SEQ ID NO: 1479350 - RNA, 11 nt, Human
ucucugugcuu

SEQ ID NO: 1479351 - RNA, 14 nt, Human
ucucugcagguccc

SEQ ID NO: 1479352 - RNA, 13 nt, Human
ucucugcaggucc

SEQ ID NO: 1479353 - RNA, 22 nt, Human
ucucugaggggcuaccaggaaa

SEQ ID NO: 1479354 - RNA, 21 nt, Human
ucucugaggggcuaccaggaa

SEQ ID NO: 1479355 - RNA, 15 nt, Human
ucucugauacagaaa

SEQ ID NO: 1479356 - RNA, 13 nt, Human
ucucucucuacaa

SEQ ID NO: 1479357 - RNA, 14 nt, Human
ucucucucuacaaa

SEQ ID NO: 1479358 - RNA, 20 nt, Human
ucucaauauucaauaaagcu

SEQ ID NO: 1479359 - RNA, 17 nt, Human
ucucaauauucaauaaa

SEQ ID NO: 1479360 - RNA, 18 nt, Human
ucucaauauucaauaaag

SEQ ID NO: 1479361 - RNA, 21 nt, Human
ucuccuggaagugcuaauuuu

SEQ ID NO: 1479362 - RNA, 19 nt, Human
ucuccugccucagccuccc

SEQ ID NO: 1479363 - RNA, 14 nt, Human
ucugcaacucugaa

SEQ ID NO: 1479364 - RNA, 15 nt, Human
ucugcaacucugaag

SEQ ID NO: 1479365 - RNA, 22 nt, Human
ucugcacacccuccagagacaa

SEQ ID NO: 1479366 - RNA, 17 nt, Human
ucugaaauuuccuggga

SEQ ID NO: 1479367 - RNA, 18 nt, Human
ucugaaauuuccugggag

SEQ ID NO: 1479368 - RNA, 20 nt, Human
ucugaaauuuccugggagcu

SEQ ID NO: 1479369 - RNA, 12 nt, Human
ucugaacacauu

SEQ ID NO: 1479370 - RNA, 13 nt, Human
ucugaacacauug

SEQ ID NO: 1479371 - RNA, 23 nt, Human
ucugacauaauccaguaaaauaa

SEQ ID NO: 1479372 - RNA, 19 nt, Human
ucugacauaauccaguaaa

SEQ ID NO: 1479373 - RNA, 13 nt, Human
ucugacauaaucc

SEQ ID NO: 1479374 - RNA, 15 nt, Human
ucugacauaaguauu

SEQ ID NO: 1479375 - RNA, 22 nt, Human
ucugaaaauugaugggauuugg

SEQ ID NO: 1479376 - RNA, 12 nt, Human
ucugaaagagaa

SEQ ID NO: 1479377 - RNA, 14 nt, Human
ucugaaaauugaug

SEQ ID NO: 1479378 - RNA, 18 nt, Human
ucucugugugcacaaaua

SEQ ID NO: 1479379 - RNA, 13 nt, Human
ucucuguucauuu

SEQ ID NO: 1479380 - RNA, 14 nt, Human
ucucuguucauuuc

SEQ ID NO: 1479381 - RNA, 16 nt, Human
ucucuguucauuuccu

SEQ ID NO: 1479382 - RNA, 17 nt, Human
ucucuguucauuuccuc

SEQ ID NO: 1479383 - RNA, 18 nt, Human
ucucuguucauuuccuca

SEQ ID NO: 1479384 - RNA, 21 nt, Human
ucguguguuucuauuuuuuga

SEQ ID NO: 1479385 - RNA, 13 nt, Human
ucguuaauuugua

SEQ ID NO: 1479386 - RNA, 14 nt, Human
ucgugucuggcaca

SEQ ID NO: 1479387 - RNA, 21 nt, Human
ucgugucuggcacagccuggc

SEQ ID NO: 1479388 - RNA, 22 nt, Human
ucuaauagggcaauuaauuccu

SEQ ID NO: 1479389 - RNA, 16 nt, Human
ucuaauagggcaauua

SEQ ID NO: 1479390 - RNA, 13 nt, Human
ucuaacagauuag

SEQ ID NO: 1479391 - RNA, 21 nt, Human
ucguggaacaguuaccucugc

SEQ ID NO: 1479392 - RNA, 22 nt, Human
ucgugggacagucaccucaugg

SEQ ID NO: 1479393 - RNA, 19 nt, Human
ucggccucccaaagugcug

SEQ ID NO: 1479394 - RNA, 23 nt, Human
ucuaggacugaauuaugaaacuu

SEQ ID NO: 1479395 - RNA, 16 nt, Human
ucuaggacugaauuau

SEQ ID NO: 1479396 - RNA, 13 nt, Human
ucuagaacacagg

SEQ ID NO: 1479397 - RNA, 15 nt, Human
ucuagaacacaggca

SEQ ID NO: 1479398 - RNA, 16 nt, Human
ucuagaacacaggcaa

SEQ ID NO: 1479399 - RNA, 23 nt, Human
ucuaggacacaguuccugggaac

SEQ ID NO: 1479400 - RNA, 21 nt, Human
ucuaggacacaguuccuggga

SEQ ID NO: 1479401 - RNA, 13 nt, Human
ucuaggacacagu

SEQ ID NO: 1479402 - RNA, 22 nt, Human
ucuagugagcagucaggaaaga

SEQ ID NO: 1479403 - RNA, 19 nt, Human
ucuagugagcagucaggaa

SEQ ID NO: 1479404 - RNA, 21 nt, Human
ucuaucaaccccagacacugg

SEQ ID NO: 1479405 - RNA, 14 nt, Human
ucuaugcauuuucu

SEQ ID NO: 1479406 - RNA, 15 nt, Human
ucuaugcauuuucug

SEQ ID NO: 1479407 - RNA, 14 nt, Human
ucuaugaaauauua

SEQ ID NO: 1479408 - RNA, 17 nt, Human
ucuaugaaauauuaugu

SEQ ID NO: 1479409 - RNA, 18 nt, Human
ucuaugaaauauuauguu

SEQ ID NO: 1479410 - RNA, 22 nt, Human
ucuaucaaccccagacacuggu

SEQ ID NO: 1479411 - RNA, 19 nt, Human
ucuaucaaccccagacacu

SEQ ID NO: 1479412 - RNA, 20 nt, Human
ucuaucaaccccagacacug

SEQ ID NO: 1479413 - RNA, 16 nt, Human
uccuuggccaugcaga

SEQ ID NO: 1479414 - RNA, 10 nt, Human
uccuuuguuc

SEQ ID NO: 1479415 - RNA, 23 nt, Human
uccuuggcaggcugauuucuagg

SEQ ID NO: 1479416 - RNA, 21 nt, Human
uccuuggcaggcugauuucua

SEQ ID NO: 1479417 - RNA, 17 nt, Human
uccuuuuaauuuuccug

SEQ ID NO: 1479418 - RNA, 16 nt, Human
uccuuuguucuuaccu

SEQ ID NO: 1479419 - RNA, 24 nt, Human
uccuuuguucuuaccuguaugucu

SEQ ID NO: 1479420 - RNA, 22 nt, Human
uccugucgauuagacuggacag

SEQ ID NO: 1479421 - RNA, 22 nt, Human
uccuugcuuaugacaucacuug

SEQ ID NO: 1479422 - RNA, 17 nt, Human
uccugccucagccuccc

SEQ ID NO: 1479423 - RNA, 14 nt, Human
uccugccucagccu

SEQ ID NO: 1479424 - RNA, 17 nt, Human
uccugucgauuagacug

SEQ ID NO: 1479425 - RNA, 21 nt, Human
uccugucgauuagacuggaca

SEQ ID NO: 1479426 - RNA, 19 nt, Human
ucccuccugggaaugaagc

SEQ ID NO: 1479427 - RNA, 11 nt, Human
ucccuccuggg

SEQ ID NO: 1479428 - RNA, 16 nt, Human
ucccuccucugcccgg

SEQ ID NO: 1479429 - RNA, 14 nt, Human
ucccuccuguuggg

SEQ ID NO: 1479430 - RNA, 11 nt, Human
ucccuccuugg

SEQ ID NO: 1479431 - RNA, 12 nt, Human
ucccuccuuggu

SEQ ID NO: 1479432 - RNA, 16 nt, Human
ucccuaauaaagcugu

SEQ ID NO: 1479433 - RNA, 19 nt, Human
ucccuaucuuugccacccu

SEQ ID NO: 1479434 - RNA, 14 nt, Human
ucccuauacugcuu

SEQ ID NO: 1479435 - RNA, 15 nt, Human
ucccuauacugcuug

SEQ ID NO: 1479436 - RNA, 17 nt, Human
ucccuauacugcuugga

SEQ ID NO: 1479437 - RNA, 15 nt, Human
ucccuaauaaagcug

SEQ ID NO: 1479438 - RNA, 20 nt, Human
ucccgucaccccuguuucug

SEQ ID NO: 1479439 - RNA, 15 nt, Human
ucccuugaugaagaa

SEQ ID NO: 1479440 - RNA, 16 nt, Human
ucccuugaugaagaag

SEQ ID NO: 1479441 - RNA, 18 nt, Human
ucccuucaugcauggaaa

SEQ ID NO: 1479442 - RNA, 17 nt, Human
ucccuucaugcauggaa

SEQ ID NO: 1479443 - RNA, 21 nt, Human
ucccuucaucuggaaccauca

SEQ ID NO: 1479444 - RNA, 18 nt, Human
ucccuggcccccucccug

SEQ ID NO: 1479445 - RNA, 19 nt, Human
ucccuggauuuuuaccagu

SEQ ID NO: 1479446 - RNA, 20 nt, Human
ucccuggcccccucccugga

SEQ ID NO: 1479447 - RNA, 18 nt, Human
ucccuggaugacauuaaa

SEQ ID NO: 1479448 - RNA, 20 nt, Human
ucccuggaugacauuaaaga

SEQ ID NO: 1479449 - RNA, 20 nt, Human
ucccuggauuuuuaccaguc

SEQ ID NO: 1479450 - RNA, 18 nt, Human
ucccuggauuuuuaccag

SEQ ID NO: 1479451 - RNA, 17 nt, Human
ucccuggauuuuuacca

SEQ ID NO: 1479452 - RNA, 16 nt, Human
ucccuuccuuccucuc

SEQ ID NO: 1479453 - RNA, 19 nt, Human
ucccuuccuuccucuccug

SEQ ID NO: 1479454 - RNA, 23 nt, Human
ucccuggaaaccuuccacccagu

SEQ ID NO: 1479455 - RNA, 18 nt, Human
ucccuggaaggacaucca

SEQ ID NO: 1479456 - RNA, 22 nt, Human
ucccuggaaaccuuccacccag

SEQ ID NO: 1479457 - RNA, 20 nt, Human
ucccuggaaaccuuccaccc

SEQ ID NO: 1479458 - RNA, 13 nt, Human
ucccugccuggac

SEQ ID NO: 1479459 - RNA, 17 nt, Human
ucccugccucucaucaa

SEQ ID NO: 1479460 - RNA, 23 nt, Human
ucccugccucucaucaacugaau

SEQ ID NO: 1479461 - RNA, 13 nt, Human
ucccugccuccug

SEQ ID NO: 1479462 - RNA, 16 nt, Human
ucccugccuccugccg

SEQ ID NO: 1479463 - RNA, 18 nt, Human
ucccugccuccugccggc

SEQ ID NO: 1479464 - RNA, 16 nt, Human
ucccucucucauaccc

SEQ ID NO: 1479465 - RNA, 14 nt, Human
ucccucucguaaga

SEQ ID NO: 1479466 - RNA, 19 nt, Human
uccucuucuauuuuguaaa

SEQ ID NO: 1479467 - RNA, 21 nt, Human
uccucaugaauguaaauuugu

SEQ ID NO: 1479468 - RNA, 20 nt, Human
uccucaugaauguaaauuug

SEQ ID NO: 1479469 - RNA, 22 nt, Human
uccuccuuccggggaaggauuu

SEQ ID NO: 1479470 - RNA, 20 nt, Human
uccuccuuccggggaaggau

SEQ ID NO: 1479471 - RNA, 20 nt, Human
uccuaguuuucuccucccag

SEQ ID NO: 1479472 - RNA, 13 nt, Human
uccuaguuuucuc

SEQ ID NO: 1479473 - RNA, 14 nt, Human
uccucaugaaugua

SEQ ID NO: 1479474 - RNA, 15 nt, Human
uccucaugaauguaa

SEQ ID NO: 1479475 - RNA, 17 nt, Human
uccucaugaauguaaau

SEQ ID NO: 1479476 - RNA, 16 nt, Human
uccuaauuuugagaaa

SEQ ID NO: 1479477 - RNA, 19 nt, Human
uccuaauaauaucccacug

SEQ ID NO: 1479478 - RNA, 22 nt, Human
uccuaauaauaucccacuggga

SEQ ID NO: 1479479 - RNA, 17 nt, Human
uauucguuaucuaauag

SEQ ID NO: 1479480 - RNA, 21 nt, Human
uauucuagccugcauugagcu

SEQ ID NO: 1479481 - RNA, 10 nt, Human
uauucuaguc

SEQ ID NO: 1479482 - RNA, 16 nt, Human
uauucuagccugcauu

SEQ ID NO: 1479483 - RNA, 14 nt, Human
uauuccuauugugc

SEQ ID NO: 1479484 - RNA, 16 nt, Human
uauuccucaaaaaauu

SEQ ID NO: 1479485 - RNA, 18 nt, Human
uauuccuccugcucauau

SEQ ID NO: 1479486 - RNA, 22 nt, Human
uauuccuguggauguaaaguga

SEQ ID NO: 1479487 - RNA, 17 nt, Human
uauuauuaacauaccua

SEQ ID NO: 1479488 - RNA, 19 nt, Human
uauuauuacuuauuuuuga

SEQ ID NO: 1479489 - RNA, 15 nt, Human
uauuacaaugaucac

SEQ ID NO: 1479490 - RNA, 16 nt, Human
uauuacacucuguaau

SEQ ID NO: 1479491 - RNA, 19 nt, Human
uauuacacucuguaauuga

SEQ ID NO: 1479492 - RNA, 14 nt, Human
uauuacaaugauca

SEQ ID NO: 1479493 - RNA, 17 nt, Human
uauuaauuuaugcagaa

SEQ ID NO: 1479494 - RNA, 17 nt, Human
uauuccccauucuuccu

SEQ ID NO: 1479495 - RNA, 19 nt, Human
uauuccaagacaugucugu

SEQ ID NO: 1479496 - RNA, 22 nt, Human
uauuuaguuguaaaccaaguga

SEQ ID NO: 1479497 - RNA, 19 nt, Human
uauuuaaaccgcuaaaaga

SEQ ID NO: 1479498 - RNA, 24 nt, Human
uauuuauaaaaauaaaaaacacug

SEQ ID NO: 1479499 - RNA, 21 nt, Human
uauuuaaaccgcuaaaagaaa

SEQ ID NO: 1479500 - RNA, 14 nt, Human
uauuuaaaaaacua

SEQ ID NO: 1479501 - RNA, 16 nt, Human
uauuuaaaaaacuaaa

SEQ ID NO: 1479502 - RNA, 21 nt, Human
uauuuaaaaaacuaaaaacua

SEQ ID NO: 1479503 - RNA, 20 nt, Human
uauuuaaaaaacuaaaaacu

SEQ ID NO: 1479504 - RNA, 14 nt, Human
uauuuaaaauagca

SEQ ID NO: 1479505 - RNA, 15 nt, Human
uauuuaaaauagcaa

SEQ ID NO: 1479506 - RNA, 23 nt, Human
uauuuaaaauagcaaaagaagaa

SEQ ID NO: 1479507 - RNA, 21 nt, Human
uauuuaaaauagcaaaagaag

SEQ ID NO: 1479508 - RNA, 22 nt, Human
uauuguuuuacaauaguucugu

SEQ ID NO: 1479509 - RNA, 20 nt, Human
uauuguuuuacaauaguucu

SEQ ID NO: 1479510 - RNA, 17 nt, Human
uauuguuuuacaauagu

SEQ ID NO: 1479511 - RNA, 15 nt, Human
uauuguuuuacaaua

SEQ ID NO: 1479512 - RNA, 14 nt, Human
uauuguuuuacaau

SEQ ID NO: 1479513 - RNA, 16 nt, Human
uauuggaauauaauug

SEQ ID NO: 1479514 - RNA, 17 nt, Human
uauuggacaaagaaccu

SEQ ID NO: 1479515 - RNA, 13 nt, Human
uauugccucacuu

SEQ ID NO: 1479516 - RNA, 15 nt, Human
uauugccucugagag

SEQ ID NO: 1479517 - RNA, 13 nt, Human
uauguacuucaug

SEQ ID NO: 1479518 - RNA, 17 nt, Human
uauguacuucaugcugu

SEQ ID NO: 1479519 - RNA, 10 nt, Human
uauguaccaa

SEQ ID NO: 1479520 - RNA, 12 nt, Human
uauguacaguua

SEQ ID NO: 1479521 - RNA, 14 nt, Human
uauguaccaagaau

SEQ ID NO: 1479522 - RNA, 23 nt, Human
uauguagaaaaaaguaaauguga

SEQ ID NO: 1479523 - RNA, 14 nt, Human
uauguagauaacaa

SEQ ID NO: 1479524 - RNA, 15 nt, Human
uauguaaaacauuua

SEQ ID NO: 1479525 - RNA, 13 nt, Human
uauggauucuaaa

SEQ ID NO: 1479526 - RNA, 14 nt, Human
uauggauucuaaaa

SEQ ID NO: 1479527 - RNA, 15 nt, Human
uauggauucuaaaau

SEQ ID NO: 1479528 - RNA, 15 nt, Human
uauggugcucugucu

SEQ ID NO: 1479529 - RNA, 23 nt, Human
uauggugcucugucuacuugcuc

SEQ ID NO: 1479530 - RNA, 13 nt, Human
uauguaaaacauu

SEQ ID NO: 1479531 - RNA, 16 nt, Human
uauggauucuaaaaug

SEQ ID NO: 1479532 - RNA, 20 nt, Human
uauggcaaccauuauaaccu

SEQ ID NO: 1479533 - RNA, 12 nt, Human
uauguugcauag

SEQ ID NO: 1479534 - RNA, 16 nt, Human
uaugucauuucauuuc

SEQ ID NO: 1479535 - RNA, 16 nt, Human
uauguugcauagaaua

SEQ ID NO: 1479536 - RNA, 18 nt, Human
uauuaauauauauuaucu

SEQ ID NO: 1479537 - RNA, 23 nt, Human
uauuaauauauauuaucuuuuca

SEQ ID NO: 1479538 - RNA, 22 nt, Human
uauuaauauauauuaucuuuuc

SEQ ID NO: 1479539 - RNA, 20 nt, Human
ucaaaucaaucuguaaaacu

SEQ ID NO: 1479540 - RNA, 23 nt, Human
ucaaauauauucagccuggcuuc

SEQ ID NO: 1479541 - RNA, 22 nt, Human
ucaaauauauucagccuggcuu

SEQ ID NO: 1479542 - RNA, 21 nt, Human
ucaaauauauucagccuggcu

SEQ ID NO: 1479543 - RNA, 23 nt, Human
ucaaaaauuaaaccggaccaucu

SEQ ID NO: 1479544 - RNA, 20 nt, Human
ucaaaaauuaucuauagcua

SEQ ID NO: 1479545 - RNA, 12 nt, Human
ucaaaaauuaaa

SEQ ID NO: 1479546 - RNA, 14 nt, Human
ucaaaacagauugu

SEQ ID NO: 1479547 - RNA, 16 nt, Human
ucaaaacagauuguuu

SEQ ID NO: 1479548 - RNA, 15 nt, Human
ucaaauccuugaaga

SEQ ID NO: 1479549 - RNA, 14 nt, Human
ucaaauucuucuga

SEQ ID NO: 1479550 - RNA, 15 nt, Human
ucaaauucuucugaa

SEQ ID NO: 1479551 - RNA, 20 nt, Human
ucaaauuguaagcaugcaca

SEQ ID NO: 1479552 - RNA, 17 nt, Human
ucaaauuguaagcaugc

SEQ ID NO: 1479553 - RNA, 14 nt, Human
ucaaauugugugaa

SEQ ID NO: 1479554 - RNA, 16 nt, Human
ucaaauucuucugaac

SEQ ID NO: 1479555 - RNA, 21 nt, Human
ucaaauucuucugaacucaaa

SEQ ID NO: 1479556 - RNA, 15 nt, Human
ucaaauugugugaaa

SEQ ID NO: 1479557 - RNA, 22 nt, Human
ucaaauugugcaguacuuugug

SEQ ID NO: 1479558 - RNA, 13 nt, Human
uauuuuuugaaaa

SEQ ID NO: 1479559 - RNA, 21 nt, Human
uauuuucugugccugaauauu

SEQ ID NO: 1479560 - RNA, 17 nt, Human
uauuuuuuuuaaguauu

SEQ ID NO: 1479561 - RNA, 17 nt, Human
uauuuuauguugcauag

SEQ ID NO: 1479562 - RNA, 17 nt, Human
ucaaugccccugaauuu

SEQ ID NO: 1479563 - RNA, 18 nt, Human
ucaaugccccugaauuua

SEQ ID NO: 1479564 - RNA, 20 nt, Human
ucaaugccccugaauuuaaa

SEQ ID NO: 1479565 - RNA, 22 nt, Human
ucaaugccccugaauuuaaaua

SEQ ID NO: 1479566 - RNA, 22 nt, Human
ucaauaagccucagcuuucuaa

SEQ ID NO: 1479567 - RNA, 21 nt, Human
ucaauaaaauccauacauuug

SEQ ID NO: 1479568 - RNA, 23 nt, Human
ucaaguuguuccuuaagucagaa

SEQ ID NO: 1479569 - RNA, 13 nt, Human
ucaauuaccacac

SEQ ID NO: 1479570 - RNA, 13 nt, Human
ucaauuacugguc

SEQ ID NO: 1479571 - RNA, 16 nt, Human
ucaauuacugguccaa

SEQ ID NO: 1479572 - RNA, 20 nt, Human
ucaauuacugguccaaaaga

SEQ ID NO: 1479573 - RNA, 22 nt, Human
ucacacccaacuugguuuugcu

SEQ ID NO: 1479574 - RNA, 20 nt, Human
ucacaccugaacugaacacc

SEQ ID NO: 1479575 - RNA, 11 nt, Human
ucacauuuucc

SEQ ID NO: 1479576 - RNA, 14 nt, Human
ucacauuuuccuuu

SEQ ID NO: 1479577 - RNA, 16 nt, Human
ucacauuuuccuuuuc

SEQ ID NO: 1479578 - RNA, 17 nt, Human
ucacauuuuccuuuuca

SEQ ID NO: 1479579 - RNA, 18 nt, Human
ucacauuuuccuuuucaa

SEQ ID NO: 1479580 - RNA, 15 nt, Human
ucaccagauuugcua

SEQ ID NO: 1479581 - RNA, 21 nt, Human
ucaccagauuugcuaauuuau

SEQ ID NO: 1479582 - RNA, 12 nt, Human
ucaccacaaacu

SEQ ID NO: 1479583 - RNA, 22 nt, Human
ucaccacaaacuguaauacaau

SEQ ID NO: 1479584 - RNA, 15 nt, Human
ucauuccauucugga

SEQ ID NO: 1479585 - RNA, 14 nt, Human
ucauuccauucugg

SEQ ID NO: 1479586 - RNA, 14 nt, Human
ucauucauuuuugu

SEQ ID NO: 1479587 - RNA, 22 nt, Human
ucauucacaucgcagauucucc

SEQ ID NO: 1479588 - RNA, 20 nt, Human
ucauucacaucgcagauucu

SEQ ID NO: 1479589 - RNA, 19 nt, Human
ucauuauuacuuuugcugu

SEQ ID NO: 1479590 - RNA, 23 nt, Human
ucauuauucguagauauuggaca

SEQ ID NO: 1479591 - RNA, 12 nt, Human
ucauuucaggau

SEQ ID NO: 1479592 - RNA, 19 nt, Human
ucauuccauucuggaagug

SEQ ID NO: 1479593 - RNA, 16 nt, Human
ucauuccauucuggaa

SEQ ID NO: 1479594 - RNA, 18 nt, Human
ucauugugaaauuauuca

SEQ ID NO: 1479595 - RNA, 17 nt, Human
ucauugugaaauuauuc

SEQ ID NO: 1479596 - RNA, 15 nt, Human
ucauugugaaauuau

SEQ ID NO: 1479597 - RNA, 12 nt, Human
ucauugugaaau

SEQ ID NO: 1479598 - RNA, 13 nt, Human
ucauuuccaagca

SEQ ID NO: 1479599 - RNA, 16 nt, Human
ucauuuccaagcaagu

SEQ ID NO: 1479600 - RNA, 15 nt, Human
ucauuucauuuccua

SEQ ID NO: 1479601 - RNA, 13 nt, Human
ucauuuccucaaa

SEQ ID NO: 1479602 - RNA, 14 nt, Human
ucauagcuaaaaaa

SEQ ID NO: 1479603 - RNA, 20 nt, Human
uccaggguggcagcaacaau

SEQ ID NO: 1479604 - RNA, 18 nt, Human
uccaggguggcagcaaca

SEQ ID NO: 1479605 - RNA, 15 nt, Human
uccaggguggcagca

SEQ ID NO: 1479606 - RNA, 14 nt, Human
uccaggguggcagc

SEQ ID NO: 1479607 - RNA, 21 nt, Human
uccagcuuuguucuucuuaaa

SEQ ID NO: 1479608 - RNA, 15 nt, Human
uccagccaucaccuu

SEQ ID NO: 1479609 - RNA, 19 nt, Human
uccagccaucaagagacug

SEQ ID NO: 1479610 - RNA, 20 nt, Human
uccagccaucaagagacuga

SEQ ID NO: 1479611 - RNA, 21 nt, Human
uccagccaucaagagacugag

SEQ ID NO: 1479612 - RNA, 24 nt, Human
uccagccaucaagagacugaguca

SEQ ID NO: 1479613 - RNA, 19 nt, Human
uccacagaagcuccaggua

SEQ ID NO: 1479614 - RNA, 14 nt, Human
uccaauuuucugga

SEQ ID NO: 1479615 - RNA, 18 nt, Human
uccaauuuucuggaauac

SEQ ID NO: 1479616 - RNA, 22 nt, Human
uccaaaauguuggucauuuuau

SEQ ID NO: 1479617 - RNA, 22 nt, Human
ucagaguaauccaagcaaaugu

SEQ ID NO: 1479618 - RNA, 21 nt, Human
ucagaguaauccaagcaaaug

SEQ ID NO: 1479619 - RNA, 19 nt, Human
ucagaggguguccugcacc

SEQ ID NO: 1479620 - RNA, 12 nt, Human
ucagagaauuuc

SEQ ID NO: 1479621 - RNA, 14 nt, Human
ucagacuguuuagu

SEQ ID NO: 1479622 - RNA, 22 nt, Human
ucagaaacacccucacacuggg

SEQ ID NO: 1479623 - RNA, 21 nt, Human
ucagaaacacccucacacugg

SEQ ID NO: 1479624 - RNA, 19 nt, Human
ucagaaacacccucacacu

SEQ ID NO: 1479625 - RNA, 20 nt, Human
ucacuuguuuuauuuaaccu

SEQ ID NO: 1479626 - RNA, 21 nt, Human
ucacuuuacacaauagaauua

SEQ ID NO: 1479627 - RNA, 18 nt, Human
ucagacagaaccccuaca

SEQ ID NO: 1479628 - RNA, 22 nt, Human
ucacucuguucauuccuccagg

SEQ ID NO: 1479629 - RNA, 21 nt, Human
ucacucuguucauuccuccag

SEQ ID NO: 1479630 - RNA, 20 nt, Human
ucacucuguucauuccucca

SEQ ID NO: 1479631 - RNA, 23 nt, Human
ucaccccuaaaagaaacccugca

SEQ ID NO: 1479632 - RNA, 19 nt, Human
ucacugcuugaacuaggcu

SEQ ID NO: 1479633 - RNA, 14 nt, Human
ucacugcucacacu

SEQ ID NO: 1479634 - RNA, 18 nt, Human
ucacuggaccacugggca

SEQ ID NO: 1479635 - RNA, 18 nt, Human
ucacugguagaccaaaau

SEQ ID NO: 1479636 - RNA, 19 nt, Human
ucacugguagaccaaaaua

SEQ ID NO: 1479637 - RNA, 20 nt, Human
ucacugguagaccaaaauaa

SEQ ID NO: 1479638 - RNA, 20 nt, Human
ucacuguagaaugauuucau

SEQ ID NO: 1479639 - RNA, 15 nt, Human
ucagauaugauucaa

SEQ ID NO: 1479640 - RNA, 16 nt, Human
ucagauaugauucaaa

SEQ ID NO: 1479641 - RNA, 12 nt, Human
ucagcaugucua

SEQ ID NO: 1479642 - RNA, 16 nt, Human
ucagcaugucuauuca

SEQ ID NO: 1479643 - RNA, 19 nt, Human
ucagcaugucuauucagcu

SEQ ID NO: 1479644 - RNA, 21 nt, Human
ucagcaugucuauucagcuuc

SEQ ID NO: 1479645 - RNA, 20 nt, Human
ucagccucccgaguagcugg

SEQ ID NO: 1479646 - RNA, 20 nt, Human
ucagccuccugaguagcugg

SEQ ID NO: 1479647 - RNA, 23 nt, Human
ucaggagcccugggaggcucugg

SEQ ID NO: 1479648 - RNA, 20 nt, Human
ucaggagcccugggaggcuc

SEQ ID NO: 1479649 - RNA, 18 nt, Human
ucaggagcccugggaggc

SEQ ID NO: 1479650 - RNA, 19 nt, Human
ucaggagcccugggaggcu

SEQ ID NO: 1479651 - RNA, 17 nt, Human
ucaggcuagauguaugu

SEQ ID NO: 1479652 - RNA, 15 nt, Human
ucagggaggcccugu

SEQ ID NO: 1479653 - RNA, 23 nt, Human
ucagggacucaucuuucccuccu

SEQ ID NO: 1479654 - RNA, 19 nt, Human
ucagggaggcccugugccc

SEQ ID NO: 1479655 - RNA, 22 nt, Human
ucagggaggcccugugccccuu

SEQ ID NO: 1479656 - RNA, 15 nt, Human
gggaggaggcagaga

SEQ ID NO: 1479657 - RNA, 14 nt, Human
gggaggagaaugag

SEQ ID NO: 1479658 - RNA, 12 nt, Human
gggaggagggca

SEQ ID NO: 1479659 - RNA, 16 nt, Human
gggaggagggcaggca

SEQ ID NO: 1479660 - RNA, 12 nt, Human
gggagcugccaa

SEQ ID NO: 1479661 - RNA, 19 nt, Human
gggagcugguuagaaaugc

SEQ ID NO: 1479662 - RNA, 13 nt, Human
gggagccgggagc

SEQ ID NO: 1479663 - RNA, 23 nt, Human
gggagcucaggaaccgaggcagg

SEQ ID NO: 1479664 - RNA, 12 nt, Human
gggagcucagga

SEQ ID NO: 1479665 - RNA, 22 nt, Human
gggagcucaggaaccgaggcag

SEQ ID NO: 1479666 - RNA, 22 nt, Human
gggaauaugagugcguggugcg

SEQ ID NO: 1479667 - RNA, 11 nt, Human
gggaaugugaa

SEQ ID NO: 1479668 - RNA, 14 nt, Human
gggaauugaggaca

SEQ ID NO: 1479669 - RNA, 14 nt, Human
gggacaccuaggcu

SEQ ID NO: 1479670 - RNA, 19 nt, Human
gggaccaggaguggguggg

SEQ ID NO: 1479671 - RNA, 23 nt, Human
gggaccaggaguggguggggagu

SEQ ID NO: 1479672 - RNA, 15 nt, Human
gggacugagaaauuu

SEQ ID NO: 1479673 - RNA, 11 nt, Human
gggacugagag

SEQ ID NO: 1479674 - RNA, 23 nt, Human
gggacugagagaugcagaaauau

SEQ ID NO: 1479675 - RNA, 12 nt, Human
gggacugagaga

SEQ ID NO: 1479676 - RNA, 15 nt, Human
ggcuugccacacccc

SEQ ID NO: 1479677 - RNA, 13 nt, Human
ggcuugccugcag

SEQ ID NO: 1479678 - RNA, 14 nt, Human
ggcuugccacaccc

SEQ ID NO: 1479679 - RNA, 14 nt, Human
ggcuugccugcagg

SEQ ID NO: 1479680 - RNA, 15 nt, Human
ggcuugccugcaggc

SEQ ID NO: 1479681 - RNA, 21 nt, Human
ggcuguggcauccagaguccc

SEQ ID NO: 1479682 - RNA, 23 nt, Human
ggcuguggcauccagagucccug

SEQ ID NO: 1479683 - RNA, 14 nt, Human
ggcugugggcaagc

SEQ ID NO: 1479684 - RNA, 14 nt, Human
ggcugucugaggcu

SEQ ID NO: 1479685 - RNA, 20 nt, Human
ggcuggagugcaguggcgcg

SEQ ID NO: 1479686 - RNA, 13 nt, Human
ggcugggaggagg

SEQ ID NO: 1479687 - RNA, 20 nt, Human
ggcugggaggagggcaggca

SEQ ID NO: 1479688 - RNA, 21 nt, Human
ggcugggaggagggcaggcau

SEQ ID NO: 1479689 - RNA, 18 nt, Human
ggcuggagcuagaauuug

SEQ ID NO: 1479690 - RNA, 23 nt, Human
ggcucuggagcccacuguacuug

SEQ ID NO: 1479691 - RNA, 19 nt, Human
ggccggcuugccacacccc

SEQ ID NO: 1479692 - RNA, 15 nt, Human
ggccuaaccugccga

SEQ ID NO: 1479693 - RNA, 16 nt, Human
ggccuaaccugccgag

SEQ ID NO: 1479694 - RNA, 21 nt, Human
ggccuaaccugccgagagucc

SEQ ID NO: 1479695 - RNA, 18 nt, Human
ggccuagacucugucuac

SEQ ID NO: 1479696 - RNA, 13 nt, Human
ggccuagacucug

SEQ ID NO: 1479697 - RNA, 13 nt, Human
ggccuagaggccu

SEQ ID NO: 1479698 - RNA, 14 nt, Human
ggccuagaggccug

SEQ ID NO: 1479699 - RNA, 11 nt, Human
ggcgcaggagg

SEQ ID NO: 1479700 - RNA, 14 nt, Human
ggcgcaggccguga

SEQ ID NO: 1479701 - RNA, 19 nt, Human
ggccugggcaggagggagg

SEQ ID NO: 1479702 - RNA, 15 nt, Human
ggccugggcaggagg

SEQ ID NO: 1479703 - RNA, 17 nt, Human
ggccugggcaggaggga

SEQ ID NO: 1479704 - RNA, 17 nt, Human
ggccugacugccaagcc

SEQ ID NO: 1479705 - RNA, 16 nt, Human
ggccugacugccaagc

SEQ ID NO: 1479706 - RNA, 20 nt, Human
ggccugacugccaagccaug

SEQ ID NO: 1479707 - RNA, 19 nt, Human
ggccugacugccaagccau

SEQ ID NO: 1479708 - RNA, 18 nt, Human
ggccugacugccaagcca

SEQ ID NO: 1479709 - RNA, 19 nt, Human
ggcucuggagcccacugua

SEQ ID NO: 1479710 - RNA, 17 nt, Human
ggcucuggagcccacug

SEQ ID NO: 1479711 - RNA, 16 nt, Human
ggcucuggagcccacu

SEQ ID NO: 1479712 - RNA, 17 nt, Human
ggcucccagggacaccu

SEQ ID NO: 1479713 - RNA, 19 nt, Human
ggcuagguggguugaaagc

SEQ ID NO: 1479714 - RNA, 12 nt, Human
ggcggggguggc

SEQ ID NO: 1479715 - RNA, 14 nt, Human
ggcggggguggcgg

SEQ ID NO: 1479716 - RNA, 19 nt, Human
ggcggggguggcggcggcc

SEQ ID NO: 1479717 - RNA, 13 nt, Human
ggcuagguacaca

SEQ ID NO: 1479718 - RNA, 18 nt, Human
ggcucaccuugugcuggg

SEQ ID NO: 1479719 - RNA, 14 nt, Human
ggagcuagaauuug

SEQ ID NO: 1479720 - RNA, 21 nt, Human
ggagcucaggaaccgaggcag

SEQ ID NO: 1479721 - RNA, 22 nt, Human
ggagccuucccaaguugugcuu

SEQ ID NO: 1479722 - RNA, 21 nt, Human
ggagccuucccaaguugugcu

SEQ ID NO: 1479723 - RNA, 13 nt, Human
ggagccuucccaa

SEQ ID NO: 1479724 - RNA, 23 nt, Human
ggagccuucccaaguugugcuug

SEQ ID NO: 1479725 - RNA, 20 nt, Human
ggagcccugggaggcucugg

SEQ ID NO: 1479726 - RNA, 19 nt, Human
ggagcccugggaggcucug

SEQ ID NO: 1479727 - RNA, 16 nt, Human
ggagcccugggaggcu

SEQ ID NO: 1479728 - RNA, 19 nt, Human
ggaggcagagaagaaagaa

SEQ ID NO: 1479729 - RNA, 17 nt, Human
ggaggcaggaguuucgu

SEQ ID NO: 1479730 - RNA, 15 nt, Human
ggaggcagagaagaa

SEQ ID NO: 1479731 - RNA, 14 nt, Human
ggaggcagagaaga

SEQ ID NO: 1479732 - RNA, 16 nt, Human
ggaggacccaggacag

SEQ ID NO: 1479733 - RNA, 15 nt, Human
ggaggacccagggcu

SEQ ID NO: 1479734 - RNA, 16 nt, Human
ggaggacccagggcuc

SEQ ID NO: 1479735 - RNA, 14 nt, Human
ggaggacccaggac

SEQ ID NO: 1479736 - RNA, 15 nt, Human
ggaggacccaggaca

SEQ ID NO: 1479737 - RNA, 19 nt, Human
ggaggacccagggcucugu

SEQ ID NO: 1479738 - RNA, 18 nt, Human
ggaggacccagggcucug

SEQ ID NO: 1479739 - RNA, 16 nt, Human
ggaggggcagagccag

SEQ ID NO: 1479740 - RNA, 15 nt, Human
ggaggggcagagcca

SEQ ID NO: 1479741 - RNA, 13 nt, Human
ggaggggcagagc

SEQ ID NO: 1479742 - RNA, 12 nt, Human
ggaggggcagag

SEQ ID NO: 1479743 - RNA, 16 nt, Human
ggagucaaaaauuaaa

SEQ ID NO: 1479744 - RNA, 15 nt, Human
ggagucacugagacc

SEQ ID NO: 1479745 - RNA, 18 nt, Human
ggacugagaaauuuauaa

SEQ ID NO: 1479746 - RNA, 11 nt, Human
ggagaagaacu

SEQ ID NO: 1479747 - RNA, 14 nt, Human
ggagaagaacugaa

SEQ ID NO: 1479748 - RNA, 12 nt, Human
ggagaaggaagg

SEQ ID NO: 1479749 - RNA, 19 nt, Human
ggagacagguuagcugcuc

SEQ ID NO: 1479750 - RNA, 14 nt, Human
ggacugagaaauuu

SEQ ID NO: 1479751 - RNA, 17 nt, Human
ggacugaauuaugaaac

SEQ ID NO: 1479752 - RNA, 19 nt, Human
ggacugaauuaugaaacuu

SEQ ID NO: 1479753 - RNA, 23 nt, Human
ggaccaggaguggguggggagug

SEQ ID NO: 1479754 - RNA, 17 nt, Human
ggacauuugcucaugga

SEQ ID NO: 1479755 - RNA, 20 nt, Human
ggacauuugcucauggaauu

SEQ ID NO: 1479756 - RNA, 12 nt, Human
ggaccagccucu

SEQ ID NO: 1479757 - RNA, 21 nt, Human
gcuuuuaugugaaacauguuu

SEQ ID NO: 1479758 - RNA, 20 nt, Human
gcuuuuaugugaaacauguu

SEQ ID NO: 1479759 - RNA, 19 nt, Human
gcuuuuaugugaaacaugu

SEQ ID NO: 1479760 - RNA, 22 nt, Human
ggauuccacucguguguuucua

SEQ ID NO: 1479761 - RNA, 18 nt, Human
ggauuccccaucucaggc

SEQ ID NO: 1479762 - RNA, 12 nt, Human
ggauuauauuau

SEQ ID NO: 1479763 - RNA, 19 nt, Human
ggauuaugggucacaggaa

SEQ ID NO: 1479764 - RNA, 18 nt, Human
ggaugaugacuauggaaa

SEQ ID NO: 1479765 - RNA, 22 nt, Human
ggaugauccccacgccacagcc

SEQ ID NO: 1479766 - RNA, 21 nt, Human
ggaugauccccacgccacagc

SEQ ID NO: 1479767 - RNA, 20 nt, Human
ggaugauccccacgccacag

SEQ ID NO: 1479768 - RNA, 16 nt, Human
ggaugauccccacgcc

SEQ ID NO: 1479769 - RNA, 14 nt, Human
ggagucacugagac

SEQ ID NO: 1479770 - RNA, 20 nt, Human
ggaugagggaaaagaaaaag

SEQ ID NO: 1479771 - RNA, 17 nt, Human
ggcagagccaggaagau

SEQ ID NO: 1479772 - RNA, 16 nt, Human
ggcagagccaggaaga

SEQ ID NO: 1479773 - RNA, 14 nt, Human
ggcagagccaggaa

SEQ ID NO: 1479774 - RNA, 13 nt, Human
ggcagagccagga

SEQ ID NO: 1479775 - RNA, 12 nt, Human
ggcagagccagg

SEQ ID NO: 1479776 - RNA, 18 nt, Human
ggcaagauugugucccau

SEQ ID NO: 1479777 - RNA, 13 nt, Human
ggcaugagaaaua

SEQ ID NO: 1479778 - RNA, 13 nt, Human
ggcagugggaaaa

SEQ ID NO: 1479779 - RNA, 15 nt, Human
ggcagugggaaaaau

SEQ ID NO: 1479780 - RNA, 14 nt, Human
ggcaguaauaaaaa

SEQ ID NO: 1479781 - RNA, 23 nt, Human
ggcauguguuuacuuuauguuac

SEQ ID NO: 1479782 - RNA, 23 nt, Human
ggcauguuagcccuuccuccaau

SEQ ID NO: 1479783 - RNA, 16 nt, Human
ggccacauagaugcug

SEQ ID NO: 1479784 - RNA, 19 nt, Human
gcucuugaugccuggcggg

SEQ ID NO: 1479785 - RNA, 22 nt, Human
gcucuccaaaccacuuuuugca

SEQ ID NO: 1479786 - RNA, 17 nt, Human
gcucuccaaaccacuuu

SEQ ID NO: 1479787 - RNA, 16 nt, Human
gcucuccaaaccacuu

SEQ ID NO: 1479788 - RNA, 13 nt, Human
gcucuuugguaga

SEQ ID NO: 1479789 - RNA, 18 nt, Human
gcucuuugguagaaaagg

SEQ ID NO: 1479790 - RNA, 22 nt, Human
gcucuuugguagaaaaggcuag

SEQ ID NO: 1479791 - RNA, 17 nt, Human
gcugacaugaagcuguu

SEQ ID NO: 1479792 - RNA, 21 nt, Human
gcugacaugaagcuguugugu

SEQ ID NO: 1479793 - RNA, 12 nt, Human
gcugaccagaca

SEQ ID NO: 1479794 - RNA, 21 nt, Human
gcugaccagccgugagcaugu

SEQ ID NO: 1479795 - RNA, 18 nt, Human
gcugcaguaugaaaauaa

SEQ ID NO: 1479796 - RNA, 20 nt, Human
gcugccaagagugaagggaa

SEQ ID NO: 1479797 - RNA, 23 nt, Human
gcugauuucuagguaggaaaugu

SEQ ID NO: 1479798 - RNA, 13 nt, Human
gcugauuucuagg

SEQ ID NO: 1479799 - RNA, 12 nt, Human
gcugauaauuuu

SEQ ID NO: 1479800 - RNA, 19 nt, Human
gcugauaauuuuaaauucu

SEQ ID NO: 1479801 - RNA, 13 nt, Human
gcugauaauuuua

SEQ ID NO: 1479802 - RNA, 14 nt, Human
gcugauaauuuuaa

SEQ ID NO: 1479803 - RNA, 16 nt, Human
gcugaucagugggccu

SEQ ID NO: 1479804 - RNA, 15 nt, Human
gcugauaauuuuaaa

SEQ ID NO: 1479805 - RNA, 17 nt, Human
gcugauauuuucucuag

SEQ ID NO: 1479806 - RNA, 9 nt, Human
gcugagacu

SEQ ID NO: 1479807 - RNA, 15 nt, Human
gcugagagaaaauaa

SEQ ID NO: 1479808 - RNA, 16 nt, Human
gcuggcauuacaggug

SEQ ID NO: 1479809 - RNA, 17 nt, Human
gcuggcaguccuggaag

SEQ ID NO: 1479810 - RNA, 17 nt, Human
gcuggaccucaccaagc

SEQ ID NO: 1479811 - RNA, 21 nt, Human
gcuggaaaaguauguuagugc

SEQ ID NO: 1479812 - RNA, 23 nt, Human
gcuggaaaaguauguuagugcaa

SEQ ID NO: 1479813 - RNA, 17 nt, Human
gcuggaaaauaauacug

SEQ ID NO: 1479814 - RNA, 22 nt, Human
gcuggaaaauaauacugcugag

SEQ ID NO: 1479815 - RNA, 21 nt, Human
gcuggaagacgcaagggccug

SEQ ID NO: 1479816 - RNA, 23 nt, Human
gcuggaagacgcaagggccugau

SEQ ID NO: 1479817 - RNA, 16 nt, Human
gcuguguggcagucug

SEQ ID NO: 1479818 - RNA, 14 nt, Human
gcuguggccaggag

SEQ ID NO: 1479819 - RNA, 18 nt, Human
gcugugggcaagccuaag

SEQ ID NO: 1479820 - RNA, 19 nt, Human
gcuguggccuaaccugccg

SEQ ID NO: 1479821 - RNA, 20 nt, Human
gcuguggccuaaccugccga

SEQ ID NO: 1479822 - RNA, 15 nt, Human
gcuguggccaggagg

SEQ ID NO: 1479823 - RNA, 16 nt, Human
gcuguggccaggaggu

SEQ ID NO: 1479824 - RNA, 20 nt, Human
gcuguggccaggaggugcca

SEQ ID NO: 1479825 - RNA, 18 nt, Human
gcuguggccaggaggugc

SEQ ID NO: 1479826 - RNA, 23 nt, Human
gcuguguuuggcuuucagggagg

SEQ ID NO: 1479827 - RNA, 18 nt, Human
gcugucaucaauuaaagg

SEQ ID NO: 1479828 - RNA, 21 nt, Human
gcugggaggagggcaggcauc

SEQ ID NO: 1479829 - RNA, 23 nt, Human
gcuggggaaaucaaaagggccaa

SEQ ID NO: 1479830 - RNA, 14 nt, Human
gcuggggaagacag

SEQ ID NO: 1479831 - RNA, 15 nt, Human
gcuggggaagacagu

SEQ ID NO: 1479832 - RNA, 16 nt, Human
gcuggggaagacagug

SEQ ID NO: 1479833 - RNA, 20 nt, Human
gcuggucucaaacuccugac

SEQ ID NO: 1479834 - RNA, 21 nt, Human
gcuggggaagacaguggcccc

SEQ ID NO: 1479835 - RNA, 18 nt, Human
gcuggggacagguccuca

SEQ ID NO: 1479836 - RNA, 15 nt, Human
gcuuuuaugugaaac

SEQ ID NO: 1479837 - RNA, 13 nt, Human
gcuuuuaugugaa

SEQ ID NO: 1479838 - RNA, 21 nt, Human
gcuuuuaguauuuuagugaac

SEQ ID NO: 1479839 - RNA, 17 nt, Human
gcuuuggugagaaccug

SEQ ID NO: 1479840 - RNA, 15 nt, Human
gcuuuccaugggacc

SEQ ID NO: 1479841 - RNA, 18 nt, Human
gcuuucagggaggcccug

SEQ ID NO: 1479842 - RNA, 13 nt, Human
gcuuguugugcuu

SEQ ID NO: 1479843 - RNA, 16 nt, Human
gcuuguugugcuuuua

SEQ ID NO: 1479844 - RNA, 13 nt, Human
gcuugccugcagg

SEQ ID NO: 1479845 - RNA, 14 nt, Human
gcuugccugcaggc

SEQ ID NO: 1479846 - RNA, 18 nt, Human
gcuuguggcaagugaauu

SEQ ID NO: 1479847 - RNA, 19 nt, Human
gcuucuguuuuauaauuuu

SEQ ID NO: 1479848 - RNA, 17 nt, Human
gcuucucauccugcagg

SEQ ID NO: 1479849 - RNA, 18 nt, Human
gcuucucauccugcaggc

SEQ ID NO: 1479850 - RNA, 22 nt, Human
gcuucucagauuucugaggaaa

SEQ ID NO: 1479851 - RNA, 16 nt, Human
gcuucucauccugcag

SEQ ID NO: 1479852 - RNA, 21 nt, Human
gcuucucagauuucugaggaa

SEQ ID NO: 1479853 - RNA, 22 nt, Human
gcuucauucaagucagcucuuc

SEQ ID NO: 1479854 - RNA, 12 nt, Human
gcuuccaauuuu

SEQ ID NO: 1479855 - RNA, 21 nt, Human
gcuuccacguacugcagccuc

SEQ ID NO: 1479856 - RNA, 18 nt, Human
gcuuaucaacuaaugauu

SEQ ID NO: 1479857 - RNA, 14 nt, Human
gcuucaucuggcaa

SEQ ID NO: 1479858 - RNA, 17 nt, Human
gcuuacugauauauuuu

SEQ ID NO: 1479859 - RNA, 21 nt, Human
gcuuacugauauauuuuacaa

SEQ ID NO: 1479860 - RNA, 22 nt, Human
gcuccuccaggguggcagcaac

SEQ ID NO: 1479861 - RNA, 21 nt, Human
gcuccuccaggguggcagcaa

SEQ ID NO: 1479862 - RNA, 21 nt, Human
gcuccuauucaacacacacau

SEQ ID NO: 1479863 - RNA, 21 nt, Human
gcuccucaaccccuccccucc

SEQ ID NO: 1479864 - RNA, 22 nt, Human
gcuccucaaccccuccccucca

SEQ ID NO: 1479865 - RNA, 18 nt, Human
gcuccucagggacucagg

SEQ ID NO: 1479866 - RNA, 19 nt, Human
gcuccucagggacucaggu

SEQ ID NO: 1479867 - RNA, 20 nt, Human
gcuccucagggacucaggug

SEQ ID NO: 1479868 - RNA, 23 nt, Human
gcuccgugugggagaccggccug

SEQ ID NO: 1479869 - RNA, 22 nt, Human
gcuccgugugggagaccggccu

SEQ ID NO: 1479870 - RNA, 22 nt, Human
gcuccguccaggagccugugcc

SEQ ID NO: 1479871 - RNA, 23 nt, Human
gcuccguccaggagccugugccu

SEQ ID NO: 1479872 - RNA, 15 nt, Human
gcuccuuaaggcucu

SEQ ID NO: 1479873 - RNA, 17 nt, Human
gcuccuuaaggcucuuu

SEQ ID NO: 1479874 - RNA, 21 nt, Human
gcuccuuaaggcucuuuugua

SEQ ID NO: 1479875 - RNA, 14 nt, Human
gcucauuucaggau

SEQ ID NO: 1479876 - RNA, 19 nt, Human
gcucccacagaacacagca

SEQ ID NO: 1479877 - RNA, 13 nt, Human
gcucccacagaac

SEQ ID NO: 1479878 - RNA, 18 nt, Human
gcucauggacuucugcca

SEQ ID NO: 1479879 - RNA, 16 nt, Human
gcucagcccugcacca

SEQ ID NO: 1479880 - RNA, 12 nt, Human
gcucagcccugc

SEQ ID NO: 1479881 - RNA, 16 nt, Human
gcuaucguaaaauuaa

SEQ ID NO: 1479882 - RNA, 15 nt, Human
gcuaucguaaaauua

SEQ ID NO: 1479883 - RNA, 17 nt, Human
gcuaucguaaaauuaag

SEQ ID NO: 1479884 - RNA, 14 nt, Human
gcucacaaaccaug

SEQ ID NO: 1479885 - RNA, 12 nt, Human
gcuauccaccaa

SEQ ID NO: 1479886 - RNA, 17 nt, Human
gcuauauaagacaagaa

SEQ ID NO: 1479887 - RNA, 21 nt, Human
gcuauacugcauacuuuuuaa

SEQ ID NO: 1479888 - RNA, 14 nt, Human
gcuagauguaugua

SEQ ID NO: 1479889 - RNA, 16 nt, Human
gcuagauguauguacu

SEQ ID NO: 1479890 - RNA, 13 nt, Human
gcuagauguaugu

SEQ ID NO: 1479891 - RNA, 22 nt, Human
gcgcccuuaacugcauccagcc

SEQ ID NO: 1479892 - RNA, 21 nt, Human
gcgccucgccggaucugaggg

SEQ ID NO: 1479893 - RNA, 17 nt, Human
gcgaagcguuguccuca

SEQ ID NO: 1479894 - RNA, 17 nt, Human
gccuuucuucucuccag

SEQ ID NO: 1479895 - RNA, 16 nt, Human
gccuuguuuuuuucua

SEQ ID NO: 1479896 - RNA, 18 nt, Human
gccuuucccuaagccagc

SEQ ID NO: 1479897 - RNA, 15 nt, Human
gccuugucacgccag

SEQ ID NO: 1479898 - RNA, 16 nt, Human
gccuugucacgccaga

SEQ ID NO: 1479899 - RNA, 17 nt, Human
gccuugucacgccagac

SEQ ID NO: 1479900 - RNA, 15 nt, Human
gccuuguuuuuuucu

SEQ ID NO: 1479901 - RNA, 24 nt, Human
gccugcaggaucucaccaggcagc

SEQ ID NO: 1479902 - RNA, 13 nt, Human
gccugcaggaucu

SEQ ID NO: 1479903 - RNA, 16 nt, Human
gccugcaggaucucac

SEQ ID NO: 1479904 - RNA, 23 nt, Human
gccugcaggaucucaccaggcag

SEQ ID NO: 1479905 - RNA, 16 nt, Human
gccuggaccagccucu

SEQ ID NO: 1479906 - RNA, 17 nt, Human
gccuggaccagccucuc

SEQ ID NO: 1479907 - RNA, 22 nt, Human
gccugcauccauucuccugagg

SEQ ID NO: 1479908 - RNA, 21 nt, Human
gccugcauccauucuccugag

SEQ ID NO: 1479909 - RNA, 21 nt, Human
gccugcauugagcuugcaugc

SEQ ID NO: 1479910 - RNA, 16 nt, Human
gccugcauugagcuug

SEQ ID NO: 1479911 - RNA, 15 nt, Human
gccuggaagagcagc

SEQ ID NO: 1479912 - RNA, 17 nt, Human
gccuggaagagcagccc

SEQ ID NO: 1479913 - RNA, 20 nt, Human
gccugguauauccaaaagcu

SEQ ID NO: 1479914 - RNA, 22 nt, Human
gccuggguguaaaaccuggaga

SEQ ID NO: 1479915 - RNA, 19 nt, Human
gccuggguguaaaaccugg

SEQ ID NO: 1479916 - RNA, 16 nt, Human
gccugggcaggaggga

SEQ ID NO: 1479917 - RNA, 13 nt, Human
gccaccugucugu

SEQ ID NO: 1479918 - RNA, 12 nt, Human
gccaccugucug

SEQ ID NO: 1479919 - RNA, 10 nt, Human
gccaccuguc

SEQ ID NO: 1479920 - RNA, 15 nt, Human
gccaccugucugucu

SEQ ID NO: 1479921 - RNA, 14 nt, Human
gccaccugucuguc

SEQ ID NO: 1479922 - RNA, 18 nt, Human
gccacggggacucagccc

SEQ ID NO: 1479923 - RNA, 16 nt, Human
gccaccugaauaaaga

SEQ ID NO: 1479924 - RNA, 14 nt, Human
gccacaguuccccu

SEQ ID NO: 1479925 - RNA, 15 nt, Human
gccacaguuccccua

SEQ ID NO: 1479926 - RNA, 21 nt, Human
gccagacuucccacggcuccu

SEQ ID NO: 1479927 - RNA, 19 nt, Human
gccaagggcauaaauuauu

SEQ ID NO: 1479928 - RNA, 18 nt, Human
gccaaggggcuucagguc

SEQ ID NO: 1479929 - RNA, 21 nt, Human
gccaaugcaccuaaagaaaaa

SEQ ID NO: 1479930 - RNA, 19 nt, Human
gccaaugcaccuaaagaaa

SEQ ID NO: 1479931 - RNA, 13 nt, Human
gccacaccaggau

SEQ ID NO: 1479932 - RNA, 16 nt, Human
gccacaccaggauaga

SEQ ID NO: 1479933 - RNA, 13 nt, Human
gccacagcccuuu

SEQ ID NO: 1479934 - RNA, 20 nt, Human
gccacagcccuuuugucucu

SEQ ID NO: 1479935 - RNA, 20 nt, Human
gccaauuucaaguuccaagu

SEQ ID NO: 1479936 - RNA, 21 nt, Human
gccacaccaggauagagacug

SEQ ID NO: 1479937 - RNA, 19 nt, Human
gccaugggcacugugggua

SEQ ID NO: 1479938 - RNA, 14 nt, Human
gccaugggaggccu

SEQ ID NO: 1479939 - RNA, 15 nt, Human
gccaugggaggccuu

SEQ ID NO: 1479940 - RNA, 12 nt, Human
gccaugggaggc

SEQ ID NO: 1479941 - RNA, 15 nt, Human
gccaugcagaaagca

SEQ ID NO: 1479942 - RNA, 17 nt, Human
gccagugaccaaccuuu

SEQ ID NO: 1479943 - RNA, 14 nt, Human
gccagggagcgagu

SEQ ID NO: 1479944 - RNA, 19 nt, Human
gccaggcuggagugcagug

SEQ ID NO: 1479945 - RNA, 18 nt, Human
gccaggcuggagugcagu

SEQ ID NO: 1479946 - RNA, 13 nt, Human
gccaggcuggguc

SEQ ID NO: 1479947 - RNA, 16 nt, Human
gccaggcuggagugca

SEQ ID NO: 1479948 - RNA, 19 nt, Human
gccagauuuuccugaaaac

SEQ ID NO: 1479949 - RNA, 16 nt, Human
gcccagcccuaaacau

SEQ ID NO: 1479950 - RNA, 14 nt, Human
gcccaaugaaauga

SEQ ID NO: 1479951 - RNA, 15 nt, Human
gcaggucccuaauaa

SEQ ID NO: 1479952 - RNA, 14 nt, Human
gcaggucccuaaua

SEQ ID NO: 1479953 - RNA, 19 nt, Human
gcaggccgugacgucuggg

SEQ ID NO: 1479954 - RNA, 20 nt, Human
gcaggccgugacgucugggu

SEQ ID NO: 1479955 - RNA, 21 nt, Human
gcaggcaucggggagccggga

SEQ ID NO: 1479956 - RNA, 22 nt, Human
gcaggcaucggggagccgggag

SEQ ID NO: 1479957 - RNA, 15 nt, Human
gcaggcaggcuccca

SEQ ID NO: 1479958 - RNA, 22 nt, Human
gcaggcaggaacaaacagggcu

SEQ ID NO: 1479959 - RNA, 18 nt, Human
gcaggcaggcucccaggg

SEQ ID NO: 1479960 - RNA, 17 nt, Human
gcaggcaggcucccagg

SEQ ID NO: 1479961 - RNA, 18 nt, Human
gcaggcaggaacaaacag

SEQ ID NO: 1479962 - RNA, 23 nt, Human
gcaggcaucggggagccgggagc

SEQ ID NO: 1479963 - RNA, 20 nt, Human
gcaggccaagucaggcccuu

SEQ ID NO: 1479964 - RNA, 19 nt, Human
gcaggucccuaauaaagcu

SEQ ID NO: 1479965 - RNA, 18 nt, Human
gcaggucccuaauaaagc

SEQ ID NO: 1479966 - RNA, 17 nt, Human
gcaggucccuaauaaag

SEQ ID NO: 1479967 - RNA, 16 nt, Human
gcaggucccuaauaaa

SEQ ID NO: 1479968 - RNA, 21 nt, Human
gcaggucccuaauaaagcugu

SEQ ID NO: 1479969 - RNA, 20 nt, Human
gcaggucccuaauaaagcug

SEQ ID NO: 1479970 - RNA, 23 nt, Human
gcaggucccuaauaaagcugugu

SEQ ID NO: 1479971 - RNA, 22 nt, Human
gcaguggcgugaucucagcuca

SEQ ID NO: 1479972 - RNA, 17 nt, Human
gcagugggaaaaaugua

SEQ ID NO: 1479973 - RNA, 19 nt, Human
gcagugggaaaaauguagg

SEQ ID NO: 1479974 - RNA, 14 nt, Human
gcagugggaaaaau

SEQ ID NO: 1479975 - RNA, 15 nt, Human
gcaucaucucagcuc

SEQ ID NO: 1479976 - RNA, 13 nt, Human
gcaucauggcuau

SEQ ID NO: 1479977 - RNA, 19 nt, Human
gcaucaggccuagaggccu

SEQ ID NO: 1479978 - RNA, 23 nt, Human
gcauuaaauuuuagcaaagauau

SEQ ID NO: 1479979 - RNA, 21 nt, Human
gcauugaauggcuauguuuuu

SEQ ID NO: 1479980 - RNA, 16 nt, Human
gcauugagcuugcaug

SEQ ID NO: 1479981 - RNA, 19 nt, Human
gcauugaauggcuauguuu

SEQ ID NO: 1479982 - RNA, 15 nt, Human
gcacagccucuuaga

SEQ ID NO: 1479983 - RNA, 20 nt, Human
gauugugucccauuccccca

SEQ ID NO: 1479984 - RNA, 19 nt, Human
gauugugucccauuccccc

SEQ ID NO: 1479985 - RNA, 18 nt, Human
gauugugucccauucccc

SEQ ID NO: 1479986 - RNA, 17 nt, Human
gauugugucccauuccc

SEQ ID NO: 1479987 - RNA, 18 nt, Human
gcacagccucuuagaugc

SEQ ID NO: 1479988 - RNA, 17 nt, Human
gcacagggagugcacau

SEQ ID NO: 1479989 - RNA, 22 nt, Human
gcacagggagugcacauaucca

SEQ ID NO: 1479990 - RNA, 20 nt, Human
gcaccaucucugauuuucaa

SEQ ID NO: 1479991 - RNA, 16 nt, Human
gcacuggcgaggagag

SEQ ID NO: 1479992 - RNA, 15 nt, Human
gcacuggcgaggaga

SEQ ID NO: 1479993 - RNA, 15 nt, Human
gcacuggccccaccc

SEQ ID NO: 1479994 - RNA, 14 nt, Human
gcacuggccccacc

SEQ ID NO: 1479995 - RNA, 17 nt, Human
gcacccucauacacaga

SEQ ID NO: 1479996 - RNA, 20 nt, Human
gcacccucauacacagaaac

SEQ ID NO: 1479997 - RNA, 20 nt, Human
gcacgcggagugaguuuuuu

SEQ ID NO: 1479998 - RNA, 18 nt, Human
gcacgugguaaaacacuu

SEQ ID NO: 1479999 - RNA, 23 nt, Human
gcacuucuuuuucucgcuguccu

SEQ ID NO: 1480000 - RNA, 20 nt, Human
gcagacucuuuaugcuugca

SEQ ID NO: 1480001 - RNA, 14 nt, Human
gcagccucuggggg

SEQ ID NO: 1480002 - RNA, 15 nt, Human
gcagccucugggggg

SEQ ID NO: 1480003 - RNA, 22 nt, Human
gcagccucugggggguggccag

SEQ ID NO: 1480004 - RNA, 23 nt, Human
gcagccucugggggguggccagg

SEQ ID NO: 1480005 - RNA, 18 nt, Human
gcaggaacaaacagggcu

SEQ ID NO: 1480006 - RNA, 16 nt, Human
gcaggaacaaacaggg

SEQ ID NO: 1480007 - RNA, 23 nt, Human
gcaggaaggacuaugaaaagcua

SEQ ID NO: 1480008 - RNA, 21 nt, Human
gauuaacagguaugaaccacc

SEQ ID NO: 1480009 - RNA, 22 nt, Human
gauguuaaaaaaauaagaagaa

SEQ ID NO: 1480010 - RNA, 18 nt, Human
gauguguuugcuuucuga

SEQ ID NO: 1480011 - RNA, 14 nt, Human
gauguguuugcuuu

SEQ ID NO: 1480012 - RNA, 16 nt, Human
gauguguuugcuuucu

SEQ ID NO: 1480013 - RNA, 21 nt, Human
gauugaaguauuuugcuggaa

SEQ ID NO: 1480014 - RNA, 23 nt, Human
gauugaaguauuuugcuggaaua

SEQ ID NO: 1480015 - RNA, 15 nt, Human
gauugucuuaauauu

SEQ ID NO: 1480016 - RNA, 14 nt, Human
gauucaaucuguaa

SEQ ID NO: 1480017 - RNA, 16 nt, Human
gauucaaucuguaaac

SEQ ID NO: 1480018 - RNA, 18 nt, Human
gauucaaucuguaaacug

SEQ ID NO: 1480019 - RNA, 19 nt, Human
gauucaaucuguaaacugu

SEQ ID NO: 1480020 - RNA, 16 nt, Human
gauucacaucucauuu

SEQ ID NO: 1480021 - RNA, 15 nt, Human
gauucacaucucauu

SEQ ID NO: 1480022 - RNA, 13 nt, Human
gauucccagagca

SEQ ID NO: 1480023 - RNA, 19 nt, Human
gauucccagagcaaaauaa

SEQ ID NO: 1480024 - RNA, 17 nt, Human
gauuccccaucucaggc

SEQ ID NO: 1480025 - RNA, 20 nt, Human
gauuccccaucucaggccag

SEQ ID NO: 1480026 - RNA, 16 nt, Human
gauuccgcagugagag

SEQ ID NO: 1480027 - RNA, 15 nt, Human
gauuccugagccagu

SEQ ID NO: 1480028 - RNA, 14 nt, Human
gaugacuauggaaa

SEQ ID NO: 1480029 - RNA, 14 nt, Human
gaugaaaauaaaga

SEQ ID NO: 1480030 - RNA, 15 nt, Human
gaugaaaauaaagaa

SEQ ID NO: 1480031 - RNA, 16 nt, Human
gaugaaaauaaagaau

SEQ ID NO: 1480032 - RNA, 12 nt, Human
gaugacuaaaau

SEQ ID NO: 1480033 - RNA, 15 nt, Human
gaugacuaaaauauu

SEQ ID NO: 1480034 - RNA, 18 nt, Human
gaugacuaaaauauuuau

SEQ ID NO: 1480035 - RNA, 18 nt, Human
gaugcaguucugaagaag

SEQ ID NO: 1480036 - RNA, 21 nt, Human
gaugccuggcgggguggggug

SEQ ID NO: 1480037 - RNA, 18 nt, Human
gauggcaaccagaccauu

SEQ ID NO: 1480038 - RNA, 19 nt, Human
gauccuguguggagaggga

SEQ ID NO: 1480039 - RNA, 20 nt, Human
gauccuguguggagagggaa

SEQ ID NO: 1480040 - RNA, 11 nt, Human
gaugaaaauaa

SEQ ID NO: 1480041 - RNA, 18 nt, Human
gauccuauccuccuaccu

SEQ ID NO: 1480042 - RNA, 16 nt, Human
gagucucugaggggcu

SEQ ID NO: 1480043 - RNA, 16 nt, Human
gagucccugccuggac

SEQ ID NO: 1480044 - RNA, 19 nt, Human
gagucccugccuggaccag

SEQ ID NO: 1480045 - RNA, 17 nt, Human
gagucguacagaaagcu

SEQ ID NO: 1480046 - RNA, 22 nt, Human
gagucguacagaaagcugccug

SEQ ID NO: 1480047 - RNA, 15 nt, Human
gagucaaaaauuaaa

SEQ ID NO: 1480048 - RNA, 19 nt, Human
gaguagcugggacuacagg

SEQ ID NO: 1480049 - RNA, 14 nt, Human
gagucccugccugg

SEQ ID NO: 1480050 - RNA, 15 nt, Human
gagucccugccugga

SEQ ID NO: 1480051 - RNA, 18 nt, Human
gaguaaagaauuauuuug

SEQ ID NO: 1480052 - RNA, 21 nt, Human
gaguugaaaaucuuauaauuu

SEQ ID NO: 1480053 - RNA, 21 nt, Human
gaguuuuccauggcaggaagg

SEQ ID NO: 1480054 - RNA, 18 nt, Human
gaguuuuccauggcagga

SEQ ID NO: 1480055 - RNA, 12 nt, Human
gaguuccugcau

SEQ ID NO: 1480056 - RNA, 14 nt, Human
gaguuccugcaugc

SEQ ID NO: 1480057 - RNA, 12 nt, Human
gagugugaccaa

SEQ ID NO: 1480058 - RNA, 21 nt, Human
gagugugaccaaaaguuacau

SEQ ID NO: 1480059 - RNA, 20 nt, Human
gagugugaccaaaaguuaca

SEQ ID NO: 1480060 - RNA, 14 nt, Human
gaguggcuggggca

SEQ ID NO: 1480061 - RNA, 17 nt, Human
gaguggcuggggcaugg

SEQ ID NO: 1480062 - RNA, 13 nt, Human
gaguggcuggggc

SEQ ID NO: 1480063 - RNA, 23 nt, Human
gauagagacuggaacacuagaca

SEQ ID NO: 1480064 - RNA, 14 nt, Human
gauagaaugacagu

SEQ ID NO: 1480065 - RNA, 12 nt, Human
gauagaaugaca

SEQ ID NO: 1480066 - RNA, 16 nt, Human
gaguuuuuuguaccaa

SEQ ID NO: 1480067 - RNA, 14 nt, Human
gauaaugaacagaa

SEQ ID NO: 1480068 - RNA, 13 nt, Human
gauaaugaacaga

SEQ ID NO: 1480069 - RNA, 21 nt, Human
gauaaugugauauuauacaua

SEQ ID NO: 1480070 - RNA, 21 nt, Human
gauauaaguguguguuuuuca

SEQ ID NO: 1480071 - RNA, 14 nt, Human
gauauauuuuacaa

SEQ ID NO: 1480072 - RNA, 23 nt, Human
gauauauuuuacaauuuuuuauc

SEQ ID NO: 1480073 - RNA, 20 nt, Human
gaggaggcagagaagaaaga

SEQ ID NO: 1480074 - RNA, 16 nt, Human
gaggaggcagagaaga

SEQ ID NO: 1480075 - RNA, 13 nt, Human
gaggagggcaggc

SEQ ID NO: 1480076 - RNA, 14 nt, Human
gaggagggcaggca

SEQ ID NO: 1480077 - RNA, 15 nt, Human
gaggagggcaggcau

SEQ ID NO: 1480078 - RNA, 14 nt, Human
gaggacacaugucc

SEQ ID NO: 1480079 - RNA, 13 nt, Human
gaggacacauguc

SEQ ID NO: 1480080 - RNA, 12 nt, Human
gaggacacaugu

SEQ ID NO: 1480081 - RNA, 11 nt, Human
gaggacacaug

SEQ ID NO: 1480082 - RNA, 22 nt, Human
gaggaauuuucuuuguguagcu

SEQ ID NO: 1480083 - RNA, 14 nt, Human
gaggaauuucaccu

SEQ ID NO: 1480084 - RNA, 15 nt, Human
gaggacaaccauucc

SEQ ID NO: 1480085 - RNA, 21 nt, Human
gaggaaggaggacccaggaca

SEQ ID NO: 1480086 - RNA, 18 nt, Human
gaggaaggaggacccagg

SEQ ID NO: 1480087 - RNA, 16 nt, Human
gaggaaggaggaccca

SEQ ID NO: 1480088 - RNA, 22 nt, Human
gagcuugaaacccguggcgcuu

SEQ ID NO: 1480089 - RNA, 17 nt, Human
gaggcacaugucagcaa

SEQ ID NO: 1480090 - RNA, 13 nt, Human
gaggauacgacag

SEQ ID NO: 1480091 - RNA, 16 nt, Human
gagggagaacaagacc

SEQ ID NO: 1480092 - RNA, 14 nt, Human
gaggcuuuccaugg

SEQ ID NO: 1480093 - RNA, 14 nt, Human
gagggaaugugaaa

SEQ ID NO: 1480094 - RNA, 18 nt, Human
gaggcuacuguaaggcaa

SEQ ID NO: 1480095 - RNA, 23 nt, Human
gaggcugggaauggaggggcaga

SEQ ID NO: 1480096 - RNA, 14 nt, Human
gaggcuuccuucau

SEQ ID NO: 1480097 - RNA, 22 nt, Human
gaggcccugugccccuugacaa

SEQ ID NO: 1480098 - RNA, 20 nt, Human
gaggccugacugccaagcca

SEQ ID NO: 1480099 - RNA, 14 nt, Human
gagcuacaaaugca

SEQ ID NO: 1480100 - RNA, 23 nt, Human
gagcucaggaaccgaggcaggga

SEQ ID NO: 1480101 - RNA, 11 nt, Human
gagcuacugcc

SEQ ID NO: 1480102 - RNA, 20 nt, Human
gagcuacguauuuaauagca

SEQ ID NO: 1480103 - RNA, 11 nt, Human
gagcucaggau

SEQ ID NO: 1480104 - RNA, 15 nt, Human
gagcuacauaauuua

SEQ ID NO: 1480105 - RNA, 15 nt, Human
gagcuacguauuuaa

SEQ ID NO: 1480106 - RNA, 12 nt, Human
gagcucaggaug

SEQ ID NO: 1480107 - RNA, 13 nt, Human
gagcucaggauga

SEQ ID NO: 1480108 - RNA, 23 nt, Human
gagcucaggaugagggaaaagaa

SEQ ID NO: 1480109 - RNA, 19 nt, Human
gagcugauggagaaggaag

SEQ ID NO: 1480110 - RNA, 18 nt, Human
gagcugauggagaaggaa

SEQ ID NO: 1480111 - RNA, 17 nt, Human
gagcucuucauguuuca

SEQ ID NO: 1480112 - RNA, 12 nt, Human
gagcugccaaga

SEQ ID NO: 1480113 - RNA, 15 nt, Human
gagccugcaggaucu

SEQ ID NO: 1480114 - RNA, 13 nt, Human
gagccugcaggau

SEQ ID NO: 1480115 - RNA, 18 nt, Human
gagccuccuuucuggcuu

SEQ ID NO: 1480116 - RNA, 13 nt, Human
gagcuacaaaugc

SEQ ID NO: 1480117 - RNA, 12 nt, Human
gagcuacaaaug

SEQ ID NO: 1480118 - RNA, 23 nt, Human
gagccuggcuccguccaggagcc

SEQ ID NO: 1480119 - RNA, 20 nt, Human
gagaucaggaagagaaggag

SEQ ID NO: 1480120 - RNA, 13 nt, Human
gagaucaggaaga

SEQ ID NO: 1480121 - RNA, 15 nt, Human
gagauccuuaucgaa

SEQ ID NO: 1480122 - RNA, 12 nt, Human
gagcaaaauaau

SEQ ID NO: 1480123 - RNA, 22 nt, Human
gagcaccgccugugaaauacca

SEQ ID NO: 1480124 - RNA, 22 nt, Human
gagcacaagaggagauccaggg

SEQ ID NO: 1480125 - RNA, 13 nt, Human
gagcacugcucca

SEQ ID NO: 1480126 - RNA, 12 nt, Human
gagccauguuuc

SEQ ID NO: 1480127 - RNA, 16 nt, Human
gaaccugaugaaaaua

SEQ ID NO: 1480128 - RNA, 21 nt, Human
gaaccuggguugcagacagga

SEQ ID NO: 1480129 - RNA, 22 nt, Human
gaacuagaguuuagcuggaaaa

SEQ ID NO: 1480130 - RNA, 15 nt, Human
gaacgucuuaucuaa

SEQ ID NO: 1480131 - RNA, 17 nt, Human
gaacuaggcugagcaau

SEQ ID NO: 1480132 - RNA, 15 nt, Human
gaacuaggcugagca

SEQ ID NO: 1480133 - RNA, 18 nt, Human
gaacuagccaaaccagga

SEQ ID NO: 1480134 - RNA, 15 nt, Human
gaaccugaugaaaau

SEQ ID NO: 1480135 - RNA, 20 nt, Human
gaaccugaugaaaauaaaga

SEQ ID NO: 1480136 - RNA, 19 nt, Human
gaaccuaauucaauucaaa

SEQ ID NO: 1480137 - RNA, 23 nt, Human
gaacagaacauagacagaagaaa

SEQ ID NO: 1480138 - RNA, 21 nt, Human
gaacuugaggacacaugucca

SEQ ID NO: 1480139 - RNA, 19 nt, Human
gaacuugaggacacauguc

SEQ ID NO: 1480140 - RNA, 18 nt, Human
gaacuugaggacacaugu

SEQ ID NO: 1480141 - RNA, 17 nt, Human
gaacuugaggacacaug

SEQ ID NO: 1480142 - RNA, 16 nt, Human
gaacuugaggacacau

SEQ ID NO: 1480143 - RNA, 15 nt, Human
gaacuugaggacaca

SEQ ID NO: 1480144 - RNA, 14 nt, Human
gaacuugaggacac

SEQ ID NO: 1480145 - RNA, 13 nt, Human
gaacuugaggaca

SEQ ID NO: 1480146 - RNA, 15 nt, Human
gaacuugacccugag

SEQ ID NO: 1480147 - RNA, 22 nt, Human
gaacuuccagauccuggaaauc

SEQ ID NO: 1480148 - RNA, 21 nt, Human
gaacugucucucaugaaccuc

SEQ ID NO: 1480149 - RNA, 17 nt, Human
gaacugucucucaugaa

SEQ ID NO: 1480150 - RNA, 22 nt, Human
gaacuuguaaaggaauuuaaaa

SEQ ID NO: 1480151 - RNA, 13 nt, Human
gaagaaaaagaag

SEQ ID NO: 1480152 - RNA, 14 nt, Human
gaagaaaaagaagc

SEQ ID NO: 1480153 - RNA, 19 nt, Human
gaagaaagaacggaagaag

SEQ ID NO: 1480154 - RNA, 16 nt, Human
gaagaaagaacggaag

SEQ ID NO: 1480155 - RNA, 20 nt, Human
gaagaaacaagguuuucagu

SEQ ID NO: 1480156 - RNA, 21 nt, Human
gaagaagcaccaaucaugaau

SEQ ID NO: 1480157 - RNA, 21 nt, Human
gaacuuguaaaggaauuuaaa

SEQ ID NO: 1480158 - RNA, 13 nt, Human
gaaauauuauguu

SEQ ID NO: 1480159 - RNA, 16 nt, Human
gaaauauuauguuaaa

SEQ ID NO: 1480160 - RNA, 16 nt, Human
gaaauggcuuugugau

SEQ ID NO: 1480161 - RNA, 23 nt, Human
gaaauuaagacuuuauguaguuu

SEQ ID NO: 1480162 - RNA, 17 nt, Human
gaaauuacacccaaaga

SEQ ID NO: 1480163 - RNA, 16 nt, Human
gaaauuggaagagcac

SEQ ID NO: 1480164 - RNA, 18 nt, Human
gaaauugcuuuguauugu

SEQ ID NO: 1480165 - RNA, 17 nt, Human
gaaauugccugacgaac

SEQ ID NO: 1480166 - RNA, 15 nt, Human
gaaauugauuuugaa

SEQ ID NO: 1480167 - RNA, 22 nt, Human
gaaauuuuaaccuaugauauuu

SEQ ID NO: 1480168 - RNA, 15 nt, Human
gaaauuuuauaugcu

SEQ ID NO: 1480169 - RNA, 19 nt, Human
gaaauuuuauaugcuuacu

SEQ ID NO: 1480170 - RNA, 22 nt, Human
gaaauuuuauaugcuuacugau

SEQ ID NO: 1480171 - RNA, 13 nt, Human
gaaauuuaaacua

SEQ ID NO: 1480172 - RNA, 14 nt, Human
gaaauuuaaacuau

SEQ ID NO: 1480173 - RNA, 20 nt, Human
gaaauuuaaacuauaagcaa

SEQ ID NO: 1480174 - RNA, 23 nt, Human
gaaauuuaaacuauaagcaagaa

SEQ ID NO: 1480175 - RNA, 11 nt, Human
gaaacauuugg

SEQ ID NO: 1480176 - RNA, 13 nt, Human
gaaacauuuauau

SEQ ID NO: 1480177 - RNA, 21 nt, Human
gaaauaaauguaucauagaaa

SEQ ID NO: 1480178 - RNA, 21 nt, Human
gaaauaaguuuuuguuucaca

SEQ ID NO: 1480179 - RNA, 21 nt, Human
gaaauauacuuuuacaaguaa

SEQ ID NO: 1480180 - RNA, 23 nt, Human
gaaauauacuuuuacaaguaaca

SEQ ID NO: 1480181 - RNA, 19 nt, Human
gaaauaucuucacuuguca

SEQ ID NO: 1480182 - RNA, 20 nt, Human
gaaauaugaagaacugagga

SEQ ID NO: 1480183 - RNA, 18 nt, Human
gaaauacaaaaauacuca

SEQ ID NO: 1480184 - RNA, 13 nt, Human
gaaauacaaaaau

SEQ ID NO: 1480185 - RNA, 14 nt, Human
gaaauacaaaaaua

SEQ ID NO: 1480186 - RNA, 17 nt, Human
gaaauacuacuguguaa

SEQ ID NO: 1480187 - RNA, 14 nt, Human
gaauacuuuauaaa

SEQ ID NO: 1480188 - RNA, 17 nt, Human
gaauaagguacaagaag

SEQ ID NO: 1480189 - RNA, 19 nt, Human
gaauaagguacaagaagca

SEQ ID NO: 1480190 - RNA, 20 nt, Human
gaauaagguacaagaagcau

SEQ ID NO: 1480191 - RNA, 23 nt, Human
gaauaagguacaagaagcauuuu

SEQ ID NO: 1480192 - RNA, 13 nt, Human
gaauaaagcaauu

SEQ ID NO: 1480193 - RNA, 11 nt, Human
gaauaaagcaa

SEQ ID NO: 1480194 - RNA, 17 nt, Human
gaauaaagaaugaaugg

SEQ ID NO: 1480195 - RNA, 12 nt, Human
gaauaaaauuuu

SEQ ID NO: 1480196 - RNA, 11 nt, Human
gaaguuucauc

SEQ ID NO: 1480197 - RNA, 19 nt, Human
gaaguaaaagcaaaaaaga

SEQ ID NO: 1480198 - RNA, 20 nt, Human
gaaucacuguuuagaacaca

SEQ ID NO: 1480199 - RNA, 19 nt, Human
gaauccccaacaugcacug

SEQ ID NO: 1480200 - RNA, 23 nt, Human
gaaucagagaccuuccagaaaua

SEQ ID NO: 1480201 - RNA, 18 nt, Human
gaaucagccuacaggccu

SEQ ID NO: 1480202 - RNA, 23 nt, Human
gaaucucaguugauuuucuggau

SEQ ID NO: 1480203 - RNA, 21 nt, Human
gaaucuuaagguguagccaca

SEQ ID NO: 1480204 - RNA, 20 nt, Human
gaauccuaggcuccacccca

SEQ ID NO: 1480205 - RNA, 22 nt, Human
gaaucuuaagguguagccacac

SEQ ID NO: 1480206 - RNA, 15 nt, Human
gaaucuugguuugcc

SEQ ID NO: 1480207 - RNA, 20 nt, Human
gaaucuugguuugccuucca

SEQ ID NO: 1480208 - RNA, 23 nt, Human
gaaucuugguuugccuuccagaa

SEQ ID NO: 1480209 - RNA, 20 nt, Human
gaaggcagggaggaggcaga

SEQ ID NO: 1480210 - RNA, 18 nt, Human
gaaggcagggaggaggca

SEQ ID NO: 1480211 - RNA, 17 nt, Human
gaaggcagggaggaggc

SEQ ID NO: 1480212 - RNA, 16 nt, Human
gaaggcagggaggagg

SEQ ID NO: 1480213 - RNA, 14 nt, Human
gaaggcagggagga

SEQ ID NO: 1480214 - RNA, 11 nt, Human
gaaggcaagau

SEQ ID NO: 1480215 - RNA, 21 nt, Human
gaaggacuaugaaaagcuaga

SEQ ID NO: 1480216 - RNA, 19 nt, Human
gaaggaucccaugagcucc

SEQ ID NO: 1480217 - RNA, 22 nt, Human
gaagccacgguguucugugaua

SEQ ID NO: 1480218 - RNA, 17 nt, Human
gaagacugcauuauauu

SEQ ID NO: 1480219 - RNA, 22 nt, Human
gaagccagcuuucccugccucu

SEQ ID NO: 1480220 - RNA, 19 nt, Human
gaagccuccuuagaaaaaa

SEQ ID NO: 1480221 - RNA, 18 nt, Human
gaagcuuuuaugugaaac

SEQ ID NO: 1480222 - RNA, 20 nt, Human
gaagcuuuggugagaaccug

SEQ ID NO: 1480223 - RNA, 14 nt, Human
gaagcuuuggugag

SEQ ID NO: 1480224 - RNA, 21 nt, Human
gaagccuuggggcugaugcag

SEQ ID NO: 1480225 - RNA, 13 nt, Human
cuuuccacagaag

SEQ ID NO: 1480226 - RNA, 17 nt, Human
cuuucccaacaccucuu

SEQ ID NO: 1480227 - RNA, 21 nt, Human
cuuuauuuucuauaauuuaaa

SEQ ID NO: 1480228 - RNA, 16 nt, Human
cuuuauuggcugagau

SEQ ID NO: 1480229 - RNA, 18 nt, Human
cuuuauuggcugagauau

SEQ ID NO: 1480230 - RNA, 20 nt, Human
cuuuauguuacuacaugcac

SEQ ID NO: 1480231 - RNA, 14 nt, Human
cuuuauuaaaaacu

SEQ ID NO: 1480232 - RNA, 17 nt, Human
cuuuauuaaaaacugag

SEQ ID NO: 1480233 - RNA, 16 nt, Human
cuuuagaauaugccuu

SEQ ID NO: 1480234 - RNA, 14 nt, Human
cuuuacuuuuaaac

SEQ ID NO: 1480235 - RNA, 13 nt, Human
cuuguuuuggaug

SEQ ID NO: 1480236 - RNA, 14 nt, Human
cuuguuuuggaugc

SEQ ID NO: 1480237 - RNA, 17 nt, Human
cuuguugugcuuuuagu

SEQ ID NO: 1480238 - RNA, 15 nt, Human
cuuguugugcuuuua

SEQ ID NO: 1480239 - RNA, 19 nt, Human
cuuguaaaggaauuuaaaa

SEQ ID NO: 1480240 - RNA, 14 nt, Human
cuugggcagcaucc

SEQ ID NO: 1480241 - RNA, 22 nt, Human
cuugggaaaggugguguuucug

SEQ ID NO: 1480242 - RNA, 10 nt, Human
cuugggaaug

SEQ ID NO: 1480243 - RNA, 18 nt, Human
cuugggaauggauccugg

SEQ ID NO: 1480244 - RNA, 17 nt, Human
cuuggagcugagcaaau

SEQ ID NO: 1480245 - RNA, 14 nt, Human
cuuggagcugagca

SEQ ID NO: 1480246 - RNA, 17 nt, Human
cuugcccgcucaggcug

SEQ ID NO: 1480247 - RNA, 14 nt, Human
cuuuuuucuaaagu

SEQ ID NO: 1480248 - RNA, 20 nt, Human
cuuuuuucucugauacagaa

SEQ ID NO: 1480249 - RNA, 22 nt, Human
cuuuuuucucugauacagaaaa

SEQ ID NO: 1480250 - RNA, 22 nt, Human
gaaaacaauaacgauaaaagac

SEQ ID NO: 1480251 - RNA, 23 nt, Human
gaaaagcuagaauugaguguuua

SEQ ID NO: 1480252 - RNA, 19 nt, Human
gaaaauaacgauaaaagac

SEQ ID NO: 1480253 - RNA, 17 nt, Human
gaaaauaagagcucagg

SEQ ID NO: 1480254 - RNA, 19 nt, Human
gaaaauaagagcucaggau

SEQ ID NO: 1480255 - RNA, 18 nt, Human
gaaaauaaucauucuuau

SEQ ID NO: 1480256 - RNA, 12 nt, Human
gaaaauaucacu

SEQ ID NO: 1480257 - RNA, 19 nt, Human
gaaaaucuuauaauuuaaa

SEQ ID NO: 1480258 - RNA, 22 nt, Human
gaaacacccucacacugggacu

SEQ ID NO: 1480259 - RNA, 19 nt, Human
gaaacacccucacacuggg

SEQ ID NO: 1480260 - RNA, 18 nt, Human
gaaacacccucacacugg

SEQ ID NO: 1480261 - RNA, 20 nt, Human
gaaaaucuuauaauuuaaaa

SEQ ID NO: 1480262 - RNA, 16 nt, Human
gaaacacuuugcauaa

SEQ ID NO: 1480263 - RNA, 11 nt, Human
gaaacagaaaa

SEQ ID NO: 1480264 - RNA, 22 nt, Human
gaaacagaaaaauauguaccaa

SEQ ID NO: 1480265 - RNA, 14 nt, Human
gaaacagaaacaaa

SEQ ID NO: 1480266 - RNA, 22 nt, Human
gaaacagaaacaaaaacacuaa

SEQ ID NO: 1480267 - RNA, 14 nt, Human
cuuuucccaaccau

SEQ ID NO: 1480268 - RNA, 18 nt, Human
cuuuucccacuguuuaag

SEQ ID NO: 1480269 - RNA, 20 nt, Human
cuuuuacguccaucucuugu

SEQ ID NO: 1480270 - RNA, 14 nt, Human
cuuuuaauuuuccu

SEQ ID NO: 1480271 - RNA, 23 nt, Human
cuuuuacaaguaacaaaaauaaa

SEQ ID NO: 1480272 - RNA, 18 nt, Human
cuuuucauacauuuucua

SEQ ID NO: 1480273 - RNA, 18 nt, Human
cuuuucccaaaauguuga

SEQ ID NO: 1480274 - RNA, 22 nt, Human
cuuuucccaaaauguugaaaua

SEQ ID NO: 1480275 - RNA, 18 nt, Human
cuuugcugagccuguaaa

SEQ ID NO: 1480276 - RNA, 23 nt, Human
cuuugcugacccuccccaaaggc

SEQ ID NO: 1480277 - RNA, 18 nt, Human
cuuugcugacccucccca

SEQ ID NO: 1480278 - RNA, 14 nt, Human
cuuugcugacccuc

SEQ ID NO: 1480279 - RNA, 13 nt, Human
cuuugcugacccu

SEQ ID NO: 1480280 - RNA, 22 nt, Human
cuucagucucuauaccaauaaa

SEQ ID NO: 1480281 - RNA, 23 nt, Human
cuucagucucuauaccaauaaag

SEQ ID NO: 1480282 - RNA, 21 nt, Human
cuucagucucuauaccaauaa

SEQ ID NO: 1480283 - RNA, 17 nt, Human
cuucagucucuauacca

SEQ ID NO: 1480284 - RNA, 13 nt, Human
cuucagucucuau

SEQ ID NO: 1480285 - RNA, 16 nt, Human
cuuccaaacuaauuuu

SEQ ID NO: 1480286 - RNA, 24 nt, Human
cuucauuugggaugcuacucuagu

SEQ ID NO: 1480287 - RNA, 19 nt, Human
cuuccaaacaggcucagag

SEQ ID NO: 1480288 - RNA, 16 nt, Human
cuucagcgguuuauau

SEQ ID NO: 1480289 - RNA, 10 nt, Human
cuucaggucc

SEQ ID NO: 1480290 - RNA, 18 nt, Human
cuucagguccaggcugug

SEQ ID NO: 1480291 - RNA, 17 nt, Human
cuucagguccaggcugu

SEQ ID NO: 1480292 - RNA, 16 nt, Human
cuucaggacacucacu

SEQ ID NO: 1480293 - RNA, 19 nt, Human
cuucaggacacucacuaca

SEQ ID NO: 1480294 - RNA, 16 nt, Human
cuucagcacuuuagaa

SEQ ID NO: 1480295 - RNA, 15 nt, Human
cuucagcacuuuaga

SEQ ID NO: 1480296 - RNA, 14 nt, Human
cuucagcacuuuag

SEQ ID NO: 1480297 - RNA, 20 nt, Human
cuucagcaaguuagaacuag

SEQ ID NO: 1480298 - RNA, 15 nt, Human
cuucacaaauucuca

SEQ ID NO: 1480299 - RNA, 17 nt, Human
cuucaaauccuugaaga

SEQ ID NO: 1480300 - RNA, 13 nt, Human
cuucaaaugccug

SEQ ID NO: 1480301 - RNA, 16 nt, Human
cuucaaaugccugacu

SEQ ID NO: 1480302 - RNA, 20 nt, Human
cuucaacaauucuaaaauga

SEQ ID NO: 1480303 - RNA, 22 nt, Human
cuucaagcauggcuauuuuaua

SEQ ID NO: 1480304 - RNA, 13 nt, Human
cuuccuucauuuc

SEQ ID NO: 1480305 - RNA, 15 nt, Human
cuuccuucauuuccu

SEQ ID NO: 1480306 - RNA, 16 nt, Human
cuuccuucauuuccuc

SEQ ID NO: 1480307 - RNA, 16 nt, Human
cuuccuguuuuucaca

SEQ ID NO: 1480308 - RNA, 17 nt, Human
cuuccuguuuuucacau

SEQ ID NO: 1480309 - RNA, 18 nt, Human
cuuccuguuuuucacauu

SEQ ID NO: 1480310 - RNA, 23 nt, Human
cuuccuguuuuucacauuuuccu

SEQ ID NO: 1480311 - RNA, 20 nt, Human
cuuccuuuuacuuuucuucu

SEQ ID NO: 1480312 - RNA, 15 nt, Human
cuucucauccugcag

SEQ ID NO: 1480313 - RNA, 16 nt, Human
cuucucauccugcagg

SEQ ID NO: 1480314 - RNA, 17 nt, Human
cuucucauccugcaggc

SEQ ID NO: 1480315 - RNA, 14 nt, Human
cuucucaugaucca

SEQ ID NO: 1480316 - RNA, 22 nt, Human
cuucccuggaaaccuuccaccc

SEQ ID NO: 1480317 - RNA, 23 nt, Human
cuucccuggaaaccuuccaccca

SEQ ID NO: 1480318 - RNA, 19 nt, Human
cuucccugcugugaaagaa

SEQ ID NO: 1480319 - RNA, 23 nt, Human
cuucccuaucuuugccacccuca

SEQ ID NO: 1480320 - RNA, 22 nt, Human
cuucccuaucuuugccacccuc

SEQ ID NO: 1480321 - RNA, 22 nt, Human
cuucccucuuccuucccugcug

SEQ ID NO: 1480322 - RNA, 15 nt, Human
cuuccuaguuuucuc

SEQ ID NO: 1480323 - RNA, 17 nt, Human
cuuccuaguuuucuccu

SEQ ID NO: 1480324 - RNA, 23 nt, Human
cuuccuaguuuucuccucccagg

SEQ ID NO: 1480325 - RNA, 22 nt, Human
cuuccuaguuuucuccucccag

SEQ ID NO: 1480326 - RNA, 18 nt, Human
cuucccuaucuuugccac

SEQ ID NO: 1480327 - RNA, 17 nt, Human
cuucccuaucuuugcca

SEQ ID NO: 1480328 - RNA, 16 nt, Human
cuucccuaucuuugcc

SEQ ID NO: 1480329 - RNA, 19 nt, Human
cuuccagauccuggaaauc

SEQ ID NO: 1480330 - RNA, 13 nt, Human
cuuccagaaauac

SEQ ID NO: 1480331 - RNA, 16 nt, Human
cuuccagaaaacaaaa

SEQ ID NO: 1480332 - RNA, 17 nt, Human
cuuaaccagaucauugu

SEQ ID NO: 1480333 - RNA, 23 nt, Human
cuuaagaagacugcauuauauuu

SEQ ID NO: 1480334 - RNA, 20 nt, Human
cuuaauaaauuguguuuccu

SEQ ID NO: 1480335 - RNA, 14 nt, Human
cuuaagguguagcc

SEQ ID NO: 1480336 - RNA, 17 nt, Human
cuuaagguguagccaca

SEQ ID NO: 1480337 - RNA, 21 nt, Human
cuuaagguguagccacaccag

SEQ ID NO: 1480338 - RNA, 17 nt, Human
cuuaauacacacaguua

SEQ ID NO: 1480339 - RNA, 15 nt, Human
cuuaaggcucuuuug

SEQ ID NO: 1480340 - RNA, 13 nt, Human
cuuaauucaaaua

SEQ ID NO: 1480341 - RNA, 16 nt, Human
cuuaauuuauuauuaa

SEQ ID NO: 1480342 - RNA, 19 nt, Human
cuuaauauauauauccaga

SEQ ID NO: 1480343 - RNA, 16 nt, Human
cuuagaauacaguuuu

SEQ ID NO: 1480344 - RNA, 15 nt, Human
cuuaauuuauuauua

SEQ ID NO: 1480345 - RNA, 20 nt, Human
cuuaccuguaugucuccagu

SEQ ID NO: 1480346 - RNA, 13 nt, Human
cuuaccuuuuuau

SEQ ID NO: 1480347 - RNA, 15 nt, Human
cuuacucuucuugaa

SEQ ID NO: 1480348 - RNA, 19 nt, Human
cuuacucuucuugaaauuu

SEQ ID NO: 1480349 - RNA, 12 nt, Human
cuuacugauaua

SEQ ID NO: 1480350 - RNA, 15 nt, Human
cuuacugauauauuu

SEQ ID NO: 1480351 - RNA, 19 nt, Human
cuuacugauauauuuuaca

SEQ ID NO: 1480352 - RNA, 21 nt, Human
cuuacugauauauuuuacaau

SEQ ID NO: 1480353 - RNA, 21 nt, Human
cuuacugauuuuuaaguuauu

SEQ ID NO: 1480354 - RNA, 21 nt, Human
cuguugccaggcuggagugca

SEQ ID NO: 1480355 - RNA, 23 nt, Human
cuguuuggaaauugauuuugaac

SEQ ID NO: 1480356 - RNA, 17 nt, Human
cuguuuaguagcaguga

SEQ ID NO: 1480357 - RNA, 14 nt, Human
cuguuuuauaauuu

SEQ ID NO: 1480358 - RNA, 22 nt, Human
cuguuuggaaauugauuuugaa

SEQ ID NO: 1480359 - RNA, 15 nt, Human
cuguuuuauaauuuu

SEQ ID NO: 1480360 - RNA, 12 nt, Human
cuguuuuucaca

SEQ ID NO: 1480361 - RNA, 13 nt, Human
cuguuuuucacau

SEQ ID NO: 1480362 - RNA, 15 nt, Human
cuguuuuucacauuu

SEQ ID NO: 1480363 - RNA, 17 nt, Human
cuguugaauuucccaca

SEQ ID NO: 1480364 - RNA, 17 nt, Human
cuguugagcaucacaga

SEQ ID NO: 1480365 - RNA, 14 nt, Human
cugugugcucagga

SEQ ID NO: 1480366 - RNA, 16 nt, Human
cugugugcacaaauau

SEQ ID NO: 1480367 - RNA, 18 nt, Human
cugugugacucaaaccaa

SEQ ID NO: 1480368 - RNA, 21 nt, Human
cuguggaacauaaaaaggaca

SEQ ID NO: 1480369 - RNA, 18 nt, Human
cuguggaacauaaaaagg

SEQ ID NO: 1480370 - RNA, 20 nt, Human
cugugccccuugacaacugg

SEQ ID NO: 1480371 - RNA, 24 nt, Human
cuguggaucaaauccagccugcug

SEQ ID NO: 1480372 - RNA, 14 nt, Human
cuguggaucaaauc

SEQ ID NO: 1480373 - RNA, 18 nt, Human
cuguggccuaaccugccg

SEQ ID NO: 1480374 - RNA, 12 nt, Human
cuguggccagga

SEQ ID NO: 1480375 - RNA, 13 nt, Human
cuguggccaggag

SEQ ID NO: 1480376 - RNA, 14 nt, Human
cuguggccaggagg

SEQ ID NO: 1480377 - RNA, 15 nt, Human
cuguggccaggaggu

SEQ ID NO: 1480378 - RNA, 15 nt, Human
cuguggguaguauga

SEQ ID NO: 1480379 - RNA, 13 nt, Human
cugucuucuggac

SEQ ID NO: 1480380 - RNA, 15 nt, Human
cugucuucuggacug

SEQ ID NO: 1480381 - RNA, 14 nt, Human
cugucuucuggacu

SEQ ID NO: 1480382 - RNA, 21 nt, Human
cugucuuuuuucuaaaguaaa

SEQ ID NO: 1480383 - RNA, 15 nt, Human
cugucugucugucug

SEQ ID NO: 1480384 - RNA, 14 nt, Human
cugucugucugucu

SEQ ID NO: 1480385 - RNA, 17 nt, Human
cugucugucugucccaa

SEQ ID NO: 1480386 - RNA, 16 nt, Human
cugucugucuguccca

SEQ ID NO: 1480387 - RNA, 15 nt, Human
cugucugucuguccc

SEQ ID NO: 1480388 - RNA, 14 nt, Human
cugucugucugucc

SEQ ID NO: 1480389 - RNA, 15 nt, Human
cugucugcucagaca

SEQ ID NO: 1480390 - RNA, 14 nt, Human
cuggugguggcucg

SEQ ID NO: 1480391 - RNA, 22 nt, Human
cuggugguggcucgggaggcga

SEQ ID NO: 1480392 - RNA, 23 nt, Human
cugguaugaacuugaggacacau

SEQ ID NO: 1480393 - RNA, 14 nt, Human
cugguuagaaaugc

SEQ ID NO: 1480394 - RNA, 23 nt, Human
cugguuagaaaugcagaauccua

SEQ ID NO: 1480395 - RNA, 20 nt, Human
cuguaaucccagcaugcuga

SEQ ID NO: 1480396 - RNA, 18 nt, Human
cuguaauugaauauuauu

SEQ ID NO: 1480397 - RNA, 19 nt, Human
cuguaauugaauauuauuc

SEQ ID NO: 1480398 - RNA, 16 nt, Human
cuguauucagacagau

SEQ ID NO: 1480399 - RNA, 15 nt, Human
cuguauucagacaga

SEQ ID NO: 1480400 - RNA, 16 nt, Human
cugggggccucuucug

SEQ ID NO: 1480401 - RNA, 16 nt, Human
cugggggguggccagg

SEQ ID NO: 1480402 - RNA, 19 nt, Human
cugggggguggccaggccg

SEQ ID NO: 1480403 - RNA, 17 nt, Human
cugggggguggccaggc

SEQ ID NO: 1480404 - RNA, 15 nt, Human
cugggcugugggcaa

SEQ ID NO: 1480405 - RNA, 22 nt, Human
cugguaugaacuugaggacaca

SEQ ID NO: 1480406 - RNA, 21 nt, Human
cugguaugaacuugaggacac

SEQ ID NO: 1480407 - RNA, 20 nt, Human
cugguaugaacuugaggaca

SEQ ID NO: 1480408 - RNA, 18 nt, Human
cugguaugaacuugagga

SEQ ID NO: 1480409 - RNA, 18 nt, Human
cugguauauccaaaagcu

SEQ ID NO: 1480410 - RNA, 19 nt, Human
cugguauauccaaaagcuu

SEQ ID NO: 1480411 - RNA, 20 nt, Human
cugguauauccaaaagcuuu

SEQ ID NO: 1480412 - RNA, 16 nt, Human
cugggucgcccuggac

SEQ ID NO: 1480413 - RNA, 15 nt, Human
cugggucgcccugga

SEQ ID NO: 1480414 - RNA, 13 nt, Human
cugggucgcccug

SEQ ID NO: 1480415 - RNA, 15 nt, Human
cugggggguggccag

SEQ ID NO: 1480416 - RNA, 23 nt, Human
cugggccccugccucucugcagg

SEQ ID NO: 1480417 - RNA, 20 nt, Human
cugggccccugccucucugc

SEQ ID NO: 1480418 - RNA, 12 nt, Human
cugauuucuagg

SEQ ID NO: 1480419 - RNA, 15 nt, Human
cugcaaacugccuuc

SEQ ID NO: 1480420 - RNA, 18 nt, Human
cugauuuucaaagcuuuu

SEQ ID NO: 1480421 - RNA, 21 nt, Human
cugauuuucaaagcuuuuucc

SEQ ID NO: 1480422 - RNA, 15 nt, Human
cugauuuuuuuuccu

SEQ ID NO: 1480423 - RNA, 19 nt, Human
cugauuuuuuuuccuuuua

SEQ ID NO: 1480424 - RNA, 20 nt, Human
cugauuuuuuuuccuuuuaa

SEQ ID NO: 1480425 - RNA, 15 nt, Human
cugcacaauaaaaau

SEQ ID NO: 1480426 - RNA, 18 nt, Human
cugcacaauaaaaauguu

SEQ ID NO: 1480427 - RNA, 22 nt, Human
cugcacaauaaaaauguuuaac

SEQ ID NO: 1480428 - RNA, 20 nt, Human
cugcacacccuccagagaca

SEQ ID NO: 1480429 - RNA, 18 nt, Human
cugcacacccuccagaga

SEQ ID NO: 1480430 - RNA, 13 nt, Human
cugaguuuuacca

SEQ ID NO: 1480431 - RNA, 11 nt, Human
cugaguuuucc

SEQ ID NO: 1480432 - RNA, 14 nt, Human
cugaguuuuaccaa

SEQ ID NO: 1480433 - RNA, 14 nt, Human
cugaguuccugcau

SEQ ID NO: 1480434 - RNA, 16 nt, Human
cugaguuccugcaugc

SEQ ID NO: 1480435 - RNA, 17 nt, Human
cugaguuacagaaauga

SEQ ID NO: 1480436 - RNA, 22 nt, Human
cugauacagaaaaguugaauuu

SEQ ID NO: 1480437 - RNA, 15 nt, Human
cugauaauuuuaaau

SEQ ID NO: 1480438 - RNA, 17 nt, Human
cugauaauuuuaaauuc

SEQ ID NO: 1480439 - RNA, 18 nt, Human
cugauaauuuuaaauucu

SEQ ID NO: 1480440 - RNA, 16 nt, Human
cugauauauuuuacaa

SEQ ID NO: 1480441 - RNA, 18 nt, Human
cugauauauuuuacaauu

SEQ ID NO: 1480442 - RNA, 18 nt, Human
cugauauuuucucuagga

SEQ ID NO: 1480443 - RNA, 16 nt, Human
cugauauuuucucuag

SEQ ID NO: 1480444 - RNA, 12 nt, Human
cugaucaaggcc

SEQ ID NO: 1480445 - RNA, 15 nt, Human
cugaucaaggccuua

SEQ ID NO: 1480446 - RNA, 14 nt, Human
cugauauuuucucu

SEQ ID NO: 1480447 - RNA, 15 nt, Human
cugauauuuucucua

SEQ ID NO: 1480448 - RNA, 14 nt, Human
cugaggcugaggca

SEQ ID NO: 1480449 - RNA, 12 nt, Human
cugaggcugagg

SEQ ID NO: 1480450 - RNA, 22 nt, Human
cugagucacccuaccugugccu

SEQ ID NO: 1480451 - RNA, 23 nt, Human
cugagucacccuaccugugccug

SEQ ID NO: 1480452 - RNA, 17 nt, Human
cugaggccuagacucug

SEQ ID NO: 1480453 - RNA, 15 nt, Human
cugaggccuagacuc

SEQ ID NO: 1480454 - RNA, 19 nt, Human
cugaggccuagacucuguc

SEQ ID NO: 1480455 - RNA, 19 nt, Human
cugagcccgguaagagcaa

SEQ ID NO: 1480456 - RNA, 23 nt, Human
cugccuggacuuggccccugcca

SEQ ID NO: 1480457 - RNA, 22 nt, Human
cugccuggacuuggccccugcc

SEQ ID NO: 1480458 - RNA, 17 nt, Human
cugccuggaccagccuc

SEQ ID NO: 1480459 - RNA, 14 nt, Human
cugccuucuggccu

SEQ ID NO: 1480460 - RNA, 18 nt, Human
cugccuucuggccuugua

SEQ ID NO: 1480461 - RNA, 19 nt, Human
cugccuucuucggaaagaa

SEQ ID NO: 1480462 - RNA, 19 nt, Human
cugccucucugcagguccc

SEQ ID NO: 1480463 - RNA, 20 nt, Human
cugccuggaagagcagcccu

SEQ ID NO: 1480464 - RNA, 23 nt, Human
cugcggaggaaggaggacccagg

SEQ ID NO: 1480465 - RNA, 18 nt, Human
cugccucucugcaggucc

SEQ ID NO: 1480466 - RNA, 17 nt, Human
cugccucucugcagguc

SEQ ID NO: 1480467 - RNA, 16 nt, Human
cugccucucugcaggu

SEQ ID NO: 1480468 - RNA, 15 nt, Human
cugccucucugcagg

SEQ ID NO: 1480469 - RNA, 13 nt, Human
cugccuauuuuaa

SEQ ID NO: 1480470 - RNA, 18 nt, Human
cugccaccugucugucug

SEQ ID NO: 1480471 - RNA, 16 nt, Human
cugccaccugucuguc

SEQ ID NO: 1480472 - RNA, 15 nt, Human
cugccaccugucugu

SEQ ID NO: 1480473 - RNA, 14 nt, Human
cugccaccugucug

SEQ ID NO: 1480474 - RNA, 13 nt, Human
cugccaccugucu

SEQ ID NO: 1480475 - RNA, 12 nt, Human
cugccaccuguc

SEQ ID NO: 1480476 - RNA, 11 nt, Human
cugccaccugu

SEQ ID NO: 1480477 - RNA, 17 nt, Human
cugccaccugucugucu

SEQ ID NO: 1480478 - RNA, 21 nt, Human
cugcccagugcacuugcugga

SEQ ID NO: 1480479 - RNA, 19 nt, Human
cugccaccuccugccucag

SEQ ID NO: 1480480 - RNA, 16 nt, Human
cugccaccuccugccu

SEQ ID NO: 1480481 - RNA, 14 nt, Human
cugccaccuccugc

SEQ ID NO: 1480482 - RNA, 12 nt, Human
cugccacacagg

SEQ ID NO: 1480483 - RNA, 23 nt, Human
cugcaugcgagugcucauuucag

SEQ ID NO: 1480484 - RNA, 13 nt, Human
cugcauccagccu

SEQ ID NO: 1480485 - RNA, 19 nt, Human
cugcauccauucuccugag

SEQ ID NO: 1480486 - RNA, 20 nt, Human
cugcaucuagaggcuuccuu

SEQ ID NO: 1480487 - RNA, 21 nt, Human
cugcaucuagaggcuuccuuc

SEQ ID NO: 1480488 - RNA, 21 nt, Human
cugcauccauucuccugagga

SEQ ID NO: 1480489 - RNA, 16 nt, Human
cugaauuaugaaacuu

SEQ ID NO: 1480490 - RNA, 13 nt, Human
cugaauuucccuc

SEQ ID NO: 1480491 - RNA, 11 nt, Human
cugaauuuuua

SEQ ID NO: 1480492 - RNA, 12 nt, Human
cugaauuuuuaa

SEQ ID NO: 1480493 - RNA, 18 nt, Human
cugaauuuuuaaacaagu

SEQ ID NO: 1480494 - RNA, 20 nt, Human
cugaccagccgugagcaugu

SEQ ID NO: 1480495 - RNA, 23 nt, Human
cugaccagccgugagcauguuug

SEQ ID NO: 1480496 - RNA, 21 nt, Human
cugagaaaagcuuugaacccu

SEQ ID NO: 1480497 - RNA, 16 nt, Human
cugacugccaagccau

SEQ ID NO: 1480498 - RNA, 18 nt, Human
cugacugccaagccaugg

SEQ ID NO: 1480499 - RNA, 15 nt, Human
cugacugccaagcca

SEQ ID NO: 1480500 - RNA, 14 nt, Human
cugacugccaagcc

SEQ ID NO: 1480501 - RNA, 17 nt, Human
cugagcaaucugacccu

SEQ ID NO: 1480502 - RNA, 13 nt, Human
cugaauuaugaaa

SEQ ID NO: 1480503 - RNA, 14 nt, Human
cugaauuaugaaac

SEQ ID NO: 1480504 - RNA, 15 nt, Human
cugaauuaugaaacu

SEQ ID NO: 1480505 - RNA, 12 nt, Human
cugaauuauuuu

SEQ ID NO: 1480506 - RNA, 15 nt, Human
cugaauaaagcaauu

SEQ ID NO: 1480507 - RNA, 20 nt, Human
cugaaugaggucagcauguc

SEQ ID NO: 1480508 - RNA, 14 nt, Human
cugaauaaagcaau

SEQ ID NO: 1480509 - RNA, 13 nt, Human
cugaauaaagcaa

SEQ ID NO: 1480510 - RNA, 17 nt, Human
cugaagaacucucugga

SEQ ID NO: 1480511 - RNA, 14 nt, Human
cugaagaagauggu

SEQ ID NO: 1480512 - RNA, 21 nt, Human
cugaacuuugcugagccugua

SEQ ID NO: 1480513 - RNA, 14 nt, Human
cugaacuuugcuga

SEQ ID NO: 1480514 - RNA, 13 nt, Human
cugaacuuugcug

SEQ ID NO: 1480515 - RNA, 12 nt, Human
cugaacuuugcu

SEQ ID NO: 1480516 - RNA, 11 nt, Human
cugaacaccau

SEQ ID NO: 1480517 - RNA, 20 nt, Human
cugaaauaaacgucuuaaau

SEQ ID NO: 1480518 - RNA, 19 nt, Human
cugaaauuuuauaugcuua

SEQ ID NO: 1480519 - RNA, 22 nt, Human
cugaaauuuuauaugcuuacug

SEQ ID NO: 1480520 - RNA, 12 nt, Human
cugaacaagaau

SEQ ID NO: 1480521 - RNA, 13 nt, Human
cugaacaagaauu

SEQ ID NO: 1480522 - RNA, 14 nt, Human
cugaacaagaauug

SEQ ID NO: 1480523 - RNA, 16 nt, Human
cugaacaagaauugga

SEQ ID NO: 1480524 - RNA, 20 nt, Human
cucuucugaauaaagcaauu

SEQ ID NO: 1480525 - RNA, 12 nt, Human
cucuucugagcu

SEQ ID NO: 1480526 - RNA, 19 nt, Human
cucuucugaauaaagcaau

SEQ ID NO: 1480527 - RNA, 16 nt, Human
cucuucugaauaaagc

SEQ ID NO: 1480528 - RNA, 10 nt, Human
cucuucugaa

SEQ ID NO: 1480529 - RNA, 15 nt, Human
cucuucugagcuauu

SEQ ID NO: 1480530 - RNA, 18 nt, Human
cucuucugagcuauuuca

SEQ ID NO: 1480531 - RNA, 21 nt, Human
cucuucugagcuauuucaucu

SEQ ID NO: 1480532 - RNA, 22 nt, Human
cucuucugagcuauuucaucua

SEQ ID NO: 1480533 - RNA, 23 nt, Human
cucuucugagcuauuucaucuau

SEQ ID NO: 1480534 - RNA, 15 nt, Human
cucugauacagaaaa

SEQ ID NO: 1480535 - RNA, 17 nt, Human
cucugaguguuuuauga

SEQ ID NO: 1480536 - RNA, 19 nt, Human
cucugaguguuuuaugaga

SEQ ID NO: 1480537 - RNA, 22 nt, Human
cucugaguguuuuaugagaaag

SEQ ID NO: 1480538 - RNA, 20 nt, Human
cucugcaggucccuaauaaa

SEQ ID NO: 1480539 - RNA, 19 nt, Human
cucugcaggucccuaauaa

SEQ ID NO: 1480540 - RNA, 22 nt, Human
cucugcaggucccuaauaaagc

SEQ ID NO: 1480541 - RNA, 21 nt, Human
cucugcaggucccuaauaaag

SEQ ID NO: 1480542 - RNA, 20 nt, Human
cucugcccgggagcucagga

SEQ ID NO: 1480543 - RNA, 14 nt, Human
cucugcccgggagc

SEQ ID NO: 1480544 - RNA, 19 nt, Human
cucugaaggguaauuauau

SEQ ID NO: 1480545 - RNA, 23 nt, Human
cucugagagcaucaggccuagag

SEQ ID NO: 1480546 - RNA, 19 nt, Human
cucuuaagaagacugcauu

SEQ ID NO: 1480547 - RNA, 15 nt, Human
cucugugugcacaaa

SEQ ID NO: 1480548 - RNA, 17 nt, Human
cucugugugcacaaaua

SEQ ID NO: 1480549 - RNA, 21 nt, Human
cucuguugccaggcuggagug

SEQ ID NO: 1480550 - RNA, 13 nt, Human
cucuuccuuucuu

SEQ ID NO: 1480551 - RNA, 17 nt, Human
cucuucuauuuuguaaa

SEQ ID NO: 1480552 - RNA, 19 nt, Human
cucuucuauuuuguaaacu

SEQ ID NO: 1480553 - RNA, 19 nt, Human
cucuuccuucccugcugug

SEQ ID NO: 1480554 - RNA, 15 nt, Human
cucuuccuucccugc

SEQ ID NO: 1480555 - RNA, 20 nt, Human
cucuggauuauauuaugaag

SEQ ID NO: 1480556 - RNA, 19 nt, Human
cucuggauuauauuaugaa

SEQ ID NO: 1480557 - RNA, 20 nt, Human
cucugucgcccaugcuggag

SEQ ID NO: 1480558 - RNA, 18 nt, Human
cucugucgcccaugcugg

SEQ ID NO: 1480559 - RNA, 16 nt, Human
cucugucuaccugguc

SEQ ID NO: 1480560 - RNA, 19 nt, Human
cucugucuacuugcucagg

SEQ ID NO: 1480561 - RNA, 20 nt, Human
cucugucuaccuggucuggu

SEQ ID NO: 1480562 - RNA, 23 nt, Human
cucaaauacgugggcauucaaau

SEQ ID NO: 1480563 - RNA, 22 nt, Human
cuauugugcaauguaaauauuu

SEQ ID NO: 1480564 - RNA, 17 nt, Human
cuauucuagccugcauu

SEQ ID NO: 1480565 - RNA, 15 nt, Human
cuauucuagccugca

SEQ ID NO: 1480566 - RNA, 23 nt, Human
cuauucuagccugcauugagcuu

SEQ ID NO: 1480567 - RNA, 13 nt, Human
cucaaccucaucc

SEQ ID NO: 1480568 - RNA, 12 nt, Human
cucaaccucauc

SEQ ID NO: 1480569 - RNA, 15 nt, Human
cucaagagaucccaa

SEQ ID NO: 1480570 - RNA, 23 nt, Human
cucacaccaggcuugccugcagg

SEQ ID NO: 1480571 - RNA, 12 nt, Human
cucacauuuaug

SEQ ID NO: 1480572 - RNA, 18 nt, Human
cucaccaggcagccucug

SEQ ID NO: 1480573 - RNA, 19 nt, Human
cucaccaggcagccucugg

SEQ ID NO: 1480574 - RNA, 21 nt, Human
cucaccaggcagccucugggg

SEQ ID NO: 1480575 - RNA, 20 nt, Human
cucaccaggcagccucuggg

SEQ ID NO: 1480576 - RNA, 17 nt, Human
cucagauuucugaggaa

SEQ ID NO: 1480577 - RNA, 16 nt, Human
cucagauuucugagga

SEQ ID NO: 1480578 - RNA, 14 nt, Human
cucagauccuccuc

SEQ ID NO: 1480579 - RNA, 23 nt, Human
cucagagaauuucuaccauuuca

SEQ ID NO: 1480580 - RNA, 21 nt, Human
cucagauaagguaaaaugcca

SEQ ID NO: 1480581 - RNA, 22 nt, Human
cucagauaagguaaaaugccau

SEQ ID NO: 1480582 - RNA, 23 nt, Human
cucagauaagguaaaaugccaug

SEQ ID NO: 1480583 - RNA, 16 nt, Human
cucagauagaaugaca

SEQ ID NO: 1480584 - RNA, 18 nt, Human
cucagauagaaugacagu

SEQ ID NO: 1480585 - RNA, 16 nt, Human
cucagauccuccucau

SEQ ID NO: 1480586 - RNA, 19 nt, Human
cucacccccagcuuugcua

SEQ ID NO: 1480587 - RNA, 17 nt, Human
cucaccauuuggauccu

SEQ ID NO: 1480588 - RNA, 14 nt, Human
cucacccccagcuu

SEQ ID NO: 1480589 - RNA, 17 nt, Human
cucacccccagcuuugc

SEQ ID NO: 1480590 - RNA, 18 nt, Human
cucacccccagcuuugcu

SEQ ID NO: 1480591 - RNA, 13 nt, Human
cuauggccugugg

SEQ ID NO: 1480592 - RNA, 19 nt, Human
cuauggagugcaccaaaga

SEQ ID NO: 1480593 - RNA, 11 nt, Human
cuaugcuuuga

SEQ ID NO: 1480594 - RNA, 15 nt, Human
cuaugcuuugaaaca

SEQ ID NO: 1480595 - RNA, 17 nt, Human
cuaugcuuugaaacaga

SEQ ID NO: 1480596 - RNA, 19 nt, Human
cuaugcuuugaaacagaaa

SEQ ID NO: 1480597 - RNA, 23 nt, Human
cuaugauauuuucugugccugaa

SEQ ID NO: 1480598 - RNA, 13 nt, Human
cuauguaaacuac

SEQ ID NO: 1480599 - RNA, 23 nt, Human
cuauggugcucugucuacuugcu

SEQ ID NO: 1480600 - RNA, 14 nt, Human
cuauggugcucugu

SEQ ID NO: 1480601 - RNA, 16 nt, Human
cuauggugcucugucu

SEQ ID NO: 1480602 - RNA, 17 nt, Human
cuauggugcucugucua

SEQ ID NO: 1480603 - RNA, 19 nt, Human
cuaugggucuaggacacag

SEQ ID NO: 1480604 - RNA, 17 nt, Human
cuauauuuuacauaaau

SEQ ID NO: 1480605 - RNA, 16 nt, Human
cuauauuuaacaagau

SEQ ID NO: 1480606 - RNA, 18 nt, Human
cuauauuguuugcuaagc

SEQ ID NO: 1480607 - RNA, 19 nt, Human
cuauagccaaaaauagcua

SEQ ID NO: 1480608 - RNA, 14 nt, Human
cuauagccaaaaau

SEQ ID NO: 1480609 - RNA, 14 nt, Human
cuauaccaauaaag

SEQ ID NO: 1480610 - RNA, 13 nt, Human
cuauaccaauaaa

SEQ ID NO: 1480611 - RNA, 13 nt, Human
cuauagccaaaaa

SEQ ID NO: 1480612 - RNA, 22 nt, Human
cuauaagcaagaaggcaaaaau

SEQ ID NO: 1480613 - RNA, 14 nt, Human
cuagucaccagaga

SEQ ID NO: 1480614 - RNA, 16 nt, Human
cuagucaaucaagucu

SEQ ID NO: 1480615 - RNA, 20 nt, Human
cuagucaaucaagucuguuu

SEQ ID NO: 1480616 - RNA, 21 nt, Human
cuagucaaucaagucuguuua

SEQ ID NO: 1480617 - RNA, 16 nt, Human
cuaguaauuggaaagg

SEQ ID NO: 1480618 - RNA, 16 nt, Human
cuaguacuaacuccua

SEQ ID NO: 1480619 - RNA, 18 nt, Human
cuagguggguugaaagcc

SEQ ID NO: 1480620 - RNA, 19 nt, Human
cuagguggguugaaagcca

SEQ ID NO: 1480621 - RNA, 23 nt, Human
cuagguggguugaaagccaagga

SEQ ID NO: 1480622 - RNA, 20 nt, Human
cuagugaaacucguuaauuu

SEQ ID NO: 1480623 - RNA, 13 nt, Human
cuagucauaaccu

SEQ ID NO: 1480624 - RNA, 21 nt, Human
cuagugagcagucaggaaaga

SEQ ID NO: 1480625 - RNA, 22 nt, Human
cuagguaaauuacaguuccuag

SEQ ID NO: 1480626 - RNA, 19 nt, Human
cuaggguuaggagguccuu

SEQ ID NO: 1480627 - RNA, 17 nt, Human
cuagguaggaaaugugg

SEQ ID NO: 1480628 - RNA, 17 nt, Human
cucgccggaucugaggg

SEQ ID NO: 1480629 - RNA, 18 nt, Human
cucgccggaucugaggga

SEQ ID NO: 1480630 - RNA, 21 nt, Human
cuccuuggugauuccgcagug

SEQ ID NO: 1480631 - RNA, 14 nt, Human
cuccuuccggggaa

SEQ ID NO: 1480632 - RNA, 20 nt, Human
cuccuuccggggaaggauuu

SEQ ID NO: 1480633 - RNA, 13 nt, Human
cucgagaucccaa

SEQ ID NO: 1480634 - RNA, 21 nt, Human
cucgagaucccaacacugcca

SEQ ID NO: 1480635 - RNA, 22 nt, Human
cucgagaucccaacacugccag

SEQ ID NO: 1480636 - RNA, 23 nt, Human
cucgagaucccaacacugccagc

SEQ ID NO: 1480637 - RNA, 17 nt, Human
cuccugccucagccucc

SEQ ID NO: 1480638 - RNA, 15 nt, Human
cuccugccggcuccu

SEQ ID NO: 1480639 - RNA, 16 nt, Human
cuccccuuuuuuuccc

SEQ ID NO: 1480640 - RNA, 14 nt, Human
cucccugccuccug

SEQ ID NO: 1480641 - RNA, 13 nt, Human
cuccaucccuggc

SEQ ID NO: 1480642 - RNA, 14 nt, Human
cuccaucccuggcc

SEQ ID NO: 1480643 - RNA, 15 nt, Human
cuccaucccuggccc

SEQ ID NO: 1480644 - RNA, 16 nt, Human
cuccaucccuggcccc

SEQ ID NO: 1480645 - RNA, 19 nt, Human
cuccaucccuggcccccuc

SEQ ID NO: 1480646 - RNA, 24 nt, Human
cuccaucccuggcccccucccugg

SEQ ID NO: 1480647 - RNA, 15 nt, Human
cuccucaaccccucc

SEQ ID NO: 1480648 - RNA, 21 nt, Human
cuccucaaccccuccccucca

SEQ ID NO: 1480649 - RNA, 14 nt, Human
cuccucacccccag

SEQ ID NO: 1480650 - RNA, 20 nt, Human
cuccucaaccccuccccucc

SEQ ID NO: 1480651 - RNA, 17 nt, Human
cuccucagggacucagg

SEQ ID NO: 1480652 - RNA, 11 nt, Human
cuccucaggga

SEQ ID NO: 1480653 - RNA, 12 nt, Human
cuccucccagga

SEQ ID NO: 1480654 - RNA, 21 nt, Human
cuccaaacugacucuuaagaa

SEQ ID NO: 1480655 - RNA, 12 nt, Human
cucauuagacug

SEQ ID NO: 1480656 - RNA, 13 nt, Human
cucauuagacugg

SEQ ID NO: 1480657 - RNA, 15 nt, Human
cucaucucuucuuuu

SEQ ID NO: 1480658 - RNA, 12 nt, Human
cucaucucuucu

SEQ ID NO: 1480659 - RNA, 16 nt, Human
cuccauccuaccacaa

SEQ ID NO: 1480660 - RNA, 11 nt, Human
cuccaucccug

SEQ ID NO: 1480661 - RNA, 12 nt, Human
cuccaucccugg

SEQ ID NO: 1480662 - RNA, 14 nt, Human
cuccaccuccuggg

SEQ ID NO: 1480663 - RNA, 16 nt, Human
cucauacccucccucc

SEQ ID NO: 1480664 - RNA, 17 nt, Human
cucauacccucccuccc

SEQ ID NO: 1480665 - RNA, 14 nt, Human
cucauagacacuga

SEQ ID NO: 1480666 - RNA, 18 nt, Human
cucauagacacugaucug

SEQ ID NO: 1480667 - RNA, 21 nt, Human
cucauauccaguauuguuccu

SEQ ID NO: 1480668 - RNA, 16 nt, Human
cucaucaacugaauga

SEQ ID NO: 1480669 - RNA, 14 nt, Human
cucaucaacugaau

SEQ ID NO: 1480670 - RNA, 16 nt, Human
cucaggaugagggaaa

SEQ ID NO: 1480671 - RNA, 20 nt, Human
cucaggaugagggaaaagaa

SEQ ID NO: 1480672 - RNA, 22 nt, Human
cucaggaugagggaaaagaaaa

SEQ ID NO: 1480673 - RNA, 21 nt, Human
cucaggaugagggaaaagaaa

SEQ ID NO: 1480674 - RNA, 21 nt, Human
cucagggacucaucuuucccu

SEQ ID NO: 1480675 - RNA, 23 nt, Human
cucagggacucaucuuucccucc

SEQ ID NO: 1480676 - RNA, 20 nt, Human
cgagauaccccaccucccuc

SEQ ID NO: 1480677 - RNA, 13 nt, Human
cgagaucccaaca

SEQ ID NO: 1480678 - RNA, 15 nt, Human
cgagaucccaacacu

SEQ ID NO: 1480679 - RNA, 21 nt, Human
cgagaucccaacacugccagc

SEQ ID NO: 1480680 - RNA, 22 nt, Human
cgagaucccaacacugccagca

SEQ ID NO: 1480681 - RNA, 13 nt, Human
cgagauaccccac

SEQ ID NO: 1480682 - RNA, 16 nt, Human
cgacuugccaaauuua

SEQ ID NO: 1480683 - RNA, 22 nt, Human
ccuuugaccugccucccuucau

SEQ ID NO: 1480684 - RNA, 21 nt, Human
ccuuugaccugccucccuuca

SEQ ID NO: 1480685 - RNA, 22 nt, Human
cgaaaaucauauaaucuuacaa

SEQ ID NO: 1480686 - RNA, 15 nt, Human
cgaacuccuugauuu

SEQ ID NO: 1480687 - RNA, 13 nt, Human
cgaagacacagac

SEQ ID NO: 1480688 - RNA, 17 nt, Human
cgcaccccccaagcugu

SEQ ID NO: 1480689 - RNA, 16 nt, Human
cgccaggauggcgcag

SEQ ID NO: 1480690 - RNA, 23 nt, Human
cgccaggauggcgcaggaacuca

SEQ ID NO: 1480691 - RNA, 19 nt, Human
cgccaggauggcgcaggaa

SEQ ID NO: 1480692 - RNA, 18 nt, Human
cgauuagacuggacagcu

SEQ ID NO: 1480693 - RNA, 14 nt, Human
cgauuugucccagg

SEQ ID NO: 1480694 - RNA, 11 nt, Human
cgauuagacug

SEQ ID NO: 1480695 - RNA, 21 nt, Human
ccuuguuucucuuccuuucuu

SEQ ID NO: 1480696 - RNA, 21 nt, Human
ccuuguucugauaaugaaaau

SEQ ID NO: 1480697 - RNA, 15 nt, Human
ccuugucacgccaga

SEQ ID NO: 1480698 - RNA, 18 nt, Human
ccuugucacgccagacuu

SEQ ID NO: 1480699 - RNA, 16 nt, Human
ccuugucacugguaga

SEQ ID NO: 1480700 - RNA, 16 nt, Human
ccuuugaccugccucc

SEQ ID NO: 1480701 - RNA, 15 nt, Human
ccuuugaccugccuc

SEQ ID NO: 1480702 - RNA, 14 nt, Human
ccuuucuagagcac

SEQ ID NO: 1480703 - RNA, 19 nt, Human
ccuuucuagagcacugcca

SEQ ID NO: 1480704 - RNA, 15 nt, Human
ccuuucuagccuggc

SEQ ID NO: 1480705 - RNA, 15 nt, Human
ccuuucuaguugaaa

SEQ ID NO: 1480706 - RNA, 14 nt, Human
ccuuucuaguugaa

SEQ ID NO: 1480707 - RNA, 19 nt, Human
ccuuggggcugaugcaguu

SEQ ID NO: 1480708 - RNA, 18 nt, Human
ccuuggggauucuuccau

SEQ ID NO: 1480709 - RNA, 22 nt, Human
ccuuggggauucuuccaucuga

SEQ ID NO: 1480710 - RNA, 20 nt, Human
ccuuggugauuccgcaguga

SEQ ID NO: 1480711 - RNA, 20 nt, Human
ccuugaguaguuuuuaucug

SEQ ID NO: 1480712 - RNA, 18 nt, Human
ccuugauugguguugcca

SEQ ID NO: 1480713 - RNA, 20 nt, Human
ccuugauuuuagccuucucu

SEQ ID NO: 1480714 - RNA, 21 nt, Human
ccuugauuuuagccuucucug

SEQ ID NO: 1480715 - RNA, 22 nt, Human
ccuugauuuuagccuucucugu

SEQ ID NO: 1480716 - RNA, 13 nt, Human
ccuugaacuagga

SEQ ID NO: 1480717 - RNA, 19 nt, Human
ccuugaguaguuuuuaucu

SEQ ID NO: 1480718 - RNA, 17 nt, Human
ccuugagggcaagagcc

SEQ ID NO: 1480719 - RNA, 19 nt, Human
ccuucuauacccacccaga

SEQ ID NO: 1480720 - RNA, 20 nt, Human
ccuucuauacccacccagaa

SEQ ID NO: 1480721 - RNA, 18 nt, Human
ccuucuauacccacccag

SEQ ID NO: 1480722 - RNA, 20 nt, Human
ccuucucuacacucuuguaa

SEQ ID NO: 1480723 - RNA, 15 nt, Human
ccuucuauuggucuc

SEQ ID NO: 1480724 - RNA, 15 nt, Human
ccuucuauucuagcc

SEQ ID NO: 1480725 - RNA, 20 nt, Human
ccuucagcacuuuagaauau

SEQ ID NO: 1480726 - RNA, 19 nt, Human
ccuuccuuuuacuuuucuu

SEQ ID NO: 1480727 - RNA, 17 nt, Human
ccuuaagagucauccag

SEQ ID NO: 1480728 - RNA, 16 nt, Human
ccuuaacugcauccag

SEQ ID NO: 1480729 - RNA, 13 nt, Human
ccuuaaggcucuu

SEQ ID NO: 1480730 - RNA, 16 nt, Human
ccuuaaggcucuuuug

SEQ ID NO: 1480731 - RNA, 18 nt, Human
ccuuaaggcucuuuugua

SEQ ID NO: 1480732 - RNA, 12 nt, Human
ccuuaagucaga

SEQ ID NO: 1480733 - RNA, 23 nt, Human
ccuuaaucagguccucagagaau

SEQ ID NO: 1480734 - RNA, 16 nt, Human
ccuuaauuuauuauua

SEQ ID NO: 1480735 - RNA, 13 nt, Human
ccuguuuuucaca

SEQ ID NO: 1480736 - RNA, 16 nt, Human
ccuguuuuucacauuu

SEQ ID NO: 1480737 - RNA, 20 nt, Human
ccuguuuuucacauuuuccu

SEQ ID NO: 1480738 - RNA, 22 nt, Human
ccuuacaaguuagaaaacauaa

SEQ ID NO: 1480739 - RNA, 14 nt, Human
ccuuaccuuuuuau

SEQ ID NO: 1480740 - RNA, 16 nt, Human
ccuuacucuucuugaa

SEQ ID NO: 1480741 - RNA, 17 nt, Human
ccuuacucuucuugaaa

SEQ ID NO: 1480742 - RNA, 22 nt, Human
ccuuacucuucuugaaauuuua

SEQ ID NO: 1480743 - RNA, 15 nt, Human
ccuguuuaagagaca

SEQ ID NO: 1480744 - RNA, 12 nt, Human
ccuguuuaagag

SEQ ID NO: 1480745 - RNA, 14 nt, Human
ccuguuucuggcac

SEQ ID NO: 1480746 - RNA, 12 nt, Human
ccuguuucuucc

SEQ ID NO: 1480747 - RNA, 12 nt, Human
ccuguguggaga

SEQ ID NO: 1480748 - RNA, 13 nt, Human
ccuguguggagag

SEQ ID NO: 1480749 - RNA, 14 nt, Human
ccuguguggagagg

SEQ ID NO: 1480750 - RNA, 15 nt, Human
ccuguguggagaggg

SEQ ID NO: 1480751 - RNA, 16 nt, Human
ccuguguggagaggga

SEQ ID NO: 1480752 - RNA, 19 nt, Human
ccuguguggagagggaaug

SEQ ID NO: 1480753 - RNA, 23 nt, Human
ccuguguggagagggaaugugaa

SEQ ID NO: 1480754 - RNA, 21 nt, Human
ccuguguggagagggaaugug

SEQ ID NO: 1480755 - RNA, 22 nt, Human
ccuguguggagagggaauguga

SEQ ID NO: 1480756 - RNA, 23 nt, Human
ccugcaggcaggaacaaacaggg

SEQ ID NO: 1480757 - RNA, 22 nt, Human
ccugcaggcaggaacaaacagg

SEQ ID NO: 1480758 - RNA, 22 nt, Human
ccugauuuuuuuuccuuuuaau

SEQ ID NO: 1480759 - RNA, 11 nt, Human
ccugccaggag

SEQ ID NO: 1480760 - RNA, 21 nt, Human
ccugccaggagcuuuggaccu

SEQ ID NO: 1480761 - RNA, 13 nt, Human
ccugccaggagga

SEQ ID NO: 1480762 - RNA, 12 nt, Human
ccugccaggagg

SEQ ID NO: 1480763 - RNA, 22 nt, Human
ccugcauccauucuccugagga

SEQ ID NO: 1480764 - RNA, 23 nt, Human
ccugcauccauucuccugaggau

SEQ ID NO: 1480765 - RNA, 13 nt, Human
ccugacacuuuaa

SEQ ID NO: 1480766 - RNA, 14 nt, Human
ccugacacuuuaau

SEQ ID NO: 1480767 - RNA, 15 nt, Human
ccugacacuuuaauu

SEQ ID NO: 1480768 - RNA, 17 nt, Human
ccugacauguccuucug

SEQ ID NO: 1480769 - RNA, 22 nt, Human
ccucuccaccaucgucuucuug

SEQ ID NO: 1480770 - RNA, 20 nt, Human
ccuggugcacuggccccacc

SEQ ID NO: 1480771 - RNA, 19 nt, Human
ccuggugcacuggccccac

SEQ ID NO: 1480772 - RNA, 17 nt, Human
ccuggugcacuggcccc

SEQ ID NO: 1480773 - RNA, 18 nt, Human
ccugguauauccaaaagc

SEQ ID NO: 1480774 - RNA, 20 nt, Human
ccugguauauccaaaagcuu

SEQ ID NO: 1480775 - RNA, 17 nt, Human
ccuggguugcagacagg

SEQ ID NO: 1480776 - RNA, 16 nt, Human
ccuggguugcagacag

SEQ ID NO: 1480777 - RNA, 17 nt, Human
ccugguagaauagauau

SEQ ID NO: 1480778 - RNA, 12 nt, Human
ccugggcaggag

SEQ ID NO: 1480779 - RNA, 16 nt, Human
ccuggcugucugaggc

SEQ ID NO: 1480780 - RNA, 14 nt, Human
ccugggcaggaggg

SEQ ID NO: 1480781 - RNA, 22 nt, Human
ccuggaaggacauccauguucc

SEQ ID NO: 1480782 - RNA, 22 nt, Human
ccugccucaccagcccuggcaa

SEQ ID NO: 1480783 - RNA, 13 nt, Human
ccugccggcuccu

SEQ ID NO: 1480784 - RNA, 23 nt, Human
ccuggaaaucaggguuaguauug

SEQ ID NO: 1480785 - RNA, 18 nt, Human
ccuggaacugucucucau

SEQ ID NO: 1480786 - RNA, 20 nt, Human
ccuggaacugucucucauga

SEQ ID NO: 1480787 - RNA, 16 nt, Human
ccuggaagagcagccc

SEQ ID NO: 1480788 - RNA, 17 nt, Human
ccuggaagagcagcccu

SEQ ID NO: 1480789 - RNA, 15 nt, Human
ccuggaagccagcuu

SEQ ID NO: 1480790 - RNA, 17 nt, Human
ccuggaagccagcuuuc

SEQ ID NO: 1480791 - RNA, 23 nt, Human
ccuggaagcauuuguuucuacuu

SEQ ID NO: 1480792 - RNA, 20 nt, Human
ccuggaaggacauccauguu

SEQ ID NO: 1480793 - RNA, 19 nt, Human
ccugcugugaaagaaguaa

SEQ ID NO: 1480794 - RNA, 15 nt, Human
ccugcuauuugaagu

SEQ ID NO: 1480795 - RNA, 16 nt, Human
ccugcucagcccugca

SEQ ID NO: 1480796 - RNA, 19 nt, Human
ccugcucagcccugcacca

SEQ ID NO: 1480797 - RNA, 20 nt, Human
ccugcucagcccugcaccau

SEQ ID NO: 1480798 - RNA, 20 nt, Human
ccucucaauauucaauaaag

SEQ ID NO: 1480799 - RNA, 18 nt, Human
ccucucaauauucaauaa

SEQ ID NO: 1480800 - RNA, 22 nt, Human
ccucucaauauucaauaaagcu

SEQ ID NO: 1480801 - RNA, 18 nt, Human
ccucuccacucaugugac

SEQ ID NO: 1480802 - RNA, 11 nt, Human
ccuccugcuca

SEQ ID NO: 1480803 - RNA, 12 nt, Human
ccuccaccucaa

SEQ ID NO: 1480804 - RNA, 13 nt, Human
ccuccaccuccug

SEQ ID NO: 1480805 - RNA, 18 nt, Human
ccuccaccgcagaaggaa

SEQ ID NO: 1480806 - RNA, 17 nt, Human
ccuccagagacaacagg

SEQ ID NO: 1480807 - RNA, 19 nt, Human
ccuccaugacugcacagua

SEQ ID NO: 1480808 - RNA, 21 nt, Human
ccucaucuccccaucauuggu

SEQ ID NO: 1480809 - RNA, 12 nt, Human
ccuaugcuuuga

SEQ ID NO: 1480810 - RNA, 17 nt, Human
ccggcuugccacacccc

SEQ ID NO: 1480811 - RNA, 19 nt, Human
ccgggacaccuaggcuagg

SEQ ID NO: 1480812 - RNA, 20 nt, Human
ccgggacaccuaggcuaggg

SEQ ID NO: 1480813 - RNA, 20 nt, Human
ccgcucaggcugaccacuuu

SEQ ID NO: 1480814 - RNA, 19 nt, Human
ccgguaagagcaaaagaau

SEQ ID NO: 1480815 - RNA, 14 nt, Human
ccgcuaaaagaaac

SEQ ID NO: 1480816 - RNA, 18 nt, Human
ccgcuaaaagaaacuuuc

SEQ ID NO: 1480817 - RNA, 13 nt, Human
ccgcaccccccaa

SEQ ID NO: 1480818 - RNA, 15 nt, Human
ccgaggcagggaagg

SEQ ID NO: 1480819 - RNA, 19 nt, Human
ccuaaaagaaacccugcac

SEQ ID NO: 1480820 - RNA, 18 nt, Human
ccuaaaagaaacccugca

SEQ ID NO: 1480821 - RNA, 19 nt, Human
ccuaaauaauaaaaauaaa

SEQ ID NO: 1480822 - RNA, 18 nt, Human
ccuaaauauauuuuaaga

SEQ ID NO: 1480823 - RNA, 16 nt, Human
ccuaaauauauuuuaa

SEQ ID NO: 1480824 - RNA, 20 nt, Human
ccuaguuuucuccucccagg

SEQ ID NO: 1480825 - RNA, 13 nt, Human
ccuauacugcuug

SEQ ID NO: 1480826 - RNA, 22 nt, Human
ccuauacugcuuggagcugagc

SEQ ID NO: 1480827 - RNA, 23 nt, Human
ccuauacugcuuggagcugagca

SEQ ID NO: 1480828 - RNA, 12 nt, Human
ccuaguuuucca

SEQ ID NO: 1480829 - RNA, 13 nt, Human
ccuaguuuuccau

SEQ ID NO: 1480830 - RNA, 15 nt, Human
ccuaguuuuccaugc

SEQ ID NO: 1480831 - RNA, 15 nt, Human
ccuaguuuucuccuc

SEQ ID NO: 1480832 - RNA, 16 nt, Human
ccuaguuuucuccucc

SEQ ID NO: 1480833 - RNA, 18 nt, Human
ccuaguuuucuccuccca

SEQ ID NO: 1480834 - RNA, 19 nt, Human
ccuaguuuucuccucccag

SEQ ID NO: 1480835 - RNA, 16 nt, Human
ccuacuucuuuugcuc

SEQ ID NO: 1480836 - RNA, 22 nt, Human
ccuacuucuuuugcucuuagcu

SEQ ID NO: 1480837 - RNA, 14 nt, Human
ccuacuuugacuuu

SEQ ID NO: 1480838 - RNA, 15 nt, Human
ccuacuuugacuuuu

SEQ ID NO: 1480839 - RNA, 21 nt, Human
ccuacuuugacuuuuugcauu

SEQ ID NO: 1480840 - RNA, 15 nt, Human
ccuaggcuccacccc

SEQ ID NO: 1480841 - RNA, 17 nt, Human
ccuaggcuccaccccau

SEQ ID NO: 1480842 - RNA, 18 nt, Human
ccuaggcuccaccccauc

SEQ ID NO: 1480843 - RNA, 21 nt, Human
cccaccucccucaaccucauc

SEQ ID NO: 1480844 - RNA, 22 nt, Human
cccucucucauacccucccucc

SEQ ID NO: 1480845 - RNA, 18 nt, Human
cccucucucauacccucc

SEQ ID NO: 1480846 - RNA, 18 nt, Human
cccuccaccgcagaagga

SEQ ID NO: 1480847 - RNA, 21 nt, Human
cccuccaccgcagaaggaagg

SEQ ID NO: 1480848 - RNA, 23 nt, Human
cccuccacauuucccccuagccu

SEQ ID NO: 1480849 - RNA, 23 nt, Human
cccuauacugcuuggagcugagc

SEQ ID NO: 1480850 - RNA, 19 nt, Human
cccuccaccgcagaaggaa

SEQ ID NO: 1480851 - RNA, 13 nt, Human
cccuccagagaca

SEQ ID NO: 1480852 - RNA, 18 nt, Human
cccugccaccugucuguc

SEQ ID NO: 1480853 - RNA, 17 nt, Human
cccugccaccugucugu

SEQ ID NO: 1480854 - RNA, 16 nt, Human
cccugccaccugucug

SEQ ID NO: 1480855 - RNA, 15 nt, Human
cccugccaccugucu

SEQ ID NO: 1480856 - RNA, 14 nt, Human
cccugccaccuguc

SEQ ID NO: 1480857 - RNA, 13 nt, Human
cccugccaccugu

SEQ ID NO: 1480858 - RNA, 20 nt, Human
cccugccaccuccugccuca

SEQ ID NO: 1480859 - RNA, 23 nt, Human
cccugcaccaugcugcuggggaa

SEQ ID NO: 1480860 - RNA, 16 nt, Human
cccugcacuguaaaau

SEQ ID NO: 1480861 - RNA, 20 nt, Human
cccugcacuguaaaaugugg

SEQ ID NO: 1480862 - RNA, 17 nt, Human
cccugcacuguaaaaug

SEQ ID NO: 1480863 - RNA, 19 nt, Human
cccugaggccuagacucug

SEQ ID NO: 1480864 - RNA, 16 nt, Human
cccugaggccuagacu

SEQ ID NO: 1480865 - RNA, 12 nt, Human
cccugaggccua

SEQ ID NO: 1480866 - RNA, 21 nt, Human
cccuggaaggacauccauguu

SEQ ID NO: 1480867 - RNA, 15 nt, Human
cccugggaggcucug

SEQ ID NO: 1480868 - RNA, 13 nt, Human
cccugggccuugg

SEQ ID NO: 1480869 - RNA, 18 nt, Human
cccugggccuugggcucc

SEQ ID NO: 1480870 - RNA, 15 nt, Human
cccuggacugugugc

SEQ ID NO: 1480871 - RNA, 21 nt, Human
cccuggacugugugcucagga

SEQ ID NO: 1480872 - RNA, 18 nt, Human
cccuggucccucugcagu

SEQ ID NO: 1480873 - RNA, 14 nt, Human
cccugggccuuggg

SEQ ID NO: 1480874 - RNA, 13 nt, Human
cccgccucagccu

SEQ ID NO: 1480875 - RNA, 20 nt, Human
cccagaaaagaaagcuacag

SEQ ID NO: 1480876 - RNA, 13 nt, Human
cccagaaaagaaa

SEQ ID NO: 1480877 - RNA, 14 nt, Human
cccuacccuggacu

SEQ ID NO: 1480878 - RNA, 14 nt, Human
cccuaccugugccu

SEQ ID NO: 1480879 - RNA, 19 nt, Human
cccuagcgcuaucucccug

SEQ ID NO: 1480880 - RNA, 13 nt, Human
ccauggcccugcc

SEQ ID NO: 1480881 - RNA, 14 nt, Human
ccauauuggccagu

SEQ ID NO: 1480882 - RNA, 18 nt, Human
ccauccuacccccugugc

SEQ ID NO: 1480883 - RNA, 14 nt, Human
ccauauuguaaaac

SEQ ID NO: 1480884 - RNA, 18 nt, Human
ccauauuguaaaacaggu

SEQ ID NO: 1480885 - RNA, 14 nt, Human
ccaucgucuucuug

SEQ ID NO: 1480886 - RNA, 20 nt, Human
ccauucacuucauaauccag

SEQ ID NO: 1480887 - RNA, 13 nt, Human
ccauguuggcuag

SEQ ID NO: 1480888 - RNA, 11 nt, Human
ccaugggacca

SEQ ID NO: 1480889 - RNA, 22 nt, Human
ccaugggagcugguuagaaaug

SEQ ID NO: 1480890 - RNA, 21 nt, Human
ccaugggaggccuuucccuaa

SEQ ID NO: 1480891 - RNA, 15 nt, Human
ccaugggaccacaac

SEQ ID NO: 1480892 - RNA, 14 nt, Human
ccaugggaggccuu

SEQ ID NO: 1480893 - RNA, 19 nt, Human
ccaugggaggccuuucccu

SEQ ID NO: 1480894 - RNA, 14 nt, Human
ccauucauuccauu

SEQ ID NO: 1480895 - RNA, 13 nt, Human
ccauucauuccau

SEQ ID NO: 1480896 - RNA, 23 nt, Human
ccauuuggauccuguguggagag

SEQ ID NO: 1480897 - RNA, 16 nt, Human
ccauuuggcaucccug

SEQ ID NO: 1480898 - RNA, 19 nt, Human
ccauuuggcaucccugggc

SEQ ID NO: 1480899 - RNA, 18 nt, Human
ccauuuggcaucccuggg

SEQ ID NO: 1480900 - RNA, 19 nt, Human
cccaaaggcuuugcccugc

SEQ ID NO: 1480901 - RNA, 18 nt, Human
ccagguuggagugcagug

SEQ ID NO: 1480902 - RNA, 23 nt, Human
ccaggcuguguuuggcuuucagg

SEQ ID NO: 1480903 - RNA, 24 nt, Human
ccaggcuaauuuuuuuguauuuua

SEQ ID NO: 1480904 - RNA, 21 nt, Human
ccaggccgggaaaaagcccac

SEQ ID NO: 1480905 - RNA, 16 nt, Human
ccaggagccugugccu

SEQ ID NO: 1480906 - RNA, 17 nt, Human
ccaggagccugugccuc

SEQ ID NO: 1480907 - RNA, 13 nt, Human
ccaggagacaggu

SEQ ID NO: 1480908 - RNA, 15 nt, Human
ccauagguagaaugu

SEQ ID NO: 1480909 - RNA, 17 nt, Human
ccaguuagccucugcag

SEQ ID NO: 1480910 - RNA, 22 nt, Human
ccaguuagccucugcaggaugu

SEQ ID NO: 1480911 - RNA, 21 nt, Human
ccaguguguggcuuucagagc

SEQ ID NO: 1480912 - RNA, 22 nt, Human
ccaguguguggcuuucagagcc

SEQ ID NO: 1480913 - RNA, 23 nt, Human
ccaguguguggcuuucagagccu

SEQ ID NO: 1480914 - RNA, 16 nt, Human
ccaguguguggcuuuc

SEQ ID NO: 1480915 - RNA, 18 nt, Human
ccaguguguggcuuucag

SEQ ID NO: 1480916 - RNA, 23 nt, Human
ccagcauaauacuugcuuuggaa

SEQ ID NO: 1480917 - RNA, 16 nt, Human
ccagcauuucccuucc

SEQ ID NO: 1480918 - RNA, 21 nt, Human
ccagcauuucccuuccuuccu

SEQ ID NO: 1480919 - RNA, 14 nt, Human
ccagccucagcucu

SEQ ID NO: 1480920 - RNA, 23 nt, Human
ccagcaauuacaacggagucaaa

SEQ ID NO: 1480921 - RNA, 15 nt, Human
ccagaccauggacac

SEQ ID NO: 1480922 - RNA, 18 nt, Human
ccagaccauugucucaga

SEQ ID NO: 1480923 - RNA, 21 nt, Human
ccagaccauugucucagagca

SEQ ID NO: 1480924 - RNA, 19 nt, Human
ccacuguacuugcucuuga

SEQ ID NO: 1480925 - RNA, 18 nt, Human
ccacuguacuugcucuug

SEQ ID NO: 1480926 - RNA, 17 nt, Human
ccacuguacuugcucuu

SEQ ID NO: 1480927 - RNA, 20 nt, Human
ccacuguacuugcucuugau

SEQ ID NO: 1480928 - RNA, 16 nt, Human
ccagagcacugcucca

SEQ ID NO: 1480929 - RNA, 13 nt, Human
ccagagcaaaaua

SEQ ID NO: 1480930 - RNA, 19 nt, Human
ccagaggcuauuauuuuca

SEQ ID NO: 1480931 - RNA, 22 nt, Human
ccagauuuaugcauauuauuuu

SEQ ID NO: 1480932 - RNA, 13 nt, Human
ccagauuuaugca

SEQ ID NO: 1480933 - RNA, 16 nt, Human
ccagaugcagcucaag

SEQ ID NO: 1480934 - RNA, 22 nt, Human
ccacugccuuugaccugccucc

SEQ ID NO: 1480935 - RNA, 14 nt, Human
ccacugccuuugac

SEQ ID NO: 1480936 - RNA, 14 nt, Human
ccacucacaacagc

SEQ ID NO: 1480937 - RNA, 20 nt, Human
ccacucacaacagcugccug

SEQ ID NO: 1480938 - RNA, 19 nt, Human
ccacucaugugacucuuuc

SEQ ID NO: 1480939 - RNA, 22 nt, Human
ccacucaugugacucuuuccaa

SEQ ID NO: 1480940 - RNA, 20 nt, Human
ccaccucccucaaccucauc

SEQ ID NO: 1480941 - RNA, 18 nt, Human
ccaccucccucaaccuca

SEQ ID NO: 1480942 - RNA, 20 nt, Human
ccaccugaauaaagaaugaa

SEQ ID NO: 1480943 - RNA, 20 nt, Human
ccacccucguggacaccugc

SEQ ID NO: 1480944 - RNA, 22 nt, Human
ccacccucguggacaccugccc

SEQ ID NO: 1480945 - RNA, 21 nt, Human
ccacccucguggacaccugcc

SEQ ID NO: 1480946 - RNA, 22 nt, Human
ccacccagaaugagacauccag

SEQ ID NO: 1480947 - RNA, 22 nt, Human
ccaaaccacuuuuugcagcuuu

SEQ ID NO: 1480948 - RNA, 14 nt, Human
ccaaaccacuuuuu

SEQ ID NO: 1480949 - RNA, 16 nt, Human
ccaaaccaggacccug

SEQ ID NO: 1480950 - RNA, 11 nt, Human
ccaaaccacuu

SEQ ID NO: 1480951 - RNA, 16 nt, Human
ccacacccacacucag

SEQ ID NO: 1480952 - RNA, 22 nt, Human
ccacccaauucaaaacauugug

SEQ ID NO: 1480953 - RNA, 13 nt, Human
ccaccaagccuug

SEQ ID NO: 1480954 - RNA, 12 nt, Human
ccaccaagccuu

SEQ ID NO: 1480955 - RNA, 14 nt, Human
ccaccaagccuuga

SEQ ID NO: 1480956 - RNA, 22 nt, Human
cauuauucguagauauuggaca

SEQ ID NO: 1480957 - RNA, 18 nt, Human
cauuauuggaauauaauu

SEQ ID NO: 1480958 - RNA, 23 nt, Human
cauuacuauaagaacuuugagcu

SEQ ID NO: 1480959 - RNA, 13 nt, Human
cauuacugcaugc

SEQ ID NO: 1480960 - RNA, 16 nt, Human
cauuacugcaugcacu

SEQ ID NO: 1480961 - RNA, 23 nt, Human
cauuacugcaugcacuucuuaca

SEQ ID NO: 1480962 - RNA, 17 nt, Human
cauuacuauaagaacuu

SEQ ID NO: 1480963 - RNA, 19 nt, Human
cauuagaagacaauugaca

SEQ ID NO: 1480964 - RNA, 20 nt, Human
cauucaaauguauuacagug

SEQ ID NO: 1480965 - RNA, 16 nt, Human
cauucaagucagcucu

SEQ ID NO: 1480966 - RNA, 17 nt, Human
cauucaagucagcucuu

SEQ ID NO: 1480967 - RNA, 17 nt, Human
cauucacaucgcagauu

SEQ ID NO: 1480968 - RNA, 18 nt, Human
cauuaacucauuagacug

SEQ ID NO: 1480969 - RNA, 15 nt, Human
cauuaacucauuaga

SEQ ID NO: 1480970 - RNA, 21 nt, Human
cauucagauaugauucaaaug

SEQ ID NO: 1480971 - RNA, 17 nt, Human
cauucagaagaaaaaga

SEQ ID NO: 1480972 - RNA, 14 nt, Human
cauucacuucauaa

SEQ ID NO: 1480973 - RNA, 15 nt, Human
cauucacuucauaau

SEQ ID NO: 1480974 - RNA, 13 nt, Human
cauucagaagaaa

SEQ ID NO: 1480975 - RNA, 18 nt, Human
cauucagaagaaaaagaa

SEQ ID NO: 1480976 - RNA, 11 nt, Human
cauucacuuca

SEQ ID NO: 1480977 - RNA, 19 nt, Human
cauucauuuucuggguguu

SEQ ID NO: 1480978 - RNA, 17 nt, Human
cauucauuuuuguuguu

SEQ ID NO: 1480979 - RNA, 17 nt, Human
cauucauuccauucugg

SEQ ID NO: 1480980 - RNA, 16 nt, Human
cauucauuccauucug

SEQ ID NO: 1480981 - RNA, 15 nt, Human
cauucauuccauucu

SEQ ID NO: 1480982 - RNA, 22 nt, Human
cauuccaacuaucucauuucca

SEQ ID NO: 1480983 - RNA, 21 nt, Human
cauuccaacucguauagcaug

SEQ ID NO: 1480984 - RNA, 14 nt, Human
cauuccauccuuga

SEQ ID NO: 1480985 - RNA, 12 nt, Human
cauuccauccuu

SEQ ID NO: 1480986 - RNA, 14 nt, Human
cauuccauucugga

SEQ ID NO: 1480987 - RNA, 15 nt, Human
cauuccauucuggaa

SEQ ID NO: 1480988 - RNA, 15 nt, Human
cauucccccagugcg

SEQ ID NO: 1480989 - RNA, 14 nt, Human
cauucccccagugc

SEQ ID NO: 1480990 - RNA, 13 nt, Human
cauucccccagug

SEQ ID NO: 1480991 - RNA, 13 nt, Human
cauuccuccaggu

SEQ ID NO: 1480992 - RNA, 12 nt, Human
cauuccuccagg

SEQ ID NO: 1480993 - RNA, 14 nt, Human
cauuccucugcccu

SEQ ID NO: 1480994 - RNA, 17 nt, Human
cauuccucaugaaugua

SEQ ID NO: 1480995 - RNA, 18 nt, Human
cauuccucaugaauguaa

SEQ ID NO: 1480996 - RNA, 19 nt, Human
cauuccucaugaauguaaa

SEQ ID NO: 1480997 - RNA, 21 nt, Human
cauuccucaugaauguaaauu

SEQ ID NO: 1480998 - RNA, 14 nt, Human
cauuccugaacagg

SEQ ID NO: 1480999 - RNA, 23 nt, Human
cauucugauucgaaugacacugu

SEQ ID NO: 1481000 - RNA, 22 nt, Human
cauucugauucgaaugacacug

SEQ ID NO: 1481001 - RNA, 16 nt, Human
cauucuggaagugacu

SEQ ID NO: 1481002 - RNA, 12 nt, Human
cauucuggaagu

SEQ ID NO: 1481003 - RNA, 13 nt, Human
cauucuggaauaa

SEQ ID NO: 1481004 - RNA, 15 nt, Human
cauucugucuugaag

SEQ ID NO: 1481005 - RNA, 21 nt, Human
cauucuuauuucaugaaaauu

SEQ ID NO: 1481006 - RNA, 13 nt, Human
cauucuuccuagu

SEQ ID NO: 1481007 - RNA, 18 nt, Human
cauucuuccuaguuuucu

SEQ ID NO: 1481008 - RNA, 21 nt, Human
cauucuuccuaguuuucuccu

SEQ ID NO: 1481009 - RNA, 12 nt, Human
cauucuuuccca

SEQ ID NO: 1481010 - RNA, 14 nt, Human
cauucuuucccaac

SEQ ID NO: 1481011 - RNA, 23 nt, Human
cauuuuaccuuugacaaagguaa

SEQ ID NO: 1481012 - RNA, 16 nt, Human
cauuugcuuuuucacc

SEQ ID NO: 1481013 - RNA, 18 nt, Human
cauuuuacauuaaauuuu

SEQ ID NO: 1481014 - RNA, 15 nt, Human
cauuucuuuuuggga

SEQ ID NO: 1481015 - RNA, 22 nt, Human
cauuucuuuuugggagagacuu

SEQ ID NO: 1481016 - RNA, 20 nt, Human
cauuugcugaauagcuacua

SEQ ID NO: 1481017 - RNA, 18 nt, Human
cauuuuuaccaucacuga

SEQ ID NO: 1481018 - RNA, 17 nt, Human
ccaaaauguugaaauau

SEQ ID NO: 1481019 - RNA, 20 nt, Human
ccaaaauguuggucauuuua

SEQ ID NO: 1481020 - RNA, 21 nt, Human
ccaaaauguuggucauuuuau

SEQ ID NO: 1481021 - RNA, 14 nt, Human
cauuuucuaagaaa

SEQ ID NO: 1481022 - RNA, 17 nt, Human
cauuuucuaagaaacau

SEQ ID NO: 1481023 - RNA, 13 nt, Human
cauuuucucccug

SEQ ID NO: 1481024 - RNA, 12 nt, Human
cauuuucucccu

SEQ ID NO: 1481025 - RNA, 12 nt, Human
cauuuucucuaa

SEQ ID NO: 1481026 - RNA, 17 nt, Human
cauuuucucccuggauu

SEQ ID NO: 1481027 - RNA, 23 nt, Human
cauuuucuaagaaacauuuauau

SEQ ID NO: 1481028 - RNA, 19 nt, Human
cauugagcuugcaugcuug

SEQ ID NO: 1481029 - RNA, 13 nt, Human
cauugaaggcuua

SEQ ID NO: 1481030 - RNA, 14 nt, Human
cauugaaggcuuaa

SEQ ID NO: 1481031 - RNA, 22 nt, Human
cauugaauggcuauguuuuuaa

SEQ ID NO: 1481032 - RNA, 14 nt, Human
cauuguuaccucua

SEQ ID NO: 1481033 - RNA, 21 nt, Human
cauuguuauauaaucauuauu

SEQ ID NO: 1481034 - RNA, 13 nt, Human
cauuuaaaacaga

SEQ ID NO: 1481035 - RNA, 17 nt, Human
cauuuaaaacagacacu

SEQ ID NO: 1481036 - RNA, 18 nt, Human
cauuuaaaacagacacug

SEQ ID NO: 1481037 - RNA, 23 nt, Human
cauuuaaaacagacacuggcaug

SEQ ID NO: 1481038 - RNA, 18 nt, Human
cauuguuaccucuauaua

SEQ ID NO: 1481039 - RNA, 17 nt, Human
cauuguuauauaaucau

SEQ ID NO: 1481040 - RNA, 18 nt, Human
cauuuaaauuuuuuuccu

SEQ ID NO: 1481041 - RNA, 21 nt, Human
cauguuaaccccuccacucuu

SEQ ID NO: 1481042 - RNA, 14 nt, Human
cauguguuuauccu

SEQ ID NO: 1481043 - RNA, 18 nt, Human
cauguguuuacuuuaugu

SEQ ID NO: 1481044 - RNA, 20 nt, Human
caugugcuaguaauuggaaa

SEQ ID NO: 1481045 - RNA, 13 nt, Human
cauguguauaaaa

SEQ ID NO: 1481046 - RNA, 14 nt, Human
cauguguauaaaaa

SEQ ID NO: 1481047 - RNA, 17 nt, Human
cauguguauaaaaauaa

SEQ ID NO: 1481048 - RNA, 14 nt, Human
caugugacucuuuc

SEQ ID NO: 1481049 - RNA, 16 nt, Human
caugugacucuuucca

SEQ ID NO: 1481050 - RNA, 17 nt, Human
caugugacucuuuccaa

SEQ ID NO: 1481051 - RNA, 16 nt, Human
caugucuauucagcuu

SEQ ID NO: 1481052 - RNA, 17 nt, Human
caugucuauucagcuuc

SEQ ID NO: 1481053 - RNA, 20 nt, Human
cauguuucuuuguaaugaaa

SEQ ID NO: 1481054 - RNA, 20 nt, Human
cauguuugcaccuuucuagu

SEQ ID NO: 1481055 - RNA, 22 nt, Human
cauguuugcaccuuucuaguug

SEQ ID NO: 1481056 - RNA, 21 nt, Human
cauguuugcaccuuucuaguu

SEQ ID NO: 1481057 - RNA, 22 nt, Human
cauguuuggaaggggucuguag

SEQ ID NO: 1481058 - RNA, 22 nt, Human
cauuaaaaaugcauauacuuua

SEQ ID NO: 1481059 - RNA, 14 nt, Human
caugcagaaagcau

SEQ ID NO: 1481060 - RNA, 17 nt, Human
caugcacuuggcugcau

SEQ ID NO: 1481061 - RNA, 15 nt, Human
caugcacugauguug

SEQ ID NO: 1481062 - RNA, 20 nt, Human
caugcacugauguuguguuu

SEQ ID NO: 1481063 - RNA, 21 nt, Human
caugcugugugacucaaacca

SEQ ID NO: 1481064 - RNA, 17 nt, Human
caugcugugugacucaa

SEQ ID NO: 1481065 - RNA, 15 nt, Human
caugcuguucaugaa

SEQ ID NO: 1481066 - RNA, 14 nt, Human
caugcugugugacu

SEQ ID NO: 1481067 - RNA, 21 nt, Human
cauggaaauucccuucaucug

SEQ ID NO: 1481068 - RNA, 20 nt, Human
cauggaauuggagcucgugg

SEQ ID NO: 1481069 - RNA, 16 nt, Human
caugcuguucaugaaa

SEQ ID NO: 1481070 - RNA, 18 nt, Human
caugcuguucaugaaaga

SEQ ID NO: 1481071 - RNA, 22 nt, Human
caugcugugugacucaaaccaa

SEQ ID NO: 1481072 - RNA, 20 nt, Human
caugcuguucaugaaagauu

SEQ ID NO: 1481073 - RNA, 20 nt, Human
cauggacacuacacccagca

SEQ ID NO: 1481074 - RNA, 19 nt, Human
cauggacacuacacccagc

SEQ ID NO: 1481075 - RNA, 18 nt, Human
cauggacacuacacccag

SEQ ID NO: 1481076 - RNA, 17 nt, Human
cauggacacuacaccca

SEQ ID NO: 1481077 - RNA, 16 nt, Human
cauggacacuacaccc

SEQ ID NO: 1481078 - RNA, 22 nt, Human
cauggacuucugccagcauaau

SEQ ID NO: 1481079 - RNA, 21 nt, Human
caugggaggccuuucccuaag

SEQ ID NO: 1481080 - RNA, 12 nt, Human
cauggcaguggg

SEQ ID NO: 1481081 - RNA, 23 nt, Human
cauggcagugggaaaaauguagg

SEQ ID NO: 1481082 - RNA, 17 nt, Human
caugggaccacaacuau

SEQ ID NO: 1481083 - RNA, 21 nt, Human
caugggagcugguuagaaaug

SEQ ID NO: 1481084 - RNA, 19 nt, Human
caugggaggccuuucccua

SEQ ID NO: 1481085 - RNA, 16 nt, Human
cauggguagccugggu

SEQ ID NO: 1481086 - RNA, 20 nt, Human
cauggguauaguucaugucu

SEQ ID NO: 1481087 - RNA, 15 nt, Human
cauggguagccuggg

SEQ ID NO: 1481088 - RNA, 13 nt, Human
caugauaaaugau

SEQ ID NO: 1481089 - RNA, 18 nt, Human
caugauaaugaacagaac

SEQ ID NO: 1481090 - RNA, 14 nt, Human
caugcacugauguu

SEQ ID NO: 1481091 - RNA, 18 nt, Human
caugagucacuacgccug

SEQ ID NO: 1481092 - RNA, 23 nt, Human
caugagcuccuuaaggcucuuuu

SEQ ID NO: 1481093 - RNA, 13 nt, Human
caugagaaauaca

SEQ ID NO: 1481094 - RNA, 18 nt, Human
caugagaaauacaaaaau

SEQ ID NO: 1481095 - RNA, 22 nt, Human
caugagaaauacaaaaauacuc

SEQ ID NO: 1481096 - RNA, 12 nt, Human
caugagaaucua

SEQ ID NO: 1481097 - RNA, 19 nt, Human
caugagaaucuauauuuaa

SEQ ID NO: 1481098 - RNA, 17 nt, Human
caugaagauauuuuucc

SEQ ID NO: 1481099 - RNA, 18 nt, Human
caugaagagauuuuucau

SEQ ID NO: 1481100 - RNA, 14 nt, Human
caugacuauggaua

SEQ ID NO: 1481101 - RNA, 19 nt, Human
caugaccuaguuuuccaug

SEQ ID NO: 1481102 - RNA, 14 nt, Human
caugaaagauucaa

SEQ ID NO: 1481103 - RNA, 22 nt, Human
caugaaauauagaucaguuaua

SEQ ID NO: 1481104 - RNA, 19 nt, Human
caugaaacagaaacaaaaa

SEQ ID NO: 1481105 - RNA, 13 nt, Human
caugaaacagaaa

SEQ ID NO: 1481106 - RNA, 15 nt, Human
caugaaacagaaaca

SEQ ID NO: 1481107 - RNA, 20 nt, Human
caugaaccucaagcugcauc

SEQ ID NO: 1481108 - RNA, 19 nt, Human
caugaaccucaagcugcau

SEQ ID NO: 1481109 - RNA, 14 nt, Human
caucuuucccuccu

SEQ ID NO: 1481110 - RNA, 13 nt, Human
caucuuucccucc

SEQ ID NO: 1481111 - RNA, 21 nt, Human
caucuuucccuccuuggugau

SEQ ID NO: 1481112 - RNA, 18 nt, Human
caucuuucccuccuuggu

SEQ ID NO: 1481113 - RNA, 17 nt, Human
caucuuucccuccuugg

SEQ ID NO: 1481114 - RNA, 16 nt, Human
caucuuucccuccuug

SEQ ID NO: 1481115 - RNA, 15 nt, Human
caucuuucccuccuu

SEQ ID NO: 1481116 - RNA, 10 nt, Human
caucuuuaag

SEQ ID NO: 1481117 - RNA, 18 nt, Human
cauccuacccccugugcc

SEQ ID NO: 1481118 - RNA, 23 nt, Human
cauccuaccacaaugcagugccu

SEQ ID NO: 1481119 - RNA, 15 nt, Human
cauccuacccccugu

SEQ ID NO: 1481120 - RNA, 21 nt, Human
cauccuaccacaaugcagugc

SEQ ID NO: 1481121 - RNA, 15 nt, Human
caucaucucagcuca

SEQ ID NO: 1481122 - RNA, 14 nt, Human
caucaucucagcuc

SEQ ID NO: 1481123 - RNA, 15 nt, Human
caucauggcuaucug

SEQ ID NO: 1481124 - RNA, 13 nt, Human
caucaccacaguu

SEQ ID NO: 1481125 - RNA, 14 nt, Human
caucaacugaauga

SEQ ID NO: 1481126 - RNA, 22 nt, Human
caucaccuuagaccaccaagcc

SEQ ID NO: 1481127 - RNA, 23 nt, Human
caucaccuuagaccaccaagccu

SEQ ID NO: 1481128 - RNA, 18 nt, Human
caucaccuuagaccacca

SEQ ID NO: 1481129 - RNA, 17 nt, Human
caucaccuuagaccacc

SEQ ID NO: 1481130 - RNA, 15 nt, Human
caucaccuuagacca

SEQ ID NO: 1481131 - RNA, 16 nt, Human
caucacugaguuuucc

SEQ ID NO: 1481132 - RNA, 23 nt, Human
caucacugaguuuuccauggcag

SEQ ID NO: 1481133 - RNA, 17 nt, Human
caucacugaguuuucca

SEQ ID NO: 1481134 - RNA, 11 nt, Human
caucaggcuuu

SEQ ID NO: 1481135 - RNA, 15 nt, Human
caucaggcuuucuuu

SEQ ID NO: 1481136 - RNA, 15 nt, Human
caucaggcuuucuua

SEQ ID NO: 1481137 - RNA, 19 nt, Human
caucaggccuagaggccug

SEQ ID NO: 1481138 - RNA, 18 nt, Human
caucccuuaccugggaaa

SEQ ID NO: 1481139 - RNA, 22 nt, Human
caucccugggccuugggcuccg

SEQ ID NO: 1481140 - RNA, 16 nt, Human
caucccuuugcccaga

SEQ ID NO: 1481141 - RNA, 13 nt, Human
caucccuccuggg

SEQ ID NO: 1481142 - RNA, 12 nt, Human
caucccuggccc

SEQ ID NO: 1481143 - RNA, 13 nt, Human
caucccuggcccc

SEQ ID NO: 1481144 - RNA, 20 nt, Human
caucccuggcccccucccug

SEQ ID NO: 1481145 - RNA, 21 nt, Human
caucccuggcccccucccugg

SEQ ID NO: 1481146 - RNA, 22 nt, Human
caucccuggcccccucccugga

SEQ ID NO: 1481147 - RNA, 23 nt, Human
caucccuggcccccucccuggau

SEQ ID NO: 1481148 - RNA, 11 nt, Human
caucccugggc

SEQ ID NO: 1481149 - RNA, 13 nt, Human
caucccugggccu

SEQ ID NO: 1481150 - RNA, 17 nt, Human
caucccugggccuuggg

SEQ ID NO: 1481151 - RNA, 21 nt, Human
caucccugggccuugggcucc

SEQ ID NO: 1481152 - RNA, 21 nt, Human
cauccagagucccugccugga

SEQ ID NO: 1481153 - RNA, 13 nt, Human
cauccaguucaug

SEQ ID NO: 1481154 - RNA, 13 nt, Human
cauccagaguccc

SEQ ID NO: 1481155 - RNA, 17 nt, Human
cauccagagucccugcc

SEQ ID NO: 1481156 - RNA, 18 nt, Human
cauccagagucccugccu

SEQ ID NO: 1481157 - RNA, 20 nt, Human
cauccagagucccugccugg

SEQ ID NO: 1481158 - RNA, 19 nt, Human
cauauuguuacugguacca

SEQ ID NO: 1481159 - RNA, 13 nt, Human
cauauuguuacug

SEQ ID NO: 1481160 - RNA, 14 nt, Human
cauauuguguguaa

SEQ ID NO: 1481161 - RNA, 13 nt, Human
cauauuguugaaa

SEQ ID NO: 1481162 - RNA, 16 nt, Human
cauauuguugaaaggu

SEQ ID NO: 1481163 - RNA, 13 nt, Human
cauauuguaaaac

SEQ ID NO: 1481164 - RNA, 16 nt, Human
cauauuguaaaacagg

SEQ ID NO: 1481165 - RNA, 17 nt, Human
cauauuguaaaacaggu

SEQ ID NO: 1481166 - RNA, 19 nt, Human
cauauuguaaaacagguag

SEQ ID NO: 1481167 - RNA, 18 nt, Human
cauauugugauucugccu

SEQ ID NO: 1481168 - RNA, 20 nt, Human
cauauugugauucugccuuu

SEQ ID NO: 1481169 - RNA, 17 nt, Human
cauauaugaggacuugu

SEQ ID NO: 1481170 - RNA, 15 nt, Human
cauauauaacaaugc

SEQ ID NO: 1481171 - RNA, 20 nt, Human
cauauauaacaaugcuguau

SEQ ID NO: 1481172 - RNA, 13 nt, Human
cauauauaacaau

SEQ ID NO: 1481173 - RNA, 16 nt, Human
cauauaagugauugcu

SEQ ID NO: 1481174 - RNA, 16 nt, Human
cauaguagaacgcuau

SEQ ID NO: 1481175 - RNA, 18 nt, Human
cauaguauucaugacuau

SEQ ID NO: 1481176 - RNA, 23 nt, Human
cauagucauguaagcugaaaaua

SEQ ID NO: 1481177 - RNA, 23 nt, Human
cagugcugaccagacagccuccc

SEQ ID NO: 1481178 - RNA, 12 nt, Human
cagugcugugcu

SEQ ID NO: 1481179 - RNA, 16 nt, Human
cagugcugugcugugc

SEQ ID NO: 1481180 - RNA, 19 nt, Human
cagugcugugcugugcuau

SEQ ID NO: 1481181 - RNA, 22 nt, Human
cagugcugugcugugcuauggu

SEQ ID NO: 1481182 - RNA, 10 nt, Human
caucaacuga

SEQ ID NO: 1481183 - RNA, 12 nt, Human
caucaacugaau

SEQ ID NO: 1481184 - RNA, 18 nt, Human
caggucccuaauaaagcu

SEQ ID NO: 1481185 - RNA, 17 nt, Human
caggucccuaauaaagc

SEQ ID NO: 1481186 - RNA, 16 nt, Human
caggucccuaauaaag

SEQ ID NO: 1481187 - RNA, 15 nt, Human
caggucccuaauaaa

SEQ ID NO: 1481188 - RNA, 14 nt, Human
caggucccuaauaa

SEQ ID NO: 1481189 - RNA, 13 nt, Human
caggucccuaaua

SEQ ID NO: 1481190 - RNA, 12 nt, Human
caggucccuaau

SEQ ID NO: 1481191 - RNA, 11 nt, Human
caggucccuaa

SEQ ID NO: 1481192 - RNA, 13 nt, Human
cagguccaggcug

SEQ ID NO: 1481193 - RNA, 20 nt, Human
cagguaaaacagggccacau

SEQ ID NO: 1481194 - RNA, 21 nt, Human
cagguacuuguaaauuauuaa

SEQ ID NO: 1481195 - RNA, 20 nt, Human
cagguagaauuaucuaauuu

SEQ ID NO: 1481196 - RNA, 22 nt, Human
cagguagaauuaucuaauuuau

SEQ ID NO: 1481197 - RNA, 23 nt, Human
cagguagaauuaucuaauuuaua

SEQ ID NO: 1481198 - RNA, 14 nt, Human
cagguaggaggcaa

SEQ ID NO: 1481199 - RNA, 23 nt, Human
cagguaggaggcaaauaucuuga

SEQ ID NO: 1481200 - RNA, 14 nt, Human
cagguauaccucac

SEQ ID NO: 1481201 - RNA, 15 nt, Human
cagguauaccucacu

SEQ ID NO: 1481202 - RNA, 17 nt, Human
cagguauagacuccuga

SEQ ID NO: 1481203 - RNA, 16 nt, Human
cagguauaccucacuu

SEQ ID NO: 1481204 - RNA, 15 nt, Human
cagguauccaaaaau

SEQ ID NO: 1481205 - RNA, 22 nt, Human
caggucccuaauaaagcugugu

SEQ ID NO: 1481206 - RNA, 21 nt, Human
caggucccuaauaaagcugug

SEQ ID NO: 1481207 - RNA, 20 nt, Human
caggucccuaauaaagcugu

SEQ ID NO: 1481208 - RNA, 19 nt, Human
caggucccuaauaaagcug

SEQ ID NO: 1481209 - RNA, 16 nt, Human
cagguccaggcugugu

SEQ ID NO: 1481210 - RNA, 15 nt, Human
cagguccucagagaa

SEQ ID NO: 1481211 - RNA, 20 nt, Human
cagguccucagagaauuucu

SEQ ID NO: 1481212 - RNA, 20 nt, Human
cagguccucaguguccucag

SEQ ID NO: 1481213 - RNA, 21 nt, Human
caggucugaagcucaacucuc

SEQ ID NO: 1481214 - RNA, 15 nt, Human
cagguggcccuacug

SEQ ID NO: 1481215 - RNA, 21 nt, Human
cagggucaaaguguuuucucu

SEQ ID NO: 1481216 - RNA, 23 nt, Human
cagggucaaaguguuuucucuga

SEQ ID NO: 1481217 - RNA, 23 nt, Human
cagguaaaacagggccacauaga

SEQ ID NO: 1481218 - RNA, 15 nt, Human
cagguaaaacagggc

SEQ ID NO: 1481219 - RNA, 14 nt, Human
cagguaaaacaggg

SEQ ID NO: 1481220 - RNA, 16 nt, Human
cagggggugugucugc

SEQ ID NO: 1481221 - RNA, 17 nt, Human
caguaauuugaggacaa

SEQ ID NO: 1481222 - RNA, 14 nt, Human
caguaauuuagaaa

SEQ ID NO: 1481223 - RNA, 23 nt, Human
caguacacugucagcagggacug

SEQ ID NO: 1481224 - RNA, 12 nt, Human
caguaccacaug

SEQ ID NO: 1481225 - RNA, 20 nt, Human
caguaccuagcuggcucugu

SEQ ID NO: 1481226 - RNA, 14 nt, Human
caguaacucaucug

SEQ ID NO: 1481227 - RNA, 16 nt, Human
caguaacucaucuguc

SEQ ID NO: 1481228 - RNA, 15 nt, Human
cagucaggaaagaga

SEQ ID NO: 1481229 - RNA, 18 nt, Human
cagucaggaaagagaacu

SEQ ID NO: 1481230 - RNA, 22 nt, Human
cagucaggaaagagaacuucca

SEQ ID NO: 1481231 - RNA, 21 nt, Human
caguauggguuagggaaaaca

SEQ ID NO: 1481232 - RNA, 16 nt, Human
caguauggguuaggga

SEQ ID NO: 1481233 - RNA, 23 nt, Human
caguauggguuagggaaaacauu

SEQ ID NO: 1481234 - RNA, 17 nt, Human
cagucauucagauauga

SEQ ID NO: 1481235 - RNA, 20 nt, Human
cagucauucagauaugauuc

SEQ ID NO: 1481236 - RNA, 22 nt, Human
caguaggggcuuauaauaaagg

SEQ ID NO: 1481237 - RNA, 19 nt, Human
caguaggggcuuauaauaa

SEQ ID NO: 1481238 - RNA, 20 nt, Human
caguagguuauuuagcuugg

SEQ ID NO: 1481239 - RNA, 22 nt, Human
caguagguuauuuagcuuggga

SEQ ID NO: 1481240 - RNA, 16 nt, Human
caguacuuugugcauu

SEQ ID NO: 1481241 - RNA, 18 nt, Human
caguacuuugugcauucu

SEQ ID NO: 1481242 - RNA, 18 nt, Human
caguagcacaaguuauuu

SEQ ID NO: 1481243 - RNA, 21 nt, Human
caguagcacaaguuauuuaaa

SEQ ID NO: 1481244 - RNA, 23 nt, Human
caguagcacaaguuauuuaaauc

SEQ ID NO: 1481245 - RNA, 22 nt, Human
caguaucucuucagucucuaua

SEQ ID NO: 1481246 - RNA, 19 nt, Human
caguaucucuucagucucu

SEQ ID NO: 1481247 - RNA, 13 nt, Human
caguaugaaaaua

SEQ ID NO: 1481248 - RNA, 14 nt, Human
caguaugaaaauaa

SEQ ID NO: 1481249 - RNA, 17 nt, Human
caguaucucuucagucu

SEQ ID NO: 1481250 - RNA, 16 nt, Human
caguaucucuucaguc

SEQ ID NO: 1481251 - RNA, 15 nt, Human
caguaucucuucagu

SEQ ID NO: 1481252 - RNA, 14 nt, Human
caguaucucuucag

SEQ ID NO: 1481253 - RNA, 16 nt, Human
caguauccacuuugca

SEQ ID NO: 1481254 - RNA, 13 nt, Human
cagucccuccaca

SEQ ID NO: 1481255 - RNA, 19 nt, Human
caguccgucaaaacagauu

SEQ ID NO: 1481256 - RNA, 20 nt, Human
cagugaaagaaaauaacaau

SEQ ID NO: 1481257 - RNA, 16 nt, Human
cagugaaagaaaauaa

SEQ ID NO: 1481258 - RNA, 14 nt, Human
cagugaaaaacuau

SEQ ID NO: 1481259 - RNA, 17 nt, Human
cagugaaaaacuauuaa

SEQ ID NO: 1481260 - RNA, 13 nt, Human
cagucuuccugac

SEQ ID NO: 1481261 - RNA, 16 nt, Human
cagucuuccugacacu

SEQ ID NO: 1481262 - RNA, 17 nt, Human
cagucuuccugacacuu

SEQ ID NO: 1481263 - RNA, 18 nt, Human
cagucuuccugacacuuu

SEQ ID NO: 1481264 - RNA, 21 nt, Human
cagucuuccugacacuuuaau

SEQ ID NO: 1481265 - RNA, 17 nt, Human
caguccuggaagccagc

SEQ ID NO: 1481266 - RNA, 22 nt, Human
caguccuggaagccagcuuucc

SEQ ID NO: 1481267 - RNA, 12 nt, Human
cagugagccuga

SEQ ID NO: 1481268 - RNA, 22 nt, Human
cagugagagaguggcuggggca

SEQ ID NO: 1481269 - RNA, 21 nt, Human
cagugagagaguggcuggggc

SEQ ID NO: 1481270 - RNA, 23 nt, Human
cagugagagaguggcuggggcau

SEQ ID NO: 1481271 - RNA, 15 nt, Human
cagugacagcuagga

SEQ ID NO: 1481272 - RNA, 12 nt, Human
cagugacagcua

SEQ ID NO: 1481273 - RNA, 13 nt, Human
cagugaagacaga

SEQ ID NO: 1481274 - RNA, 14 nt, Human
cagugaagacagaa

SEQ ID NO: 1481275 - RNA, 15 nt, Human
cagugaagacagaag

SEQ ID NO: 1481276 - RNA, 16 nt, Human
cagugaagacagaagu

SEQ ID NO: 1481277 - RNA, 20 nt, Human
cagugaauuguguaggagag

SEQ ID NO: 1481278 - RNA, 17 nt, Human
cagugcccucauuuuau

SEQ ID NO: 1481279 - RNA, 19 nt, Human
cagugcccucauuuuaugu

SEQ ID NO: 1481280 - RNA, 22 nt, Human
cagugccuuccuguuuuucaca

SEQ ID NO: 1481281 - RNA, 23 nt, Human
cagugccuuucuucucuccagug

SEQ ID NO: 1481282 - RNA, 12 nt, Human
cagugcggccag

SEQ ID NO: 1481283 - RNA, 15 nt, Human
cagggggcaagagga

SEQ ID NO: 1481284 - RNA, 23 nt, Human
cagggggccccuuugcugacccu

SEQ ID NO: 1481285 - RNA, 11 nt, Human
caggggacagg

SEQ ID NO: 1481286 - RNA, 16 nt, Human
caggggacaggauggu

SEQ ID NO: 1481287 - RNA, 16 nt, Human
caggggccugcccagu

SEQ ID NO: 1481288 - RNA, 23 nt, Human
cagggaccggcggaccccagcca

SEQ ID NO: 1481289 - RNA, 12 nt, Human
cagggacucagg

SEQ ID NO: 1481290 - RNA, 22 nt, Human
cagggacucaucuuucccuccu

SEQ ID NO: 1481291 - RNA, 21 nt, Human
cagggacucaucuuucccucc

SEQ ID NO: 1481292 - RNA, 23 nt, Human
cagggacucaucuuucccuccuu

SEQ ID NO: 1481293 - RNA, 15 nt, Human
cagggcaaggccauu

SEQ ID NO: 1481294 - RNA, 22 nt, Human
cagggacaccugggagaaaucu

SEQ ID NO: 1481295 - RNA, 17 nt, Human
cagggacaccugggaga

SEQ ID NO: 1481296 - RNA, 13 nt, Human
cagggaaggaucc

SEQ ID NO: 1481297 - RNA, 18 nt, Human
cagggaaggaucccauga

SEQ ID NO: 1481298 - RNA, 13 nt, Human
caggcuagaugua

SEQ ID NO: 1481299 - RNA, 19 nt, Human
caggcuagauguauguacu

SEQ ID NO: 1481300 - RNA, 11 nt, Human
caggcucagag

SEQ ID NO: 1481301 - RNA, 15 nt, Human
caggcucagagggug

SEQ ID NO: 1481302 - RNA, 14 nt, Human
caggcucccaggga

SEQ ID NO: 1481303 - RNA, 16 nt, Human
caggcucccagggaca

SEQ ID NO: 1481304 - RNA, 19 nt, Human
caggcucccagggacaccu

SEQ ID NO: 1481305 - RNA, 22 nt, Human
caggcucccagggacaccuggg

SEQ ID NO: 1481306 - RNA, 23 nt, Human
caggcucccagggacaccuggga

SEQ ID NO: 1481307 - RNA, 21 nt, Human
caggcccuuauuuucaagaaa

SEQ ID NO: 1481308 - RNA, 21 nt, Human
caggcugggucgcccuggacu

SEQ ID NO: 1481309 - RNA, 23 nt, Human
caggcugggucgcccuggacugu

SEQ ID NO: 1481310 - RNA, 16 nt, Human
caggcuggagugcagu

SEQ ID NO: 1481311 - RNA, 17 nt, Human
caggcugauuucuaggu

SEQ ID NO: 1481312 - RNA, 16 nt, Human
caggcugauuucuagg

SEQ ID NO: 1481313 - RNA, 23 nt, Human
caggcuuuuuuaucaugugaaau

SEQ ID NO: 1481314 - RNA, 15 nt, Human
caggcuugccugcag

SEQ ID NO: 1481315 - RNA, 16 nt, Human
caggcuugccugcagg

SEQ ID NO: 1481316 - RNA, 17 nt, Human
caggcuugccugcaggc

SEQ ID NO: 1481317 - RNA, 18 nt, Human
caggcuugccugcaggca

SEQ ID NO: 1481318 - RNA, 22 nt, Human
caggcuguguuuggcuuucagg

SEQ ID NO: 1481319 - RNA, 14 nt, Human
caggcaggagcccu

SEQ ID NO: 1481320 - RNA, 18 nt, Human
caggcaggcucccaggga

SEQ ID NO: 1481321 - RNA, 16 nt, Human
caggcaggcucccagg

SEQ ID NO: 1481322 - RNA, 13 nt, Human
caggcagccucug

SEQ ID NO: 1481323 - RNA, 14 nt, Human
caggcagccucugg

SEQ ID NO: 1481324 - RNA, 15 nt, Human
caggcagccucuggg

SEQ ID NO: 1481325 - RNA, 16 nt, Human
caggcagccucugggg

SEQ ID NO: 1481326 - RNA, 19 nt, Human
caggcagccucuggggggu

SEQ ID NO: 1481327 - RNA, 19 nt, Human
caggcagcuuuuucucucc

SEQ ID NO: 1481328 - RNA, 22 nt, Human
caggcagcuuuuucucucccac

SEQ ID NO: 1481329 - RNA, 20 nt, Human
caggcaggaacaaacagggc

SEQ ID NO: 1481330 - RNA, 13 nt, Human
caggcaggaacaa

SEQ ID NO: 1481331 - RNA, 14 nt, Human
caggauuggggaag

SEQ ID NO: 1481332 - RNA, 15 nt, Human
caggauuggggaaga

SEQ ID NO: 1481333 - RNA, 20 nt, Human
caggauuggggaagagagcc

SEQ ID NO: 1481334 - RNA, 24 nt, Human
caggauuggggaagagagccugca

SEQ ID NO: 1481335 - RNA, 14 nt, Human
caggcaaaauccuu

SEQ ID NO: 1481336 - RNA, 18 nt, Human
caggcaaaauccuugcuu

SEQ ID NO: 1481337 - RNA, 22 nt, Human
caggcaacgcacaaaacagaaa

SEQ ID NO: 1481338 - RNA, 20 nt, Human
caggcaucggggagccggga

SEQ ID NO: 1481339 - RNA, 21 nt, Human
caggcaucggggagccgggag

SEQ ID NO: 1481340 - RNA, 20 nt, Human
caggcaggucugaagcucaa

SEQ ID NO: 1481341 - RNA, 13 nt, Human
caggauccaggcc

SEQ ID NO: 1481342 - RNA, 17 nt, Human
caggaucaguuaacuau

SEQ ID NO: 1481343 - RNA, 17 nt, Human
caggaucucaccaggca

SEQ ID NO: 1481344 - RNA, 18 nt, Human
caggaucucaccaggcag

SEQ ID NO: 1481345 - RNA, 22 nt, Human
caggaucucaccaggcagccuc

SEQ ID NO: 1481346 - RNA, 21 nt, Human
caggauauucucacagcucca

SEQ ID NO: 1481347 - RNA, 14 nt, Human
caggauagagacug

SEQ ID NO: 1481348 - RNA, 16 nt, Human
caggauagagacugga

SEQ ID NO: 1481349 - RNA, 15 nt, Human
caggaucaguuaacu

SEQ ID NO: 1481350 - RNA, 20 nt, Human
caggaugaugacuauggaaa

SEQ ID NO: 1481351 - RNA, 18 nt, Human
caggaugaugacuaugga

SEQ ID NO: 1481352 - RNA, 18 nt, Human
caggaugagggaaaagaa

SEQ ID NO: 1481353 - RNA, 22 nt, Human
caggaugagggaaaagaaaaag

SEQ ID NO: 1481354 - RNA, 19 nt, Human
caggaucucaccaggcagc

SEQ ID NO: 1481355 - RNA, 22 nt, Human
caggaugaugacuauggaaaga

SEQ ID NO: 1481356 - RNA, 18 nt, Human
caggauggucuccaucuc

SEQ ID NO: 1481357 - RNA, 23 nt, Human
caggaugggguauggauucuaaa

SEQ ID NO: 1481358 - RNA, 14 nt, Human
caggauggcgcagg

SEQ ID NO: 1481359 - RNA, 21 nt, Human
caggauggcaaccagaccauu

SEQ ID NO: 1481360 - RNA, 23 nt, Human
caggauggcgcaggaacucaaua

SEQ ID NO: 1481361 - RNA, 21 nt, Human
caggaugguucccuugaugaa

SEQ ID NO: 1481362 - RNA, 23 nt, Human
caggaugguucccuugaugaaga

SEQ ID NO: 1481363 - RNA, 15 nt, Human
caggauguguuugcu

SEQ ID NO: 1481364 - RNA, 18 nt, Human
caggauguguuugcuuuc

SEQ ID NO: 1481365 - RNA, 20 nt, Human
caggauguguuugcuuucug

SEQ ID NO: 1481366 - RNA, 17 nt, Human
caggcccccaccuggcu

SEQ ID NO: 1481367 - RNA, 18 nt, Human
caggcccccaccuggcuc

SEQ ID NO: 1481368 - RNA, 19 nt, Human
caggcccccaccuggcuca

SEQ ID NO: 1481369 - RNA, 13 nt, Human
caggcccacagua

SEQ ID NO: 1481370 - RNA, 21 nt, Human
caggagcccugggaggcucug

SEQ ID NO: 1481371 - RNA, 11 nt, Human
caggagccugg

SEQ ID NO: 1481372 - RNA, 12 nt, Human
caggagccuggc

SEQ ID NO: 1481373 - RNA, 15 nt, Human
caggagccugugccu

SEQ ID NO: 1481374 - RNA, 16 nt, Human
caggagccugugccuc

SEQ ID NO: 1481375 - RNA, 19 nt, Human
caggagcccugggaggcuc

SEQ ID NO: 1481376 - RNA, 18 nt, Human
caggagcccugggaggcu

SEQ ID NO: 1481377 - RNA, 16 nt, Human
caggagcccugggagg

SEQ ID NO: 1481378 - RNA, 14 nt, Human
caggagcccuggga

SEQ ID NO: 1481379 - RNA, 11 nt, Human
caggagcccug

SEQ ID NO: 1481380 - RNA, 23 nt, Human
caggagacagguuagcugcuccc

SEQ ID NO: 1481381 - RNA, 19 nt, Human
caggagagaguugaaccua

SEQ ID NO: 1481382 - RNA, 19 nt, Human
caggaguuucguuuucaaa

SEQ ID NO: 1481383 - RNA, 18 nt, Human
caggaguggguggggagu

SEQ ID NO: 1481384 - RNA, 14 nt, Human
caggaguggguggg

SEQ ID NO: 1481385 - RNA, 16 nt, Human
caggagugggugggga

SEQ ID NO: 1481386 - RNA, 17 nt, Human
caggaguggguggggag

SEQ ID NO: 1481387 - RNA, 19 nt, Human
caggauagagacuggaaca

SEQ ID NO: 1481388 - RNA, 20 nt, Human
caggauacuggcacagaggu

SEQ ID NO: 1481389 - RNA, 19 nt, Human
caggauacuggcacagagg

SEQ ID NO: 1481390 - RNA, 18 nt, Human
caggauacuggcacagag

SEQ ID NO: 1481391 - RNA, 17 nt, Human
caggauacuggcacaga

SEQ ID NO: 1481392 - RNA, 15 nt, Human
caggauacuggcaca

SEQ ID NO: 1481393 - RNA, 18 nt, Human
caggaagaucccccagaa

SEQ ID NO: 1481394 - RNA, 17 nt, Human
caggaagaucccccaga

SEQ ID NO: 1481395 - RNA, 17 nt, Human
caggaagagaaggagca

SEQ ID NO: 1481396 - RNA, 15 nt, Human
caggaagagaaggag

SEQ ID NO: 1481397 - RNA, 14 nt, Human
caggaagagaagga

SEQ ID NO: 1481398 - RNA, 19 nt, Human
caggaagaucccccagaaa

SEQ ID NO: 1481399 - RNA, 15 nt, Human
caggaaccgaggcag

SEQ ID NO: 1481400 - RNA, 17 nt, Human
caggaaccgaggcaggg

SEQ ID NO: 1481401 - RNA, 18 nt, Human
caggaaccgaggcaggga

SEQ ID NO: 1481402 - RNA, 12 nt, Human
caggaacugggc

SEQ ID NO: 1481403 - RNA, 13 nt, Human
caggaacugggcc

SEQ ID NO: 1481404 - RNA, 21 nt, Human
caggaagcuuuggugagaacc

SEQ ID NO: 1481405 - RNA, 23 nt, Human
caggaagcuuuggugagaaccug

SEQ ID NO: 1481406 - RNA, 22 nt, Human
caggaagcuuuggugagaaccu

SEQ ID NO: 1481407 - RNA, 16 nt, Human
caggaaggacuaugaa

SEQ ID NO: 1481408 - RNA, 19 nt, Human
caggaaggacuaugaaaag

SEQ ID NO: 1481409 - RNA, 14 nt, Human
caggaaucuuaagg

SEQ ID NO: 1481410 - RNA, 15 nt, Human
caggaaucuuaaggu

SEQ ID NO: 1481411 - RNA, 13 nt, Human
caggaaggcuugu

SEQ ID NO: 1481412 - RNA, 22 nt, Human
caggaaggcuuguugugcuuuu

SEQ ID NO: 1481413 - RNA, 19 nt, Human
cagcuguaugauucccagc

SEQ ID NO: 1481414 - RNA, 20 nt, Human
cagcuucguuuauuuucaag

SEQ ID NO: 1481415 - RNA, 22 nt, Human
cagcuucguuuauuuucaagaa

SEQ ID NO: 1481416 - RNA, 18 nt, Human
cagcuucucauccugcag

SEQ ID NO: 1481417 - RNA, 19 nt, Human
cagcuucucauccugcagg

SEQ ID NO: 1481418 - RNA, 20 nt, Human
cagcuucucauccugcaggc

SEQ ID NO: 1481419 - RNA, 21 nt, Human
cagcuucucauccugcaggca

SEQ ID NO: 1481420 - RNA, 20 nt, Human
cagcuuuucccaaaagccca

SEQ ID NO: 1481421 - RNA, 18 nt, Human
cagcuuuucccaaaagcc

SEQ ID NO: 1481422 - RNA, 17 nt, Human
cagcuuuuuaccaaguu

SEQ ID NO: 1481423 - RNA, 18 nt, Human
caggaaccacaagacugc

SEQ ID NO: 1481424 - RNA, 22 nt, Human
cagcuuugcuaccaaagcaccu

SEQ ID NO: 1481425 - RNA, 11 nt, Human
cagcuuugcua

SEQ ID NO: 1481426 - RNA, 14 nt, Human
cagcuuuagccaag

SEQ ID NO: 1481427 - RNA, 18 nt, Human
cagcuuguggcaagugaa

SEQ ID NO: 1481428 - RNA, 20 nt, Human
cagcuuguggcaagugaauu

SEQ ID NO: 1481429 - RNA, 21 nt, Human
cagcuuguggcaagugaauuu

SEQ ID NO: 1481430 - RNA, 21 nt, Human
cagcuuuauggagauauaauu

SEQ ID NO: 1481431 - RNA, 17 nt, Human
cagcuuucccugccucu

SEQ ID NO: 1481432 - RNA, 19 nt, Human
cagcuuucccugccucuca

SEQ ID NO: 1481433 - RNA, 18 nt, Human
cagcucucaguugcagcc

SEQ ID NO: 1481434 - RNA, 15 nt, Human
cagcucuacuggucu

SEQ ID NO: 1481435 - RNA, 20 nt, Human
cagcucuagacacugccaca

SEQ ID NO: 1481436 - RNA, 12 nt, Human
cagcucugaaag

SEQ ID NO: 1481437 - RNA, 16 nt, Human
cagcucugaaagagaa

SEQ ID NO: 1481438 - RNA, 14 nt, Human
cagcucugacauuc

SEQ ID NO: 1481439 - RNA, 20 nt, Human
cagcucugacauucugauuc

SEQ ID NO: 1481440 - RNA, 21 nt, Human
cagcucugacauucugauucg

SEQ ID NO: 1481441 - RNA, 22 nt, Human
cagcuggggccaggcugggucg

SEQ ID NO: 1481442 - RNA, 21 nt, Human
cagcuggggccaggcuggguc

SEQ ID NO: 1481443 - RNA, 18 nt, Human
cagcuguaugauucccag

SEQ ID NO: 1481444 - RNA, 20 nt, Human
cagcuggggccaggcugggu

SEQ ID NO: 1481445 - RNA, 19 nt, Human
cagcuggggccaggcuggg

SEQ ID NO: 1481446 - RNA, 18 nt, Human
cagcuggggccaggcugg

SEQ ID NO: 1481447 - RNA, 16 nt, Human
cagcuggagaagaccc

SEQ ID NO: 1481448 - RNA, 16 nt, Human
cagccuucuacugcuc

SEQ ID NO: 1481449 - RNA, 23 nt, Human
cagccucuccacucaugugacuc

SEQ ID NO: 1481450 - RNA, 23 nt, Human
cagccuggcuguggccuaaccug

SEQ ID NO: 1481451 - RNA, 15 nt, Human
cagcucacugcaacc

SEQ ID NO: 1481452 - RNA, 21 nt, Human
cagcucagaaguuucuucuuu

SEQ ID NO: 1481453 - RNA, 22 nt, Human
cagcucagaaguuucuucuuua

SEQ ID NO: 1481454 - RNA, 13 nt, Human
cagcucacugcaa

SEQ ID NO: 1481455 - RNA, 22 nt, Human
cagcucaagagaucccaaguag

SEQ ID NO: 1481456 - RNA, 15 nt, Human
cagcucaagagaucc

SEQ ID NO: 1481457 - RNA, 21 nt, Human
cagcgagauaccccaccuccc

SEQ ID NO: 1481458 - RNA, 15 nt, Human
cagcuaagcuaggaa

SEQ ID NO: 1481459 - RNA, 18 nt, Human
cagcuaagcuaggaauga

SEQ ID NO: 1481460 - RNA, 16 nt, Human
cagccuaguugaucag

SEQ ID NO: 1481461 - RNA, 12 nt, Human
cagccuccagag

SEQ ID NO: 1481462 - RNA, 23 nt, Human
cagccucccccuguccccucuau

SEQ ID NO: 1481463 - RNA, 21 nt, Human
cagccuccauccuacccccug

SEQ ID NO: 1481464 - RNA, 18 nt, Human
cagccuccauccuacccc

SEQ ID NO: 1481465 - RNA, 20 nt, Human
cagcccugcugcugccugcc

SEQ ID NO: 1481466 - RNA, 13 nt, Human
cagcccugcacca

SEQ ID NO: 1481467 - RNA, 15 nt, Human
cagcccugcaccaug

SEQ ID NO: 1481468 - RNA, 17 nt, Human
cagcccugcaccaugcu

SEQ ID NO: 1481469 - RNA, 23 nt, Human
cagcccugcaccaugcugcuggg

SEQ ID NO: 1481470 - RNA, 14 nt, Human
cagccuacaggccu

SEQ ID NO: 1481471 - RNA, 16 nt, Human
cagccuacaggccuca

SEQ ID NO: 1481472 - RNA, 17 nt, Human
cagccgugagcauguuu

SEQ ID NO: 1481473 - RNA, 14 nt, Human
cagccgugagcaug

SEQ ID NO: 1481474 - RNA, 16 nt, Human
cagcccuaaacaucau

SEQ ID NO: 1481475 - RNA, 14 nt, Human
cagcccuaaacauc

SEQ ID NO: 1481476 - RNA, 18 nt, Human
cagccaacuauggccugu

SEQ ID NO: 1481477 - RNA, 15 nt, Human
cagcauuucccuucc

SEQ ID NO: 1481478 - RNA, 18 nt, Human
cagcaugucuauucagcu

SEQ ID NO: 1481479 - RNA, 21 nt, Human
cagcagggacuguaaacacag

SEQ ID NO: 1481480 - RNA, 22 nt, Human
cagcagggacuguaaacacaga

SEQ ID NO: 1481481 - RNA, 14 nt, Human
cagcaggcuggccu

SEQ ID NO: 1481482 - RNA, 23 nt, Human
cagccauccagggggcaagagga

SEQ ID NO: 1481483 - RNA, 21 nt, Human
cagccaucaccuuagaccacc

SEQ ID NO: 1481484 - RNA, 18 nt, Human
cagccaucaagagacuga

SEQ ID NO: 1481485 - RNA, 21 nt, Human
cagccaucaagagacugaguc

SEQ ID NO: 1481486 - RNA, 19 nt, Human
cagccaucaccuuagacca

SEQ ID NO: 1481487 - RNA, 22 nt, Human
cagcccaggauacuggcacaga

SEQ ID NO: 1481488 - RNA, 20 nt, Human
cagcccaggauacuggcaca

SEQ ID NO: 1481489 - RNA, 21 nt, Human
cagccacggggacucagcccu

SEQ ID NO: 1481490 - RNA, 22 nt, Human
cagccaagucgguuaguggaag

SEQ ID NO: 1481491 - RNA, 22 nt, Human
cagcacuuuagaauaugccuug

SEQ ID NO: 1481492 - RNA, 14 nt, Human
cagcacuuuagaau

SEQ ID NO: 1481493 - RNA, 15 nt, Human
cagcagacucagcuc

SEQ ID NO: 1481494 - RNA, 17 nt, Human
cagcagacucagcucug

SEQ ID NO: 1481495 - RNA, 18 nt, Human
cagcagacucagcucuga

SEQ ID NO: 1481496 - RNA, 21 nt, Human
cagcagacucagcucugacau

SEQ ID NO: 1481497 - RNA, 23 nt, Human
cagcagacucagcucugacauuc

SEQ ID NO: 1481498 - RNA, 16 nt, Human
cagcaauuuaaauguu

SEQ ID NO: 1481499 - RNA, 15 nt, Human
cagcaauuuaaaugu

SEQ ID NO: 1481500 - RNA, 14 nt, Human
cagcaauuuaaaug

SEQ ID NO: 1481501 - RNA, 22 nt, Human
cagcaauuacaacggagucaaa

SEQ ID NO: 1481502 - RNA, 15 nt, Human
cagcaauagagacgg

SEQ ID NO: 1481503 - RNA, 17 nt, Human
cagcaauagagacggga

SEQ ID NO: 1481504 - RNA, 23 nt, Human
cagcaaguuagaacuagccaaac

SEQ ID NO: 1481505 - RNA, 20 nt, Human
cagcaacaauaaauagacac

SEQ ID NO: 1481506 - RNA, 19 nt, Human
cagcaacaauaaauagaca

SEQ ID NO: 1481507 - RNA, 14 nt, Human
cagcaacaauaaau

SEQ ID NO: 1481508 - RNA, 20 nt, Human
cagcaaacucuuuucccacu

SEQ ID NO: 1481509 - RNA, 16 nt, Human
cagauuuuuacacaug

SEQ ID NO: 1481510 - RNA, 14 nt, Human
cagauuuuccugaa

SEQ ID NO: 1481511 - RNA, 15 nt, Human
cagauuuuccugaaa

SEQ ID NO: 1481512 - RNA, 19 nt, Human
cagauuuucagcaaacucu

SEQ ID NO: 1481513 - RNA, 22 nt, Human
cagauuuucagcaaacucuuuu

SEQ ID NO: 1481514 - RNA, 13 nt, Human
cagauuuucagca

SEQ ID NO: 1481515 - RNA, 15 nt, Human
cagauuuucagcaaa

SEQ ID NO: 1481516 - RNA, 18 nt, Human
cagauucccagagcaaaa

SEQ ID NO: 1481517 - RNA, 19 nt, Human
cagauucccagagcaaaau

SEQ ID NO: 1481518 - RNA, 21 nt, Human
cagauucccagagcaaaauaa

SEQ ID NO: 1481519 - RNA, 14 nt, Human
cagauucccagagc

SEQ ID NO: 1481520 - RNA, 17 nt, Human
cagauucccagagcaaa

SEQ ID NO: 1481521 - RNA, 14 nt, Human
cagaugugaaccau

SEQ ID NO: 1481522 - RNA, 17 nt, Human
cagaugugaaccauuaa

SEQ ID NO: 1481523 - RNA, 22 nt, Human
cagauggcauguguuuacuuua

SEQ ID NO: 1481524 - RNA, 16 nt, Human
cagauggcauguguuu

SEQ ID NO: 1481525 - RNA, 13 nt, Human
cagagccaggaag

SEQ ID NO: 1481526 - RNA, 13 nt, Human
cagagccacaguu

SEQ ID NO: 1481527 - RNA, 12 nt, Human
cagagccacagu

SEQ ID NO: 1481528 - RNA, 20 nt, Human
cagagccaaggggcuucagg

SEQ ID NO: 1481529 - RNA, 21 nt, Human
cagagccaaggggcuucaggu

SEQ ID NO: 1481530 - RNA, 23 nt, Human
cagagccaggaagaucccccaga

SEQ ID NO: 1481531 - RNA, 21 nt, Human
cagagccaggaagauccccca

SEQ ID NO: 1481532 - RNA, 17 nt, Human
cagagccaggaagaucc

SEQ ID NO: 1481533 - RNA, 15 nt, Human
cagagccaggaagau

SEQ ID NO: 1481534 - RNA, 14 nt, Human
cagagccaggaaga

SEQ ID NO: 1481535 - RNA, 15 nt, Human
cagagcacugcucca

SEQ ID NO: 1481536 - RNA, 13 nt, Human
cagagcacugcuc

SEQ ID NO: 1481537 - RNA, 20 nt, Human
cagagccuccuuucuggcuu

SEQ ID NO: 1481538 - RNA, 19 nt, Human
cagagaagaaagaacggaa

SEQ ID NO: 1481539 - RNA, 18 nt, Human
cagagaagaaagaacgga

SEQ ID NO: 1481540 - RNA, 14 nt, Human
cagagaagaaagaa

SEQ ID NO: 1481541 - RNA, 13 nt, Human
cagagaagaaaga

SEQ ID NO: 1481542 - RNA, 13 nt, Human
cagagaauuucua

SEQ ID NO: 1481543 - RNA, 15 nt, Human
cagagaauuucuacc

SEQ ID NO: 1481544 - RNA, 16 nt, Human
cagagaauuucuacca

SEQ ID NO: 1481545 - RNA, 22 nt, Human
cagagaauuucuaccauuucag

SEQ ID NO: 1481546 - RNA, 23 nt, Human
cagagaauuucuaccauuucaga

SEQ ID NO: 1481547 - RNA, 23 nt, Human
cagagacaacagguaaaacaggg

SEQ ID NO: 1481548 - RNA, 14 nt, Human
cagagacaacaggu

SEQ ID NO: 1481549 - RNA, 22 nt, Human
cagagacaacagguaaaacagg

SEQ ID NO: 1481550 - RNA, 17 nt, Human
cagagcaagaccccauc

SEQ ID NO: 1481551 - RNA, 14 nt, Human
cagagcaaaauaau

SEQ ID NO: 1481552 - RNA, 16 nt, Human
cagagcaaaauaauuu

SEQ ID NO: 1481553 - RNA, 16 nt, Human
cagagauaaagaccuu

SEQ ID NO: 1481554 - RNA, 23 nt, Human
cagagagugagagacauuaacuc

SEQ ID NO: 1481555 - RNA, 17 nt, Human
cagagaccuuccagaaa

SEQ ID NO: 1481556 - RNA, 23 nt, Human
cagaggcgcaugaauuugugaag

SEQ ID NO: 1481557 - RNA, 20 nt, Human
cagaggcuauuauuuucacu

SEQ ID NO: 1481558 - RNA, 20 nt, Human
cagagucuggugaagcucac

SEQ ID NO: 1481559 - RNA, 18 nt, Human
cagagucccugccuggac

SEQ ID NO: 1481560 - RNA, 14 nt, Human
cagagucccugccu

SEQ ID NO: 1481561 - RNA, 14 nt, Human
cagauaaucacaau

SEQ ID NO: 1481562 - RNA, 15 nt, Human
cagauaaucccugua

SEQ ID NO: 1481563 - RNA, 22 nt, Human
cagauaacugaaaauuauuuaa

SEQ ID NO: 1481564 - RNA, 19 nt, Human
cagauaacugaaaauuauu

SEQ ID NO: 1481565 - RNA, 20 nt, Human
cagauaagguaaaaugccau

SEQ ID NO: 1481566 - RNA, 22 nt, Human
cagauaagguaaaaugccauga

SEQ ID NO: 1481567 - RNA, 22 nt, Human
cagauaaagguucaugcaaacu

SEQ ID NO: 1481568 - RNA, 20 nt, Human
cagaguugcugcaaaccuga

SEQ ID NO: 1481569 - RNA, 14 nt, Human
cagauccuggaaau

SEQ ID NO: 1481570 - RNA, 21 nt, Human
cagaucuagucaaucaagucu

SEQ ID NO: 1481571 - RNA, 16 nt, Human
cagaugcagcucaaga

SEQ ID NO: 1481572 - RNA, 16 nt, Human
cagaugaggcuuucca

SEQ ID NO: 1481573 - RNA, 21 nt, Human
cagaccauggacacuacaccc

SEQ ID NO: 1481574 - RNA, 22 nt, Human
cagaccauggacacuacaccca

SEQ ID NO: 1481575 - RNA, 17 nt, Human
cagaccauugucucaga

SEQ ID NO: 1481576 - RNA, 14 nt, Human
cagaccauggacac

SEQ ID NO: 1481577 - RNA, 19 nt, Human
cagaccagcaggcuggccu

SEQ ID NO: 1481578 - RNA, 13 nt, Human
cagacauuuuaaa

SEQ ID NO: 1481579 - RNA, 12 nt, Human
cagagaaaaagg

SEQ ID NO: 1481580 - RNA, 17 nt, Human
cagagaaaaagggaggg

SEQ ID NO: 1481581 - RNA, 18 nt, Human
cagagaaaaagggagggg

SEQ ID NO: 1481582 - RNA, 12 nt, Human
cagacuucccac

SEQ ID NO: 1481583 - RNA, 22 nt, Human
cagacuucccacggcuccucga

SEQ ID NO: 1481584 - RNA, 14 nt, Human
cagacucagcucug

SEQ ID NO: 1481585 - RNA, 15 nt, Human
cagacucagcucuga

SEQ ID NO: 1481586 - RNA, 15 nt, Human
cagaccuuuuuuagg

SEQ ID NO: 1481587 - RNA, 21 nt, Human
cagaaugagacauccagcaga

SEQ ID NO: 1481588 - RNA, 14 nt, Human
cagaauguauauua

SEQ ID NO: 1481589 - RNA, 21 nt, Human
cagaaugugauaaggaaauca

SEQ ID NO: 1481590 - RNA, 21 nt, Human
cagaaugucauuuugguacuu

SEQ ID NO: 1481591 - RNA, 16 nt, Human
cagaauguugauuaca

SEQ ID NO: 1481592 - RNA, 22 nt, Human
cagaauguugauuacagugcag

SEQ ID NO: 1481593 - RNA, 23 nt, Human
cagaauuacuguaacugauuaca

SEQ ID NO: 1481594 - RNA, 14 nt, Human
cagaauuacuguaa

SEQ ID NO: 1481595 - RNA, 22 nt, Human
cagaauuacuguaacugauuac

SEQ ID NO: 1481596 - RNA, 22 nt, Human
cagacacugguuugaagaaugu

SEQ ID NO: 1481597 - RNA, 23 nt, Human
cagaaacacccucacacugggac

SEQ ID NO: 1481598 - RNA, 22 nt, Human
cagaaacacccucacacuggga

SEQ ID NO: 1481599 - RNA, 21 nt, Human
cagaaacacccucacacuggg

SEQ ID NO: 1481600 - RNA, 20 nt, Human
cagaaacacccucacacugg

SEQ ID NO: 1481601 - RNA, 18 nt, Human
cagaaacacccucacacu

SEQ ID NO: 1481602 - RNA, 22 nt, Human
cagaaagcaucccucacccauc

SEQ ID NO: 1481603 - RNA, 23 nt, Human
cagaaagcaguugagacaagaaa

SEQ ID NO: 1481604 - RNA, 22 nt, Human
cagaaagcaguugagacaagaa

SEQ ID NO: 1481605 - RNA, 14 nt, Human
cagaaagcugccug

SEQ ID NO: 1481606 - RNA, 15 nt, Human
cagaaagcugccugg

SEQ ID NO: 1481607 - RNA, 16 nt, Human
cagaacauagacagaa

SEQ ID NO: 1481608 - RNA, 21 nt, Human
cagaacauagacagaagaaac

SEQ ID NO: 1481609 - RNA, 19 nt, Human
cagaacauagacagaagaa

SEQ ID NO: 1481610 - RNA, 23 nt, Human
cagaaaagaaagcuacagaagaa

SEQ ID NO: 1481611 - RNA, 17 nt, Human
cagaaaaguugaauuuu

SEQ ID NO: 1481612 - RNA, 20 nt, Human
cagaaaaguugaauuuuaca

SEQ ID NO: 1481613 - RNA, 22 nt, Human
cagaaaaguugaauuuuacaug

SEQ ID NO: 1481614 - RNA, 19 nt, Human
cagaaaauaucccuccugu

SEQ ID NO: 1481615 - RNA, 18 nt, Human
cagaaacaaaaacacuaa

SEQ ID NO: 1481616 - RNA, 20 nt, Human
cagaaacaaaaacacuaaaa

SEQ ID NO: 1481617 - RNA, 12 nt, Human
cacuuugcauaa

SEQ ID NO: 1481618 - RNA, 17 nt, Human
cacuuugcacagcucuc

SEQ ID NO: 1481619 - RNA, 14 nt, Human
cacuuugcacagcu

SEQ ID NO: 1481620 - RNA, 19 nt, Human
cacuugguaauuguacuaa

SEQ ID NO: 1481621 - RNA, 15 nt, Human
cacuugguaauugua

SEQ ID NO: 1481622 - RNA, 19 nt, Human
cacuuucucaguuuucaua

SEQ ID NO: 1481623 - RNA, 15 nt, Human
cacuuuuugcagcuu

SEQ ID NO: 1481624 - RNA, 18 nt, Human
cacuuuuugcagcuuucu

SEQ ID NO: 1481625 - RNA, 14 nt, Human
cacuuuuugcagcu

SEQ ID NO: 1481626 - RNA, 18 nt, Human
cagaaaaauauguaccaa

SEQ ID NO: 1481627 - RNA, 22 nt, Human
cagaaaaauauguaccaagaau

SEQ ID NO: 1481628 - RNA, 13 nt, Human
cagaaaacaaaac

SEQ ID NO: 1481629 - RNA, 14 nt, Human
cagaaaacaaaacu

SEQ ID NO: 1481630 - RNA, 16 nt, Human
cacuuuuccucccuca

SEQ ID NO: 1481631 - RNA, 17 nt, Human
cacuuuuaaugaacaaa

SEQ ID NO: 1481632 - RNA, 13 nt, Human
cagaacuacuucu

SEQ ID NO: 1481633 - RNA, 23 nt, Human
cagaaccccuacaugaaacagaa

SEQ ID NO: 1481634 - RNA, 21 nt, Human
cagaacuugacccugagcuga

SEQ ID NO: 1481635 - RNA, 14 nt, Human
cagaagaaacaagg

SEQ ID NO: 1481636 - RNA, 22 nt, Human
cagaaggaaggcagggaggagg

SEQ ID NO: 1481637 - RNA, 20 nt, Human
cagaaggaaggcagggagga

SEQ ID NO: 1481638 - RNA, 15 nt, Human
cagaaggaaggcagg

SEQ ID NO: 1481639 - RNA, 11 nt, Human
cagaaggaagg

SEQ ID NO: 1481640 - RNA, 23 nt, Human
cagaagguugcucuagauugaga

SEQ ID NO: 1481641 - RNA, 15 nt, Human
cagaaaacaaaacug

SEQ ID NO: 1481642 - RNA, 16 nt, Human
cacucguguguuucua

SEQ ID NO: 1481643 - RNA, 15 nt, Human
cacucguguguuucu

SEQ ID NO: 1481644 - RNA, 16 nt, Human
cacucugaguguuuua

SEQ ID NO: 1481645 - RNA, 22 nt, Human
cacucaugugacucuuuccaac

SEQ ID NO: 1481646 - RNA, 16 nt, Human
cacucaugugacucuu

SEQ ID NO: 1481647 - RNA, 19 nt, Human
cacucaugcauuguccucu

SEQ ID NO: 1481648 - RNA, 18 nt, Human
cacucaugcauuguccuc

SEQ ID NO: 1481649 - RNA, 17 nt, Human
cacucaugcauuguccu

SEQ ID NO: 1481650 - RNA, 17 nt, Human
cacuaagagagaaugag

SEQ ID NO: 1481651 - RNA, 16 nt, Human
cacuaacaugauuugg

SEQ ID NO: 1481652 - RNA, 19 nt, Human
cacuaguauuucuaugaaa

SEQ ID NO: 1481653 - RNA, 14 nt, Human
cacuaucuuucagc

SEQ ID NO: 1481654 - RNA, 21 nt, Human
cacucaaggcggugcuugaua

SEQ ID NO: 1481655 - RNA, 11 nt, Human
cacucaaggcg

SEQ ID NO: 1481656 - RNA, 17 nt, Human
cacucaaggcggugcuu

SEQ ID NO: 1481657 - RNA, 19 nt, Human
cacucaaggcggugcuuga

SEQ ID NO: 1481658 - RNA, 17 nt, Human
cacucacaacagcugcc

SEQ ID NO: 1481659 - RNA, 18 nt, Human
cacucagauccuccucau

SEQ ID NO: 1481660 - RNA, 13 nt, Human
cacuaaacaaaga

SEQ ID NO: 1481661 - RNA, 18 nt, Human
cacgugguaaaacacuug

SEQ ID NO: 1481662 - RNA, 14 nt, Human
cacgugacacaaac

SEQ ID NO: 1481663 - RNA, 17 nt, Human
cacgugacacaaacaca

SEQ ID NO: 1481664 - RNA, 20 nt, Human
cacggcuccucgagauccca

SEQ ID NO: 1481665 - RNA, 22 nt, Human
cacggcuccucgagaucccaac

SEQ ID NO: 1481666 - RNA, 19 nt, Human
cacgcucucuccaggcagg

SEQ ID NO: 1481667 - RNA, 23 nt, Human
cacgcucucuccaggcaggucug

SEQ ID NO: 1481668 - RNA, 16 nt, Human
cacgccuggcuaauuu

SEQ ID NO: 1481669 - RNA, 13 nt, Human
cacgcacggcagc

SEQ ID NO: 1481670 - RNA, 11 nt, Human
cacgccacagc

SEQ ID NO: 1481671 - RNA, 13 nt, Human
cacgccacagccc

SEQ ID NO: 1481672 - RNA, 12 nt, Human
cacgccacagcc

SEQ ID NO: 1481673 - RNA, 14 nt, Human
cacgccacagcccu

SEQ ID NO: 1481674 - RNA, 22 nt, Human
caccuguggaacauaaaaagga

SEQ ID NO: 1481675 - RNA, 22 nt, Human
caccugucugucugucuguccc

SEQ ID NO: 1481676 - RNA, 16 nt, Human
caccugucugucuguc

SEQ ID NO: 1481677 - RNA, 13 nt, Human
caccuuagcuggc

SEQ ID NO: 1481678 - RNA, 21 nt, Human
caccuuagaccaccaagccuu

SEQ ID NO: 1481679 - RNA, 20 nt, Human
caccuuagaccaccaagccu

SEQ ID NO: 1481680 - RNA, 19 nt, Human
caccuuagaccaccaagcc

SEQ ID NO: 1481681 - RNA, 18 nt, Human
caccuuagaccaccaagc

SEQ ID NO: 1481682 - RNA, 14 nt, Human
caccuuagaccacc

SEQ ID NO: 1481683 - RNA, 23 nt, Human
caccuuagaccaccaagccuuga

SEQ ID NO: 1481684 - RNA, 14 nt, Human
cacugcaaccucug

SEQ ID NO: 1481685 - RNA, 19 nt, Human
cacugcaaccuccaccucg

SEQ ID NO: 1481686 - RNA, 17 nt, Human
cacugcaaccuccaccu

SEQ ID NO: 1481687 - RNA, 14 nt, Human
cacugcaaccucca

SEQ ID NO: 1481688 - RNA, 14 nt, Human
cacugcaaccuccg

SEQ ID NO: 1481689 - RNA, 19 nt, Human
cacugauguuguguuuuua

SEQ ID NO: 1481690 - RNA, 13 nt, Human
cacugcaaccucc

SEQ ID NO: 1481691 - RNA, 21 nt, Human
cacugcaaaccgccaccuccc

SEQ ID NO: 1481692 - RNA, 20 nt, Human
cacugcaaaccgccaccucc

SEQ ID NO: 1481693 - RNA, 19 nt, Human
cacugcaaccuccaccucc

SEQ ID NO: 1481694 - RNA, 20 nt, Human
cacugcaaucuccaccuccc

SEQ ID NO: 1481695 - RNA, 15 nt, Human
cacugagaccaaggc

SEQ ID NO: 1481696 - RNA, 17 nt, Human
cacugagaccaaggcuu

SEQ ID NO: 1481697 - RNA, 15 nt, Human
cacugaguuuuccau

SEQ ID NO: 1481698 - RNA, 21 nt, Human
cacugaguuuuccauggcagg

SEQ ID NO: 1481699 - RNA, 22 nt, Human
cacugaguuuuccauggcagga

SEQ ID NO: 1481700 - RNA, 14 nt, Human
cacucuguaauuga

SEQ ID NO: 1481701 - RNA, 23 nt, Human
cacucuguaauugaauauuauuc

SEQ ID NO: 1481702 - RNA, 20 nt, Human
cacugccuucucaacuccaa

SEQ ID NO: 1481703 - RNA, 12 nt, Human
cacugccuuuga

SEQ ID NO: 1481704 - RNA, 20 nt, Human
cacugcugauauuuucucua

SEQ ID NO: 1481705 - RNA, 13 nt, Human
cacugcucacacu

SEQ ID NO: 1481706 - RNA, 17 nt, Human
cacugcuugaacuaggc

SEQ ID NO: 1481707 - RNA, 20 nt, Human
cacugcuugaacuaggcuga

SEQ ID NO: 1481708 - RNA, 16 nt, Human
cacuggaccacugggc

SEQ ID NO: 1481709 - RNA, 19 nt, Human
cacuguacuugcucuugau

SEQ ID NO: 1481710 - RNA, 18 nt, Human
cacuguagaaugauuuca

SEQ ID NO: 1481711 - RNA, 18 nt, Human
cacuguacuugcucuuga

SEQ ID NO: 1481712 - RNA, 15 nt, Human
cacuguacuugcucu

SEQ ID NO: 1481713 - RNA, 15 nt, Human
cacuguaugagugga

SEQ ID NO: 1481714 - RNA, 13 nt, Human
cacuggcgaggag

SEQ ID NO: 1481715 - RNA, 16 nt, Human
cacuggccccacccuc

SEQ ID NO: 1481716 - RNA, 14 nt, Human
cacuggccccaccc

SEQ ID NO: 1481717 - RNA, 13 nt, Human
cacuggccccacc

SEQ ID NO: 1481718 - RNA, 12 nt, Human
cacuguaaaaug

SEQ ID NO: 1481719 - RNA, 13 nt, Human
cacuguaaaaugu

SEQ ID NO: 1481720 - RNA, 22 nt, Human
cacugucagcagggacuguaaa

SEQ ID NO: 1481721 - RNA, 22 nt, Human
cacuguggguagacacacauga

SEQ ID NO: 1481722 - RNA, 24 nt, Human
cacuguggguagacacacaugaag

SEQ ID NO: 1481723 - RNA, 19 nt, Human
cacuguggguagacacaca

SEQ ID NO: 1481724 - RNA, 18 nt, Human
cacuucagguauaccuca

SEQ ID NO: 1481725 - RNA, 19 nt, Human
cacuucagguauaccucac

SEQ ID NO: 1481726 - RNA, 20 nt, Human
cacuucagguauaccucacu

SEQ ID NO: 1481727 - RNA, 14 nt, Human
cacuucauaaucca

SEQ ID NO: 1481728 - RNA, 15 nt, Human
cacuucauaauccag

SEQ ID NO: 1481729 - RNA, 22 nt, Human
cacuuauuggaacucugcuuga

SEQ ID NO: 1481730 - RNA, 20 nt, Human
cacuuauuuaugaaccugcc

SEQ ID NO: 1481731 - RNA, 18 nt, Human
cacuucugggcuucaucu

SEQ ID NO: 1481732 - RNA, 12 nt, Human
cacuugcaaccu

SEQ ID NO: 1481733 - RNA, 20 nt, Human
cacuucugggcuucaucugg

SEQ ID NO: 1481734 - RNA, 19 nt, Human
cacuucuuacaauaauucu

SEQ ID NO: 1481735 - RNA, 22 nt, Human
cacuugcggauauucuggacug

SEQ ID NO: 1481736 - RNA, 16 nt, Human
cacuugcuggaagacg

SEQ ID NO: 1481737 - RNA, 23 nt, Human
cacuuggcugcauaaauguggua

SEQ ID NO: 1481738 - RNA, 13 nt, Human
caccucucaauau

SEQ ID NO: 1481739 - RNA, 15 nt, Human
caccgcagaaggaag

SEQ ID NO: 1481740 - RNA, 14 nt, Human
caccgcagaaggaa

SEQ ID NO: 1481741 - RNA, 14 nt, Human
caccggggccuggg

SEQ ID NO: 1481742 - RNA, 21 nt, Human
caccggggccugggcaggagg

SEQ ID NO: 1481743 - RNA, 22 nt, Human
caccggggccugggcaggaggg

SEQ ID NO: 1481744 - RNA, 24 nt, Human
caccgugcccagcccuaaacauca

SEQ ID NO: 1481745 - RNA, 19 nt, Human
caccucccucaaccucauc

SEQ ID NO: 1481746 - RNA, 17 nt, Human
caccucccucaaccuca

SEQ ID NO: 1481747 - RNA, 15 nt, Human
caccucccucaaccu

SEQ ID NO: 1481748 - RNA, 21 nt, Human
caccucccuauacugcuugga

SEQ ID NO: 1481749 - RNA, 20 nt, Human
caccucccuauacugcuugg

SEQ ID NO: 1481750 - RNA, 11 nt, Human
caccucaugga

SEQ ID NO: 1481751 - RNA, 12 nt, Human
caccucauggaa

SEQ ID NO: 1481752 - RNA, 14 nt, Human
caccucauggaauu

SEQ ID NO: 1481753 - RNA, 10 nt, Human
caccucccag

SEQ ID NO: 1481754 - RNA, 11 nt, Human
caccucccagg

SEQ ID NO: 1481755 - RNA, 12 nt, Human
caccucccagga

SEQ ID NO: 1481756 - RNA, 23 nt, Human
caccucucaauauucaauaaagc

SEQ ID NO: 1481757 - RNA, 22 nt, Human
caccucucaauauucaauaaag

SEQ ID NO: 1481758 - RNA, 21 nt, Human
caccucucaauauucaauaaa

SEQ ID NO: 1481759 - RNA, 19 nt, Human
caccucgcagguucaagca

SEQ ID NO: 1481760 - RNA, 20 nt, Human
caccuccuggguucaagcga

SEQ ID NO: 1481761 - RNA, 22 nt, Human
caccuccuggguucaagcgauu

SEQ ID NO: 1481762 - RNA, 21 nt, Human
caccucccucaaccucauccu

SEQ ID NO: 1481763 - RNA, 15 nt, Human
caccuccugccucag

SEQ ID NO: 1481764 - RNA, 13 nt, Human
caccuccugccuc

SEQ ID NO: 1481765 - RNA, 14 nt, Human
caccugucugucug

SEQ ID NO: 1481766 - RNA, 13 nt, Human
caccugucugucu

SEQ ID NO: 1481767 - RNA, 12 nt, Human
caccugucuguc

SEQ ID NO: 1481768 - RNA, 11 nt, Human
caccugucugu

SEQ ID NO: 1481769 - RNA, 15 nt, Human
caccugucccagaaa

SEQ ID NO: 1481770 - RNA, 14 nt, Human
caccugucccagaa

SEQ ID NO: 1481771 - RNA, 16 nt, Human
caccugggagaaaucu

SEQ ID NO: 1481772 - RNA, 17 nt, Human
caccugggagaaaucug

SEQ ID NO: 1481773 - RNA, 14 nt, Human
caccuguaaaccug

SEQ ID NO: 1481774 - RNA, 15 nt, Human
caccuguaaaccuga

SEQ ID NO: 1481775 - RNA, 16 nt, Human
caccuguaaaccugag

SEQ ID NO: 1481776 - RNA, 20 nt, Human
caccugggauuacaagcaug

SEQ ID NO: 1481777 - RNA, 17 nt, Human
caccugaacugaacacc

SEQ ID NO: 1481778 - RNA, 19 nt, Human
caccugaacugaacaccau

SEQ ID NO: 1481779 - RNA, 13 nt, Human
caccugaacugaa

SEQ ID NO: 1481780 - RNA, 21 nt, Human
caccuggaagcauuuguuucu

SEQ ID NO: 1481781 - RNA, 22 nt, Human
caccuggaagcauuuguuucua

SEQ ID NO: 1481782 - RNA, 19 nt, Human
caccugagucacccuaccu

SEQ ID NO: 1481783 - RNA, 23 nt, Human
caccugagucacccuaccugugc

SEQ ID NO: 1481784 - RNA, 13 nt, Human
caccgcagaagga

SEQ ID NO: 1481785 - RNA, 15 nt, Human
caccgacugaaaaua

SEQ ID NO: 1481786 - RNA, 18 nt, Human
cacccuugguuccuaacu

SEQ ID NO: 1481787 - RNA, 12 nt, Human
cacccucacacu

SEQ ID NO: 1481788 - RNA, 16 nt, Human
cacccuaccugugccu

SEQ ID NO: 1481789 - RNA, 12 nt, Human
caccccuaggac

SEQ ID NO: 1481790 - RNA, 18 nt, Human
ggcagacucuuuaugcuu

SEQ ID NO: 1481791 - RNA, 21 nt, Human
ggcaguguagggaguuguggg

SEQ ID NO: 1481792 - RNA, 20 nt, Human
ggcucagaggguguccugca

SEQ ID NO: 1481793 - RNA, 22 nt, Human
ggcugacaugaagcuguugugu

SEQ ID NO: 1481794 - RNA, 16 nt, Human
ggcugccuucuggccu

SEQ ID NO: 1481795 - RNA, 17 nt, Human
ggcuccuugguucuuga

SEQ ID NO: 1481796 - RNA, 20 nt, Human
gggacagucaccucauggaa

SEQ ID NO: 1481797 - RNA, 21 nt, Human
gggacagucaccucauggaau

SEQ ID NO: 1481798 - RNA, 22 nt, Human
gggacagucaccucauggaauu

SEQ ID NO: 1481799 - RNA, 17 nt, Human
gggacagguccucagug

SEQ ID NO: 1481800 - RNA, 11 nt, Human
gggaagacagu

SEQ ID NO: 1481801 - RNA, 12 nt, Human
gggaagacagug

SEQ ID NO: 1481802 - RNA, 14 nt, Human
gggaagacaguggc

SEQ ID NO: 1481803 - RNA, 22 nt, Human
gggacaccuaggcuaggguggg

SEQ ID NO: 1481804 - RNA, 16 nt, Human
gggaagacaguggccc

SEQ ID NO: 1481805 - RNA, 18 nt, Human
gggaagagacagcccagg

SEQ ID NO: 1481806 - RNA, 18 nt, Human
ggcuucuggccaggaagc

SEQ ID NO: 1481807 - RNA, 20 nt, Human
ggcugggucgcccuggacug

SEQ ID NO: 1481808 - RNA, 17 nt, Human
ggcugggucgcccugga

SEQ ID NO: 1481809 - RNA, 14 nt, Human
ggcugggucgcccu

SEQ ID NO: 1481810 - RNA, 22 nt, Human
aaaaauaagaagaaugcuuaau

SEQ ID NO: 1481811 - RNA, 14 nt, Human
aaaaauaacaauga

SEQ ID NO: 1481812 - RNA, 14 nt, Human
aaaaauaagaagaa

SEQ ID NO: 1481813 - RNA, 16 nt, Human
aaaaauaagaagaaug

SEQ ID NO: 1481814 - RNA, 13 nt, Human
aaaaggaaagaaa

SEQ ID NO: 1481815 - RNA, 14 nt, Human
aaaaggaaagaaaa

SEQ ID NO: 1481816 - RNA, 14 nt, Human
aaaagcuuuuuauu

SEQ ID NO: 1481817 - RNA, 21 nt, Human
aaaagcuuugaacccugggac

SEQ ID NO: 1481818 - RNA, 19 nt, Human
aaaagcccaccauuuggca

SEQ ID NO: 1481819 - RNA, 15 nt, Human
gggacuugugucugc

SEQ ID NO: 1481820 - RNA, 14 nt, Human
gggacuugugucug

SEQ ID NO: 1481821 - RNA, 13 nt, Human
gggacuugugucu

SEQ ID NO: 1481822 - RNA, 19 nt, Human
gggaugacuaaaauauuua

SEQ ID NO: 1481823 - RNA, 20 nt, Human
gggaugacuaaaauauuuau

SEQ ID NO: 1481824 - RNA, 16 nt, Human
gggaggguaggcagga

SEQ ID NO: 1481825 - RNA, 15 nt, Human
gggaggguaccagca

SEQ ID NO: 1481826 - RNA, 19 nt, Human
gggacauuugcucauggaa

SEQ ID NO: 1481827 - RNA, 18 nt, Human
gggaccaggagugggugg

SEQ ID NO: 1481828 - RNA, 12 nt, Human
gggaccaggagu

SEQ ID NO: 1481829 - RNA, 13 nt, Human
aaaaaugguaauu

SEQ ID NO: 1481830 - RNA, 11 nt, Human
aaaaauguagg

SEQ ID NO: 1481831 - RNA, 12 nt, Human
aaaaauguagga

SEQ ID NO: 1481832 - RNA, 18 nt, Human
aaaaauguaggagacugu

SEQ ID NO: 1481833 - RNA, 21 nt, Human
aaaagauugaaguauuuugcu

SEQ ID NO: 1481834 - RNA, 14 nt, Human
aaaagauugcugaa

SEQ ID NO: 1481835 - RNA, 16 nt, Human
aaaagauugcugaaau

SEQ ID NO: 1481836 - RNA, 18 nt, Human
aaaagauugcugaaauuu

SEQ ID NO: 1481837 - RNA, 21 nt, Human
aaaagauugcugaaauuuuau

SEQ ID NO: 1481838 - RNA, 16 nt, Human
aaaagcaaaaaagaaa

SEQ ID NO: 1481839 - RNA, 19 nt, Human
aaaacucuuauaaauuucu

SEQ ID NO: 1481840 - RNA, 21 nt, Human
guacuucaaauccuugaagau

SEQ ID NO: 1481841 - RNA, 22 nt, Human
guacuucaaauccuugaagauu

SEQ ID NO: 1481842 - RNA, 15 nt, Human
guacuucaugcuguc

SEQ ID NO: 1481843 - RNA, 19 nt, Human
guacuggcugauggaguaa

SEQ ID NO: 1481844 - RNA, 20 nt, Human
guacugggauuacaggcgug

SEQ ID NO: 1481845 - RNA, 13 nt, Human
guacugcagccuc

SEQ ID NO: 1481846 - RNA, 14 nt, Human
guacuauuuaacug

SEQ ID NO: 1481847 - RNA, 18 nt, Human
guacuauuuaacugacua

SEQ ID NO: 1481848 - RNA, 15 nt, Human
guacuauuuaacuga

SEQ ID NO: 1481849 - RNA, 16 nt, Human
guagaauguaaagcuu

SEQ ID NO: 1481850 - RNA, 21 nt, Human
guagaauguaaagcuugucug

SEQ ID NO: 1481851 - RNA, 19 nt, Human
guagaauguaaagcuuguc

SEQ ID NO: 1481852 - RNA, 17 nt, Human
guagaauuaucuaauuu

SEQ ID NO: 1481853 - RNA, 22 nt, Human
guagaauuaucuaauuuauaaa

SEQ ID NO: 1481854 - RNA, 18 nt, Human
guagacaguauauaacua

SEQ ID NO: 1481855 - RNA, 14 nt, Human
guagaccaaaauaa

SEQ ID NO: 1481856 - RNA, 15 nt, Human
guagaccaaaauaaa

SEQ ID NO: 1481857 - RNA, 16 nt, Human
guagaccaaaauaaaa

SEQ ID NO: 1481858 - RNA, 15 nt, Human
aaauccauacauuug

SEQ ID NO: 1481859 - RNA, 18 nt, Human
aaauccauacauuugugu

SEQ ID NO: 1481860 - RNA, 23 nt, Human
guaccaagacuacuagggaaaug

SEQ ID NO: 1481861 - RNA, 20 nt, Human
guaccaagacuacuagggaa

SEQ ID NO: 1481862 - RNA, 21 nt, Human
guaccaagaaucuugguuugc

SEQ ID NO: 1481863 - RNA, 17 nt, Human
guaccagaugcagcuca

SEQ ID NO: 1481864 - RNA, 21 nt, Human
aaaucagacuaugaaguuuuu

SEQ ID NO: 1481865 - RNA, 14 nt, Human
aaaucagacuauga

SEQ ID NO: 1481866 - RNA, 17 nt, Human
aaaucacgcuuuuugaa

SEQ ID NO: 1481867 - RNA, 19 nt, Human
aaaucaccacaaacuguaa

SEQ ID NO: 1481868 - RNA, 20 nt, Human
aaaucaccacaaacuguaau

SEQ ID NO: 1481869 - RNA, 20 nt, Human
aaaucacgcuuuuugaaaaa

SEQ ID NO: 1481870 - RNA, 17 nt, Human
aaauauuaugagaugcu

SEQ ID NO: 1481871 - RNA, 17 nt, Human
aaauauuauguuaaaac

SEQ ID NO: 1481872 - RNA, 16 nt, Human
aaauauuaugagaugc

SEQ ID NO: 1481873 - RNA, 17 nt, Human
aaauauuagaaacagcu

SEQ ID NO: 1481874 - RNA, 14 nt, Human
aaauauuagaaaca

SEQ ID NO: 1481875 - RNA, 15 nt, Human
aaauccacuuuaucu

SEQ ID NO: 1481876 - RNA, 14 nt, Human
aaaucauuuugcaa

SEQ ID NO: 1481877 - RNA, 22 nt, Human
aaaucauaagauauuuuucaug

SEQ ID NO: 1481878 - RNA, 20 nt, Human
guaauaggcguaacuaauuu

SEQ ID NO: 1481879 - RNA, 15 nt, Human
guaacucaucuguca

SEQ ID NO: 1481880 - RNA, 13 nt, Human
guaacucaucugu

SEQ ID NO: 1481881 - RNA, 20 nt, Human
guaaacuguguauuccaaga

SEQ ID NO: 1481882 - RNA, 21 nt, Human
guaauccaagcaaaugugaau

SEQ ID NO: 1481883 - RNA, 21 nt, Human
guaauuguugcuaaucuucuu

SEQ ID NO: 1481884 - RNA, 18 nt, Human
guaauuuagaaaucauuu

SEQ ID NO: 1481885 - RNA, 16 nt, Human
guaauuugaggacaac

SEQ ID NO: 1481886 - RNA, 23 nt, Human
guaauuugagagaaauaugaaga

SEQ ID NO: 1481887 - RNA, 18 nt, Human
aaauacauuguauauaug

SEQ ID NO: 1481888 - RNA, 13 nt, Human
aaauacaugcuaa

SEQ ID NO: 1481889 - RNA, 18 nt, Human
aaauacaugcuaagagaa

SEQ ID NO: 1481890 - RNA, 15 nt, Human
aaauacaaaaauacu

SEQ ID NO: 1481891 - RNA, 11 nt, Human
aaauacaaaaa

SEQ ID NO: 1481892 - RNA, 22 nt, Human
aaauaauuuuuauauuugaaau

SEQ ID NO: 1481893 - RNA, 23 nt, Human
aaauaauuuuuauauuugaaaua

SEQ ID NO: 1481894 - RNA, 23 nt, Human
guacacugccuucucaacuccaa

SEQ ID NO: 1481895 - RNA, 21 nt, Human
aaauaauuuuuauauuugaaa

SEQ ID NO: 1481896 - RNA, 18 nt, Human
guacacagcaccagaaug

SEQ ID NO: 1481897 - RNA, 20 nt, Human
guacacagcucuagacacug

SEQ ID NO: 1481898 - RNA, 22 nt, Human
aaaguugcuauuugaacuuuuu

SEQ ID NO: 1481899 - RNA, 17 nt, Human
aaaguugguaaaccuuu

SEQ ID NO: 1481900 - RNA, 16 nt, Human
aaaguugguaaaccuu

SEQ ID NO: 1481901 - RNA, 12 nt, Human
aaaguuuaauaa

SEQ ID NO: 1481902 - RNA, 15 nt, Human
aaaguuuaauaaauu

SEQ ID NO: 1481903 - RNA, 13 nt, Human
aaauaauaauuuu

SEQ ID NO: 1481904 - RNA, 17 nt, Human
aaauaauacugcugaga

SEQ ID NO: 1481905 - RNA, 13 nt, Human
aaauaaguuuuug

SEQ ID NO: 1481906 - RNA, 16 nt, Human
aaauaaguuuuuguuu

SEQ ID NO: 1481907 - RNA, 14 nt, Human
aaauaaucauucuu

SEQ ID NO: 1481908 - RNA, 12 nt, Human
aaauaagaaacu

SEQ ID NO: 1481909 - RNA, 14 nt, Human
aaauaagaaacuuu

SEQ ID NO: 1481910 - RNA, 21 nt, Human
aaauaagaaacuuuuuuauuu

SEQ ID NO: 1481911 - RNA, 15 nt, Human
aaauaagaaacuuuu

SEQ ID NO: 1481912 - RNA, 14 nt, Human
aaauaagaagaaug

SEQ ID NO: 1481913 - RNA, 15 nt, Human
aaauaagaagaaugc

SEQ ID NO: 1481914 - RNA, 20 nt, Human
aaauaagaagaaugcuuaau

SEQ ID NO: 1481915 - RNA, 17 nt, Human
aaauaagagcucaggau

SEQ ID NO: 1481916 - RNA, 23 nt, Human
aaauaagacggauuuauuuuucc

SEQ ID NO: 1481917 - RNA, 19 nt, Human
aaauaauuuuaucucuuuc

SEQ ID NO: 1481918 - RNA, 12 nt, Human
aaauaauuuuaa

SEQ ID NO: 1481919 - RNA, 14 nt, Human
aaauaauuuuaaac

SEQ ID NO: 1481920 - RNA, 18 nt, Human
aaauaauuuuaaacaaag

SEQ ID NO: 1481921 - RNA, 20 nt, Human
aaauaauuuuaaacaaaggu

SEQ ID NO: 1481922 - RNA, 18 nt, Human
aaaguauguuagugcaaa

SEQ ID NO: 1481923 - RNA, 19 nt, Human
ggugcugggccccugccuc

SEQ ID NO: 1481924 - RNA, 22 nt, Human
ggugcuucuaguucugccagga

SEQ ID NO: 1481925 - RNA, 15 nt, Human
gguggaacaagcaca

SEQ ID NO: 1481926 - RNA, 16 nt, Human
ggugcugggccccugc

SEQ ID NO: 1481927 - RNA, 15 nt, Human
ggugcugggccccug

SEQ ID NO: 1481928 - RNA, 13 nt, Human
ggugcugggcccc

SEQ ID NO: 1481929 - RNA, 11 nt, Human
ggugcugggcc

SEQ ID NO: 1481930 - RNA, 21 nt, Human
ggugcauauuuauaaaaauaa

SEQ ID NO: 1481931 - RNA, 20 nt, Human
ggucgcccuggacugugugc

SEQ ID NO: 1481932 - RNA, 19 nt, Human
ggugaaacauuuucucccu

SEQ ID NO: 1481933 - RNA, 20 nt, Human
ggugaaacauuuucucccug

SEQ ID NO: 1481934 - RNA, 14 nt, Human
ggucgcccuggacu

SEQ ID NO: 1481935 - RNA, 14 nt, Human
aaagguaaaucaga

SEQ ID NO: 1481936 - RNA, 14 nt, Human
aaagguacuucaaa

SEQ ID NO: 1481937 - RNA, 23 nt, Human
aaagcugcugagaaucuagccuc

SEQ ID NO: 1481938 - RNA, 15 nt, Human
aaagcugguuuaaug

SEQ ID NO: 1481939 - RNA, 20 nt, Human
gguggaugauccccacgcca

SEQ ID NO: 1481940 - RNA, 13 nt, Human
aaagacagugaaa

SEQ ID NO: 1481941 - RNA, 15 nt, Human
aaagaccauuuuucc

SEQ ID NO: 1481942 - RNA, 16 nt, Human
aaacuuugaaguuagc

SEQ ID NO: 1481943 - RNA, 16 nt, Human
aaacuuguauuaugug

SEQ ID NO: 1481944 - RNA, 23 nt, Human
aaacuucagcgguuuauauaagc

SEQ ID NO: 1481945 - RNA, 15 nt, Human
ggguggggggggugc

SEQ ID NO: 1481946 - RNA, 13 nt, Human
ggguggggagaga

SEQ ID NO: 1481947 - RNA, 14 nt, Human
ggguggggagagac

SEQ ID NO: 1481948 - RNA, 18 nt, Human
ggguggggagagacgggc

SEQ ID NO: 1481949 - RNA, 10 nt, Human
gguccuucaa

SEQ ID NO: 1481950 - RNA, 19 nt, Human
aaagaugcuuuuaacagag

SEQ ID NO: 1481951 - RNA, 22 nt, Human
aaagcaagcauucagaagaaaa

SEQ ID NO: 1481952 - RNA, 12 nt, Human
aaagaugcuuuu

SEQ ID NO: 1481953 - RNA, 13 nt, Human
aaagaugcuuuua

SEQ ID NO: 1481954 - RNA, 14 nt, Human
aaagagauacagag

SEQ ID NO: 1481955 - RNA, 15 nt, Human
gggucgcccuggacu

SEQ ID NO: 1481956 - RNA, 13 nt, Human
gggucgcccugga

SEQ ID NO: 1481957 - RNA, 19 nt, Human
gggggugcugggccccugc

SEQ ID NO: 1481958 - RNA, 13 nt, Human
ggggguggccagg

SEQ ID NO: 1481959 - RNA, 20 nt, Human
ggggguggccaggccgggaa

SEQ ID NO: 1481960 - RNA, 11 nt, Human
ggguccaggag

SEQ ID NO: 1481961 - RNA, 12 nt, Human
ggguccaggagg

SEQ ID NO: 1481962 - RNA, 18 nt, Human
gggggcgcggcugggagg

SEQ ID NO: 1481963 - RNA, 18 nt, Human
aaaccuuuuauauuuagu

SEQ ID NO: 1481964 - RNA, 18 nt, Human
aaaccuuuguuugcaucu

SEQ ID NO: 1481965 - RNA, 17 nt, Human
aaaccuuucuucaccaa

SEQ ID NO: 1481966 - RNA, 18 nt, Human
aaaccugaccccugcuca

SEQ ID NO: 1481967 - RNA, 12 nt, Human
aaacauucuauc

SEQ ID NO: 1481968 - RNA, 15 nt, Human
aaacucguuaauuug

SEQ ID NO: 1481969 - RNA, 13 nt, Human
aaacucaaaauau

SEQ ID NO: 1481970 - RNA, 21 nt, Human
aaacucaaaauauuuguacau

SEQ ID NO: 1481971 - RNA, 22 nt, Human
aaacuaggugcauauuuauaaa

SEQ ID NO: 1481972 - RNA, 22 nt, Human
aaacuauaagcaagaaggcaaa

SEQ ID NO: 1481973 - RNA, 16 nt, Human
aaacuaucuuggugaa

SEQ ID NO: 1481974 - RNA, 13 nt, Human
aaacgucuuaaau

SEQ ID NO: 1481975 - RNA, 18 nt, Human
aaacuaggugcauauuua

SEQ ID NO: 1481976 - RNA, 14 nt, Human
aaacgucuuaaaua

SEQ ID NO: 1481977 - RNA, 13 nt, Human
ggguggcagcaac

SEQ ID NO: 1481978 - RNA, 12 nt, Human
ggguggccaggc

SEQ ID NO: 1481979 - RNA, 13 nt, Human
ggguggccaggcc

SEQ ID NO: 1481980 - RNA, 14 nt, Human
ggguggccaggccg

SEQ ID NO: 1481981 - RNA, 18 nt, Human
ggguggccaggccgggaa

SEQ ID NO: 1481982 - RNA, 20 nt, Human
ggguggccaggccgggaaaa

SEQ ID NO: 1481983 - RNA, 19 nt, Human
aaacuguguauuccaagac

SEQ ID NO: 1481984 - RNA, 16 nt, Human
aaacucguuuuuuaca

SEQ ID NO: 1481985 - RNA, 10 nt, Human
aaacugugua

SEQ ID NO: 1481986 - RNA, 20 nt, Human
aaacuguguacauaacugaa

SEQ ID NO: 1481987 - RNA, 21 nt, Human
aaacuguguacauaacugaaa

SEQ ID NO: 1481988 - RNA, 16 nt, Human
aaacuguguauuccaa

SEQ ID NO: 1481989 - RNA, 18 nt, Human
aaacuguguauuccaaga

SEQ ID NO: 1481990 - RNA, 19 nt, Human
ggggaauugaggacacuga

SEQ ID NO: 1481991 - RNA, 19 nt, Human
ggggacacauguauuuggu

SEQ ID NO: 1481992 - RNA, 19 nt, Human
ggggaagagagccugcagg

SEQ ID NO: 1481993 - RNA, 17 nt, Human
ggggaagacaguggccc

SEQ ID NO: 1481994 - RNA, 20 nt, Human
ggggaagagagccugcagga

SEQ ID NO: 1481995 - RNA, 21 nt, Human
ggggaccaggagugggugggg

SEQ ID NO: 1481996 - RNA, 17 nt, Human
ggggacacauguauuug

SEQ ID NO: 1481997 - RNA, 12 nt, Human
ggggaccaggag

SEQ ID NO: 1481998 - RNA, 13 nt, Human
ggggaccaggagu

SEQ ID NO: 1481999 - RNA, 19 nt, Human
ggggacuuacaugauucau

SEQ ID NO: 1482000 - RNA, 17 nt, Human
ggggccgggggcagucu

SEQ ID NO: 1482001 - RNA, 15 nt, Human
aaaauuuuuaaucuu

SEQ ID NO: 1482002 - RNA, 17 nt, Human
aaacaaagguugagaug

SEQ ID NO: 1482003 - RNA, 20 nt, Human
aaaauuuauauuguaaauau

SEQ ID NO: 1482004 - RNA, 16 nt, Human
aaaauguucagaaggu

SEQ ID NO: 1482005 - RNA, 13 nt, Human
aaaauguugaaau

SEQ ID NO: 1482006 - RNA, 17 nt, Human
aaaauguugaaauauga

SEQ ID NO: 1482007 - RNA, 21 nt, Human
aaaauguuggucauuuuaugu

SEQ ID NO: 1482008 - RNA, 17 nt, Human
aaacacauuaggaaaag

SEQ ID NO: 1482009 - RNA, 22 nt, Human
aaacagggcugccuucuggccu

SEQ ID NO: 1482010 - RNA, 15 nt, Human
aaacagggcugccuu

SEQ ID NO: 1482011 - RNA, 14 nt, Human
aaacaauguuuaaa

SEQ ID NO: 1482012 - RNA, 23 nt, Human
gcugggccccugccucucugcag

SEQ ID NO: 1482013 - RNA, 22 nt, Human
gcugggccccugccucucugca

SEQ ID NO: 1482014 - RNA, 21 nt, Human
gcugggccccugccucucugc

SEQ ID NO: 1482015 - RNA, 12 nt, Human
gcugggucgccc

SEQ ID NO: 1482016 - RNA, 15 nt, Human
gcuggagugcagugg

SEQ ID NO: 1482017 - RNA, 16 nt, Human
gcuuaugguaccagau

SEQ ID NO: 1482018 - RNA, 20 nt, Human
gcuuaugguaccagaugcag

SEQ ID NO: 1482019 - RNA, 15 nt, Human
gcuugagccaggagg

SEQ ID NO: 1482020 - RNA, 21 nt, Human
gcuugagagcccugaggccua

SEQ ID NO: 1482021 - RNA, 15 nt, Human
gcuuugaaacagaaa

SEQ ID NO: 1482022 - RNA, 16 nt, Human
gcuucuaguucugcca

SEQ ID NO: 1482023 - RNA, 17 nt, Human
gcuucuaguucugccag

SEQ ID NO: 1482024 - RNA, 14 nt, Human
gcuucguuuauuuu

SEQ ID NO: 1482025 - RNA, 16 nt, Human
gcuucguuuauuuuca

SEQ ID NO: 1482026 - RNA, 17 nt, Human
gcuucguuuauuuucaa

SEQ ID NO: 1482027 - RNA, 17 nt, Human
ggaagagaaggagcaga

SEQ ID NO: 1482028 - RNA, 12 nt, Human
ggaagagaagga

SEQ ID NO: 1482029 - RNA, 21 nt, Human
ggaagagagccugcaggaucu

SEQ ID NO: 1482030 - RNA, 17 nt, Human
ggaagagacagcccagg

SEQ ID NO: 1482031 - RNA, 16 nt, Human
ggaagagacagcccag

SEQ ID NO: 1482032 - RNA, 18 nt, Human
ggaagagagccugcagga

SEQ ID NO: 1482033 - RNA, 14 nt, Human
ggaacuugaacuga

SEQ ID NO: 1482034 - RNA, 16 nt, Human
ggaacuugaacugauu

SEQ ID NO: 1482035 - RNA, 18 nt, Human
ggaacuugaacugauuca

SEQ ID NO: 1482036 - RNA, 14 nt, Human
ggaagacaguggcc

SEQ ID NO: 1482037 - RNA, 15 nt, Human
ggaagacaguggccc

SEQ ID NO: 1482038 - RNA, 19 nt, Human
ggaagccccugggcccagu

SEQ ID NO: 1482039 - RNA, 18 nt, Human
ggaagccccugggcccag

SEQ ID NO: 1482040 - RNA, 15 nt, Human
ggaagccccugggcc

SEQ ID NO: 1482041 - RNA, 14 nt, Human
ggaagccccugggc

SEQ ID NO: 1482042 - RNA, 13 nt, Human
ggaagccccuggg

SEQ ID NO: 1482043 - RNA, 18 nt, Human
ggaaguugacuuauagua

SEQ ID NO: 1482044 - RNA, 21 nt, Human
ggaagcuuuggugagaaccug

SEQ ID NO: 1482045 - RNA, 20 nt, Human
ggaagcuuuggugagaaccu

SEQ ID NO: 1482046 - RNA, 17 nt, Human
ggaagcugcccugccca

SEQ ID NO: 1482047 - RNA, 20 nt, Human
ggaagcugugcgugugugug

SEQ ID NO: 1482048 - RNA, 18 nt, Human
ggaaugaagcaaugcuuc

SEQ ID NO: 1482049 - RNA, 19 nt, Human
ggaaugaagauacugaaau

SEQ ID NO: 1482050 - RNA, 19 nt, Human
ggaauaagguacaagaagc

SEQ ID NO: 1482051 - RNA, 17 nt, Human
ggacaccugcccugccc

SEQ ID NO: 1482052 - RNA, 16 nt, Human
ggacaccugcccugcc

SEQ ID NO: 1482053 - RNA, 19 nt, Human
ggacaccugggagaaaucu

SEQ ID NO: 1482054 - RNA, 22 nt, Human
ggacagcuuguggcaagugaau

SEQ ID NO: 1482055 - RNA, 15 nt, Human
ggacaggauccaggc

SEQ ID NO: 1482056 - RNA, 12 nt, Human
ggacagcuugug

SEQ ID NO: 1482057 - RNA, 17 nt, Human
ggacaggauguguuugc

SEQ ID NO: 1482058 - RNA, 18 nt, Human
ggacaggauguguuugcu

SEQ ID NO: 1482059 - RNA, 20 nt, Human
ggacaggauguguuugcuuu

SEQ ID NO: 1482060 - RNA, 18 nt, Human
ggagaaaugaaaaaauau

SEQ ID NO: 1482061 - RNA, 22 nt, Human
ggagaaaucuggcuucuggcca

SEQ ID NO: 1482062 - RNA, 19 nt, Human
ggacuugcaaaaaggguca

SEQ ID NO: 1482063 - RNA, 20 nt, Human
ggacuuuauagaucagccag

SEQ ID NO: 1482064 - RNA, 19 nt, Human
ggacuaugaaaagcuagaa

SEQ ID NO: 1482065 - RNA, 18 nt, Human
ggacucaagccccggacu

SEQ ID NO: 1482066 - RNA, 20 nt, Human
ggacucagguggcccuacug

SEQ ID NO: 1482067 - RNA, 19 nt, Human
ggacucaucuuucccuccu

SEQ ID NO: 1482068 - RNA, 16 nt, Human
ggacucaucuuucccu

SEQ ID NO: 1482069 - RNA, 22 nt, Human
ggacucaucuuucccuccuugg

SEQ ID NO: 1482070 - RNA, 23 nt, Human
ggacucaucuuucccuccuuggu

SEQ ID NO: 1482071 - RNA, 21 nt, Human
ggacucaucuuucccuccuug

SEQ ID NO: 1482072 - RNA, 20 nt, Human
ggacucaucuuucccuccuu

SEQ ID NO: 1482073 - RNA, 13 nt, Human
ggacccuguccaa

SEQ ID NO: 1482074 - RNA, 21 nt, Human
gccugccccuacccuggacuu

SEQ ID NO: 1482075 - RNA, 22 nt, Human
gccugccccuacccuggacuug

SEQ ID NO: 1482076 - RNA, 19 nt, Human
gccuccuuagaaaaaaaau

SEQ ID NO: 1482077 - RNA, 23 nt, Human
gccuccauccuacccccugugcc

SEQ ID NO: 1482078 - RNA, 15 nt, Human
gccucuuagaugcag

SEQ ID NO: 1482079 - RNA, 19 nt, Human
gccucuuaaauaaaccuuu

SEQ ID NO: 1482080 - RNA, 13 nt, Human
gccucuucccucu

SEQ ID NO: 1482081 - RNA, 21 nt, Human
gccucuuccagucuuccugac

SEQ ID NO: 1482082 - RNA, 19 nt, Human
gccugugccuccucacccc

SEQ ID NO: 1482083 - RNA, 14 nt, Human
gcgaucucagcuca

SEQ ID NO: 1482084 - RNA, 17 nt, Human
gcgaucucggcucacug

SEQ ID NO: 1482085 - RNA, 16 nt, Human
gccuugcggcuccuca

SEQ ID NO: 1482086 - RNA, 17 nt, Human
gccuugcggcuccucag

SEQ ID NO: 1482087 - RNA, 20 nt, Human
gccuugcggcuccucaggga

SEQ ID NO: 1482088 - RNA, 18 nt, Human
gccuugcggcuccucagg

SEQ ID NO: 1482089 - RNA, 16 nt, Human
gcccccaccuggcuca

SEQ ID NO: 1482090 - RNA, 19 nt, Human
gcccccacugccuuugacc

SEQ ID NO: 1482091 - RNA, 23 nt, Human
gccccugccaccuccugccucag

SEQ ID NO: 1482092 - RNA, 23 nt, Human
gccccugccucucugcagguccc

SEQ ID NO: 1482093 - RNA, 20 nt, Human
gccccugccucucugcaggu

SEQ ID NO: 1482094 - RNA, 17 nt, Human
gcccgguaagagcaaaa

SEQ ID NO: 1482095 - RNA, 17 nt, Human
gcccugccaccugucug

SEQ ID NO: 1482096 - RNA, 16 nt, Human
gcccugccaccugucu

SEQ ID NO: 1482097 - RNA, 15 nt, Human
gcccugccaccuguc

SEQ ID NO: 1482098 - RNA, 14 nt, Human
gcccugccaccugu

SEQ ID NO: 1482099 - RNA, 13 nt, Human
gcccugccaccug

SEQ ID NO: 1482100 - RNA, 17 nt, Human
gcccugcccugccaccu

SEQ ID NO: 1482101 - RNA, 13 nt, Human
gcccugcccugcc

SEQ ID NO: 1482102 - RNA, 20 nt, Human
gcccugugccccuugacaac

SEQ ID NO: 1482103 - RNA, 20 nt, Human
gcucacugcaaccucugccu

SEQ ID NO: 1482104 - RNA, 14 nt, Human
gcuauuugaagugu

SEQ ID NO: 1482105 - RNA, 18 nt, Human
gcuauuuuauauuacacu

SEQ ID NO: 1482106 - RNA, 23 nt, Human
gcuauuuuauauuacacuacaca

SEQ ID NO: 1482107 - RNA, 20 nt, Human
gcucaggaugagggaaaaga

SEQ ID NO: 1482108 - RNA, 19 nt, Human
gcucacugaccugccugua

SEQ ID NO: 1482109 - RNA, 16 nt, Human
gcucaggaaccgaggc

SEQ ID NO: 1482110 - RNA, 19 nt, Human
gcucaggaaccgaggcagg

SEQ ID NO: 1482111 - RNA, 20 nt, Human
gcucaggaaccgaggcaggg

SEQ ID NO: 1482112 - RNA, 21 nt, Human
gcucaggaaccgaggcaggga

SEQ ID NO: 1482113 - RNA, 19 nt, Human
gcuacucuaguauuccaga

SEQ ID NO: 1482114 - RNA, 20 nt, Human
gcuacucuaguauuccagac

SEQ ID NO: 1482115 - RNA, 21 nt, Human
gcuacucuaguauuccagacc

SEQ ID NO: 1482116 - RNA, 19 nt, Human
gcguuuuuuaaauguauac

SEQ ID NO: 1482117 - RNA, 11 nt, Human
gcgugcagaug

SEQ ID NO: 1482118 - RNA, 18 nt, Human
gcgugguggucccugggu

SEQ ID NO: 1482119 - RNA, 17 nt, Human
gcgugguggucccuggg

SEQ ID NO: 1482120 - RNA, 12 nt, Human
gcuaaaagaaac

SEQ ID NO: 1482121 - RNA, 15 nt, Human
gcuaaaagaaacuuu

SEQ ID NO: 1482122 - RNA, 16 nt, Human
gcuaaaagaaacuuuc

SEQ ID NO: 1482123 - RNA, 17 nt, Human
gcuaaaauaaagaaaua

SEQ ID NO: 1482124 - RNA, 18 nt, Human
cugcucaguaaagcacuu

SEQ ID NO: 1482125 - RNA, 19 nt, Human
cugcucaguaaagcacuug

SEQ ID NO: 1482126 - RNA, 15 nt, Human
cugcucauauuguga

SEQ ID NO: 1482127 - RNA, 19 nt, Human
cugcucauauugugauucu

SEQ ID NO: 1482128 - RNA, 14 nt, Human
cugccucccuucau

SEQ ID NO: 1482129 - RNA, 12 nt, Human
cugaugaaaaua

SEQ ID NO: 1482130 - RNA, 15 nt, Human
cugaucuggcugcag

SEQ ID NO: 1482131 - RNA, 13 nt, Human
cugaugaaaauaa

SEQ ID NO: 1482132 - RNA, 14 nt, Human
cugaugaaaauaaa

SEQ ID NO: 1482133 - RNA, 16 nt, Human
cugaugaaaauaaaga

SEQ ID NO: 1482134 - RNA, 17 nt, Human
cugaugaaaauaaagaa

SEQ ID NO: 1482135 - RNA, 18 nt, Human
cugaugaaaauaaagaau

SEQ ID NO: 1482136 - RNA, 19 nt, Human
cugaugaaaauaaagaaug

SEQ ID NO: 1482137 - RNA, 20 nt, Human
cugaugaaaauaaagaaugg

SEQ ID NO: 1482138 - RNA, 23 nt, Human
cugccucccuucaugcauggaaa

SEQ ID NO: 1482139 - RNA, 21 nt, Human
cugccucccuucaugcaugga

SEQ ID NO: 1482140 - RNA, 19 nt, Human
cugccucccuucaugcaug

SEQ ID NO: 1482141 - RNA, 18 nt, Human
cugccucccuucaugcau

SEQ ID NO: 1482142 - RNA, 17 nt, Human
cugccucccuucaugca

SEQ ID NO: 1482143 - RNA, 15 nt, Human
cugccucccuucaug

SEQ ID NO: 1482144 - RNA, 19 nt, Human
cuggacuuggccccugcca

SEQ ID NO: 1482145 - RNA, 18 nt, Human
cuggacuuggccccugcc

SEQ ID NO: 1482146 - RNA, 17 nt, Human
cuggacuuggccccugc

SEQ ID NO: 1482147 - RNA, 16 nt, Human
cuggacuugccucugc

SEQ ID NO: 1482148 - RNA, 15 nt, Human
cuggacuugccucug

SEQ ID NO: 1482149 - RNA, 20 nt, Human
cuggaacuugaacugauuca

SEQ ID NO: 1482150 - RNA, 21 nt, Human
cuggaagacgcaagggccuga

SEQ ID NO: 1482151 - RNA, 16 nt, Human
cuggaagagcagcccu

SEQ ID NO: 1482152 - RNA, 23 nt, Human
cugggacuauaggcaugcgccac

SEQ ID NO: 1482153 - RNA, 23 nt, Human
cugggaauggaggggcagagcca

SEQ ID NO: 1482154 - RNA, 20 nt, Human
cugggaauggaggggcagag

SEQ ID NO: 1482155 - RNA, 13 nt, Human
cugggaauggagg

SEQ ID NO: 1482156 - RNA, 19 nt, Human
cugggccaacucaccugag

SEQ ID NO: 1482157 - RNA, 20 nt, Human
cuggggcugaggcugaggca

SEQ ID NO: 1482158 - RNA, 15 nt, Human
cuggggccaggcugg

SEQ ID NO: 1482159 - RNA, 17 nt, Human
cuggggcauggaaggca

SEQ ID NO: 1482160 - RNA, 17 nt, Human
cugugaccucuccccug

SEQ ID NO: 1482161 - RNA, 20 nt, Human
cugugccuugucacgccaga

SEQ ID NO: 1482162 - RNA, 15 nt, Human
cugugccugaauauu

SEQ ID NO: 1482163 - RNA, 13 nt, Human
cuguuauaaucuu

SEQ ID NO: 1482164 - RNA, 19 nt, Human
cuguuauaaucuuucacag

SEQ ID NO: 1482165 - RNA, 22 nt, Human
cuguaguaggcauuuuuaccau

SEQ ID NO: 1482166 - RNA, 18 nt, Human
cuguaguaggcauuuuua

SEQ ID NO: 1482167 - RNA, 15 nt, Human
cuggugaagcucacu

SEQ ID NO: 1482168 - RNA, 18 nt, Human
cuggucuuguggaauugg

SEQ ID NO: 1482169 - RNA, 20 nt, Human
cuggucuuguggaauuggga

SEQ ID NO: 1482170 - RNA, 20 nt, Human
cuggugaagcucacuucugg

SEQ ID NO: 1482171 - RNA, 14 nt, Human
cuguaaacugugua

SEQ ID NO: 1482172 - RNA, 20 nt, Human
cuguaaacuguguauuccaa

SEQ ID NO: 1482173 - RNA, 12 nt, Human
cuguaaacugug

SEQ ID NO: 1482174 - RNA, 13 nt, Human
cuguaaacugugu

SEQ ID NO: 1482175 - RNA, 14 nt, Human
cugguuuaauguuu

SEQ ID NO: 1482176 - RNA, 14 nt, Human
cugucauagaaauu

SEQ ID NO: 1482177 - RNA, 16 nt, Human
cugucauagaaauuac

SEQ ID NO: 1482178 - RNA, 22 nt, Human
cugucauaugcucugauuuauc

SEQ ID NO: 1482179 - RNA, 16 nt, Human
cugucaucaauuaaag

SEQ ID NO: 1482180 - RNA, 23 nt, Human
cugucaucaauuaaaggcaaagg

SEQ ID NO: 1482181 - RNA, 14 nt, Human
cuguuuaagagaca

SEQ ID NO: 1482182 - RNA, 12 nt, Human
cuguuuaagaga

SEQ ID NO: 1482183 - RNA, 15 nt, Human
cuguuguagaagaca

SEQ ID NO: 1482184 - RNA, 12 nt, Human
cuguugggagag

SEQ ID NO: 1482185 - RNA, 17 nt, Human
cuuaaauaagaaacuuu

SEQ ID NO: 1482186 - RNA, 13 nt, Human
cuuaaauaagaaa

SEQ ID NO: 1482187 - RNA, 16 nt, Human
cuuaaauaagaaacuu

SEQ ID NO: 1482188 - RNA, 14 nt, Human
cuuagcugucugcu

SEQ ID NO: 1482189 - RNA, 17 nt, Human
cuuagcugucugcucag

SEQ ID NO: 1482190 - RNA, 19 nt, Human
cuuaccaggcaccaaaaga

SEQ ID NO: 1482191 - RNA, 20 nt, Human
cuuaccaggcaccaaaagaa

SEQ ID NO: 1482192 - RNA, 15 nt, Human
cuugcaaaaaggguc

SEQ ID NO: 1482193 - RNA, 12 nt, Human
cuugauuuuugc

SEQ ID NO: 1482194 - RNA, 16 nt, Human
cuugcaaaaaggguca

SEQ ID NO: 1482195 - RNA, 19 nt, Human
cuugauuuuagccuucucu

SEQ ID NO: 1482196 - RNA, 20 nt, Human
cuugauuuuagccuucucug

SEQ ID NO: 1482197 - RNA, 21 nt, Human
cuugauuuuagccuucucugu

SEQ ID NO: 1482198 - RNA, 20 nt, Human
cuugacaguggaacuacauu

SEQ ID NO: 1482199 - RNA, 19 nt, Human
cuucugacauaauccagua

SEQ ID NO: 1482200 - RNA, 22 nt, Human
cuucugaauaaagcaauuagca

SEQ ID NO: 1482201 - RNA, 18 nt, Human
cuucugaauaaagcaauu

SEQ ID NO: 1482202 - RNA, 16 nt, Human
cuucugaauaaagcaa

SEQ ID NO: 1482203 - RNA, 15 nt, Human
cuucugaauaaagca

SEQ ID NO: 1482204 - RNA, 16 nt, Human
cuucucuuguuaggua

SEQ ID NO: 1482205 - RNA, 21 nt, Human
cuucuuacaauaauucuauga

SEQ ID NO: 1482206 - RNA, 20 nt, Human
cuucucacauuuauauuuuu

SEQ ID NO: 1482207 - RNA, 13 nt, Human
cuucucacauuua

SEQ ID NO: 1482208 - RNA, 19 nt, Human
cuucuaguucugccaggag

SEQ ID NO: 1482209 - RNA, 13 nt, Human
cuucucuguucau

SEQ ID NO: 1482210 - RNA, 14 nt, Human
cuucucuguucauu

SEQ ID NO: 1482211 - RNA, 17 nt, Human
cuucucuguucauuucc

SEQ ID NO: 1482212 - RNA, 16 nt, Human
cuucuaguucugccag

SEQ ID NO: 1482213 - RNA, 17 nt, Human
cuucuaguucugccagg

SEQ ID NO: 1482214 - RNA, 18 nt, Human
cuucuaguucugccagga

SEQ ID NO: 1482215 - RNA, 15 nt, Human
cuuccugacacuuua

SEQ ID NO: 1482216 - RNA, 16 nt, Human
cuuccugacacuuuaa

SEQ ID NO: 1482217 - RNA, 17 nt, Human
cuuccugacacuuuaau

SEQ ID NO: 1482218 - RNA, 18 nt, Human
cuuccugacacuuuaauu

SEQ ID NO: 1482219 - RNA, 20 nt, Human
cuuugaccugccucccuuca

SEQ ID NO: 1482220 - RNA, 17 nt, Human
cuuucucacuaaaucuu

SEQ ID NO: 1482221 - RNA, 22 nt, Human
cuuucucacuaaaucuuuuaua

SEQ ID NO: 1482222 - RNA, 15 nt, Human
cuuucucaguuuuca

SEQ ID NO: 1482223 - RNA, 16 nt, Human
cuuucucaguuuucau

SEQ ID NO: 1482224 - RNA, 17 nt, Human
cuuucucaguuuucaua

SEQ ID NO: 1482225 - RNA, 20 nt, Human
cuuucucaguuuucauaagu

SEQ ID NO: 1482226 - RNA, 23 nt, Human
cuuugaccugccucccuucaugc

SEQ ID NO: 1482227 - RNA, 18 nt, Human
cuuucucaauaagccuca

SEQ ID NO: 1482228 - RNA, 13 nt, Human
cuuuguauucaaa

SEQ ID NO: 1482229 - RNA, 15 nt, Human
cuuuguaaugaaaac

SEQ ID NO: 1482230 - RNA, 14 nt, Human
cuuuguaaugaaaa

SEQ ID NO: 1482231 - RNA, 16 nt, Human
cuuuguaaugaaaacc

SEQ ID NO: 1482232 - RNA, 14 nt, Human
cuuugacuuuuugc

SEQ ID NO: 1482233 - RNA, 15 nt, Human
cuuugacuuuuugca

SEQ ID NO: 1482234 - RNA, 17 nt, Human
cuuugacuuuuugcauu

SEQ ID NO: 1482235 - RNA, 18 nt, Human
cuuugcacagcucuccgg

SEQ ID NO: 1482236 - RNA, 14 nt, Human
cuuugguucagcua

SEQ ID NO: 1482237 - RNA, 19 nt, Human
cuugugaaucaagggucag

SEQ ID NO: 1482238 - RNA, 20 nt, Human
cuugugaaucaagggucagg

SEQ ID NO: 1482239 - RNA, 22 nt, Human
cuugugaaucaagggucaggcc

SEQ ID NO: 1482240 - RNA, 20 nt, Human
cuuggugaauuuuuuuuucc

SEQ ID NO: 1482241 - RNA, 22 nt, Human
cuuggugaauuuuuuuuuccua

SEQ ID NO: 1482242 - RNA, 19 nt, Human
cuuggugauuccgcaguga

SEQ ID NO: 1482243 - RNA, 18 nt, Human
cuuguggaauugggagcu

SEQ ID NO: 1482244 - RNA, 18 nt, Human
cuuuaauuaccaaccugu

SEQ ID NO: 1482245 - RNA, 19 nt, Human
cuuuaauuaccaaccuguu

SEQ ID NO: 1482246 - RNA, 17 nt, Human
gaagcacagugaucaag

SEQ ID NO: 1482247 - RNA, 23 nt, Human
gaagacuaucuuacuauuucaca

SEQ ID NO: 1482248 - RNA, 19 nt, Human
gaagcacgugguaaaacac

SEQ ID NO: 1482249 - RNA, 10 nt, Human
gaagacagug

SEQ ID NO: 1482250 - RNA, 12 nt, Human
gaagacaguggc

SEQ ID NO: 1482251 - RNA, 15 nt, Human
gaagacaguggcccc

SEQ ID NO: 1482252 - RNA, 13 nt, Human
gaagacaguggcc

SEQ ID NO: 1482253 - RNA, 14 nt, Human
gaagacccuccccg

SEQ ID NO: 1482254 - RNA, 17 nt, Human
gaagacagaaguuugca

SEQ ID NO: 1482255 - RNA, 12 nt, Human
gaaccaucagaa

SEQ ID NO: 1482256 - RNA, 21 nt, Human
gaaccccuacaugaaacagaa

SEQ ID NO: 1482257 - RNA, 16 nt, Human
gaaccauuaaccagau

SEQ ID NO: 1482258 - RNA, 13 nt, Human
gaacugaaaucau

SEQ ID NO: 1482259 - RNA, 17 nt, Human
gaacugauguaaguaaa

SEQ ID NO: 1482260 - RNA, 23 nt, Human
gaacugauucacaucucauuuuu

SEQ ID NO: 1482261 - RNA, 21 nt, Human
gaacugauucacaucucauuu

SEQ ID NO: 1482262 - RNA, 11 nt, Human
gaaaugaaaaa

SEQ ID NO: 1482263 - RNA, 20 nt, Human
gaaaucuggcuucuggccag

SEQ ID NO: 1482264 - RNA, 22 nt, Human
gaaaucuggcuucuggccagga

SEQ ID NO: 1482265 - RNA, 23 nt, Human
gaaaucuggcuucuggccaggaa

SEQ ID NO: 1482266 - RNA, 19 nt, Human
gaacacuagacaagccaga

SEQ ID NO: 1482267 - RNA, 19 nt, Human
gaacaccauugaaggcuua

SEQ ID NO: 1482268 - RNA, 20 nt, Human
gaacaccauugaaggcuuaa

SEQ ID NO: 1482269 - RNA, 15 nt, Human
gaacacuagacaagc

SEQ ID NO: 1482270 - RNA, 17 nt, Human
gaacacuagacaagcca

SEQ ID NO: 1482271 - RNA, 18 nt, Human
gaacacuagacaagccag

SEQ ID NO: 1482272 - RNA, 20 nt, Human
gaacacuagacaagccagaa

SEQ ID NO: 1482273 - RNA, 15 nt, Human
gaacaaauggccuuu

SEQ ID NO: 1482274 - RNA, 20 nt, Human
gaacaccauagguagaaugu

SEQ ID NO: 1482275 - RNA, 16 nt, Human
gaacaccauugaaggc

SEQ ID NO: 1482276 - RNA, 17 nt, Human
gaacacaggcaaaaucc

SEQ ID NO: 1482277 - RNA, 21 nt, Human
gaaacaagucagucauucaga

SEQ ID NO: 1482278 - RNA, 23 nt, Human
gaaacaaagaguucaagaaauaa

SEQ ID NO: 1482279 - RNA, 22 nt, Human
gaaaacuuguauuauguguguu

SEQ ID NO: 1482280 - RNA, 19 nt, Human
gaaaacuuguauuaugugu

SEQ ID NO: 1482281 - RNA, 15 nt, Human
gaaaagaaagcuaca

SEQ ID NO: 1482282 - RNA, 21 nt, Human
gaaaagaaaauuuuuguagua

SEQ ID NO: 1482283 - RNA, 16 nt, Human
gaaaacuuuaaagcgu

SEQ ID NO: 1482284 - RNA, 12 nt, Human
gaaaacuuuaaa

SEQ ID NO: 1482285 - RNA, 13 nt, Human
gaaaauuauuuaa

SEQ ID NO: 1482286 - RNA, 23 nt, Human
gaaaauuauuuaaaccgcuaaaa

SEQ ID NO: 1482287 - RNA, 22 nt, Human
gacccuccaccgcagaaggaag

SEQ ID NO: 1482288 - RNA, 21 nt, Human
gacccuccaccgcagaaggaa

SEQ ID NO: 1482289 - RNA, 15 nt, Human
gacccuccccgcacc

SEQ ID NO: 1482290 - RNA, 17 nt, Human
gacccuccccgcacccc

SEQ ID NO: 1482291 - RNA, 18 nt, Human
gacccuccccaaaggcuu

SEQ ID NO: 1482292 - RNA, 19 nt, Human
gacccuccaccgcagaagg

SEQ ID NO: 1482293 - RNA, 20 nt, Human
gacccuaugggucuaggaca

SEQ ID NO: 1482294 - RNA, 20 nt, Human
gacccucaucuuucuuccaa

SEQ ID NO: 1482295 - RNA, 15 nt, Human
gacccucaucuuucu

SEQ ID NO: 1482296 - RNA, 19 nt, Human
gacccucaucuuucuucca

SEQ ID NO: 1482297 - RNA, 16 nt, Human
gacuuuggcugcaugc

SEQ ID NO: 1482298 - RNA, 19 nt, Human
gacuuuggcugcaugcgag

SEQ ID NO: 1482299 - RNA, 13 nt, Human
gacuguuuggaaa

SEQ ID NO: 1482300 - RNA, 18 nt, Human
gacuguuuuucggacagu

SEQ ID NO: 1482301 - RNA, 19 nt, Human
gacuguuuuucggacaguu

SEQ ID NO: 1482302 - RNA, 20 nt, Human
gacugugugcucaggagccc

SEQ ID NO: 1482303 - RNA, 17 nt, Human
gacugugugcucaggag

SEQ ID NO: 1482304 - RNA, 16 nt, Human
gacugugugcucagga

SEQ ID NO: 1482305 - RNA, 14 nt, Human
gacugugugcucag

SEQ ID NO: 1482306 - RNA, 15 nt, Human
gacugucauagaaau

SEQ ID NO: 1482307 - RNA, 14 nt, Human
gacucacaccugaa

SEQ ID NO: 1482308 - RNA, 23 nt, Human
gacucacaccugaacugaacacc

SEQ ID NO: 1482309 - RNA, 17 nt, Human
gacuguaaacacagaca

SEQ ID NO: 1482310 - RNA, 18 nt, Human
gacuguaaacacagacag

SEQ ID NO: 1482311 - RNA, 14 nt, Human
gacucaagccccgg

SEQ ID NO: 1482312 - RNA, 15 nt, Human
gacucaagccccgga

SEQ ID NO: 1482313 - RNA, 22 nt, Human
gaccagcuuuucccaaaagccc

SEQ ID NO: 1482314 - RNA, 10 nt, Human
gaccaggagu

SEQ ID NO: 1482315 - RNA, 11 nt, Human
gaccaggagug

SEQ ID NO: 1482316 - RNA, 18 nt, Human
gaccaggagugggugggg

SEQ ID NO: 1482317 - RNA, 21 nt, Human
gaccauggacacuacacccag

SEQ ID NO: 1482318 - RNA, 16 nt, Human
gaccauggacacuaca

SEQ ID NO: 1482319 - RNA, 23 nt, Human
gaccauggacacuacacccagca

SEQ ID NO: 1482320 - RNA, 23 nt, Human
gaccccugcucaguaaagcacuu

SEQ ID NO: 1482321 - RNA, 22 nt, Human
gacccguucaacuuuuccuuug

SEQ ID NO: 1482322 - RNA, 18 nt, Human
gacccuaugggucuagga

SEQ ID NO: 1482323 - RNA, 14 nt, Human
gacaguauauaacu

SEQ ID NO: 1482324 - RNA, 17 nt, Human
gacaggguuucaccaug

SEQ ID NO: 1482325 - RNA, 18 nt, Human
gacagggcggggguggcg

SEQ ID NO: 1482326 - RNA, 21 nt, Human
gacagcccuucuuuccacaga

SEQ ID NO: 1482327 - RNA, 18 nt, Human
gacagccucccccugucc

SEQ ID NO: 1482328 - RNA, 20 nt, Human
gacagccucccccugucccc

SEQ ID NO: 1482329 - RNA, 19 nt, Human
gacagggcggggguggcgg

SEQ ID NO: 1482330 - RNA, 12 nt, Human
gaggggaccagg

SEQ ID NO: 1482331 - RNA, 13 nt, Human
gaggggaccagga

SEQ ID NO: 1482332 - RNA, 14 nt, Human
gaggggaccaggag

SEQ ID NO: 1482333 - RNA, 15 nt, Human
gaggggaccaggagu

SEQ ID NO: 1482334 - RNA, 20 nt, Human
gaggcucuggagcccacugu

SEQ ID NO: 1482335 - RNA, 15 nt, Human
gagggcgcaggccgu

SEQ ID NO: 1482336 - RNA, 19 nt, Human
gaggcucuggagcccacug

SEQ ID NO: 1482337 - RNA, 14 nt, Human
gaggcucuggagcc

SEQ ID NO: 1482338 - RNA, 14 nt, Human
gagucacugagacc

SEQ ID NO: 1482339 - RNA, 15 nt, Human
gagucacugagacca

SEQ ID NO: 1482340 - RNA, 19 nt, Human
gagccugugccuccucacc

SEQ ID NO: 1482341 - RNA, 21 nt, Human
gagcagugggaggguaccagc

SEQ ID NO: 1482342 - RNA, 13 nt, Human
gagaagcucugaa

SEQ ID NO: 1482343 - RNA, 21 nt, Human
gccaaggagucacugagacca

SEQ ID NO: 1482344 - RNA, 21 nt, Human
gccaagccauggguagccugg

SEQ ID NO: 1482345 - RNA, 19 nt, Human
gccaacuauggccugugga

SEQ ID NO: 1482346 - RNA, 15 nt, Human
gccaacuauggccug

SEQ ID NO: 1482347 - RNA, 14 nt, Human
gccaacuauggccu

SEQ ID NO: 1482348 - RNA, 14 nt, Human
gccaagacugcugu

SEQ ID NO: 1482349 - RNA, 15 nt, Human
gccaagacugcugug

SEQ ID NO: 1482350 - RNA, 20 nt, Human
gccaagacugcuguggccag

SEQ ID NO: 1482351 - RNA, 21 nt, Human
gccaagacugcuguggccagg

SEQ ID NO: 1482352 - RNA, 22 nt, Human
gccaagacugcuguggccagga

SEQ ID NO: 1482353 - RNA, 23 nt, Human
gccaagacugcuguggccaggag

SEQ ID NO: 1482354 - RNA, 18 nt, Human
gcauuucccuuccuuccu

SEQ ID NO: 1482355 - RNA, 18 nt, Human
gcauuuaaaacagacacu

SEQ ID NO: 1482356 - RNA, 22 nt, Human
gcauuucacuuucccgguguuc

SEQ ID NO: 1482357 - RNA, 19 nt, Human
gcauguccuguaaagguua

SEQ ID NO: 1482358 - RNA, 12 nt, Human
gcauuguccucu

SEQ ID NO: 1482359 - RNA, 13 nt, Human
gcauaaauuauug

SEQ ID NO: 1482360 - RNA, 20 nt, Human
gcagggacuguaaacacaga

SEQ ID NO: 1482361 - RNA, 17 nt, Human
gcaguugagacaagaaa

SEQ ID NO: 1482362 - RNA, 23 nt, Human
gcaggcucccagggacaccuggg

SEQ ID NO: 1482363 - RNA, 12 nt, Human
gcaggcugauuu

SEQ ID NO: 1482364 - RNA, 17 nt, Human
gcaggcugauuucuagg

SEQ ID NO: 1482365 - RNA, 11 nt, Human
gcaauagagac

SEQ ID NO: 1482366 - RNA, 22 nt, Human
gcacacaccaccacgccuggcu

SEQ ID NO: 1482367 - RNA, 18 nt, Human
gcaauagucaaauugugu

SEQ ID NO: 1482368 - RNA, 18 nt, Human
gcaaguuuccaucaucua

SEQ ID NO: 1482369 - RNA, 13 nt, Human
gcaaccuccaccu

SEQ ID NO: 1482370 - RNA, 19 nt, Human
gcaaccuaccuguugagca

SEQ ID NO: 1482371 - RNA, 19 nt, Human
gcaaccucaguaauuuaga

SEQ ID NO: 1482372 - RNA, 16 nt, Human
gcaaccuccaccuccu

SEQ ID NO: 1482373 - RNA, 17 nt, Human
gcaaccuccaccuccug

SEQ ID NO: 1482374 - RNA, 23 nt, Human
gcaaccgucuguuaugcugugac

SEQ ID NO: 1482375 - RNA, 11 nt, Human
gcaaaagaaga

SEQ ID NO: 1482376 - RNA, 15 nt, Human
gcaaaagaagaaguu

SEQ ID NO: 1482377 - RNA, 19 nt, Human
gcaaaagaauggcagaaaa

SEQ ID NO: 1482378 - RNA, 18 nt, Human
gcacuaucuuucagcucc

SEQ ID NO: 1482379 - RNA, 19 nt, Human
gcacuaucuuucagcucca

SEQ ID NO: 1482380 - RNA, 14 nt, Human
gcaaaaaagaaaac

SEQ ID NO: 1482381 - RNA, 13 nt, Human
gcaaaaaagaaaa

SEQ ID NO: 1482382 - RNA, 19 nt, Human
gaugugaguugcacagcua

SEQ ID NO: 1482383 - RNA, 11 nt, Human
gaugugcauuc

SEQ ID NO: 1482384 - RNA, 13 nt, Human
gaucuggcugcag

SEQ ID NO: 1482385 - RNA, 12 nt, Human
gaucuggcaugu

SEQ ID NO: 1482386 - RNA, 22 nt, Human
gaugaggccagaccauggacac

SEQ ID NO: 1482387 - RNA, 15 nt, Human
gaugaggccagacca

SEQ ID NO: 1482388 - RNA, 13 nt, Human
gaugaggccagac

SEQ ID NO: 1482389 - RNA, 14 nt, Human
gaugaugacuaugg

SEQ ID NO: 1482390 - RNA, 21 nt, Human
gaugagggaaaagaaaaagau

SEQ ID NO: 1482391 - RNA, 15 nt, Human
gaugcuuuuaacaga

SEQ ID NO: 1482392 - RNA, 14 nt, Human
gaugcuuuuaacag

SEQ ID NO: 1482393 - RNA, 12 nt, Human
gauguaaaguga

SEQ ID NO: 1482394 - RNA, 23 nt, Human
cugacccuccaccgcagaaggaa

SEQ ID NO: 1482395 - RNA, 15 nt, Human
cugacccuccccaaa

SEQ ID NO: 1482396 - RNA, 17 nt, Human
cugacccuaugggucua

SEQ ID NO: 1482397 - RNA, 18 nt, Human
cugacccuccaccgcaga

SEQ ID NO: 1482398 - RNA, 16 nt, Human
cugaccccugcucagu

SEQ ID NO: 1482399 - RNA, 18 nt, Human
cugacccucaucuuucuu

SEQ ID NO: 1482400 - RNA, 13 nt, Human
cugaccccugcuc

SEQ ID NO: 1482401 - RNA, 14 nt, Human
cugaccccugcuca

SEQ ID NO: 1482402 - RNA, 22 nt, Human
cugacccuccccaaaggcuuug

SEQ ID NO: 1482403 - RNA, 21 nt, Human
cugaggaaauugcuuuguauu

SEQ ID NO: 1482404 - RNA, 18 nt, Human
cugaggggcuaccaggaa

SEQ ID NO: 1482405 - RNA, 20 nt, Human
cugaggggcuaccaggaaag

SEQ ID NO: 1482406 - RNA, 17 nt, Human
cugaggggcuaccagga

SEQ ID NO: 1482407 - RNA, 16 nt, Human
cugaggaauuucaccu

SEQ ID NO: 1482408 - RNA, 16 nt, Human
cugaggaauuuucuuu

SEQ ID NO: 1482409 - RNA, 24 nt, Human
cugaaaauauuguuuuacaauagu

SEQ ID NO: 1482410 - RNA, 22 nt, Human
cugaaaauauuguuuuacaaua

SEQ ID NO: 1482411 - RNA, 20 nt, Human
cugaaaauauuguuuuacaa

SEQ ID NO: 1482412 - RNA, 17 nt, Human
cugaaaauauuguuuua

SEQ ID NO: 1482413 - RNA, 21 nt, Human
cugaaaaaugguaauuguugc

SEQ ID NO: 1482414 - RNA, 17 nt, Human
cugaaaagguuuaugaa

SEQ ID NO: 1482415 - RNA, 13 nt, Human
cucuugauuuuca

SEQ ID NO: 1482416 - RNA, 20 nt, Human
cucuugccucaaccucccaa

SEQ ID NO: 1482417 - RNA, 18 nt, Human
cucuugccucaaccuccc

SEQ ID NO: 1482418 - RNA, 14 nt, Human
cugaaagagaaaca

SEQ ID NO: 1482419 - RNA, 19 nt, Human
cugacacuuuaauuaccaa

SEQ ID NO: 1482420 - RNA, 21 nt, Human
cucguggacaccugcccugcc

SEQ ID NO: 1482421 - RNA, 20 nt, Human
cucguggacaccugcccugc

SEQ ID NO: 1482422 - RNA, 19 nt, Human
cucguggacaccugcccug

SEQ ID NO: 1482423 - RNA, 17 nt, Human
cucguggacaccugccc

SEQ ID NO: 1482424 - RNA, 13 nt, Human
cucguauagcaug

SEQ ID NO: 1482425 - RNA, 14 nt, Human
cucguauagcaugc

SEQ ID NO: 1482426 - RNA, 16 nt, Human
cucguaagauuuccuu

SEQ ID NO: 1482427 - RNA, 14 nt, Human
cuccuuucuggcuu

SEQ ID NO: 1482428 - RNA, 15 nt, Human
cuccuaggaaaauac

SEQ ID NO: 1482429 - RNA, 13 nt, Human
cucugaaagagaa

SEQ ID NO: 1482430 - RNA, 14 nt, Human
cucugaaagagaaa

SEQ ID NO: 1482431 - RNA, 16 nt, Human
cucugaaagagaaaca

SEQ ID NO: 1482432 - RNA, 21 nt, Human
cucugaaagagaaacacguau

SEQ ID NO: 1482433 - RNA, 17 nt, Human
cucugaaagagaaacac

SEQ ID NO: 1482434 - RNA, 12 nt, Human
cucugaacacau

SEQ ID NO: 1482435 - RNA, 13 nt, Human
cucugaacacauu

SEQ ID NO: 1482436 - RNA, 14 nt, Human
cuccgucaacucau

SEQ ID NO: 1482437 - RNA, 19 nt, Human
cuccccaugauguuuagaa

SEQ ID NO: 1482438 - RNA, 13 nt, Human
cgugucuggcaca

SEQ ID NO: 1482439 - RNA, 20 nt, Human
cguguuucugacucugagcu

SEQ ID NO: 1482440 - RNA, 17 nt, Human
cguguccgacucuucug

SEQ ID NO: 1482441 - RNA, 17 nt, Human
cuaaagaaaaacaaacu

SEQ ID NO: 1482442 - RNA, 20 nt, Human
cuaaagaaaaacaaacucgu

SEQ ID NO: 1482443 - RNA, 13 nt, Human
cuaaagaaaaaca

SEQ ID NO: 1482444 - RNA, 17 nt, Human
cuaaagcugguuuaaug

SEQ ID NO: 1482445 - RNA, 18 nt, Human
cuaaagcugguuuaaugu

SEQ ID NO: 1482446 - RNA, 15 nt, Human
cgguuuauauaagcu

SEQ ID NO: 1482447 - RNA, 20 nt, Human
cgguucaggaaaauugaaug

SEQ ID NO: 1482448 - RNA, 15 nt, Human
cgaguaauaugccug

SEQ ID NO: 1482449 - RNA, 20 nt, Human
cuacuagggaaaugccuuug

SEQ ID NO: 1482450 - RNA, 13 nt, Human
cuagacacugcca

SEQ ID NO: 1482451 - RNA, 16 nt, Human
cuagaauugaguguuu

SEQ ID NO: 1482452 - RNA, 19 nt, Human
cuagaauugaguguuuaaa

SEQ ID NO: 1482453 - RNA, 21 nt, Human
cuagaauugaguguuuaaagu

SEQ ID NO: 1482454 - RNA, 18 nt, Human
cuagcccaaugaaaugaa

SEQ ID NO: 1482455 - RNA, 21 nt, Human
cuaggccuugcggcuccucag

SEQ ID NO: 1482456 - RNA, 20 nt, Human
cuaguuuucuccucccagga

SEQ ID NO: 1482457 - RNA, 14 nt, Human
cuaguucugccagg

SEQ ID NO: 1482458 - RNA, 15 nt, Human
cuaguucugccagga

SEQ ID NO: 1482459 - RNA, 16 nt, Human
cuaguucugccaggag

SEQ ID NO: 1482460 - RNA, 15 nt, Human
cuaggguggggagag

SEQ ID NO: 1482461 - RNA, 13 nt, Human
cuaguucugccag

SEQ ID NO: 1482462 - RNA, 15 nt, Human
cuaggcuaggguggg

SEQ ID NO: 1482463 - RNA, 13 nt, Human
cuaggcuccaccc

SEQ ID NO: 1482464 - RNA, 14 nt, Human
cuagggagccaugu

SEQ ID NO: 1482465 - RNA, 19 nt, Human
cucagaaaacaaggaugaa

SEQ ID NO: 1482466 - RNA, 23 nt, Human
cucagaaaacaaggaugaauuaa

SEQ ID NO: 1482467 - RNA, 20 nt, Human
cucagaaaauaucccuccug

SEQ ID NO: 1482468 - RNA, 16 nt, Human
cucagaaguuucuucu

SEQ ID NO: 1482469 - RNA, 19 nt, Human
cucagaaguuucuucuuua

SEQ ID NO: 1482470 - RNA, 18 nt, Human
cucacuuguuuuauuuaa

SEQ ID NO: 1482471 - RNA, 21 nt, Human
cucacuuuuaaugaacaaaug

SEQ ID NO: 1482472 - RNA, 22 nt, Human
cucacuuuuaaugaacaaaugg

SEQ ID NO: 1482473 - RNA, 12 nt, Human
cucacuucaggu

SEQ ID NO: 1482474 - RNA, 20 nt, Human
cucacuucugggcuucaucu

SEQ ID NO: 1482475 - RNA, 19 nt, Human
cucaccugagucacccuac

SEQ ID NO: 1482476 - RNA, 17 nt, Human
cucacaacagcugccug

SEQ ID NO: 1482477 - RNA, 21 nt, Human
cuaucucugugugcacaaaua

SEQ ID NO: 1482478 - RNA, 16 nt, Human
cuaucugggaagcuau

SEQ ID NO: 1482479 - RNA, 15 nt, Human
cuaucucccugccuc

SEQ ID NO: 1482480 - RNA, 17 nt, Human
cuaucucccugccuccu

SEQ ID NO: 1482481 - RNA, 18 nt, Human
cuaucucccugccuccug

SEQ ID NO: 1482482 - RNA, 17 nt, Human
cuaucucugugugcaca

SEQ ID NO: 1482483 - RNA, 16 nt, Human
cuaugucauuucauuu

SEQ ID NO: 1482484 - RNA, 18 nt, Human
cuaugucauuucauuucc

SEQ ID NO: 1482485 - RNA, 19 nt, Human
cuauguggaaguggggcgg

SEQ ID NO: 1482486 - RNA, 23 nt, Human
cuauguggaaguggggcgggcuu

SEQ ID NO: 1482487 - RNA, 19 nt, Human
cuauuuuuaauguuuguac

SEQ ID NO: 1482488 - RNA, 14 nt, Human
cuauuuuuaucuga

SEQ ID NO: 1482489 - RNA, 18 nt, Human
cuauuuuuggcagucuga

SEQ ID NO: 1482490 - RNA, 21 nt, Human
cuauuuuuggcagucugaauu

SEQ ID NO: 1482491 - RNA, 22 nt, Human
cuauuuuuggcagucugaauuu

SEQ ID NO: 1482492 - RNA, 19 nt, Human
cucaaacugaggaauuuca

SEQ ID NO: 1482493 - RNA, 22 nt, Human
cucaaacugaggaauuucaccu

SEQ ID NO: 1482494 - RNA, 18 nt, Human
cucaaagagggagugcau

SEQ ID NO: 1482495 - RNA, 19 nt, Human
cucaaagcaagcauucaga

SEQ ID NO: 1482496 - RNA, 15 nt, Human
ccugccucucugcag

SEQ ID NO: 1482497 - RNA, 14 nt, Human
ccugccucucugca

SEQ ID NO: 1482498 - RNA, 13 nt, Human
ccugccucucugc

SEQ ID NO: 1482499 - RNA, 23 nt, Human
ccugccucucaucaacugaauga

SEQ ID NO: 1482500 - RNA, 20 nt, Human
ccugccucucaucaacugaa

SEQ ID NO: 1482501 - RNA, 16 nt, Human
ccugccucagccuccc

SEQ ID NO: 1482502 - RNA, 23 nt, Human
ccugaccccaaguuauccaccug

SEQ ID NO: 1482503 - RNA, 22 nt, Human
ccugcaggaucucaccaggcag

SEQ ID NO: 1482504 - RNA, 23 nt, Human
ccugcaggaucucaccaggcagc

SEQ ID NO: 1482505 - RNA, 18 nt, Human
ccugacccucaucuuucu

SEQ ID NO: 1482506 - RNA, 16 nt, Human
ccugaccccugcucag

SEQ ID NO: 1482507 - RNA, 14 nt, Human
ccugaccccugcuc

SEQ ID NO: 1482508 - RNA, 15 nt, Human
ccugaccccugcuca

SEQ ID NO: 1482509 - RNA, 19 nt, Human
ccugacccucaucuuucuu

SEQ ID NO: 1482510 - RNA, 16 nt, Human
ccuggauuuuuaccag

SEQ ID NO: 1482511 - RNA, 17 nt, Human
ccugggccuugggcucc

SEQ ID NO: 1482512 - RNA, 18 nt, Human
ccugggccuugggcuccg

SEQ ID NO: 1482513 - RNA, 21 nt, Human
ccuggugguggcucgggaggc

SEQ ID NO: 1482514 - RNA, 18 nt, Human
ccuggugguggcucggga

SEQ ID NO: 1482515 - RNA, 21 nt, Human
ccugucucccuccucugcccg

SEQ ID NO: 1482516 - RNA, 12 nt, Human
ccuguaaaccug

SEQ ID NO: 1482517 - RNA, 13 nt, Human
ccuguaaaccuga

SEQ ID NO: 1482518 - RNA, 16 nt, Human
ccuguaacaagccaga

SEQ ID NO: 1482519 - RNA, 14 nt, Human
ccucaaccucaucc

SEQ ID NO: 1482520 - RNA, 13 nt, Human
ccucaaccucauc

SEQ ID NO: 1482521 - RNA, 23 nt, Human
ccucaaccccuccccuccauccc

SEQ ID NO: 1482522 - RNA, 14 nt, Human
ccucaaccccuccc

SEQ ID NO: 1482523 - RNA, 17 nt, Human
ccucagcucucaguugc

SEQ ID NO: 1482524 - RNA, 14 nt, Human
ccucaaccucccaa

SEQ ID NO: 1482525 - RNA, 14 nt, Human
ccucaacugccuac

SEQ ID NO: 1482526 - RNA, 15 nt, Human
ccucaacugccuacu

SEQ ID NO: 1482527 - RNA, 12 nt, Human
ccucaaccuccc

SEQ ID NO: 1482528 - RNA, 13 nt, Human
ccuccucaccccc

SEQ ID NO: 1482529 - RNA, 14 nt, Human
ccuccucaccccca

SEQ ID NO: 1482530 - RNA, 16 nt, Human
ccuccucacccccagc

SEQ ID NO: 1482531 - RNA, 20 nt, Human
ccucgcccagcggcaucagg

SEQ ID NO: 1482532 - RNA, 21 nt, Human
ccucgcccagcggcaucaggc

SEQ ID NO: 1482533 - RNA, 13 nt, Human
ccuaauaaagcug

SEQ ID NO: 1482534 - RNA, 12 nt, Human
ccuaauaaagcu

SEQ ID NO: 1482535 - RNA, 14 nt, Human
ccgugacgucuggg

SEQ ID NO: 1482536 - RNA, 16 nt, Human
ccgugacgucugggug

SEQ ID NO: 1482537 - RNA, 15 nt, Human
ccgugagcauguuug

SEQ ID NO: 1482538 - RNA, 20 nt, Human
ccuaauucaauucaaagcug

SEQ ID NO: 1482539 - RNA, 16 nt, Human
ccuaauucaauucaaa

SEQ ID NO: 1482540 - RNA, 21 nt, Human
cccuucuccauggcccugcca

SEQ ID NO: 1482541 - RNA, 21 nt, Human
cccuucuauacccacccagaa

SEQ ID NO: 1482542 - RNA, 20 nt, Human
cccuucuauacccacccaga

SEQ ID NO: 1482543 - RNA, 19 nt, Human
cccuucuauacccacccag

SEQ ID NO: 1482544 - RNA, 18 nt, Human
cccuucuauacccaccca

SEQ ID NO: 1482545 - RNA, 13 nt, Human
cccuucuauaccc

SEQ ID NO: 1482546 - RNA, 20 nt, Human
cccuccuguugggagagggc

SEQ ID NO: 1482547 - RNA, 14 nt, Human
cccuucuccccugc

SEQ ID NO: 1482548 - RNA, 15 nt, Human
cccuucuccccugca

SEQ ID NO: 1482549 - RNA, 16 nt, Human
cccuucuccccugcac

SEQ ID NO: 1482550 - RNA, 18 nt, Human
cccuucuccccugcacug

SEQ ID NO: 1482551 - RNA, 21 nt, Human
cccuucuccccugcacuguaa

SEQ ID NO: 1482552 - RNA, 23 nt, Human
cccaagagcuacguauuuaauag

SEQ ID NO: 1482553 - RNA, 13 nt, Human
cccaacuccagaa

SEQ ID NO: 1482554 - RNA, 23 nt, Human
cccaacuacccccagcugugcuu

SEQ ID NO: 1482555 - RNA, 13 nt, Human
cccaccccuagga

SEQ ID NO: 1482556 - RNA, 13 nt, Human
ccauuucagagag

SEQ ID NO: 1482557 - RNA, 12 nt, Human
ccauucuuuccc

SEQ ID NO: 1482558 - RNA, 20 nt, Human
ccauucuuccuaguuuucuc

SEQ ID NO: 1482559 - RNA, 14 nt, Human
ccauucuuucccaa

SEQ ID NO: 1482560 - RNA, 20 nt, Human
ccauucuuucccaacaccuc

SEQ ID NO: 1482561 - RNA, 14 nt, Human
ccauucuuccuagu

SEQ ID NO: 1482562 - RNA, 19 nt, Human
ccauucuuccuaguuuucu

SEQ ID NO: 1482563 - RNA, 19 nt, Human
ccauucuggaagugacuuu

SEQ ID NO: 1482564 - RNA, 14 nt, Human
ccaugaugccucug

SEQ ID NO: 1482565 - RNA, 20 nt, Human
ccaugaugccucugucuucu

SEQ ID NO: 1482566 - RNA, 23 nt, Human
ccaguuggaguuuuuuguaccaa

SEQ ID NO: 1482567 - RNA, 15 nt, Human
ccaguuggaguuuuu

SEQ ID NO: 1482568 - RNA, 18 nt, Human
ccaggcuggagugcagug

SEQ ID NO: 1482569 - RNA, 17 nt, Human
ccaggcuggagugcagu

SEQ ID NO: 1482570 - RNA, 17 nt, Human
ccaggcaggucugaagc

SEQ ID NO: 1482571 - RNA, 16 nt, Human
ccaggauagagacugg

SEQ ID NO: 1482572 - RNA, 21 nt, Human
ccaggauacuggcacagaggu

SEQ ID NO: 1482573 - RNA, 18 nt, Human
ccaggauagagacuggaa

SEQ ID NO: 1482574 - RNA, 20 nt, Human
ccaggauacuggcacagagg

SEQ ID NO: 1482575 - RNA, 18 nt, Human
ccaggaucguuuuuuccc

SEQ ID NO: 1482576 - RNA, 23 nt, Human
ccagcuuuucccaaaagcccauu

SEQ ID NO: 1482577 - RNA, 13 nt, Human
ccagcuuuuccca

SEQ ID NO: 1482578 - RNA, 20 nt, Human
ccagcuuugcuaccaaagca

SEQ ID NO: 1482579 - RNA, 12 nt, Human
ccagcuuucccu

SEQ ID NO: 1482580 - RNA, 14 nt, Human
ccagcuuucccugc

SEQ ID NO: 1482581 - RNA, 18 nt, Human
ccagcuuucccugccucu

SEQ ID NO: 1482582 - RNA, 17 nt, Human
ccccugaauuuaaauag

SEQ ID NO: 1482583 - RNA, 13 nt, Human
ccccugaauuuaa

SEQ ID NO: 1482584 - RNA, 17 nt, Human
ccccugccaccuccugc

SEQ ID NO: 1482585 - RNA, 15 nt, Human
ccccugccaccuccu

SEQ ID NO: 1482586 - RNA, 18 nt, Human
cccucaaccucauccucu

SEQ ID NO: 1482587 - RNA, 13 nt, Human
cccagccauccag

SEQ ID NO: 1482588 - RNA, 20 nt, Human
cccagcuggggccaggcugg

SEQ ID NO: 1482589 - RNA, 18 nt, Human
cccagggacaccugggag

SEQ ID NO: 1482590 - RNA, 19 nt, Human
cccagggacaccugggaga

SEQ ID NO: 1482591 - RNA, 21 nt, Human
cacucuguucauuccuccagg

SEQ ID NO: 1482592 - RNA, 20 nt, Human
cacucuguucauuccuccag

SEQ ID NO: 1482593 - RNA, 19 nt, Human
cacucuguucauuccucca

SEQ ID NO: 1482594 - RNA, 18 nt, Human
cacucuguucauuccucc

SEQ ID NO: 1482595 - RNA, 17 nt, Human
cacucuguucauuccuc

SEQ ID NO: 1482596 - RNA, 21 nt, Human
cacuacacccagcaauagaga

SEQ ID NO: 1482597 - RNA, 12 nt, Human
cacggccuuucu

SEQ ID NO: 1482598 - RNA, 20 nt, Human
cacggccuuucuagccuggc

SEQ ID NO: 1482599 - RNA, 22 nt, Human
cacucuguucauuccuccaggu

SEQ ID NO: 1482600 - RNA, 12 nt, Human
caccuuucuagu

SEQ ID NO: 1482601 - RNA, 13 nt, Human
caccuuucuaguu

SEQ ID NO: 1482602 - RNA, 17 nt, Human
caccuuucuaguugaaa

SEQ ID NO: 1482603 - RNA, 17 nt, Human
caccuuuuuucaacagu

SEQ ID NO: 1482604 - RNA, 20 nt, Human
caccucagagacauacaccu

SEQ ID NO: 1482605 - RNA, 18 nt, Human
cacuuuagaauaugccuu

SEQ ID NO: 1482606 - RNA, 20 nt, Human
cacuuuaauuaccaaccugu

SEQ ID NO: 1482607 - RNA, 22 nt, Human
cacuuuacacaauagaauuaua

SEQ ID NO: 1482608 - RNA, 17 nt, Human
cacuuguguuuugcaag

SEQ ID NO: 1482609 - RNA, 19 nt, Human
cacugggagaaaugaaaaa

SEQ ID NO: 1482610 - RNA, 20 nt, Human
cacugguagaccaaaauaaa

SEQ ID NO: 1482611 - RNA, 14 nt, Human
cagaaauacaauuu

SEQ ID NO: 1482612 - RNA, 14 nt, Human
cagaaauacuacug

SEQ ID NO: 1482613 - RNA, 22 nt, Human
cagaaauauuugugacaaaaaa

SEQ ID NO: 1482614 - RNA, 21 nt, Human
cagaaauauuugugacaaaaa

SEQ ID NO: 1482615 - RNA, 21 nt, Human
cagaaaugaggagacacaccu

SEQ ID NO: 1482616 - RNA, 20 nt, Human
caauaaaauccauacauuug

SEQ ID NO: 1482617 - RNA, 23 nt, Human
caauaaaauccauacauuugugu

SEQ ID NO: 1482618 - RNA, 20 nt, Human
caauaaaaauguuuaacggu

SEQ ID NO: 1482619 - RNA, 17 nt, Human
caauaaaaauguuuaac

SEQ ID NO: 1482620 - RNA, 21 nt, Human
caaggccugguguuucuugau

SEQ ID NO: 1482621 - RNA, 22 nt, Human
caaggccugguguuucuugaua

SEQ ID NO: 1482622 - RNA, 22 nt, Human
caaggccuuauuggaaagcagu

SEQ ID NO: 1482623 - RNA, 13 nt, Human
caaggcggugcuu

SEQ ID NO: 1482624 - RNA, 16 nt, Human
caaggcggugcuugau

SEQ ID NO: 1482625 - RNA, 21 nt, Human
caagucagucauucagauaug

SEQ ID NO: 1482626 - RNA, 19 nt, Human
caagucaggcccuuauuuu

SEQ ID NO: 1482627 - RNA, 22 nt, Human
caagauuguuccugcuuuuccc

SEQ ID NO: 1482628 - RNA, 20 nt, Human
caagauugugucccauuccc

SEQ ID NO: 1482629 - RNA, 15 nt, Human
caagauuguguccca

SEQ ID NO: 1482630 - RNA, 23 nt, Human
caauugagaaaaauauauacuaa

SEQ ID NO: 1482631 - RNA, 14 nt, Human
caauugagaaaaau

SEQ ID NO: 1482632 - RNA, 21 nt, Human
caauugacaacaguuacauaa

SEQ ID NO: 1482633 - RNA, 22 nt, Human
caauugacaacaguuacauaau

SEQ ID NO: 1482634 - RNA, 19 nt, Human
caauugacugucacuguuc

SEQ ID NO: 1482635 - RNA, 21 nt, Human
caauugcacgcggagugaguu

SEQ ID NO: 1482636 - RNA, 23 nt, Human
caauugcacgcggagugaguuuu

SEQ ID NO: 1482637 - RNA, 14 nt, Human
caauugacaacagu

SEQ ID NO: 1482638 - RNA, 20 nt, Human
caauuucuacaaaauccuga

SEQ ID NO: 1482639 - RNA, 13 nt, Human
caauuucugaaca

SEQ ID NO: 1482640 - RNA, 22 nt, Human
caaucccuuaauauccuaaaca

SEQ ID NO: 1482641 - RNA, 20 nt, Human
caccaggcuugccugcaggc

SEQ ID NO: 1482642 - RNA, 17 nt, Human
caccaaagagaaugccc

SEQ ID NO: 1482643 - RNA, 13 nt, Human
caccaaagagaau

SEQ ID NO: 1482644 - RNA, 15 nt, Human
caccaaaagaaguaa

SEQ ID NO: 1482645 - RNA, 18 nt, Human
cacacaugcuucccuuuc

SEQ ID NO: 1482646 - RNA, 16 nt, Human
cacagaaaccaauuuu

SEQ ID NO: 1482647 - RNA, 20 nt, Human
cacagcucuccggucucucu

SEQ ID NO: 1482648 - RNA, 21 nt, Human
cacagcucuccggucucucuc

SEQ ID NO: 1482649 - RNA, 17 nt, Human
auuaugggucacaggaa

SEQ ID NO: 1482650 - RNA, 15 nt, Human
auuaugggucacagg

SEQ ID NO: 1482651 - RNA, 16 nt, Human
auuaugggucacagga

SEQ ID NO: 1482652 - RNA, 16 nt, Human
auucaaaugucuauaa

SEQ ID NO: 1482653 - RNA, 12 nt, Human
auucaacaaaca

SEQ ID NO: 1482654 - RNA, 13 nt, Human
auucaacaaacau

SEQ ID NO: 1482655 - RNA, 22 nt, Human
auucaaucuguaaacuguguau

SEQ ID NO: 1482656 - RNA, 17 nt, Human
auucaaucuguaaacug

SEQ ID NO: 1482657 - RNA, 18 nt, Human
auucaaucuguaaacugu

SEQ ID NO: 1482658 - RNA, 14 nt, Human
auucaaucuguaaa

SEQ ID NO: 1482659 - RNA, 15 nt, Human
auucaaucuguaaac

SEQ ID NO: 1482660 - RNA, 16 nt, Human
auucaaucuguaaacu

SEQ ID NO: 1482661 - RNA, 20 nt, Human
auuaguacuccccuccuuga

SEQ ID NO: 1482662 - RNA, 18 nt, Human
auuaguaagcuagcaaau

SEQ ID NO: 1482663 - RNA, 19 nt, Human
auuaugaauuacauuugua

SEQ ID NO: 1482664 - RNA, 20 nt, Human
auuaugaauuacauuuguau

SEQ ID NO: 1482665 - RNA, 22 nt, Human
auuaugaauuacauuuguauaa

SEQ ID NO: 1482666 - RNA, 19 nt, Human
auuaguacacagcaccaga

SEQ ID NO: 1482667 - RNA, 16 nt, Human
auuaugcauuauauca

SEQ ID NO: 1482668 - RNA, 14 nt, Human
auuaggcagacucu

SEQ ID NO: 1482669 - RNA, 21 nt, Human
auuaggcagacucuuuaugcu

SEQ ID NO: 1482670 - RNA, 18 nt, Human
auucuugauguaaaaucu

SEQ ID NO: 1482671 - RNA, 19 nt, Human
auucuugauguaaaaucuu

SEQ ID NO: 1482672 - RNA, 20 nt, Human
auucuugauguaaaaucuug

SEQ ID NO: 1482673 - RNA, 17 nt, Human
auuccuucagcacuuua

SEQ ID NO: 1482674 - RNA, 15 nt, Human
auuccuucagcacuu

SEQ ID NO: 1482675 - RNA, 22 nt, Human
auuccuguggauguaaagugau

SEQ ID NO: 1482676 - RNA, 11 nt, Human
auuccuccagg

SEQ ID NO: 1482677 - RNA, 23 nt, Human
auuccucaugaauguaaauuugu

SEQ ID NO: 1482678 - RNA, 16 nt, Human
auuccucaugaaugua

SEQ ID NO: 1482679 - RNA, 17 nt, Human
auuccucaugaauguaa

SEQ ID NO: 1482680 - RNA, 18 nt, Human
auuccucaugaauguaaa

SEQ ID NO: 1482681 - RNA, 19 nt, Human
auuccucaugaauguaaau

SEQ ID NO: 1482682 - RNA, 13 nt, Human
auuccuccugcuc

SEQ ID NO: 1482683 - RNA, 14 nt, Human
auuccuccugcuca

SEQ ID NO: 1482684 - RNA, 15 nt, Human
auuccuccugcucau

SEQ ID NO: 1482685 - RNA, 16 nt, Human
auuccuccugcucaua

SEQ ID NO: 1482686 - RNA, 20 nt, Human
auuccuccugcucauauugu

SEQ ID NO: 1482687 - RNA, 22 nt, Human
auuccucaugaauguaaauuug

SEQ ID NO: 1482688 - RNA, 22 nt, Human
auuccuauugugcaauguaaau

SEQ ID NO: 1482689 - RNA, 20 nt, Human
auuguguucccauuucagcu

SEQ ID NO: 1482690 - RNA, 18 nt, Human
auuguaagcaugcacaaa

SEQ ID NO: 1482691 - RNA, 14 nt, Human
auuguuaaaggcua

SEQ ID NO: 1482692 - RNA, 16 nt, Human
auuguugucugcaacu

SEQ ID NO: 1482693 - RNA, 15 nt, Human
auuguguucccauuu

SEQ ID NO: 1482694 - RNA, 18 nt, Human
auuguaacccugucugga

SEQ ID NO: 1482695 - RNA, 14 nt, Human
auugcuguccugga

SEQ ID NO: 1482696 - RNA, 23 nt, Human
auuucuauagccaaaaauagcua

SEQ ID NO: 1482697 - RNA, 14 nt, Human
auuucuaugaaaua

SEQ ID NO: 1482698 - RNA, 17 nt, Human
auuucuauagccaaaaa

SEQ ID NO: 1482699 - RNA, 22 nt, Human
auuuaugcauauuauuuuaugu

SEQ ID NO: 1482700 - RNA, 16 nt, Human
auuuaugcauauuauu

SEQ ID NO: 1482701 - RNA, 13 nt, Human
auuuauauugaua

SEQ ID NO: 1482702 - RNA, 20 nt, Human
auuuauauugauaagaucuu

SEQ ID NO: 1482703 - RNA, 21 nt, Human
auuuauauugauaagaucuuu

SEQ ID NO: 1482704 - RNA, 22 nt, Human
auuuauauugauaagaucuuuu

SEQ ID NO: 1482705 - RNA, 15 nt, Human
auuuauauuguaaau

SEQ ID NO: 1482706 - RNA, 19 nt, Human
auuuaucugagucaacucc

SEQ ID NO: 1482707 - RNA, 22 nt, Human
auuuaucuuuacuuuuaaacag

SEQ ID NO: 1482708 - RNA, 23 nt, Human
auuuaugaauugaauuaucuugg

SEQ ID NO: 1482709 - RNA, 17 nt, Human
auuuaugagcucuucau

SEQ ID NO: 1482710 - RNA, 17 nt, Human
caacucauauuuucaug

SEQ ID NO: 1482711 - RNA, 21 nt, Human
caacuaccugagcuaaauaaa

SEQ ID NO: 1482712 - RNA, 19 nt, Human
caacuacagucuaaagcug

SEQ ID NO: 1482713 - RNA, 15 nt, Human
caacuacagucuaaa

SEQ ID NO: 1482714 - RNA, 17 nt, Human
caacuacccccagcugu

SEQ ID NO: 1482715 - RNA, 19 nt, Human
caacuacccccagcugugc

SEQ ID NO: 1482716 - RNA, 20 nt, Human
caacuacccccagcugugcu

SEQ ID NO: 1482717 - RNA, 15 nt, Human
caacuaccugagcua

SEQ ID NO: 1482718 - RNA, 11 nt, Human
caacuaccuga

SEQ ID NO: 1482719 - RNA, 13 nt, Human
caaccaucgcuuu

SEQ ID NO: 1482720 - RNA, 21 nt, Human
caaccagaccauugucucaga

SEQ ID NO: 1482721 - RNA, 19 nt, Human
caaccagauugucagcucc

SEQ ID NO: 1482722 - RNA, 20 nt, Human
caaccagauugucagcuccu

SEQ ID NO: 1482723 - RNA, 21 nt, Human
caaccccuccccuccaucccu

SEQ ID NO: 1482724 - RNA, 22 nt, Human
caaccccuccccuccaucccug

SEQ ID NO: 1482725 - RNA, 22 nt, Human
caagauggggagugagaggcug

SEQ ID NO: 1482726 - RNA, 20 nt, Human
caagaauuucuaggacugaa

SEQ ID NO: 1482727 - RNA, 14 nt, Human
caacucgcuuuagg

SEQ ID NO: 1482728 - RNA, 19 nt, Human
caacucgcuuuaggucagc

SEQ ID NO: 1482729 - RNA, 16 nt, Human
caacucguauagcaug

SEQ ID NO: 1482730 - RNA, 21 nt, Human
caagaauuggaagcugcccug

SEQ ID NO: 1482731 - RNA, 19 nt, Human
caacucguauagcaugcau

SEQ ID NO: 1482732 - RNA, 18 nt, Human
caacacacacaugcuucc

SEQ ID NO: 1482733 - RNA, 23 nt, Human
caacacacacaugcuucccuuuc

SEQ ID NO: 1482734 - RNA, 15 nt, Human
caacacacacaugcu

SEQ ID NO: 1482735 - RNA, 19 nt, Human
caacaaccucaacugccua

SEQ ID NO: 1482736 - RNA, 18 nt, Human
caacaaccucaacugccu

SEQ ID NO: 1482737 - RNA, 21 nt, Human
caacaagaagggacugagaga

SEQ ID NO: 1482738 - RNA, 20 nt, Human
caacaagaagggacugagag

SEQ ID NO: 1482739 - RNA, 22 nt, Human
caaagguaaaucagacuaugaa

SEQ ID NO: 1482740 - RNA, 14 nt, Human
caaagguaaaucag

SEQ ID NO: 1482741 - RNA, 16 nt, Human
caaagcaugaaaugga

SEQ ID NO: 1482742 - RNA, 19 nt, Human
caaaguccugggauuacag

SEQ ID NO: 1482743 - RNA, 22 nt, Human
caaaucuugguugaugccaaaa

SEQ ID NO: 1482744 - RNA, 14 nt, Human
auuuuauguugcau

SEQ ID NO: 1482745 - RNA, 16 nt, Human
auuuucugugccugaa

SEQ ID NO: 1482746 - RNA, 18 nt, Human
auuuucugugccugaaua

SEQ ID NO: 1482747 - RNA, 20 nt, Human
auuuucugugccugaauauu

SEQ ID NO: 1482748 - RNA, 14 nt, Human
auuuuauggugcau

SEQ ID NO: 1482749 - RNA, 22 nt, Human
auuuuauguuaagggaagaauu

SEQ ID NO: 1482750 - RNA, 16 nt, Human
auuuuauggugcauua

SEQ ID NO: 1482751 - RNA, 15 nt, Human
auuuuauaugcuuac

SEQ ID NO: 1482752 - RNA, 16 nt, Human
auuuuauaugcuuacu

SEQ ID NO: 1482753 - RNA, 18 nt, Human
auuuuauaugcuuacuga

SEQ ID NO: 1482754 - RNA, 19 nt, Human
auuuuagggguagcauuug

SEQ ID NO: 1482755 - RNA, 18 nt, Human
auuuuagcgugcucacug

SEQ ID NO: 1482756 - RNA, 21 nt, Human
auuuucugugccugaauauuu

SEQ ID NO: 1482757 - RNA, 20 nt, Human
auuuugaaccugaugaaaau

SEQ ID NO: 1482758 - RNA, 22 nt, Human
auuuugaaccugaugaaaauaa

SEQ ID NO: 1482759 - RNA, 18 nt, Human
auuuuuaauauauacuau

SEQ ID NO: 1482760 - RNA, 19 nt, Human
auuuuuaauauauacuaug

SEQ ID NO: 1482761 - RNA, 20 nt, Human
caaaagaagaaguuucauca

SEQ ID NO: 1482762 - RNA, 12 nt, Human
caaaagaaguaa

SEQ ID NO: 1482763 - RNA, 19 nt, Human
caaaagaaguaaaagcaaa

SEQ ID NO: 1482764 - RNA, 17 nt, Human
caaaagaaguaaaagca

SEQ ID NO: 1482765 - RNA, 18 nt, Human
caaaagaaguaaaagcaa

SEQ ID NO: 1482766 - RNA, 19 nt, Human
caaaagaauggcagaaaag

SEQ ID NO: 1482767 - RNA, 20 nt, Human
caaaagaauggcagaaaagu

SEQ ID NO: 1482768 - RNA, 15 nt, Human
auuuuuauauuugaa

SEQ ID NO: 1482769 - RNA, 16 nt, Human
auuuuuauauuugaaa

SEQ ID NO: 1482770 - RNA, 21 nt, Human
caaaaggauaaugaauacuuu

SEQ ID NO: 1482771 - RNA, 13 nt, Human
caaaagcuuuuua

SEQ ID NO: 1482772 - RNA, 17 nt, Human
caaacauauauaacaau

SEQ ID NO: 1482773 - RNA, 17 nt, Human
caaagaguucaagaaau

SEQ ID NO: 1482774 - RNA, 21 nt, Human
caaagaguucaagaaauaagu

SEQ ID NO: 1482775 - RNA, 17 nt, Human
caaagauaucucaucuc

SEQ ID NO: 1482776 - RNA, 23 nt, Human
cauccuucaucuggauuccagag

SEQ ID NO: 1482777 - RNA, 18 nt, Human
cauccuuccucacaccag

SEQ ID NO: 1482778 - RNA, 18 nt, Human
cauccauguuccgagaag

SEQ ID NO: 1482779 - RNA, 19 nt, Human
cauccauguuccgagaaga

SEQ ID NO: 1482780 - RNA, 22 nt, Human
cauaauuuaguuucauauaaag

SEQ ID NO: 1482781 - RNA, 20 nt, Human
cauacaccuaugucauuuca

SEQ ID NO: 1482782 - RNA, 23 nt, Human
cauacacuuauuggaacucugcu

SEQ ID NO: 1482783 - RNA, 23 nt, Human
cauacagaauuacuguaacugau

SEQ ID NO: 1482784 - RNA, 12 nt, Human
caugcacaaauu

SEQ ID NO: 1482785 - RNA, 16 nt, Human
caugcacccucauaca

SEQ ID NO: 1482786 - RNA, 20 nt, Human
caugcacccucauacacaga

SEQ ID NO: 1482787 - RNA, 23 nt, Human
caugcuaucucugugugcacaaa

SEQ ID NO: 1482788 - RNA, 16 nt, Human
caugaaggugucauac

SEQ ID NO: 1482789 - RNA, 15 nt, Human
caugaagcuguugug

SEQ ID NO: 1482790 - RNA, 16 nt, Human
cauggccagcuaauuu

SEQ ID NO: 1482791 - RNA, 14 nt, Human
cauucuauuguuaa

SEQ ID NO: 1482792 - RNA, 21 nt, Human
cauuaguacacagcaccagaa

SEQ ID NO: 1482793 - RNA, 18 nt, Human
caugucaaggguucaaga

SEQ ID NO: 1482794 - RNA, 20 nt, Human
caugucaaggguucaagauu

SEQ ID NO: 1482795 - RNA, 23 nt, Human
cauguaucuaugcauuuucugga

SEQ ID NO: 1482796 - RNA, 20 nt, Human
cauguaucuaugcauuuucu

SEQ ID NO: 1482797 - RNA, 13 nt, Human
cauuuauauguac

SEQ ID NO: 1482798 - RNA, 13 nt, Human
cauuuauauugau

SEQ ID NO: 1482799 - RNA, 21 nt, Human
cauuuggauccuguguggaga

SEQ ID NO: 1482800 - RNA, 16 nt, Human
ccacagaagcuccagg

SEQ ID NO: 1482801 - RNA, 18 nt, Human
ccaccagucugacuguuu

SEQ ID NO: 1482802 - RNA, 18 nt, Human
ccacagcccuuuugucuc

SEQ ID NO: 1482803 - RNA, 20 nt, Human
ccacagcccuuuugucucug

SEQ ID NO: 1482804 - RNA, 18 nt, Human
ccacagaagcuccaggua

SEQ ID NO: 1482805 - RNA, 16 nt, Human
ccacagaagugcuuuc

SEQ ID NO: 1482806 - RNA, 16 nt, Human
ccacagauaacugaaa

SEQ ID NO: 1482807 - RNA, 18 nt, Human
ccacagauaacugaaaau

SEQ ID NO: 1482808 - RNA, 12 nt, Human
ccacgccacagc

SEQ ID NO: 1482809 - RNA, 21 nt, Human
ccacgccacagcccuuuuguc

SEQ ID NO: 1482810 - RNA, 18 nt, Human
ccacgccacagcccuuuu

SEQ ID NO: 1482811 - RNA, 14 nt, Human
ccacgccacagccc

SEQ ID NO: 1482812 - RNA, 13 nt, Human
ccacgccacagcc

SEQ ID NO: 1482813 - RNA, 22 nt, Human
cagugcacuaauguguaagaca

SEQ ID NO: 1482814 - RNA, 17 nt, Human
cagugcaccugucauau

SEQ ID NO: 1482815 - RNA, 18 nt, Human
cagucugagagaggccau

SEQ ID NO: 1482816 - RNA, 22 nt, Human
cagucugaugagaacucugagc

SEQ ID NO: 1482817 - RNA, 19 nt, Human
cagucucagaaugucauuu

SEQ ID NO: 1482818 - RNA, 21 nt, Human
cagucucagaaugucauuuug

SEQ ID NO: 1482819 - RNA, 15 nt, Human
cagucaccucaugga

SEQ ID NO: 1482820 - RNA, 23 nt, Human
caggugcagcccccacugccuuu

SEQ ID NO: 1482821 - RNA, 20 nt, Human
caggugcagcccccacugcc

SEQ ID NO: 1482822 - RNA, 18 nt, Human
caggugcagcccccacug

SEQ ID NO: 1482823 - RNA, 17 nt, Human
caggagcuuuggaccua

SEQ ID NO: 1482824 - RNA, 20 nt, Human
caggaggugccacuggagug

SEQ ID NO: 1482825 - RNA, 17 nt, Human
caggaggugccacugga

SEQ ID NO: 1482826 - RNA, 19 nt, Human
caggaggugccacuggagu

SEQ ID NO: 1482827 - RNA, 17 nt, Human
cagggaggcccugugcc

SEQ ID NO: 1482828 - RNA, 20 nt, Human
caggccuagaggccugacug

SEQ ID NO: 1482829 - RNA, 16 nt, Human
cagcuccaagaauuuc

SEQ ID NO: 1482830 - RNA, 19 nt, Human
cagcuccaagaauuucuag

SEQ ID NO: 1482831 - RNA, 16 nt, Human
cagcuccaguuggagu

SEQ ID NO: 1482832 - RNA, 19 nt, Human
cagcugccucuucccucuu

SEQ ID NO: 1482833 - RNA, 21 nt, Human
cagcugcccccagagccacag

SEQ ID NO: 1482834 - RNA, 22 nt, Human
cagcugcccccagagccacagu

SEQ ID NO: 1482835 - RNA, 20 nt, Human
cagcugcccccagagccaca

SEQ ID NO: 1482836 - RNA, 18 nt, Human
cagcugcccccagagcca

SEQ ID NO: 1482837 - RNA, 17 nt, Human
cagcugcccccagagcc

SEQ ID NO: 1482838 - RNA, 16 nt, Human
cagcugcccccagagc

SEQ ID NO: 1482839 - RNA, 19 nt, Human
caggaaagcgccuccaacc

SEQ ID NO: 1482840 - RNA, 20 nt, Human
caggaaagcgccuccaaccc

SEQ ID NO: 1482841 - RNA, 15 nt, Human
caggaacaaacaggg

SEQ ID NO: 1482842 - RNA, 22 nt, Human
caggaacaaacagggcugccuu

SEQ ID NO: 1482843 - RNA, 14 nt, Human
caggaacaaacagg

SEQ ID NO: 1482844 - RNA, 15 nt, Human
cagcccuucuuucca

SEQ ID NO: 1482845 - RNA, 19 nt, Human
cagcccuucuuuccacaga

SEQ ID NO: 1482846 - RNA, 20 nt, Human
cagcccuucuuuccacagaa

SEQ ID NO: 1482847 - RNA, 22 nt, Human
cagccucugggggguggccagg

SEQ ID NO: 1482848 - RNA, 23 nt, Human
cagccucugggggguggccaggc

SEQ ID NO: 1482849 - RNA, 22 nt, Human
cagcacagccucuuagaugcag

SEQ ID NO: 1482850 - RNA, 16 nt, Human
cagauaugauucaaau

SEQ ID NO: 1482851 - RNA, 17 nt, Human
cagauaugauucaaaug

SEQ ID NO: 1482852 - RNA, 19 nt, Human
cagauaugauucaaauguc

SEQ ID NO: 1482853 - RNA, 17 nt, Human
auuccagagcacugcuc

SEQ ID NO: 1482854 - RNA, 17 nt, Human
auuccagccaucaccuu

SEQ ID NO: 1482855 - RNA, 17 nt, Human
auucccagagcaaaaua

SEQ ID NO: 1482856 - RNA, 19 nt, Human
auucccagagcaaaauaau

SEQ ID NO: 1482857 - RNA, 13 nt, Human
auucccccagugc

SEQ ID NO: 1482858 - RNA, 20 nt, Human
auucacauuguauucagagu

SEQ ID NO: 1482859 - RNA, 13 nt, Human
auucacauuguau

SEQ ID NO: 1482860 - RNA, 14 nt, Human
auucagaagaaaaa

SEQ ID NO: 1482861 - RNA, 16 nt, Human
auucagaagaaaaaga

SEQ ID NO: 1482862 - RNA, 17 nt, Human
auucagaagaaaaagaa

SEQ ID NO: 1482863 - RNA, 18 nt, Human
auucagaagaaaaagaag

SEQ ID NO: 1482864 - RNA, 13 nt, Human
auucagacagaug

SEQ ID NO: 1482865 - RNA, 14 nt, Human
auucagacagauga

SEQ ID NO: 1482866 - RNA, 20 nt, Human
auucagacagaugaggcuuu

SEQ ID NO: 1482867 - RNA, 12 nt, Human
auuauuuuguga

SEQ ID NO: 1482868 - RNA, 18 nt, Human
auucacaucgcagauucu

SEQ ID NO: 1482869 - RNA, 15 nt, Human
auucacaucucauuu

SEQ ID NO: 1482870 - RNA, 16 nt, Human
auucacaucucauuuu

SEQ ID NO: 1482871 - RNA, 15 nt, Human
auuauuauuuggccc

SEQ ID NO: 1482872 - RNA, 14 nt, Human
auuauuacuuuugc

SEQ ID NO: 1482873 - RNA, 15 nt, Human
auuauuacuuuugcu

SEQ ID NO: 1482874 - RNA, 20 nt, Human
auuauuacuuauuuuugaca

SEQ ID NO: 1482875 - RNA, 21 nt, Human
auuauuacuuauuuuugacag

SEQ ID NO: 1482876 - RNA, 15 nt, Human
auuauauuuauuacu

SEQ ID NO: 1482877 - RNA, 18 nt, Human
auuauauuuauuacugua

SEQ ID NO: 1482878 - RNA, 21 nt, Human
auuauguuaaaacugggacag

SEQ ID NO: 1482879 - RNA, 13 nt, Human
auuaucuaauuua

SEQ ID NO: 1482880 - RNA, 14 nt, Human
auuaucuaauuuau

SEQ ID NO: 1482881 - RNA, 18 nt, Human
auuauauguucagauuau

SEQ ID NO: 1482882 - RNA, 14 nt, Human
auuauauuaugaag

SEQ ID NO: 1482883 - RNA, 15 nt, Human
auuauauuuacaaau

SEQ ID NO: 1482884 - RNA, 20 nt, Human
auucuucccuaucuuugcca

SEQ ID NO: 1482885 - RNA, 12 nt, Human
auucuuccuagu

SEQ ID NO: 1482886 - RNA, 21 nt, Human
auucuucccuaucuuugccac

SEQ ID NO: 1482887 - RNA, 17 nt, Human
auucuuccuaguuuucu

SEQ ID NO: 1482888 - RNA, 19 nt, Human
auucuuccuaguuuucucc

SEQ ID NO: 1482889 - RNA, 13 nt, Human
auucuuccaucug

SEQ ID NO: 1482890 - RNA, 14 nt, Human
auucuuccaucuga

SEQ ID NO: 1482891 - RNA, 15 nt, Human
auucuuccaucugau

SEQ ID NO: 1482892 - RNA, 23 nt, Human
auucuuccaucugauugugaugu

SEQ ID NO: 1482893 - RNA, 17 nt, Human
auugacaacaguuacau

SEQ ID NO: 1482894 - RNA, 21 nt, Human
auuuuuauuuuugcugagacu

SEQ ID NO: 1482895 - RNA, 20 nt, Human
auuuuuccuccacugaacua

SEQ ID NO: 1482896 - RNA, 15 nt, Human
auuuuucacuucaaa

SEQ ID NO: 1482897 - RNA, 18 nt, Human
auuuuucaugauaaugaa

SEQ ID NO: 1482898 - RNA, 19 nt, Human
auuuuucaugauuuugaaa

SEQ ID NO: 1482899 - RNA, 15 nt, Human
auuuuugacaguguu

SEQ ID NO: 1482900 - RNA, 21 nt, Human
auuuuugauacuaagcauuga

SEQ ID NO: 1482901 - RNA, 19 nt, Human
auuuuugauacuaagcauu

SEQ ID NO: 1482902 - RNA, 12 nt, Human
auuuuugccucu

SEQ ID NO: 1482903 - RNA, 18 nt, Human
auuuuugccucuuccagu

SEQ ID NO: 1482904 - RNA, 21 nt, Human
auuuuugccucuuccagucuu

SEQ ID NO: 1482905 - RNA, 15 nt, Human
auuuuugcugagacu

SEQ ID NO: 1482906 - RNA, 23 nt, Human
auuuuuggaagaggacuccuuaa

SEQ ID NO: 1482907 - RNA, 21 nt, Human
auuuuuggggggaguaaagaa

SEQ ID NO: 1482908 - RNA, 19 nt, Human
auuuuuggcagucugaauu

SEQ ID NO: 1482909 - RNA, 19 nt, Human
auuuuuugaaaagcagaca

SEQ ID NO: 1482910 - RNA, 16 nt, Human
auuuuuugaaaagcag

SEQ ID NO: 1482911 - RNA, 20 nt, Human
auuuuuucucuaggaaauau

SEQ ID NO: 1482912 - RNA, 23 nt, Human
auuuuuucucuaggaaauauuua

SEQ ID NO: 1482913 - RNA, 22 nt, Human
auuuuuugggcagcaauuuaaa

SEQ ID NO: 1482914 - RNA, 14 nt, Human
auuuuuuaauaauu

SEQ ID NO: 1482915 - RNA, 16 nt, Human
auuuuuuaucaugcau

SEQ ID NO: 1482916 - RNA, 21 nt, Human
auuuuuuaucaugcauguccu

SEQ ID NO: 1482917 - RNA, 20 nt, Human
auuuuuuccuucaaaguuua

SEQ ID NO: 1482918 - RNA, 21 nt, Human
auuuuuuccuucaaaguuuaa

SEQ ID NO: 1482919 - RNA, 23 nt, Human
auuuuuuccuucaaaguuuaaua

SEQ ID NO: 1482920 - RNA, 22 nt, Human
auuuuugugauuuugugauuga

SEQ ID NO: 1482921 - RNA, 15 nt, Human
auuuuuguaguagcg

SEQ ID NO: 1482922 - RNA, 14 nt, Human
auuuuuuaaaaaag

SEQ ID NO: 1482923 - RNA, 17 nt, Human
auuuuuuaaaaaagcuu

SEQ ID NO: 1482924 - RNA, 18 nt, Human
auuuuuuaaaaaagcuua

SEQ ID NO: 1482925 - RNA, 19 nt, Human
auuuuuuaaaaaagcuuaa

SEQ ID NO: 1482926 - RNA, 20 nt, Human
auuuuuuaaaaaagcuuaaa

SEQ ID NO: 1482927 - RNA, 17 nt, Human
auuuuaauaaacacucu

SEQ ID NO: 1482928 - RNA, 16 nt, Human
auuuuaauaaacacuc

SEQ ID NO: 1482929 - RNA, 15 nt, Human
auuuuaauaaacacu

SEQ ID NO: 1482930 - RNA, 12 nt, Human
auuuuaauaaug

SEQ ID NO: 1482931 - RNA, 13 nt, Human
auuuuaauaauau

SEQ ID NO: 1482932 - RNA, 15 nt, Human
auuuucuauaauuua

SEQ ID NO: 1482933 - RNA, 14 nt, Human
auuuucuauaauuu

SEQ ID NO: 1482934 - RNA, 18 nt, Human
auuuuccuggugccaauu

SEQ ID NO: 1482935 - RNA, 22 nt, Human
auuuuccuggugccaauuucaa

SEQ ID NO: 1482936 - RNA, 14 nt, Human
auuuuccugaaaac

SEQ ID NO: 1482937 - RNA, 23 nt, Human
auuuuccuggugccaauuucaag

SEQ ID NO: 1482938 - RNA, 14 nt, Human
auuuugaugaacaa

SEQ ID NO: 1482939 - RNA, 20 nt, Human
auuuugccaagggcauaaau

SEQ ID NO: 1482940 - RNA, 14 nt, Human
auuuugcuggaaua

SEQ ID NO: 1482941 - RNA, 19 nt, Human
auuuugccaagggcauaaa

SEQ ID NO: 1482942 - RNA, 21 nt, Human
auuuugcaaucccuuaauauc

SEQ ID NO: 1482943 - RNA, 17 nt, Human
auuuuguguuuaggaac

SEQ ID NO: 1482944 - RNA, 18 nt, Human
auuuugugaugcaaauaa

SEQ ID NO: 1482945 - RNA, 16 nt, Human
auuuuguuucagugca

SEQ ID NO: 1482946 - RNA, 15 nt, Human
auuuuguuuaaauua

SEQ ID NO: 1482947 - RNA, 19 nt, Human
auuuuguugcuguuuugau

SEQ ID NO: 1482948 - RNA, 23 nt, Human
auuuuguugcuguuuugauuugu

SEQ ID NO: 1482949 - RNA, 17 nt, Human
auuuugugaugcaaaua

SEQ ID NO: 1482950 - RNA, 19 nt, Human
auuuuguaaacucaaaaua

SEQ ID NO: 1482951 - RNA, 20 nt, Human
auuuuguaaacucaaaauau

SEQ ID NO: 1482952 - RNA, 18 nt, Human
auuuuguaacgaagacac

SEQ ID NO: 1482953 - RNA, 19 nt, Human
auuuuguaacgaagacaca

SEQ ID NO: 1482954 - RNA, 17 nt, Human
auuuuguaacuuucucu

SEQ ID NO: 1482955 - RNA, 12 nt, Human
auuuuguaaguu

SEQ ID NO: 1482956 - RNA, 22 nt, Human
auuuguaguguuggagaagaac

SEQ ID NO: 1482957 - RNA, 14 nt, Human
auuuguauaaaaua

SEQ ID NO: 1482958 - RNA, 15 nt, Human
auuuguauaaaauaa

SEQ ID NO: 1482959 - RNA, 20 nt, Human
auuuggcaucccugggccuu

SEQ ID NO: 1482960 - RNA, 23 nt, Human
auuuuaaaagaaugauuaugaau

SEQ ID NO: 1482961 - RNA, 22 nt, Human
auuuuaaccuaugauauuuucu

SEQ ID NO: 1482962 - RNA, 21 nt, Human
auuugugaagguggaaauaaa

SEQ ID NO: 1482963 - RNA, 18 nt, Human
auuugugaagguggaaau

SEQ ID NO: 1482964 - RNA, 16 nt, Human
auuuuaaaagaaugau

SEQ ID NO: 1482965 - RNA, 23 nt, Human
auuugugaagguggaaauaaacu

SEQ ID NO: 1482966 - RNA, 17 nt, Human
auuucuaggacugaauu

SEQ ID NO: 1482967 - RNA, 18 nt, Human
auuucuaggacugaauua

SEQ ID NO: 1482968 - RNA, 14 nt, Human
auuucccucucuca

SEQ ID NO: 1482969 - RNA, 20 nt, Human
auuucccuuccuuccucucc

SEQ ID NO: 1482970 - RNA, 16 nt, Human
auuucccuuccuuccu

SEQ ID NO: 1482971 - RNA, 20 nt, Human
auuucuaggacugaauuaug

SEQ ID NO: 1482972 - RNA, 23 nt, Human
auuucuaggacugaauuaugaaa

SEQ ID NO: 1482973 - RNA, 11 nt, Human
auuucuaggua

SEQ ID NO: 1482974 - RNA, 20 nt, Human
auuucuagguaggaaaugug

SEQ ID NO: 1482975 - RNA, 19 nt, Human
auuucuagguaggaaaugu

SEQ ID NO: 1482976 - RNA, 18 nt, Human
auuugaaacacuuugcau

SEQ ID NO: 1482977 - RNA, 20 nt, Human
auuucuugagguaaaagcau

SEQ ID NO: 1482978 - RNA, 14 nt, Human
auuuauuuuaauaa

SEQ ID NO: 1482979 - RNA, 17 nt, Human
auuuauuuuaauaaugu

SEQ ID NO: 1482980 - RNA, 14 nt, Human
auuuauuuaaaaua

SEQ ID NO: 1482981 - RNA, 16 nt, Human
auuuauuuaaaauagc

SEQ ID NO: 1482982 - RNA, 18 nt, Human
auugggagcuugggaaug

SEQ ID NO: 1482983 - RNA, 21 nt, Human
auugggagcuugggaauggau

SEQ ID NO: 1482984 - RNA, 19 nt, Human
auuggacaguaaaauccac

SEQ ID NO: 1482985 - RNA, 13 nt, Human
auuggaaacaagu

SEQ ID NO: 1482986 - RNA, 17 nt, Human
auuggacaaagaaccuu

SEQ ID NO: 1482987 - RNA, 13 nt, Human
auugacuuuuuau

SEQ ID NO: 1482988 - RNA, 18 nt, Human
auugacuuuuuauggcac

SEQ ID NO: 1482989 - RNA, 21 nt, Human
auugcuuuguauuguauauua

SEQ ID NO: 1482990 - RNA, 14 nt, Human
auuguuuuacaaua

SEQ ID NO: 1482991 - RNA, 13 nt, Human
auuguuuuacaau

SEQ ID NO: 1482992 - RNA, 16 nt, Human
auuguggguguuaauu

SEQ ID NO: 1482993 - RNA, 18 nt, Human
auuguuuuacaauaguuc

SEQ ID NO: 1482994 - RNA, 17 nt, Human
auuguuuuacaauaguu

SEQ ID NO: 1482995 - RNA, 15 nt, Human
auuguuuuacaauag

SEQ ID NO: 1482996 - RNA, 18 nt, Human
auuuaaaccgcuaaaaga

SEQ ID NO: 1482997 - RNA, 19 nt, Human
auuuaaaccgcuaaaagaa

SEQ ID NO: 1482998 - RNA, 20 nt, Human
auuuaaaccgcuaaaagaaa

SEQ ID NO: 1482999 - RNA, 21 nt, Human
auuuaaaccgcuaaaagaaac

SEQ ID NO: 1483000 - RNA, 22 nt, Human
auuuaaaccgcuaaaagaaacu

SEQ ID NO: 1483001 - RNA, 23 nt, Human
auuuaaaccgcuaaaagaaacuu

SEQ ID NO: 1483002 - RNA, 24 nt, Human
auuuaaaccgcuaaaagaaacuuu

SEQ ID NO: 1483003 - RNA, 12 nt, Human
auuuaaacuaua

SEQ ID NO: 1483004 - RNA, 19 nt, Human
auuuaaacuauaagcaaga

SEQ ID NO: 1483005 - RNA, 20 nt, Human
auuuaaacuauaagcaagaa

SEQ ID NO: 1483006 - RNA, 13 nt, Human
auugucuagugaa

SEQ ID NO: 1483007 - RNA, 12 nt, Human
auugucucagag

SEQ ID NO: 1483008 - RNA, 14 nt, Human
auugucucagagca

SEQ ID NO: 1483009 - RNA, 21 nt, Human
auuguggggaugaugaaauaa

SEQ ID NO: 1483010 - RNA, 20 nt, Human
auuguggggaugaugaaaua

SEQ ID NO: 1483011 - RNA, 17 nt, Human
uuugaaauuaugugaca

SEQ ID NO: 1483012 - RNA, 15 nt, Human
uuugaaauuauguga

SEQ ID NO: 1483013 - RNA, 22 nt, Human
uuugaaauuaugugacauuuua

SEQ ID NO: 1483014 - RNA, 21 nt, Human
auggggcauccucuuuuucca

SEQ ID NO: 1483015 - RNA, 15 nt, Human
uuugaaaaagcgaaa

SEQ ID NO: 1483016 - RNA, 23 nt, Human
uuugaaaaagcgaaaaaaucagg

SEQ ID NO: 1483017 - RNA, 20 nt, Human
uuugaaaaagcgaaaaaauc

SEQ ID NO: 1483018 - RNA, 14 nt, Human
auggggguuucacc

SEQ ID NO: 1483019 - RNA, 15 nt, Human
augggguggaaggca

SEQ ID NO: 1483020 - RNA, 12 nt, Human
augggucacagg

SEQ ID NO: 1483021 - RNA, 14 nt, Human
augggucacaggaa

SEQ ID NO: 1483022 - RNA, 13 nt, Human
augggucacagga

SEQ ID NO: 1483023 - RNA, 17 nt, Human
augggauucuggacagg

SEQ ID NO: 1483024 - RNA, 14 nt, Human
augggauucuggac

SEQ ID NO: 1483025 - RNA, 22 nt, Human
uuucuguaagaaaccuacugcc

SEQ ID NO: 1483026 - RNA, 19 nt, Human
uuucugggcugucuauucu

SEQ ID NO: 1483027 - RNA, 21 nt, Human
uuucugggcugucuauucuag

SEQ ID NO: 1483028 - RNA, 17 nt, Human
uuucugugccugaauau

SEQ ID NO: 1483029 - RNA, 13 nt, Human
auguaaauauuuu

SEQ ID NO: 1483030 - RNA, 15 nt, Human
auguaaauauuuuaa

SEQ ID NO: 1483031 - RNA, 19 nt, Human
auguaaauauuuuaaagaa

SEQ ID NO: 1483032 - RNA, 20 nt, Human
auguaaauauuuuaaagaau

SEQ ID NO: 1483033 - RNA, 21 nt, Human
auguaaauauuuuaaagaauu

SEQ ID NO: 1483034 - RNA, 23 nt, Human
auguaaauauuuuaaagaauugu

SEQ ID NO: 1483035 - RNA, 16 nt, Human
auguaaagugauauuu

SEQ ID NO: 1483036 - RNA, 12 nt, Human
auguaaauuugu

SEQ ID NO: 1483037 - RNA, 20 nt, Human
auguaaaacauuuauuuuga

SEQ ID NO: 1483038 - RNA, 21 nt, Human
auguaaaacauuuauuuugac

SEQ ID NO: 1483039 - RNA, 21 nt, Human
auguaaaagguauuaaauuga

SEQ ID NO: 1483040 - RNA, 12 nt, Human
auguaaaaucuu

SEQ ID NO: 1483041 - RNA, 13 nt, Human
auguaaaaucuug

SEQ ID NO: 1483042 - RNA, 14 nt, Human
auguaaaaucuugu

SEQ ID NO: 1483043 - RNA, 15 nt, Human
auguaaaaucuuguc

SEQ ID NO: 1483044 - RNA, 16 nt, Human
auguaaaaucuuguca

SEQ ID NO: 1483045 - RNA, 20 nt, Human
auguaaaaucuugucaugug

SEQ ID NO: 1483046 - RNA, 21 nt, Human
auguaaaaucuugucaugugu

SEQ ID NO: 1483047 - RNA, 22 nt, Human
auguaaaaucuugucaugugua

SEQ ID NO: 1483048 - RNA, 23 nt, Human
auguaaaaucuugucauguguau

SEQ ID NO: 1483049 - RNA, 14 nt, Human
auguaaagauauuu

SEQ ID NO: 1483050 - RNA, 19 nt, Human
auguaaagaacauaaauaa

SEQ ID NO: 1483051 - RNA, 21 nt, Human
auguaaagauauuuuuaucuu

SEQ ID NO: 1483052 - RNA, 13 nt, Human
auguaaagccaug

SEQ ID NO: 1483053 - RNA, 14 nt, Human
auguaaagccaugc

SEQ ID NO: 1483054 - RNA, 14 nt, Human
auguaaagcuuguc

SEQ ID NO: 1483055 - RNA, 16 nt, Human
auguaaagcuugucug

SEQ ID NO: 1483056 - RNA, 13 nt, Human
augguuguacaua

SEQ ID NO: 1483057 - RNA, 21 nt, Human
augguucccuugaugaagaag

SEQ ID NO: 1483058 - RNA, 14 nt, Human
augguuuucuccaa

SEQ ID NO: 1483059 - RNA, 20 nt, Human
augguuuucuccaagagcua

SEQ ID NO: 1483060 - RNA, 21 nt, Human
augguuuucuccaagagcuac

SEQ ID NO: 1483061 - RNA, 13 nt, Human
auguaaaacauuu

SEQ ID NO: 1483062 - RNA, 14 nt, Human
auguaaaacauuua

SEQ ID NO: 1483063 - RNA, 15 nt, Human
auguaaaacauuuau

SEQ ID NO: 1483064 - RNA, 19 nt, Human
auggugcauuacgugggca

SEQ ID NO: 1483065 - RNA, 22 nt, Human
augguggaugauccccacgcca

SEQ ID NO: 1483066 - RNA, 19 nt, Human
augguggaugauccccacg

SEQ ID NO: 1483067 - RNA, 14 nt, Human
auggugccuucauu

SEQ ID NO: 1483068 - RNA, 16 nt, Human
auggugccuucauuug

SEQ ID NO: 1483069 - RNA, 13 nt, Human
augguuaacuaau

SEQ ID NO: 1483070 - RNA, 20 nt, Human
uuugugaagguggaaauaaa

SEQ ID NO: 1483071 - RNA, 17 nt, Human
uuugugaagcaaaauuu

SEQ ID NO: 1483072 - RNA, 14 nt, Human
uuuguaaugaaaac

SEQ ID NO: 1483073 - RNA, 13 nt, Human
uuuguaaugaaaa

SEQ ID NO: 1483074 - RNA, 12 nt, Human
uuuguauaaaag

SEQ ID NO: 1483075 - RNA, 19 nt, Human
uuuguaguguuggagaaga

SEQ ID NO: 1483076 - RNA, 21 nt, Human
uuuguaguguuggagaagaac

SEQ ID NO: 1483077 - RNA, 18 nt, Human
augugacauuuuacauua

SEQ ID NO: 1483078 - RNA, 12 nt, Human
augugacucuuu

SEQ ID NO: 1483079 - RNA, 16 nt, Human
augugacucuuuccaa

SEQ ID NO: 1483080 - RNA, 16 nt, Human
augugacauuuuacau

SEQ ID NO: 1483081 - RNA, 13 nt, Human
augucucuucuga

SEQ ID NO: 1483082 - RNA, 16 nt, Human
augucucuucugagcu

SEQ ID NO: 1483083 - RNA, 17 nt, Human
augucucuucugagcua

SEQ ID NO: 1483084 - RNA, 21 nt, Human
augugacucuuuccaaccggc

SEQ ID NO: 1483085 - RNA, 13 nt, Human
uuuggcaggugca

SEQ ID NO: 1483086 - RNA, 23 nt, Human
uuuggcaucccugggccuugggc

SEQ ID NO: 1483087 - RNA, 16 nt, Human
uuuggcaucccugggc

SEQ ID NO: 1483088 - RNA, 18 nt, Human
uuuggcaucccugggccu

SEQ ID NO: 1483089 - RNA, 22 nt, Human
auguauuacaguggggaaugaa

SEQ ID NO: 1483090 - RNA, 13 nt, Human
auguccuguaaag

SEQ ID NO: 1483091 - RNA, 14 nt, Human
auguccuguaaagg

SEQ ID NO: 1483092 - RNA, 16 nt, Human
auguccuucugagccc

SEQ ID NO: 1483093 - RNA, 16 nt, Human
auguaccguaggcuuu

SEQ ID NO: 1483094 - RNA, 16 nt, Human
auguacuucaugcugu

SEQ ID NO: 1483095 - RNA, 19 nt, Human
auguagauaacaagaccuc

SEQ ID NO: 1483096 - RNA, 19 nt, Human
auguagccccucuccugga

SEQ ID NO: 1483097 - RNA, 22 nt, Human
auguaggaaagaccauuuuucc

SEQ ID NO: 1483098 - RNA, 18 nt, Human
uuugacaguguugaaaau

SEQ ID NO: 1483099 - RNA, 19 nt, Human
uuugacaguguugaaaaug

SEQ ID NO: 1483100 - RNA, 14 nt, Human
uuugcaagccagau

SEQ ID NO: 1483101 - RNA, 14 nt, Human
uuugcaaagugcaa

SEQ ID NO: 1483102 - RNA, 17 nt, Human
uuugccucuuccagucu

SEQ ID NO: 1483103 - RNA, 12 nt, Human
uuugccuguaac

SEQ ID NO: 1483104 - RNA, 21 nt, Human
uuugccuguaacaagccagau

SEQ ID NO: 1483105 - RNA, 13 nt, Human
uuugccuguaaca

SEQ ID NO: 1483106 - RNA, 14 nt, Human
uuugccuguaacaa

SEQ ID NO: 1483107 - RNA, 12 nt, Human
uuugcugagacu

SEQ ID NO: 1483108 - RNA, 21 nt, Human
uuugcugacccuccccaaagg

SEQ ID NO: 1483109 - RNA, 19 nt, Human
uuugcugacccuccccaaa

SEQ ID NO: 1483110 - RNA, 17 nt, Human
uuugcugacccucccca

SEQ ID NO: 1483111 - RNA, 15 nt, Human
uuugcuggaauaagu

SEQ ID NO: 1483112 - RNA, 18 nt, Human
uuuaaauauaugcuaagu

SEQ ID NO: 1483113 - RNA, 13 nt, Human
uuuaaguauuuag

SEQ ID NO: 1483114 - RNA, 18 nt, Human
uuuaaguauuuagguuuu

SEQ ID NO: 1483115 - RNA, 20 nt, Human
uuuaauguauaguaaaucac

SEQ ID NO: 1483116 - RNA, 16 nt, Human
uuuaauguuuaaaaca

SEQ ID NO: 1483117 - RNA, 17 nt, Human
uuuaauguuuaaaacau

SEQ ID NO: 1483118 - RNA, 21 nt, Human
uuuaauguuuaaaacaucauu

SEQ ID NO: 1483119 - RNA, 13 nt, Human
augcagcucaaga

SEQ ID NO: 1483120 - RNA, 13 nt, Human
augcaguucugaa

SEQ ID NO: 1483121 - RNA, 15 nt, Human
augcauuugggucca

SEQ ID NO: 1483122 - RNA, 17 nt, Human
augcauuuggguccagg

SEQ ID NO: 1483123 - RNA, 18 nt, Human
augcauuuggguccagga

SEQ ID NO: 1483124 - RNA, 19 nt, Human
augcauuuggguccaggag

SEQ ID NO: 1483125 - RNA, 20 nt, Human
augcauuuggguccaggagg

SEQ ID NO: 1483126 - RNA, 22 nt, Human
augcauuuggguccaggaggaa

SEQ ID NO: 1483127 - RNA, 17 nt, Human
augccaaaaaaaaauac

SEQ ID NO: 1483128 - RNA, 18 nt, Human
augccaaaaaaaaauaca

SEQ ID NO: 1483129 - RNA, 19 nt, Human
augccaaaaaaaaauacau

SEQ ID NO: 1483130 - RNA, 22 nt, Human
augccaauuagcaauugacugu

SEQ ID NO: 1483131 - RNA, 14 nt, Human
augccaugaugccu

SEQ ID NO: 1483132 - RNA, 16 nt, Human
augcccuucuccuuau

SEQ ID NO: 1483133 - RNA, 19 nt, Human
augauugaauuauauguuc

SEQ ID NO: 1483134 - RNA, 20 nt, Human
augcacccucauacacagaa

SEQ ID NO: 1483135 - RNA, 14 nt, Human
augcaccuaaagaa

SEQ ID NO: 1483136 - RNA, 15 nt, Human
augcaccuaaagaaa

SEQ ID NO: 1483137 - RNA, 16 nt, Human
augcaccuaaagaaaa

SEQ ID NO: 1483138 - RNA, 18 nt, Human
augcaccuaaagaaaaac

SEQ ID NO: 1483139 - RNA, 23 nt, Human
augcaccuaaagaaaaacaaacu

SEQ ID NO: 1483140 - RNA, 14 nt, Human
uuguuuuggaugcc

SEQ ID NO: 1483141 - RNA, 13 nt, Human
uuuaaagaauugu

SEQ ID NO: 1483142 - RNA, 12 nt, Human
uuuaaagaauug

SEQ ID NO: 1483143 - RNA, 22 nt, Human
uuuaaagugacuaauggcauga

SEQ ID NO: 1483144 - RNA, 17 nt, Human
uuuaaaguuguuugugc

SEQ ID NO: 1483145 - RNA, 21 nt, Human
augauccaacuaaugccuuac

SEQ ID NO: 1483146 - RNA, 21 nt, Human
augauacuugaaaauuaacau

SEQ ID NO: 1483147 - RNA, 17 nt, Human
augauacuugaaaauua

SEQ ID NO: 1483148 - RNA, 14 nt, Human
augauuaaguaaug

SEQ ID NO: 1483149 - RNA, 18 nt, Human
augauuaaguaaugauaa

SEQ ID NO: 1483150 - RNA, 23 nt, Human
augauccccacgccacagcccuu

SEQ ID NO: 1483151 - RNA, 19 nt, Human
augauccccacgccacagc

SEQ ID NO: 1483152 - RNA, 18 nt, Human
augauccccacgccacag

SEQ ID NO: 1483153 - RNA, 15 nt, Human
augauaacuggaaac

SEQ ID NO: 1483154 - RNA, 15 nt, Human
augauaaugaacaga

SEQ ID NO: 1483155 - RNA, 12 nt, Human
augauaaugaac

SEQ ID NO: 1483156 - RNA, 18 nt, Human
uuuaucaugugaaaucau

SEQ ID NO: 1483157 - RNA, 17 nt, Human
uuuaucaugugaaauca

SEQ ID NO: 1483158 - RNA, 16 nt, Human
uuuaucaugcaugucc

SEQ ID NO: 1483159 - RNA, 22 nt, Human
uuuaucaugcauguccuguaaa

SEQ ID NO: 1483160 - RNA, 23 nt, Human
uuuaucaugcauguccuguaaag

SEQ ID NO: 1483161 - RNA, 19 nt, Human
uuuauauuguaaauauugu

SEQ ID NO: 1483162 - RNA, 14 nt, Human
uuuauauuguaaau

SEQ ID NO: 1483163 - RNA, 16 nt, Human
uuuauauuguaaauau

SEQ ID NO: 1483164 - RNA, 16 nt, Human
uuuauauuacacuaca

SEQ ID NO: 1483165 - RNA, 22 nt, Human
uuuauauugauaagaucuuuua

SEQ ID NO: 1483166 - RNA, 13 nt, Human
uuuauauguugua

SEQ ID NO: 1483167 - RNA, 15 nt, Human
augcuaagagaagua

SEQ ID NO: 1483168 - RNA, 16 nt, Human
augcuaagagaaguag

SEQ ID NO: 1483169 - RNA, 17 nt, Human
augcuaagagaaguaga

SEQ ID NO: 1483170 - RNA, 22 nt, Human
augcuaagagaaguagaaauca

SEQ ID NO: 1483171 - RNA, 18 nt, Human
augcuaagagaaguagaa

SEQ ID NO: 1483172 - RNA, 13 nt, Human
augcuaucucugu

SEQ ID NO: 1483173 - RNA, 19 nt, Human
uuuauuaauauauauuauc

SEQ ID NO: 1483174 - RNA, 17 nt, Human
uuuauuaauauauauua

SEQ ID NO: 1483175 - RNA, 21 nt, Human
uuuauuaauaaacauucuauc

SEQ ID NO: 1483176 - RNA, 16 nt, Human
uuuauuaauaaacauu

SEQ ID NO: 1483177 - RNA, 17 nt, Human
augcuguucaugaaaga

SEQ ID NO: 1483178 - RNA, 21 nt, Human
augcugcuggggaagacagug

SEQ ID NO: 1483179 - RNA, 20 nt, Human
augcugcuggggaagacagu

SEQ ID NO: 1483180 - RNA, 13 nt, Human
augcugcugggga

SEQ ID NO: 1483181 - RNA, 14 nt, Human
augcugcuggggaa

SEQ ID NO: 1483182 - RNA, 16 nt, Human
augcugcuggggaaga

SEQ ID NO: 1483183 - RNA, 17 nt, Human
augcugcuggggaagac

SEQ ID NO: 1483184 - RNA, 18 nt, Human
augcugcuggggaagaca

SEQ ID NO: 1483185 - RNA, 19 nt, Human
augcugcuggggaagacag

SEQ ID NO: 1483186 - RNA, 16 nt, Human
augcuucccuuuccug

SEQ ID NO: 1483187 - RNA, 23 nt, Human
augcuguucaugaaagauucaau

SEQ ID NO: 1483188 - RNA, 14 nt, Human
augcugugugacuc

SEQ ID NO: 1483189 - RNA, 19 nt, Human
augcuguucaugaaagauu

SEQ ID NO: 1483190 - RNA, 13 nt, Human
uuucaaaagaaag

SEQ ID NO: 1483191 - RNA, 22 nt, Human
uuuauuuuuccauuuacaacaa

SEQ ID NO: 1483192 - RNA, 16 nt, Human
uuuauuuuguguuuag

SEQ ID NO: 1483193 - RNA, 20 nt, Human
uuuauuuuguguuuaggaac

SEQ ID NO: 1483194 - RNA, 22 nt, Human
uuucaaaauuguuacaaauugu

SEQ ID NO: 1483195 - RNA, 16 nt, Human
uuucaaacauauauaa

SEQ ID NO: 1483196 - RNA, 17 nt, Human
uuucaaacauauauaac

SEQ ID NO: 1483197 - RNA, 22 nt, Human
auggacacuacacccagcaaua

SEQ ID NO: 1483198 - RNA, 19 nt, Human
auggacacuacacccagca

SEQ ID NO: 1483199 - RNA, 18 nt, Human
auggacacuacacccagc

SEQ ID NO: 1483200 - RNA, 17 nt, Human
auggacacuacacccag

SEQ ID NO: 1483201 - RNA, 16 nt, Human
auggacacuacaccca

SEQ ID NO: 1483202 - RNA, 15 nt, Human
auggacacuacaccc

SEQ ID NO: 1483203 - RNA, 13 nt, Human
auggagaaggaag

SEQ ID NO: 1483204 - RNA, 12 nt, Human
auggagaaggaa

SEQ ID NO: 1483205 - RNA, 17 nt, Human
uuucaacagugaagaca

SEQ ID NO: 1483206 - RNA, 20 nt, Human
uuucaacagugaagacagaa

SEQ ID NO: 1483207 - RNA, 19 nt, Human
uuucaacagugaagacaga

SEQ ID NO: 1483208 - RNA, 17 nt, Human
uuucaaagcuuuuucca

SEQ ID NO: 1483209 - RNA, 19 nt, Human
uuucaaauagggucuaacu

SEQ ID NO: 1483210 - RNA, 20 nt, Human
uuucaaauagggucuaacuc

SEQ ID NO: 1483211 - RNA, 18 nt, Human
uuucccccuagccugccu

SEQ ID NO: 1483212 - RNA, 19 nt, Human
uuuccaugcguguuucuga

SEQ ID NO: 1483213 - RNA, 23 nt, Human
uuuccaugcacccucauacacag

SEQ ID NO: 1483214 - RNA, 15 nt, Human
auggagaaggaaggc

SEQ ID NO: 1483215 - RNA, 14 nt, Human
auggagaaggaagg

SEQ ID NO: 1483216 - RNA, 14 nt, Human
auggcacuaguauu

SEQ ID NO: 1483217 - RNA, 16 nt, Human
auggcacuaguauuuc

SEQ ID NO: 1483218 - RNA, 17 nt, Human
auggcaggaaggcuugu

SEQ ID NO: 1483219 - RNA, 15 nt, Human
auggcaugagaaaua

SEQ ID NO: 1483220 - RNA, 17 nt, Human
auggcaugagaaauaca

SEQ ID NO: 1483221 - RNA, 22 nt, Human
auggccauggaguguacaagua

SEQ ID NO: 1483222 - RNA, 21 nt, Human
augggagcugguuagaaaugc

SEQ ID NO: 1483223 - RNA, 21 nt, Human
augggaggccuuucccuaagc

SEQ ID NO: 1483224 - RNA, 20 nt, Human
augggagcugguuagaaaug

SEQ ID NO: 1483225 - RNA, 22 nt, Human
augggagcugguuagaaaugca

SEQ ID NO: 1483226 - RNA, 19 nt, Human
auggcuauguuuuuaaugu

SEQ ID NO: 1483227 - RNA, 13 nt, Human
auggcuauuuuau

SEQ ID NO: 1483228 - RNA, 17 nt, Human
aucaggguuaguauugu

SEQ ID NO: 1483229 - RNA, 16 nt, Human
aucagguccucagaga

SEQ ID NO: 1483230 - RNA, 20 nt, Human
aucagguccucagagaauuu

SEQ ID NO: 1483231 - RNA, 14 nt, Human
aucaggcuuucuua

SEQ ID NO: 1483232 - RNA, 22 nt, Human
aucaggcuuucuuaaagugaga

SEQ ID NO: 1483233 - RNA, 14 nt, Human
aucaggcuuucuuu

SEQ ID NO: 1483234 - RNA, 22 nt, Human
aucaggcuuucuuuuuuuucuu

SEQ ID NO: 1483235 - RNA, 14 nt, Human
aucaggccuagagg

SEQ ID NO: 1483236 - RNA, 19 nt, Human
aucaggccuagaggccuga

SEQ ID NO: 1483237 - RNA, 13 nt, Human
uucuaggacugaa

SEQ ID NO: 1483238 - RNA, 14 nt, Human
uucuaggacugaau

SEQ ID NO: 1483239 - RNA, 22 nt, Human
uucuagcuuaucuacuuccaaa

SEQ ID NO: 1483240 - RNA, 16 nt, Human
uucuaggacugaauua

SEQ ID NO: 1483241 - RNA, 23 nt, Human
uucuaggacugaauuaugaaacu

SEQ ID NO: 1483242 - RNA, 15 nt, Human
uucucacuaaaucuu

SEQ ID NO: 1483243 - RNA, 22 nt, Human
aucacuugucaauaaaauccau

SEQ ID NO: 1483244 - RNA, 21 nt, Human
aucacuuguacaaaauaaaca

SEQ ID NO: 1483245 - RNA, 16 nt, Human
aucacuuucucaguuu

SEQ ID NO: 1483246 - RNA, 14 nt, Human
aucacuuguacaaa

SEQ ID NO: 1483247 - RNA, 16 nt, Human
aucacuuguacaaaau

SEQ ID NO: 1483248 - RNA, 17 nt, Human
aucacuuguacaaaaua

SEQ ID NO: 1483249 - RNA, 18 nt, Human
aucacuuguacaaaauaa

SEQ ID NO: 1483250 - RNA, 13 nt, Human
uucuaaaguaaaa

SEQ ID NO: 1483251 - RNA, 16 nt, Human
aucacugcucacacug

SEQ ID NO: 1483252 - RNA, 19 nt, Human
uucggacaguuuauuuguu

SEQ ID NO: 1483253 - RNA, 20 nt, Human
uucggacaguuuauuuguug

SEQ ID NO: 1483254 - RNA, 23 nt, Human
uucggaaagaagaaggugggagg

SEQ ID NO: 1483255 - RNA, 20 nt, Human
uuccuaaauauauuuuaaga

SEQ ID NO: 1483256 - RNA, 20 nt, Human
uuccucugcccuuccugcag

SEQ ID NO: 1483257 - RNA, 11 nt, Human
uuccucugccc

SEQ ID NO: 1483258 - RNA, 14 nt, Human
uuccugaacaggau

SEQ ID NO: 1483259 - RNA, 15 nt, Human
uuccugaacaggaua

SEQ ID NO: 1483260 - RNA, 19 nt, Human
uuccguagguuauuuucag

SEQ ID NO: 1483261 - RNA, 18 nt, Human
uuccgugacgucacugga

SEQ ID NO: 1483262 - RNA, 15 nt, Human
auagcaaaagaagaa

SEQ ID NO: 1483263 - RNA, 16 nt, Human
auagcaaaagaagaag

SEQ ID NO: 1483264 - RNA, 17 nt, Human
auagcaaaagaagaagu

SEQ ID NO: 1483265 - RNA, 18 nt, Human
auagcaaaagaagaaguu

SEQ ID NO: 1483266 - RNA, 19 nt, Human
auagcaaaagaagaaguuu

SEQ ID NO: 1483267 - RNA, 13 nt, Human
auagcaaagaauu

SEQ ID NO: 1483268 - RNA, 14 nt, Human
auagcaaagaauug

SEQ ID NO: 1483269 - RNA, 15 nt, Human
auagcaaagaauuga

SEQ ID NO: 1483270 - RNA, 18 nt, Human
aucaaggccuuauuggaa

SEQ ID NO: 1483271 - RNA, 22 nt, Human
aucaaggccuuauuggaaagca

SEQ ID NO: 1483272 - RNA, 20 nt, Human
aucaccuuagaccaccaagc

SEQ ID NO: 1483273 - RNA, 21 nt, Human
aucaaucuguaaaacuaagaa

SEQ ID NO: 1483274 - RNA, 14 nt, Human
aucacgcuuuccug

SEQ ID NO: 1483275 - RNA, 19 nt, Human
aucaccuuagaccaccaag

SEQ ID NO: 1483276 - RNA, 18 nt, Human
aucacgcuuuccugaauc

SEQ ID NO: 1483277 - RNA, 18 nt, Human
aucacgcuuuuugaaaaa

SEQ ID NO: 1483278 - RNA, 15 nt, Human
aucacugaguuuucc

SEQ ID NO: 1483279 - RNA, 16 nt, Human
aucacugaguuuucca

SEQ ID NO: 1483280 - RNA, 17 nt, Human
aucacugaguuuuccau

SEQ ID NO: 1483281 - RNA, 18 nt, Human
aucacugaguuuuccaug

SEQ ID NO: 1483282 - RNA, 21 nt, Human
uuccuguggauguaaagugau

SEQ ID NO: 1483283 - RNA, 14 nt, Human
auauuuuuaucuuu

SEQ ID NO: 1483284 - RNA, 15 nt, Human
auauuuuuaucuuua

SEQ ID NO: 1483285 - RNA, 20 nt, Human
auauuuuuaucuuuauauga

SEQ ID NO: 1483286 - RNA, 22 nt, Human
auauuuuuaucuuuauaugaag

SEQ ID NO: 1483287 - RNA, 20 nt, Human
uugaaauuaugugacauuuu

SEQ ID NO: 1483288 - RNA, 17 nt, Human
uugaaauuaugugacau

SEQ ID NO: 1483289 - RNA, 21 nt, Human
uugaaagggguugugaagagg

SEQ ID NO: 1483290 - RNA, 17 nt, Human
uugaaauuguauuacaa

SEQ ID NO: 1483291 - RNA, 18 nt, Human
uugaaccugaugaaaaua

SEQ ID NO: 1483292 - RNA, 20 nt, Human
uugaaccugaugaaaauaaa

SEQ ID NO: 1483293 - RNA, 19 nt, Human
uugaaccugaugaaaauaa

SEQ ID NO: 1483294 - RNA, 14 nt, Human
auccuaaacaucau

SEQ ID NO: 1483295 - RNA, 11 nt, Human
auccuccucau

SEQ ID NO: 1483296 - RNA, 14 nt, Human
auccuacccccugu

SEQ ID NO: 1483297 - RNA, 21 nt, Human
auccuaccacaaugcagugcc

SEQ ID NO: 1483298 - RNA, 22 nt, Human
auccuaccacaaugcagugccu

SEQ ID NO: 1483299 - RNA, 16 nt, Human
auccuacccccugugc

SEQ ID NO: 1483300 - RNA, 16 nt, Human
uucuuuguaaugaaaa

SEQ ID NO: 1483301 - RNA, 22 nt, Human
uucuuugguuucccaagagcua

SEQ ID NO: 1483302 - RNA, 18 nt, Human
uucuuuuugggagagacu

SEQ ID NO: 1483303 - RNA, 15 nt, Human
uucuuuguaaugaaa

SEQ ID NO: 1483304 - RNA, 19 nt, Human
uucuuuuugggagagacuu

SEQ ID NO: 1483305 - RNA, 21 nt, Human
uucuuuuugggagagacuugu

SEQ ID NO: 1483306 - RNA, 16 nt, Human
uucuuuuuuuagagaa

SEQ ID NO: 1483307 - RNA, 20 nt, Human
uucuucugaacucaaacuga

SEQ ID NO: 1483308 - RNA, 23 nt, Human
uucuucugaacucaaacugagga

SEQ ID NO: 1483309 - RNA, 13 nt, Human
uucuucugaacuc

SEQ ID NO: 1483310 - RNA, 16 nt, Human
auccagugauccuuac

SEQ ID NO: 1483311 - RNA, 21 nt, Human
auccagugauccuuacaaguu

SEQ ID NO: 1483312 - RNA, 16 nt, Human
auccaguucaugagaa

SEQ ID NO: 1483313 - RNA, 22 nt, Human
aucauuuugcaaucccuuaaua

SEQ ID NO: 1483314 - RNA, 16 nt, Human
uucugggcuucaucug

SEQ ID NO: 1483315 - RNA, 12 nt, Human
uucucuaggaaa

SEQ ID NO: 1483316 - RNA, 13 nt, Human
uucucuugccuca

SEQ ID NO: 1483317 - RNA, 16 nt, Human
uucugaacucaaacug

SEQ ID NO: 1483318 - RNA, 17 nt, Human
uucugaacucaaacuga

SEQ ID NO: 1483319 - RNA, 18 nt, Human
uucugaacucaaacugag

SEQ ID NO: 1483320 - RNA, 22 nt, Human
uucugaacucaaacugaggaau

SEQ ID NO: 1483321 - RNA, 13 nt, Human
uucugccaggaga

SEQ ID NO: 1483322 - RNA, 14 nt, Human
aucucauuuccaag

SEQ ID NO: 1483323 - RNA, 13 nt, Human
aucuacuuccaaa

SEQ ID NO: 1483324 - RNA, 15 nt, Human
aucuacuuccaaacu

SEQ ID NO: 1483325 - RNA, 19 nt, Human
aucuacuuccaaacuaauu

SEQ ID NO: 1483326 - RNA, 21 nt, Human
aucuagaacacaggcaaaauc

SEQ ID NO: 1483327 - RNA, 17 nt, Human
aucuagaggcuuccuuc

SEQ ID NO: 1483328 - RNA, 19 nt, Human
aucuagaggcuuccuucau

SEQ ID NO: 1483329 - RNA, 23 nt, Human
aucuagaggcuuccuucauuucc

SEQ ID NO: 1483330 - RNA, 14 nt, Human
aucucuucuuuuaa

SEQ ID NO: 1483331 - RNA, 15 nt, Human
uugcauuuaaaacag

SEQ ID NO: 1483332 - RNA, 20 nt, Human
uugcauuuaaaacagacacu

SEQ ID NO: 1483333 - RNA, 21 nt, Human
uugcauuuaaaacagacacug

SEQ ID NO: 1483334 - RNA, 12 nt, Human
aucugaauuuuu

SEQ ID NO: 1483335 - RNA, 14 nt, Human
aucugaauuuuuaa

SEQ ID NO: 1483336 - RNA, 18 nt, Human
aucugaauuuuuaaacaa

SEQ ID NO: 1483337 - RNA, 19 nt, Human
aucugaauuuuuaaacaag

SEQ ID NO: 1483338 - RNA, 20 nt, Human
aucugaauuuuuaaacaagu

SEQ ID NO: 1483339 - RNA, 14 nt, Human
uugauuacagugca

SEQ ID NO: 1483340 - RNA, 17 nt, Human
uugauuacagugcagug

SEQ ID NO: 1483341 - RNA, 18 nt, Human
uugacuuauaguacauga

SEQ ID NO: 1483342 - RNA, 16 nt, Human
uugagucaaaaaaucu

SEQ ID NO: 1483343 - RNA, 16 nt, Human
uugagauguguucaca

SEQ ID NO: 1483344 - RNA, 23 nt, Human
uugagagaaauaugaagaacuga

SEQ ID NO: 1483345 - RNA, 21 nt, Human
uugagauggagucuugcucug

SEQ ID NO: 1483346 - RNA, 15 nt, Human
uugauacuaagcauu

SEQ ID NO: 1483347 - RNA, 17 nt, Human
uugaagggaaauuucag

SEQ ID NO: 1483348 - RNA, 11 nt, Human
uugaaggcuua

SEQ ID NO: 1483349 - RNA, 12 nt, Human
uugaaggcuuaa

SEQ ID NO: 1483350 - RNA, 23 nt, Human
uugaauauuauuccucaaaaaau

SEQ ID NO: 1483351 - RNA, 15 nt, Human
uugaauccucucucu

SEQ ID NO: 1483352 - RNA, 21 nt, Human
auccucuccacagcugccucu

SEQ ID NO: 1483353 - RNA, 14 nt, Human
aucuuauaauuuaa

SEQ ID NO: 1483354 - RNA, 19 nt, Human
aucuugcccgcucaggcug

SEQ ID NO: 1483355 - RNA, 20 nt, Human
aucuugguugaugccaaaaa

SEQ ID NO: 1483356 - RNA, 21 nt, Human
aucuugguugaugccaaaaaa

SEQ ID NO: 1483357 - RNA, 21 nt, Human
aucuugguuugccuuccagaa

SEQ ID NO: 1483358 - RNA, 14 nt, Human
aucuugguuugccu

SEQ ID NO: 1483359 - RNA, 17 nt, Human
aucuugguuugccuucc

SEQ ID NO: 1483360 - RNA, 20 nt, Human
aucuugguuugccuuccaga

SEQ ID NO: 1483361 - RNA, 11 nt, Human
aucuugucaug

SEQ ID NO: 1483362 - RNA, 12 nt, Human
aucuugucaugu

SEQ ID NO: 1483363 - RNA, 14 nt, Human
aucuugucaugugu

SEQ ID NO: 1483364 - RNA, 15 nt, Human
aucuugucaugugua

SEQ ID NO: 1483365 - RNA, 16 nt, Human
aucuugucauguguau

SEQ ID NO: 1483366 - RNA, 17 nt, Human
aucuugucauguguaua

SEQ ID NO: 1483367 - RNA, 14 nt, Human
aucuuguccccaac

SEQ ID NO: 1483368 - RNA, 17 nt, Human
aucuuguccccaacacc

SEQ ID NO: 1483369 - RNA, 19 nt, Human
aucuugucauguguauaaa

SEQ ID NO: 1483370 - RNA, 20 nt, Human
uugcauuuauauguaccgua

SEQ ID NO: 1483371 - RNA, 15 nt, Human
uugcauuuauaugua

SEQ ID NO: 1483372 - RNA, 22 nt, Human
uugcauuuaaaacagacacugg

SEQ ID NO: 1483373 - RNA, 15 nt, Human
aucugcgugugugca

SEQ ID NO: 1483374 - RNA, 12 nt, Human
aucugccucccu

SEQ ID NO: 1483375 - RNA, 22 nt, Human
augaacuugaggacacaugucc

SEQ ID NO: 1483376 - RNA, 15 nt, Human
augaagaacugagga

SEQ ID NO: 1483377 - RNA, 21 nt, Human
augaacuugaggacacauguc

SEQ ID NO: 1483378 - RNA, 20 nt, Human
augaacuugaggacacaugu

SEQ ID NO: 1483379 - RNA, 19 nt, Human
augaacuugaggacacaug

SEQ ID NO: 1483380 - RNA, 18 nt, Human
augaacuugaggacacau

SEQ ID NO: 1483381 - RNA, 17 nt, Human
augaacuugaggacaca

SEQ ID NO: 1483382 - RNA, 16 nt, Human
augaacuugaggacac

SEQ ID NO: 1483383 - RNA, 18 nt, Human
augaacuuguaaaggaau

SEQ ID NO: 1483384 - RNA, 16 nt, Human
augaauauuuaguguu

SEQ ID NO: 1483385 - RNA, 16 nt, Human
augaagagauuuuuca

SEQ ID NO: 1483386 - RNA, 20 nt, Human
augaagagauuuuucaugau

SEQ ID NO: 1483387 - RNA, 15 nt, Human
augaacuugaggaca

SEQ ID NO: 1483388 - RNA, 13 nt, Human
augaacuugagga

SEQ ID NO: 1483389 - RNA, 15 nt, Human
augaauuacauuugu

SEQ ID NO: 1483390 - RNA, 16 nt, Human
augaauguaaauuugu

SEQ ID NO: 1483391 - RNA, 19 nt, Human
augaauguaaauuuguacu

SEQ ID NO: 1483392 - RNA, 21 nt, Human
augaauguaaauuuguacuau

SEQ ID NO: 1483393 - RNA, 12 nt, Human
augaauguaaau

SEQ ID NO: 1483394 - RNA, 13 nt, Human
augaauguaaauu

SEQ ID NO: 1483395 - RNA, 15 nt, Human
augaauguaaauuug

SEQ ID NO: 1483396 - RNA, 21 nt, Human
augaauauuuaguguucauaa

SEQ ID NO: 1483397 - RNA, 16 nt, Human
augaauuacauuugua

SEQ ID NO: 1483398 - RNA, 17 nt, Human
augaauuacauuuguau

SEQ ID NO: 1483399 - RNA, 11 nt, Human
uuggggaagag

SEQ ID NO: 1483400 - RNA, 22 nt, Human
uuggggaagagagccugcagga

SEQ ID NO: 1483401 - RNA, 23 nt, Human
uuggggaagagagccugcaggau

SEQ ID NO: 1483402 - RNA, 14 nt, Human
uuggggacacaugu

SEQ ID NO: 1483403 - RNA, 20 nt, Human
uuggggacacauguauuugg

SEQ ID NO: 1483404 - RNA, 14 nt, Human
uuggugagaaccug

SEQ ID NO: 1483405 - RNA, 20 nt, Human
uuggugauuccgcagugaga

SEQ ID NO: 1483406 - RNA, 16 nt, Human
uuggugauuccgcagu

SEQ ID NO: 1483407 - RNA, 14 nt, Human
aucuuuucauacau

SEQ ID NO: 1483408 - RNA, 14 nt, Human
auaauuuuaaaugu

SEQ ID NO: 1483409 - RNA, 14 nt, Human
auaauuuuaaauuc

SEQ ID NO: 1483410 - RNA, 13 nt, Human
auaauuuuaaaug

SEQ ID NO: 1483411 - RNA, 12 nt, Human
auaauuuuaaau

SEQ ID NO: 1483412 - RNA, 15 nt, Human
auaauuuuaaacaaa

SEQ ID NO: 1483413 - RNA, 14 nt, Human
auaauuuagauggu

SEQ ID NO: 1483414 - RNA, 20 nt, Human
auaauuuaguuucauauaaa

SEQ ID NO: 1483415 - RNA, 17 nt, Human
auaauuuaguuucauau

SEQ ID NO: 1483416 - RNA, 23 nt, Human
auaauucacauuguauucagagu

SEQ ID NO: 1483417 - RNA, 14 nt, Human
auaaucuuucacag

SEQ ID NO: 1483418 - RNA, 20 nt, Human
auaaucuucugccuucucau

SEQ ID NO: 1483419 - RNA, 19 nt, Human
auaauauauuuuaaauauu

SEQ ID NO: 1483420 - RNA, 14 nt, Human
auaaucuucugccu

SEQ ID NO: 1483421 - RNA, 15 nt, Human
auaaucuucugccuu

SEQ ID NO: 1483422 - RNA, 17 nt, Human
auaaucuucugccuucu

SEQ ID NO: 1483423 - RNA, 18 nt, Human
auaauauuuuuaauauau

SEQ ID NO: 1483424 - RNA, 14 nt, Human
uuaggguuaugauu

SEQ ID NO: 1483425 - RNA, 16 nt, Human
uuaggguuaugauuaa

SEQ ID NO: 1483426 - RNA, 14 nt, Human
uuaguaaucauauu

SEQ ID NO: 1483427 - RNA, 13 nt, Human
uuaguaaucauau

SEQ ID NO: 1483428 - RNA, 17 nt, Human
uuagguaauuuuuuuca

SEQ ID NO: 1483429 - RNA, 22 nt, Human
uuauaaaaauaaaaaacacugg

SEQ ID NO: 1483430 - RNA, 21 nt, Human
uuauaaaaauaaaaaacacug

SEQ ID NO: 1483431 - RNA, 19 nt, Human
uuauaaaaagguguuuuga

SEQ ID NO: 1483432 - RNA, 19 nt, Human
uuaguacuccccuccuuga

SEQ ID NO: 1483433 - RNA, 15 nt, Human
uuauaaaaauaaaaa

SEQ ID NO: 1483434 - RNA, 12 nt, Human
uuaauuuuugau

SEQ ID NO: 1483435 - RNA, 13 nt, Human
uuaauuuuugaua

SEQ ID NO: 1483436 - RNA, 15 nt, Human
uuaauuuuugauacu

SEQ ID NO: 1483437 - RNA, 18 nt, Human
uuacaaagcccuuuuaua

SEQ ID NO: 1483438 - RNA, 17 nt, Human
uuacaguggggaaugaa

SEQ ID NO: 1483439 - RNA, 14 nt, Human
uuacagugcagugc

SEQ ID NO: 1483440 - RNA, 21 nt, Human
uuaccaggcaccaaaagaagu

SEQ ID NO: 1483441 - RNA, 23 nt, Human
uuaccaggcaccaaaagaaguaa

SEQ ID NO: 1483442 - RNA, 13 nt, Human
auaagaucuuuua

SEQ ID NO: 1483443 - RNA, 15 nt, Human
auaagaucuuuuauu

SEQ ID NO: 1483444 - RNA, 17 nt, Human
auaagaucuuuuauuuu

SEQ ID NO: 1483445 - RNA, 20 nt, Human
auaagaucuuuuauuuugcc

SEQ ID NO: 1483446 - RNA, 13 nt, Human
auaagaaacuuuu

SEQ ID NO: 1483447 - RNA, 14 nt, Human
auaagaaacuuuuu

SEQ ID NO: 1483448 - RNA, 22 nt, Human
auaagaaacuuuuuuauuuaaa

SEQ ID NO: 1483449 - RNA, 21 nt, Human
auaagaaacuuuuuuauuuaa

SEQ ID NO: 1483450 - RNA, 18 nt, Human
auaagauauuuuucauga

SEQ ID NO: 1483451 - RNA, 17 nt, Human
uuacugucuuuuuucua

SEQ ID NO: 1483452 - RNA, 20 nt, Human
uuacugcuuaauucaaauaa

SEQ ID NO: 1483453 - RNA, 23 nt, Human
uuacuguacagacagaaaaaacu

SEQ ID NO: 1483454 - RNA, 16 nt, Human
uuacucaguaauuugu

SEQ ID NO: 1483455 - RNA, 17 nt, Human
uuaaucuuuaauuuuac

SEQ ID NO: 1483456 - RNA, 13 nt, Human
uuaaucuuuaauu

SEQ ID NO: 1483457 - RNA, 14 nt, Human
uuaauuuauuauua

SEQ ID NO: 1483458 - RNA, 14 nt, Human
uuaauuuaugcaga

SEQ ID NO: 1483459 - RNA, 13 nt, Human
uuaauuuuccugg

SEQ ID NO: 1483460 - RNA, 16 nt, Human
uuaauuugguuuucac

SEQ ID NO: 1483461 - RNA, 22 nt, Human
uuaagacgaaacauuuguucua

SEQ ID NO: 1483462 - RNA, 22 nt, Human
uuaagagagucuauuuacggaa

SEQ ID NO: 1483463 - RNA, 17 nt, Human
uuaagacuugacagugg

SEQ ID NO: 1483464 - RNA, 13 nt, Human
uuaagacuugaca

SEQ ID NO: 1483465 - RNA, 17 nt, Human
uuaaucagauagauauu

SEQ ID NO: 1483466 - RNA, 20 nt, Human
uuaaucagguccucagagaa

SEQ ID NO: 1483467 - RNA, 15 nt, Human
aguuuuuuuuauaca

SEQ ID NO: 1483468 - RNA, 21 nt, Human
aguuuuuugaaauuaugugac

SEQ ID NO: 1483469 - RNA, 17 nt, Human
aguuuuuuauuaugcau

SEQ ID NO: 1483470 - RNA, 16 nt, Human
aguuuuauaugcuucu

SEQ ID NO: 1483471 - RNA, 19 nt, Human
aguuuuacuuuuaaacugu

SEQ ID NO: 1483472 - RNA, 20 nt, Human
aguuuuacuuuuaaacugug

SEQ ID NO: 1483473 - RNA, 20 nt, Human
auaaaagccuguuuaagaga

SEQ ID NO: 1483474 - RNA, 23 nt, Human
aguuuuuugaaauuaugugacau

SEQ ID NO: 1483475 - RNA, 15 nt, Human
aguuuuuuguaccaa

SEQ ID NO: 1483476 - RNA, 22 nt, Human
auaaaagggacugagaaauuua

SEQ ID NO: 1483477 - RNA, 19 nt, Human
uuaagacgaaacauuuguu

SEQ ID NO: 1483478 - RNA, 20 nt, Human
aguuuaaauuguaauaggcg

SEQ ID NO: 1483479 - RNA, 17 nt, Human
aguuuaaauuguaauag

SEQ ID NO: 1483480 - RNA, 15 nt, Human
aguuagcuuuaacuu

SEQ ID NO: 1483481 - RNA, 20 nt, Human
aguuagcuuuaacuuaaaua

SEQ ID NO: 1483482 - RNA, 22 nt, Human
aguuagcuuuaacuuaaauagu

SEQ ID NO: 1483483 - RNA, 21 nt, Human
aguuagcuuuaacuuaaauag

SEQ ID NO: 1483484 - RNA, 15 nt, Human
aguuuagcuggaaaa

SEQ ID NO: 1483485 - RNA, 16 nt, Human
aguuuagcuggaaaag

SEQ ID NO: 1483486 - RNA, 21 nt, Human
uuaaaaaagcuuaaaacuuug

SEQ ID NO: 1483487 - RNA, 12 nt, Human
uuaaaaaagcuu

SEQ ID NO: 1483488 - RNA, 19 nt, Human
uuaaaaaagcuuaaaacuu

SEQ ID NO: 1483489 - RNA, 19 nt, Human
uuaaaaugagaaaucuaaa

SEQ ID NO: 1483490 - RNA, 12 nt, Human
uuaaaaugagaa

SEQ ID NO: 1483491 - RNA, 16 nt, Human
uuaaaauguaaagcca

SEQ ID NO: 1483492 - RNA, 17 nt, Human
uuaaaauguaaagccau

SEQ ID NO: 1483493 - RNA, 15 nt, Human
uuaaaguuguuugug

SEQ ID NO: 1483494 - RNA, 16 nt, Human
uuaaauuuuuuuuaca

SEQ ID NO: 1483495 - RNA, 15 nt, Human
aguuuauauuuaacu

SEQ ID NO: 1483496 - RNA, 16 nt, Human
aguuuauauuuaacuc

SEQ ID NO: 1483497 - RNA, 18 nt, Human
aguuuauauuuaacucuc

SEQ ID NO: 1483498 - RNA, 15 nt, Human
aguuuguugaaacac

SEQ ID NO: 1483499 - RNA, 14 nt, Human
aguuucugaguuuu

SEQ ID NO: 1483500 - RNA, 20 nt, Human
aguuucugaguuuuaccaaa

SEQ ID NO: 1483501 - RNA, 19 nt, Human
aguuucugaguuuuaccaa

SEQ ID NO: 1483502 - RNA, 18 nt, Human
aguuucugaguuuuacca

SEQ ID NO: 1483503 - RNA, 17 nt, Human
aguuucugaguuuuacc

SEQ ID NO: 1483504 - RNA, 13 nt, Human
aguuuauuuguug

SEQ ID NO: 1483505 - RNA, 12 nt, Human
auagauguuuga

SEQ ID NO: 1483506 - RNA, 18 nt, Human
auagauaggucagugcaa

SEQ ID NO: 1483507 - RNA, 14 nt, Human
auagagacgggacu

SEQ ID NO: 1483508 - RNA, 16 nt, Human
auagagacuugggaau

SEQ ID NO: 1483509 - RNA, 14 nt, Human
auagaacaaggcug

SEQ ID NO: 1483510 - RNA, 13 nt, Human
auagaaguaaaaa

SEQ ID NO: 1483511 - RNA, 22 nt, Human
auagaauaaaauuuuuaaucuu

SEQ ID NO: 1483512 - RNA, 19 nt, Human
auagaauaaaauuuuuaau

SEQ ID NO: 1483513 - RNA, 14 nt, Human
auagaauaaaauuu

SEQ ID NO: 1483514 - RNA, 13 nt, Human
auagaaugacagu

SEQ ID NO: 1483515 - RNA, 18 nt, Human
auagaaugguaucaauaa

SEQ ID NO: 1483516 - RNA, 12 nt, Human
auagacacgcac

SEQ ID NO: 1483517 - RNA, 21 nt, Human
auagacaauugagguaaguuu

SEQ ID NO: 1483518 - RNA, 13 nt, Human
auagacagaagaa

SEQ ID NO: 1483519 - RNA, 14 nt, Human
auagacagaagaaa

SEQ ID NO: 1483520 - RNA, 16 nt, Human
auagacagaagaaaca

SEQ ID NO: 1483521 - RNA, 17 nt, Human
auagacagaagaaacaa

SEQ ID NO: 1483522 - RNA, 19 nt, Human
auagacagaagaaacaagg

SEQ ID NO: 1483523 - RNA, 18 nt, Human
auagacagaagaaacaag

SEQ ID NO: 1483524 - RNA, 14 nt, Human
auagacaauugagg

SEQ ID NO: 1483525 - RNA, 22 nt, Human
auagaauuauaacuggaaagaa

SEQ ID NO: 1483526 - RNA, 15 nt, Human
auacuggcacagagg

SEQ ID NO: 1483527 - RNA, 13 nt, Human
auacuggcacaga

SEQ ID NO: 1483528 - RNA, 12 nt, Human
auacugcugaga

SEQ ID NO: 1483529 - RNA, 18 nt, Human
auacugcugagauacaua

SEQ ID NO: 1483530 - RNA, 19 nt, Human
auacugcugagauacauac

SEQ ID NO: 1483531 - RNA, 21 nt, Human
auacugcugagauacauacag

SEQ ID NO: 1483532 - RNA, 10 nt, Human
auacugcuug

SEQ ID NO: 1483533 - RNA, 22 nt, Human
auacugcugagauacauacaga

SEQ ID NO: 1483534 - RNA, 15 nt, Human
auacugcuuggagcu

SEQ ID NO: 1483535 - RNA, 20 nt, Human
auacugcuuggagcugagca

SEQ ID NO: 1483536 - RNA, 21 nt, Human
auacugcuuggagcugagcaa

SEQ ID NO: 1483537 - RNA, 15 nt, Human
auacugcauacuuuu

SEQ ID NO: 1483538 - RNA, 21 nt, Human
auacugcauacuuuuuaaaug

SEQ ID NO: 1483539 - RNA, 14 nt, Human
auacucuuauaucu

SEQ ID NO: 1483540 - RNA, 18 nt, Human
auacucuuauaucuauau

SEQ ID NO: 1483541 - RNA, 20 nt, Human
auacucucaccauuuggauc

SEQ ID NO: 1483542 - RNA, 17 nt, Human
auacucauuuuucauga

SEQ ID NO: 1483543 - RNA, 16 nt, Human
uuauuccuccugcuca

SEQ ID NO: 1483544 - RNA, 20 nt, Human
uuauuccuccugcucauauu

SEQ ID NO: 1483545 - RNA, 20 nt, Human
uuauuccccauucuuccuag

SEQ ID NO: 1483546 - RNA, 14 nt, Human
uuauuauauuuaca

SEQ ID NO: 1483547 - RNA, 19 nt, Human
uuauguuaaaacugggaca

SEQ ID NO: 1483548 - RNA, 22 nt, Human
uuauguuaagggaagaauucca

SEQ ID NO: 1483549 - RNA, 15 nt, Human
uuauuauauuuacaa

SEQ ID NO: 1483550 - RNA, 12 nt, Human
uuauucauaauu

SEQ ID NO: 1483551 - RNA, 14 nt, Human
uuauuaugcauuau

SEQ ID NO: 1483552 - RNA, 13 nt, Human
uuaugugaaacau

SEQ ID NO: 1483553 - RNA, 17 nt, Human
uuaugucuguggauuuu

SEQ ID NO: 1483554 - RNA, 15 nt, Human
uuaugucucuucuga

SEQ ID NO: 1483555 - RNA, 11 nt, Human
uuauguaguuu

SEQ ID NO: 1483556 - RNA, 21 nt, Human
uuauguaguuuuuauauguug

SEQ ID NO: 1483557 - RNA, 20 nt, Human
uuaugugacauuuuacauua

SEQ ID NO: 1483558 - RNA, 22 nt, Human
uuaugugccagauuuaugcaua

SEQ ID NO: 1483559 - RNA, 19 nt, Human
uuaugugacauuuuacauu

SEQ ID NO: 1483560 - RNA, 14 nt, Human
uuaugugacauuuu

SEQ ID NO: 1483561 - RNA, 15 nt, Human
uuaugugaaacaugu

SEQ ID NO: 1483562 - RNA, 11 nt, Human
uuaugggucac

SEQ ID NO: 1483563 - RNA, 13 nt, Human
uuaugggucacag

SEQ ID NO: 1483564 - RNA, 15 nt, Human
uuaugggucacagga

SEQ ID NO: 1483565 - RNA, 19 nt, Human
uuaugauuaaguaaugaua

SEQ ID NO: 1483566 - RNA, 22 nt, Human
uuaugauuaaguaaugauaacu

SEQ ID NO: 1483567 - RNA, 18 nt, Human
uuaugaaaaagaagaauc

SEQ ID NO: 1483568 - RNA, 19 nt, Human
uuaugaaaaagaagaaucu

SEQ ID NO: 1483569 - RNA, 14 nt, Human
uuaugaaacuuuug

SEQ ID NO: 1483570 - RNA, 17 nt, Human
uuaugaaacuuuuggaa

SEQ ID NO: 1483571 - RNA, 18 nt, Human
uuaugaaacuuuuggaag

SEQ ID NO: 1483572 - RNA, 20 nt, Human
uuaugaagcuuuuaugugaa

SEQ ID NO: 1483573 - RNA, 19 nt, Human
uuaugaaacuuuuggaagg

SEQ ID NO: 1483574 - RNA, 20 nt, Human
uuaugauacuugaaaauuaa

SEQ ID NO: 1483575 - RNA, 16 nt, Human
uuaugacuauguaaac

SEQ ID NO: 1483576 - RNA, 15 nt, Human
uuaugacuauguaaa

SEQ ID NO: 1483577 - RNA, 15 nt, Human
uuaugacugccaaga

SEQ ID NO: 1483578 - RNA, 15 nt, Human
uuaugagaaagccuu

SEQ ID NO: 1483579 - RNA, 18 nt, Human
uuaugagcucuucauguu

SEQ ID NO: 1483580 - RNA, 14 nt, Human
uuaugaauuacauu

SEQ ID NO: 1483581 - RNA, 16 nt, Human
uuaugaauuacauuug

SEQ ID NO: 1483582 - RNA, 17 nt, Human
uuaugaauuacauuugu

SEQ ID NO: 1483583 - RNA, 21 nt, Human
uuaugaauuacauuuguauaa

SEQ ID NO: 1483584 - RNA, 16 nt, Human
uuaugacaucacuugu

SEQ ID NO: 1483585 - RNA, 18 nt, Human
uuaugacaucacuuguac

SEQ ID NO: 1483586 - RNA, 21 nt, Human
uuaugacaucacuuguacaaa

SEQ ID NO: 1483587 - RNA, 23 nt, Human
uuaugacaucacuuguacaaaau

SEQ ID NO: 1483588 - RNA, 21 nt, Human
auacaggaugaugacuaugga

SEQ ID NO: 1483589 - RNA, 22 nt, Human
auacauguaauucuaccaaggu

SEQ ID NO: 1483590 - RNA, 22 nt, Human
auacaugcuaagagaaguagaa

SEQ ID NO: 1483591 - RNA, 18 nt, Human
auacaugcuaagagaagu

SEQ ID NO: 1483592 - RNA, 17 nt, Human
auacauacagaauuacu

SEQ ID NO: 1483593 - RNA, 12 nt, Human
auacauacagaa

SEQ ID NO: 1483594 - RNA, 22 nt, Human
uuauaaacuuuuuucuuacugu

SEQ ID NO: 1483595 - RNA, 16 nt, Human
uuauaaacuuuuuucu

SEQ ID NO: 1483596 - RNA, 12 nt, Human
uuauaaacuuuu

SEQ ID NO: 1483597 - RNA, 20 nt, Human
auacagaauuacuguaacug

SEQ ID NO: 1483598 - RNA, 18 nt, Human
auacgugggcauucaaau

SEQ ID NO: 1483599 - RNA, 19 nt, Human
auacgugggcauucaaaug

SEQ ID NO: 1483600 - RNA, 16 nt, Human
auacgacaguacacug

SEQ ID NO: 1483601 - RNA, 19 nt, Human
uuauauuugaaauauugac

SEQ ID NO: 1483602 - RNA, 21 nt, Human
auacuauuaaaaagguuuaca

SEQ ID NO: 1483603 - RNA, 14 nt, Human
auacuauaguacca

SEQ ID NO: 1483604 - RNA, 15 nt, Human
auacuauauuuuagg

SEQ ID NO: 1483605 - RNA, 22 nt, Human
auacuauuaaaaagguuuacag

SEQ ID NO: 1483606 - RNA, 16 nt, Human
aguggggaaugaagau

SEQ ID NO: 1483607 - RNA, 12 nt, Human
aguggggguggg

SEQ ID NO: 1483608 - RNA, 19 nt, Human
aguggggguggggguaggg

SEQ ID NO: 1483609 - RNA, 22 nt, Human
aguggguuuuuuaguugaauuu

SEQ ID NO: 1483610 - RNA, 22 nt, Human
aguggacuggccucaaagcaag

SEQ ID NO: 1483611 - RNA, 18 nt, Human
uguuacaaauuguagaag

SEQ ID NO: 1483612 - RNA, 17 nt, Human
uguuacaaauuguagaa

SEQ ID NO: 1483613 - RNA, 13 nt, Human
uguuaauauugau

SEQ ID NO: 1483614 - RNA, 19 nt, Human
uguuaauauugauuuauua

SEQ ID NO: 1483615 - RNA, 15 nt, Human
uguuaagacuugaca

SEQ ID NO: 1483616 - RNA, 17 nt, Human
uguuaagacuugacagu

SEQ ID NO: 1483617 - RNA, 20 nt, Human
uguuaagacuugacagugga

SEQ ID NO: 1483618 - RNA, 14 nt, Human
ugugucugcucagu

SEQ ID NO: 1483619 - RNA, 16 nt, Human
agugccauuaacaaau

SEQ ID NO: 1483620 - RNA, 21 nt, Human
ugugguacaagcauucugucu

SEQ ID NO: 1483621 - RNA, 19 nt, Human
ugugguacaugguguuugu

SEQ ID NO: 1483622 - RNA, 16 nt, Human
ugugguacaugguguu

SEQ ID NO: 1483623 - RNA, 20 nt, Human
uguuaugacuauguaaacua

SEQ ID NO: 1483624 - RNA, 18 nt, Human
uguuaugacuauguaaac

SEQ ID NO: 1483625 - RNA, 17 nt, Human
uguuaugacuauguaaa

SEQ ID NO: 1483626 - RNA, 16 nt, Human
uguuaugacuauguaa

SEQ ID NO: 1483627 - RNA, 14 nt, Human
uguucauuuccuca

SEQ ID NO: 1483628 - RNA, 19 nt, Human
uguuccuuaagucagaaca

SEQ ID NO: 1483629 - RNA, 17 nt, Human
agugugaccaaaaguua

SEQ ID NO: 1483630 - RNA, 19 nt, Human
agugugaccaaaaguuaca

SEQ ID NO: 1483631 - RNA, 22 nt, Human
agugugaccaaaaguuacaugu

SEQ ID NO: 1483632 - RNA, 23 nt, Human
aguggguuuuuuaguugaauuuu

SEQ ID NO: 1483633 - RNA, 19 nt, Human
agugguaaaaaggccuccu

SEQ ID NO: 1483634 - RNA, 20 nt, Human
agugugcgugguggucccug

SEQ ID NO: 1483635 - RNA, 22 nt, Human
agugugcgugguggucccuggg

SEQ ID NO: 1483636 - RNA, 23 nt, Human
agugugcgugguggucccugggu

SEQ ID NO: 1483637 - RNA, 22 nt, Human
agugugcuucuguuaucaaaca

SEQ ID NO: 1483638 - RNA, 19 nt, Human
aguguguguuuuucauaaa

SEQ ID NO: 1483639 - RNA, 18 nt, Human
aguguguguuuuucauaa

SEQ ID NO: 1483640 - RNA, 16 nt, Human
aguguugaaaauguuc

SEQ ID NO: 1483641 - RNA, 17 nt, Human
aguguugaaaauguuca

SEQ ID NO: 1483642 - RNA, 15 nt, Human
uguugcauagaauaa

SEQ ID NO: 1483643 - RNA, 22 nt, Human
uguugcccacagcuguaugauu

SEQ ID NO: 1483644 - RNA, 17 nt, Human
uguugccaguuguccuc

SEQ ID NO: 1483645 - RNA, 21 nt, Human
aguguguggcuuucagagccu

SEQ ID NO: 1483646 - RNA, 18 nt, Human
uguugccaguuguccucc

SEQ ID NO: 1483647 - RNA, 19 nt, Human
uguugccaguuguccuccu

SEQ ID NO: 1483648 - RNA, 18 nt, Human
agugccagcaccugccca

SEQ ID NO: 1483649 - RNA, 22 nt, Human
agugcauuuaugagcucuucau

SEQ ID NO: 1483650 - RNA, 17 nt, Human
agugcacuaauguguaa

SEQ ID NO: 1483651 - RNA, 21 nt, Human
agugcacuaauguguaagaca

SEQ ID NO: 1483652 - RNA, 14 nt, Human
agugcaaggaccua

SEQ ID NO: 1483653 - RNA, 16 nt, Human
agugcacuugcuggaa

SEQ ID NO: 1483654 - RNA, 20 nt, Human
agugcacuugcuggaagacg

SEQ ID NO: 1483655 - RNA, 18 nt, Human
agugcacuugcuggaaga

SEQ ID NO: 1483656 - RNA, 23 nt, Human
agugcaguggcaucaucucagcu

SEQ ID NO: 1483657 - RNA, 23 nt, Human
agugcaguggcgugaucucagcu

SEQ ID NO: 1483658 - RNA, 23 nt, Human
agugcaguggcgcgaucucagcu

SEQ ID NO: 1483659 - RNA, 14 nt, Human
agugcaaauuguca

SEQ ID NO: 1483660 - RNA, 21 nt, Human
agugauuuuuaugccaccuga

SEQ ID NO: 1483661 - RNA, 16 nt, Human
agugauuuuuaugcca

SEQ ID NO: 1483662 - RNA, 20 nt, Human
agugauuuuuaugccaccug

SEQ ID NO: 1483663 - RNA, 15 nt, Human
agugaguuuuuuagu

SEQ ID NO: 1483664 - RNA, 19 nt, Human
agugaguuuuuuagugcgu

SEQ ID NO: 1483665 - RNA, 21 nt, Human
ugugcucaggagcccugggag

SEQ ID NO: 1483666 - RNA, 16 nt, Human
ugugauucaaucugua

SEQ ID NO: 1483667 - RNA, 20 nt, Human
ugugauucaaucuguaaacu

SEQ ID NO: 1483668 - RNA, 22 nt, Human
ugugauucaaucuguaaacugu

SEQ ID NO: 1483669 - RNA, 21 nt, Human
uguggaucaaauccagccugc

SEQ ID NO: 1483670 - RNA, 19 nt, Human
uguggaucaaccaucgcuu

SEQ ID NO: 1483671 - RNA, 20 nt, Human
uguggaucaaccaucgcuuu

SEQ ID NO: 1483672 - RNA, 19 nt, Human
ugugcugugcuauggugcu

SEQ ID NO: 1483673 - RNA, 18 nt, Human
agugacuuuggcugcaug

SEQ ID NO: 1483674 - RNA, 18 nt, Human
agugacucuauauagcug

SEQ ID NO: 1483675 - RNA, 12 nt, Human
agugagaggcug

SEQ ID NO: 1483676 - RNA, 11 nt, Human
agugagccuga

SEQ ID NO: 1483677 - RNA, 21 nt, Human
agugagccugaauuuuguugc

SEQ ID NO: 1483678 - RNA, 15 nt, Human
ugugauucaaucugu

SEQ ID NO: 1483679 - RNA, 18 nt, Human
agucuuucacauuuaaau

SEQ ID NO: 1483680 - RNA, 16 nt, Human
agucuuucacauuuaa

SEQ ID NO: 1483681 - RNA, 16 nt, Human
agugacuaauggcaug

SEQ ID NO: 1483682 - RNA, 17 nt, Human
agugacuaauggcauga

SEQ ID NO: 1483683 - RNA, 20 nt, Human
agucugaaccuauuucuuaa

SEQ ID NO: 1483684 - RNA, 14 nt, Human
agucaccagagacu

SEQ ID NO: 1483685 - RNA, 20 nt, Human
aguauuuuagugaacuugaa

SEQ ID NO: 1483686 - RNA, 18 nt, Human
aguauuuuagugaacuug

SEQ ID NO: 1483687 - RNA, 17 nt, Human
aguauuuugcuggaaua

SEQ ID NO: 1483688 - RNA, 13 nt, Human
aguauuuguuaau

SEQ ID NO: 1483689 - RNA, 14 nt, Human
aguauuuguuaauu

SEQ ID NO: 1483690 - RNA, 15 nt, Human
aguauuuguuaauuu

SEQ ID NO: 1483691 - RNA, 18 nt, Human
aguauuuguuaauuuaga

SEQ ID NO: 1483692 - RNA, 19 nt, Human
uguauauuacaaugaucac

SEQ ID NO: 1483693 - RNA, 19 nt, Human
uguauauuaagguguggcu

SEQ ID NO: 1483694 - RNA, 20 nt, Human
aguauuccagaccugaagaa

SEQ ID NO: 1483695 - RNA, 15 nt, Human
aguauaccugauuuu

SEQ ID NO: 1483696 - RNA, 16 nt, Human
ugucagcagggacugu

SEQ ID NO: 1483697 - RNA, 15 nt, Human
agucuauuuacggaa

SEQ ID NO: 1483698 - RNA, 20 nt, Human
agucuauuuacggaacucaa

SEQ ID NO: 1483699 - RNA, 22 nt, Human
agucuaucaaccccagacacug

SEQ ID NO: 1483700 - RNA, 23 nt, Human
agucuaucaaccccagacacugg

SEQ ID NO: 1483701 - RNA, 18 nt, Human
agucuaucaaucaacuua

SEQ ID NO: 1483702 - RNA, 19 nt, Human
agucucagaaugucauuuu

SEQ ID NO: 1483703 - RNA, 18 nt, Human
agucguacagaaagcugc

SEQ ID NO: 1483704 - RNA, 21 nt, Human
agucuaaagcugguuuaaugu

SEQ ID NO: 1483705 - RNA, 20 nt, Human
agucuaaagcugguuuaaug

SEQ ID NO: 1483706 - RNA, 14 nt, Human
agucaggaaagaga

SEQ ID NO: 1483707 - RNA, 15 nt, Human
agucaggaaagagaa

SEQ ID NO: 1483708 - RNA, 22 nt, Human
agucagaacagcagacucagcu

SEQ ID NO: 1483709 - RNA, 12 nt, Human
agucagaacagc

SEQ ID NO: 1483710 - RNA, 14 nt, Human
agucagaacagcag

SEQ ID NO: 1483711 - RNA, 15 nt, Human
agucagaacagcaga

SEQ ID NO: 1483712 - RNA, 17 nt, Human
agucagaacagcagacu

SEQ ID NO: 1483713 - RNA, 23 nt, Human
aguaccaguaggggcuuauaaua

SEQ ID NO: 1483714 - RNA, 23 nt, Human
aguagcacaaguuauuuaaaucu

SEQ ID NO: 1483715 - RNA, 14 nt, Human
aguagcagugauug

SEQ ID NO: 1483716 - RNA, 22 nt, Human
aguagcagugauugucuuaaua

SEQ ID NO: 1483717 - RNA, 20 nt, Human
uguagugauuuuuaugccac

SEQ ID NO: 1483718 - RNA, 21 nt, Human
uguagugauuuuuaugccacc

SEQ ID NO: 1483719 - RNA, 17 nt, Human
uguaguguuggagaaga

SEQ ID NO: 1483720 - RNA, 18 nt, Human
uguaguguuggagaagaa

SEQ ID NO: 1483721 - RNA, 19 nt, Human
uguaguguuggagaagaac

SEQ ID NO: 1483722 - RNA, 15 nt, Human
uguauauuacaauga

SEQ ID NO: 1483723 - RNA, 14 nt, Human
uguauauuacaaug

SEQ ID NO: 1483724 - RNA, 16 nt, Human
uguauauuaaggugug

SEQ ID NO: 1483725 - RNA, 15 nt, Human
uguauauauauauau

SEQ ID NO: 1483726 - RNA, 14 nt, Human
aguaaaaaggcuaa

SEQ ID NO: 1483727 - RNA, 23 nt, Human
aguaaaaacaaagaaauuaugug

SEQ ID NO: 1483728 - RNA, 16 nt, Human
aguaaaaacaaagaaa

SEQ ID NO: 1483729 - RNA, 22 nt, Human
aguaauaaaauucaacaaacau

SEQ ID NO: 1483730 - RNA, 15 nt, Human
aguaauaaaauucaa

SEQ ID NO: 1483731 - RNA, 23 nt, Human
aguaauaaaauucaacaaacauu

SEQ ID NO: 1483732 - RNA, 13 nt, Human
aguaaugauaacu

SEQ ID NO: 1483733 - RNA, 13 nt, Human
aguaaucugcauu

SEQ ID NO: 1483734 - RNA, 23 nt, Human
aguaaucugcauuauuggaauau

SEQ ID NO: 1483735 - RNA, 12 nt, Human
aguaauuggaaa

SEQ ID NO: 1483736 - RNA, 13 nt, Human
aguaauuggaaag

SEQ ID NO: 1483737 - RNA, 12 nt, Human
aguaauuuagaa

SEQ ID NO: 1483738 - RNA, 14 nt, Human
aguaauuuagaaau

SEQ ID NO: 1483739 - RNA, 23 nt, Human
aguaauuuagaaaucauuuugca

SEQ ID NO: 1483740 - RNA, 17 nt, Human
aguaauuuagaaaucau

SEQ ID NO: 1483741 - RNA, 13 nt, Human
agguugaaaaaca

SEQ ID NO: 1483742 - RNA, 20 nt, Human
agguguagccacaccaggau

SEQ ID NO: 1483743 - RNA, 15 nt, Human
aggugucauacagau

SEQ ID NO: 1483744 - RNA, 21 nt, Human
aggugucauacagauuugcaa

SEQ ID NO: 1483745 - RNA, 20 nt, Human
aggugggaggaugugaauug

SEQ ID NO: 1483746 - RNA, 13 nt, Human
aggugggaggaug

SEQ ID NO: 1483747 - RNA, 11 nt, Human
aggugggagga

SEQ ID NO: 1483748 - RNA, 20 nt, Human
agguuucacuguguuggcca

SEQ ID NO: 1483749 - RNA, 19 nt, Human
agguuucugaguuccugca

SEQ ID NO: 1483750 - RNA, 21 nt, Human
agguuucugaguuccugcaug

SEQ ID NO: 1483751 - RNA, 17 nt, Human
uguaauugaauauuauu

SEQ ID NO: 1483752 - RNA, 19 nt, Human
uguaauugaauauuauucc

SEQ ID NO: 1483753 - RNA, 14 nt, Human
uguacauauaagug

SEQ ID NO: 1483754 - RNA, 18 nt, Human
uguacauaguuauuuauu

SEQ ID NO: 1483755 - RNA, 17 nt, Human
uguacauaacugaaaau

SEQ ID NO: 1483756 - RNA, 18 nt, Human
uguacauaacugaaaaug

SEQ ID NO: 1483757 - RNA, 19 nt, Human
uguacauaacugaaaaugu

SEQ ID NO: 1483758 - RNA, 13 nt, Human
uguacaaaauaaa

SEQ ID NO: 1483759 - RNA, 17 nt, Human
uguacaaaauaaacaaa

SEQ ID NO: 1483760 - RNA, 13 nt, Human
uguacauaacuga

SEQ ID NO: 1483761 - RNA, 14 nt, Human
uguacauaacugaa

SEQ ID NO: 1483762 - RNA, 15 nt, Human
uguacauaacugaaa

SEQ ID NO: 1483763 - RNA, 18 nt, Human
ugggaaacaaaaggauaa

SEQ ID NO: 1483764 - RNA, 17 nt, Human
ugggaaaaauguaggag

SEQ ID NO: 1483765 - RNA, 16 nt, Human
ugggaaaaauguagga

SEQ ID NO: 1483766 - RNA, 19 nt, Human
uggcugagauaugaacaua

SEQ ID NO: 1483767 - RNA, 14 nt, Human
uggcugcaggaauc

SEQ ID NO: 1483768 - RNA, 16 nt, Human
uggcugcaggaaucuu

SEQ ID NO: 1483769 - RNA, 17 nt, Human
uggcuguggcauccaga

SEQ ID NO: 1483770 - RNA, 20 nt, Human
uggcuguggccuaaccugcc

SEQ ID NO: 1483771 - RNA, 15 nt, Human
aggcucccagggaca

SEQ ID NO: 1483772 - RNA, 22 nt, Human
uggcugaaaggaagcugugcgu

SEQ ID NO: 1483773 - RNA, 16 nt, Human
uggcugaaaggaagcu

SEQ ID NO: 1483774 - RNA, 18 nt, Human
uggcugacaugaagcugu

SEQ ID NO: 1483775 - RNA, 21 nt, Human
aggcugggucgcccuggacug

SEQ ID NO: 1483776 - RNA, 20 nt, Human
aggcugggucgcccuggacu

SEQ ID NO: 1483777 - RNA, 18 nt, Human
aggcugggucgcccugga

SEQ ID NO: 1483778 - RNA, 15 nt, Human
aggcugggucgcccu

SEQ ID NO: 1483779 - RNA, 10 nt, Human
aggcuggguc

SEQ ID NO: 1483780 - RNA, 18 nt, Human
agggaaaacauuccaucc

SEQ ID NO: 1483781 - RNA, 16 nt, Human
agggaaaacauuccau

SEQ ID NO: 1483782 - RNA, 15 nt, Human
agggaaaacauucca

SEQ ID NO: 1483783 - RNA, 21 nt, Human
aggcuuuuuuaucaugugaaa

SEQ ID NO: 1483784 - RNA, 18 nt, Human
aggcuuuuuuaucaugug

SEQ ID NO: 1483785 - RNA, 15 nt, Human
aggcuuuuuuaucau

SEQ ID NO: 1483786 - RNA, 13 nt, Human
aggcuuucucuac

SEQ ID NO: 1483787 - RNA, 20 nt, Human
aggcuuugcccugcugcccu

SEQ ID NO: 1483788 - RNA, 18 nt, Human
aggcuuugcccugcugcc

SEQ ID NO: 1483789 - RNA, 13 nt, Human
aggcuuugcccug

SEQ ID NO: 1483790 - RNA, 14 nt, Human
aggcuuguugugcu

SEQ ID NO: 1483791 - RNA, 16 nt, Human
aggcuuguugugcuuu

SEQ ID NO: 1483792 - RNA, 15 nt, Human
aggcuuguugugcuu

SEQ ID NO: 1483793 - RNA, 23 nt, Human
aggcuuccacguacugcagccuc

SEQ ID NO: 1483794 - RNA, 14 nt, Human
aggcuuccuucauu

SEQ ID NO: 1483795 - RNA, 16 nt, Human
aggcuuccuucauuuc

SEQ ID NO: 1483796 - RNA, 18 nt, Human
aggcuuccuucauuuccu

SEQ ID NO: 1483797 - RNA, 19 nt, Human
aggcuuccuucauuuccuc

SEQ ID NO: 1483798 - RNA, 21 nt, Human
aggcuuccuucauuuccuccg

SEQ ID NO: 1483799 - RNA, 15 nt, Human
aggcuugccugcagg

SEQ ID NO: 1483800 - RNA, 16 nt, Human
aggcuugccugcaggc

SEQ ID NO: 1483801 - RNA, 17 nt, Human
aggcuugccugcaggca

SEQ ID NO: 1483802 - RNA, 14 nt, Human
ugggcauucaaaug

SEQ ID NO: 1483803 - RNA, 19 nt, Human
ugggcaaugauggcaauuu

SEQ ID NO: 1483804 - RNA, 23 nt, Human
ugggaggcucuggagcccacugu

SEQ ID NO: 1483805 - RNA, 17 nt, Human
ugggaggcucuggagcc

SEQ ID NO: 1483806 - RNA, 14 nt, Human
ugggaggcucugga

SEQ ID NO: 1483807 - RNA, 16 nt, Human
ugggagaaaugaaaaa

SEQ ID NO: 1483808 - RNA, 19 nt, Human
ugggagaaaucuggcuucu

SEQ ID NO: 1483809 - RNA, 20 nt, Human
ugggaggccuuucccuaagc

SEQ ID NO: 1483810 - RNA, 15 nt, Human
ugggaggaugugaau

SEQ ID NO: 1483811 - RNA, 21 nt, Human
agggagacuggguaggaaaga

SEQ ID NO: 1483812 - RNA, 13 nt, Human
agggaaauuucag

SEQ ID NO: 1483813 - RNA, 15 nt, Human
ugggagaaaugaaaa

SEQ ID NO: 1483814 - RNA, 16 nt, Human
agggagccauguuuca

SEQ ID NO: 1483815 - RNA, 22 nt, Human
agggcuguuauaaucuuucaca

SEQ ID NO: 1483816 - RNA, 18 nt, Human
ugggcuccgugugggaga

SEQ ID NO: 1483817 - RNA, 15 nt, Human
agggcuccuauucaa

SEQ ID NO: 1483818 - RNA, 17 nt, Human
agggcugagcucucugu

SEQ ID NO: 1483819 - RNA, 20 nt, Human
agggcugccuucuggccuug

SEQ ID NO: 1483820 - RNA, 18 nt, Human
agggccacauagaugcug

SEQ ID NO: 1483821 - RNA, 13 nt, Human
agggccaaagaac

SEQ ID NO: 1483822 - RNA, 23 nt, Human
agggccaaagaaccaaagaagaa

SEQ ID NO: 1483823 - RNA, 16 nt, Human
agggccaaagaaccaa

SEQ ID NO: 1483824 - RNA, 16 nt, Human
agggcauaaauuauug

SEQ ID NO: 1483825 - RNA, 16 nt, Human
ugggccaacucaccug

SEQ ID NO: 1483826 - RNA, 23 nt, Human
uggaagugacuuuggcugcaugc

SEQ ID NO: 1483827 - RNA, 17 nt, Human
uggaagugacuuuggcu

SEQ ID NO: 1483828 - RNA, 15 nt, Human
uggaagugacuuugg

SEQ ID NO: 1483829 - RNA, 14 nt, Human
uggaagugcuaauu

SEQ ID NO: 1483830 - RNA, 19 nt, Human
uggaaguggggcgggcuuc

SEQ ID NO: 1483831 - RNA, 19 nt, Human
aggaguuucguuuucaaaa

SEQ ID NO: 1483832 - RNA, 20 nt, Human
uggaacacuagacaagccag

SEQ ID NO: 1483833 - RNA, 22 nt, Human
uggaacacuagacaagccagaa

SEQ ID NO: 1483834 - RNA, 23 nt, Human
ugcugcccucccccuccucucca

SEQ ID NO: 1483835 - RNA, 21 nt, Human
uggaacacuagacaagccaga

SEQ ID NO: 1483836 - RNA, 17 nt, Human
uggaagcugcccugccc

SEQ ID NO: 1483837 - RNA, 18 nt, Human
uggaagcugcccugccca

SEQ ID NO: 1483838 - RNA, 17 nt, Human
uggacaaaauggaauac

SEQ ID NO: 1483839 - RNA, 15 nt, Human
uggacaaagaaccuu

SEQ ID NO: 1483840 - RNA, 14 nt, Human
uggacaaaauggaa

SEQ ID NO: 1483841 - RNA, 16 nt, Human
uggacaccugcccugc

SEQ ID NO: 1483842 - RNA, 15 nt, Human
uggacaccugcccug

SEQ ID NO: 1483843 - RNA, 14 nt, Human
uggacaccugcccu

SEQ ID NO: 1483844 - RNA, 13 nt, Human
uggacaccugccc

SEQ ID NO: 1483845 - RNA, 12 nt, Human
uggacaccugcc

SEQ ID NO: 1483846 - RNA, 11 nt, Human
uggacaccugc

SEQ ID NO: 1483847 - RNA, 10 nt, Human
uggacaccug

SEQ ID NO: 1483848 - RNA, 14 nt, Human
uggaauuugaaaca

SEQ ID NO: 1483849 - RNA, 17 nt, Human
aggaucucaccaggcag

SEQ ID NO: 1483850 - RNA, 23 nt, Human
aggaucucaccaggcagccucug

SEQ ID NO: 1483851 - RNA, 18 nt, Human
aggaucucaccaggcagc

SEQ ID NO: 1483852 - RNA, 12 nt, Human
aggauuggggaa

SEQ ID NO: 1483853 - RNA, 21 nt, Human
aggauuggggaagagagccug

SEQ ID NO: 1483854 - RNA, 17 nt, Human
aggauuuauuuaaaaua

SEQ ID NO: 1483855 - RNA, 12 nt, Human
uggagcugagca

SEQ ID NO: 1483856 - RNA, 16 nt, Human
aggcacaugucagcaa

SEQ ID NO: 1483857 - RNA, 17 nt, Human
aggcaccaaaagaagua

SEQ ID NO: 1483858 - RNA, 20 nt, Human
aggcaccaaaagaaguaaaa

SEQ ID NO: 1483859 - RNA, 18 nt, Human
aggcaccaaaagaaguaa

SEQ ID NO: 1483860 - RNA, 23 nt, Human
uggagcccacuguacuugcucuu

SEQ ID NO: 1483861 - RNA, 19 nt, Human
uggagcccacuguacuugc

SEQ ID NO: 1483862 - RNA, 16 nt, Human
uggagcccacuguacu

SEQ ID NO: 1483863 - RNA, 16 nt, Human
uggagaagaacugaaa

SEQ ID NO: 1483864 - RNA, 17 nt, Human
uggagaagacccucccc

SEQ ID NO: 1483865 - RNA, 18 nt, Human
uggacaccugcccugccc

SEQ ID NO: 1483866 - RNA, 17 nt, Human
uggacaccugcccugcc

SEQ ID NO: 1483867 - RNA, 19 nt, Human
aggcaguucaaagcaggau

SEQ ID NO: 1483868 - RNA, 18 nt, Human
aggcaguucaaagcagga

SEQ ID NO: 1483869 - RNA, 20 nt, Human
aggcagcucuaaaugucaau

SEQ ID NO: 1483870 - RNA, 15 nt, Human
aggcagccucugggg

SEQ ID NO: 1483871 - RNA, 16 nt, Human
aggcagccucuggggg

SEQ ID NO: 1483872 - RNA, 22 nt, Human
aggcagccucugggggguggcc

SEQ ID NO: 1483873 - RNA, 21 nt, Human
aggcagccucugggggguggc

SEQ ID NO: 1483874 - RNA, 13 nt, Human
aggcagccucugg

SEQ ID NO: 1483875 - RNA, 14 nt, Human
aggcagccucuggg

SEQ ID NO: 1483876 - RNA, 22 nt, Human
aggcagggaggaggcagagaag

SEQ ID NO: 1483877 - RNA, 20 nt, Human
aggcaggaguuucguuuuca

SEQ ID NO: 1483878 - RNA, 18 nt, Human
uggcaucaucucagcuca

SEQ ID NO: 1483879 - RNA, 20 nt, Human
uggcauccagagucccugcc

SEQ ID NO: 1483880 - RNA, 21 nt, Human
uggcauccagagucccugccu

SEQ ID NO: 1483881 - RNA, 22 nt, Human
uggcauccagagucccugccug

SEQ ID NO: 1483882 - RNA, 16 nt, Human
aggccugacugccaag

SEQ ID NO: 1483883 - RNA, 17 nt, Human
aggccuagacucugucu

SEQ ID NO: 1483884 - RNA, 16 nt, Human
aggccuagacucuguc

SEQ ID NO: 1483885 - RNA, 14 nt, Human
aggccuagacucug

SEQ ID NO: 1483886 - RNA, 15 nt, Human
aggccuagaggccug

SEQ ID NO: 1483887 - RNA, 21 nt, Human
aggccuagacucugucuaccu

SEQ ID NO: 1483888 - RNA, 18 nt, Human
aggccgggaaaaagccca

SEQ ID NO: 1483889 - RNA, 14 nt, Human
aggccgggaaaaag

SEQ ID NO: 1483890 - RNA, 17 nt, Human
aggccgugacgucuggg

SEQ ID NO: 1483891 - RNA, 20 nt, Human
aggccgugacgucugggugg

SEQ ID NO: 1483892 - RNA, 21 nt, Human
aggccgugacgucuggguggc

SEQ ID NO: 1483893 - RNA, 22 nt, Human
aggccgugacgucuggguggcc

SEQ ID NO: 1483894 - RNA, 13 nt, Human
uggcagcaacaau

SEQ ID NO: 1483895 - RNA, 22 nt, Human
uggcacagccuggcuguggccu

SEQ ID NO: 1483896 - RNA, 23 nt, Human
uggcacagagguagucucacugc

SEQ ID NO: 1483897 - RNA, 20 nt, Human
aggcauccuuccucacacca

SEQ ID NO: 1483898 - RNA, 18 nt, Human
aggcauccuuccucacac

SEQ ID NO: 1483899 - RNA, 14 nt, Human
aggccagagccaag

SEQ ID NO: 1483900 - RNA, 14 nt, Human
aggccauucuuucc

SEQ ID NO: 1483901 - RNA, 15 nt, Human
aggccauucuuuccc

SEQ ID NO: 1483902 - RNA, 12 nt, Human
uggcauguguuu

SEQ ID NO: 1483903 - RNA, 20 nt, Human
uggcauguuagcccuuccuc

SEQ ID NO: 1483904 - RNA, 19 nt, Human
uggcauuacagcuggagaa

SEQ ID NO: 1483905 - RNA, 21 nt, Human
uggcccuuaugacugccaaga

SEQ ID NO: 1483906 - RNA, 19 nt, Human
aggccuugcggcuccucag

SEQ ID NO: 1483907 - RNA, 20 nt, Human
aggccuugcggcuccucagg

SEQ ID NO: 1483908 - RNA, 23 nt, Human
aggccuugcggcuccucagggac

SEQ ID NO: 1483909 - RNA, 22 nt, Human
aggccuugcggcuccucaggga

SEQ ID NO: 1483910 - RNA, 18 nt, Human
aggcgaagcguuguccuc

SEQ ID NO: 1483911 - RNA, 16 nt, Human
aggccuuuuggaaugu

SEQ ID NO: 1483912 - RNA, 20 nt, Human
aggccuuucccuaagccagc

SEQ ID NO: 1483913 - RNA, 18 nt, Human
aggccuuucccuaagcca

SEQ ID NO: 1483914 - RNA, 16 nt, Human
aggccuuucccuaagc

SEQ ID NO: 1483915 - RNA, 15 nt, Human
aggccuuucccuaag

SEQ ID NO: 1483916 - RNA, 14 nt, Human
aggccuuucccuaa

SEQ ID NO: 1483917 - RNA, 16 nt, Human
aggcuauuauuuucac

SEQ ID NO: 1483918 - RNA, 18 nt, Human
aggcuauuauuuucacug

SEQ ID NO: 1483919 - RNA, 19 nt, Human
aggcuauuauuuucacugu

SEQ ID NO: 1483920 - RNA, 22 nt, Human
aggcuccaccccauccaguuca

SEQ ID NO: 1483921 - RNA, 18 nt, Human
aggcucagaggguguccu

SEQ ID NO: 1483922 - RNA, 19 nt, Human
aggcucagaggguguccug

SEQ ID NO: 1483923 - RNA, 20 nt, Human
aggcucagaggguguccugc

SEQ ID NO: 1483924 - RNA, 20 nt, Human
agcuggggccaggcuggguc

SEQ ID NO: 1483925 - RNA, 17 nt, Human
agcugugaccucucccc

SEQ ID NO: 1483926 - RNA, 17 nt, Human
ugccuugucacgccaga

SEQ ID NO: 1483927 - RNA, 15 nt, Human
ugccuuacucuucuu

SEQ ID NO: 1483928 - RNA, 18 nt, Human
ugccuuacucuucuugaa

SEQ ID NO: 1483929 - RNA, 19 nt, Human
ugccuuacucuucuugaaa

SEQ ID NO: 1483930 - RNA, 13 nt, Human
ugccuuguuucau

SEQ ID NO: 1483931 - RNA, 22 nt, Human
ugccuuuuuauuuuuguuuuua

SEQ ID NO: 1483932 - RNA, 19 nt, Human
agcugccucuucccucuuc

SEQ ID NO: 1483933 - RNA, 15 nt, Human
agcugccucuucccu

SEQ ID NO: 1483934 - RNA, 21 nt, Human
ugccucucugcaggucccuaa

SEQ ID NO: 1483935 - RNA, 22 nt, Human
ugccucugagagcaucaggccu

SEQ ID NO: 1483936 - RNA, 12 nt, Human
ugccucugagag

SEQ ID NO: 1483937 - RNA, 20 nt, Human
agcugccuggaagagcagcc

SEQ ID NO: 1483938 - RNA, 21 nt, Human
agcugccuggaagagcagccc

SEQ ID NO: 1483939 - RNA, 15 nt, Human
agcugccugguauau

SEQ ID NO: 1483940 - RNA, 15 nt, Human
agcuggaccucacca

SEQ ID NO: 1483941 - RNA, 16 nt, Human
agcuggaccucaccaa

SEQ ID NO: 1483942 - RNA, 17 nt, Human
agcuggggccaggcugg

SEQ ID NO: 1483943 - RNA, 15 nt, Human
agcuggagaagaccc

SEQ ID NO: 1483944 - RNA, 20 nt, Human
ugccucucugcaggucccua

SEQ ID NO: 1483945 - RNA, 19 nt, Human
ugccucucugcaggucccu

SEQ ID NO: 1483946 - RNA, 18 nt, Human
ugccucucugcagguccc

SEQ ID NO: 1483947 - RNA, 16 nt, Human
ugccucucugcagguc

SEQ ID NO: 1483948 - RNA, 14 nt, Human
agcugccaagagug

SEQ ID NO: 1483949 - RNA, 19 nt, Human
agcugauggagaaggaagg

SEQ ID NO: 1483950 - RNA, 17 nt, Human
agcugauggagaaggaa

SEQ ID NO: 1483951 - RNA, 16 nt, Human
agcugauggagaagga

SEQ ID NO: 1483952 - RNA, 15 nt, Human
agcugauggagaagg

SEQ ID NO: 1483953 - RNA, 14 nt, Human
agcugauggagaag

SEQ ID NO: 1483954 - RNA, 14 nt, Human
agcucuucuccauc

SEQ ID NO: 1483955 - RNA, 21 nt, Human
agcucucaguugcagcccugc

SEQ ID NO: 1483956 - RNA, 17 nt, Human
agcucucaguugcagcc

SEQ ID NO: 1483957 - RNA, 18 nt, Human
ugcccucauuuuauguca

SEQ ID NO: 1483958 - RNA, 18 nt, Human
agcucuccggucucucuc

SEQ ID NO: 1483959 - RNA, 14 nt, Human
aggaaauauuuauu

SEQ ID NO: 1483960 - RNA, 18 nt, Human
aggaaauauuuauuuuaa

SEQ ID NO: 1483961 - RNA, 24 nt, Human
aggaaagcgccuccaacccuagca

SEQ ID NO: 1483962 - RNA, 15 nt, Human
ugcucuuagcugucu

SEQ ID NO: 1483963 - RNA, 12 nt, Human
ugcucuuagcug

SEQ ID NO: 1483964 - RNA, 14 nt, Human
ugcucugauuuauc

SEQ ID NO: 1483965 - RNA, 17 nt, Human
ugcuaucauuauucgua

SEQ ID NO: 1483966 - RNA, 23 nt, Human
aggaaugaaauccugcuucagug

SEQ ID NO: 1483967 - RNA, 22 nt, Human
aggaaucuuuaaaagaugcuuu

SEQ ID NO: 1483968 - RNA, 16 nt, Human
aggaaucuuuaaaaga

SEQ ID NO: 1483969 - RNA, 17 nt, Human
aggaagagaaggagcag

SEQ ID NO: 1483970 - RNA, 16 nt, Human
aggaagagaaggagca

SEQ ID NO: 1483971 - RNA, 14 nt, Human
aggaagagaaggag

SEQ ID NO: 1483972 - RNA, 12 nt, Human
aggaagagaagg

SEQ ID NO: 1483973 - RNA, 22 nt, Human
aggaauuuuauuuuuuucugaa

SEQ ID NO: 1483974 - RNA, 14 nt, Human
aggaauuuucuuug

SEQ ID NO: 1483975 - RNA, 16 nt, Human
aggaauuuucuuugug

SEQ ID NO: 1483976 - RNA, 14 nt, Human
aggacaaccauucc

SEQ ID NO: 1483977 - RNA, 21 nt, Human
agcuuauugucuagugaaacu

SEQ ID NO: 1483978 - RNA, 23 nt, Human
agcuuaucuacuuccaaacuaau

SEQ ID NO: 1483979 - RNA, 12 nt, Human
agcuugggaaug

SEQ ID NO: 1483980 - RNA, 14 nt, Human
agcuugggaaugga

SEQ ID NO: 1483981 - RNA, 20 nt, Human
agcuugggaaaggugguguu

SEQ ID NO: 1483982 - RNA, 14 nt, Human
agcuguuuucuucu

SEQ ID NO: 1483983 - RNA, 12 nt, Human
agcuuaaaacuu

SEQ ID NO: 1483984 - RNA, 13 nt, Human
agcuuaaaacuuu

SEQ ID NO: 1483985 - RNA, 14 nt, Human
agcuuaaaacuuug

SEQ ID NO: 1483986 - RNA, 22 nt, Human
agcuuaaaacuuugaaguuagc

SEQ ID NO: 1483987 - RNA, 16 nt, Human
agcuuaaaacuuugaa

SEQ ID NO: 1483988 - RNA, 13 nt, Human
aggaaagaaaaca

SEQ ID NO: 1483989 - RNA, 12 nt, Human
aggaaagaaaac

SEQ ID NO: 1483990 - RNA, 13 nt, Human
aggaaagagaacu

SEQ ID NO: 1483991 - RNA, 19 nt, Human
aggaaagagaacuuccaga

SEQ ID NO: 1483992 - RNA, 16 nt, Human
ugcuaguaauuggaaa

SEQ ID NO: 1483993 - RNA, 13 nt, Human
ugcuauacugcau

SEQ ID NO: 1483994 - RNA, 17 nt, Human
aggaaagaggaagcaaa

SEQ ID NO: 1483995 - RNA, 14 nt, Human
ugcuaguaauugga

SEQ ID NO: 1483996 - RNA, 15 nt, Human
ugcauaauggucaga

SEQ ID NO: 1483997 - RNA, 22 nt, Human
ugcauaacguauaaaagccugu

SEQ ID NO: 1483998 - RNA, 20 nt, Human
ugcaggucccuaauaaagcu

SEQ ID NO: 1483999 - RNA, 19 nt, Human
ugcaggucccuaauaaagc

SEQ ID NO: 1484000 - RNA, 18 nt, Human
ugcaggucccuaauaaag

SEQ ID NO: 1484001 - RNA, 21 nt, Human
ugcaggucccuaauaaagcug

SEQ ID NO: 1484002 - RNA, 22 nt, Human
ugcagcccugcugcugccugcc

SEQ ID NO: 1484003 - RNA, 19 nt, Human
ugcagcugagagaaaauaa

SEQ ID NO: 1484004 - RNA, 19 nt, Human
agccugacccucaucuuuc

SEQ ID NO: 1484005 - RNA, 14 nt, Human
agccugcaggaucu

SEQ ID NO: 1484006 - RNA, 22 nt, Human
agccugcaggaucucaccaggc

SEQ ID NO: 1484007 - RNA, 23 nt, Human
agccugcaggaucucaccaggca

SEQ ID NO: 1484008 - RNA, 23 nt, Human
agccugcauugagcuugcaugcu

SEQ ID NO: 1484009 - RNA, 22 nt, Human
agccugcauugagcuugcaugc

SEQ ID NO: 1484010 - RNA, 15 nt, Human
agccugcauugagcu

SEQ ID NO: 1484011 - RNA, 18 nt, Human
agcccuucuuuccacaga

SEQ ID NO: 1484012 - RNA, 19 nt, Human
agcccuucuuuccacagaa

SEQ ID NO: 1484013 - RNA, 12 nt, Human
agccuaagggau

SEQ ID NO: 1484014 - RNA, 16 nt, Human
agccuaagggauccug

SEQ ID NO: 1484015 - RNA, 21 nt, Human
agccuaagggauccugccugc

SEQ ID NO: 1484016 - RNA, 13 nt, Human
agccuacaggccu

SEQ ID NO: 1484017 - RNA, 14 nt, Human
agccuacaggccuc

SEQ ID NO: 1484018 - RNA, 20 nt, Human
ugcagaaagcaucccucacc

SEQ ID NO: 1484019 - RNA, 13 nt, Human
ugcagaaagcauc

SEQ ID NO: 1484020 - RNA, 15 nt, Human
ugcacaauaaaaaug

SEQ ID NO: 1484021 - RNA, 20 nt, Human
ugcacaauaaaaauguuuaa

SEQ ID NO: 1484022 - RNA, 21 nt, Human
ugcacaauaaaaauguuuaac

SEQ ID NO: 1484023 - RNA, 23 nt, Human
ugccacaccccccaccccuagga

SEQ ID NO: 1484024 - RNA, 21 nt, Human
ugccacaccccccaccccuag

SEQ ID NO: 1484025 - RNA, 16 nt, Human
ugcauucuggauuuua

SEQ ID NO: 1484026 - RNA, 19 nt, Human
agcgcuagaggaagcagcc

SEQ ID NO: 1484027 - RNA, 20 nt, Human
agcgcuagaggaagcagcca

SEQ ID NO: 1484028 - RNA, 13 nt, Human
agcgcuaucuccc

SEQ ID NO: 1484029 - RNA, 18 nt, Human
agcgcuaucucccugccu

SEQ ID NO: 1484030 - RNA, 17 nt, Human
agcgcuaucucccugcc

SEQ ID NO: 1484031 - RNA, 15 nt, Human
agcggcaucaggcuu

SEQ ID NO: 1484032 - RNA, 13 nt, Human
agcggcaucaggc

SEQ ID NO: 1484033 - RNA, 13 nt, Human
ugccacuggagug

SEQ ID NO: 1484034 - RNA, 17 nt, Human
agcuauauaagacaaga

SEQ ID NO: 1484035 - RNA, 11 nt, Human
agcuauauaag

SEQ ID NO: 1484036 - RNA, 19 nt, Human
agcuauggugucauaggcu

SEQ ID NO: 1484037 - RNA, 13 nt, Human
agcuauuucaucu

SEQ ID NO: 1484038 - RNA, 14 nt, Human
agcuauuucaucua

SEQ ID NO: 1484039 - RNA, 17 nt, Human
agcuauuucaucuauuu

SEQ ID NO: 1484040 - RNA, 21 nt, Human
agcuauuucaucuauuuuugg

SEQ ID NO: 1484041 - RNA, 23 nt, Human
agcuacugccgucagugcugugc

SEQ ID NO: 1484042 - RNA, 18 nt, Human
agcuauaaaaugaauaca

SEQ ID NO: 1484043 - RNA, 14 nt, Human
ugccauuaacaaau

SEQ ID NO: 1484044 - RNA, 16 nt, Human
ugccauucacuucaua

SEQ ID NO: 1484045 - RNA, 18 nt, Human
ugcccccagagccacagu

SEQ ID NO: 1484046 - RNA, 16 nt, Human
ugcccccagagccaca

SEQ ID NO: 1484047 - RNA, 14 nt, Human
ugcccccagagcca

SEQ ID NO: 1484048 - RNA, 17 nt, Human
ugcccccagagccacag

SEQ ID NO: 1484049 - RNA, 17 nt, Human
ugccccuacccuggacu

SEQ ID NO: 1484050 - RNA, 14 nt, Human
agaagcuccaggua

SEQ ID NO: 1484051 - RNA, 17 nt, Human
ucuggccaggaagcuuu

SEQ ID NO: 1484052 - RNA, 16 nt, Human
ucuggccaggaagcuu

SEQ ID NO: 1484053 - RNA, 18 nt, Human
ucuggauuauauuaugaa

SEQ ID NO: 1484054 - RNA, 12 nt, Human
ucuggauuauau

SEQ ID NO: 1484055 - RNA, 21 nt, Human
agaagaacugaaaucauacuu

SEQ ID NO: 1484056 - RNA, 18 nt, Human
agaagaaagaacggaaga

SEQ ID NO: 1484057 - RNA, 13 nt, Human
agaagaaacaagg

SEQ ID NO: 1484058 - RNA, 16 nt, Human
agaagaaagaacggaa

SEQ ID NO: 1484059 - RNA, 21 nt, Human
agaagaaacaagguuuucagu

SEQ ID NO: 1484060 - RNA, 20 nt, Human
ucugccuucucaugauccaa

SEQ ID NO: 1484061 - RNA, 22 nt, Human
ucugccuuuggggacuuuucuu

SEQ ID NO: 1484062 - RNA, 16 nt, Human
ucugcuacuuugcugc

SEQ ID NO: 1484063 - RNA, 22 nt, Human
ucugcucaguaauuugaggaca

SEQ ID NO: 1484064 - RNA, 18 nt, Human
ucugcuugauuuuugccu

SEQ ID NO: 1484065 - RNA, 21 nt, Human
ucugaggggcuaccaggaaag

SEQ ID NO: 1484066 - RNA, 20 nt, Human
ucugaggggcuaccaggaaa

SEQ ID NO: 1484067 - RNA, 19 nt, Human
ucugaggggcuaccaggaa

SEQ ID NO: 1484068 - RNA, 22 nt, Human
ucugagaaaagcuuugaacccu

SEQ ID NO: 1484069 - RNA, 16 nt, Human
ucugauacagaaaagu

SEQ ID NO: 1484070 - RNA, 17 nt, Human
ucugauacagaaaaguu

SEQ ID NO: 1484071 - RNA, 22 nt, Human
ucugauaggguuugugacaggg

SEQ ID NO: 1484072 - RNA, 21 nt, Human
ucugauaggguuugugacagg

SEQ ID NO: 1484073 - RNA, 15 nt, Human
ucugaucaaggccuu

SEQ ID NO: 1484074 - RNA, 14 nt, Human
ucugaccuccauga

SEQ ID NO: 1484075 - RNA, 21 nt, Human
ucugacuguuuccaucaaggg

SEQ ID NO: 1484076 - RNA, 13 nt, Human
agaagaaaaagaa

SEQ ID NO: 1484077 - RNA, 15 nt, Human
agaagaaaaagaagc

SEQ ID NO: 1484078 - RNA, 16 nt, Human
agaacucucuggaagc

SEQ ID NO: 1484079 - RNA, 21 nt, Human
agaacucucuggaagccccug

SEQ ID NO: 1484080 - RNA, 13 nt, Human
agaacucucugga

SEQ ID NO: 1484081 - RNA, 13 nt, Human
agaaauuuaaacu

SEQ ID NO: 1484082 - RNA, 16 nt, Human
agaaauuuaaacuaua

SEQ ID NO: 1484083 - RNA, 20 nt, Human
agaaauuuaaacuauaagca

SEQ ID NO: 1484084 - RNA, 24 nt, Human
agaaauuuaaacuauaagcaagaa

SEQ ID NO: 1484085 - RNA, 14 nt, Human
agaaccuaauucaa

SEQ ID NO: 1484086 - RNA, 15 nt, Human
agaaccuaauucaau

SEQ ID NO: 1484087 - RNA, 19 nt, Human
agaaccuaauucaauucaa

SEQ ID NO: 1484088 - RNA, 22 nt, Human
acuuuuuuuuuuuaagaguaaa

SEQ ID NO: 1484089 - RNA, 17 nt, Human
acuuuuugcagcuuucu

SEQ ID NO: 1484090 - RNA, 13 nt, Human
acuuuuugcauuu

SEQ ID NO: 1484091 - RNA, 15 nt, Human
acuuuuugcagcuuu

SEQ ID NO: 1484092 - RNA, 13 nt, Human
acuuuuugcagcu

SEQ ID NO: 1484093 - RNA, 12 nt, Human
acuuuuugcagc

SEQ ID NO: 1484094 - RNA, 15 nt, Human
acuuuuuuauuuaaa

SEQ ID NO: 1484095 - RNA, 23 nt, Human
acuuuuuuauuuaaaaaacuaaa

SEQ ID NO: 1484096 - RNA, 14 nt, Human
acuuuuggcauuuu

SEQ ID NO: 1484097 - RNA, 17 nt, Human
acuuuuguaagacaaag

SEQ ID NO: 1484098 - RNA, 12 nt, Human
acuuuuguaaga

SEQ ID NO: 1484099 - RNA, 15 nt, Human
acuuuuuauugauuu

SEQ ID NO: 1484100 - RNA, 17 nt, Human
acuuuggcugcaugcga

SEQ ID NO: 1484101 - RNA, 14 nt, Human
acuuuggcugcaug

SEQ ID NO: 1484102 - RNA, 21 nt, Human
acuuugacuuuuugcauuuaa

SEQ ID NO: 1484103 - RNA, 15 nt, Human
acuuugacuuuuugc

SEQ ID NO: 1484104 - RNA, 20 nt, Human
acuuugacuuuuugcauuua

SEQ ID NO: 1484105 - RNA, 14 nt, Human
acuugugucucugu

SEQ ID NO: 1484106 - RNA, 16 nt, Human
acuugugucucugugc

SEQ ID NO: 1484107 - RNA, 21 nt, Human
acuugugucucugugcuuuua

SEQ ID NO: 1484108 - RNA, 22 nt, Human
acuugugucucugugcuuuuaa

SEQ ID NO: 1484109 - RNA, 11 nt, Human
acuugugucug

SEQ ID NO: 1484110 - RNA, 19 nt, Human
ucuccauugugccuaaguc

SEQ ID NO: 1484111 - RNA, 18 nt, Human
ucucccaaaaaacuacuu

SEQ ID NO: 1484112 - RNA, 13 nt, Human
agaaacccugcac

SEQ ID NO: 1484113 - RNA, 19 nt, Human
agaaaacuuguauuaugug

SEQ ID NO: 1484114 - RNA, 16 nt, Human
agaaaaccuuucuuca

SEQ ID NO: 1484115 - RNA, 20 nt, Human
agaaagaacggaagaagaga

SEQ ID NO: 1484116 - RNA, 18 nt, Human
agaaacugaggaauuuuc

SEQ ID NO: 1484117 - RNA, 23 nt, Human
agaaaccuacugcccaggcacug

SEQ ID NO: 1484118 - RNA, 15 nt, Human
agaaaccuacugccc

SEQ ID NO: 1484119 - RNA, 16 nt, Human
agaaaccuacugccca

SEQ ID NO: 1484120 - RNA, 13 nt, Human
agaaacugaggaa

SEQ ID NO: 1484121 - RNA, 16 nt, Human
agaaacugaggaauuu

SEQ ID NO: 1484122 - RNA, 19 nt, Human
agaaaacaaggaugaauua

SEQ ID NO: 1484123 - RNA, 23 nt, Human
agaaaacauaaucuucugccuuc

SEQ ID NO: 1484124 - RNA, 17 nt, Human
agaaaaauauauacuaa

SEQ ID NO: 1484125 - RNA, 16 nt, Human
agaaaaauauguacca

SEQ ID NO: 1484126 - RNA, 19 nt, Human
ucucuuuaugucuguggau

SEQ ID NO: 1484127 - RNA, 21 nt, Human
ucucuucugagcuauuucauc

SEQ ID NO: 1484128 - RNA, 22 nt, Human
ucucuucugagcuauuucaucu

SEQ ID NO: 1484129 - RNA, 15 nt, Human
ucucuccuuguucug

SEQ ID NO: 1484130 - RNA, 19 nt, Human
ucucuccuuguucugauaa

SEQ ID NO: 1484131 - RNA, 20 nt, Human
ucuguuuuauaauuuuguga

SEQ ID NO: 1484132 - RNA, 18 nt, Human
ucuguuuuauaauuuugu

SEQ ID NO: 1484133 - RNA, 19 nt, Human
agaauugugucagacuguu

SEQ ID NO: 1484134 - RNA, 23 nt, Human
agaauugugucagacuguuuagu

SEQ ID NO: 1484135 - RNA, 20 nt, Human
agaauugugucagacuguuu

SEQ ID NO: 1484136 - RNA, 13 nt, Human
agaauuucuagga

SEQ ID NO: 1484137 - RNA, 21 nt, Human
agaauuucuaggacugaauua

SEQ ID NO: 1484138 - RNA, 21 nt, Human
agaauuucuaccauuucagag

SEQ ID NO: 1484139 - RNA, 16 nt, Human
agaauuucuaccauuu

SEQ ID NO: 1484140 - RNA, 20 nt, Human
agaauuucuaccauuucaga

SEQ ID NO: 1484141 - RNA, 17 nt, Human
ucuguucauuccuccag

SEQ ID NO: 1484142 - RNA, 16 nt, Human
ucuguucauuccucca

SEQ ID NO: 1484143 - RNA, 18 nt, Human
ucuguucauuuccucaaa

SEQ ID NO: 1484144 - RNA, 20 nt, Human
ucuguucuacauagaugcuu

SEQ ID NO: 1484145 - RNA, 15 nt, Human
ucugugccugaauau

SEQ ID NO: 1484146 - RNA, 17 nt, Human
ucugugccugaauauuu

SEQ ID NO: 1484147 - RNA, 14 nt, Human
ucuggucucgaacu

SEQ ID NO: 1484148 - RNA, 21 nt, Human
agaaggaaggcagggaggagg

SEQ ID NO: 1484149 - RNA, 20 nt, Human
agaaggaaggcagggaggag

SEQ ID NO: 1484150 - RNA, 19 nt, Human
agaaggaaggcagggagga

SEQ ID NO: 1484151 - RNA, 17 nt, Human
agaaggaaggcagggag

SEQ ID NO: 1484152 - RNA, 11 nt, Human
agaaggaaggc

SEQ ID NO: 1484153 - RNA, 21 nt, Human
agaaggaaaauuuuagcgugc

SEQ ID NO: 1484154 - RNA, 13 nt, Human
ucuggguggcccu

SEQ ID NO: 1484155 - RNA, 20 nt, Human
agacagaaucucagucuguc

SEQ ID NO: 1484156 - RNA, 22 nt, Human
agacagcuucucauccugcagg

SEQ ID NO: 1484157 - RNA, 23 nt, Human
agacagcuucucauccugcaggc

SEQ ID NO: 1484158 - RNA, 17 nt, Human
agaauuugauaugugaa

SEQ ID NO: 1484159 - RNA, 18 nt, Human
agaauuugauaugugaac

SEQ ID NO: 1484160 - RNA, 19 nt, Human
agaauuugauaugugaaca

SEQ ID NO: 1484161 - RNA, 20 nt, Human
agaauuugauaugugaacag

SEQ ID NO: 1484162 - RNA, 17 nt, Human
agacaccguucauucag

SEQ ID NO: 1484163 - RNA, 19 nt, Human
ucuuaauauguucuuuuaa

SEQ ID NO: 1484164 - RNA, 18 nt, Human
agacaguauauaacuaac

SEQ ID NO: 1484165 - RNA, 19 nt, Human
agacagggucaaaguguuu

SEQ ID NO: 1484166 - RNA, 22 nt, Human
ucuuagaugcaguucugaagaa

SEQ ID NO: 1484167 - RNA, 21 nt, Human
ucuucccuggaaaccuuccac

SEQ ID NO: 1484168 - RNA, 18 nt, Human
ucuuccagucuuccugac

SEQ ID NO: 1484169 - RNA, 21 nt, Human
ucuuccagucuuccugacacu

SEQ ID NO: 1484170 - RNA, 14 nt, Human
ucuucaaaugccug

SEQ ID NO: 1484171 - RNA, 16 nt, Human
ucuucaccaaaucuug

SEQ ID NO: 1484172 - RNA, 20 nt, Human
ucuugaugccuggcggggug

SEQ ID NO: 1484173 - RNA, 14 nt, Human
ucuugaugccuggc

SEQ ID NO: 1484174 - RNA, 19 nt, Human
ucuuccuaguuuucuccuc

SEQ ID NO: 1484175 - RNA, 21 nt, Human
ucuuccuaguuuucuccuccc

SEQ ID NO: 1484176 - RNA, 23 nt, Human
ucuuccuaguuuucuccucccag

SEQ ID NO: 1484177 - RNA, 18 nt, Human
agacaugucuguucuaca

SEQ ID NO: 1484178 - RNA, 20 nt, Human
agacaugucuguucuacaua

SEQ ID NO: 1484179 - RNA, 21 nt, Human
agacccuuauugcuguccugg

SEQ ID NO: 1484180 - RNA, 22 nt, Human
agacccuuucuucagcucugaa

SEQ ID NO: 1484181 - RNA, 22 nt, Human
agacccuuauugcuguccugga

SEQ ID NO: 1484182 - RNA, 19 nt, Human
agaccuaaucucuguaaag

SEQ ID NO: 1484183 - RNA, 21 nt, Human
agaccuaaucucuguaaagcu

SEQ ID NO: 1484184 - RNA, 20 nt, Human
ucuuuaaaauuacaacuaag

SEQ ID NO: 1484185 - RNA, 15 nt, Human
ucuuuaaaauuacaa

SEQ ID NO: 1484186 - RNA, 20 nt, Human
ucuuuaaaauguaaagccau

SEQ ID NO: 1484187 - RNA, 23 nt, Human
ucuuuaaagugacuaauggcaug

SEQ ID NO: 1484188 - RNA, 12 nt, Human
ucuuuacuuuua

SEQ ID NO: 1484189 - RNA, 12 nt, Human
agacucuaagaa

SEQ ID NO: 1484190 - RNA, 18 nt, Human
agagacacacugaagaag

SEQ ID NO: 1484191 - RNA, 20 nt, Human
agagacacacugaagaagca

SEQ ID NO: 1484192 - RNA, 17 nt, Human
agagacacacugaagaa

SEQ ID NO: 1484193 - RNA, 21 nt, Human
agagaaugcccuucuccuuau

SEQ ID NO: 1484194 - RNA, 15 nt, Human
agagaaugagagaca

SEQ ID NO: 1484195 - RNA, 19 nt, Human
agacuucaagcauggcuau

SEQ ID NO: 1484196 - RNA, 22 nt, Human
agacuucaagcauggcuauuuu

SEQ ID NO: 1484197 - RNA, 12 nt, Human
agacuugacagu

SEQ ID NO: 1484198 - RNA, 13 nt, Human
agacuugacagug

SEQ ID NO: 1484199 - RNA, 14 nt, Human
agacuugacagugg

SEQ ID NO: 1484200 - RNA, 15 nt, Human
agacuugacagugga

SEQ ID NO: 1484201 - RNA, 16 nt, Human
agacucuaagaaagaa

SEQ ID NO: 1484202 - RNA, 17 nt, Human
agacucuaagaaagaac

SEQ ID NO: 1484203 - RNA, 21 nt, Human
agaggcgcaugaauuugugaa

SEQ ID NO: 1484204 - RNA, 18 nt, Human
agaggcaccugucccaga

SEQ ID NO: 1484205 - RNA, 19 nt, Human
agaggccuuuuggaaugug

SEQ ID NO: 1484206 - RNA, 17 nt, Human
agaggugagaaauuuaa

SEQ ID NO: 1484207 - RNA, 16 nt, Human
agaggugagaaauuua

SEQ ID NO: 1484208 - RNA, 12 nt, Human
agagggaaugug

SEQ ID NO: 1484209 - RNA, 13 nt, Human
agagggaauguga

SEQ ID NO: 1484210 - RNA, 14 nt, Human
agagggaaugugaa

SEQ ID NO: 1484211 - RNA, 15 nt, Human
agagggaaugugaaa

SEQ ID NO: 1484212 - RNA, 16 nt, Human
agagggaaugugaaau

SEQ ID NO: 1484213 - RNA, 18 nt, Human
agagggaaugugaaauuu

SEQ ID NO: 1484214 - RNA, 15 nt, Human
ugaagcuguugugug

SEQ ID NO: 1484215 - RNA, 16 nt, Human
ugaagcuguuguguga

SEQ ID NO: 1484216 - RNA, 19 nt, Human
ugaagcuguugugugaggu

SEQ ID NO: 1484217 - RNA, 22 nt, Human
ugaagaagcaccaaucaugaau

SEQ ID NO: 1484218 - RNA, 14 nt, Human
ugaagaagauggua

SEQ ID NO: 1484219 - RNA, 20 nt, Human
ugaagaagcaccaaucauga

SEQ ID NO: 1484220 - RNA, 15 nt, Human
ucuuuguaaugaaaa

SEQ ID NO: 1484221 - RNA, 13 nt, Human
ucuuuguaaugaa

SEQ ID NO: 1484222 - RNA, 12 nt, Human
ucuuuguaauga

SEQ ID NO: 1484223 - RNA, 18 nt, Human
ugaagguggaaauaaacu

SEQ ID NO: 1484224 - RNA, 16 nt, Human
ugaagcuuuuauguga

SEQ ID NO: 1484225 - RNA, 21 nt, Human
ugaaggugaaacauuuucucc

SEQ ID NO: 1484226 - RNA, 18 nt, Human
agagucuauuuacggaac

SEQ ID NO: 1484227 - RNA, 14 nt, Human
agagugaagggaag

SEQ ID NO: 1484228 - RNA, 22 nt, Human
agagugaagggaagagacagcc

SEQ ID NO: 1484229 - RNA, 20 nt, Human
ugaauggcuauguuuuuaau

SEQ ID NO: 1484230 - RNA, 21 nt, Human
ugaauggcuauguuuuuaaug

SEQ ID NO: 1484231 - RNA, 18 nt, Human
agauaagguaaaaugcca

SEQ ID NO: 1484232 - RNA, 19 nt, Human
agauaaugugauauuauac

SEQ ID NO: 1484233 - RNA, 13 nt, Human
agauaaucccugu

SEQ ID NO: 1484234 - RNA, 16 nt, Human
agauaaucuagaacac

SEQ ID NO: 1484235 - RNA, 23 nt, Human
agauaaucuagaacacaggcaaa

SEQ ID NO: 1484236 - RNA, 22 nt, Human
agagugagagacauuaacucau

SEQ ID NO: 1484237 - RNA, 13 nt, Human
agagugagagaca

SEQ ID NO: 1484238 - RNA, 17 nt, Human
agauauuuuuaucuuua

SEQ ID NO: 1484239 - RNA, 19 nt, Human
agauauuuuuaucuuuaua

SEQ ID NO: 1484240 - RNA, 20 nt, Human
agauauuuuuaucuuuauau

SEQ ID NO: 1484241 - RNA, 21 nt, Human
agauauuuuuaucuuuauaug

SEQ ID NO: 1484242 - RNA, 13 nt, Human
agauauuuuucau

SEQ ID NO: 1484243 - RNA, 12 nt, Human
agauauuuuuca

SEQ ID NO: 1484244 - RNA, 19 nt, Human
agauauuuuuccauuuuuu

SEQ ID NO: 1484245 - RNA, 19 nt, Human
agauauuuuucaugauuuu

SEQ ID NO: 1484246 - RNA, 16 nt, Human
agauauuuuucaugau

SEQ ID NO: 1484247 - RNA, 11 nt, Human
agaucacuuuc

SEQ ID NO: 1484248 - RNA, 21 nt, Human
agaucauugugaaauuauuca

SEQ ID NO: 1484249 - RNA, 16 nt, Human
ugacauuuuacauuaa

SEQ ID NO: 1484250 - RNA, 15 nt, Human
ugacauuuuacauua

SEQ ID NO: 1484251 - RNA, 15 nt, Human
ugaccaaaaguuaca

SEQ ID NO: 1484252 - RNA, 16 nt, Human
ugaccaaaaguuacau

SEQ ID NO: 1484253 - RNA, 22 nt, Human
ugaccaaaaguuacauguuugc

SEQ ID NO: 1484254 - RNA, 23 nt, Human
ugaccaaaaguuacauguuugca

SEQ ID NO: 1484255 - RNA, 14 nt, Human
ugacauuuuacauu

SEQ ID NO: 1484256 - RNA, 12 nt, Human
ugacauuuuaca

SEQ ID NO: 1484257 - RNA, 18 nt, Human
ugacaguccgucaaaaca

SEQ ID NO: 1484258 - RNA, 22 nt, Human
ugacaguccgucaaaacagauu

SEQ ID NO: 1484259 - RNA, 18 nt, Human
agaucacuuucucaguuu

SEQ ID NO: 1484260 - RNA, 19 nt, Human
agaucacuuucucaguuuu

SEQ ID NO: 1484261 - RNA, 23 nt, Human
agaucacuuucucaguuuucaua

SEQ ID NO: 1484262 - RNA, 18 nt, Human
agauguguucacaaugga

SEQ ID NO: 1484263 - RNA, 15 nt, Human
agauguguucacaau

SEQ ID NO: 1484264 - RNA, 11 nt, Human
agaugcuuuua

SEQ ID NO: 1484265 - RNA, 20 nt, Human
agaugcuuuuaacagagucu

SEQ ID NO: 1484266 - RNA, 18 nt, Human
agaugcuuuuaacagagu

SEQ ID NO: 1484267 - RNA, 23 nt, Human
agauuauauauauuuuuuucuga

SEQ ID NO: 1484268 - RNA, 21 nt, Human
agauucaaugccccugaauuu

SEQ ID NO: 1484269 - RNA, 22 nt, Human
agauucaaugccccugaauuua

SEQ ID NO: 1484270 - RNA, 15 nt, Human
ugacuguuuccauca

SEQ ID NO: 1484271 - RNA, 13 nt, Human
ugacugucacugu

SEQ ID NO: 1484272 - RNA, 16 nt, Human
ugacugucacuguucc

SEQ ID NO: 1484273 - RNA, 17 nt, Human
ugacugucacuguuccu

SEQ ID NO: 1484274 - RNA, 15 nt, Human
agcaacaauuuauga

SEQ ID NO: 1484275 - RNA, 14 nt, Human
agauuuuccugaaa

SEQ ID NO: 1484276 - RNA, 19 nt, Human
agauuuucagcaaacucuu

SEQ ID NO: 1484277 - RNA, 21 nt, Human
agcaacaauuuaugaauugaa

SEQ ID NO: 1484278 - RNA, 14 nt, Human
agauuuaugcauau

SEQ ID NO: 1484279 - RNA, 16 nt, Human
agauuuaccacuugug

SEQ ID NO: 1484280 - RNA, 15 nt, Human
ugagguaaguuuuuu

SEQ ID NO: 1484281 - RNA, 23 nt, Human
agcagagcugauggagaaggaag

SEQ ID NO: 1484282 - RNA, 22 nt, Human
agcagagcugauggagaaggaa

SEQ ID NO: 1484283 - RNA, 21 nt, Human
agcagagcugauggagaagga

SEQ ID NO: 1484284 - RNA, 19 nt, Human
agcagagcugauggagaag

SEQ ID NO: 1484285 - RNA, 17 nt, Human
agcagagcugauggaga

SEQ ID NO: 1484286 - RNA, 19 nt, Human
ugaggggcuaccaggaaag

SEQ ID NO: 1484287 - RNA, 17 nt, Human
ugaggggcuaccaggaa

SEQ ID NO: 1484288 - RNA, 16 nt, Human
ugaggggcuaccagga

SEQ ID NO: 1484289 - RNA, 13 nt, Human
ugaggggaccagg

SEQ ID NO: 1484290 - RNA, 14 nt, Human
ugaggggaccagga

SEQ ID NO: 1484291 - RNA, 15 nt, Human
ugaggggaccaggag

SEQ ID NO: 1484292 - RNA, 16 nt, Human
ugaggggaccaggagu

SEQ ID NO: 1484293 - RNA, 18 nt, Human
ugaggggaccaggagugg

SEQ ID NO: 1484294 - RNA, 22 nt, Human
ugaggggaccaggagugggugg

SEQ ID NO: 1484295 - RNA, 16 nt, Human
ugaggccuagacucug

SEQ ID NO: 1484296 - RNA, 14 nt, Human
ugagcuaggaauug

SEQ ID NO: 1484297 - RNA, 16 nt, Human
ugagcuacaaaugcau

SEQ ID NO: 1484298 - RNA, 24 nt, Human
ugagcuacugccgucagugcugug

SEQ ID NO: 1484299 - RNA, 21 nt, Human
ugagcuacugccgucagugcu

SEQ ID NO: 1484300 - RNA, 21 nt, Human
ugagcuaaauaaagauauugu

SEQ ID NO: 1484301 - RNA, 14 nt, Human
ugagcuacaaaugc

SEQ ID NO: 1484302 - RNA, 13 nt, Human
ugagcuacaaaug

SEQ ID NO: 1484303 - RNA, 19 nt, Human
ugaggaaagcauguauuca

SEQ ID NO: 1484304 - RNA, 13 nt, Human
ugaggccagacca

SEQ ID NO: 1484305 - RNA, 16 nt, Human
ugaggacacaugucca

SEQ ID NO: 1484306 - RNA, 15 nt, Human
ugaggacacugauau

SEQ ID NO: 1484307 - RNA, 15 nt, Human
ugaggacacaugucc

SEQ ID NO: 1484308 - RNA, 14 nt, Human
ugaggacacauguc

SEQ ID NO: 1484309 - RNA, 13 nt, Human
ugaggacacaugu

SEQ ID NO: 1484310 - RNA, 12 nt, Human
ugaggacacaug

SEQ ID NO: 1484311 - RNA, 15 nt, Human
ugaggaauuucaccu

SEQ ID NO: 1484312 - RNA, 21 nt, Human
ugaggaauuucaccuguaaac

SEQ ID NO: 1484313 - RNA, 22 nt, Human
ugaggaauuucaccuguaaacc

SEQ ID NO: 1484314 - RNA, 13 nt, Human
ugaggaauuuucu

SEQ ID NO: 1484315 - RNA, 14 nt, Human
ugaggaauuuucuu

SEQ ID NO: 1484316 - RNA, 18 nt, Human
ugaggaauuuucuuugug

SEQ ID NO: 1484317 - RNA, 19 nt, Human
ugaggacaaccauuccaga

SEQ ID NO: 1484318 - RNA, 20 nt, Human
ugaggacaaccauuccagac

SEQ ID NO: 1484319 - RNA, 15 nt, Human
agcacagugaucaag

SEQ ID NO: 1484320 - RNA, 22 nt, Human
agcacagccucuuagaugcagu

SEQ ID NO: 1484321 - RNA, 16 nt, Human
agcaccaaucaugaau

SEQ ID NO: 1484322 - RNA, 15 nt, Human
agcaaccucaguaau

SEQ ID NO: 1484323 - RNA, 11 nt, Human
agcagacauuu

SEQ ID NO: 1484324 - RNA, 16 nt, Human
agcagacucagcucug

SEQ ID NO: 1484325 - RNA, 19 nt, Human
agcagacucagcucugaca

SEQ ID NO: 1484326 - RNA, 20 nt, Human
agcagacucagcucugacau

SEQ ID NO: 1484327 - RNA, 21 nt, Human
agcacuuuagaauaugccuug

SEQ ID NO: 1484328 - RNA, 14 nt, Human
agcacuuuagaaua

SEQ ID NO: 1484329 - RNA, 20 nt, Human
agcacuuuagaauaugccuu

SEQ ID NO: 1484330 - RNA, 14 nt, Human
agcaccagaaugua

SEQ ID NO: 1484331 - RNA, 16 nt, Human
acuguaaggcaaucau

SEQ ID NO: 1484332 - RNA, 14 nt, Human
acuggggcaggggc

SEQ ID NO: 1484333 - RNA, 16 nt, Human
ucgcuccucaaccccu

SEQ ID NO: 1484334 - RNA, 18 nt, Human
ucgcuccucaaccccucc

SEQ ID NO: 1484335 - RNA, 19 nt, Human
ucgcuccucaaccccuccc

SEQ ID NO: 1484336 - RNA, 22 nt, Human
ucgcuccucaaccccuccccuc

SEQ ID NO: 1484337 - RNA, 13 nt, Human
acugggcaaugau

SEQ ID NO: 1484338 - RNA, 18 nt, Human
acugggcaaugauggcaa

SEQ ID NO: 1484339 - RNA, 22 nt, Human
acuguaaucuuauuuaggaagu

SEQ ID NO: 1484340 - RNA, 19 nt, Human
acuguaaucuuauuuagga

SEQ ID NO: 1484341 - RNA, 20 nt, Human
acuguacagacagaaaaaac

SEQ ID NO: 1484342 - RNA, 18 nt, Human
acuguagaaugauuucau

SEQ ID NO: 1484343 - RNA, 19 nt, Human
acuguagaaugauuucaug

SEQ ID NO: 1484344 - RNA, 20 nt, Human
acuguagaaugauuucaugc

SEQ ID NO: 1484345 - RNA, 22 nt, Human
ucgagaucccaacacugccagc

SEQ ID NO: 1484346 - RNA, 23 nt, Human
ucgagaucccaacacugccagca

SEQ ID NO: 1484347 - RNA, 14 nt, Human
uccuucccugcugu

SEQ ID NO: 1484348 - RNA, 15 nt, Human
uccuucauuuccucc

SEQ ID NO: 1484349 - RNA, 21 nt, Human
uccuuccucacaccaggcuug

SEQ ID NO: 1484350 - RNA, 16 nt, Human
uccuuccucacaccag

SEQ ID NO: 1484351 - RNA, 11 nt, Human
uccuucauuuc

SEQ ID NO: 1484352 - RNA, 14 nt, Human
uccuucauuuccuc

SEQ ID NO: 1484353 - RNA, 15 nt, Human
uccuucagcacuuua

SEQ ID NO: 1484354 - RNA, 18 nt, Human
uccuucagcacuuuagaa

SEQ ID NO: 1484355 - RNA, 21 nt, Human
acuggcauggauauaguuuua

SEQ ID NO: 1484356 - RNA, 23 nt, Human
acuggcauggauauaguuuuacu

SEQ ID NO: 1484357 - RNA, 21 nt, Human
acuggcaggcaggcucccagg

SEQ ID NO: 1484358 - RNA, 21 nt, Human
acugcucuccuccaccucaac

SEQ ID NO: 1484359 - RNA, 15 nt, Human
acugcucuccuccac

SEQ ID NO: 1484360 - RNA, 18 nt, Human
acugcugagauacauaca

SEQ ID NO: 1484361 - RNA, 19 nt, Human
acugcugagauacauacag

SEQ ID NO: 1484362 - RNA, 20 nt, Human
acugcugagauacauacaga

SEQ ID NO: 1484363 - RNA, 22 nt, Human
acugcugagauacauacagaau

SEQ ID NO: 1484364 - RNA, 23 nt, Human
acugcgcccuuaacugcauccag

SEQ ID NO: 1484365 - RNA, 13 nt, Human
acugccuuugacc

SEQ ID NO: 1484366 - RNA, 11 nt, Human
acugccuuuga

SEQ ID NO: 1484367 - RNA, 22 nt, Human
acugccuucucaacuccaaacu

SEQ ID NO: 1484368 - RNA, 18 nt, Human
acugcuuggagcugagca

SEQ ID NO: 1484369 - RNA, 13 nt, Human
acugcuuggagcu

SEQ ID NO: 1484370 - RNA, 16 nt, Human
acugcuuggagcugag

SEQ ID NO: 1484371 - RNA, 23 nt, Human
acugcuugaacuaggcugagcaa

SEQ ID NO: 1484372 - RNA, 16 nt, Human
acugcaaccucugccu

SEQ ID NO: 1484373 - RNA, 13 nt, Human
uccugaguagcug

SEQ ID NO: 1484374 - RNA, 20 nt, Human
uccugcaccggggccugggc

SEQ ID NO: 1484375 - RNA, 21 nt, Human
uccugcaccggggccugggca

SEQ ID NO: 1484376 - RNA, 18 nt, Human
uccugcuaaguuaauguu

SEQ ID NO: 1484377 - RNA, 15 nt, Human
uccugcucauauugu

SEQ ID NO: 1484378 - RNA, 16 nt, Human
uccugcucauauugug

SEQ ID NO: 1484379 - RNA, 17 nt, Human
uccugcaggcaggaaca

SEQ ID NO: 1484380 - RNA, 22 nt, Human
uccugcaggcaggaacaaacag

SEQ ID NO: 1484381 - RNA, 14 nt, Human
acugaggaucagag

SEQ ID NO: 1484382 - RNA, 20 nt, Human
acugaggaauuuucuuugug

SEQ ID NO: 1484383 - RNA, 17 nt, Human
acugaggaauuucaccu

SEQ ID NO: 1484384 - RNA, 19 nt, Human
acugaggaauuucaccugu

SEQ ID NO: 1484385 - RNA, 16 nt, Human
acugaggaauuuucuu

SEQ ID NO: 1484386 - RNA, 20 nt, Human
acugcaaccuccaccucgca

SEQ ID NO: 1484387 - RNA, 18 nt, Human
acugcaaccuccaccucc

SEQ ID NO: 1484388 - RNA, 17 nt, Human
acugcaaccuccaccuc

SEQ ID NO: 1484389 - RNA, 16 nt, Human
acugcaaccuccaccu

SEQ ID NO: 1484390 - RNA, 18 nt, Human
acugaguuuuccauggca

SEQ ID NO: 1484391 - RNA, 13 nt, Human
acugaguuuucca

SEQ ID NO: 1484392 - RNA, 13 nt, Human
acugcaaccucca

SEQ ID NO: 1484393 - RNA, 14 nt, Human
acugcaaccuccac

SEQ ID NO: 1484394 - RNA, 12 nt, Human
acugagugacuc

SEQ ID NO: 1484395 - RNA, 23 nt, Human
acugagugacucuauauagcuga

SEQ ID NO: 1484396 - RNA, 13 nt, Human
uccugguagaaua

SEQ ID NO: 1484397 - RNA, 15 nt, Human
uccuguguggagagg

SEQ ID NO: 1484398 - RNA, 16 nt, Human
uccuguguggagaggg

SEQ ID NO: 1484399 - RNA, 18 nt, Human
uccuguguggagagggaa

SEQ ID NO: 1484400 - RNA, 22 nt, Human
uccuguguggagagggaaugug

SEQ ID NO: 1484401 - RNA, 21 nt, Human
uccuguguggagagggaaugu

SEQ ID NO: 1484402 - RNA, 13 nt, Human
uccuguugggaga

SEQ ID NO: 1484403 - RNA, 14 nt, Human
uccuguugggagag

SEQ ID NO: 1484404 - RNA, 21 nt, Human
uccuguugggagagggcgcag

SEQ ID NO: 1484405 - RNA, 14 nt, Human
uccuguuuuucaca

SEQ ID NO: 1484406 - RNA, 23 nt, Human
acucuuauaucuauauuuuacau

SEQ ID NO: 1484407 - RNA, 15 nt, Human
acucugcuugauuuu

SEQ ID NO: 1484408 - RNA, 16 nt, Human
acucugcuugauuuuu

SEQ ID NO: 1484409 - RNA, 18 nt, Human
acucugcuugauuuuugc

SEQ ID NO: 1484410 - RNA, 21 nt, Human
acucucuuauugccucacuuc

SEQ ID NO: 1484411 - RNA, 23 nt, Human
acucucuuauugccucacuucag

SEQ ID NO: 1484412 - RNA, 21 nt, Human
acucggccucccaaagugcug

SEQ ID NO: 1484413 - RNA, 22 nt, Human
acucggccucccaaagugcugg

SEQ ID NO: 1484414 - RNA, 20 nt, Human
uccuaggcuccaccccaucc

SEQ ID NO: 1484415 - RNA, 22 nt, Human
uccuaggcuccaccccauccag

SEQ ID NO: 1484416 - RNA, 22 nt, Human
uccucaaccccuccccuccauc

SEQ ID NO: 1484417 - RNA, 19 nt, Human
uccucaaccccuccccucc

SEQ ID NO: 1484418 - RNA, 16 nt, Human
uccucagacucuaaga

SEQ ID NO: 1484419 - RNA, 21 nt, Human
uccucagacucuaagaaagaa

SEQ ID NO: 1484420 - RNA, 11 nt, Human
uccucagcccc

SEQ ID NO: 1484421 - RNA, 17 nt, Human
uccucagagaauuucua

SEQ ID NO: 1484422 - RNA, 20 nt, Human
uccucagagaauuucuacca

SEQ ID NO: 1484423 - RNA, 17 nt, Human
uccucagacucuaagaa

SEQ ID NO: 1484424 - RNA, 13 nt, Human
uccucacccccag

SEQ ID NO: 1484425 - RNA, 16 nt, Human
uccucacccccagcuu

SEQ ID NO: 1484426 - RNA, 20 nt, Human
uccucacccccagcuuugcu

SEQ ID NO: 1484427 - RNA, 18 nt, Human
acuccugaccucaaguga

SEQ ID NO: 1484428 - RNA, 14 nt, Human
acuccugaccucag

SEQ ID NO: 1484429 - RNA, 15 nt, Human
acuccugaccucagg

SEQ ID NO: 1484430 - RNA, 16 nt, Human
acuccugaccucaggc

SEQ ID NO: 1484431 - RNA, 16 nt, Human
acuccuaggaaaauac

SEQ ID NO: 1484432 - RNA, 17 nt, Human
acuccugaccucaggca

SEQ ID NO: 1484433 - RNA, 21 nt, Human
acucaucuagguaaauuacag

SEQ ID NO: 1484434 - RNA, 20 nt, Human
acucaucuuucccuccuugg

SEQ ID NO: 1484435 - RNA, 21 nt, Human
acucaucuuucccuccuuggu

SEQ ID NO: 1484436 - RNA, 18 nt, Human
acucaucuuucccuccuu

SEQ ID NO: 1484437 - RNA, 17 nt, Human
acucaucuuucccuccu

SEQ ID NO: 1484438 - RNA, 15 nt, Human
acucaugugacucuu

SEQ ID NO: 1484439 - RNA, 16 nt, Human
acucaugugacucuuu

SEQ ID NO: 1484440 - RNA, 17 nt, Human
acucaugcauuguccuc

SEQ ID NO: 1484441 - RNA, 16 nt, Human
acucaugcauuguccu

SEQ ID NO: 1484442 - RNA, 17 nt, Human
acucaugugacucuuuc

SEQ ID NO: 1484443 - RNA, 18 nt, Human
acucaucuagguaaauua

SEQ ID NO: 1484444 - RNA, 16 nt, Human
acucaucuagguaaau

SEQ ID NO: 1484445 - RNA, 16 nt, Human
ucccucagugcccuca

SEQ ID NO: 1484446 - RNA, 16 nt, Human
uccguucacaugugug

SEQ ID NO: 1484447 - RNA, 23 nt, Human
uccgucaaaacagauuguuugca

SEQ ID NO: 1484448 - RNA, 16 nt, Human
uccgucaaaacagauu

SEQ ID NO: 1484449 - RNA, 17 nt, Human
ucccuuugcccagaaag

SEQ ID NO: 1484450 - RNA, 13 nt, Human
uccuagaugcucu

SEQ ID NO: 1484451 - RNA, 21 nt, Human
uccuaaacaucauucauuuuu

SEQ ID NO: 1484452 - RNA, 23 nt, Human
uccuaaacugagacaaugccuug

SEQ ID NO: 1484453 - RNA, 22 nt, Human
ucccuguuucuuccacagugcc

SEQ ID NO: 1484454 - RNA, 14 nt, Human
ucccucacccaucc

SEQ ID NO: 1484455 - RNA, 18 nt, Human
ucccucacccauccuaga

SEQ ID NO: 1484456 - RNA, 12 nt, Human
ucccucacccau

SEQ ID NO: 1484457 - RNA, 19 nt, Human
ucccucaaccucauccucu

SEQ ID NO: 1484458 - RNA, 18 nt, Human
ucccucaaccucauccuc

SEQ ID NO: 1484459 - RNA, 14 nt, Human
uccccuucuccccu

SEQ ID NO: 1484460 - RNA, 20 nt, Human
uccccuucuccccugcacug

SEQ ID NO: 1484461 - RNA, 18 nt, Human
uccccuucuccccugcac

SEQ ID NO: 1484462 - RNA, 18 nt, Human
uccccuugaacucuucac

SEQ ID NO: 1484463 - RNA, 17 nt, Human
uccccacgccacagccc

SEQ ID NO: 1484464 - RNA, 16 nt, Human
uccccacgccacagcc

SEQ ID NO: 1484465 - RNA, 15 nt, Human
uccccacgccacagc

SEQ ID NO: 1484466 - RNA, 14 nt, Human
uccccacgccacag

SEQ ID NO: 1484467 - RNA, 19 nt, Human
uccccacgccacagcccuu

SEQ ID NO: 1484468 - RNA, 22 nt, Human
uccccacgccacagcccuuuug

SEQ ID NO: 1484469 - RNA, 22 nt, Human
acuaugaaguuuuuuuuauaca

SEQ ID NO: 1484470 - RNA, 16 nt, Human
acuaugaaaagcuaga

SEQ ID NO: 1484471 - RNA, 19 nt, Human
acuaugaaaagcuagaauu

SEQ ID NO: 1484472 - RNA, 20 nt, Human
acuaugaaaagcuagaauug

SEQ ID NO: 1484473 - RNA, 21 nt, Human
acuaugaaaagcuagaauuga

SEQ ID NO: 1484474 - RNA, 20 nt, Human
acuaucuuacuauuucacaa

SEQ ID NO: 1484475 - RNA, 16 nt, Human
acuaucuuggugaauu

SEQ ID NO: 1484476 - RNA, 18 nt, Human
acuaucuuucagcuccag

SEQ ID NO: 1484477 - RNA, 22 nt, Human
acuauuaaaaagguuuacagaa

SEQ ID NO: 1484478 - RNA, 18 nt, Human
acuauuauccccauuucu

SEQ ID NO: 1484479 - RNA, 19 nt, Human
uccagccuggggcugaggc

SEQ ID NO: 1484480 - RNA, 23 nt, Human
acguuuaagccaaaacaauguuu

SEQ ID NO: 1484481 - RNA, 19 nt, Human
acguuuaagccaaaacaau

SEQ ID NO: 1484482 - RNA, 17 nt, Human
acguuuaagccaaaaca

SEQ ID NO: 1484483 - RNA, 14 nt, Human
acuaaaauauuuau

SEQ ID NO: 1484484 - RNA, 18 nt, Human
acuaaacacgugacacaa

SEQ ID NO: 1484485 - RNA, 16 nt, Human
acuaaagccaaacaua

SEQ ID NO: 1484486 - RNA, 17 nt, Human
acuaaagccaaacauau

SEQ ID NO: 1484487 - RNA, 23 nt, Human
acuaaagccaaacauauauauac

SEQ ID NO: 1484488 - RNA, 22 nt, Human
acuaaaguuagaaaguugauuu

SEQ ID NO: 1484489 - RNA, 13 nt, Human
ucccaucuaggga

SEQ ID NO: 1484490 - RNA, 22 nt, Human
uccccaaaggcuuugcccugcu

SEQ ID NO: 1484491 - RNA, 14 nt, Human
uccccaaaggcuuu

SEQ ID NO: 1484492 - RNA, 23 nt, Human
uccccaaaggcuuugcccugcug

SEQ ID NO: 1484493 - RNA, 18 nt, Human
uccccaacauguaauaag

SEQ ID NO: 1484494 - RNA, 22 nt, Human
uccccaaguacaaccacaccca

SEQ ID NO: 1484495 - RNA, 12 nt, Human
acuacaugcacu

SEQ ID NO: 1484496 - RNA, 14 nt, Human
acuacaugcacuug

SEQ ID NO: 1484497 - RNA, 15 nt, Human
ucaugcauggaaauu

SEQ ID NO: 1484498 - RNA, 18 nt, Human
ucaugcauguccuguaaa

SEQ ID NO: 1484499 - RNA, 16 nt, Human
ucaugcauuguccucu

SEQ ID NO: 1484500 - RNA, 17 nt, Human
ucaugauaaugaacaga

SEQ ID NO: 1484501 - RNA, 21 nt, Human
ucaugauaaugaacagaacau

SEQ ID NO: 1484502 - RNA, 13 nt, Human
ucaugauccaacu

SEQ ID NO: 1484503 - RNA, 15 nt, Human
ucaugaccaguaaag

SEQ ID NO: 1484504 - RNA, 14 nt, Human
ucaugaccaguaaa

SEQ ID NO: 1484505 - RNA, 22 nt, Human
ucaugaauuaguuuuauaugcu

SEQ ID NO: 1484506 - RNA, 14 nt, Human
ucaugugaaaucau

SEQ ID NO: 1484507 - RNA, 16 nt, Human
ucauguuuaagaaauu

SEQ ID NO: 1484508 - RNA, 14 nt, Human
ucauguuuaagaaa

SEQ ID NO: 1484509 - RNA, 15 nt, Human
ucauuaaauggggcu

SEQ ID NO: 1484510 - RNA, 21 nt, Human
accucuccccuggaacugucu

SEQ ID NO: 1484511 - RNA, 21 nt, Human
accucuaaauucuuucauuuu

SEQ ID NO: 1484512 - RNA, 18 nt, Human
accucuaaauucuuucau

SEQ ID NO: 1484513 - RNA, 23 nt, Human
accucgcccagcggcaucaggcu

SEQ ID NO: 1484514 - RNA, 12 nt, Human
accggaccaucu

SEQ ID NO: 1484515 - RNA, 12 nt, Human
accuagauuuuu

SEQ ID NO: 1484516 - RNA, 11 nt, Human
accuaauccaa

SEQ ID NO: 1484517 - RNA, 18 nt, Human
accuagcuggcucuguga

SEQ ID NO: 1484518 - RNA, 19 nt, Human
accuaugauauuuucugug

SEQ ID NO: 1484519 - RNA, 12 nt, Human
accuaugucauu

SEQ ID NO: 1484520 - RNA, 15 nt, Human
accuaugucauuuca

SEQ ID NO: 1484521 - RNA, 16 nt, Human
accuaugucauuucau

SEQ ID NO: 1484522 - RNA, 18 nt, Human
accuaugucauuucauuu

SEQ ID NO: 1484523 - RNA, 14 nt, Human
accucaagcugcau

SEQ ID NO: 1484524 - RNA, 19 nt, Human
accuaugucauuucauuuc

SEQ ID NO: 1484525 - RNA, 13 nt, Human
accucaauguccc

SEQ ID NO: 1484526 - RNA, 19 nt, Human
accucaaucagucucagaa

SEQ ID NO: 1484527 - RNA, 21 nt, Human
accucaaucagucucagaaug

SEQ ID NO: 1484528 - RNA, 16 nt, Human
accucaagcugcaucu

SEQ ID NO: 1484529 - RNA, 17 nt, Human
accucaccaagcugcug

SEQ ID NO: 1484530 - RNA, 20 nt, Human
ucauuuuagggguagcauuu

SEQ ID NO: 1484531 - RNA, 20 nt, Human
ucauuuuaacaucugagaaa

SEQ ID NO: 1484532 - RNA, 15 nt, Human
ucauuuguuggaaug

SEQ ID NO: 1484533 - RNA, 22 nt, Human
ucauuuuaacaucugagaaaag

SEQ ID NO: 1484534 - RNA, 23 nt, Human
uccaaagucucuggaauuugaaa

SEQ ID NO: 1484535 - RNA, 15 nt, Human
ucauuuuauguuaag

SEQ ID NO: 1484536 - RNA, 16 nt, Human
ucauuuuuuaaaaaag

SEQ ID NO: 1484537 - RNA, 18 nt, Human
accuggaagcauuuguuu

SEQ ID NO: 1484538 - RNA, 23 nt, Human
accuggaagcauuuguuucuacu

SEQ ID NO: 1484539 - RNA, 18 nt, Human
accugaauaaagaaugaa

SEQ ID NO: 1484540 - RNA, 21 nt, Human
uccaacuaucucauuuccaag

SEQ ID NO: 1484541 - RNA, 22 nt, Human
uccaacuaaugccuuacucuuc

SEQ ID NO: 1484542 - RNA, 15 nt, Human
uccaacuaaugccuu

SEQ ID NO: 1484543 - RNA, 19 nt, Human
uccaacuaaugccuuacuc

SEQ ID NO: 1484544 - RNA, 14 nt, Human
accuuccacccagu

SEQ ID NO: 1484545 - RNA, 15 nt, Human
accuuccagaaauac

SEQ ID NO: 1484546 - RNA, 23 nt, Human
accuuccagaaauacuacugugu

SEQ ID NO: 1484547 - RNA, 12 nt, Human
accuuccaccca

SEQ ID NO: 1484548 - RNA, 14 nt, Human
accuuagaauacag

SEQ ID NO: 1484549 - RNA, 21 nt, Human
accuuagcuggcauuacagcu

SEQ ID NO: 1484550 - RNA, 22 nt, Human
accuuagcuggcauuacagcug

SEQ ID NO: 1484551 - RNA, 14 nt, Human
accuggucucuccu

SEQ ID NO: 1484552 - RNA, 15 nt, Human
accuuaauuuauuau

SEQ ID NO: 1484553 - RNA, 14 nt, Human
accuuaauuuauua

SEQ ID NO: 1484554 - RNA, 16 nt, Human
uccacucuuucuuuca

SEQ ID NO: 1484555 - RNA, 15 nt, Human
uccacucuuucuuuc

SEQ ID NO: 1484556 - RNA, 13 nt, Human
uccacucuuucuu

SEQ ID NO: 1484557 - RNA, 15 nt, Human
uccacguacugcagc

SEQ ID NO: 1484558 - RNA, 17 nt, Human
uccacguacugcagccu

SEQ ID NO: 1484559 - RNA, 18 nt, Human
uccacguacugcagccuc

SEQ ID NO: 1484560 - RNA, 16 nt, Human
ucaggaagagaaggag

SEQ ID NO: 1484561 - RNA, 15 nt, Human
ucaggaagagaagga

SEQ ID NO: 1484562 - RNA, 18 nt, Human
ucaggaaccgaggcaggg

SEQ ID NO: 1484563 - RNA, 17 nt, Human
ucaggaaccgaggcagg

SEQ ID NO: 1484564 - RNA, 20 nt, Human
ucaggaagagaaggagcaga

SEQ ID NO: 1484565 - RNA, 19 nt, Human
ucaggcccuuauuuucaag

SEQ ID NO: 1484566 - RNA, 20 nt, Human
ucaggcccccaccuggcuca

SEQ ID NO: 1484567 - RNA, 21 nt, Human
ucaggcccccaccuggcucac

SEQ ID NO: 1484568 - RNA, 21 nt, Human
acccuccaccgcagaaggaag

SEQ ID NO: 1484569 - RNA, 20 nt, Human
acccuccaccgcagaaggaa

SEQ ID NO: 1484570 - RNA, 18 nt, Human
acccuccaccgcagaagg

SEQ ID NO: 1484571 - RNA, 15 nt, Human
acccuccagagacaa

SEQ ID NO: 1484572 - RNA, 21 nt, Human
acccuuauugcuguccuggag

SEQ ID NO: 1484573 - RNA, 17 nt, Human
acccuuauugcuguccu

SEQ ID NO: 1484574 - RNA, 15 nt, Human
acccuuauugcuguc

SEQ ID NO: 1484575 - RNA, 19 nt, Human
acccuuauugcuguccugg

SEQ ID NO: 1484576 - RNA, 16 nt, Human
ucagccccgcguggaa

SEQ ID NO: 1484577 - RNA, 14 nt, Human
ucagcccugcacca

SEQ ID NO: 1484578 - RNA, 20 nt, Human
acccagguuggagugcagug

SEQ ID NO: 1484579 - RNA, 17 nt, Human
acccaguaacucaucug

SEQ ID NO: 1484580 - RNA, 18 nt, Human
acccaguaacucaucugu

SEQ ID NO: 1484581 - RNA, 19 nt, Human
acccagguuggagugcagu

SEQ ID NO: 1484582 - RNA, 11 nt, Human
acccaggacag

SEQ ID NO: 1484583 - RNA, 10 nt, Human
acccaggaca

SEQ ID NO: 1484584 - RNA, 15 nt, Human
ucagcccugcaccau

SEQ ID NO: 1484585 - RNA, 14 nt, Human
ucagauucccagag

SEQ ID NO: 1484586 - RNA, 18 nt, Human
ucagaagaaaaagaagca

SEQ ID NO: 1484587 - RNA, 17 nt, Human
ucagaagaaaaagaagc

SEQ ID NO: 1484588 - RNA, 13 nt, Human
ucagaagaaaaag

SEQ ID NO: 1484589 - RNA, 16 nt, Human
ucagaagaaaaagaag

SEQ ID NO: 1484590 - RNA, 19 nt, Human
ucagccuggcuucaaauug

SEQ ID NO: 1484591 - RNA, 13 nt, Human
accccuguuucug

SEQ ID NO: 1484592 - RNA, 22 nt, Human
accccauggcagugggaaaaau

SEQ ID NO: 1484593 - RNA, 16 nt, Human
acccccagcuuugcua

SEQ ID NO: 1484594 - RNA, 14 nt, Human
acccccagcuuugc

SEQ ID NO: 1484595 - RNA, 14 nt, Human
accccccaagcugu

SEQ ID NO: 1484596 - RNA, 19 nt, Human
accacuuguguuuugcaag

SEQ ID NO: 1484597 - RNA, 23 nt, Human
accacuuguguuuugcaagccag

SEQ ID NO: 1484598 - RNA, 18 nt, Human
accagagaaaaagggagg

SEQ ID NO: 1484599 - RNA, 20 nt, Human
accagagaaaaagggagggg

SEQ ID NO: 1484600 - RNA, 17 nt, Human
accaggauagagacugg

SEQ ID NO: 1484601 - RNA, 17 nt, Human
accaggcaccaaaagaa

SEQ ID NO: 1484602 - RNA, 19 nt, Human
accaggcaccaaaagaagu

SEQ ID NO: 1484603 - RNA, 20 nt, Human
accaggcaccaaaagaagua

SEQ ID NO: 1484604 - RNA, 16 nt, Human
accaggaguggguggg

SEQ ID NO: 1484605 - RNA, 20 nt, Human
accaggaguggguggggagu

SEQ ID NO: 1484606 - RNA, 14 nt, Human
accaggauagagac

SEQ ID NO: 1484607 - RNA, 16 nt, Human
accaggauagagacug

SEQ ID NO: 1484608 - RNA, 19 nt, Human
accaggauagagacuggaa

SEQ ID NO: 1484609 - RNA, 21 nt, Human
accaggcaccaaaagaaguaa

SEQ ID NO: 1484610 - RNA, 17 nt, Human
accaggcagccucuggg

SEQ ID NO: 1484611 - RNA, 20 nt, Human
accaggcagccucugggggg

SEQ ID NO: 1484612 - RNA, 21 nt, Human
accaggcagccucuggggggu

SEQ ID NO: 1484613 - RNA, 17 nt, Human
uauuucaugaaaauugu

SEQ ID NO: 1484614 - RNA, 19 nt, Human
acccagaaugagacaucca

SEQ ID NO: 1484615 - RNA, 20 nt, Human
acccagaaugagacauccag

SEQ ID NO: 1484616 - RNA, 18 nt, Human
acccagaaugagacaucc

SEQ ID NO: 1484617 - RNA, 14 nt, Human
ucagaacagcagac

SEQ ID NO: 1484618 - RNA, 23 nt, Human
ucagaacagcagacucagcucug

SEQ ID NO: 1484619 - RNA, 19 nt, Human
acccacuugcuuuuaaaau

SEQ ID NO: 1484620 - RNA, 23 nt, Human
acccaaccacaucccacucacaa

SEQ ID NO: 1484621 - RNA, 13 nt, Human
accauuuccucag

SEQ ID NO: 1484622 - RNA, 15 nt, Human
accauuuccucagac

SEQ ID NO: 1484623 - RNA, 11 nt, Human
accauuucaga

SEQ ID NO: 1484624 - RNA, 14 nt, Human
accauuucagagag

SEQ ID NO: 1484625 - RNA, 20 nt, Human
accauuucagagaggccuuu

SEQ ID NO: 1484626 - RNA, 21 nt, Human
ucacuguagaaugauuucaug

SEQ ID NO: 1484627 - RNA, 13 nt, Human
ucaccuggaagca

SEQ ID NO: 1484628 - RNA, 19 nt, Human
ucaccuggaagcauuuguu

SEQ ID NO: 1484629 - RNA, 24 nt, Human
accaugaagagauuuuucaugauu

SEQ ID NO: 1484630 - RNA, 21 nt, Human
accagggaugaugcaacaucc

SEQ ID NO: 1484631 - RNA, 21 nt, Human
uauguuuucaggcuagaugua

SEQ ID NO: 1484632 - RNA, 23 nt, Human
uauuacaguggggaaugaagaua

SEQ ID NO: 1484633 - RNA, 22 nt, Human
uauuagcccuucuccauggccc

SEQ ID NO: 1484634 - RNA, 15 nt, Human
uauucagcucaugga

SEQ ID NO: 1484635 - RNA, 11 nt, Human
uauucaauaaa

SEQ ID NO: 1484636 - RNA, 13 nt, Human
uauucagacagau

SEQ ID NO: 1484637 - RNA, 21 nt, Human
uauucauauuuucuuucaaaa

SEQ ID NO: 1484638 - RNA, 21 nt, Human
acaguuaccucugccucagaa

SEQ ID NO: 1484639 - RNA, 13 nt, Human
acaguuacauaau

SEQ ID NO: 1484640 - RNA, 19 nt, Human
acaguuacauaauucacuc

SEQ ID NO: 1484641 - RNA, 19 nt, Human
acaguguugaaaauguuca

SEQ ID NO: 1484642 - RNA, 21 nt, Human
acaguguugaaaauguucaga

SEQ ID NO: 1484643 - RNA, 13 nt, Human
acagugaagacag

SEQ ID NO: 1484644 - RNA, 14 nt, Human
acagugaagacaga

SEQ ID NO: 1484645 - RNA, 18 nt, Human
acagugaagacagaaguu

SEQ ID NO: 1484646 - RNA, 21 nt, Human
acagugaagacagaaguuugc

SEQ ID NO: 1484647 - RNA, 19 nt, Human
acagugaagacagaaguuu

SEQ ID NO: 1484648 - RNA, 12 nt, Human
acagugagccug

SEQ ID NO: 1484649 - RNA, 14 nt, Human
acagugagccugaa

SEQ ID NO: 1484650 - RNA, 20 nt, Human
acagugaaagaaaauaacaa

SEQ ID NO: 1484651 - RNA, 12 nt, Human
acagucuaaagc

SEQ ID NO: 1484652 - RNA, 15 nt, Human
acagucuaaagcugg

SEQ ID NO: 1484653 - RNA, 14 nt, Human
acagucuaaagcug

SEQ ID NO: 1484654 - RNA, 15 nt, Human
acagggccacauaga

SEQ ID NO: 1484655 - RNA, 17 nt, Human
acaguccgucaaaacag

SEQ ID NO: 1484656 - RNA, 21 nt, Human
acaguccgucaaaacagauug

SEQ ID NO: 1484657 - RNA, 19 nt, Human
uauuguauauuacaaugau

SEQ ID NO: 1484658 - RNA, 17 nt, Human
uauuguauauuacaaug

SEQ ID NO: 1484659 - RNA, 16 nt, Human
uauuguauauuacaau

SEQ ID NO: 1484660 - RNA, 17 nt, Human
uauuguagcauccugga

SEQ ID NO: 1484661 - RNA, 18 nt, Human
uauuguagcauccuggaa

SEQ ID NO: 1484662 - RNA, 20 nt, Human
uauuguagcauccuggaaua

SEQ ID NO: 1484663 - RNA, 21 nt, Human
uauuguagcauccuggaauau

SEQ ID NO: 1484664 - RNA, 17 nt, Human
uauugucuagugaaacu

SEQ ID NO: 1484665 - RNA, 17 nt, Human
uauuuaaccucuaaauu

SEQ ID NO: 1484666 - RNA, 18 nt, Human
uauuuaaccucuaaauuc

SEQ ID NO: 1484667 - RNA, 16 nt, Human
uauuuaacucucuuua

SEQ ID NO: 1484668 - RNA, 23 nt, Human
uauuuaacucucuuuaugucugu

SEQ ID NO: 1484669 - RNA, 11 nt, Human
uauuuaacuga

SEQ ID NO: 1484670 - RNA, 13 nt, Human
uauuuaacugacu

SEQ ID NO: 1484671 - RNA, 14 nt, Human
uauuuaauagguuu

SEQ ID NO: 1484672 - RNA, 18 nt, Human
uauuuaauagcaaagaau

SEQ ID NO: 1484673 - RNA, 19 nt, Human
uauuuaauagcaaagaauu

SEQ ID NO: 1484674 - RNA, 20 nt, Human
uauuuaauagcaaagaauug

SEQ ID NO: 1484675 - RNA, 22 nt, Human
uauuuaauagcaaagaauugac

SEQ ID NO: 1484676 - RNA, 13 nt, Human
uauuuaauagcaa

SEQ ID NO: 1484677 - RNA, 14 nt, Human
uauuuauuuuaaua

SEQ ID NO: 1484678 - RNA, 16 nt, Human
uauuuauuuuaauaau

SEQ ID NO: 1484679 - RNA, 18 nt, Human
uauuuauuuuaauaaugu

SEQ ID NO: 1484680 - RNA, 20 nt, Human
uauuuauuuuuuuuaaguau

SEQ ID NO: 1484681 - RNA, 16 nt, Human
uauuucaauguuagcc

SEQ ID NO: 1484682 - RNA, 15 nt, Human
uauuucaauguuagc

SEQ ID NO: 1484683 - RNA, 15 nt, Human
uauuucacaacagcc

SEQ ID NO: 1484684 - RNA, 19 nt, Human
uauuuaguguucauaaaua

SEQ ID NO: 1484685 - RNA, 19 nt, Human
uauuuagcuugggaaaggu

SEQ ID NO: 1484686 - RNA, 14 nt, Human
uauuuaauucaugu

SEQ ID NO: 1484687 - RNA, 15 nt, Human
uauuguaaaacaggu

SEQ ID NO: 1484688 - RNA, 15 nt, Human
uauuguaaauauugu

SEQ ID NO: 1484689 - RNA, 20 nt, Human
uauuguaacccugucuggau

SEQ ID NO: 1484690 - RNA, 16 nt, Human
uauucuugauguaaaa

SEQ ID NO: 1484691 - RNA, 14 nt, Human
uauucuugauguaa

SEQ ID NO: 1484692 - RNA, 22 nt, Human
acaguucggugagcuacaaaug

SEQ ID NO: 1484693 - RNA, 19 nt, Human
acaguucggugagcuacaa

SEQ ID NO: 1484694 - RNA, 23 nt, Human
acaguucggugagcuacaaaugc

SEQ ID NO: 1484695 - RNA, 19 nt, Human
acaguuccccuauguggaa

SEQ ID NO: 1484696 - RNA, 20 nt, Human
acaguuccccuauguggaag

SEQ ID NO: 1484697 - RNA, 18 nt, Human
acaguuccccuaugugga

SEQ ID NO: 1484698 - RNA, 15 nt, Human
acaguuaucuaaguu

SEQ ID NO: 1484699 - RNA, 16 nt, Human
acaguuaucuaaguua

SEQ ID NO: 1484700 - RNA, 17 nt, Human
acaguuaucuaaguuaa

SEQ ID NO: 1484701 - RNA, 23 nt, Human
acaguuaucuaaguuaauuuaaa

SEQ ID NO: 1484702 - RNA, 12 nt, Human
acaguucaagaa

SEQ ID NO: 1484703 - RNA, 20 nt, Human
acaguucaagaaagcuucaa

SEQ ID NO: 1484704 - RNA, 16 nt, Human
acaguucaagaaagcu

SEQ ID NO: 1484705 - RNA, 13 nt, Human
acaguuccuggga

SEQ ID NO: 1484706 - RNA, 21 nt, Human
acaguuccugggaacaucaca

SEQ ID NO: 1484707 - RNA, 16 nt, Human
uauauugauccagaaa

SEQ ID NO: 1484708 - RNA, 23 nt, Human
acagacugcgauuugucccaggu

SEQ ID NO: 1484709 - RNA, 14 nt, Human
acagacacuggcau

SEQ ID NO: 1484710 - RNA, 19 nt, Human
uaucaauaaauagaccauu

SEQ ID NO: 1484711 - RNA, 14 nt, Human
uauauuuacaaaug

SEQ ID NO: 1484712 - RNA, 16 nt, Human
uauauugauaagaucu

SEQ ID NO: 1484713 - RNA, 15 nt, Human
uauauuuacaaaugg

SEQ ID NO: 1484714 - RNA, 22 nt, Human
uaucucccugccuccugccggc

SEQ ID NO: 1484715 - RNA, 16 nt, Human
uaucucccugccuccu

SEQ ID NO: 1484716 - RNA, 17 nt, Human
uaucuaguuuaauuaau

SEQ ID NO: 1484717 - RNA, 17 nt, Human
uaucuacuuccaaacua

SEQ ID NO: 1484718 - RNA, 17 nt, Human
uaucuaggcaacauagu

SEQ ID NO: 1484719 - RNA, 22 nt, Human
uaucuacuuccaaacuaauuuu

SEQ ID NO: 1484720 - RNA, 15 nt, Human
acagcuccaagaauu

SEQ ID NO: 1484721 - RNA, 12 nt, Human
acagccuggcug

SEQ ID NO: 1484722 - RNA, 14 nt, Human
uauggccuguggau

SEQ ID NO: 1484723 - RNA, 22 nt, Human
uauggccugugagcuaggaauu

SEQ ID NO: 1484724 - RNA, 21 nt, Human
uaugauggguguuuuuagcag

SEQ ID NO: 1484725 - RNA, 14 nt, Human
uaugauguuaaaaa

SEQ ID NO: 1484726 - RNA, 18 nt, Human
uaugauguuaaaaaaaua

SEQ ID NO: 1484727 - RNA, 15 nt, Human
uaucuugaauaaugu

SEQ ID NO: 1484728 - RNA, 17 nt, Human
uaugaggacuugugucu

SEQ ID NO: 1484729 - RNA, 23 nt, Human
uaugaggacuugugucucugugc

SEQ ID NO: 1484730 - RNA, 18 nt, Human
acagauaacugaaaauua

SEQ ID NO: 1484731 - RNA, 14 nt, Human
acagauaacugaaa

SEQ ID NO: 1484732 - RNA, 21 nt, Human
acagcccaggauacuggcaca

SEQ ID NO: 1484733 - RNA, 20 nt, Human
acagcccaggauacuggcac

SEQ ID NO: 1484734 - RNA, 15 nt, Human
acagcccaggauacu

SEQ ID NO: 1484735 - RNA, 14 nt, Human
uauaauuuugugaa

SEQ ID NO: 1484736 - RNA, 16 nt, Human
uauaaccagacacaua

SEQ ID NO: 1484737 - RNA, 22 nt, Human
uauaagcaagaaggcaaaaaua

SEQ ID NO: 1484738 - RNA, 20 nt, Human
acaccuaggcuagggugggg

SEQ ID NO: 1484739 - RNA, 23 nt, Human
acaccuaggcuaggguggggaga

SEQ ID NO: 1484740 - RNA, 17 nt, Human
acaccuaugucauuuca

SEQ ID NO: 1484741 - RNA, 20 nt, Human
acaccuaugucauuucauuu

SEQ ID NO: 1484742 - RNA, 12 nt, Human
acaccucccagg

SEQ ID NO: 1484743 - RNA, 14 nt, Human
uauaccaauaaagu

SEQ ID NO: 1484744 - RNA, 17 nt, Human
uauaccaaagcacauuu

SEQ ID NO: 1484745 - RNA, 15 nt, Human
uauaccaauaaagug

SEQ ID NO: 1484746 - RNA, 13 nt, Human
uauaccaauaaag

SEQ ID NO: 1484747 - RNA, 12 nt, Human
uauaccaauaaa

SEQ ID NO: 1484748 - RNA, 22 nt, Human
uauaccaaagcacauuuuaaaa

SEQ ID NO: 1484749 - RNA, 19 nt, Human
uauaauuuugugaagcaaa

SEQ ID NO: 1484750 - RNA, 13 nt, Human
uauauaucaaaua

SEQ ID NO: 1484751 - RNA, 14 nt, Human
uauauauauauaug

SEQ ID NO: 1484752 - RNA, 15 nt, Human
uauauauauauguac

SEQ ID NO: 1484753 - RNA, 16 nt, Human
uauauauagcagcuuu

SEQ ID NO: 1484754 - RNA, 16 nt, Human
uauauauauauaugua

SEQ ID NO: 1484755 - RNA, 21 nt, Human
uauauauuuuuuucugaaauu

SEQ ID NO: 1484756 - RNA, 22 nt, Human
uauauauuuuuuucugaaauuu

SEQ ID NO: 1484757 - RNA, 23 nt, Human
uauauauuuuuuucugaaauuuc

SEQ ID NO: 1484758 - RNA, 20 nt, Human
uauauccaaaagcuuuuuau

SEQ ID NO: 1484759 - RNA, 14 nt, Human
uauagcuaaguaca

SEQ ID NO: 1484760 - RNA, 16 nt, Human
uaguuuuauaugcuuc

SEQ ID NO: 1484761 - RNA, 13 nt, Human
uaguucugccagg

SEQ ID NO: 1484762 - RNA, 14 nt, Human
uaguucugccagga

SEQ ID NO: 1484763 - RNA, 22 nt, Human
uaguuagccaauauuuuucuua

SEQ ID NO: 1484764 - RNA, 19 nt, Human
uagugaucaaauugugcag

SEQ ID NO: 1484765 - RNA, 16 nt, Human
uagucucuuuaaaagg

SEQ ID NO: 1484766 - RNA, 18 nt, Human
uagucucuuuaaaaggaa

SEQ ID NO: 1484767 - RNA, 22 nt, Human
uagugagcagucaggaaagaga

SEQ ID NO: 1484768 - RNA, 22 nt, Human
acaagcucacagaccuuugaac

SEQ ID NO: 1484769 - RNA, 21 nt, Human
acaccuacuagucaccagaga

SEQ ID NO: 1484770 - RNA, 18 nt, Human
acaccguucauucaggca

SEQ ID NO: 1484771 - RNA, 22 nt, Human
acaccaggauagagacuggaac

SEQ ID NO: 1484772 - RNA, 21 nt, Human
acaccaggcuugccugcaggc

SEQ ID NO: 1484773 - RNA, 12 nt, Human
uauaaaagccug

SEQ ID NO: 1484774 - RNA, 17 nt, Human
uauaaaagccuguuuaa

SEQ ID NO: 1484775 - RNA, 14 nt, Human
uauaaaagccuguu

SEQ ID NO: 1484776 - RNA, 21 nt, Human
uauaaaauaauuuuuauauuu

SEQ ID NO: 1484777 - RNA, 22 nt, Human
uauaaaauaauuuuuauauuug

SEQ ID NO: 1484778 - RNA, 19 nt, Human
uauaaaagccuguuuaaga

SEQ ID NO: 1484779 - RNA, 23 nt, Human
uauaaaauaauuuuuauauuuga

SEQ ID NO: 1484780 - RNA, 22 nt, Human
aauucuuuaaaauuacaacuaa

SEQ ID NO: 1484781 - RNA, 17 nt, Human
aauucuuuaaaauuaca

SEQ ID NO: 1484782 - RNA, 23 nt, Human
aauucuucugaacucaaacugag

SEQ ID NO: 1484783 - RNA, 14 nt, Human
aauucuuucauuuu

SEQ ID NO: 1484784 - RNA, 19 nt, Human
aauucuuaugccauauaau

SEQ ID NO: 1484785 - RNA, 21 nt, Human
aauucuucccuaucuuugcca

SEQ ID NO: 1484786 - RNA, 13 nt, Human
aauucuucugaac

SEQ ID NO: 1484787 - RNA, 11 nt, Human
aauucuucccu

SEQ ID NO: 1484788 - RNA, 15 nt, Human
aauucuucugaacuc

SEQ ID NO: 1484789 - RNA, 18 nt, Human
aauucuucugaacucaaa

SEQ ID NO: 1484790 - RNA, 21 nt, Human
aauucuugccaaauauaaaua

SEQ ID NO: 1484791 - RNA, 20 nt, Human
uacucuuauaucuauauuuu

SEQ ID NO: 1484792 - RNA, 22 nt, Human
uacucuuauaucuauauuuuac

SEQ ID NO: 1484793 - RNA, 14 nt, Human
uacucuucuugaaa

SEQ ID NO: 1484794 - RNA, 17 nt, Human
uacucuucuugaaauuu

SEQ ID NO: 1484795 - RNA, 18 nt, Human
uacucuucuugaaauuuu

SEQ ID NO: 1484796 - RNA, 22 nt, Human
uacuagucaccagagacuuuag

SEQ ID NO: 1484797 - RNA, 12 nt, Human
uacuauuaaaaa

SEQ ID NO: 1484798 - RNA, 17 nt, Human
uacuauaagaacuuuga

SEQ ID NO: 1484799 - RNA, 21 nt, Human
uacuagucaccagagacuuua

SEQ ID NO: 1484800 - RNA, 20 nt, Human
uacuagucaccagagacuuu

SEQ ID NO: 1484801 - RNA, 18 nt, Human
uacgugcucugugggucu

SEQ ID NO: 1484802 - RNA, 16 nt, Human
uacguauuuaauagca

SEQ ID NO: 1484803 - RNA, 19 nt, Human
uacgugggcauugucuuuu

SEQ ID NO: 1484804 - RNA, 18 nt, Human
aauuugagagaaauauga

SEQ ID NO: 1484805 - RNA, 20 nt, Human
aauuugagagaaauaugaag

SEQ ID NO: 1484806 - RNA, 13 nt, Human
aauuugaggacaa

SEQ ID NO: 1484807 - RNA, 20 nt, Human
aauuugaaacacuuugcaua

SEQ ID NO: 1484808 - RNA, 14 nt, Human
uacuucaaauccuu

SEQ ID NO: 1484809 - RNA, 19 nt, Human
uacuucaaauccuugaaga

SEQ ID NO: 1484810 - RNA, 19 nt, Human
aauuugauaugugaacagu

SEQ ID NO: 1484811 - RNA, 20 nt, Human
uacuuauuuuugacaguguu

SEQ ID NO: 1484812 - RNA, 15 nt, Human
aauuugauaugugaa

SEQ ID NO: 1484813 - RNA, 16 nt, Human
aauuugauaugugaac

SEQ ID NO: 1484814 - RNA, 18 nt, Human
aauuugauaugugaacag

SEQ ID NO: 1484815 - RNA, 14 nt, Human
aauuugaggacaac

SEQ ID NO: 1484816 - RNA, 16 nt, Human
aauuuagaaaacuuua

SEQ ID NO: 1484817 - RNA, 15 nt, Human
aauuuagaaaacuuu

SEQ ID NO: 1484818 - RNA, 14 nt, Human
aauuuagaaaucau

SEQ ID NO: 1484819 - RNA, 15 nt, Human
aauuuagaaaucauu

SEQ ID NO: 1484820 - RNA, 17 nt, Human
aauuuagaaaucauuuu

SEQ ID NO: 1484821 - RNA, 20 nt, Human
aauuuagaaaucauuuugca

SEQ ID NO: 1484822 - RNA, 21 nt, Human
aauuuagaaaucauuuugcaa

SEQ ID NO: 1484823 - RNA, 17 nt, Human
aauuuagacuucaagca

SEQ ID NO: 1484824 - RNA, 18 nt, Human
aauuuauccugaaauuuc

SEQ ID NO: 1484825 - RNA, 19 nt, Human
aauuuauccugaaauuuca

SEQ ID NO: 1484826 - RNA, 23 nt, Human
aauuuauccugaaauuucagauu

SEQ ID NO: 1484827 - RNA, 21 nt, Human
aauuuaugaauugaauuaucu

SEQ ID NO: 1484828 - RNA, 23 nt, Human
aauuuaugaauugaauuaucuug

SEQ ID NO: 1484829 - RNA, 16 nt, Human
aauuucuaccauuuca

SEQ ID NO: 1484830 - RNA, 18 nt, Human
aauuucuaccauuucaga

SEQ ID NO: 1484831 - RNA, 15 nt, Human
aauuuaaauagcuuu

SEQ ID NO: 1484832 - RNA, 22 nt, Human
aauuuaaaguuguuugugccuu

SEQ ID NO: 1484833 - RNA, 16 nt, Human
aauuuaaauagcuuuu

SEQ ID NO: 1484834 - RNA, 16 nt, Human
aauuuacaucauuucu

SEQ ID NO: 1484835 - RNA, 19 nt, Human
aauuguuuuaucugaauuu

SEQ ID NO: 1484836 - RNA, 22 nt, Human
aauuguuuuaucugaauuuuua

SEQ ID NO: 1484837 - RNA, 22 nt, Human
aauuuaaacuauaagcaagaag

SEQ ID NO: 1484838 - RNA, 23 nt, Human
aauugugugaaagguacuucaaa

SEQ ID NO: 1484839 - RNA, 13 nt, Human
uacuguaagaaaa

SEQ ID NO: 1484840 - RNA, 23 nt, Human
aauugcuauguuuugacauuuuu

SEQ ID NO: 1484841 - RNA, 20 nt, Human
aauuguguuuauaauuuuaa

SEQ ID NO: 1484842 - RNA, 22 nt, Human
uagaagagagagguugaaaaac

SEQ ID NO: 1484843 - RNA, 14 nt, Human
uagaagagagaggu

SEQ ID NO: 1484844 - RNA, 21 nt, Human
uacuucaaauccuugaagauu

SEQ ID NO: 1484845 - RNA, 16 nt, Human
uacuucaugcugucua

SEQ ID NO: 1484846 - RNA, 14 nt, Human
uagaacuagccaaa

SEQ ID NO: 1484847 - RNA, 23 nt, Human
uagaagucacauuccugaacagg

SEQ ID NO: 1484848 - RNA, 22 nt, Human
uagaagccccguuauaacuccu

SEQ ID NO: 1484849 - RNA, 17 nt, Human
uagaauugaguguuuaa

SEQ ID NO: 1484850 - RNA, 20 nt, Human
uagaauugaguguuuaaagu

SEQ ID NO: 1484851 - RNA, 19 nt, Human
uagaauuugauaugugaac

SEQ ID NO: 1484852 - RNA, 13 nt, Human
uagacaagccaga

SEQ ID NO: 1484853 - RNA, 19 nt, Human
uagaauugaguguuuaaag

SEQ ID NO: 1484854 - RNA, 18 nt, Human
uagacaauugagguaagu

SEQ ID NO: 1484855 - RNA, 15 nt, Human
uagacaauugaggua

SEQ ID NO: 1484856 - RNA, 22 nt, Human
uagacaaguccagccuggcaag

SEQ ID NO: 1484857 - RNA, 14 nt, Human
uagacaagccagaa

SEQ ID NO: 1484858 - RNA, 15 nt, Human
uagacaagccagaac

SEQ ID NO: 1484859 - RNA, 19 nt, Human
uagacaagccagaacuuga

SEQ ID NO: 1484860 - RNA, 19 nt, Human
aauuuuuauauuugaaaua

SEQ ID NO: 1484861 - RNA, 17 nt, Human
aauuuuaaacaaagguu

SEQ ID NO: 1484862 - RNA, 14 nt, Human
aauuuuaaacaaag

SEQ ID NO: 1484863 - RNA, 19 nt, Human
aauuuuaaccuaugauauu

SEQ ID NO: 1484864 - RNA, 22 nt, Human
aauuuuuauuuuugcugagacu

SEQ ID NO: 1484865 - RNA, 19 nt, Human
aauuuguacuauuuaacug

SEQ ID NO: 1484866 - RNA, 19 nt, Human
aauuuuuucucuaggaaau

SEQ ID NO: 1484867 - RNA, 18 nt, Human
aauuuuuuaucaugcaug

SEQ ID NO: 1484868 - RNA, 20 nt, Human
aauuuuuuaucaugcauguc

SEQ ID NO: 1484869 - RNA, 13 nt, Human
aauuuuuuucacc

SEQ ID NO: 1484870 - RNA, 22 nt, Human
aauuuuuucucuaggaaauauu

SEQ ID NO: 1484871 - RNA, 13 nt, Human
aauuuuuguagua

SEQ ID NO: 1484872 - RNA, 19 nt, Human
acaaaaaaaaaauuugcca

SEQ ID NO: 1484873 - RNA, 20 nt, Human
aauuuuuuucaccuagauuu

SEQ ID NO: 1484874 - RNA, 20 nt, Human
aauuuuuuuccuuaccuuuu

SEQ ID NO: 1484875 - RNA, 19 nt, Human
uagcauuuguguugaagag

SEQ ID NO: 1484876 - RNA, 15 nt, Human
acaaauuaucuuaaa

SEQ ID NO: 1484877 - RNA, 18 nt, Human
acaaauucugucucugga

SEQ ID NO: 1484878 - RNA, 14 nt, Human
acaacaauccuucu

SEQ ID NO: 1484879 - RNA, 15 nt, Human
acaagaagcauuuug

SEQ ID NO: 1484880 - RNA, 17 nt, Human
acaagaagcauuuugua

SEQ ID NO: 1484881 - RNA, 18 nt, Human
acaagaagcauuuuguaa

SEQ ID NO: 1484882 - RNA, 18 nt, Human
acaagcacuaaacaaaga

SEQ ID NO: 1484883 - RNA, 21 nt, Human
acaagcauucugucuugaagg

SEQ ID NO: 1484884 - RNA, 22 nt, Human
acaagccagaacuugacccuga

SEQ ID NO: 1484885 - RNA, 14 nt, Human
acaagccagaacuu

SEQ ID NO: 1484886 - RNA, 21 nt, Human
uagcaugucgucaaagcugaa

SEQ ID NO: 1484887 - RNA, 20 nt, Human
uagaugcaguucugaagaag

SEQ ID NO: 1484888 - RNA, 13 nt, Human
uagauuuucugcu

SEQ ID NO: 1484889 - RNA, 15 nt, Human
uagaggaagcagcca

SEQ ID NO: 1484890 - RNA, 16 nt, Human
uagauauuggacaaag

SEQ ID NO: 1484891 - RNA, 17 nt, Human
uagaugcaguucugaag

SEQ ID NO: 1484892 - RNA, 19 nt, Human
uagaugcaguucugaagaa

SEQ ID NO: 1484893 - RNA, 18 nt, Human
acaaaaagaaaagaaaau

SEQ ID NO: 1484894 - RNA, 14 nt, Human
acaaaaagaaaaga

SEQ ID NO: 1484895 - RNA, 14 nt, Human
uagagcacugccac

SEQ ID NO: 1484896 - RNA, 17 nt, Human
uagagcacugccaccag

SEQ ID NO: 1484897 - RNA, 16 nt, Human
uagagcacugccacca

SEQ ID NO: 1484898 - RNA, 23 nt, Human
uaccccaccucccucaaccucau

SEQ ID NO: 1484899 - RNA, 16 nt, Human
uacccccagcugugcu

SEQ ID NO: 1484900 - RNA, 16 nt, Human
uaccauauacagcuca

SEQ ID NO: 1484901 - RNA, 20 nt, Human
uaccaucacugaguuuucca

SEQ ID NO: 1484902 - RNA, 17 nt, Human
uaccaucacugaguuuu

SEQ ID NO: 1484903 - RNA, 17 nt, Human
uaccacugcugauauuu

SEQ ID NO: 1484904 - RNA, 20 nt, Human
uaccacugcugauauuuucu

SEQ ID NO: 1484905 - RNA, 19 nt, Human
uaccagagaaaaagggagg

SEQ ID NO: 1484906 - RNA, 22 nt, Human
uaccacugcugauauuuucucu

SEQ ID NO: 1484907 - RNA, 21 nt, Human
uaccacugcugauauuuucuc

SEQ ID NO: 1484908 - RNA, 13 nt, Human
uaccagaaagcag

SEQ ID NO: 1484909 - RNA, 20 nt, Human
uacauuuauaguuguaacua

SEQ ID NO: 1484910 - RNA, 18 nt, Human
aauguugacaugggacau

SEQ ID NO: 1484911 - RNA, 14 nt, Human
aauguugaauuuug

SEQ ID NO: 1484912 - RNA, 19 nt, Human
aauguugauuacagugcag

SEQ ID NO: 1484913 - RNA, 19 nt, Human
aauuaacaugaauauuuag

SEQ ID NO: 1484914 - RNA, 20 nt, Human
aauuaagaaaggauaaaguu

SEQ ID NO: 1484915 - RNA, 15 nt, Human
uacauuguauauaug

SEQ ID NO: 1484916 - RNA, 21 nt, Human
uacauuguuaccucuauauac

SEQ ID NO: 1484917 - RNA, 17 nt, Human
uacauuguuaccucuau

SEQ ID NO: 1484918 - RNA, 22 nt, Human
uacauguuugcaccuuucuagu

SEQ ID NO: 1484919 - RNA, 12 nt, Human
uacauguuugca

SEQ ID NO: 1484920 - RNA, 13 nt, Human
uacauguuugcac

SEQ ID NO: 1484921 - RNA, 15 nt, Human
uacauuaauuaucua

SEQ ID NO: 1484922 - RNA, 17 nt, Human
uacauguacugauuacu

SEQ ID NO: 1484923 - RNA, 23 nt, Human
uacauggcuggagcuagaauuug

SEQ ID NO: 1484924 - RNA, 15 nt, Human
uacaugguguuugug

SEQ ID NO: 1484925 - RNA, 20 nt, Human
uacaguggggaaugaagaua

SEQ ID NO: 1484926 - RNA, 14 nt, Human
uacagucuaaagcu

SEQ ID NO: 1484927 - RNA, 15 nt, Human
uacagucuaaagcug

SEQ ID NO: 1484928 - RNA, 22 nt, Human
uacagcaacaauuuaugaauug

SEQ ID NO: 1484929 - RNA, 19 nt, Human
uacagcaacaauuuaugaa

SEQ ID NO: 1484930 - RNA, 20 nt, Human
uacagcaacaauuuaugaau

SEQ ID NO: 1484931 - RNA, 16 nt, Human
aauguaucauagaaau

SEQ ID NO: 1484932 - RNA, 18 nt, Human
aauguaucauagaaaugu

SEQ ID NO: 1484933 - RNA, 19 nt, Human
aauguaucauagaaaugua

SEQ ID NO: 1484934 - RNA, 22 nt, Human
aauguaucauagaaauguaacu

SEQ ID NO: 1484935 - RNA, 22 nt, Human
aauguaggagacuguuuggaaa

SEQ ID NO: 1484936 - RNA, 12 nt, Human
uacauacagaau

SEQ ID NO: 1484937 - RNA, 20 nt, Human
uacauacagaauuacuguaa

SEQ ID NO: 1484938 - RNA, 14 nt, Human
uacauagaugcuua

SEQ ID NO: 1484939 - RNA, 13 nt, Human
aauguaagacaaa

SEQ ID NO: 1484940 - RNA, 23 nt, Human
uacaaugaaaaggacuuuauaga

SEQ ID NO: 1484941 - RNA, 16 nt, Human
uacaauaauucuauga

SEQ ID NO: 1484942 - RNA, 14 nt, Human
uacaccuaugucau

SEQ ID NO: 1484943 - RNA, 17 nt, Human
uacaccuaugucauuuc

SEQ ID NO: 1484944 - RNA, 21 nt, Human
uacaccuaugucauuucauuu

SEQ ID NO: 1484945 - RNA, 13 nt, Human
uaauucauguugc

SEQ ID NO: 1484946 - RNA, 15 nt, Human
uaauuugacuagaaa

SEQ ID NO: 1484947 - RNA, 16 nt, Human
uaauuugacuagaaaa

SEQ ID NO: 1484948 - RNA, 15 nt, Human
uaauuugagagaaau

SEQ ID NO: 1484949 - RNA, 18 nt, Human
uaauuugaggacaaccau

SEQ ID NO: 1484950 - RNA, 22 nt, Human
uaauuugaggacaaccauucca

SEQ ID NO: 1484951 - RNA, 16 nt, Human
uacaagccugcacaau

SEQ ID NO: 1484952 - RNA, 13 nt, Human
uacaaguuagaaa

SEQ ID NO: 1484953 - RNA, 15 nt, Human
uacaaguuagaaaac

SEQ ID NO: 1484954 - RNA, 21 nt, Human
uacaagcauucugucuugaag

SEQ ID NO: 1484955 - RNA, 14 nt, Human
uaauuauccaggaa

SEQ ID NO: 1484956 - RNA, 23 nt, Human
uaauuauaccgcuaucauuccaa

SEQ ID NO: 1484957 - RNA, 19 nt, Human
uaauucaauucaaagcugu

SEQ ID NO: 1484958 - RNA, 15 nt, Human
uaauguaagacaaau

SEQ ID NO: 1484959 - RNA, 13 nt, Human
uaaugaacaaaug

SEQ ID NO: 1484960 - RNA, 14 nt, Human
uaaugaacaaaugg

SEQ ID NO: 1484961 - RNA, 16 nt, Human
aaucuugucaugugua

SEQ ID NO: 1484962 - RNA, 19 nt, Human
aaucuugguugaugccaaa

SEQ ID NO: 1484963 - RNA, 13 nt, Human
aaucuugguuugc

SEQ ID NO: 1484964 - RNA, 15 nt, Human
aaucuugucaugugu

SEQ ID NO: 1484965 - RNA, 16 nt, Human
aaucuuuuauaggauu

SEQ ID NO: 1484966 - RNA, 13 nt, Human
uaaugugauauua

SEQ ID NO: 1484967 - RNA, 22 nt, Human
uaauccaagcaaaugugaauca

SEQ ID NO: 1484968 - RNA, 22 nt, Human
uaaucauucuuauuucaugaaa

SEQ ID NO: 1484969 - RNA, 20 nt, Human
uaaucauucuuauuucauga

SEQ ID NO: 1484970 - RNA, 17 nt, Human
uaaucuuuaauuuuaca

SEQ ID NO: 1484971 - RNA, 13 nt, Human
uaaucuuucacag

SEQ ID NO: 1484972 - RNA, 14 nt, Human
uaaucuucugccuu

SEQ ID NO: 1484973 - RNA, 15 nt, Human
uaaucuucugccuuc

SEQ ID NO: 1484974 - RNA, 16 nt, Human
uaauauuccucaguuc

SEQ ID NO: 1484975 - RNA, 16 nt, Human
uaauauugauuuauua

SEQ ID NO: 1484976 - RNA, 19 nt, Human
uaaucagguccucagagaa

SEQ ID NO: 1484977 - RNA, 22 nt, Human
uaaucagguccucagagaauuu

SEQ ID NO: 1484978 - RNA, 18 nt, Human
uaauacuugcuuuggaaa

SEQ ID NO: 1484979 - RNA, 20 nt, Human
uaauacauuccaacucguau

SEQ ID NO: 1484980 - RNA, 16 nt, Human
uaauaccacagcuuuu

SEQ ID NO: 1484981 - RNA, 21 nt, Human
uaauacagcaacaauuuauga

SEQ ID NO: 1484982 - RNA, 22 nt, Human
uaauacagcaacaauuuaugaa

SEQ ID NO: 1484983 - RNA, 23 nt, Human
aauacaucccuuaccugggaaag

SEQ ID NO: 1484984 - RNA, 18 nt, Human
uaauacagcaacaauuua

SEQ ID NO: 1484985 - RNA, 19 nt, Human
uaacaaugcuguauuuuaa

SEQ ID NO: 1484986 - RNA, 16 nt, Human
aagcuuuuaugugaaa

SEQ ID NO: 1484987 - RNA, 19 nt, Human
aaggaaaaaauaacaauga

SEQ ID NO: 1484988 - RNA, 16 nt, Human
aaggaaaaaauaacaa

SEQ ID NO: 1484989 - RNA, 22 nt, Human
aagcuuuggugagaaccugggu

SEQ ID NO: 1484990 - RNA, 19 nt, Human
aagcuuuggugagaaccug

SEQ ID NO: 1484991 - RNA, 15 nt, Human
aagcucugaagaacu

SEQ ID NO: 1484992 - RNA, 22 nt, Human
guguuuauccuaucucuccaac

SEQ ID NO: 1484993 - RNA, 13 nt, Human
guugaauuuuaca

SEQ ID NO: 1484994 - RNA, 20 nt, Human
guugaauuuuuuuuaacauu

SEQ ID NO: 1484995 - RNA, 21 nt, Human
guugaauuuuuuuuaacauuc

SEQ ID NO: 1484996 - RNA, 23 nt, Human
guugaauuuuuuuuaacauuccu

SEQ ID NO: 1484997 - RNA, 13 nt, Human
guugacaugggac

SEQ ID NO: 1484998 - RNA, 12 nt, Human
guugagacagag

SEQ ID NO: 1484999 - RNA, 15 nt, Human
guugagagugugacc

SEQ ID NO: 1485000 - RNA, 17 nt, Human
guugagagugugaccaa

SEQ ID NO: 1485001 - RNA, 15 nt, Human
guugagacaagaaaa

SEQ ID NO: 1485002 - RNA, 20 nt, Human
aaggccugguguuucuugau

SEQ ID NO: 1485003 - RNA, 15 nt, Human
aaggccuccuggcug

SEQ ID NO: 1485004 - RNA, 20 nt, Human
guugggagagggcgcaggcc

SEQ ID NO: 1485005 - RNA, 21 nt, Human
guuggggacacauguauuugg

SEQ ID NO: 1485006 - RNA, 18 nt, Human
guugggacuacaggcgug

SEQ ID NO: 1485007 - RNA, 22 nt, Human
aaggagcaagucagaauagaaa

SEQ ID NO: 1485008 - RNA, 17 nt, Human
aaggaaggcuccaucuc

SEQ ID NO: 1485009 - RNA, 17 nt, Human
aaggaaggcagggagga

SEQ ID NO: 1485010 - RNA, 15 nt, Human
aaggaagcugugcgu

SEQ ID NO: 1485011 - RNA, 21 nt, Human
aaggauaaaguugguaaaccu

SEQ ID NO: 1485012 - RNA, 23 nt, Human
aaggaggauggcauauaauacaa

SEQ ID NO: 1485013 - RNA, 23 nt, Human
aaggauaaaguugguaaaccuuu

SEQ ID NO: 1485014 - RNA, 13 nt, Human
aaggauaaugaau

SEQ ID NO: 1485015 - RNA, 22 nt, Human
aaggaggacccaggacaggauc

SEQ ID NO: 1485016 - RNA, 21 nt, Human
aaggaggacccaggacaggau

SEQ ID NO: 1485017 - RNA, 18 nt, Human
aaggaggacccaggacag

SEQ ID NO: 1485018 - RNA, 17 nt, Human
aaggaggacccaggaca

SEQ ID NO: 1485019 - RNA, 15 nt, Human
aaggaggacccagga

SEQ ID NO: 1485020 - RNA, 14 nt, Human
aaggaggacccagg

SEQ ID NO: 1485021 - RNA, 13 nt, Human
aaggaggacccag

SEQ ID NO: 1485022 - RNA, 23 nt, Human
aaggagcagagcugauggagaag

SEQ ID NO: 1485023 - RNA, 20 nt, Human
aagucacauuccugaacagg

SEQ ID NO: 1485024 - RNA, 18 nt, Human
aagucaauguuuucaguu

SEQ ID NO: 1485025 - RNA, 17 nt, Human
aagucaauguuuucagu

SEQ ID NO: 1485026 - RNA, 23 nt, Human
aaguauguuagugcaaauuguca

SEQ ID NO: 1485027 - RNA, 17 nt, Human
guuuuuuuguuauuaaa

SEQ ID NO: 1485028 - RNA, 14 nt, Human
guuuuuuucuaaua

SEQ ID NO: 1485029 - RNA, 15 nt, Human
guuuuuuuuuaaaga

SEQ ID NO: 1485030 - RNA, 23 nt, Human
guuuuuuuuuaaaaaagaaacau

SEQ ID NO: 1485031 - RNA, 16 nt, Human
guuuuuuaguugaauu

SEQ ID NO: 1485032 - RNA, 14 nt, Human
guuuuuuguaccaa

SEQ ID NO: 1485033 - RNA, 19 nt, Human
aagugacuuuggcugcaug

SEQ ID NO: 1485034 - RNA, 19 nt, Human
aagugacuaauggcaugag

SEQ ID NO: 1485035 - RNA, 15 nt, Human
aagugaauuugccug

SEQ ID NO: 1485036 - RNA, 16 nt, Human
aagugaauuugccugu

SEQ ID NO: 1485037 - RNA, 20 nt, Human
aagugaauuugccuguaaca

SEQ ID NO: 1485038 - RNA, 17 nt, Human
aagugaauuugccugua

SEQ ID NO: 1485039 - RNA, 22 nt, Human
aagucuuauauauuguagauaa

SEQ ID NO: 1485040 - RNA, 15 nt, Human
guuuuauaauuuugu

SEQ ID NO: 1485041 - RNA, 22 nt, Human
guuuuauaauuuugugaagcaa

SEQ ID NO: 1485042 - RNA, 13 nt, Human
guuuuacuuuuaa

SEQ ID NO: 1485043 - RNA, 18 nt, Human
guuuuacuuuuaaacugu

SEQ ID NO: 1485044 - RNA, 21 nt, Human
guuuuacuuuuaaacugugua

SEQ ID NO: 1485045 - RNA, 17 nt, Human
guuugcacuaucuuuca

SEQ ID NO: 1485046 - RNA, 19 nt, Human
guuugcaucugaaaauuga

SEQ ID NO: 1485047 - RNA, 15 nt, Human
guuugccuuccagaa

SEQ ID NO: 1485048 - RNA, 16 nt, Human
guuguaaaccaaguga

SEQ ID NO: 1485049 - RNA, 13 nt, Human
aaguaaaagcaaa

SEQ ID NO: 1485050 - RNA, 21 nt, Human
aaguaaaagcaaaaaagaaaa

SEQ ID NO: 1485051 - RNA, 18 nt, Human
aaguaaaagcaaaaaaga

SEQ ID NO: 1485052 - RNA, 11 nt, Human
aagggucaggc

SEQ ID NO: 1485053 - RNA, 12 nt, Human
aagggucaggcc

SEQ ID NO: 1485054 - RNA, 13 nt, Human
aagggucaggccu

SEQ ID NO: 1485055 - RNA, 14 nt, Human
aagggucaggccuu

SEQ ID NO: 1485056 - RNA, 20 nt, Human
aagggucaggccuuugagcu

SEQ ID NO: 1485057 - RNA, 16 nt, Human
aagggucaggccuuug

SEQ ID NO: 1485058 - RNA, 14 nt, Human
aaggguugagcugg

SEQ ID NO: 1485059 - RNA, 19 nt, Human
aauaagguacaagaagcau

SEQ ID NO: 1485060 - RNA, 14 nt, Human
aauaagguugaaca

SEQ ID NO: 1485061 - RNA, 15 nt, Human
aauaagguacaagaa

SEQ ID NO: 1485062 - RNA, 22 nt, Human
aauaacguuuaagccaaaacaa

SEQ ID NO: 1485063 - RNA, 20 nt, Human
aauaaauauccuuuaauuga

SEQ ID NO: 1485064 - RNA, 15 nt, Human
aauaacaauaaaaga

SEQ ID NO: 1485065 - RNA, 15 nt, Human
aauaaaaaagauccc

SEQ ID NO: 1485066 - RNA, 20 nt, Human
uaaagugacccugcucucac

SEQ ID NO: 1485067 - RNA, 17 nt, Human
uaaagugacccugcucu

SEQ ID NO: 1485068 - RNA, 19 nt, Human
uaaagugacuaauggcaug

SEQ ID NO: 1485069 - RNA, 15 nt, Human
uaaagugauauuucc

SEQ ID NO: 1485070 - RNA, 16 nt, Human
uaaagugauauuuccc

SEQ ID NO: 1485071 - RNA, 12 nt, Human
aauaaaaauaau

SEQ ID NO: 1485072 - RNA, 14 nt, Human
aauaaaaauguuua

SEQ ID NO: 1485073 - RNA, 15 nt, Human
aauaaaaauguuuaa

SEQ ID NO: 1485074 - RNA, 22 nt, Human
aauaaaauccauacauuugugu

SEQ ID NO: 1485075 - RNA, 12 nt, Human
uaaauagcuuuu

SEQ ID NO: 1485076 - RNA, 13 nt, Human
uaaauaguauuuc

SEQ ID NO: 1485077 - RNA, 12 nt, Human
uaaauaguauuu

SEQ ID NO: 1485078 - RNA, 23 nt, Human
uaaauguuuuuuuuuaaagacuu

SEQ ID NO: 1485079 - RNA, 20 nt, Human
uaaauguuuuuuuuuaaaga

SEQ ID NO: 1485080 - RNA, 13 nt, Human
uaaauuuguacua

SEQ ID NO: 1485081 - RNA, 14 nt, Human
uaaauuuguacuau

SEQ ID NO: 1485082 - RNA, 19 nt, Human
uaaauuuguacuauuuaac

SEQ ID NO: 1485083 - RNA, 20 nt, Human
uaaauuuguacuauuuaacu

SEQ ID NO: 1485084 - RNA, 22 nt, Human
uaaauuuguacuauuuaacuga

SEQ ID NO: 1485085 - RNA, 13 nt, Human
uaacaaaaauaaa

SEQ ID NO: 1485086 - RNA, 20 nt, Human
uaacaaaaauaaaaacucuu

SEQ ID NO: 1485087 - RNA, 16 nt, Human
uaaauuuuuuuccuua

SEQ ID NO: 1485088 - RNA, 21 nt, Human
uaaauuuguacuauuuaacug

SEQ ID NO: 1485089 - RNA, 15 nt, Human
uaacaaugcuguauu

SEQ ID NO: 1485090 - RNA, 17 nt, Human
uaacaaugcuguauuuu

SEQ ID NO: 1485091 - RNA, 15 nt, Human
uaacaagccagauuu

SEQ ID NO: 1485092 - RNA, 15 nt, Human
uaacaaccaaagacu

SEQ ID NO: 1485093 - RNA, 13 nt, Human
uaaacgucuuaaa

SEQ ID NO: 1485094 - RNA, 17 nt, Human
uaaacgucuuaaauauu

SEQ ID NO: 1485095 - RNA, 13 nt, Human
uaaacuaaacacg

SEQ ID NO: 1485096 - RNA, 13 nt, Human
uaaaccuuuuuug

SEQ ID NO: 1485097 - RNA, 23 nt, Human
uaaacccauauuguaaaacaggu

SEQ ID NO: 1485098 - RNA, 16 nt, Human
uaaaccggaccaucuc

SEQ ID NO: 1485099 - RNA, 17 nt, Human
uaaaccgcuaaaagaaa

SEQ ID NO: 1485100 - RNA, 17 nt, Human
uaaacuauaagcaagaa

SEQ ID NO: 1485101 - RNA, 15 nt, Human
uaaacuauaagcaag

SEQ ID NO: 1485102 - RNA, 20 nt, Human
uaaacuaucuuggugaauuu

SEQ ID NO: 1485103 - RNA, 21 nt, Human
uaaacuaucuuggugaauuuu

SEQ ID NO: 1485104 - RNA, 22 nt, Human
uaaacuaucuuggugaauuuuu

SEQ ID NO: 1485105 - RNA, 14 nt, Human
uaaacucaaaauau

SEQ ID NO: 1485106 - RNA, 16 nt, Human
uaaacucaaaauauuu

SEQ ID NO: 1485107 - RNA, 19 nt, Human
uaaacucaaaauauuugua

SEQ ID NO: 1485108 - RNA, 21 nt, Human
uaaacucaaaauauuuguaca

SEQ ID NO: 1485109 - RNA, 22 nt, Human
uaaacucaaaauauuuguacau

SEQ ID NO: 1485110 - RNA, 23 nt, Human
uaaacucaaaauauuuguacaua

SEQ ID NO: 1485111 - RNA, 16 nt, Human
uaaagacuuuuaugau

SEQ ID NO: 1485112 - RNA, 15 nt, Human
uaaagaauuauuuug

SEQ ID NO: 1485113 - RNA, 16 nt, Human
uaaagaauuauuuugu

SEQ ID NO: 1485114 - RNA, 13 nt, Human
uaaagaauuauuu

SEQ ID NO: 1485115 - RNA, 17 nt, Human
uaaagaaauagaacaag

SEQ ID NO: 1485116 - RNA, 16 nt, Human
uaaagaaauagaacaa

SEQ ID NO: 1485117 - RNA, 15 nt, Human
uaaagaacauaaaua

SEQ ID NO: 1485118 - RNA, 22 nt, Human
uaaagauuuuuuaauaauuuag

SEQ ID NO: 1485119 - RNA, 12 nt, Human
uaaagauuuuuu

SEQ ID NO: 1485120 - RNA, 16 nt, Human
uaaagauuuuuuaaua

SEQ ID NO: 1485121 - RNA, 17 nt, Human
uaaagauuuuuuaauaa

SEQ ID NO: 1485122 - RNA, 20 nt, Human
uaaagauuuuuuaauaauuu

SEQ ID NO: 1485123 - RNA, 21 nt, Human
uaaagauuuuuuaauaauuua

SEQ ID NO: 1485124 - RNA, 18 nt, Human
uaaagauauuuuuaucuu

SEQ ID NO: 1485125 - RNA, 21 nt, Human
uaaagauauuuuuaucuuuau

SEQ ID NO: 1485126 - RNA, 22 nt, Human
uaaagauauuuuuaucuuuaua

SEQ ID NO: 1485127 - RNA, 22 nt, Human
aaguuuaguuugaggaauucuu

SEQ ID NO: 1485128 - RNA, 23 nt, Human
aaguuuagccccugaaagccaug

SEQ ID NO: 1485129 - RNA, 15 nt, Human
aaguuucaucauuuu

SEQ ID NO: 1485130 - RNA, 19 nt, Human
aaguuugcacuaucuuuca

SEQ ID NO: 1485131 - RNA, 21 nt, Human
aaguuugcacuaucuuucagc

SEQ ID NO: 1485132 - RNA, 20 nt, Human
aaguuugcacuaucuuucag

SEQ ID NO: 1485133 - RNA, 19 nt, Human
uaaaauuuuuaaucuuuaa

SEQ ID NO: 1485134 - RNA, 13 nt, Human
uaaacaaagguug

SEQ ID NO: 1485135 - RNA, 17 nt, Human
uaaaauuuuuaaucuuu

SEQ ID NO: 1485136 - RNA, 19 nt, Human
uaaaauuacaacuaaguga

SEQ ID NO: 1485137 - RNA, 17 nt, Human
uaaaauuacaacuaagu

SEQ ID NO: 1485138 - RNA, 15 nt, Human
uaaaauuacaacuaa

SEQ ID NO: 1485139 - RNA, 13 nt, Human
uaaaauuacaacu

SEQ ID NO: 1485140 - RNA, 20 nt, Human
aaguuuaauggugccuucau

SEQ ID NO: 1485141 - RNA, 16 nt, Human
aaguuuaccagaaagc

SEQ ID NO: 1485142 - RNA, 21 nt, Human
aaguuuagccccugaaagcca

SEQ ID NO: 1485143 - RNA, 17 nt, Human
guuuuuuuuuaaagacu

SEQ ID NO: 1485144 - RNA, 23 nt, Human
aaguguuucauaaauuugagagu

SEQ ID NO: 1485145 - RNA, 13 nt, Human
aaguguuuucucu

SEQ ID NO: 1485146 - RNA, 22 nt, Human
aaguguuuucucugaacacauu

SEQ ID NO: 1485147 - RNA, 14 nt, Human
aaguguuuucucug

SEQ ID NO: 1485148 - RNA, 16 nt, Human
aaguuacauguuugca

SEQ ID NO: 1485149 - RNA, 19 nt, Human
aaguuacauguuugcaccu

SEQ ID NO: 1485150 - RNA, 20 nt, Human
aaguuacauguuugcaccuu

SEQ ID NO: 1485151 - RNA, 22 nt, Human
aaguuagaacuagccaaaccag

SEQ ID NO: 1485152 - RNA, 17 nt, Human
guguugaaaauguucag

SEQ ID NO: 1485153 - RNA, 21 nt, Human
guguuuaaaguucaacauguu

SEQ ID NO: 1485154 - RNA, 16 nt, Human
guguugaaaauguuca

SEQ ID NO: 1485155 - RNA, 15 nt, Human
guguguguauauaua

SEQ ID NO: 1485156 - RNA, 15 nt, Human
guguguguguguaug

SEQ ID NO: 1485157 - RNA, 19 nt, Human
aagcaaguaaaaaggcuaa

SEQ ID NO: 1485158 - RNA, 21 nt, Human
aagcaagcauucagaagaaaa

SEQ ID NO: 1485159 - RNA, 13 nt, Human
aagcaagcuuaau

SEQ ID NO: 1485160 - RNA, 15 nt, Human
aagcaagcauucaga

SEQ ID NO: 1485161 - RNA, 19 nt, Human
aagcaagcauucagaagaa

SEQ ID NO: 1485162 - RNA, 20 nt, Human
aagcaaguaaaaaggcuaaa

SEQ ID NO: 1485163 - RNA, 16 nt, Human
aagcaaguauuagaau

SEQ ID NO: 1485164 - RNA, 20 nt, Human
aagcaaaugugaaucauuuu

SEQ ID NO: 1485165 - RNA, 14 nt, Human
aagcaaaugugaau

SEQ ID NO: 1485166 - RNA, 13 nt, Human
aagcaaaugugaa

SEQ ID NO: 1485167 - RNA, 17 nt, Human
aagcaaaucgaaugaaa

SEQ ID NO: 1485168 - RNA, 18 nt, Human
aagcaaaucgaaugaaau

SEQ ID NO: 1485169 - RNA, 19 nt, Human
aagcaaaauuuuuucucua

SEQ ID NO: 1485170 - RNA, 13 nt, Human
aagaugaucauuu

SEQ ID NO: 1485171 - RNA, 15 nt, Human
aagaucacuuucuca

SEQ ID NO: 1485172 - RNA, 17 nt, Human
aagaucacuuucucagu

SEQ ID NO: 1485173 - RNA, 23 nt, Human
aagaucacuuucucaguuuucau

SEQ ID NO: 1485174 - RNA, 18 nt, Human
guggggggggugcugggc

SEQ ID NO: 1485175 - RNA, 22 nt, Human
gugggauuaugggucacaggaa

SEQ ID NO: 1485176 - RNA, 17 nt, Human
guggcuuucagagccuc

SEQ ID NO: 1485177 - RNA, 19 nt, Human
guggcuuuaggagcagugg

SEQ ID NO: 1485178 - RNA, 18 nt, Human
aagagcuacguauuuaau

SEQ ID NO: 1485179 - RNA, 21 nt, Human
gugggagaccggccugccagg

SEQ ID NO: 1485180 - RNA, 22 nt, Human
gugggagaccggccugccagga

SEQ ID NO: 1485181 - RNA, 23 nt, Human
gugggagaccggccugccaggag

SEQ ID NO: 1485182 - RNA, 13 nt, Human
aagaccauuuuuc

SEQ ID NO: 1485183 - RNA, 18 nt, Human
aagacugcuguggccagg

SEQ ID NO: 1485184 - RNA, 19 nt, Human
aagacugcuguggccagga

SEQ ID NO: 1485185 - RNA, 20 nt, Human
aagacugcuguggccaggag

SEQ ID NO: 1485186 - RNA, 21 nt, Human
aagacugcuguggccaggagg

SEQ ID NO: 1485187 - RNA, 22 nt, Human
aagacugcuguggccaggaggu

SEQ ID NO: 1485188 - RNA, 15 nt, Human
aagagauuccugagc

SEQ ID NO: 1485189 - RNA, 20 nt, Human
aagagcuacguauuuaauag

SEQ ID NO: 1485190 - RNA, 12 nt, Human
aagagcucagga

SEQ ID NO: 1485191 - RNA, 13 nt, Human
aagagcucaggau

SEQ ID NO: 1485192 - RNA, 24 nt, Human
aagaauuucuaggacugaauuaug

SEQ ID NO: 1485193 - RNA, 18 nt, Human
aagaauguuaagacuuga

SEQ ID NO: 1485194 - RNA, 11 nt, Human
aagaauuauuu

SEQ ID NO: 1485195 - RNA, 14 nt, Human
aagaauuauuuugu

SEQ ID NO: 1485196 - RNA, 16 nt, Human
aagacaaaaagcuacu

SEQ ID NO: 1485197 - RNA, 13 nt, Human
guggcagcaacaa

SEQ ID NO: 1485198 - RNA, 21 nt, Human
aagaaucacaauaauuuucua

SEQ ID NO: 1485199 - RNA, 19 nt, Human
aagaauguuaagacuugac

SEQ ID NO: 1485200 - RNA, 12 nt, Human
aagaauguuaag

SEQ ID NO: 1485201 - RNA, 19 nt, Human
guggcaagugaauuugccu

SEQ ID NO: 1485202 - RNA, 17 nt, Human
guggcacuggggcaggg

SEQ ID NO: 1485203 - RNA, 18 nt, Human
guggcacuggggcagggg

SEQ ID NO: 1485204 - RNA, 19 nt, Human
guggacaccugcccugccc

SEQ ID NO: 1485205 - RNA, 18 nt, Human
guggacaccugcccugcc

SEQ ID NO: 1485206 - RNA, 17 nt, Human
guggacaccugcccugc

SEQ ID NO: 1485207 - RNA, 16 nt, Human
guggacaccugcccug

SEQ ID NO: 1485208 - RNA, 14 nt, Human
guggacaccugccc

SEQ ID NO: 1485209 - RNA, 13 nt, Human
guggacaccugcc

SEQ ID NO: 1485210 - RNA, 12 nt, Human
guggacaccugc

SEQ ID NO: 1485211 - RNA, 11 nt, Human
guggacaccug

SEQ ID NO: 1485212 - RNA, 19 nt, Human
gugcugggccccugccucu

SEQ ID NO: 1485213 - RNA, 16 nt, Human
gugcugggccccugcc

SEQ ID NO: 1485214 - RNA, 17 nt, Human
aagaagggacugagaga

SEQ ID NO: 1485215 - RNA, 22 nt, Human
aagaaguaaaagcaaaaaagaa

SEQ ID NO: 1485216 - RNA, 14 nt, Human
aagaaguaaaagca

SEQ ID NO: 1485217 - RNA, 20 nt, Human
gugcacuaauguguaagaca

SEQ ID NO: 1485218 - RNA, 22 nt, Human
gugcacuaauguguaagacaaa

SEQ ID NO: 1485219 - RNA, 21 nt, Human
aacuugguuuugcuacauaau

SEQ ID NO: 1485220 - RNA, 16 nt, Human
aacuugguuuugcuac

SEQ ID NO: 1485221 - RNA, 22 nt, Human
aacuugguuuugcuacauaauu

SEQ ID NO: 1485222 - RNA, 18 nt, Human
aacuugcuuaucaacuuc

SEQ ID NO: 1485223 - RNA, 19 nt, Human
aagaaaauuuuuguaguag

SEQ ID NO: 1485224 - RNA, 16 nt, Human
aagaaagucagccaua

SEQ ID NO: 1485225 - RNA, 13 nt, Human
aagaaaguccacc

SEQ ID NO: 1485226 - RNA, 15 nt, Human
aagaaauaaguuuuu

SEQ ID NO: 1485227 - RNA, 13 nt, Human
aagaaaauaucac

SEQ ID NO: 1485228 - RNA, 13 nt, Human
aagaaaaucacuu

SEQ ID NO: 1485229 - RNA, 22 nt, Human
aagaaaaucuauuuuguaacuu

SEQ ID NO: 1485230 - RNA, 22 nt, Human
aagaagcauuuuguaaguugaa

SEQ ID NO: 1485231 - RNA, 16 nt, Human
aagaagggacugagag

SEQ ID NO: 1485232 - RNA, 17 nt, Human
aagaaaacaucuuuaag

SEQ ID NO: 1485233 - RNA, 13 nt, Human
aagaaaacaucuu

SEQ ID NO: 1485234 - RNA, 20 nt, Human
aagaaaauaagagcucagga

SEQ ID NO: 1485235 - RNA, 18 nt, Human
gucgcccuggacugugug

SEQ ID NO: 1485236 - RNA, 20 nt, Human
gucgcccaugcuggagugca

SEQ ID NO: 1485237 - RNA, 14 nt, Human
gucgcccuggacug

SEQ ID NO: 1485238 - RNA, 15 nt, Human
gucuacuugcucagg

SEQ ID NO: 1485239 - RNA, 21 nt, Human
gucuaucaaccccagacacug

SEQ ID NO: 1485240 - RNA, 23 nt, Human
gucuaucaaccccagacacuggu

SEQ ID NO: 1485241 - RNA, 22 nt, Human
gucuaucaaccccagacacugg

SEQ ID NO: 1485242 - RNA, 13 nt, Human
gucgccaggcuag

SEQ ID NO: 1485243 - RNA, 20 nt, Human
guccuuggcaggcugauuuc

SEQ ID NO: 1485244 - RNA, 15 nt, Human
guccugcaccggggc

SEQ ID NO: 1485245 - RNA, 19 nt, Human
guccugcaccggggccugg

SEQ ID NO: 1485246 - RNA, 20 nt, Human
guccugcaccggggccuggg

SEQ ID NO: 1485247 - RNA, 21 nt, Human
aacauuacucugaaauuguaa

SEQ ID NO: 1485248 - RNA, 22 nt, Human
aaccaaaucacugaacuuugcu

SEQ ID NO: 1485249 - RNA, 21 nt, Human
gucuccaguauccacuuugca

SEQ ID NO: 1485250 - RNA, 15 nt, Human
gucucaaacuccuga

SEQ ID NO: 1485251 - RNA, 22 nt, Human
gucucaaacuccugaccucagg

SEQ ID NO: 1485252 - RNA, 22 nt, Human
guagcguuuuuuaaauguauac

SEQ ID NO: 1485253 - RNA, 18 nt, Human
guagcguuuuuuaaaugu

SEQ ID NO: 1485254 - RNA, 17 nt, Human
guagcguuuuuuaaaug

SEQ ID NO: 1485255 - RNA, 13 nt, Human
guagcguuuuuua

SEQ ID NO: 1485256 - RNA, 23 nt, Human
guagcgggggaggguaggcagga

SEQ ID NO: 1485257 - RNA, 19 nt, Human
guccguucacauguguggu

SEQ ID NO: 1485258 - RNA, 20 nt, Human
guccuaauaauaucccacug

SEQ ID NO: 1485259 - RNA, 14 nt, Human
aacauauuguugaa

SEQ ID NO: 1485260 - RNA, 20 nt, Human
aacauguuauuuguaauaga

SEQ ID NO: 1485261 - RNA, 16 nt, Human
aacauauauaacaaug

SEQ ID NO: 1485262 - RNA, 22 nt, Human
aacauagaaauugccugacgaa

SEQ ID NO: 1485263 - RNA, 15 nt, Human
aacauagacagaaga

SEQ ID NO: 1485264 - RNA, 16 nt, Human
aacauagacagaagaa

SEQ ID NO: 1485265 - RNA, 15 nt, Human
aacauauauauacua

SEQ ID NO: 1485266 - RNA, 20 nt, Human
aacauaaucuucugccuucu

SEQ ID NO: 1485267 - RNA, 21 nt, Human
aacagugagccugaauuuugu

SEQ ID NO: 1485268 - RNA, 17 nt, Human
aacagugaagacagaag

SEQ ID NO: 1485269 - RNA, 13 nt, Human
aacagugagccug

SEQ ID NO: 1485270 - RNA, 22 nt, Human
aacauaaucuucugccuucuca

SEQ ID NO: 1485271 - RNA, 16 nt, Human
aacagugaagacagaa

SEQ ID NO: 1485272 - RNA, 20 nt, Human
aacugaaaucauacuucuua

SEQ ID NO: 1485273 - RNA, 21 nt, Human
aacugaacaccauugaaggcu

SEQ ID NO: 1485274 - RNA, 22 nt, Human
aacugaacaccauugaaggcuu

SEQ ID NO: 1485275 - RNA, 23 nt, Human
aacugaacaccauugaaggcuua

SEQ ID NO: 1485276 - RNA, 16 nt, Human
aacucugcuugauuuu

SEQ ID NO: 1485277 - RNA, 20 nt, Human
gugagaaccuggguugcaga

SEQ ID NO: 1485278 - RNA, 15 nt, Human
gugagaaauuuaaac

SEQ ID NO: 1485279 - RNA, 22 nt, Human
gugagaaccuggguugcagaca

SEQ ID NO: 1485280 - RNA, 21 nt, Human
gugacauuuuacauuaaauuu

SEQ ID NO: 1485281 - RNA, 20 nt, Human
gugacauuuuacauuaaauu

SEQ ID NO: 1485282 - RNA, 17 nt, Human
gugaccaaaaguuacau

SEQ ID NO: 1485283 - RNA, 19 nt, Human
gugacauuuuacauuaaau

SEQ ID NO: 1485284 - RNA, 17 nt, Human
gugacauuuuacauuaa

SEQ ID NO: 1485285 - RNA, 13 nt, Human
aacuauauuguuu

SEQ ID NO: 1485286 - RNA, 20 nt, Human
aacuaucucauuuccaagca

SEQ ID NO: 1485287 - RNA, 23 nt, Human
aacuaucucauuuccaagcaagu

SEQ ID NO: 1485288 - RNA, 14 nt, Human
gugaagaauacuuc

SEQ ID NO: 1485289 - RNA, 14 nt, Human
gugaagacagaagu

SEQ ID NO: 1485290 - RNA, 18 nt, Human
gugaagggaagagacagc

SEQ ID NO: 1485291 - RNA, 22 nt, Human
aacuacuucucuuguuagguaa

SEQ ID NO: 1485292 - RNA, 19 nt, Human
aacuaagaaacuuaaauuu

SEQ ID NO: 1485293 - RNA, 15 nt, Human
aacuaagaaacuuaa

SEQ ID NO: 1485294 - RNA, 20 nt, Human
aacguuuaagccaaaacaau

SEQ ID NO: 1485295 - RNA, 16 nt, Human
aaccuuucuucaccaa

SEQ ID NO: 1485296 - RNA, 18 nt, Human
aaccuuucuucaccaaau

SEQ ID NO: 1485297 - RNA, 18 nt, Human
aacguuaagaauuguuaa

SEQ ID NO: 1485298 - RNA, 17 nt, Human
aaccuuaauuuauuauu

SEQ ID NO: 1485299 - RNA, 23 nt, Human
aaccugaugaaaauaaagaaugg

SEQ ID NO: 1485300 - RNA, 21 nt, Human
aaccuguuaccuacuuugacu

SEQ ID NO: 1485301 - RNA, 24 nt, Human
aaccuguuaccuacuuugacuuuu

SEQ ID NO: 1485302 - RNA, 18 nt, Human
aaccuuaauuuauuauua

SEQ ID NO: 1485303 - RNA, 22 nt, Human
gucucuuuaaaaggaaagaaaa

SEQ ID NO: 1485304 - RNA, 24 nt, Human
aaccaugaagagauuuuucaugau

SEQ ID NO: 1485305 - RNA, 19 nt, Human
aaccaugcaaaugcuauga

SEQ ID NO: 1485306 - RNA, 23 nt, Human
aaccaugaagagauuuuucauga

SEQ ID NO: 1485307 - RNA, 21 nt, Human
aaccaugaagagauuuuucau

SEQ ID NO: 1485308 - RNA, 15 nt, Human
gucuggugaagcuca

SEQ ID NO: 1485309 - RNA, 18 nt, Human
gucugguugggcagccag

SEQ ID NO: 1485310 - RNA, 22 nt, Human
aaaaaccuuguauaucuuguuu

SEQ ID NO: 1485311 - RNA, 14 nt, Human
aaaaacuaaaaacu

SEQ ID NO: 1485312 - RNA, 17 nt, Human
aaaaacuaaaaacuaga

SEQ ID NO: 1485313 - RNA, 19 nt, Human
aaaaacuacaaccaaugga

SEQ ID NO: 1485314 - RNA, 20 nt, Human
aguggcgugaucucagcuca

SEQ ID NO: 1485315 - RNA, 14 nt, Human
aguggcucaacauu

SEQ ID NO: 1485316 - RNA, 19 nt, Human
aguggcgugaucucagcuc

SEQ ID NO: 1485317 - RNA, 20 nt, Human
aguggcgcgaucucagcuca

SEQ ID NO: 1485318 - RNA, 19 nt, Human
aguggcgcgaucucagcuc

SEQ ID NO: 1485319 - RNA, 22 nt, Human
aguggcuggggcauggaaggca

SEQ ID NO: 1485320 - RNA, 16 nt, Human
aguggcuggggcaugg

SEQ ID NO: 1485321 - RNA, 13 nt, Human
aguggcuggggca

SEQ ID NO: 1485322 - RNA, 16 nt, Human
aguguauggaaauaaa

SEQ ID NO: 1485323 - RNA, 20 nt, Human
aguguauggaaauaaaugua

SEQ ID NO: 1485324 - RNA, 21 nt, Human
aguguauggaaauaaauguau

SEQ ID NO: 1485325 - RNA, 22 nt, Human
aguguauggaaauaaauguauc

SEQ ID NO: 1485326 - RNA, 14 nt, Human
aguguccucagggg

SEQ ID NO: 1485327 - RNA, 22 nt, Human
aguugaaaaucuuauaauuuaa

SEQ ID NO: 1485328 - RNA, 13 nt, Human
aguucaugagaau

SEQ ID NO: 1485329 - RNA, 21 nt, Human
aguucaugagaaucuauauuu

SEQ ID NO: 1485330 - RNA, 17 nt, Human
aguucaugucugcuauc

SEQ ID NO: 1485331 - RNA, 16 nt, Human
aguucaugucugcuau

SEQ ID NO: 1485332 - RNA, 19 nt, Human
aguuacagaaaugauuacu

SEQ ID NO: 1485333 - RNA, 23 nt, Human
aguugaaaaucuuauaauuuaaa

SEQ ID NO: 1485334 - RNA, 16 nt, Human
aguugaaaauaaagug

SEQ ID NO: 1485335 - RNA, 18 nt, Human
aguugaaaauaaagugua

SEQ ID NO: 1485336 - RNA, 19 nt, Human
aguugaaaauaaaguguau

SEQ ID NO: 1485337 - RNA, 16 nt, Human
aguuguguuugaagca

SEQ ID NO: 1485338 - RNA, 21 nt, Human
aguugugucuggcaguuuaua

SEQ ID NO: 1485339 - RNA, 16 nt, Human
aguaucucuucagucu

SEQ ID NO: 1485340 - RNA, 18 nt, Human
aguaucucuucagucucu

SEQ ID NO: 1485341 - RNA, 16 nt, Human
aguaucuuuuuauuca

SEQ ID NO: 1485342 - RNA, 12 nt, Human
aguaugaaaaua

SEQ ID NO: 1485343 - RNA, 13 nt, Human
aguaugaaaauaa

SEQ ID NO: 1485344 - RNA, 23 nt, Human
aguaugcuugaaaagauaaauua

SEQ ID NO: 1485345 - RNA, 23 nt, Human
agucaaauugugugaaagguacu

SEQ ID NO: 1485346 - RNA, 19 nt, Human
agucaaauugugugaaagg

SEQ ID NO: 1485347 - RNA, 18 nt, Human
aguauggguuagggaaaa

SEQ ID NO: 1485348 - RNA, 19 nt, Human
aguccugggauuacaggug

SEQ ID NO: 1485349 - RNA, 12 nt, Human
aguccuguaaug

SEQ ID NO: 1485350 - RNA, 12 nt, Human
agugaagaauac

SEQ ID NO: 1485351 - RNA, 14 nt, Human
agugaagaauacuu

SEQ ID NO: 1485352 - RNA, 22 nt, Human
agugaagaauacuucucauuuu

SEQ ID NO: 1485353 - RNA, 14 nt, Human
agugaagacagaag

SEQ ID NO: 1485354 - RNA, 15 nt, Human
agugaagacagaagu

SEQ ID NO: 1485355 - RNA, 23 nt, Human
agugaagggaagagacagcccag

SEQ ID NO: 1485356 - RNA, 20 nt, Human
agugacagcuaggaugugca

SEQ ID NO: 1485357 - RNA, 12 nt, Human
agugacagcuag

SEQ ID NO: 1485358 - RNA, 14 nt, Human
auagucaaauugug

SEQ ID NO: 1485359 - RNA, 17 nt, Human
auagucaaauuguguga

SEQ ID NO: 1485360 - RNA, 23 nt, Human
auauagaucaguuauaaguagca

SEQ ID NO: 1485361 - RNA, 18 nt, Human
auauacuuuuacaaguaa

SEQ ID NO: 1485362 - RNA, 15 nt, Human
auagguuuaauaauu

SEQ ID NO: 1485363 - RNA, 14 nt, Human
auagguuuggacaa

SEQ ID NO: 1485364 - RNA, 18 nt, Human
auagguuuggacaaaaug

SEQ ID NO: 1485365 - RNA, 23 nt, Human
auagguagaauguaaagcuuguc

SEQ ID NO: 1485366 - RNA, 13 nt, Human
auagccaaaaaua

SEQ ID NO: 1485367 - RNA, 14 nt, Human
auagccaaaaauag

SEQ ID NO: 1485368 - RNA, 15 nt, Human
auagccaaaaauagc

SEQ ID NO: 1485369 - RNA, 16 nt, Human
auagccaaaaauagcu

SEQ ID NO: 1485370 - RNA, 18 nt, Human
auagccaaaaauagcuaa

SEQ ID NO: 1485371 - RNA, 16 nt, Human
auaucaaauauauuca

SEQ ID NO: 1485372 - RNA, 19 nt, Human
auauauuuuuuucugaaau

SEQ ID NO: 1485373 - RNA, 23 nt, Human
auauuaugaagcuuuuaugugaa

SEQ ID NO: 1485374 - RNA, 13 nt, Human
auauuaucuuuuc

SEQ ID NO: 1485375 - RNA, 16 nt, Human
auauuaugagaugcug

SEQ ID NO: 1485376 - RNA, 14 nt, Human
auauuaugagaugc

SEQ ID NO: 1485377 - RNA, 15 nt, Human
auauuaugagaugcu

SEQ ID NO: 1485378 - RNA, 19 nt, Human
auauuauuccucaaaaaau

SEQ ID NO: 1485379 - RNA, 14 nt, Human
auauuauuuuaugu

SEQ ID NO: 1485380 - RNA, 13 nt, Human
auauuuauuuuaa

SEQ ID NO: 1485381 - RNA, 13 nt, Human
auauccuaaacau

SEQ ID NO: 1485382 - RNA, 15 nt, Human
auauccuaaacauca

SEQ ID NO: 1485383 - RNA, 12 nt, Human
auauccaaaagc

SEQ ID NO: 1485384 - RNA, 19 nt, Human
auauccaaaagcuuuuuau

SEQ ID NO: 1485385 - RNA, 22 nt, Human
auauccuaaacaucauucauuu

SEQ ID NO: 1485386 - RNA, 23 nt, Human
auaugcuucuguuuuauaauuuu

SEQ ID NO: 1485387 - RNA, 20 nt, Human
auaugcucugauuuaucuga

SEQ ID NO: 1485388 - RNA, 20 nt, Human
auaugcuucuguuuuauaau

SEQ ID NO: 1485389 - RNA, 22 nt, Human
auaugcuucuguuuuauaauuu

SEQ ID NO: 1485390 - RNA, 23 nt, Human
auaauguuucaaacauauauaac

SEQ ID NO: 1485391 - RNA, 13 nt, Human
auacacacaguua

SEQ ID NO: 1485392 - RNA, 14 nt, Human
auaagcuuuucuuu

SEQ ID NO: 1485393 - RNA, 13 nt, Human
auaagcuuuucuu

SEQ ID NO: 1485394 - RNA, 20 nt, Human
auaaggaaaucaacuugcuu

SEQ ID NO: 1485395 - RNA, 22 nt, Human
auaaggaaaucaacuugcuuau

SEQ ID NO: 1485396 - RNA, 24 nt, Human
auaaggaaaucaacuugcuuauca

SEQ ID NO: 1485397 - RNA, 14 nt, Human
auacccacccagaa

SEQ ID NO: 1485398 - RNA, 13 nt, Human
auacccacccaga

SEQ ID NO: 1485399 - RNA, 12 nt, Human
auaccucacuuu

SEQ ID NO: 1485400 - RNA, 14 nt, Human
auaacaacuucaua

SEQ ID NO: 1485401 - RNA, 18 nt, Human
auaaaggauuaaugucaa

SEQ ID NO: 1485402 - RNA, 20 nt, Human
auaaacuuuuuucuuacugu

SEQ ID NO: 1485403 - RNA, 19 nt, Human
auaaaaauaaaaaagaucc

SEQ ID NO: 1485404 - RNA, 14 nt, Human
auaaaaauaaaaaa

SEQ ID NO: 1485405 - RNA, 12 nt, Human
auaaaaaggugu

SEQ ID NO: 1485406 - RNA, 14 nt, Human
auaaaggacuguaa

SEQ ID NO: 1485407 - RNA, 18 nt, Human
auaaagcuguguggcagu

SEQ ID NO: 1485408 - RNA, 15 nt, Human
auaaagcaggcagaa

SEQ ID NO: 1485409 - RNA, 11 nt, Human
auaaagaaugg

SEQ ID NO: 1485410 - RNA, 18 nt, Human
auaaagaaauagaacaag

SEQ ID NO: 1485411 - RNA, 17 nt, Human
auaaagaaauagaacaa

SEQ ID NO: 1485412 - RNA, 17 nt, Human
auauuuauuuuaauaau

SEQ ID NO: 1485413 - RNA, 14 nt, Human
auauuuauuuuaau

SEQ ID NO: 1485414 - RNA, 15 nt, Human
auauuuauuuuaaua

SEQ ID NO: 1485415 - RNA, 16 nt, Human
aucaugugaaaucauu

SEQ ID NO: 1485416 - RNA, 15 nt, Human
aucaugugaaaucau

SEQ ID NO: 1485417 - RNA, 16 nt, Human
auccagaaagaaaacu

SEQ ID NO: 1485418 - RNA, 18 nt, Human
auccagaaagaaaacuug

SEQ ID NO: 1485419 - RNA, 16 nt, Human
auccaggcaccaggac

SEQ ID NO: 1485420 - RNA, 15 nt, Human
auccaggcaccagga

SEQ ID NO: 1485421 - RNA, 20 nt, Human
auccccaacaugcacugaug

SEQ ID NO: 1485422 - RNA, 20 nt, Human
auccucccacuucagccucc

SEQ ID NO: 1485423 - RNA, 17 nt, Human
aucgcuucauguaacua

SEQ ID NO: 1485424 - RNA, 23 nt, Human
augaaguuuuuuuuauacaggau

SEQ ID NO: 1485425 - RNA, 19 nt, Human
augagcuccuuaaggcucu

SEQ ID NO: 1485426 - RNA, 19 nt, Human
augaaguuuuuuuuauaca

SEQ ID NO: 1485427 - RNA, 22 nt, Human
augaagcuuuuaugugaaacau

SEQ ID NO: 1485428 - RNA, 18 nt, Human
augaaggugucauacaga

SEQ ID NO: 1485429 - RNA, 14 nt, Human
augaaaaagaagaa

SEQ ID NO: 1485430 - RNA, 15 nt, Human
augaaaaagaagaau

SEQ ID NO: 1485431 - RNA, 17 nt, Human
augaaaaagaagaaucu

SEQ ID NO: 1485432 - RNA, 16 nt, Human
augaaaaagaagaauc

SEQ ID NO: 1485433 - RNA, 17 nt, Human
aucuauauuuuacauaa

SEQ ID NO: 1485434 - RNA, 21 nt, Human
aucuauauuuuacauaaauuu

SEQ ID NO: 1485435 - RNA, 16 nt, Human
aucuaugcauuuucug

SEQ ID NO: 1485436 - RNA, 18 nt, Human
aucuaugcauuuucugga

SEQ ID NO: 1485437 - RNA, 19 nt, Human
aucuauuccugguagaaua

SEQ ID NO: 1485438 - RNA, 13 nt, Human
aucucccugccuc

SEQ ID NO: 1485439 - RNA, 14 nt, Human
aucucccugccucc

SEQ ID NO: 1485440 - RNA, 19 nt, Human
aucucccugccuccugccg

SEQ ID NO: 1485441 - RNA, 16 nt, Human
aucucccugccuccug

SEQ ID NO: 1485442 - RNA, 18 nt, Human
aucuggaaccaucagaaa

SEQ ID NO: 1485443 - RNA, 17 nt, Human
aucuggcaacaucuuua

SEQ ID NO: 1485444 - RNA, 18 nt, Human
aucucuguaaagcuaaaa

SEQ ID NO: 1485445 - RNA, 13 nt, Human
aucucuguaaagc

SEQ ID NO: 1485446 - RNA, 17 nt, Human
aucucuguaaagcuaaa

SEQ ID NO: 1485447 - RNA, 15 nt, Human
aucucugugugcaca

SEQ ID NO: 1485448 - RNA, 17 nt, Human
aucucugugugcacaaa

SEQ ID NO: 1485449 - RNA, 19 nt, Human
aucucugugugcacaaaua

SEQ ID NO: 1485450 - RNA, 18 nt, Human
aucuugaauaauguaaga

SEQ ID NO: 1485451 - RNA, 16 nt, Human
aucuucugccuucuca

SEQ ID NO: 1485452 - RNA, 18 nt, Human
aucuucugccuucucaug

SEQ ID NO: 1485453 - RNA, 17 nt, Human
aucuucuuaugcaauuu

SEQ ID NO: 1485454 - RNA, 20 nt, Human
aucuucuuaugcaauuuccu

SEQ ID NO: 1485455 - RNA, 12 nt, Human
aucuggcuucug

SEQ ID NO: 1485456 - RNA, 21 nt, Human
aucuggcugcaguuuugcuau

SEQ ID NO: 1485457 - RNA, 22 nt, Human
aucuggcuucuggccaggaagc

SEQ ID NO: 1485458 - RNA, 22 nt, Human
aucuggcugcaguuuugcuauc

SEQ ID NO: 1485459 - RNA, 20 nt, Human
aucuggcuucuggccaggaa

SEQ ID NO: 1485460 - RNA, 15 nt, Human
aucugggaagcuauu

SEQ ID NO: 1485461 - RNA, 14 nt, Human
aucuucugccuucu

SEQ ID NO: 1485462 - RNA, 11 nt, Human
augugaacagu

SEQ ID NO: 1485463 - RNA, 21 nt, Human
augugaacaguuguguuugaa

SEQ ID NO: 1485464 - RNA, 23 nt, Human
augugaacaguuguguuugaagc

SEQ ID NO: 1485465 - RNA, 22 nt, Human
augugaaccauuaaccagaucu

SEQ ID NO: 1485466 - RNA, 12 nt, Human
augugaaccauu

SEQ ID NO: 1485467 - RNA, 14 nt, Human
augugaaaucauuc

SEQ ID NO: 1485468 - RNA, 13 nt, Human
augucaaacaaau

SEQ ID NO: 1485469 - RNA, 11 nt, Human
augugaauugu

SEQ ID NO: 1485470 - RNA, 23 nt, Human
augugaauuguuaguuucugagu

SEQ ID NO: 1485471 - RNA, 24 nt, Human
auggucacguuuggugcuucucag

SEQ ID NO: 1485472 - RNA, 21 nt, Human
auggucacguuuggugcuucu

SEQ ID NO: 1485473 - RNA, 20 nt, Human
auggucacguuuggugcuuc

SEQ ID NO: 1485474 - RNA, 23 nt, Human
augguaucaauaaauagaccauu

SEQ ID NO: 1485475 - RNA, 17 nt, Human
auguaagcugaaaauau

SEQ ID NO: 1485476 - RNA, 24 nt, Human
auguauucagcuuuaguagauauu

SEQ ID NO: 1485477 - RNA, 15 nt, Human
auguuuucaggcuag

SEQ ID NO: 1485478 - RNA, 22 nt, Human
auguuugcucagcuucuccaac

SEQ ID NO: 1485479 - RNA, 17 nt, Human
auguuucacaaggucuu

SEQ ID NO: 1485480 - RNA, 18 nt, Human
augugggauuauggguca

SEQ ID NO: 1485481 - RNA, 20 nt, Human
augugggauuaugggucaca

SEQ ID NO: 1485482 - RNA, 22 nt, Human
augugggauuaugggucacagg

SEQ ID NO: 1485483 - RNA, 13 nt, Human
augugggauuaug

SEQ ID NO: 1485484 - RNA, 14 nt, Human
augugggauuaugg

SEQ ID NO: 1485485 - RNA, 20 nt, Human
augcauauuauuuuauguug

SEQ ID NO: 1485486 - RNA, 16 nt, Human
augcauauuauuuuau

SEQ ID NO: 1485487 - RNA, 12 nt, Human
augcaucuguuu

SEQ ID NO: 1485488 - RNA, 20 nt, Human
augcaucuguuuauucuaua

SEQ ID NO: 1485489 - RNA, 11 nt, Human
augcauauacu

SEQ ID NO: 1485490 - RNA, 14 nt, Human
augauguuaaaaaa

SEQ ID NO: 1485491 - RNA, 22 nt, Human
augauguuaaaaaaauaagaag

SEQ ID NO: 1485492 - RNA, 21 nt, Human
augauguuaaaaaaauaagaa

SEQ ID NO: 1485493 - RNA, 22 nt, Human
augaugccucugucuucuggac

SEQ ID NO: 1485494 - RNA, 17 nt, Human
augcaauuuccuuuuuu

SEQ ID NO: 1485495 - RNA, 19 nt, Human
augccucugucuucuggac

SEQ ID NO: 1485496 - RNA, 13 nt, Human
auggauucuaaaa

SEQ ID NO: 1485497 - RNA, 14 nt, Human
auggauucuaaaau

SEQ ID NO: 1485498 - RNA, 15 nt, Human
auggauucuaaaaug

SEQ ID NO: 1485499 - RNA, 18 nt, Human
auggauucuaaaaugccu

SEQ ID NO: 1485500 - RNA, 19 nt, Human
auggaaagcuucagugcug

SEQ ID NO: 1485501 - RNA, 21 nt, Human
agagugugaccaaaaguuaca

SEQ ID NO: 1485502 - RNA, 11 nt, Human
agagugugacc

SEQ ID NO: 1485503 - RNA, 14 nt, Human
agagugugaccaaa

SEQ ID NO: 1485504 - RNA, 14 nt, Human
agaguggcuggggc

SEQ ID NO: 1485505 - RNA, 13 nt, Human
agaguggcugggg

SEQ ID NO: 1485506 - RNA, 14 nt, Human
agaguucaagaaau

SEQ ID NO: 1485507 - RNA, 15 nt, Human
agaguucaagaaaua

SEQ ID NO: 1485508 - RNA, 18 nt, Human
agaguucaagaaauaagu

SEQ ID NO: 1485509 - RNA, 21 nt, Human
agaguucaagaaauaaguuuu

SEQ ID NO: 1485510 - RNA, 18 nt, Human
agaucuuuuauuuugcca

SEQ ID NO: 1485511 - RNA, 16 nt, Human
agaucuuuuauuuugc

SEQ ID NO: 1485512 - RNA, 23 nt, Human
agacagagucuuccucugucucc

SEQ ID NO: 1485513 - RNA, 20 nt, Human
agacagagucuuacucuguu

SEQ ID NO: 1485514 - RNA, 19 nt, Human
agacagagucuuacucugu

SEQ ID NO: 1485515 - RNA, 20 nt, Human
agacagagucuuccucuguc

SEQ ID NO: 1485516 - RNA, 23 nt, Human
agacagcccaggauacuggcaca

SEQ ID NO: 1485517 - RNA, 22 nt, Human
agacagcccaggauacuggcac

SEQ ID NO: 1485518 - RNA, 17 nt, Human
agacagcccaggauacu

SEQ ID NO: 1485519 - RNA, 23 nt, Human
agacaacagguaaaacagggcca

SEQ ID NO: 1485520 - RNA, 19 nt, Human
agacaacagguaaaacagg

SEQ ID NO: 1485521 - RNA, 17 nt, Human
agagaagaaagaacgga

SEQ ID NO: 1485522 - RNA, 13 nt, Human
agagaagaaagaa

SEQ ID NO: 1485523 - RNA, 17 nt, Human
agagaacuuccagaucc

SEQ ID NO: 1485524 - RNA, 18 nt, Human
agagagccugcaggaucu

SEQ ID NO: 1485525 - RNA, 14 nt, Human
agagagccugcagg

SEQ ID NO: 1485526 - RNA, 15 nt, Human
agagagccugcagga

SEQ ID NO: 1485527 - RNA, 23 nt, Human
agacugcgauuugucccaggucc

SEQ ID NO: 1485528 - RNA, 13 nt, Human
agccaagugcagg

SEQ ID NO: 1485529 - RNA, 14 nt, Human
agccaauauuuuuc

SEQ ID NO: 1485530 - RNA, 15 nt, Human
agcaugccuucaaau

SEQ ID NO: 1485531 - RNA, 15 nt, Human
agcccgguaagagca

SEQ ID NO: 1485532 - RNA, 16 nt, Human
agcccgguaagagcaa

SEQ ID NO: 1485533 - RNA, 21 nt, Human
agcccuaaacaucauucuuga

SEQ ID NO: 1485534 - RNA, 21 nt, Human
agcccgguaagagcaaaagaa

SEQ ID NO: 1485535 - RNA, 22 nt, Human
agcccgguaagagcaaaagaau

SEQ ID NO: 1485536 - RNA, 13 nt, Human
agcccuaaacauc

SEQ ID NO: 1485537 - RNA, 14 nt, Human
agcccuaaacauca

SEQ ID NO: 1485538 - RNA, 15 nt, Human
agcccuaaacaucau

SEQ ID NO: 1485539 - RNA, 17 nt, Human
agccccagugacagcua

SEQ ID NO: 1485540 - RNA, 13 nt, Human
agccgugagcaug

SEQ ID NO: 1485541 - RNA, 14 nt, Human
agccgggagccuga

SEQ ID NO: 1485542 - RNA, 23 nt, Human
aggaugguucccuugaugaagaa

SEQ ID NO: 1485543 - RNA, 14 nt, Human
aggaccuaaaacau

SEQ ID NO: 1485544 - RNA, 16 nt, Human
aggaccuaaaacaucu

SEQ ID NO: 1485545 - RNA, 15 nt, Human
aggagaaugagccuc

SEQ ID NO: 1485546 - RNA, 18 nt, Human
aggagacacaccugaggc

SEQ ID NO: 1485547 - RNA, 14 nt, Human
aggagucacugaga

SEQ ID NO: 1485548 - RNA, 15 nt, Human
aggagucacugagac

SEQ ID NO: 1485549 - RNA, 17 nt, Human
aggagucacugagacca

SEQ ID NO: 1485550 - RNA, 16 nt, Human
aggagucacugagacc

SEQ ID NO: 1485551 - RNA, 15 nt, Human
aggagugggugggga

SEQ ID NO: 1485552 - RNA, 22 nt, Human
aggaguuaguggauuacugcca

SEQ ID NO: 1485553 - RNA, 22 nt, Human
aggaguggguggggaguggggg

SEQ ID NO: 1485554 - RNA, 23 nt, Human
aggacccaggacaggauccaggc

SEQ ID NO: 1485555 - RNA, 18 nt, Human
aggacccaggacaggauc

SEQ ID NO: 1485556 - RNA, 12 nt, Human
aggacccagggc

SEQ ID NO: 1485557 - RNA, 13 nt, Human
aggacccagggcu

SEQ ID NO: 1485558 - RNA, 14 nt, Human
aggacccagggcuc

SEQ ID NO: 1485559 - RNA, 15 nt, Human
aggacccagggcucu

SEQ ID NO: 1485560 - RNA, 14 nt, Human
aggacccaggacag

SEQ ID NO: 1485561 - RNA, 13 nt, Human
aggacccaggaca

SEQ ID NO: 1485562 - RNA, 12 nt, Human
aggacccaggac

SEQ ID NO: 1485563 - RNA, 17 nt, Human
aggacccagggcucugu

SEQ ID NO: 1485564 - RNA, 21 nt, Human
agcuuuucccuuuuuuuaagu

SEQ ID NO: 1485565 - RNA, 22 nt, Human
agcuuuuuauuccuccugcuca

SEQ ID NO: 1485566 - RNA, 19 nt, Human
agcuuuuuccagaggcuau

SEQ ID NO: 1485567 - RNA, 22 nt, Human
agcuccuuaaggcucuuuugua

SEQ ID NO: 1485568 - RNA, 16 nt, Human
agcugagcaaaucacc

SEQ ID NO: 1485569 - RNA, 20 nt, Human
agcugagcaaaucaccacaa

SEQ ID NO: 1485570 - RNA, 16 nt, Human
agcugagagaaaauaa

SEQ ID NO: 1485571 - RNA, 12 nt, Human
agcugaaaauau

SEQ ID NO: 1485572 - RNA, 14 nt, Human
agcugcuccccacg

SEQ ID NO: 1485573 - RNA, 17 nt, Human
agcugcuccccacguca

SEQ ID NO: 1485574 - RNA, 11 nt, Human
aggucccuaau

SEQ ID NO: 1485575 - RNA, 12 nt, Human
aggucccuaaua

SEQ ID NO: 1485576 - RNA, 17 nt, Human
agguaauuuuuuucacc

SEQ ID NO: 1485577 - RNA, 23 nt, Human
agguaaaucagacuaugaaguuu

SEQ ID NO: 1485578 - RNA, 18 nt, Human
agguaaaucagacuauga

SEQ ID NO: 1485579 - RNA, 14 nt, Human
agguaaaaugccau

SEQ ID NO: 1485580 - RNA, 15 nt, Human
agguaaaaugccaug

SEQ ID NO: 1485581 - RNA, 16 nt, Human
agguaaaaugccauga

SEQ ID NO: 1485582 - RNA, 13 nt, Human
agguaaaaugcca

SEQ ID NO: 1485583 - RNA, 14 nt, Human
agguaaaacagggc

SEQ ID NO: 1485584 - RNA, 22 nt, Human
agguaaaaugccaugaugccuc

SEQ ID NO: 1485585 - RNA, 20 nt, Human
agguaaaagcaucacaugaa

SEQ ID NO: 1485586 - RNA, 16 nt, Human
aggucccuaauaaagc

SEQ ID NO: 1485587 - RNA, 16 nt, Human
agguacacagcucuag

SEQ ID NO: 1485588 - RNA, 16 nt, Human
agguacaagaagcauu

SEQ ID NO: 1485589 - RNA, 15 nt, Human
aggucccuaauaaag

SEQ ID NO: 1485590 - RNA, 13 nt, Human
aggucccuaauaa

SEQ ID NO: 1485591 - RNA, 15 nt, Human
agguuacaagccugc

SEQ ID NO: 1485592 - RNA, 21 nt, Human
agguuacaagccugcacaaua

SEQ ID NO: 1485593 - RNA, 12 nt, Human
agggucaggccu

SEQ ID NO: 1485594 - RNA, 13 nt, Human
agggucaggccuu

SEQ ID NO: 1485595 - RNA, 14 nt, Human
agggucaggccuuu

SEQ ID NO: 1485596 - RNA, 22 nt, Human
agggucaggccuuugagcucag

SEQ ID NO: 1485597 - RNA, 22 nt, Human
agggucauaucacucaggcccu

SEQ ID NO: 1485598 - RNA, 22 nt, Human
agggaccggcggaccccagcca

SEQ ID NO: 1485599 - RNA, 15 nt, Human
aggcuagauguaugu

SEQ ID NO: 1485600 - RNA, 16 nt, Human
aggcuagauguaugua

SEQ ID NO: 1485601 - RNA, 17 nt, Human
aggcuagauguauguac

SEQ ID NO: 1485602 - RNA, 23 nt, Human
aggcuacuguaaggcaaucaugg

SEQ ID NO: 1485603 - RNA, 18 nt, Human
aggcgugagccaccucgc

SEQ ID NO: 1485604 - RNA, 17 nt, Human
aggcgugagccaccucg

SEQ ID NO: 1485605 - RNA, 18 nt, Human
aggcgugagccaccaugc

SEQ ID NO: 1485606 - RNA, 16 nt, Human
aggcccuuauuuucaa

SEQ ID NO: 1485607 - RNA, 20 nt, Human
aggcccuuauuuucaagaaa

SEQ ID NO: 1485608 - RNA, 22 nt, Human
aggcccuuauuuucaagaaacu

SEQ ID NO: 1485609 - RNA, 13 nt, Human
accccuccacucu

SEQ ID NO: 1485610 - RNA, 12 nt, Human
accccuccccuc

SEQ ID NO: 1485611 - RNA, 13 nt, Human
accccuccccucc

SEQ ID NO: 1485612 - RNA, 14 nt, Human
accccuccccucca

SEQ ID NO: 1485613 - RNA, 19 nt, Human
accccuccccuccaucccu

SEQ ID NO: 1485614 - RNA, 20 nt, Human
accccuccccuccaucccug

SEQ ID NO: 1485615 - RNA, 17 nt, Human
accccuccacucuuucu

SEQ ID NO: 1485616 - RNA, 13 nt, Human
acccccugugccu

SEQ ID NO: 1485617 - RNA, 14 nt, Human
acccagugcugaau

SEQ ID NO: 1485618 - RNA, 22 nt, Human
acccauuagcagucccuccaca

SEQ ID NO: 1485619 - RNA, 23 nt, Human
acccauuuaaauuuuuuuccuua

SEQ ID NO: 1485620 - RNA, 20 nt, Human
acccauuuaaauuuuuuucc

SEQ ID NO: 1485621 - RNA, 15 nt, Human
accaucgcuuuauug

SEQ ID NO: 1485622 - RNA, 19 nt, Human
accaucgucuucuuggcca

SEQ ID NO: 1485623 - RNA, 13 nt, Human
accagaucauugu

SEQ ID NO: 1485624 - RNA, 22 nt, Human
accagagugcugaaggaaugga

SEQ ID NO: 1485625 - RNA, 23 nt, Human
accaccucucaauauucaauaaa

SEQ ID NO: 1485626 - RNA, 15 nt, Human
accaccucucaauau

SEQ ID NO: 1485627 - RNA, 21 nt, Human
accaccgcgcccagccuuuuu

SEQ ID NO: 1485628 - RNA, 14 nt, Human
accagaugcagcuc

SEQ ID NO: 1485629 - RNA, 17 nt, Human
accaauaaagugacccu

SEQ ID NO: 1485630 - RNA, 12 nt, Human
accaauaaagug

SEQ ID NO: 1485631 - RNA, 11 nt, Human
accaauaaagu

SEQ ID NO: 1485632 - RNA, 23 nt, Human
accaauagggcugagcucucugu

SEQ ID NO: 1485633 - RNA, 17 nt, Human
accaauaaaauaauuuu

SEQ ID NO: 1485634 - RNA, 23 nt, Human
accaaguuucagguauuaagaaa

SEQ ID NO: 1485635 - RNA, 23 nt, Human
accaaguuggaacauccuuggaa

SEQ ID NO: 1485636 - RNA, 17 nt, Human
accaaggcuuucucuac

SEQ ID NO: 1485637 - RNA, 23 nt, Human
accaaggcuuucucuacugauuc

SEQ ID NO: 1485638 - RNA, 20 nt, Human
acauuuuaaaaaauggucac

SEQ ID NO: 1485639 - RNA, 16 nt, Human
acauuuuaaaagugcc

SEQ ID NO: 1485640 - RNA, 16 nt, Human
acauuuuaaacacauu

SEQ ID NO: 1485641 - RNA, 19 nt, Human
acauuuuaaaagugccauu

SEQ ID NO: 1485642 - RNA, 19 nt, Human
acauuuguucuauagcuuu

SEQ ID NO: 1485643 - RNA, 16 nt, Human
acauuuauuuugacau

SEQ ID NO: 1485644 - RNA, 17 nt, Human
acaggcacacaccacca

SEQ ID NO: 1485645 - RNA, 15 nt, Human
acagguaaaacaggg

SEQ ID NO: 1485646 - RNA, 14 nt, Human
acagguaaaacagg

SEQ ID NO: 1485647 - RNA, 16 nt, Human
acagguaaaacagggc

SEQ ID NO: 1485648 - RNA, 22 nt, Human
acauguuucuuuguaaugaaaa

SEQ ID NO: 1485649 - RNA, 19 nt, Human
acauguuucuuuguaauga

SEQ ID NO: 1485650 - RNA, 23 nt, Human
acauguuucuuuguaaugaaaac

SEQ ID NO: 1485651 - RNA, 12 nt, Human
acaucagcaaac

SEQ ID NO: 1485652 - RNA, 13 nt, Human
acaucagcaaaca

SEQ ID NO: 1485653 - RNA, 13 nt, Human
acaugauucauuu

SEQ ID NO: 1485654 - RNA, 19 nt, Human
acaugauuccagccaucac

SEQ ID NO: 1485655 - RNA, 20 nt, Human
acaugcauuacugcaugcac

SEQ ID NO: 1485656 - RNA, 16 nt, Human
acaugcauuacugcau

SEQ ID NO: 1485657 - RNA, 19 nt, Human
acagccaacuauggccugu

SEQ ID NO: 1485658 - RNA, 17 nt, Human
acagccaacuauggccu

SEQ ID NO: 1485659 - RNA, 19 nt, Human
acagagucuuccucugucu

SEQ ID NO: 1485660 - RNA, 14 nt, Human
acagagucuuccuc

SEQ ID NO: 1485661 - RNA, 22 nt, Human
acagaauuacuguaacugauua

SEQ ID NO: 1485662 - RNA, 18 nt, Human
acagaaugugauaaggaa

SEQ ID NO: 1485663 - RNA, 18 nt, Human
acagaauuuuauggugca

SEQ ID NO: 1485664 - RNA, 11 nt, Human
acacugccagc

SEQ ID NO: 1485665 - RNA, 21 nt, Human
acaggaugaugacuauggaaa

SEQ ID NO: 1485666 - RNA, 13 nt, Human
acaggauccaggc

SEQ ID NO: 1485667 - RNA, 12 nt, Human
acaggauccagg

SEQ ID NO: 1485668 - RNA, 19 nt, Human
acaggaucaguuaacuauu

SEQ ID NO: 1485669 - RNA, 18 nt, Human
acaggauccaggccggcu

SEQ ID NO: 1485670 - RNA, 22 nt, Human
acaggaugguucccuugaugaa

SEQ ID NO: 1485671 - RNA, 19 nt, Human
acaggcaaaauccuugcuu

SEQ ID NO: 1485672 - RNA, 13 nt, Human
aauuuuguugcug

SEQ ID NO: 1485673 - RNA, 13 nt, Human
aauuuugugaagc

SEQ ID NO: 1485674 - RNA, 15 nt, Human
aauuuuguaacgaag

SEQ ID NO: 1485675 - RNA, 22 nt, Human
aauuuucuggaauacaugaaau

SEQ ID NO: 1485676 - RNA, 22 nt, Human
acaacggagucaaaaauuaaac

SEQ ID NO: 1485677 - RNA, 20 nt, Human
acaacggagucaaaaauuaa

SEQ ID NO: 1485678 - RNA, 14 nt, Human
acaacggagucaaa

SEQ ID NO: 1485679 - RNA, 22 nt, Human
acaacuaagugauuuguauguc

SEQ ID NO: 1485680 - RNA, 10 nt, Human
acaacuaagu

SEQ ID NO: 1485681 - RNA, 19 nt, Human
acaagaaaauaagagcuca

SEQ ID NO: 1485682 - RNA, 23 nt, Human
acaagaaaauaagagcucaggau

SEQ ID NO: 1485683 - RNA, 22 nt, Human
acaauugagguaaguuuuuuga

SEQ ID NO: 1485684 - RNA, 20 nt, Human
acaauugggagcugccaaga

SEQ ID NO: 1485685 - RNA, 13 nt, Human
acaauugggagcu

SEQ ID NO: 1485686 - RNA, 17 nt, Human
acaccaacauaaaaaug

SEQ ID NO: 1485687 - RNA, 18 nt, Human
acaccaacauaaaaauga

SEQ ID NO: 1485688 - RNA, 12 nt, Human
accugucugucu

SEQ ID NO: 1485689 - RNA, 11 nt, Human
accugucuguc

SEQ ID NO: 1485690 - RNA, 16 nt, Human
accugccgagagucca

SEQ ID NO: 1485691 - RNA, 23 nt, Human
accugccgagaguccaucagccu

SEQ ID NO: 1485692 - RNA, 21 nt, Human
accucuguauuugaaucagcc

SEQ ID NO: 1485693 - RNA, 11 nt, Human
accuuucuagu

SEQ ID NO: 1485694 - RNA, 15 nt, Human
accuuucuaguugaa

SEQ ID NO: 1485695 - RNA, 21 nt, Human
accuguugagcaucacagaau

SEQ ID NO: 1485696 - RNA, 17 nt, Human
accuguuaccuacuuug

SEQ ID NO: 1485697 - RNA, 18 nt, Human
accuguuaccuacuuuga

SEQ ID NO: 1485698 - RNA, 14 nt, Human
accuguugagcauc

SEQ ID NO: 1485699 - RNA, 19 nt, Human
accuguugagcaucacaga

SEQ ID NO: 1485700 - RNA, 20 nt, Human
accuguugagcaucacagaa

SEQ ID NO: 1485701 - RNA, 22 nt, Human
accuguugagcaucacagaaug

SEQ ID NO: 1485702 - RNA, 14 nt, Human
acggaacucaaaua

SEQ ID NO: 1485703 - RNA, 18 nt, Human
acgcuuuccugaauccaa

SEQ ID NO: 1485704 - RNA, 17 nt, Human
acgcuuuuugaaaaagc

SEQ ID NO: 1485705 - RNA, 12 nt, Human
acgccacagccc

SEQ ID NO: 1485706 - RNA, 22 nt, Human
acgccacagcccuuuugucucu

SEQ ID NO: 1485707 - RNA, 17 nt, Human
acgccacagcccuuuug

SEQ ID NO: 1485708 - RNA, 13 nt, Human
acuaagagagaau

SEQ ID NO: 1485709 - RNA, 15 nt, Human
acuaagagagaauga

SEQ ID NO: 1485710 - RNA, 20 nt, Human
acgugacacaaacacacaca

SEQ ID NO: 1485711 - RNA, 21 nt, Human
acgugacacaaacacacacaa

SEQ ID NO: 1485712 - RNA, 20 nt, Human
acuaguauuucuaugaaaua

SEQ ID NO: 1485713 - RNA, 14 nt, Human
acuagccaaaccag

SEQ ID NO: 1485714 - RNA, 18 nt, Human
acuagccaaaccaggacc

SEQ ID NO: 1485715 - RNA, 12 nt, Human
acuauuuaacug

SEQ ID NO: 1485716 - RNA, 13 nt, Human
acuauuuaacuga

SEQ ID NO: 1485717 - RNA, 14 nt, Human
acuauuuaacugac

SEQ ID NO: 1485718 - RNA, 15 nt, Human
acuauuuaacugacu

SEQ ID NO: 1485719 - RNA, 16 nt, Human
acuauuuaacugacua

SEQ ID NO: 1485720 - RNA, 17 nt, Human
acuauuuaacugacuau

SEQ ID NO: 1485721 - RNA, 14 nt, Human
acucaguaauuugu

SEQ ID NO: 1485722 - RNA, 15 nt, Human
acucagguggcccua

SEQ ID NO: 1485723 - RNA, 15 nt, Human
acucauauuuucaug

SEQ ID NO: 1485724 - RNA, 18 nt, Human
acucauagacacugaucu

SEQ ID NO: 1485725 - RNA, 19 nt, Human
acuguaagaaaauaucacu

SEQ ID NO: 1485726 - RNA, 13 nt, Human
acuguaagaaaau

SEQ ID NO: 1485727 - RNA, 22 nt, Human
acuguaagaaaauaucacuugu

SEQ ID NO: 1485728 - RNA, 20 nt, Human
acugguuugaagaauguuaa

SEQ ID NO: 1485729 - RNA, 17 nt, Human
acugguuugaagaaugu

SEQ ID NO: 1485730 - RNA, 15 nt, Human
acugucucucaugaa

SEQ ID NO: 1485731 - RNA, 17 nt, Human
acugucucucaugaacc

SEQ ID NO: 1485732 - RNA, 18 nt, Human
acugucucucaugaaccu

SEQ ID NO: 1485733 - RNA, 18 nt, Human
acugguaggaaacuaggu

SEQ ID NO: 1485734 - RNA, 21 nt, Human
acugguccaaaagauugcuga

SEQ ID NO: 1485735 - RNA, 22 nt, Human
acugguccaaaagauugcugaa

SEQ ID NO: 1485736 - RNA, 12 nt, Human
acugccagcauu

SEQ ID NO: 1485737 - RNA, 18 nt, Human
acuuguaaaggaauuuaa

SEQ ID NO: 1485738 - RNA, 14 nt, Human
acuugguuuugcua

SEQ ID NO: 1485739 - RNA, 17 nt, Human
acuucugggcuucaucu

SEQ ID NO: 1485740 - RNA, 19 nt, Human
acuucugggcuucaucugg

SEQ ID NO: 1485741 - RNA, 22 nt, Human
acuucugggcuucaucuggcaa

SEQ ID NO: 1485742 - RNA, 23 nt, Human
acuguuuggaaauugauuuugaa

SEQ ID NO: 1485743 - RNA, 17 nt, Human
acuuauuuaugaaccug

SEQ ID NO: 1485744 - RNA, 14 nt, Human
acuuauuuuugaca

SEQ ID NO: 1485745 - RNA, 16 nt, Human
acuuauuuuugacagu

SEQ ID NO: 1485746 - RNA, 19 nt, Human
acuuauuuuugacaguguu

SEQ ID NO: 1485747 - RNA, 22 nt, Human
acuuauuuuugacaguguugaa

SEQ ID NO: 1485748 - RNA, 14 nt, Human
acuuuuggaaggua

SEQ ID NO: 1485749 - RNA, 22 nt, Human
acuuuugcuguaauguuaauau

SEQ ID NO: 1485750 - RNA, 17 nt, Human
agaaaauaaucauucuu

SEQ ID NO: 1485751 - RNA, 23 nt, Human
acuuuuaugauacuugaaaauua

SEQ ID NO: 1485752 - RNA, 20 nt, Human
acuuuucuucuauugccucu

SEQ ID NO: 1485753 - RNA, 16 nt, Human
acuuuuaugauacuug

SEQ ID NO: 1485754 - RNA, 12 nt, Human
acuuuuaugaua

SEQ ID NO: 1485755 - RNA, 13 nt, Human
acuuuuacaagua

SEQ ID NO: 1485756 - RNA, 14 nt, Human
acuuuuacaaguaa

SEQ ID NO: 1485757 - RNA, 21 nt, Human
acuuuuacaaguaacaaaaau

SEQ ID NO: 1485758 - RNA, 20 nt, Human
acuuuuaaacuguguacaua

SEQ ID NO: 1485759 - RNA, 18 nt, Human
acuuuuaaugaacaaaug

SEQ ID NO: 1485760 - RNA, 22 nt, Human
acuuuaucuugaauaauguaag

SEQ ID NO: 1485761 - RNA, 22 nt, Human
acuuuauuuucuauaauuuaaa

SEQ ID NO: 1485762 - RNA, 17 nt, Human
agaaauaaauuuauuuc

SEQ ID NO: 1485763 - RNA, 13 nt, Human
agaaauaaguuuu

SEQ ID NO: 1485764 - RNA, 14 nt, Human
agaaauaaguuuuu

SEQ ID NO: 1485765 - RNA, 16 nt, Human
agaaauaaguuuuugu

SEQ ID NO: 1485766 - RNA, 23 nt, Human
agaaauaaguuuuuguuucacag

SEQ ID NO: 1485767 - RNA, 12 nt, Human
agaaaguugauu

SEQ ID NO: 1485768 - RNA, 16 nt, Human
agaaagguuaguauca

SEQ ID NO: 1485769 - RNA, 22 nt, Human
agaaagucuuauuuauucauau

SEQ ID NO: 1485770 - RNA, 19 nt, Human
agaaagucuuauuuauuca

SEQ ID NO: 1485771 - RNA, 13 nt, Human
agaaaaucacuua

SEQ ID NO: 1485772 - RNA, 20 nt, Human
aauguuuuuuuuuaaagacu

SEQ ID NO: 1485773 - RNA, 15 nt, Human
aauguuuuuuuuuaa

SEQ ID NO: 1485774 - RNA, 22 nt, Human
aauguuuuuuuuuaaagacuuu

SEQ ID NO: 1485775 - RNA, 23 nt, Human
aauguuucaaacauauauaacaa

SEQ ID NO: 1485776 - RNA, 15 nt, Human
aauguuuaaaccuuu

SEQ ID NO: 1485777 - RNA, 14 nt, Human
aaugucauuuuggu

SEQ ID NO: 1485778 - RNA, 19 nt, Human
aaugucauuuugguacuuu

SEQ ID NO: 1485779 - RNA, 15 nt, Human
aaugccuuuucccaa

SEQ ID NO: 1485780 - RNA, 13 nt, Human
aauacucuuauau

SEQ ID NO: 1485781 - RNA, 13 nt, Human
aauacugcugaga

SEQ ID NO: 1485782 - RNA, 15 nt, Human
aauacugcugagaua

SEQ ID NO: 1485783 - RNA, 18 nt, Human
aauacugcugagauacau

SEQ ID NO: 1485784 - RNA, 21 nt, Human
aauacugcugagauacauaca

SEQ ID NO: 1485785 - RNA, 18 nt, Human
aaucaccacaaacuguaa

SEQ ID NO: 1485786 - RNA, 21 nt, Human
aaucaagucuguuuacugcaa

SEQ ID NO: 1485787 - RNA, 14 nt, Human
aaucaagggucagg

SEQ ID NO: 1485788 - RNA, 15 nt, Human
aaucaagggucaggc

SEQ ID NO: 1485789 - RNA, 18 nt, Human
aaucaagggucaggccuu

SEQ ID NO: 1485790 - RNA, 15 nt, Human
aaucaagucuguuua

SEQ ID NO: 1485791 - RNA, 17 nt, Human
aaucaagucuguuuacu

SEQ ID NO: 1485792 - RNA, 13 nt, Human
aauauuagaaaca

SEQ ID NO: 1485793 - RNA, 13 nt, Human
aauauauauuauc

SEQ ID NO: 1485794 - RNA, 15 nt, Human
aauauauauuaucuu

SEQ ID NO: 1485795 - RNA, 16 nt, Human
aauauauauuaucuuu

SEQ ID NO: 1485796 - RNA, 19 nt, Human
aauauauauuaucuuuuca

SEQ ID NO: 1485797 - RNA, 18 nt, Human
aauauauauuaucuuuuc

SEQ ID NO: 1485798 - RNA, 18 nt, Human
aauccaagcaaaugugaa

SEQ ID NO: 1485799 - RNA, 17 nt, Human
aauccaagcaaauguga

SEQ ID NO: 1485800 - RNA, 21 nt, Human
aaugauuaugaauuacauuug

SEQ ID NO: 1485801 - RNA, 23 nt, Human
aaugauuaugaauuacauuugua

SEQ ID NO: 1485802 - RNA, 15 nt, Human
aaugauuaugaauua

SEQ ID NO: 1485803 - RNA, 19 nt, Human
aaugauccuguauucagac

SEQ ID NO: 1485804 - RNA, 21 nt, Human
aaugauccuguauucagacag

SEQ ID NO: 1485805 - RNA, 23 nt, Human
aaugauccuguauucagacagau

SEQ ID NO: 1485806 - RNA, 21 nt, Human
aaugaaauccugcuucagugu

SEQ ID NO: 1485807 - RNA, 17 nt, Human
aaugaaguuguagguaa

SEQ ID NO: 1485808 - RNA, 13 nt, Human
aauccagccugcu

SEQ ID NO: 1485809 - RNA, 15 nt, Human
aauccaaugaaauga

SEQ ID NO: 1485810 - RNA, 12 nt, Human
aaucucuguaaa

SEQ ID NO: 1485811 - RNA, 13 nt, Human
aaucucuguaaag

SEQ ID NO: 1485812 - RNA, 20 nt, Human
aaggugaggagcuugaaacc

SEQ ID NO: 1485813 - RNA, 14 nt, Human
aaggucggaccagc

SEQ ID NO: 1485814 - RNA, 18 nt, Human
aaguccaagcauuuagau

SEQ ID NO: 1485815 - RNA, 14 nt, Human
aagucuccaaaguc

SEQ ID NO: 1485816 - RNA, 14 nt, Human
aagucgguuagugg

SEQ ID NO: 1485817 - RNA, 12 nt, Human
aagggccaaaga

SEQ ID NO: 1485818 - RNA, 20 nt, Human
aagggccaaagaaccaaaga

SEQ ID NO: 1485819 - RNA, 22 nt, Human
aagggccaaagaaccaaagaag

SEQ ID NO: 1485820 - RNA, 15 nt, Human
aagucuccaaagucu

SEQ ID NO: 1485821 - RNA, 22 nt, Human
aagucugugagauucauucaug

SEQ ID NO: 1485822 - RNA, 13 nt, Human
aagucuguuuacu

SEQ ID NO: 1485823 - RNA, 14 nt, Human
aagucuguuuacug

SEQ ID NO: 1485824 - RNA, 16 nt, Human
aagucuguuuacugca

SEQ ID NO: 1485825 - RNA, 23 nt, Human
aaguugacuuauaguacaugaua

SEQ ID NO: 1485826 - RNA, 21 nt, Human
aaguugacuuauaguacauga

SEQ ID NO: 1485827 - RNA, 20 nt, Human
aaguugacuuauaguacaug

SEQ ID NO: 1485828 - RNA, 19 nt, Human
aaguugacuuauaguacau

SEQ ID NO: 1485829 - RNA, 16 nt, Human
aaguugacuuauagua

SEQ ID NO: 1485830 - RNA, 14 nt, Human
aaguguaauugaga

SEQ ID NO: 1485831 - RNA, 12 nt, Human
aaguugaauuuu

SEQ ID NO: 1485832 - RNA, 13 nt, Human
aagugcuuucuuc

SEQ ID NO: 1485833 - RNA, 17 nt, Human
aaggacaucagcaaaca

SEQ ID NO: 1485834 - RNA, 15 nt, Human
aaggacaucagcaaa

SEQ ID NO: 1485835 - RNA, 14 nt, Human
aaggacaucagcaa

SEQ ID NO: 1485836 - RNA, 18 nt, Human
aagcuguguggcagucug

SEQ ID NO: 1485837 - RNA, 16 nt, Human
aagcugguuuaauguu

SEQ ID NO: 1485838 - RNA, 20 nt, Human
aaggcagcucuaaaugucaa

SEQ ID NO: 1485839 - RNA, 20 nt, Human
aagcuacagaagaaacuggg

SEQ ID NO: 1485840 - RNA, 20 nt, Human
aagcgccuccaacccuagca

SEQ ID NO: 1485841 - RNA, 16 nt, Human
aagcgccuccaacccu

SEQ ID NO: 1485842 - RNA, 22 nt, Human
aagcgcuagaggaagcagccaa

SEQ ID NO: 1485843 - RNA, 15 nt, Human
aagcgccuccaaccc

SEQ ID NO: 1485844 - RNA, 14 nt, Human
aagcgccuccaacc

SEQ ID NO: 1485845 - RNA, 14 nt, Human
aagauacugaaaua

SEQ ID NO: 1485846 - RNA, 20 nt, Human
aagauuacucaguaauuugu

SEQ ID NO: 1485847 - RNA, 13 nt, Human
aagauacugaaau

SEQ ID NO: 1485848 - RNA, 14 nt, Human
aaaucuggcuucug

SEQ ID NO: 1485849 - RNA, 18 nt, Human
aaaucuggcuucuggcca

SEQ ID NO: 1485850 - RNA, 21 nt, Human
aaaucuggcuucuggccagga

SEQ ID NO: 1485851 - RNA, 20 nt, Human
aaaucaaucuguaaaacuaa

SEQ ID NO: 1485852 - RNA, 19 nt, Human
aaaucaauuacugguccaa

SEQ ID NO: 1485853 - RNA, 23 nt, Human
aaaucaauuacugguccaaaaga

SEQ ID NO: 1485854 - RNA, 15 nt, Human
aaauauuuauuuuaa

SEQ ID NO: 1485855 - RNA, 13 nt, Human
aaauauuuauuuu

SEQ ID NO: 1485856 - RNA, 20 nt, Human
aaauauuuauuuuaauaaug

SEQ ID NO: 1485857 - RNA, 17 nt, Human
aaauagcuuuuuucucu

SEQ ID NO: 1485858 - RNA, 20 nt, Human
aaauagcuuuuuucucugau

SEQ ID NO: 1485859 - RNA, 12 nt, Human
aaaggcaaaggc

SEQ ID NO: 1485860 - RNA, 22 nt, Human
aaagccaaggagucacugagac

SEQ ID NO: 1485861 - RNA, 23 nt, Human
aaagccaaggagucacugagacc

SEQ ID NO: 1485862 - RNA, 13 nt, Human
aaaaguugaauuu

SEQ ID NO: 1485863 - RNA, 12 nt, Human
aaaauaaacaaa

SEQ ID NO: 1485864 - RNA, 14 nt, Human
aaaauaaacaaaua

SEQ ID NO: 1485865 - RNA, 18 nt, Human
aaaaguuacauguuugca

SEQ ID NO: 1485866 - RNA, 19 nt, Human
aaaaguuacauguuugcac

SEQ ID NO: 1485867 - RNA, 13 nt, Human
aaaauccuugcuu

SEQ ID NO: 1485868 - RNA, 20 nt, Human
aaaauccuugcuuaugacau

SEQ ID NO: 1485869 - RNA, 14 nt, Human
aaaauaaagaaaua

SEQ ID NO: 1485870 - RNA, 12 nt, Human
aaaauaaagaau

SEQ ID NO: 1485871 - RNA, 13 nt, Human
aaaauaaagaaug

SEQ ID NO: 1485872 - RNA, 21 nt, Human
aaaaucagguggcuuuugcgg

SEQ ID NO: 1485873 - RNA, 16 nt, Human
aaaaagaaacauuugg

SEQ ID NO: 1485874 - RNA, 20 nt, Human
aaaagugccauuaacaaaug

SEQ ID NO: 1485875 - RNA, 23 nt, Human
aaaaguggguuuuuuaguugaau

SEQ ID NO: 1485876 - RNA, 21 nt, Human
aaacacugggagaaaugaaaa

SEQ ID NO: 1485877 - RNA, 22 nt, Human
aaacacugggagaaaugaaaaa

SEQ ID NO: 1485878 - RNA, 21 nt, Human
aaaauugaugggauuugguca

SEQ ID NO: 1485879 - RNA, 16 nt, Human
aaaaucucaauauuuc

SEQ ID NO: 1485880 - RNA, 17 nt, Human
aaaaucucaauauuuca

SEQ ID NO: 1485881 - RNA, 12 nt, Human
aaacagacacug

SEQ ID NO: 1485882 - RNA, 13 nt, Human
aaacagaaacaaa

SEQ ID NO: 1485883 - RNA, 19 nt, Human
aaacagaaacaaaaacacu

SEQ ID NO: 1485884 - RNA, 21 nt, Human
aaacagaaacaaaaacacuaa

SEQ ID NO: 1485885 - RNA, 17 nt, Human
aaagaaauauaccuaaa

SEQ ID NO: 1485886 - RNA, 14 nt, Human
aaacugaggaauuu

SEQ ID NO: 1485887 - RNA, 19 nt, Human
aaacugaggaauuucaccu

SEQ ID NO: 1485888 - RNA, 18 nt, Human
aaacugaggaauuuucuu

SEQ ID NO: 1485889 - RNA, 19 nt, Human
aaacugaggaauuuucuuu

SEQ ID NO: 1485890 - RNA, 15 nt, Human
aaagaaguaaaagca

SEQ ID NO: 1485891 - RNA, 14 nt, Human
aaagaguucaagaa

SEQ ID NO: 1485892 - RNA, 20 nt, Human
aaagaguucaagaaauaagu

SEQ ID NO: 1485893 - RNA, 16 nt, Human
aaagaguucaagaaau

SEQ ID NO: 1485894 - RNA, 23 nt, Human
aaaccaugaagagauuuuucaug

SEQ ID NO: 1485895 - RNA, 15 nt, Human
aaaccaugcaaaugc

SEQ ID NO: 1485896 - RNA, 19 nt, Human
aacagcagacucagcucug

SEQ ID NO: 1485897 - RNA, 20 nt, Human
aacagcagacucagcucuga

SEQ ID NO: 1485898 - RNA, 17 nt, Human
aaccuagggugauauua

SEQ ID NO: 1485899 - RNA, 14 nt, Human
aacccuagcaaaag

SEQ ID NO: 1485900 - RNA, 23 nt, Human
aacccuaaauaauaaaaauaaac

SEQ ID NO: 1485901 - RNA, 12 nt, Human
aaccagaucauu

SEQ ID NO: 1485902 - RNA, 21 nt, Human
aaccgaacugauguaaguaaa

SEQ ID NO: 1485903 - RNA, 15 nt, Human
aacaucccuccuggg

SEQ ID NO: 1485904 - RNA, 16 nt, Human
aacagcuucucaauuu

SEQ ID NO: 1485905 - RNA, 15 nt, Human
aaccagagugcugaa

SEQ ID NO: 1485906 - RNA, 17 nt, Human
aaccacuuuuugcagcu

SEQ ID NO: 1485907 - RNA, 15 nt, Human
aaccacuuuuugcag

SEQ ID NO: 1485908 - RNA, 14 nt, Human
aaccacuuuuugca

SEQ ID NO: 1485909 - RNA, 21 nt, Human
aacacguaucccaccugacau

SEQ ID NO: 1485910 - RNA, 14 nt, Human
aacacuaaaaauaa

SEQ ID NO: 1485911 - RNA, 15 nt, Human
aacacuaaaaauaaa

SEQ ID NO: 1485912 - RNA, 18 nt, Human
aaauuuuuuuuacauuuu

SEQ ID NO: 1485913 - RNA, 17 nt, Human
aaauuuuuuuuacauuu

SEQ ID NO: 1485914 - RNA, 16 nt, Human
aaauuuuuuuuacauu

SEQ ID NO: 1485915 - RNA, 19 nt, Human
aacaaaaacacuaaaaaua

SEQ ID NO: 1485916 - RNA, 14 nt, Human
aacaaccucaacug

SEQ ID NO: 1485917 - RNA, 18 nt, Human
aacaaccucaacugccua

SEQ ID NO: 1485918 - RNA, 20 nt, Human
aacaccauagguagaaugua

SEQ ID NO: 1485919 - RNA, 15 nt, Human
aacaccauugaaggc

SEQ ID NO: 1485920 - RNA, 17 nt, Human
aacaccauugaaggcuu

SEQ ID NO: 1485921 - RNA, 19 nt, Human
aacaccauugaaggcuuaa

SEQ ID NO: 1485922 - RNA, 15 nt, Human
aaaugccuuuguacu

SEQ ID NO: 1485923 - RNA, 16 nt, Human
aaaugccuuuucccaa

SEQ ID NO: 1485924 - RNA, 21 nt, Human
aaaugccuuuucccaaaaugu

SEQ ID NO: 1485925 - RNA, 17 nt, Human
aaaucuuauaauuuaaa

SEQ ID NO: 1485926 - RNA, 17 nt, Human
aaauguuggucauuuua

SEQ ID NO: 1485927 - RNA, 19 nt, Human
aaauguuggucauuuuaug

SEQ ID NO: 1485928 - RNA, 15 nt, Human
aaauuuuuuuuacau

SEQ ID NO: 1485929 - RNA, 14 nt, Human
aaauugaaugcaaa

SEQ ID NO: 1485930 - RNA, 15 nt, Human
aaauugaaugcaaac

SEQ ID NO: 1485931 - RNA, 13 nt, Human
aaauugaaugcaa

SEQ ID NO: 1485932 - RNA, 19 nt, Human
aaauuaaaccggaccaucu

SEQ ID NO: 1485933 - RNA, 13 nt, Human
aaauuaaagcauu

SEQ ID NO: 1485934 - RNA, 13 nt, Human
aaauucuuucauu

SEQ ID NO: 1485935 - RNA, 21 nt, Human
aacuauugcauuuauauguac

SEQ ID NO: 1485936 - RNA, 15 nt, Human
aacuauugcauuuau

SEQ ID NO: 1485937 - RNA, 16 nt, Human
aacuauugcauuuaua

SEQ ID NO: 1485938 - RNA, 12 nt, Human
aacuauuuucag

SEQ ID NO: 1485939 - RNA, 13 nt, Human
aacuauuuucaga

SEQ ID NO: 1485940 - RNA, 14 nt, Human
aacuauuuucagau

SEQ ID NO: 1485941 - RNA, 20 nt, Human
aacuauuuucagaugugaac

SEQ ID NO: 1485942 - RNA, 16 nt, Human
aacuauuuucagaugu

SEQ ID NO: 1485943 - RNA, 15 nt, Human
aacucaaaauauuug

SEQ ID NO: 1485944 - RNA, 12 nt, Human
aacggagucaaa

SEQ ID NO: 1485945 - RNA, 14 nt, Human
aacggaagaagaga

SEQ ID NO: 1485946 - RNA, 15 nt, Human
aacugacucuuaaga

SEQ ID NO: 1485947 - RNA, 18 nt, Human
aacugacucuuaagaaga

SEQ ID NO: 1485948 - RNA, 19 nt, Human
aacugacucuuaagaagac

SEQ ID NO: 1485949 - RNA, 20 nt, Human
aacugacucuuaagaagacu

SEQ ID NO: 1485950 - RNA, 20 nt, Human
aacugacuauucuugaugua

SEQ ID NO: 1485951 - RNA, 22 nt, Human
aacugacuauucuugauguaaa

SEQ ID NO: 1485952 - RNA, 23 nt, Human
aacugacuauucuugauguaaaa

SEQ ID NO: 1485953 - RNA, 19 nt, Human
aacuuaaauuuuaguucuu

SEQ ID NO: 1485954 - RNA, 18 nt, Human
aacugaggaauuuucuuu

SEQ ID NO: 1485955 - RNA, 20 nt, Human
aacugaggaauuuucuuugu

SEQ ID NO: 1485956 - RNA, 23 nt, Human
caccccuaaaagaaacccugcac

SEQ ID NO: 1485957 - RNA, 12 nt, Human
cacccccagcuu

SEQ ID NO: 1485958 - RNA, 14 nt, Human
caccccccaagcug

SEQ ID NO: 1485959 - RNA, 15 nt, Human
caccccccaagcugu

SEQ ID NO: 1485960 - RNA, 16 nt, Human
caccccgacuuuuguu

SEQ ID NO: 1485961 - RNA, 22 nt, Human
cacccaccaguugaauuucauc

SEQ ID NO: 1485962 - RNA, 16 nt, Human
cacccaauucaaaaca

SEQ ID NO: 1485963 - RNA, 17 nt, Human
cacccaauucaaaacau

SEQ ID NO: 1485964 - RNA, 15 nt, Human
caaaaaacuacuucu

SEQ ID NO: 1485965 - RNA, 11 nt, Human
caaaaaacuac

SEQ ID NO: 1485966 - RNA, 12 nt, Human
caaaaaagaaaa

SEQ ID NO: 1485967 - RNA, 14 nt, Human
caaaaaagaaaacc

SEQ ID NO: 1485968 - RNA, 13 nt, Human
caaagagguauuu

SEQ ID NO: 1485969 - RNA, 16 nt, Human
caaagcuuuuuccaga

SEQ ID NO: 1485970 - RNA, 12 nt, Human
caaauauauuca

SEQ ID NO: 1485971 - RNA, 20 nt, Human
caaauaauuuuucacuucaa

SEQ ID NO: 1485972 - RNA, 13 nt, Human
caaaguuuaauaa

SEQ ID NO: 1485973 - RNA, 20 nt, Human
caaaguuuaauaaauuuauu

SEQ ID NO: 1485974 - RNA, 19 nt, Human
caaaguuuaccagaaagca

SEQ ID NO: 1485975 - RNA, 14 nt, Human
caaaucacugaacu

SEQ ID NO: 1485976 - RNA, 19 nt, Human
caaaucaccacaaacugua

SEQ ID NO: 1485977 - RNA, 20 nt, Human
caaaucaccacaaacuguaa

SEQ ID NO: 1485978 - RNA, 15 nt, Human
caaaucaccacaaac

SEQ ID NO: 1485979 - RNA, 15 nt, Human
caaaucacugaacuu

SEQ ID NO: 1485980 - RNA, 14 nt, Human
caaaucaccacaaa

SEQ ID NO: 1485981 - RNA, 12 nt, Human
caacuuuguaua

SEQ ID NO: 1485982 - RNA, 11 nt, Human
caacuuuguau

SEQ ID NO: 1485983 - RNA, 14 nt, Human
caacuucaguccaa

SEQ ID NO: 1485984 - RNA, 11 nt, Human
caacuuauuaa

SEQ ID NO: 1485985 - RNA, 14 nt, Human
caacuuacuacuga

SEQ ID NO: 1485986 - RNA, 15 nt, Human
caacugcuaaucuac

SEQ ID NO: 1485987 - RNA, 18 nt, Human
caacugccuacuccaaaa

SEQ ID NO: 1485988 - RNA, 22 nt, Human
caacugccuacuccaaaauguu

SEQ ID NO: 1485989 - RNA, 21 nt, Human
caacucugaaggguaauuaua

SEQ ID NO: 1485990 - RNA, 13 nt, Human
caacucucuuauu

SEQ ID NO: 1485991 - RNA, 16 nt, Human
caacucucuuauugcc

SEQ ID NO: 1485992 - RNA, 21 nt, Human
caacucucuuauugccucacu

SEQ ID NO: 1485993 - RNA, 22 nt, Human
caacucucuuauugccucacuu

SEQ ID NO: 1485994 - RNA, 14 nt, Human
caacugccuacucc

SEQ ID NO: 1485995 - RNA, 15 nt, Human
caacugccuacucca

SEQ ID NO: 1485996 - RNA, 18 nt, Human
caaauucugucucuggau

SEQ ID NO: 1485997 - RNA, 15 nt, Human
caaauucugucucug

SEQ ID NO: 1485998 - RNA, 23 nt, Human
caacagguaaaacagggccacau

SEQ ID NO: 1485999 - RNA, 16 nt, Human
caacagugaagacaga

SEQ ID NO: 1486000 - RNA, 22 nt, Human
caacauuucuauagccaaaaau

SEQ ID NO: 1486001 - RNA, 14 nt, Human
caaccaauggaaug

SEQ ID NO: 1486002 - RNA, 14 nt, Human
caaccacacccaca

SEQ ID NO: 1486003 - RNA, 15 nt, Human
caacaugcacugaug

SEQ ID NO: 1486004 - RNA, 15 nt, Human
caacauguuauuugu

SEQ ID NO: 1486005 - RNA, 22 nt, Human
caacauguuauuuguaauagau

SEQ ID NO: 1486006 - RNA, 23 nt, Human
caacauguuauuuguaauagaug

SEQ ID NO: 1486007 - RNA, 17 nt, Human
caacagguaaaacaggg

SEQ ID NO: 1486008 - RNA, 22 nt, Human
caagugcagggccuguaauccc

SEQ ID NO: 1486009 - RNA, 14 nt, Human
caagucuguuuacu

SEQ ID NO: 1486010 - RNA, 20 nt, Human
caagucuguuuacugcaagg

SEQ ID NO: 1486011 - RNA, 14 nt, Human
caaggucugcuuuu

SEQ ID NO: 1486012 - RNA, 14 nt, Human
caaggucuuugguu

SEQ ID NO: 1486013 - RNA, 13 nt, Human
caaggucuuuaaa

SEQ ID NO: 1486014 - RNA, 18 nt, Human
caaguccugccucuuaaa

SEQ ID NO: 1486015 - RNA, 17 nt, Human
caagcacuaaacaaaga

SEQ ID NO: 1486016 - RNA, 14 nt, Human
caagcacuucuuuu

SEQ ID NO: 1486017 - RNA, 19 nt, Human
caagaaacugaggaauuuu

SEQ ID NO: 1486018 - RNA, 20 nt, Human
caagaaaauaagagcucagg

SEQ ID NO: 1486019 - RNA, 18 nt, Human
caagaaaauaagagcuca

SEQ ID NO: 1486020 - RNA, 18 nt, Human
caagaaacugaggaauuu

SEQ ID NO: 1486021 - RNA, 17 nt, Human
caaggagucacugagac

SEQ ID NO: 1486022 - RNA, 18 nt, Human
caaggagucacugagacc

SEQ ID NO: 1486023 - RNA, 16 nt, Human
caaggagucacugaga

SEQ ID NO: 1486024 - RNA, 17 nt, Human
caaggauagaaguauac

SEQ ID NO: 1486025 - RNA, 16 nt, Human
cacauuccugaacagg

SEQ ID NO: 1486026 - RNA, 23 nt, Human
cacauucagggcuauuuuuuccc

SEQ ID NO: 1486027 - RNA, 21 nt, Human
cacauuagaagacaauugaca

SEQ ID NO: 1486028 - RNA, 21 nt, Human
cacauuaggaaaaguugcuau

SEQ ID NO: 1486029 - RNA, 12 nt, Human
cacauguguggu

SEQ ID NO: 1486030 - RNA, 12 nt, Human
cacauguccagu

SEQ ID NO: 1486031 - RNA, 18 nt, Human
cacaugggugaacacuca

SEQ ID NO: 1486032 - RNA, 17 nt, Human
cacauguaucuaugcau

SEQ ID NO: 1486033 - RNA, 20 nt, Human
cacaugcuucccuuuccuga

SEQ ID NO: 1486034 - RNA, 23 nt, Human
cacauggccccucccccugccag

SEQ ID NO: 1486035 - RNA, 18 nt, Human
cacauauccaggcaccag

SEQ ID NO: 1486036 - RNA, 18 nt, Human
cacauuggagauguuuag

SEQ ID NO: 1486037 - RNA, 17 nt, Human
cacauuggaaacaaguc

SEQ ID NO: 1486038 - RNA, 13 nt, Human
caccaagccuuga

SEQ ID NO: 1486039 - RNA, 20 nt, Human
cacaggaaccacaagacugc

SEQ ID NO: 1486040 - RNA, 19 nt, Human
cacauauccaggcaccagg

SEQ ID NO: 1486041 - RNA, 15 nt, Human
cacauauccaggcac

SEQ ID NO: 1486042 - RNA, 19 nt, Human
cacagcaccagaauguaua

SEQ ID NO: 1486043 - RNA, 16 nt, Human
cacagcaccagaaugu

SEQ ID NO: 1486044 - RNA, 19 nt, Human
cacacugggacuugcaaaa

SEQ ID NO: 1486045 - RNA, 16 nt, Human
cacacuuacuuuuucu

SEQ ID NO: 1486046 - RNA, 14 nt, Human
cacacuuacuuuuu

SEQ ID NO: 1486047 - RNA, 19 nt, Human
cacacucagauccuccuca

SEQ ID NO: 1486048 - RNA, 20 nt, Human
cacacucagauccuccucau

SEQ ID NO: 1486049 - RNA, 13 nt, Human
cacaacuauauug

SEQ ID NO: 1486050 - RNA, 18 nt, Human
cacacacaugcuucccuu

SEQ ID NO: 1486051 - RNA, 21 nt, Human
cacaccaggcuugccugcagg

SEQ ID NO: 1486052 - RNA, 22 nt, Human
cacaccaggcuugccugcaggc

SEQ ID NO: 1486053 - RNA, 20 nt, Human
caaugaucaccgacugaaaa

SEQ ID NO: 1486054 - RNA, 19 nt, Human
caaugauccuguauucaga

SEQ ID NO: 1486055 - RNA, 13 nt, Human
caaugauggcaau

SEQ ID NO: 1486056 - RNA, 16 nt, Human
caaugauggcaauuuu

SEQ ID NO: 1486057 - RNA, 21 nt, Human
caaugauggcaauuuuguaac

SEQ ID NO: 1486058 - RNA, 16 nt, Human
caaugcagugccuuuc

SEQ ID NO: 1486059 - RNA, 22 nt, Human
caauccucccacuucagccucc

SEQ ID NO: 1486060 - RNA, 18 nt, Human
caauccucccacuucagc

SEQ ID NO: 1486061 - RNA, 21 nt, Human
caaugaaaugaauuaaagugg

SEQ ID NO: 1486062 - RNA, 23 nt, Human
caaugaaaugaauuaaaguggac

SEQ ID NO: 1486063 - RNA, 19 nt, Human
caaugaaaugaauuaaagu

SEQ ID NO: 1486064 - RNA, 17 nt, Human
caauagucaaauugugu

SEQ ID NO: 1486065 - RNA, 21 nt, Human
cacaaauucugucucuggauu

SEQ ID NO: 1486066 - RNA, 15 nt, Human
cacaaauuaucuuaa

SEQ ID NO: 1486067 - RNA, 23 nt, Human
cacaacagccugacaacauuucu

SEQ ID NO: 1486068 - RNA, 19 nt, Human
caauuuucuggaauacaug

SEQ ID NO: 1486069 - RNA, 17 nt, Human
cacaaacuguaauacaa

SEQ ID NO: 1486070 - RNA, 13 nt, Human
caauucaaagcug

SEQ ID NO: 1486071 - RNA, 18 nt, Human
caauucauccucacucag

SEQ ID NO: 1486072 - RNA, 14 nt, Human
caauuaaaggcaaa

SEQ ID NO: 1486073 - RNA, 18 nt, Human
uuggacaaaauggaauac

SEQ ID NO: 1486074 - RNA, 15 nt, Human
uuggaauauaauugu

SEQ ID NO: 1486075 - RNA, 24 nt, Human
uuggaagacuaucuuacuauuuca

SEQ ID NO: 1486076 - RNA, 16 nt, Human
uugcuaagcauuccaa

SEQ ID NO: 1486077 - RNA, 18 nt, Human
uugcuaagcauuccaacu

SEQ ID NO: 1486078 - RNA, 21 nt, Human
uugcuggaagacgcaagggcc

SEQ ID NO: 1486079 - RNA, 21 nt, Human
uugcuggaauaaguucaaauu

SEQ ID NO: 1486080 - RNA, 23 nt, Human
uugcuggacugucauagaaauua

SEQ ID NO: 1486081 - RNA, 13 nt, Human
uugccuuaaaaua

SEQ ID NO: 1486082 - RNA, 14 nt, Human
uugccuguaacaag

SEQ ID NO: 1486083 - RNA, 19 nt, Human
uugccuguaacaagccaga

SEQ ID NO: 1486084 - RNA, 22 nt, Human
uugccuuccagaaaacaaaacu

SEQ ID NO: 1486085 - RNA, 18 nt, Human
uuguacuuuagggaagua

SEQ ID NO: 1486086 - RNA, 17 nt, Human
uuguagaagucacauuc

SEQ ID NO: 1486087 - RNA, 22 nt, Human
uuguagaagucacauuccugaa

SEQ ID NO: 1486088 - RNA, 15 nt, Human
uuguagcauccugga

SEQ ID NO: 1486089 - RNA, 15 nt, Human
uuguaccaacuuuua

SEQ ID NO: 1486090 - RNA, 16 nt, Human
uuguaaacucaaaaua

SEQ ID NO: 1486091 - RNA, 22 nt, Human
uuguaaacucaaaauauuugua

SEQ ID NO: 1486092 - RNA, 18 nt, Human
uugucuauuaccuguuag

SEQ ID NO: 1486093 - RNA, 20 nt, Human
uugucucugcaaacugccuu

SEQ ID NO: 1486094 - RNA, 22 nt, Human
uugucucugcaaacugccuucu

SEQ ID NO: 1486095 - RNA, 12 nt, Human
uugucuuaauau

SEQ ID NO: 1486096 - RNA, 17 nt, Human
uugucuuaauauugugg

SEQ ID NO: 1486097 - RNA, 14 nt, Human
uuggcagucugaau

SEQ ID NO: 1486098 - RNA, 13 nt, Human
uugggagagacuu

SEQ ID NO: 1486099 - RNA, 23 nt, Human
uugggagagacuuguuuuggaug

SEQ ID NO: 1486100 - RNA, 16 nt, Human
uugggagagggcgcag

SEQ ID NO: 1486101 - RNA, 18 nt, Human
uugggaauggauccugga

SEQ ID NO: 1486102 - RNA, 20 nt, Human
uugguaaggggaauugagga

SEQ ID NO: 1486103 - RNA, 15 nt, Human
uugggagagggcgca

SEQ ID NO: 1486104 - RNA, 17 nt, Human
uugggagcuugggaaug

SEQ ID NO: 1486105 - RNA, 19 nt, Human
uugggagcuugggaaugga

SEQ ID NO: 1486106 - RNA, 15 nt, Human
uugggauaucuccug

SEQ ID NO: 1486107 - RNA, 22 nt, Human
uuggucucccuucucuacacuc

SEQ ID NO: 1486108 - RNA, 21 nt, Human
uugaagagguuuuaaagcuuc

SEQ ID NO: 1486109 - RNA, 20 nt, Human
uugaagcacagugaucaagu

SEQ ID NO: 1486110 - RNA, 20 nt, Human
uugaagcaaaucgaaugaaa

SEQ ID NO: 1486111 - RNA, 16 nt, Human
uugaagagguuuuaaa

SEQ ID NO: 1486112 - RNA, 18 nt, Human
uugaaaauuaacaugaau

SEQ ID NO: 1486113 - RNA, 15 nt, Human
uugaaacagaaaaau

SEQ ID NO: 1486114 - RNA, 21 nt, Human
uugaaaaucuuauaauuuaaa

SEQ ID NO: 1486115 - RNA, 17 nt, Human
uucuggccuuguaagac

SEQ ID NO: 1486116 - RNA, 13 nt, Human
uucugugccugaa

SEQ ID NO: 1486117 - RNA, 15 nt, Human
uucugugccugaaua

SEQ ID NO: 1486118 - RNA, 16 nt, Human
uucugugccugaauau

SEQ ID NO: 1486119 - RNA, 17 nt, Human
uucugugccugaauauu

SEQ ID NO: 1486120 - RNA, 14 nt, Human
uucuggccaggaag

SEQ ID NO: 1486121 - RNA, 15 nt, Human
uucuggccaggaagc

SEQ ID NO: 1486122 - RNA, 19 nt, Human
uucuuaggguuaugauuaa

SEQ ID NO: 1486123 - RNA, 18 nt, Human
uucuuaugccauauaauu

SEQ ID NO: 1486124 - RNA, 14 nt, Human
uucuuuaacuuaau

SEQ ID NO: 1486125 - RNA, 20 nt, Human
uugauaugccuuuucccaac

SEQ ID NO: 1486126 - RNA, 16 nt, Human
uugauaugugaacagu

SEQ ID NO: 1486127 - RNA, 15 nt, Human
uugauaugacuguuu

SEQ ID NO: 1486128 - RNA, 15 nt, Human
uugauauuucuagcu

SEQ ID NO: 1486129 - RNA, 17 nt, Human
uugauccagaaagaaaa

SEQ ID NO: 1486130 - RNA, 13 nt, Human
uugaauuaucuug

SEQ ID NO: 1486131 - RNA, 18 nt, Human
uugaauuaucuugguuga

SEQ ID NO: 1486132 - RNA, 20 nt, Human
uugaauuaucuugguugaaa

SEQ ID NO: 1486133 - RNA, 22 nt, Human
uugaauuaucuugguugaaaau

SEQ ID NO: 1486134 - RNA, 16 nt, Human
uugcauaacguauaaa

SEQ ID NO: 1486135 - RNA, 13 nt, Human
uugcauaagagcu

SEQ ID NO: 1486136 - RNA, 23 nt, Human
uugccaggcuggagugcaguggc

SEQ ID NO: 1486137 - RNA, 19 nt, Human
uugccaggcuggagugcag

SEQ ID NO: 1486138 - RNA, 22 nt, Human
uugcagcccugcugcugccugc

SEQ ID NO: 1486139 - RNA, 15 nt, Human
uuguuauuaaacaaa

SEQ ID NO: 1486140 - RNA, 13 nt, Human
uuguuuuacaaua

SEQ ID NO: 1486141 - RNA, 12 nt, Human
uuguuuuacaau

SEQ ID NO: 1486142 - RNA, 15 nt, Human
uuuaaaacagacacu

SEQ ID NO: 1486143 - RNA, 12 nt, Human
uuguuucuuaaa

SEQ ID NO: 1486144 - RNA, 14 nt, Human
uuguuucuuaaaua

SEQ ID NO: 1486145 - RNA, 23 nt, Human
uuguuucuuaaauaagaaacuuu

SEQ ID NO: 1486146 - RNA, 15 nt, Human
uuguuucuuaaauaa

SEQ ID NO: 1486147 - RNA, 16 nt, Human
uuuaaaaugagaaauc

SEQ ID NO: 1486148 - RNA, 17 nt, Human
uuuaaaauguaaagcca

SEQ ID NO: 1486149 - RNA, 18 nt, Human
uuuaaaauguaaagccau

SEQ ID NO: 1486150 - RNA, 20 nt, Human
uuuaaaauguaaagccaugc

SEQ ID NO: 1486151 - RNA, 12 nt, Human
uuuaaaaugucu

SEQ ID NO: 1486152 - RNA, 16 nt, Human
uuuaaaauuacaacua

SEQ ID NO: 1486153 - RNA, 17 nt, Human
uuuaaaauuuauauugu

SEQ ID NO: 1486154 - RNA, 20 nt, Human
uuuaaaauuuauauuguaaa

SEQ ID NO: 1486155 - RNA, 14 nt, Human
uuuaaacuguguac

SEQ ID NO: 1486156 - RNA, 18 nt, Human
uuuaaaccuauacucacu

SEQ ID NO: 1486157 - RNA, 11 nt, Human
uuuaaaccuuu

SEQ ID NO: 1486158 - RNA, 15 nt, Human
uuuaaacuauaagca

SEQ ID NO: 1486159 - RNA, 15 nt, Human
uuuaaacaaguauuu

SEQ ID NO: 1486160 - RNA, 17 nt, Human
uuuaaaccgcuaaaaga

SEQ ID NO: 1486161 - RNA, 20 nt, Human
uuuaaaccgcuaaaagaaac

SEQ ID NO: 1486162 - RNA, 21 nt, Human
uuuaaaccgcuaaaagaaacu

SEQ ID NO: 1486163 - RNA, 22 nt, Human
uuuaaaccgcuaaaagaaacuu

SEQ ID NO: 1486164 - RNA, 23 nt, Human
uuuaaaccgcuaaaagaaacuuu

SEQ ID NO: 1486165 - RNA, 17 nt, Human
uuuaaaaggaaagaaaa

SEQ ID NO: 1486166 - RNA, 23 nt, Human
uuuaaaagugccauuaacaaaug

SEQ ID NO: 1486167 - RNA, 12 nt, Human
uuuaaaauagca

SEQ ID NO: 1486168 - RNA, 14 nt, Human
uuuaaaagaaugau

SEQ ID NO: 1486169 - RNA, 14 nt, Human
uuuaaaacccauuu

SEQ ID NO: 1486170 - RNA, 21 nt, Human
uuuaaaacccauuuaaauuuu

SEQ ID NO: 1486171 - RNA, 17 nt, Human
uuuaaaagaaugauuau

SEQ ID NO: 1486172 - RNA, 17 nt, Human
uuuaaaagaugcuuuua

SEQ ID NO: 1486173 - RNA, 13 nt, Human
uuuaaaagaugcu

SEQ ID NO: 1486174 - RNA, 16 nt, Human
uuuacauggcuggagc

SEQ ID NO: 1486175 - RNA, 13 nt, Human
uuuaccagaaagc

SEQ ID NO: 1486176 - RNA, 22 nt, Human
uuuaauaaacacucuugaaaaa

SEQ ID NO: 1486177 - RNA, 15 nt, Human
uuuaauaauguuuca

SEQ ID NO: 1486178 - RNA, 16 nt, Human
uuuaaccuaugauauu

SEQ ID NO: 1486179 - RNA, 19 nt, Human
uuuaauaauguuucaaaca

SEQ ID NO: 1486180 - RNA, 15 nt, Human
uuuaauaaacacucu

SEQ ID NO: 1486181 - RNA, 14 nt, Human
uuuaauaaacacuc

SEQ ID NO: 1486182 - RNA, 14 nt, Human
uuuaaccucuaaau

SEQ ID NO: 1486183 - RNA, 13 nt, Human
uuuaacauuccuc

SEQ ID NO: 1486184 - RNA, 12 nt, Human
uuuaacauuccu

SEQ ID NO: 1486185 - RNA, 23 nt, Human
uuuaacauuccucaugaauguaa

SEQ ID NO: 1486186 - RNA, 22 nt, Human
uuuaacauuccucaugaaugua

SEQ ID NO: 1486187 - RNA, 18 nt, Human
uuuaguugcaacuuugua

SEQ ID NO: 1486188 - RNA, 17 nt, Human
uuuaguugcaacuuugu

SEQ ID NO: 1486189 - RNA, 11 nt, Human
uuuaguugaau

SEQ ID NO: 1486190 - RNA, 14 nt, Human
uuuaguugaauuuu

SEQ ID NO: 1486191 - RNA, 23 nt, Human
uuuaguugaauuuuuuuuaacau

SEQ ID NO: 1486192 - RNA, 19 nt, Human
uuuauccugaaauuucaga

SEQ ID NO: 1486193 - RNA, 16 nt, Human
uuuaucgcagaccuuu

SEQ ID NO: 1486194 - RNA, 16 nt, Human
uuuauccuaucucucc

SEQ ID NO: 1486195 - RNA, 18 nt, Human
uuuauccugaaauuucag

SEQ ID NO: 1486196 - RNA, 16 nt, Human
uuuaucugaauuuuua

SEQ ID NO: 1486197 - RNA, 12 nt, Human
uuuaucuuuaua

SEQ ID NO: 1486198 - RNA, 17 nt, Human
uuuauggcacuaguauu

SEQ ID NO: 1486199 - RNA, 22 nt, Human
uuuaugauacuugaaaauuaac

SEQ ID NO: 1486200 - RNA, 17 nt, Human
uuuaugagaaagccuuc

SEQ ID NO: 1486201 - RNA, 14 nt, Human
uuuaugccaccuga

SEQ ID NO: 1486202 - RNA, 13 nt, Human
uuuaugcuugcaa

SEQ ID NO: 1486203 - RNA, 17 nt, Human
uuucacaaggucuuuaa

SEQ ID NO: 1486204 - RNA, 18 nt, Human
uuucaguccccacagaua

SEQ ID NO: 1486205 - RNA, 12 nt, Human
uuucugaaauuu

SEQ ID NO: 1486206 - RNA, 19 nt, Human
uuucugaaauuuccuggga

SEQ ID NO: 1486207 - RNA, 18 nt, Human
uuucugaguuuuaccaaa

SEQ ID NO: 1486208 - RNA, 17 nt, Human
uuucugaguuuuaccaa

SEQ ID NO: 1486209 - RNA, 12 nt, Human
uuucucuaggaa

SEQ ID NO: 1486210 - RNA, 22 nt, Human
uuucucgcuguccuuucuagag

SEQ ID NO: 1486211 - RNA, 16 nt, Human
uuucuaccauuucaga

SEQ ID NO: 1486212 - RNA, 17 nt, Human
uuucuaaaguaaaaaca

SEQ ID NO: 1486213 - RNA, 14 nt, Human
uuuccuggugccaa

SEQ ID NO: 1486214 - RNA, 16 nt, Human
uuuccuggugccaauu

SEQ ID NO: 1486215 - RNA, 19 nt, Human
uuuccuggugccaauuuca

SEQ ID NO: 1486216 - RNA, 22 nt, Human
uuuccuggugccaauuucaagu

SEQ ID NO: 1486217 - RNA, 22 nt, Human
uuucuaaaguaaaaacaaagaa

SEQ ID NO: 1486218 - RNA, 19 nt, Human
uuuccuaagugauuguaug

SEQ ID NO: 1486219 - RNA, 22 nt, Human
uuuccuccgucaccucagagac

SEQ ID NO: 1486220 - RNA, 18 nt, Human
uuugccacccucaugcug

SEQ ID NO: 1486221 - RNA, 19 nt, Human
uuugccacccucaugcugu

SEQ ID NO: 1486222 - RNA, 23 nt, Human
uuugccaagggcauaaauuauug

SEQ ID NO: 1486223 - RNA, 22 nt, Human
uuugccaagggcauaaauuauu

SEQ ID NO: 1486224 - RNA, 14 nt, Human
uuugauaugugaac

SEQ ID NO: 1486225 - RNA, 15 nt, Human
uuugauaugugaaca

SEQ ID NO: 1486226 - RNA, 17 nt, Human
uuugauaugugaacagu

SEQ ID NO: 1486227 - RNA, 16 nt, Human
uuuggaccuaauccaa

SEQ ID NO: 1486228 - RNA, 18 nt, Human
uuugguaaggggaauuga

SEQ ID NO: 1486229 - RNA, 19 nt, Human
uuugguuucccaagagcua

SEQ ID NO: 1486230 - RNA, 13 nt, Human
uuuguauucaaaa

SEQ ID NO: 1486231 - RNA, 16 nt, Human
uuuguaaacucaaaau

SEQ ID NO: 1486232 - RNA, 17 nt, Human
uuuguaaacucaaaaua

SEQ ID NO: 1486233 - RNA, 22 nt, Human
uuuguaaacucaaaauauuugu

SEQ ID NO: 1486234 - RNA, 13 nt, Human
uuugaaccaauaa

SEQ ID NO: 1486235 - RNA, 18 nt, Human
uuugaaccugaugaaaau

SEQ ID NO: 1486236 - RNA, 20 nt, Human
uuugaaccugaugaaaauaa

SEQ ID NO: 1486237 - RNA, 21 nt, Human
uuugaaauuguauuacaaauc

SEQ ID NO: 1486238 - RNA, 18 nt, Human
uuucuuaaccagaucauu

SEQ ID NO: 1486239 - RNA, 21 nt, Human
uuucuuaaauaagaaacuuuu

SEQ ID NO: 1486240 - RNA, 18 nt, Human
uuucuuaaauaagaaacu

SEQ ID NO: 1486241 - RNA, 19 nt, Human
uuucuuaaauaagaaacuu

SEQ ID NO: 1486242 - RNA, 15 nt, Human
uuucugaucaaggcc

SEQ ID NO: 1486243 - RNA, 17 nt, Human
uuucugaucaaggccuu

SEQ ID NO: 1486244 - RNA, 12 nt, Human
uuucuuaaauaa

SEQ ID NO: 1486245 - RNA, 13 nt, Human
uuucuuaaauaag

SEQ ID NO: 1486246 - RNA, 20 nt, Human
uuucuuaaauaagaaacuuu

SEQ ID NO: 1486247 - RNA, 17 nt, Human
uuugaaguuagcuuuaa

SEQ ID NO: 1486248 - RNA, 13 nt, Human
uuugaaguguaau

SEQ ID NO: 1486249 - RNA, 23 nt, Human
uuugaaguuagcuuuaacuuaaa

SEQ ID NO: 1486250 - RNA, 16 nt, Human
uuugaaguuagcuuua

SEQ ID NO: 1486251 - RNA, 21 nt, Human
uguuucaaacauauauaacaa

SEQ ID NO: 1486252 - RNA, 22 nt, Human
uguuucaaacauauauaacaau

SEQ ID NO: 1486253 - RNA, 16 nt, Human
uguuucacaaggucuu

SEQ ID NO: 1486254 - RNA, 13 nt, Human
uguuucacaaggu

SEQ ID NO: 1486255 - RNA, 20 nt, Human
uguuuguacacaacaauccu

SEQ ID NO: 1486256 - RNA, 17 nt, Human
uguuucuacuuugauau

SEQ ID NO: 1486257 - RNA, 13 nt, Human
uuaaaagaaugau

SEQ ID NO: 1486258 - RNA, 20 nt, Human
uuaaaagaugcuuuuaacag

SEQ ID NO: 1486259 - RNA, 22 nt, Human
uuaaaagaugcuuuuaacagag

SEQ ID NO: 1486260 - RNA, 18 nt, Human
uuaaaaguguauuuguua

SEQ ID NO: 1486261 - RNA, 19 nt, Human
uuaaaauagcaaaagaaga

SEQ ID NO: 1486262 - RNA, 21 nt, Human
uuaaaauagcaaaagaagaag

SEQ ID NO: 1486263 - RNA, 23 nt, Human
uuaaaauagcaaaagaagaaguu

SEQ ID NO: 1486264 - RNA, 22 nt, Human
uuaaaauagcaaaagaagaagu

SEQ ID NO: 1486265 - RNA, 12 nt, Human
uuaaacugugua

SEQ ID NO: 1486266 - RNA, 19 nt, Human
uuaaacuguguacauaacu

SEQ ID NO: 1486267 - RNA, 18 nt, Human
uguuuuuuuuuaaagacu

SEQ ID NO: 1486268 - RNA, 18 nt, Human
uguuuuuuuguuauuaaa

SEQ ID NO: 1486269 - RNA, 16 nt, Human
uguuuuuuuguuauua

SEQ ID NO: 1486270 - RNA, 15 nt, Human
uguuuuuuucuaaua

SEQ ID NO: 1486271 - RNA, 22 nt, Human
uuaacuauugcauuuauaugua

SEQ ID NO: 1486272 - RNA, 21 nt, Human
uuaacuauugcauuuauaugu

SEQ ID NO: 1486273 - RNA, 14 nt, Human
uuaacuauugcauu

SEQ ID NO: 1486274 - RNA, 15 nt, Human
uuaacucauuagacu

SEQ ID NO: 1486275 - RNA, 16 nt, Human
uuaacucauuagacug

SEQ ID NO: 1486276 - RNA, 17 nt, Human
uuaacucauuagacugg

SEQ ID NO: 1486277 - RNA, 15 nt, Human
uuaacucucuuuaug

SEQ ID NO: 1486278 - RNA, 19 nt, Human
uuaacucucuuuaugucug

SEQ ID NO: 1486279 - RNA, 17 nt, Human
uuaacucucuuuauguc

SEQ ID NO: 1486280 - RNA, 21 nt, Human
uuaacuggguaaugaaacaaa

SEQ ID NO: 1486281 - RNA, 17 nt, Human
uuaacuggguaaugaaa

SEQ ID NO: 1486282 - RNA, 15 nt, Human
uuaacuuaaauagua

SEQ ID NO: 1486283 - RNA, 13 nt, Human
uuaacuuaaauag

SEQ ID NO: 1486284 - RNA, 23 nt, Human
uuaaauguuuuuuuuuaaagacu

SEQ ID NO: 1486285 - RNA, 21 nt, Human
uuaaauguuuuuuuuuaaaga

SEQ ID NO: 1486286 - RNA, 14 nt, Human
uuaaagacuuuuau

SEQ ID NO: 1486287 - RNA, 13 nt, Human
uuaaccagaucua

SEQ ID NO: 1486288 - RNA, 22 nt, Human
uuaaccagaucuagucaaucaa

SEQ ID NO: 1486289 - RNA, 20 nt, Human
uuaaccuaugauauuuucug

SEQ ID NO: 1486290 - RNA, 21 nt, Human
uuaaccuaugauauuuucugu

SEQ ID NO: 1486291 - RNA, 22 nt, Human
uuaaugucaauucuugccaaau

SEQ ID NO: 1486292 - RNA, 19 nt, Human
uuaauguauaguaaaucac

SEQ ID NO: 1486293 - RNA, 13 nt, Human
uuaauguguauua

SEQ ID NO: 1486294 - RNA, 20 nt, Human
uuaauggugccuucauuugg

SEQ ID NO: 1486295 - RNA, 17 nt, Human
uuaauggugccuucauu

SEQ ID NO: 1486296 - RNA, 19 nt, Human
uuaauggugccuucauuug

SEQ ID NO: 1486297 - RNA, 18 nt, Human
uuaauggcugauaauuuu

SEQ ID NO: 1486298 - RNA, 15 nt, Human
uuaauguuuaaaaca

SEQ ID NO: 1486299 - RNA, 17 nt, Human
uuacaaguaacaaaaau

SEQ ID NO: 1486300 - RNA, 20 nt, Human
uuacaaguaacaaaaauaaa

SEQ ID NO: 1486301 - RNA, 19 nt, Human
uuacaaguaacaaaaauaa

SEQ ID NO: 1486302 - RNA, 20 nt, Human
uuaauauauauuaucuuuuc

SEQ ID NO: 1486303 - RNA, 19 nt, Human
uuacugucuuuuuucuaaa

SEQ ID NO: 1486304 - RNA, 18 nt, Human
uuacuuauuaucuucagg

SEQ ID NO: 1486305 - RNA, 22 nt, Human
uuacuucguguccgacucuucu

SEQ ID NO: 1486306 - RNA, 15 nt, Human
uuacaauuuuuuauc

SEQ ID NO: 1486307 - RNA, 17 nt, Human
uuacaauuuuuuaucau

SEQ ID NO: 1486308 - RNA, 18 nt, Human
uuacaauuuuuuaucaug

SEQ ID NO: 1486309 - RNA, 20 nt, Human
uuacaauuuuuuaucaugca

SEQ ID NO: 1486310 - RNA, 15 nt, Human
uuacuauaagaacuu

SEQ ID NO: 1486311 - RNA, 20 nt, Human
uuacuauaagaacuuugagc

SEQ ID NO: 1486312 - RNA, 23 nt, Human
uuacuauaagaacuuugagcuac

SEQ ID NO: 1486313 - RNA, 20 nt, Human
uuacuaaggaagauuacuca

SEQ ID NO: 1486314 - RNA, 13 nt, Human
uuacuacaugcac

SEQ ID NO: 1486315 - RNA, 14 nt, Human
uuacuacaugcacu

SEQ ID NO: 1486316 - RNA, 15 nt, Human
uuagacuggaacuug

SEQ ID NO: 1486317 - RNA, 16 nt, Human
uuagacuggaacuuga

SEQ ID NO: 1486318 - RNA, 17 nt, Human
uuagacuggaacuugaa

SEQ ID NO: 1486319 - RNA, 21 nt, Human
uuagacuggaacuugaacuga

SEQ ID NO: 1486320 - RNA, 22 nt, Human
uuagacuggaacuugaacugau

SEQ ID NO: 1486321 - RNA, 15 nt, Human
uuagacuggacagcu

SEQ ID NO: 1486322 - RNA, 16 nt, Human
uuagacuggacagcuu

SEQ ID NO: 1486323 - RNA, 17 nt, Human
uuagacuggacagcuug

SEQ ID NO: 1486324 - RNA, 19 nt, Human
uuagacuggacagcuugug

SEQ ID NO: 1486325 - RNA, 19 nt, Human
uuagaccaccaagccuuga

SEQ ID NO: 1486326 - RNA, 17 nt, Human
uuagaccaccaagccuu

SEQ ID NO: 1486327 - RNA, 16 nt, Human
uuagaccaccaagccu

SEQ ID NO: 1486328 - RNA, 19 nt, Human
uuagaaacacaacuauauu

SEQ ID NO: 1486329 - RNA, 21 nt, Human
uuagaaaacauaaucuucugc

SEQ ID NO: 1486330 - RNA, 16 nt, Human
uuagaaaacuuuaaag

SEQ ID NO: 1486331 - RNA, 14 nt, Human
uuagaaaacuuuaa

SEQ ID NO: 1486332 - RNA, 17 nt, Human
uuacuuuuaaacaguga

SEQ ID NO: 1486333 - RNA, 14 nt, Human
uuacuuuuaaacug

SEQ ID NO: 1486334 - RNA, 15 nt, Human
uuacuuuuaaacugu

SEQ ID NO: 1486335 - RNA, 16 nt, Human
uuacuuuuaaacugug

SEQ ID NO: 1486336 - RNA, 19 nt, Human
uuacuuuuaaacuguguac

SEQ ID NO: 1486337 - RNA, 14 nt, Human
uuacuuuugcugua

SEQ ID NO: 1486338 - RNA, 16 nt, Human
uuacuuuauguuacua

SEQ ID NO: 1486339 - RNA, 14 nt, Human
uuagggaaaacauu

SEQ ID NO: 1486340 - RNA, 14 nt, Human
uuaggccucugaga

SEQ ID NO: 1486341 - RNA, 23 nt, Human
uuaggaaguugacuuauaguaca

SEQ ID NO: 1486342 - RNA, 22 nt, Human
uuaggaaguugacuuauaguac

SEQ ID NO: 1486343 - RNA, 18 nt, Human
uuaggaagcaagcuuaau

SEQ ID NO: 1486344 - RNA, 16 nt, Human
uuaggcagacucuuua

SEQ ID NO: 1486345 - RNA, 15 nt, Human
uuaggcagacucuuu

SEQ ID NO: 1486346 - RNA, 14 nt, Human
uuaguguucauaaa

SEQ ID NO: 1486347 - RNA, 17 nt, Human
uuagucccucaugcaaa

SEQ ID NO: 1486348 - RNA, 12 nt, Human
uuagcuggaaaa

SEQ ID NO: 1486349 - RNA, 13 nt, Human
uuagcuggaaaag

SEQ ID NO: 1486350 - RNA, 16 nt, Human
uuagcuggcauuacag

SEQ ID NO: 1486351 - RNA, 15 nt, Human
uuagcugucugcuca

SEQ ID NO: 1486352 - RNA, 17 nt, Human
uuagcugucugcucaga

SEQ ID NO: 1486353 - RNA, 13 nt, Human
uuagcuuuaacuu

SEQ ID NO: 1486354 - RNA, 20 nt, Human
uuagaugcaguucugaagaa

SEQ ID NO: 1486355 - RNA, 21 nt, Human
uuagaugcaguucugaagaag

SEQ ID NO: 1486356 - RNA, 15 nt, Human
uuagaucuggcaugu

SEQ ID NO: 1486357 - RNA, 18 nt, Human
uuagagggaggagaauga

SEQ ID NO: 1486358 - RNA, 16 nt, Human
uuaugcuuaaauucaa

SEQ ID NO: 1486359 - RNA, 17 nt, Human
uuaugcugugacacaug

SEQ ID NO: 1486360 - RNA, 21 nt, Human
uuauggcacuaguauuucuau

SEQ ID NO: 1486361 - RNA, 16 nt, Human
uuaugccaccugaaua

SEQ ID NO: 1486362 - RNA, 14 nt, Human
uuaugaaaaagaag

SEQ ID NO: 1486363 - RNA, 13 nt, Human
uuaugccaccuga

SEQ ID NO: 1486364 - RNA, 17 nt, Human
uuaucuugguugaaaau

SEQ ID NO: 1486365 - RNA, 16 nt, Human
uuaucuuuacuuuuaa

SEQ ID NO: 1486366 - RNA, 12 nt, Human
uuaucuuuauau

SEQ ID NO: 1486367 - RNA, 17 nt, Human
uuaugaaaaagaagaau

SEQ ID NO: 1486368 - RNA, 20 nt, Human
uuaguugcaacuuuguauaa

SEQ ID NO: 1486369 - RNA, 13 nt, Human
uuaguugcaacuu

SEQ ID NO: 1486370 - RNA, 17 nt, Human
uuaucugaauuuuuaaa

SEQ ID NO: 1486371 - RNA, 18 nt, Human
uuaucugaauuuuuaaac

SEQ ID NO: 1486372 - RNA, 21 nt, Human
uuaucugaauuuuuaaacaag

SEQ ID NO: 1486373 - RNA, 18 nt, Human
uuaucugagucaacuccu

SEQ ID NO: 1486374 - RNA, 20 nt, Human
uuaucugaauuuuuaaacaa

SEQ ID NO: 1486375 - RNA, 20 nt, Human
uuaucuugaauaauguaaga

SEQ ID NO: 1486376 - RNA, 16 nt, Human
uuauuaaacaaauaau

SEQ ID NO: 1486377 - RNA, 16 nt, Human
uuauuacuguaagaaa

SEQ ID NO: 1486378 - RNA, 12 nt, Human
uuauuaauuuga

SEQ ID NO: 1486379 - RNA, 17 nt, Human
uuauuacuguaagaaaa

SEQ ID NO: 1486380 - RNA, 18 nt, Human
uuauuacuguaagaaaau

SEQ ID NO: 1486381 - RNA, 19 nt, Human
uuauucguagauauuggac

SEQ ID NO: 1486382 - RNA, 15 nt, Human
uucagagaggccuuu

SEQ ID NO: 1486383 - RNA, 22 nt, Human
uucagagccuccuuucuggcuu

SEQ ID NO: 1486384 - RNA, 22 nt, Human
uucagaguugaugguuguacau

SEQ ID NO: 1486385 - RNA, 21 nt, Human
uucagaguugaugguuguaca

SEQ ID NO: 1486386 - RNA, 20 nt, Human
uucagauaaucacaauacau

SEQ ID NO: 1486387 - RNA, 21 nt, Human
uucaccuggaagcauuuguuu

SEQ ID NO: 1486388 - RNA, 13 nt, Human
uucaccuguaaac

SEQ ID NO: 1486389 - RNA, 16 nt, Human
uucaccuguaaaccug

SEQ ID NO: 1486390 - RNA, 17 nt, Human
uucaccuguaaaccuga

SEQ ID NO: 1486391 - RNA, 18 nt, Human
uucaccuguaaaccugag

SEQ ID NO: 1486392 - RNA, 23 nt, Human
uucaaaucaaucuguaaaacuaa

SEQ ID NO: 1486393 - RNA, 22 nt, Human
uucaaaucaaucuguaaaacua

SEQ ID NO: 1486394 - RNA, 18 nt, Human
uucaaauagggucuaacu

SEQ ID NO: 1486395 - RNA, 19 nt, Human
uucaaauagggucuaacuc

SEQ ID NO: 1486396 - RNA, 14 nt, Human
uucaaaguuuaaua

SEQ ID NO: 1486397 - RNA, 19 nt, Human
uucaaaguuuaauaaauuu

SEQ ID NO: 1486398 - RNA, 17 nt, Human
uucaaauccuugaagau

SEQ ID NO: 1486399 - RNA, 20 nt, Human
uucaaagcuguguguuugga

SEQ ID NO: 1486400 - RNA, 23 nt, Human
uucaaagcuguguguuuggaaga

SEQ ID NO: 1486401 - RNA, 22 nt, Human
uucaaagcuuuuuccagaggcu

SEQ ID NO: 1486402 - RNA, 20 nt, Human
uuauuuuauguugcauagaa

SEQ ID NO: 1486403 - RNA, 17 nt, Human
uuauuuuaauaauguuu

SEQ ID NO: 1486404 - RNA, 22 nt, Human
uuauuggcugagauaugaacau

SEQ ID NO: 1486405 - RNA, 15 nt, Human
uuauuggcugagaua

SEQ ID NO: 1486406 - RNA, 16 nt, Human
uuauuggcugagauau

SEQ ID NO: 1486407 - RNA, 14 nt, Human
uuauuggcugagau

SEQ ID NO: 1486408 - RNA, 15 nt, Human
uuauuuuaauaaugu

SEQ ID NO: 1486409 - RNA, 16 nt, Human
uuauuuuaauaauguu

SEQ ID NO: 1486410 - RNA, 15 nt, Human
uuauugucuagugaa

SEQ ID NO: 1486411 - RNA, 19 nt, Human
uuccacucguguguuucua

SEQ ID NO: 1486412 - RNA, 14 nt, Human
uuccaaacuaauuu

SEQ ID NO: 1486413 - RNA, 15 nt, Human
uucaugaaagauuca

SEQ ID NO: 1486414 - RNA, 17 nt, Human
uucaugaaagauucaau

SEQ ID NO: 1486415 - RNA, 15 nt, Human
uucaugauuuugaaa

SEQ ID NO: 1486416 - RNA, 13 nt, Human
uucaggaaaauug

SEQ ID NO: 1486417 - RNA, 18 nt, Human
uucaggaaaauugaaugc

SEQ ID NO: 1486418 - RNA, 13 nt, Human
uucaugcauggaa

SEQ ID NO: 1486419 - RNA, 17 nt, Human
uucaugcaaacuuuauu

SEQ ID NO: 1486420 - RNA, 17 nt, Human
uucaugauuuugaaauc

SEQ ID NO: 1486421 - RNA, 15 nt, Human
uuccauucuggaagu

SEQ ID NO: 1486422 - RNA, 13 nt, Human
uuccauucuggaa

SEQ ID NO: 1486423 - RNA, 14 nt, Human
uucccauuucagcu

SEQ ID NO: 1486424 - RNA, 15 nt, Human
uucccauuucagcug

SEQ ID NO: 1486425 - RNA, 19 nt, Human
uuccccaucucaggccaga

SEQ ID NO: 1486426 - RNA, 23 nt, Human
uuccccaugguuuuaaucuguau

SEQ ID NO: 1486427 - RNA, 22 nt, Human
uucccuggaaaccuuccaccca

SEQ ID NO: 1486428 - RNA, 23 nt, Human
uucccuggaaaccuuccacccag

SEQ ID NO: 1486429 - RNA, 20 nt, Human
uucccuggaaaccuuccacc

SEQ ID NO: 1486430 - RNA, 22 nt, Human
uucccugcugugaaagaaguaa

SEQ ID NO: 1486431 - RNA, 14 nt, Human
uucccugccucuca

SEQ ID NO: 1486432 - RNA, 23 nt, Human
uucccugccucucaucaacugaa

SEQ ID NO: 1486433 - RNA, 17 nt, Human
uucccuugaugaagaag

SEQ ID NO: 1486434 - RNA, 21 nt, Human
uucccucucucauacccuccc

SEQ ID NO: 1486435 - RNA, 12 nt, Human
uucccuccuugg

SEQ ID NO: 1486436 - RNA, 13 nt, Human
uucccuccuuggu

SEQ ID NO: 1486437 - RNA, 18 nt, Human
uucccuugaugaagaagu

SEQ ID NO: 1486438 - RNA, 14 nt, Human
uuccuaugcuuuga

SEQ ID NO: 1486439 - RNA, 21 nt, Human
uuccucacaccaggcuugccu

SEQ ID NO: 1486440 - RNA, 14 nt, Human
uuccucagacucua

SEQ ID NO: 1486441 - RNA, 18 nt, Human
uuccucagacucuaagaa

SEQ ID NO: 1486442 - RNA, 22 nt, Human
uuccucaugaauguaaauuugu

SEQ ID NO: 1486443 - RNA, 16 nt, Human
uuccuaugcuuugaaa

SEQ ID NO: 1486444 - RNA, 15 nt, Human
uucguuuauuuucaa

SEQ ID NO: 1486445 - RNA, 22 nt, Human
uggggccaggcugggucgcccu

SEQ ID NO: 1486446 - RNA, 21 nt, Human
uggggccaggcugggucgccc

SEQ ID NO: 1486447 - RNA, 20 nt, Human
uggggaguuuaggguggggg

SEQ ID NO: 1486448 - RNA, 13 nt, Human
ugggcuucaucug

SEQ ID NO: 1486449 - RNA, 20 nt, Human
uggguauaguucaugucugc

SEQ ID NO: 1486450 - RNA, 10 nt, Human
uggggguggg

SEQ ID NO: 1486451 - RNA, 16 nt, Human
uggggguggggguagg

SEQ ID NO: 1486452 - RNA, 18 nt, Human
uggguaaugaaacaaaga

SEQ ID NO: 1486453 - RNA, 14 nt, Human
ugggggacuuacau

SEQ ID NO: 1486454 - RNA, 21 nt, Human
ugggggacuuacaugauucau

SEQ ID NO: 1486455 - RNA, 16 nt, Human
ugggggguggccaggc

SEQ ID NO: 1486456 - RNA, 23 nt, Human
ugggccccugccucucugcaggu

SEQ ID NO: 1486457 - RNA, 21 nt, Human
ugggccccugccucucugcag

SEQ ID NO: 1486458 - RNA, 13 nt, Human
ugggcaggaggga

SEQ ID NO: 1486459 - RNA, 15 nt, Human
ugggcaggagggagg

SEQ ID NO: 1486460 - RNA, 16 nt, Human
ugggcaggagggaggu

SEQ ID NO: 1486461 - RNA, 18 nt, Human
ugggcaggagggaggugc

SEQ ID NO: 1486462 - RNA, 12 nt, Human
uggucccugggu

SEQ ID NO: 1486463 - RNA, 13 nt, Human
ugguauguuuuca

SEQ ID NO: 1486464 - RNA, 21 nt, Human
ugguauguuuucaggcuagau

SEQ ID NO: 1486465 - RNA, 22 nt, Human
uggguaucaccacuggagauca

SEQ ID NO: 1486466 - RNA, 13 nt, Human
ugggucacaggaa

SEQ ID NO: 1486467 - RNA, 21 nt, Human
uggguaucaccacuggagauc

SEQ ID NO: 1486468 - RNA, 12 nt, Human
ugggucacagga

SEQ ID NO: 1486469 - RNA, 15 nt, Human
uggugccaauuucaa

SEQ ID NO: 1486470 - RNA, 18 nt, Human
uggucuaagguucagccu

SEQ ID NO: 1486471 - RNA, 20 nt, Human
uggaccaauagggcugagcu

SEQ ID NO: 1486472 - RNA, 21 nt, Human
uggaccaauagggcugagcuc

SEQ ID NO: 1486473 - RNA, 20 nt, Human
uggacacuacacccagcaau

SEQ ID NO: 1486474 - RNA, 19 nt, Human
uggacacuacacccagcaa

SEQ ID NO: 1486475 - RNA, 18 nt, Human
uggacacuacacccagca

SEQ ID NO: 1486476 - RNA, 17 nt, Human
uggacacuacacccagc

SEQ ID NO: 1486477 - RNA, 16 nt, Human
uggacacuacacccag

SEQ ID NO: 1486478 - RNA, 23 nt, Human
uggacaccugcccugcccugcca

SEQ ID NO: 1486479 - RNA, 14 nt, Human
uggagaaggaaggc

SEQ ID NO: 1486480 - RNA, 13 nt, Human
uggagaaggaagg

SEQ ID NO: 1486481 - RNA, 12 nt, Human
uggagaaggaag

SEQ ID NO: 1486482 - RNA, 11 nt, Human
uggagaaggaa

SEQ ID NO: 1486483 - RNA, 15 nt, Human
uggaccagccucucc

SEQ ID NO: 1486484 - RNA, 15 nt, Human
uggaccacugggcaa

SEQ ID NO: 1486485 - RNA, 19 nt, Human
uggaccacugggcaaugau

SEQ ID NO: 1486486 - RNA, 17 nt, Human
uggaguuuuuuguacca

SEQ ID NO: 1486487 - RNA, 18 nt, Human
uggaguuuuuuguaccaa

SEQ ID NO: 1486488 - RNA, 20 nt, Human
uggcaauagucaaauugugu

SEQ ID NO: 1486489 - RNA, 17 nt, Human
uggcaaggguucaccug

SEQ ID NO: 1486490 - RNA, 14 nt, Human
uggcaagugaauuu

SEQ ID NO: 1486491 - RNA, 15 nt, Human
uggcacuaguauuuc

SEQ ID NO: 1486492 - RNA, 23 nt, Human
uggauuuuuuccuucaaaguuua

SEQ ID NO: 1486493 - RNA, 15 nt, Human
uggcgggguggggug

SEQ ID NO: 1486494 - RNA, 21 nt, Human
uggccaggaagcuuuggugag

SEQ ID NO: 1486495 - RNA, 13 nt, Human
uggccaggaagcu

SEQ ID NO: 1486496 - RNA, 22 nt, Human
uggccaggccgggaaaaagccc

SEQ ID NO: 1486497 - RNA, 11 nt, Human
uggcccccucc

SEQ ID NO: 1486498 - RNA, 15 nt, Human
uggccucaaagcaag

SEQ ID NO: 1486499 - RNA, 16 nt, Human
uggccuauguggucua

SEQ ID NO: 1486500 - RNA, 19 nt, Human
uggccuauguggucuaagg

SEQ ID NO: 1486501 - RNA, 20 nt, Human
ugccuugcauaauggucaga

SEQ ID NO: 1486502 - RNA, 20 nt, Human
ugcucaggagcccugggagg

SEQ ID NO: 1486503 - RNA, 19 nt, Human
ugcucaggagcccugggag

SEQ ID NO: 1486504 - RNA, 18 nt, Human
ugcucaggagcccuggga

SEQ ID NO: 1486505 - RNA, 13 nt, Human
ugcucagacagaa

SEQ ID NO: 1486506 - RNA, 13 nt, Human
ugcucuccuccac

SEQ ID NO: 1486507 - RNA, 22 nt, Human
ugcucauauugugauucugccu

SEQ ID NO: 1486508 - RNA, 23 nt, Human
ugcucauauugugauucugccuu

SEQ ID NO: 1486509 - RNA, 21 nt, Human
ugcucauauugugauucugcc

SEQ ID NO: 1486510 - RNA, 16 nt, Human
ugcuguucaugaaaga

SEQ ID NO: 1486511 - RNA, 17 nt, Human
ugcuguucaugaaagau

SEQ ID NO: 1486512 - RNA, 13 nt, Human
ugcugguuuuagu

SEQ ID NO: 1486513 - RNA, 18 nt, Human
ugcuggugagccaagcag

SEQ ID NO: 1486514 - RNA, 16 nt, Human
ugcuggggaagacagu

SEQ ID NO: 1486515 - RNA, 17 nt, Human
ugcuggggaagacagug

SEQ ID NO: 1486516 - RNA, 22 nt, Human
ugcuggggaagacaguggcccc

SEQ ID NO: 1486517 - RNA, 17 nt, Human
ugcugccugcuuuuuau

SEQ ID NO: 1486518 - RNA, 15 nt, Human
ugcugccugcuuuuu

SEQ ID NO: 1486519 - RNA, 24 nt, Human
ugcugggccccugccucucugcag

SEQ ID NO: 1486520 - RNA, 23 nt, Human
ugcugggccccugccucucugca

SEQ ID NO: 1486521 - RNA, 22 nt, Human
ugcugggccccugccucucugc

SEQ ID NO: 1486522 - RNA, 21 nt, Human
ugcugggccccugccucucug

SEQ ID NO: 1486523 - RNA, 19 nt, Human
ugcugggccccugccucuc

SEQ ID NO: 1486524 - RNA, 18 nt, Human
ugcugggccccugccucu

SEQ ID NO: 1486525 - RNA, 17 nt, Human
ugcugggccccugccuc

SEQ ID NO: 1486526 - RNA, 16 nt, Human
ugcugggccccugccu

SEQ ID NO: 1486527 - RNA, 14 nt, Human
ugcugggccccugc

SEQ ID NO: 1486528 - RNA, 14 nt, Human
ugcugcugccugcc

SEQ ID NO: 1486529 - RNA, 13 nt, Human
ugcugcugccugc

SEQ ID NO: 1486530 - RNA, 14 nt, Human
ugccuccugccggc

SEQ ID NO: 1486531 - RNA, 21 nt, Human
ugccuccugccggcuccuugg

SEQ ID NO: 1486532 - RNA, 20 nt, Human
ugccuccugccggcuccuug

SEQ ID NO: 1486533 - RNA, 14 nt, Human
ugccucaaccuccc

SEQ ID NO: 1486534 - RNA, 19 nt, Human
ugccaggcuggagugcagu

SEQ ID NO: 1486535 - RNA, 17 nt, Human
ugccaggcuggagugca

SEQ ID NO: 1486536 - RNA, 16 nt, Human
ugccaggcuaauuuuu

SEQ ID NO: 1486537 - RNA, 17 nt, Human
ugccaggcuaauuuuuu

SEQ ID NO: 1486538 - RNA, 20 nt, Human
ugccccuugacaacuggcag

SEQ ID NO: 1486539 - RNA, 21 nt, Human
ugccccuugacaacuggcagg

SEQ ID NO: 1486540 - RNA, 20 nt, Human
ugcccgccugggucuccuaa

SEQ ID NO: 1486541 - RNA, 13 nt, Human
ugccaccugucug

SEQ ID NO: 1486542 - RNA, 12 nt, Human
ugccaccugucu

SEQ ID NO: 1486543 - RNA, 11 nt, Human
ugccaccuguc

SEQ ID NO: 1486544 - RNA, 10 nt, Human
ugccaccugu

SEQ ID NO: 1486545 - RNA, 14 nt, Human
ugccaccuccugcc

SEQ ID NO: 1486546 - RNA, 16 nt, Human
ugccaccugucugucu

SEQ ID NO: 1486547 - RNA, 15 nt, Human
ugccaccugucuguc

SEQ ID NO: 1486548 - RNA, 14 nt, Human
ugccaccugucugu

SEQ ID NO: 1486549 - RNA, 13 nt, Human
ugccaggaggacc

SEQ ID NO: 1486550 - RNA, 17 nt, Human
ugccaggaggacccagg

SEQ ID NO: 1486551 - RNA, 14 nt, Human
ugcauuugggucca

SEQ ID NO: 1486552 - RNA, 16 nt, Human
ugcauuuggguccagg

SEQ ID NO: 1486553 - RNA, 17 nt, Human
ugcauuuggguccagga

SEQ ID NO: 1486554 - RNA, 18 nt, Human
ugcauuuggguccaggag

SEQ ID NO: 1486555 - RNA, 20 nt, Human
ugcauuuggguccaggagga

SEQ ID NO: 1486556 - RNA, 19 nt, Human
ugcauuuggguccaggagg

SEQ ID NO: 1486557 - RNA, 18 nt, Human
ugcauauuauuuuauguu

SEQ ID NO: 1486558 - RNA, 12 nt, Human
ugcaguucugaa

SEQ ID NO: 1486559 - RNA, 14 nt, Human
ugcaguucugaaga

SEQ ID NO: 1486560 - RNA, 23 nt, Human
ugacauaaguauuuaauucaugu

SEQ ID NO: 1486561 - RNA, 16 nt, Human
ugacauaaaguugaua

SEQ ID NO: 1486562 - RNA, 12 nt, Human
ugacaagcucac

SEQ ID NO: 1486563 - RNA, 15 nt, Human
ugacaagcucacaga

SEQ ID NO: 1486564 - RNA, 20 nt, Human
ugacaagcucacagaccuuu

SEQ ID NO: 1486565 - RNA, 12 nt, Human
ugacacaaacac

SEQ ID NO: 1486566 - RNA, 14 nt, Human
ugacaauugggagc

SEQ ID NO: 1486567 - RNA, 17 nt, Human
ugacacaaacacacaca

SEQ ID NO: 1486568 - RNA, 13 nt, Human
ugacacaaacaca

SEQ ID NO: 1486569 - RNA, 22 nt, Human
ugacacuuuaauuaccaaccug

SEQ ID NO: 1486570 - RNA, 17 nt, Human
ugacaugggacauuugc

SEQ ID NO: 1486571 - RNA, 18 nt, Human
ugacaugggacauuugcu

SEQ ID NO: 1486572 - RNA, 14 nt, Human
ugacauguccuucu

SEQ ID NO: 1486573 - RNA, 17 nt, Human
ugacauguccuucugag

SEQ ID NO: 1486574 - RNA, 15 nt, Human
ugaagauacugaaau

SEQ ID NO: 1486575 - RNA, 16 nt, Human
ugaagauacugaaaua

SEQ ID NO: 1486576 - RNA, 18 nt, Human
ugaagauacugaaauaaa

SEQ ID NO: 1486577 - RNA, 14 nt, Human
ugaagauacugaaa

SEQ ID NO: 1486578 - RNA, 13 nt, Human
ugaaguccaagca

SEQ ID NO: 1486579 - RNA, 11 nt, Human
ugaaguccaag

SEQ ID NO: 1486580 - RNA, 23 nt, Human
ugaaguuagcuuuaacuuaaaua

SEQ ID NO: 1486581 - RNA, 18 nt, Human
ugaaguuagcuuuaacuu

SEQ ID NO: 1486582 - RNA, 15 nt, Human
ugaauuauauguuca

SEQ ID NO: 1486583 - RNA, 15 nt, Human
ugaauuacauuugua

SEQ ID NO: 1486584 - RNA, 16 nt, Human
ugaauuacauuuguau

SEQ ID NO: 1486585 - RNA, 18 nt, Human
ugaauuacauuuguauaa

SEQ ID NO: 1486586 - RNA, 16 nt, Human
ugaauuauuuucucuc

SEQ ID NO: 1486587 - RNA, 13 nt, Human
ugaauuaugaaac

SEQ ID NO: 1486588 - RNA, 21 nt, Human
ugaauuaucuugguugaaaau

SEQ ID NO: 1486589 - RNA, 15 nt, Human
ugaauuaugaaacuu

SEQ ID NO: 1486590 - RNA, 17 nt, Human
ugaauuaugaaacuuuu

SEQ ID NO: 1486591 - RNA, 23 nt, Human
ugaaucauuuuaccuuugacaaa

SEQ ID NO: 1486592 - RNA, 22 nt, Human
ugaaucauuuuaccuuugacaa

SEQ ID NO: 1486593 - RNA, 15 nt, Human
ugaauccaaacuaau

SEQ ID NO: 1486594 - RNA, 16 nt, Human
ugaauccaaacuaauc

SEQ ID NO: 1486595 - RNA, 22 nt, Human
ugaaugaggucagcaugucuau

SEQ ID NO: 1486596 - RNA, 16 nt, Human
ucuuucuuucaauaaa

SEQ ID NO: 1486597 - RNA, 13 nt, Human
ucuuucuuuauuu

SEQ ID NO: 1486598 - RNA, 19 nt, Human
ucuuuccacagaagcucca

SEQ ID NO: 1486599 - RNA, 12 nt, Human
ucuuugccaagu

SEQ ID NO: 1486600 - RNA, 20 nt, Human
ucuuugccacccucaugcug

SEQ ID NO: 1486601 - RNA, 18 nt, Human
ucuuugccacccucaugc

SEQ ID NO: 1486602 - RNA, 17 nt, Human
ucuuugccacccucaug

SEQ ID NO: 1486603 - RNA, 16 nt, Human
ucuuugccacccucau

SEQ ID NO: 1486604 - RNA, 14 nt, Human
ucuuugccacccuc

SEQ ID NO: 1486605 - RNA, 14 nt, Human
ucuuuuauaggauu

SEQ ID NO: 1486606 - RNA, 23 nt, Human
ucuugcaggaaggacuaugaaaa

SEQ ID NO: 1486607 - RNA, 22 nt, Human
ugaaauuaugugacauuuuaca

SEQ ID NO: 1486608 - RNA, 20 nt, Human
ugaaauuaugugacauuuua

SEQ ID NO: 1486609 - RNA, 12 nt, Human
ugaaauuauuca

SEQ ID NO: 1486610 - RNA, 22 nt, Human
ugaaauuaacuggguaaugaaa

SEQ ID NO: 1486611 - RNA, 15 nt, Human
ugaaaucauucauuu

SEQ ID NO: 1486612 - RNA, 16 nt, Human
ugaaauauugacuuuu

SEQ ID NO: 1486613 - RNA, 17 nt, Human
ugaaauggauacuuaua

SEQ ID NO: 1486614 - RNA, 19 nt, Human
ugaacaguuguguuugaag

SEQ ID NO: 1486615 - RNA, 11 nt, Human
ugaacaagaau

SEQ ID NO: 1486616 - RNA, 12 nt, Human
ugaacaagaauu

SEQ ID NO: 1486617 - RNA, 14 nt, Human
ugaacaagaauugg

SEQ ID NO: 1486618 - RNA, 18 nt, Human
ugaacaagaauuggaagc

SEQ ID NO: 1486619 - RNA, 16 nt, Human
ugaaaagcagacauuu

SEQ ID NO: 1486620 - RNA, 17 nt, Human
ugaaaagcuagaauuga

SEQ ID NO: 1486621 - RNA, 20 nt, Human
ugaaaagcuccauuuuuagu

SEQ ID NO: 1486622 - RNA, 19 nt, Human
ugaaacauuuucucccugg

SEQ ID NO: 1486623 - RNA, 18 nt, Human
ugaaacauuuucucccug

SEQ ID NO: 1486624 - RNA, 16 nt, Human
ugaaacauuuucuccc

SEQ ID NO: 1486625 - RNA, 23 nt, Human
ugaaacaaagaguucaagaaaua

SEQ ID NO: 1486626 - RNA, 14 nt, Human
ugaaacaaagaguu

SEQ ID NO: 1486627 - RNA, 16 nt, Human
ugaaagguacuucaaa

SEQ ID NO: 1486628 - RNA, 16 nt, Human
ugaaagguaauuugag

SEQ ID NO: 1486629 - RNA, 15 nt, Human
ugaaagguacuucaa

SEQ ID NO: 1486630 - RNA, 16 nt, Human
ugaaagaugaucauuu

SEQ ID NO: 1486631 - RNA, 16 nt, Human
ugaaagccauggagau

SEQ ID NO: 1486632 - RNA, 13 nt, Human
ugaaagccaugga

SEQ ID NO: 1486633 - RNA, 23 nt, Human
ugaaagccaaggagucacugaga

SEQ ID NO: 1486634 - RNA, 16 nt, Human
ugaggagcuugaaacc

SEQ ID NO: 1486635 - RNA, 17 nt, Human
ugagggagaacaagacc

SEQ ID NO: 1486636 - RNA, 16 nt, Human
ugauaacuggaaacuu

SEQ ID NO: 1486637 - RNA, 19 nt, Human
ugaguuuuccauggcagga

SEQ ID NO: 1486638 - RNA, 13 nt, Human
ugaguuuuccaug

SEQ ID NO: 1486639 - RNA, 12 nt, Human
ugaguuuuacca

SEQ ID NO: 1486640 - RNA, 13 nt, Human
ugaguuuuaccaa

SEQ ID NO: 1486641 - RNA, 17 nt, Human
ugagucguacagaaagc

SEQ ID NO: 1486642 - RNA, 19 nt, Human
ugagucguacagaaagcug

SEQ ID NO: 1486643 - RNA, 19 nt, Human
ugagaccaccucucaauau

SEQ ID NO: 1486644 - RNA, 15 nt, Human
ugagaccaccucuca

SEQ ID NO: 1486645 - RNA, 12 nt, Human
ugagaccaccuc

SEQ ID NO: 1486646 - RNA, 12 nt, Human
ugagaaccuggg

SEQ ID NO: 1486647 - RNA, 21 nt, Human
ugagaaccuggguugcagaca

SEQ ID NO: 1486648 - RNA, 23 nt, Human
ugagaaccuggguugcagacagg

SEQ ID NO: 1486649 - RNA, 22 nt, Human
ugagaaccuggguugcagacag

SEQ ID NO: 1486650 - RNA, 22 nt, Human
ugagacuaaucuuauucauuuu

SEQ ID NO: 1486651 - RNA, 17 nt, Human
ugagaaauuuauaaacu

SEQ ID NO: 1486652 - RNA, 18 nt, Human
ugagaaauuuaaacuaua

SEQ ID NO: 1486653 - RNA, 20 nt, Human
ugaccucaggcaaucugccc

SEQ ID NO: 1486654 - RNA, 21 nt, Human
ugaccucaggcaaucugcccg

SEQ ID NO: 1486655 - RNA, 21 nt, Human
ugagacuaaucuuauucauuu

SEQ ID NO: 1486656 - RNA, 12 nt, Human
ugagagugugac

SEQ ID NO: 1486657 - RNA, 14 nt, Human
ugagagugugacca

SEQ ID NO: 1486658 - RNA, 13 nt, Human
ugagagugugacc

SEQ ID NO: 1486659 - RNA, 12 nt, Human
ugagcaucacag

SEQ ID NO: 1486660 - RNA, 18 nt, Human
ugagcaucacagaaugug

SEQ ID NO: 1486661 - RNA, 13 nt, Human
ugagcaucacaga

SEQ ID NO: 1486662 - RNA, 14 nt, Human
ugagcaucacagaa

SEQ ID NO: 1486663 - RNA, 15 nt, Human
ugagcaucacagaau

SEQ ID NO: 1486664 - RNA, 19 nt, Human
ugagcuccuuaaggcucuu

SEQ ID NO: 1486665 - RNA, 21 nt, Human
ugagcuccuuaaggcucuuuu

SEQ ID NO: 1486666 - RNA, 18 nt, Human
ugagcuggaccucaccaa

SEQ ID NO: 1486667 - RNA, 12 nt, Human
ugauucugccuu

SEQ ID NO: 1486668 - RNA, 13 nt, Human
ugauucugccuuu

SEQ ID NO: 1486669 - RNA, 18 nt, Human
ugauugucuuaauauugu

SEQ ID NO: 1486670 - RNA, 20 nt, Human
ugauuguaguaaucugcauu

SEQ ID NO: 1486671 - RNA, 13 nt, Human
ugauugucuuaau

SEQ ID NO: 1486672 - RNA, 14 nt, Human
ugauugucuuaaua

SEQ ID NO: 1486673 - RNA, 13 nt, Human
ugauuauauguca

SEQ ID NO: 1486674 - RNA, 17 nt, Human
ugauuaugaauuacauu

SEQ ID NO: 1486675 - RNA, 19 nt, Human
ugauuaugaauuacauuug

SEQ ID NO: 1486676 - RNA, 22 nt, Human
ugauguuuagaaacacaacuau

SEQ ID NO: 1486677 - RNA, 21 nt, Human
ugauuaugaauuacauuugua

SEQ ID NO: 1486678 - RNA, 22 nt, Human
ugauuaugaauuacauuuguau

SEQ ID NO: 1486679 - RNA, 16 nt, Human
ugauucaaucuguaaa

SEQ ID NO: 1486680 - RNA, 17 nt, Human
ugauucaaucuguaaac

SEQ ID NO: 1486681 - RNA, 21 nt, Human
ugauucaaucuguaaacugug

SEQ ID NO: 1486682 - RNA, 22 nt, Human
ugauucaaucuguaaacugugu

SEQ ID NO: 1486683 - RNA, 23 nt, Human
ugauucaaucuguaaacugugua

SEQ ID NO: 1486684 - RNA, 16 nt, Human
ugauucacaucucauu

SEQ ID NO: 1486685 - RNA, 21 nt, Human
ugaugguuguacauauaagug

SEQ ID NO: 1486686 - RNA, 14 nt, Human
ugaugguuguacau

SEQ ID NO: 1486687 - RNA, 13 nt, Human
ugaugguuguaca

SEQ ID NO: 1486688 - RNA, 12 nt, Human
ugauguuaaaaa

SEQ ID NO: 1486689 - RNA, 13 nt, Human
ugauguuaaaaaa

SEQ ID NO: 1486690 - RNA, 14 nt, Human
ugauguuaaaaaaa

SEQ ID NO: 1486691 - RNA, 23 nt, Human
ugauguuaaaaaaauaagaagaa

SEQ ID NO: 1486692 - RNA, 11 nt, Human
ugaugccuggc

SEQ ID NO: 1486693 - RNA, 20 nt, Human
ugaugcuacaggauuugaaa

SEQ ID NO: 1486694 - RNA, 23 nt, Human
ugaugcuacaggauuugaaauug

SEQ ID NO: 1486695 - RNA, 21 nt, Human
ugaugccucugucuucuggac

SEQ ID NO: 1486696 - RNA, 20 nt, Human
ugaugauuuagagugcuguc

SEQ ID NO: 1486697 - RNA, 14 nt, Human
ugaugccucugucu

SEQ ID NO: 1486698 - RNA, 17 nt, Human
ugaucagcuuauugucu

SEQ ID NO: 1486699 - RNA, 24 nt, Human
ugaucagcuuauugucuagugaaa

SEQ ID NO: 1486700 - RNA, 14 nt, Human
ugauagauuuucug

SEQ ID NO: 1486701 - RNA, 13 nt, Human
ugauccaacuaau

SEQ ID NO: 1486702 - RNA, 14 nt, Human
ugauccaacuaaug

SEQ ID NO: 1486703 - RNA, 18 nt, Human
ucuccagccucagcucuc

SEQ ID NO: 1486704 - RNA, 19 nt, Human
ucuccagccucagccuccc

SEQ ID NO: 1486705 - RNA, 16 nt, Human
ucuccagccucagccu

SEQ ID NO: 1486706 - RNA, 15 nt, Human
ucuccaggcaggucu

SEQ ID NO: 1486707 - RNA, 12 nt, Human
ucuccccugcac

SEQ ID NO: 1486708 - RNA, 13 nt, Human
ucuccccugcacu

SEQ ID NO: 1486709 - RNA, 14 nt, Human
ucuccccugcacug

SEQ ID NO: 1486710 - RNA, 15 nt, Human
ucuccccugcacugu

SEQ ID NO: 1486711 - RNA, 16 nt, Human
ucuccccugcacugua

SEQ ID NO: 1486712 - RNA, 17 nt, Human
ucuccccugcacuguaa

SEQ ID NO: 1486713 - RNA, 21 nt, Human
ucuccccugcacuguaaaaug

SEQ ID NO: 1486714 - RNA, 18 nt, Human
ucucccuccucugcccgg

SEQ ID NO: 1486715 - RNA, 15 nt, Human
ucucccugccuccug

SEQ ID NO: 1486716 - RNA, 16 nt, Human
ucucauacccucccuc

SEQ ID NO: 1486717 - RNA, 16 nt, Human
ucucagugaagaauac

SEQ ID NO: 1486718 - RNA, 15 nt, Human
ucucagucugucacc

SEQ ID NO: 1486719 - RNA, 13 nt, Human
ucucauccugcag

SEQ ID NO: 1486720 - RNA, 15 nt, Human
ucucauccugcaggc

SEQ ID NO: 1486721 - RNA, 19 nt, Human
ucucaucucagugaagaau

SEQ ID NO: 1486722 - RNA, 20 nt, Human
ucucaucucagugaagaaua

SEQ ID NO: 1486723 - RNA, 18 nt, Human
ucucaucucuucuuuuaa

SEQ ID NO: 1486724 - RNA, 13 nt, Human
ucucaugaaccuc

SEQ ID NO: 1486725 - RNA, 14 nt, Human
ucucaugaaccuca

SEQ ID NO: 1486726 - RNA, 22 nt, Human
ucucaugaaccucaagcugcau

SEQ ID NO: 1486727 - RNA, 17 nt, Human
ucuacacuaagagagaa

SEQ ID NO: 1486728 - RNA, 18 nt, Human
ucuacaaaauccugauga

SEQ ID NO: 1486729 - RNA, 15 nt, Human
ucuaccuggucuggu

SEQ ID NO: 1486730 - RNA, 16 nt, Human
ucuacuggucuugugg

SEQ ID NO: 1486731 - RNA, 20 nt, Human
ucuacuggucuuguggaauu

SEQ ID NO: 1486732 - RNA, 23 nt, Human
ucuacuggucuuguggaauuggg

SEQ ID NO: 1486733 - RNA, 22 nt, Human
ucuacuuccaaacuaauuuuua

SEQ ID NO: 1486734 - RNA, 19 nt, Human
ucuacuuccaaacuaauuu

SEQ ID NO: 1486735 - RNA, 23 nt, Human
ucuaugaacucuguuuucuuucu

SEQ ID NO: 1486736 - RNA, 20 nt, Human
ucguggacaccugcccugcc

SEQ ID NO: 1486737 - RNA, 19 nt, Human
ucguggacaccugcccugc

SEQ ID NO: 1486738 - RNA, 18 nt, Human
ucguggacaccugcccug

SEQ ID NO: 1486739 - RNA, 17 nt, Human
ucguggacaccugcccu

SEQ ID NO: 1486740 - RNA, 16 nt, Human
ucguggacaccugccc

SEQ ID NO: 1486741 - RNA, 15 nt, Human
ucguggacaccugcc

SEQ ID NO: 1486742 - RNA, 14 nt, Human
ucguggacaccugc

SEQ ID NO: 1486743 - RNA, 13 nt, Human
ucguggacaccug

SEQ ID NO: 1486744 - RNA, 12 nt, Human
ucguggacaccu

SEQ ID NO: 1486745 - RNA, 15 nt, Human
ucgucuucuuggcca

SEQ ID NO: 1486746 - RNA, 19 nt, Human
uccuuagaaaaaaaauuau

SEQ ID NO: 1486747 - RNA, 18 nt, Human
uccuuagaucuggcaugu

SEQ ID NO: 1486748 - RNA, 17 nt, Human
uccuuagaucuggcaug

SEQ ID NO: 1486749 - RNA, 17 nt, Human
uccuggcaauagucaaa

SEQ ID NO: 1486750 - RNA, 19 nt, Human
uccuggaggggcuggggac

SEQ ID NO: 1486751 - RNA, 15 nt, Human
uccugucucccuccu

SEQ ID NO: 1486752 - RNA, 23 nt, Human
uccugucucccuccucugcccgg

SEQ ID NO: 1486753 - RNA, 14 nt, Human
uccugccggcuccu

SEQ ID NO: 1486754 - RNA, 17 nt, Human
uccugccggcuccuugg

SEQ ID NO: 1486755 - RNA, 11 nt, Human
uccuggagggg

SEQ ID NO: 1486756 - RNA, 23 nt, Human
uccugagccagugucaggaggaa

SEQ ID NO: 1486757 - RNA, 22 nt, Human
uccuaagcuggagugcaguggc

SEQ ID NO: 1486758 - RNA, 13 nt, Human
uccuacccccugu

SEQ ID NO: 1486759 - RNA, 15 nt, Human
uccuacccccugugc

SEQ ID NO: 1486760 - RNA, 16 nt, Human
uccuacccccugugcc

SEQ ID NO: 1486761 - RNA, 17 nt, Human
uccuacccccugugccu

SEQ ID NO: 1486762 - RNA, 20 nt, Human
uccuacauuaauuaucuagu

SEQ ID NO: 1486763 - RNA, 21 nt, Human
uccuccaggguggcagcaaca

SEQ ID NO: 1486764 - RNA, 20 nt, Human
uccuccaggguggcagcaac

SEQ ID NO: 1486765 - RNA, 17 nt, Human
uccuccaccucaacucc

SEQ ID NO: 1486766 - RNA, 15 nt, Human
uccgcuauccaccaa

SEQ ID NO: 1486767 - RNA, 14 nt, Human
uccgcagugagaga

SEQ ID NO: 1486768 - RNA, 23 nt, Human
uccagaaagaaaacuuguauuau

SEQ ID NO: 1486769 - RNA, 13 nt, Human
uccagaaaacaaa

SEQ ID NO: 1486770 - RNA, 14 nt, Human
uccagaaaacaaaa

SEQ ID NO: 1486771 - RNA, 18 nt, Human
uccagagucccugccugg

SEQ ID NO: 1486772 - RNA, 19 nt, Human
uccagagucccugccugga

SEQ ID NO: 1486773 - RNA, 20 nt, Human
uccagagucccugccuggac

SEQ ID NO: 1486774 - RNA, 21 nt, Human
uccagagucccugccuggacc

SEQ ID NO: 1486775 - RNA, 20 nt, Human
uccaugggccauaugaaaag

SEQ ID NO: 1486776 - RNA, 21 nt, Human
uccaugcguguuucugacucu

SEQ ID NO: 1486777 - RNA, 22 nt, Human
uccaugcguguuucugacucug

SEQ ID NO: 1486778 - RNA, 15 nt, Human
uccauacauuugugu

SEQ ID NO: 1486779 - RNA, 23 nt, Human
uccaguuggaguuuuuuguacca

SEQ ID NO: 1486780 - RNA, 16 nt, Human
uccaguucaugagaau

SEQ ID NO: 1486781 - RNA, 19 nt, Human
uccaguucaugagaaucua

SEQ ID NO: 1486782 - RNA, 14 nt, Human
uccaguaaaauaau

SEQ ID NO: 1486783 - RNA, 21 nt, Human
uccagguauucguuaucuaau

SEQ ID NO: 1486784 - RNA, 19 nt, Human
uccagguagagggugugua

SEQ ID NO: 1486785 - RNA, 14 nt, Human
ucccauguucaagc

SEQ ID NO: 1486786 - RNA, 11 nt, Human
ucccaggaacu

SEQ ID NO: 1486787 - RNA, 16 nt, Human
ucccaggaacugggcc

SEQ ID NO: 1486788 - RNA, 17 nt, Human
ucaugcuguucaugaaa

SEQ ID NO: 1486789 - RNA, 19 nt, Human
ucaucuuucccuccuuggu

SEQ ID NO: 1486790 - RNA, 18 nt, Human
ucaucuuucccuccuugg

SEQ ID NO: 1486791 - RNA, 17 nt, Human
ucaucuuucccuccuug

SEQ ID NO: 1486792 - RNA, 12 nt, Human
ucaucuuucuuc

SEQ ID NO: 1486793 - RNA, 16 nt, Human
ucaucuuucccuccuu

SEQ ID NO: 1486794 - RNA, 15 nt, Human
ucaucuuucccuccu

SEQ ID NO: 1486795 - RNA, 14 nt, Human
ucaucuuucccucc

SEQ ID NO: 1486796 - RNA, 16 nt, Human
ucaucuccccaucauu

SEQ ID NO: 1486797 - RNA, 18 nt, Human
ucaucucagcucacugca

SEQ ID NO: 1486798 - RNA, 19 nt, Human
ucaucucagcucacugcaa

SEQ ID NO: 1486799 - RNA, 22 nt, Human
ucaucucagugaagaauacuuc

SEQ ID NO: 1486800 - RNA, 22 nt, Human
ucaguguagaaccuaauucaau

SEQ ID NO: 1486801 - RNA, 21 nt, Human
ucaguguauggaaauaaaugu

SEQ ID NO: 1486802 - RNA, 22 nt, Human
ucaguguauggaaauaaaugua

SEQ ID NO: 1486803 - RNA, 13 nt, Human
ucauagagacuug

SEQ ID NO: 1486804 - RNA, 13 nt, Human
ucaucaauuaaag

SEQ ID NO: 1486805 - RNA, 22 nt, Human
ucaucauguaucgcuucaugua

SEQ ID NO: 1486806 - RNA, 14 nt, Human
ucauggugcucaga

SEQ ID NO: 1486807 - RNA, 20 nt, Human
ucauuagacuggaacuugaa

SEQ ID NO: 1486808 - RNA, 14 nt, Human
ucauuguagaaaag

SEQ ID NO: 1486809 - RNA, 23 nt, Human
ucauugucugugaagugagaccu

SEQ ID NO: 1486810 - RNA, 12 nt, Human
uccaaaccacuu

SEQ ID NO: 1486811 - RNA, 22 nt, Human
uccaaaccacuuuuugcagcuu

SEQ ID NO: 1486812 - RNA, 12 nt, Human
uccaaacuaauu

SEQ ID NO: 1486813 - RNA, 16 nt, Human
uccaaacuaauuuuua

SEQ ID NO: 1486814 - RNA, 14 nt, Human
uccaaacaggcuca

SEQ ID NO: 1486815 - RNA, 17 nt, Human
uccaaaaauguguaaga

SEQ ID NO: 1486816 - RNA, 21 nt, Human
uccaaaaauguguaagaacaa

SEQ ID NO: 1486817 - RNA, 20 nt, Human
ucagucucuauaccaauaaa

SEQ ID NO: 1486818 - RNA, 21 nt, Human
ucagucucuauaccaauaaag

SEQ ID NO: 1486819 - RNA, 18 nt, Human
ucagucucuauaccaaua

SEQ ID NO: 1486820 - RNA, 15 nt, Human
ucagucucuauacca

SEQ ID NO: 1486821 - RNA, 18 nt, Human
ucagucucagaaugucau

SEQ ID NO: 1486822 - RNA, 19 nt, Human
ucagucucagaaugucauu

SEQ ID NO: 1486823 - RNA, 13 nt, Human
ucaggcuagaugu

SEQ ID NO: 1486824 - RNA, 17 nt, Human
ucagguauuaagaaaau

SEQ ID NO: 1486825 - RNA, 15 nt, Human
ucagguauuaagaaa

SEQ ID NO: 1486826 - RNA, 16 nt, Human
ucagguccucagagaa

SEQ ID NO: 1486827 - RNA, 15 nt, Human
ucaggagcccuggga

SEQ ID NO: 1486828 - RNA, 14 nt, Human
ucaggagcccuggg

SEQ ID NO: 1486829 - RNA, 12 nt, Human
ucaggagcccug

SEQ ID NO: 1486830 - RNA, 11 nt, Human
ucaggagcccu

SEQ ID NO: 1486831 - RNA, 19 nt, Human
ucaggaaucggaauccugu

SEQ ID NO: 1486832 - RNA, 18 nt, Human
ucaggaugagggaaaaga

SEQ ID NO: 1486833 - RNA, 19 nt, Human
ucaggaugagggaaaagaa

SEQ ID NO: 1486834 - RNA, 18 nt, Human
ucaggccuuugagcucag

SEQ ID NO: 1486835 - RNA, 17 nt, Human
ucaggccuagaggccug

SEQ ID NO: 1486836 - RNA, 18 nt, Human
ucaccggggugguuuagu

SEQ ID NO: 1486837 - RNA, 14 nt, Human
ucagcucugaaaga

SEQ ID NO: 1486838 - RNA, 16 nt, Human
ucagcucugaaagaga

SEQ ID NO: 1486839 - RNA, 18 nt, Human
ucagcucugaaagagaaa

SEQ ID NO: 1486840 - RNA, 21 nt, Human
ucagcucugaaagagaaacac

SEQ ID NO: 1486841 - RNA, 16 nt, Human
ucagcucugacauucu

SEQ ID NO: 1486842 - RNA, 22 nt, Human
ucagcucugacauucugauucg

SEQ ID NO: 1486843 - RNA, 22 nt, Human
ucagcucuucuccauccuacca

SEQ ID NO: 1486844 - RNA, 16 nt, Human
uaugauucccagccag

SEQ ID NO: 1486845 - RNA, 16 nt, Human
uaugauucaaaugucu

SEQ ID NO: 1486846 - RNA, 21 nt, Human
uaugauucaaaugucuauaaa

SEQ ID NO: 1486847 - RNA, 14 nt, Human
uaugagcucuucau

SEQ ID NO: 1486848 - RNA, 15 nt, Human
uaugagcucuucaug

SEQ ID NO: 1486849 - RNA, 16 nt, Human
uaugagcucuucaugu

SEQ ID NO: 1486850 - RNA, 18 nt, Human
uaugacuauguaaacuac

SEQ ID NO: 1486851 - RNA, 17 nt, Human
uaugacuauguaaacua

SEQ ID NO: 1486852 - RNA, 16 nt, Human
uaugacuauguaaacu

SEQ ID NO: 1486853 - RNA, 14 nt, Human
uaugcacaguaaaa

SEQ ID NO: 1486854 - RNA, 16 nt, Human
uaugcaauuuccuuuu

SEQ ID NO: 1486855 - RNA, 19 nt, Human
uaugauuuuuuuuucauac

SEQ ID NO: 1486856 - RNA, 17 nt, Human
uaugauuuuuuuuucau

SEQ ID NO: 1486857 - RNA, 20 nt, Human
uaugcauauuauuuuauguu

SEQ ID NO: 1486858 - RNA, 15 nt, Human
uaugcuucuguuuua

SEQ ID NO: 1486859 - RNA, 16 nt, Human
uaugcuucuguuuuau

SEQ ID NO: 1486860 - RNA, 17 nt, Human
uauggaaauaaauguau

SEQ ID NO: 1486861 - RNA, 16 nt, Human
uaugcuugcaaaaacu

SEQ ID NO: 1486862 - RNA, 15 nt, Human
uaugcuuugaaacag

SEQ ID NO: 1486863 - RNA, 16 nt, Human
uauggaaauaaaugua

SEQ ID NO: 1486864 - RNA, 20 nt, Human
uaugaaguuuuuuuuauaca

SEQ ID NO: 1486865 - RNA, 14 nt, Human
uaucuucacuuguc

SEQ ID NO: 1486866 - RNA, 18 nt, Human
uaucuuacuauuucacaa

SEQ ID NO: 1486867 - RNA, 17 nt, Human
uaucuuacuauuucaca

SEQ ID NO: 1486868 - RNA, 18 nt, Human
uaucugggcugugggcaa

SEQ ID NO: 1486869 - RNA, 17 nt, Human
uaugaauuacauuugua

SEQ ID NO: 1486870 - RNA, 23 nt, Human
uaugaauuacauuuguauaaaau

SEQ ID NO: 1486871 - RNA, 18 nt, Human
uaugaauugaauuaucuu

SEQ ID NO: 1486872 - RNA, 20 nt, Human
uaugacaucacuuguacaaa

SEQ ID NO: 1486873 - RNA, 23 nt, Human
uaugacaucacuuguacaaaaua

SEQ ID NO: 1486874 - RNA, 24 nt, Human
uaugacaucacuuguacaaaauaa

SEQ ID NO: 1486875 - RNA, 19 nt, Human
uaugacaucacuuguacaa

SEQ ID NO: 1486876 - RNA, 18 nt, Human
uaucguaaaauuaagaaa

SEQ ID NO: 1486877 - RNA, 15 nt, Human
uaucguaaaauuaag

SEQ ID NO: 1486878 - RNA, 14 nt, Human
uauccugaaauuuc

SEQ ID NO: 1486879 - RNA, 16 nt, Human
uauccugaaauuucag

SEQ ID NO: 1486880 - RNA, 17 nt, Human
uauccugaaauuucaga

SEQ ID NO: 1486881 - RNA, 21 nt, Human
uaucugaggcacaugucagca

SEQ ID NO: 1486882 - RNA, 23 nt, Human
uaucugaguuacagaaaugauua

SEQ ID NO: 1486883 - RNA, 23 nt, Human
uaucugggaagcuauuuuuuuca

SEQ ID NO: 1486884 - RNA, 22 nt, Human
uaucuaaguuaauuuaaaguug

SEQ ID NO: 1486885 - RNA, 13 nt, Human
uaucuaaucauga

SEQ ID NO: 1486886 - RNA, 13 nt, Human
uaucuaauuuaua

SEQ ID NO: 1486887 - RNA, 23 nt, Human
uaucuaaguuaauuuaaaguugu

SEQ ID NO: 1486888 - RNA, 19 nt, Human
uaucuaaguuaauuuaaag

SEQ ID NO: 1486889 - RNA, 20 nt, Human
uaucuaaguuaauuuaaagu

SEQ ID NO: 1486890 - RNA, 15 nt, Human
uaggucucaauaccu

SEQ ID NO: 1486891 - RNA, 16 nt, Human
uaggucagugcaaaua

SEQ ID NO: 1486892 - RNA, 14 nt, Human
uagguaggaaaugu

SEQ ID NO: 1486893 - RNA, 14 nt, Human
uagguacacagcuc

SEQ ID NO: 1486894 - RNA, 16 nt, Human
uaggcuagggugggga

SEQ ID NO: 1486895 - RNA, 20 nt, Human
uaggccuugcggcuccucag

SEQ ID NO: 1486896 - RNA, 15 nt, Human
uaggcuagggugggg

SEQ ID NO: 1486897 - RNA, 19 nt, Human
uaggacacaguuccuggga

SEQ ID NO: 1486898 - RNA, 20 nt, Human
uaguugcaacuuuguauaaa

SEQ ID NO: 1486899 - RNA, 13 nt, Human
uaguguucauaaa

SEQ ID NO: 1486900 - RNA, 13 nt, Human
uagucaaauugug

SEQ ID NO: 1486901 - RNA, 14 nt, Human
uagucaaauugugu

SEQ ID NO: 1486902 - RNA, 14 nt, Human
uagugcaaauuguc

SEQ ID NO: 1486903 - RNA, 15 nt, Human
uagugcaaauuguca

SEQ ID NO: 1486904 - RNA, 18 nt, Human
uaguauuucuaugaaaua

SEQ ID NO: 1486905 - RNA, 19 nt, Human
uaguauuucuaugaaauau

SEQ ID NO: 1486906 - RNA, 16 nt, Human
uaguauuucuaugaaa

SEQ ID NO: 1486907 - RNA, 18 nt, Human
uaguaucaucagauagca

SEQ ID NO: 1486908 - RNA, 20 nt, Human
uauaauucacauuguauuca

SEQ ID NO: 1486909 - RNA, 15 nt, Human
uauaauucacauugu

SEQ ID NO: 1486910 - RNA, 23 nt, Human
uauaaucauuauuacuuuugcug

SEQ ID NO: 1486911 - RNA, 17 nt, Human
uauaaucauuauuacuu

SEQ ID NO: 1486912 - RNA, 22 nt, Human
uauaauaaaggacuguaaucuu

SEQ ID NO: 1486913 - RNA, 19 nt, Human
uauaauaaaggacuguaau

SEQ ID NO: 1486914 - RNA, 14 nt, Human
uauaauaaaggacu

SEQ ID NO: 1486915 - RNA, 17 nt, Human
uaguugccuuaaaauaa

SEQ ID NO: 1486916 - RNA, 17 nt, Human
uauacugcauacuuuuu

SEQ ID NO: 1486917 - RNA, 23 nt, Human
uauacugcuuggagcugagcaaa

SEQ ID NO: 1486918 - RNA, 12 nt, Human
uauacugcauac

SEQ ID NO: 1486919 - RNA, 16 nt, Human
uauacugcauacuuuu

SEQ ID NO: 1486920 - RNA, 22 nt, Human
uauaguuauuaaguucuuuaaa

SEQ ID NO: 1486921 - RNA, 21 nt, Human
uauaguucaugucugcuauca

SEQ ID NO: 1486922 - RNA, 15 nt, Human
uauaguuuuacuuuu

SEQ ID NO: 1486923 - RNA, 13 nt, Human
uauauaacaaugc

SEQ ID NO: 1486924 - RNA, 16 nt, Human
uauaguuuuacuuuua

SEQ ID NO: 1486925 - RNA, 17 nt, Human
uauaguuuuacuuuuaa

SEQ ID NO: 1486926 - RNA, 14 nt, Human
uauauguguaugca

SEQ ID NO: 1486927 - RNA, 13 nt, Human
uauaugcuucugu

SEQ ID NO: 1486928 - RNA, 21 nt, Human
uauaugcuuacugauauauuu

SEQ ID NO: 1486929 - RNA, 16 nt, Human
uauaugcuuacugaua

SEQ ID NO: 1486930 - RNA, 17 nt, Human
uauaugcuuacugauau

SEQ ID NO: 1486931 - RNA, 14 nt, Human
uauaugcuuacuga

SEQ ID NO: 1486932 - RNA, 14 nt, Human
uauuucuaugaaau

SEQ ID NO: 1486933 - RNA, 15 nt, Human
uauuucuaugaaaua

SEQ ID NO: 1486934 - RNA, 16 nt, Human
uauuugaaccaauaaa

SEQ ID NO: 1486935 - RNA, 14 nt, Human
uauuugaacuuuuu

SEQ ID NO: 1486936 - RNA, 13 nt, Human
uauuucuaugaaa

SEQ ID NO: 1486937 - RNA, 14 nt, Human
uauuuauuacugua

SEQ ID NO: 1486938 - RNA, 12 nt, Human
uauuuaucuuua

SEQ ID NO: 1486939 - RNA, 15 nt, Human
uauuuaacaagaucu

SEQ ID NO: 1486940 - RNA, 17 nt, Human
uauugugcaauguaaau

SEQ ID NO: 1486941 - RNA, 19 nt, Human
uauugugcaauguaaauau

SEQ ID NO: 1486942 - RNA, 17 nt, Human
uauugcauuuauaugua

SEQ ID NO: 1486943 - RNA, 13 nt, Human
uauugcauuuaua

SEQ ID NO: 1486944 - RNA, 17 nt, Human
uauuccaagacaugucu

SEQ ID NO: 1486945 - RNA, 15 nt, Human
uauucauuuucucua

SEQ ID NO: 1486946 - RNA, 17 nt, Human
uauugauaagaucuuuu

SEQ ID NO: 1486947 - RNA, 18 nt, Human
uauugauaagaucuuuua

SEQ ID NO: 1486948 - RNA, 19 nt, Human
uauugauaagaucuuuuau

SEQ ID NO: 1486949 - RNA, 23 nt, Human
uauugauaagaucuuuuauuuug

SEQ ID NO: 1486950 - RNA, 14 nt, Human
uauucauuuucucu

SEQ ID NO: 1486951 - RNA, 16 nt, Human
uauucauuuucucuaa

SEQ ID NO: 1486952 - RNA, 12 nt, Human
uauuaucuuuuc

SEQ ID NO: 1486953 - RNA, 16 nt, Human
uauuauccccauuucu

SEQ ID NO: 1486954 - RNA, 14 nt, Human
uauuaucuuuucau

SEQ ID NO: 1486955 - RNA, 19 nt, Human
uauuaucuuuucauacauu

SEQ ID NO: 1486956 - RNA, 14 nt, Human
uauuaugagaugcu

SEQ ID NO: 1486957 - RNA, 15 nt, Human
uauuaugagaugcug

SEQ ID NO: 1486958 - RNA, 17 nt, Human
uauuaugagaugcuggc

SEQ ID NO: 1486959 - RNA, 19 nt, Human
uauuaugcauuauaucaaa

SEQ ID NO: 1486960 - RNA, 20 nt, Human
uauuauggaggcaggaguuu

SEQ ID NO: 1486961 - RNA, 17 nt, Human
uauuaugucucuucuga

SEQ ID NO: 1486962 - RNA, 16 nt, Human
uauuauguuaaaacug

SEQ ID NO: 1486963 - RNA, 21 nt, Human
uauuaugucucuucugagcua

SEQ ID NO: 1486964 - RNA, 16 nt, Human
uauuaagguguggcuu

SEQ ID NO: 1486965 - RNA, 19 nt, Human
uauuaauaaacauucuauc

SEQ ID NO: 1486966 - RNA, 17 nt, Human
uauuauauuuacaaaug

SEQ ID NO: 1486967 - RNA, 13 nt, Human
uauguguguuuua

SEQ ID NO: 1486968 - RNA, 14 nt, Human
uauggaggcaggag

SEQ ID NO: 1486969 - RNA, 12 nt, Human
uauguuaaaacu

SEQ ID NO: 1486970 - RNA, 19 nt, Human
uauguuagugcaaauuguc

SEQ ID NO: 1486971 - RNA, 19 nt, Human
uauguuaagggaagaauuc

SEQ ID NO: 1486972 - RNA, 18 nt, Human
uauguuacuacaugcacu

SEQ ID NO: 1486973 - RNA, 16 nt, Human
uauguucagauuauug

SEQ ID NO: 1486974 - RNA, 22 nt, Human
uauguuguaauauuucuucaaa

SEQ ID NO: 1486975 - RNA, 13 nt, Human
uauuaacauaccu

SEQ ID NO: 1486976 - RNA, 20 nt, Human
ucaaaccaaaucacugaacu

SEQ ID NO: 1486977 - RNA, 19 nt, Human
ucaaacugaggaauuucac

SEQ ID NO: 1486978 - RNA, 17 nt, Human
ucaaacauauauaacaa

SEQ ID NO: 1486979 - RNA, 16 nt, Human
ucaaauccuugaagau

SEQ ID NO: 1486980 - RNA, 20 nt, Human
ucaaaucuaccacuguauga

SEQ ID NO: 1486981 - RNA, 15 nt, Human
ucaaaucuaccacug

SEQ ID NO: 1486982 - RNA, 22 nt, Human
ucaacuccaaacugacucuuaa

SEQ ID NO: 1486983 - RNA, 20 nt, Human
ucaacucucuuauugccuca

SEQ ID NO: 1486984 - RNA, 21 nt, Human
ucaacucucuuauugccucac

SEQ ID NO: 1486985 - RNA, 23 nt, Human
ucaacucucuuauugccucacuu

SEQ ID NO: 1486986 - RNA, 24 nt, Human
ucaacucucuuauugccucacuuc

SEQ ID NO: 1486987 - RNA, 16 nt, Human
ucaaccccuccccucc

SEQ ID NO: 1486988 - RNA, 19 nt, Human
ucaaccccuccccuccauc

SEQ ID NO: 1486989 - RNA, 21 nt, Human
ucaaccccuccccuccauccc

SEQ ID NO: 1486990 - RNA, 23 nt, Human
ucaaccccuccccuccaucccug

SEQ ID NO: 1486991 - RNA, 23 nt, Human
ucaauuaaaauagucucuuuaaa

SEQ ID NO: 1486992 - RNA, 15 nt, Human
ucaauguuuucaguu

SEQ ID NO: 1486993 - RNA, 14 nt, Human
ucaauaaaauccau

SEQ ID NO: 1486994 - RNA, 15 nt, Human
ucaauucaaagcugu

SEQ ID NO: 1486995 - RNA, 17 nt, Human
ucaauucaaagcugugu

SEQ ID NO: 1486996 - RNA, 22 nt, Human
ucaauucaaagcuguguguuug

SEQ ID NO: 1486997 - RNA, 14 nt, Human
ucacauuggaaaca

SEQ ID NO: 1486998 - RNA, 23 nt, Human
ucacagguagacaguauauaacu

SEQ ID NO: 1486999 - RNA, 23 nt, Human
ucacaccaggcuugccugcaggc

SEQ ID NO: 1487000 - RNA, 21 nt, Human
ucacaccaggcuugccugcag

SEQ ID NO: 1487001 - RNA, 22 nt, Human
ucacaccaggcuugccugcagg

SEQ ID NO: 1487002 - RNA, 12 nt, Human
ucacauuuaaau

SEQ ID NO: 1487003 - RNA, 22 nt, Human
ucacauuguauucagaguugau

SEQ ID NO: 1487004 - RNA, 17 nt, Human
ucacauuggaaacaagu

SEQ ID NO: 1487005 - RNA, 19 nt, Human
ucaccagagacuuuagggg

SEQ ID NO: 1487006 - RNA, 15 nt, Human
ucaccagagacuuua

SEQ ID NO: 1487007 - RNA, 14 nt, Human
ucaccagagacuuu

SEQ ID NO: 1487008 - RNA, 15 nt, Human
ucaccccuguuucug

SEQ ID NO: 1487009 - RNA, 22 nt, Human
ucaccgacugaaaauauuguuu

SEQ ID NO: 1487010 - RNA, 15 nt, Human
ucacccuaccugugc

SEQ ID NO: 1487011 - RNA, 17 nt, Human
ucacccuaccugugccu

SEQ ID NO: 1487012 - RNA, 19 nt, Human
guggcaucaucucagcuca

SEQ ID NO: 1487013 - RNA, 14 nt, Human
guggcauccagagu

SEQ ID NO: 1487014 - RNA, 18 nt, Human
guggcucgggaggcgaag

SEQ ID NO: 1487015 - RNA, 16 nt, Human
guggcucgggaggcga

SEQ ID NO: 1487016 - RNA, 12 nt, Human
guggccaggagg

SEQ ID NO: 1487017 - RNA, 13 nt, Human
guggccaggaggu

SEQ ID NO: 1487018 - RNA, 10 nt, Human
guggccaggc

SEQ ID NO: 1487019 - RNA, 23 nt, Human
guggccaggccgggaaaaagccc

SEQ ID NO: 1487020 - RNA, 11 nt, Human
guggcagucug

SEQ ID NO: 1487021 - RNA, 21 nt, Human
guggaacauaaaaaggacauc

SEQ ID NO: 1487022 - RNA, 20 nt, Human
guggaacauaaaaaggacau

SEQ ID NO: 1487023 - RNA, 19 nt, Human
guggaacauaaaaaggaca

SEQ ID NO: 1487024 - RNA, 20 nt, Human
guggaaauuaagacuuuaug

SEQ ID NO: 1487025 - RNA, 23 nt, Human
guggaacuacauuaguacacagc

SEQ ID NO: 1487026 - RNA, 12 nt, Human
guggagagggaa

SEQ ID NO: 1487027 - RNA, 14 nt, Human
guggagagggaaug

SEQ ID NO: 1487028 - RNA, 15 nt, Human
guggagagggaaugu

SEQ ID NO: 1487029 - RNA, 18 nt, Human
guggagagggaaugugaa

SEQ ID NO: 1487030 - RNA, 23 nt, Human
guggaugauccccacgccacagc

SEQ ID NO: 1487031 - RNA, 19 nt, Human
gugccuugucacgccagac

SEQ ID NO: 1487032 - RNA, 23 nt, Human
gugcuuucuucucccaauucauc

SEQ ID NO: 1487033 - RNA, 15 nt, Human
gugcuuuuaaaugca

SEQ ID NO: 1487034 - RNA, 18 nt, Human
gugcuugauagaaaugcc

SEQ ID NO: 1487035 - RNA, 14 nt, Human
gugcuugagccagg

SEQ ID NO: 1487036 - RNA, 20 nt, Human
gugcuucuaguucugccagg

SEQ ID NO: 1487037 - RNA, 21 nt, Human
gugcuucuaguucugccagga

SEQ ID NO: 1487038 - RNA, 22 nt, Human
gugcuucuaguucugccaggag

SEQ ID NO: 1487039 - RNA, 16 nt, Human
gugcuuaugguaccag

SEQ ID NO: 1487040 - RNA, 24 nt, Human
gugcaguggcgcgaucucagcuca

SEQ ID NO: 1487041 - RNA, 18 nt, Human
gugcaaauugucacagga

SEQ ID NO: 1487042 - RNA, 23 nt, Human
gugcagggccuguaaucccagca

SEQ ID NO: 1487043 - RNA, 15 nt, Human
gugcaguacuuugug

SEQ ID NO: 1487044 - RNA, 24 nt, Human
gugcaguggcaucaucucagcuca

SEQ ID NO: 1487045 - RNA, 22 nt, Human
gugcccccaaccauuuccucag

SEQ ID NO: 1487046 - RNA, 21 nt, Human
gugaucccuagcugugaccuc

SEQ ID NO: 1487047 - RNA, 22 nt, Human
gugaucccuagcugugaccucu

SEQ ID NO: 1487048 - RNA, 13 nt, Human
gugauucugccuu

SEQ ID NO: 1487049 - RNA, 16 nt, Human
gugauuuuuaugccac

SEQ ID NO: 1487050 - RNA, 17 nt, Human
gugauuuuuaugccacc

SEQ ID NO: 1487051 - RNA, 19 nt, Human
gugauuuuuaugccaccug

SEQ ID NO: 1487052 - RNA, 20 nt, Human
gugauuuuuaugccaccuga

SEQ ID NO: 1487053 - RNA, 15 nt, Human
gugauuccgcaguga

SEQ ID NO: 1487054 - RNA, 16 nt, Human
gugacaagcucacaga

SEQ ID NO: 1487055 - RNA, 17 nt, Human
gugaauuuuuuuuuccu

SEQ ID NO: 1487056 - RNA, 13 nt, Human
gugacaaaaaauu

SEQ ID NO: 1487057 - RNA, 20 nt, Human
gugacaaaaaauuaaagcau

SEQ ID NO: 1487058 - RNA, 12 nt, Human
gugacucuuucc

SEQ ID NO: 1487059 - RNA, 16 nt, Human
gugagcagucaggaaa

SEQ ID NO: 1487060 - RNA, 13 nt, Human
gugagcauguuug

SEQ ID NO: 1487061 - RNA, 19 nt, Human
gugagcauguuuggaaggg

SEQ ID NO: 1487062 - RNA, 13 nt, Human
gugaaucaagggu

SEQ ID NO: 1487063 - RNA, 15 nt, Human
gugaaucaaggguca

SEQ ID NO: 1487064 - RNA, 17 nt, Human
gugaaucaagggucagg

SEQ ID NO: 1487065 - RNA, 21 nt, Human
gugaaucaagggucaggccuu

SEQ ID NO: 1487066 - RNA, 20 nt, Human
gugaaauuauucauaauuau

SEQ ID NO: 1487067 - RNA, 18 nt, Human
gugaaauuauucauaauu

SEQ ID NO: 1487068 - RNA, 22 nt, Human
gugaaauuuacaucauuucuuu

SEQ ID NO: 1487069 - RNA, 20 nt, Human
gugaaauuuacaucauuucu

SEQ ID NO: 1487070 - RNA, 13 nt, Human
gugaaaucauuca

SEQ ID NO: 1487071 - RNA, 22 nt, Human
gugaaauaccaaccugaagaca

SEQ ID NO: 1487072 - RNA, 13 nt, Human
gugaaagaaguaa

SEQ ID NO: 1487073 - RNA, 19 nt, Human
gugaaagaaaauaacaaua

SEQ ID NO: 1487074 - RNA, 20 nt, Human
gugaaacucguuaauuugua

SEQ ID NO: 1487075 - RNA, 18 nt, Human
gugaaacauuuucucccu

SEQ ID NO: 1487076 - RNA, 15 nt, Human
gugaaacauuuucuc

SEQ ID NO: 1487077 - RNA, 19 nt, Human
gugaaacauuuucucccug

SEQ ID NO: 1487078 - RNA, 17 nt, Human
gucuacacuaagagaga

SEQ ID NO: 1487079 - RNA, 23 nt, Human
gucuacacuaagagagaaugaga

SEQ ID NO: 1487080 - RNA, 13 nt, Human
gucugacuguuuc

SEQ ID NO: 1487081 - RNA, 21 nt, Human
gucucuauaccaauaaaguga

SEQ ID NO: 1487082 - RNA, 16 nt, Human
gucucucaugaaccuc

SEQ ID NO: 1487083 - RNA, 15 nt, Human
gucucucaugaaccu

SEQ ID NO: 1487084 - RNA, 20 nt, Human
gucccuggguagcgggggag

SEQ ID NO: 1487085 - RNA, 20 nt, Human
gucccugccuggaccagccu

SEQ ID NO: 1487086 - RNA, 21 nt, Human
gucccugccuggaccagccuc

SEQ ID NO: 1487087 - RNA, 14 nt, Human
gucccugccuggac

SEQ ID NO: 1487088 - RNA, 22 nt, Human
gucccugccuggaccagccucu

SEQ ID NO: 1487089 - RNA, 23 nt, Human
gucccugccuggaccagccucuc

SEQ ID NO: 1487090 - RNA, 12 nt, Human
guccucagcccc

SEQ ID NO: 1487091 - RNA, 20 nt, Human
guccucagagaauuucuacc

SEQ ID NO: 1487092 - RNA, 19 nt, Human
gucacguuuggugcuucuc

SEQ ID NO: 1487093 - RNA, 21 nt, Human
gucagcaaguccuaagccugu

SEQ ID NO: 1487094 - RNA, 20 nt, Human
gucagcagccucccugaaga

SEQ ID NO: 1487095 - RNA, 14 nt, Human
gucacgccagacuu

SEQ ID NO: 1487096 - RNA, 21 nt, Human
gucaccucagagacauacacc

SEQ ID NO: 1487097 - RNA, 23 nt, Human
gucagcagccucccugaagacca

SEQ ID NO: 1487098 - RNA, 13 nt, Human
gucauagaaauua

SEQ ID NO: 1487099 - RNA, 22 nt, Human
gucauagaaauuacacccaaag

SEQ ID NO: 1487100 - RNA, 23 nt, Human
gucaucaauuaaaggcaaaggca

SEQ ID NO: 1487101 - RNA, 14 nt, Human
gucauguguauaaa

SEQ ID NO: 1487102 - RNA, 15 nt, Human
gucauguuuaagaaa

SEQ ID NO: 1487103 - RNA, 20 nt, Human
gucauguaagcugaaaauau

SEQ ID NO: 1487104 - RNA, 15 nt, Human
gucaugugacaggua

SEQ ID NO: 1487105 - RNA, 12 nt, Human
gucauguguaua

SEQ ID NO: 1487106 - RNA, 13 nt, Human
gucauguguauaa

SEQ ID NO: 1487107 - RNA, 13 nt, Human
guccaggagccug

SEQ ID NO: 1487108 - RNA, 22 nt, Human
gucccagaaaaagcaucauggc

SEQ ID NO: 1487109 - RNA, 16 nt, Human
guauucguuaucuaau

SEQ ID NO: 1487110 - RNA, 19 nt, Human
guauuccagaccugaagaa

SEQ ID NO: 1487111 - RNA, 17 nt, Human
guauuucuaugaaauau

SEQ ID NO: 1487112 - RNA, 22 nt, Human
guauuucuaugaaauauuaugu

SEQ ID NO: 1487113 - RNA, 15 nt, Human
guauuugaaucagcc

SEQ ID NO: 1487114 - RNA, 20 nt, Human
guauuacaguggggaaugaa

SEQ ID NO: 1487115 - RNA, 22 nt, Human
guauuacaguggggaaugaaga

SEQ ID NO: 1487116 - RNA, 19 nt, Human
guauucaaaaauuaucuau

SEQ ID NO: 1487117 - RNA, 16 nt, Human
guauuaugucucuucu

SEQ ID NO: 1487118 - RNA, 15 nt, Human
guauuauguguguuu

SEQ ID NO: 1487119 - RNA, 14 nt, Human
gucaccucauggaa

SEQ ID NO: 1487120 - RNA, 16 nt, Human
gucaccucagagacau

SEQ ID NO: 1487121 - RNA, 20 nt, Human
gucacccagguuggagugca

SEQ ID NO: 1487122 - RNA, 20 nt, Human
gucacccaggcuggacugca

SEQ ID NO: 1487123 - RNA, 15 nt, Human
gucaauaaaauccau

SEQ ID NO: 1487124 - RNA, 21 nt, Human
gucaauaaaauccauacauuu

SEQ ID NO: 1487125 - RNA, 15 nt, Human
gucaauguuuucagu

SEQ ID NO: 1487126 - RNA, 16 nt, Human
guauuuuaaaagaaug

SEQ ID NO: 1487127 - RNA, 17 nt, Human
guauuuuaaaagaauga

SEQ ID NO: 1487128 - RNA, 17 nt, Human
guauuuguuaauuuaga

SEQ ID NO: 1487129 - RNA, 18 nt, Human
guauuuguuaauuuagaa

SEQ ID NO: 1487130 - RNA, 23 nt, Human
guauuuguuaauuuagaaaacuu

SEQ ID NO: 1487131 - RNA, 18 nt, Human
guauuuuaaaagaaugau

SEQ ID NO: 1487132 - RNA, 22 nt, Human
guauuuguuaauuuagaaaacu

SEQ ID NO: 1487133 - RNA, 16 nt, Human
ggggcagagccaggaa

SEQ ID NO: 1487134 - RNA, 15 nt, Human
ggggcagagccagga

SEQ ID NO: 1487135 - RNA, 14 nt, Human
ggggcagagccagg

SEQ ID NO: 1487136 - RNA, 13 nt, Human
ggggcagagccag

SEQ ID NO: 1487137 - RNA, 18 nt, Human
ggggaguuuagggugggg

SEQ ID NO: 1487138 - RNA, 22 nt, Human
ggggaguaaagaauuauuuugu

SEQ ID NO: 1487139 - RNA, 17 nt, Human
gggcuucagguccaggc

SEQ ID NO: 1487140 - RNA, 20 nt, Human
ggggcuuauaauaaaggacu

SEQ ID NO: 1487141 - RNA, 16 nt, Human
gggccuuuggcaggug

SEQ ID NO: 1487142 - RNA, 13 nt, Human
gggccuugggcuc

SEQ ID NO: 1487143 - RNA, 14 nt, Human
gggccuugggcucc

SEQ ID NO: 1487144 - RNA, 24 nt, Human
gggccuugggcuccgugugggaga

SEQ ID NO: 1487145 - RNA, 12 nt, Human
gggcgcaggccg

SEQ ID NO: 1487146 - RNA, 14 nt, Human
gggcgcggcuggga

SEQ ID NO: 1487147 - RNA, 11 nt, Human
gggcccggacg

SEQ ID NO: 1487148 - RNA, 12 nt, Human
gggcccggacgc

SEQ ID NO: 1487149 - RNA, 20 nt, Human
gggcuuauaauaaaggacug

SEQ ID NO: 1487150 - RNA, 23 nt, Human
gggcuccuccaggguggcagcaa

SEQ ID NO: 1487151 - RNA, 22 nt, Human
gggcuccuccaggguggcagca

SEQ ID NO: 1487152 - RNA, 17 nt, Human
gggcuccgugugggaga

SEQ ID NO: 1487153 - RNA, 18 nt, Human
gggcuccgugugggagac

SEQ ID NO: 1487154 - RNA, 19 nt, Human
gggugcugggccccugccu

SEQ ID NO: 1487155 - RNA, 16 nt, Human
ggguagcgggggaggg

SEQ ID NO: 1487156 - RNA, 22 nt, Human
gguacuucaaauccuugaagau

SEQ ID NO: 1487157 - RNA, 20 nt, Human
ggguuucaccauguuggcca

SEQ ID NO: 1487158 - RNA, 20 nt, Human
ggguuucaccauguuagcca

SEQ ID NO: 1487159 - RNA, 15 nt, Human
ggguugugugucugu

SEQ ID NO: 1487160 - RNA, 15 nt, Human
gguagacacacauga

SEQ ID NO: 1487161 - RNA, 20 nt, Human
gguagaaagagauacagagg

SEQ ID NO: 1487162 - RNA, 19 nt, Human
gguagaauguaaagcuugu

SEQ ID NO: 1487163 - RNA, 22 nt, Human
gguagacacacaugaaguccaa

SEQ ID NO: 1487164 - RNA, 15 nt, Human
gguagaauguaaagc

SEQ ID NO: 1487165 - RNA, 21 nt, Human
ggucagcaugucuauucagcu

SEQ ID NO: 1487166 - RNA, 11 nt, Human
ggucccugggu

SEQ ID NO: 1487167 - RNA, 20 nt, Human
ggucccuggguagcggggga

SEQ ID NO: 1487168 - RNA, 17 nt, Human
ggucccuaauaaagcug

SEQ ID NO: 1487169 - RNA, 16 nt, Human
ggucccuaauaaagcu

SEQ ID NO: 1487170 - RNA, 13 nt, Human
ggucccuaauaaa

SEQ ID NO: 1487171 - RNA, 12 nt, Human
ggucccuaauaa

SEQ ID NO: 1487172 - RNA, 18 nt, Human
ggucccuaauaaagcugu

SEQ ID NO: 1487173 - RNA, 21 nt, Human
ggugaagcucacuucugggcu

SEQ ID NO: 1487174 - RNA, 21 nt, Human
ggucucccuucucuacacucu

SEQ ID NO: 1487175 - RNA, 20 nt, Human
ggucucccuucucuacacuc

SEQ ID NO: 1487176 - RNA, 21 nt, Human
guaaaucacgcuuuuugaaaa

SEQ ID NO: 1487177 - RNA, 14 nt, Human
guaaauauuuuaaa

SEQ ID NO: 1487178 - RNA, 13 nt, Human
guaaauauuuuaa

SEQ ID NO: 1487179 - RNA, 23 nt, Human
guaaauauuuuaaagaauugugu

SEQ ID NO: 1487180 - RNA, 16 nt, Human
guaaaauaaaaggucg

SEQ ID NO: 1487181 - RNA, 19 nt, Human
guaaaagcaaaaaagaaaa

SEQ ID NO: 1487182 - RNA, 17 nt, Human
guaaaagguauuaaauu

SEQ ID NO: 1487183 - RNA, 23 nt, Human
guaagcauaagcuuaugcuuaaa

SEQ ID NO: 1487184 - RNA, 14 nt, Human
guaacuuuuguaag

SEQ ID NO: 1487185 - RNA, 15 nt, Human
guaacuuuuguaaga

SEQ ID NO: 1487186 - RNA, 17 nt, Human
guaacuuuuguaagaca

SEQ ID NO: 1487187 - RNA, 20 nt, Human
guaagaaaccuacugcccag

SEQ ID NO: 1487188 - RNA, 23 nt, Human
guaagaacaacuaccugagcuaa

SEQ ID NO: 1487189 - RNA, 18 nt, Human
guaagaacaacuaccuga

SEQ ID NO: 1487190 - RNA, 15 nt, Human
guaagacaaagguuu

SEQ ID NO: 1487191 - RNA, 15 nt, Human
guaagagcaaaagaa

SEQ ID NO: 1487192 - RNA, 13 nt, Human
guaagauuuccuu

SEQ ID NO: 1487193 - RNA, 18 nt, Human
guaagauuuccuucuuuu

SEQ ID NO: 1487194 - RNA, 20 nt, Human
guaaaaacaaagaaauuaug

SEQ ID NO: 1487195 - RNA, 18 nt, Human
guaaaaacaaagaaauua

SEQ ID NO: 1487196 - RNA, 17 nt, Human
guaaaaauggaaacuau

SEQ ID NO: 1487197 - RNA, 15 nt, Human
guaaaaaugauuuca

SEQ ID NO: 1487198 - RNA, 11 nt, Human
guaaaacauuu

SEQ ID NO: 1487199 - RNA, 18 nt, Human
guaaaacauuuauuuuga

SEQ ID NO: 1487200 - RNA, 20 nt, Human
guaaaaccuggagauggugg

SEQ ID NO: 1487201 - RNA, 20 nt, Human
guaaaacagggccacauaga

SEQ ID NO: 1487202 - RNA, 17 nt, Human
guaaaacagggccacau

SEQ ID NO: 1487203 - RNA, 12 nt, Human
guaaaagcaaaa

SEQ ID NO: 1487204 - RNA, 18 nt, Human
guaaaagcaaaaaagaaa

SEQ ID NO: 1487205 - RNA, 20 nt, Human
guaaaacauuuauuuugaca

SEQ ID NO: 1487206 - RNA, 20 nt, Human
gguuuucacauuggaaacaa

SEQ ID NO: 1487207 - RNA, 19 nt, Human
gguuuaauguuuuggccaa

SEQ ID NO: 1487208 - RNA, 13 nt, Human
gguuuaauguuuu

SEQ ID NO: 1487209 - RNA, 23 nt, Human
gguuuuuguuuguuuccuuuguu

SEQ ID NO: 1487210 - RNA, 14 nt, Human
gguuuuuuaguuga

SEQ ID NO: 1487211 - RNA, 20 nt, Human
gguggcccuuaugacugcca

SEQ ID NO: 1487212 - RNA, 23 nt, Human
gguggcccuuaugacugccaaga

SEQ ID NO: 1487213 - RNA, 14 nt, Human
gguucaacuuauua

SEQ ID NO: 1487214 - RNA, 21 nt, Human
gguugggcagccagaccagca

SEQ ID NO: 1487215 - RNA, 19 nt, Human
guaaugauaacuggaaacu

SEQ ID NO: 1487216 - RNA, 17 nt, Human
guaauguuaauauugau

SEQ ID NO: 1487217 - RNA, 22 nt, Human
guaauguuaauauugauuuauu

SEQ ID NO: 1487218 - RNA, 18 nt, Human
guaauguuaauauugauu

SEQ ID NO: 1487219 - RNA, 13 nt, Human
guaaugaaaacca

SEQ ID NO: 1487220 - RNA, 11 nt, Human
guaaugaaaac

SEQ ID NO: 1487221 - RNA, 23 nt, Human
guaauucuaccaaggucuucuua

SEQ ID NO: 1487222 - RNA, 15 nt, Human
guaauuggaaaggca

SEQ ID NO: 1487223 - RNA, 23 nt, Human
guaauuguacuaaagccaaacau

SEQ ID NO: 1487224 - RNA, 15 nt, Human
guacagacagaaaaa

SEQ ID NO: 1487225 - RNA, 14 nt, Human
guacagaaagcugc

SEQ ID NO: 1487226 - RNA, 13 nt, Human
guacagaaagcug

SEQ ID NO: 1487227 - RNA, 18 nt, Human
guaauuguacuaaagcca

SEQ ID NO: 1487228 - RNA, 17 nt, Human
guacauaguuauuuauu

SEQ ID NO: 1487229 - RNA, 18 nt, Human
guacauaguuauuuauuu

SEQ ID NO: 1487230 - RNA, 14 nt, Human
guacauaacugaaa

SEQ ID NO: 1487231 - RNA, 14 nt, Human
guacaguuaucuaa

SEQ ID NO: 1487232 - RNA, 20 nt, Human
guacaguuaucuaaguuaau

SEQ ID NO: 1487233 - RNA, 19 nt, Human
guacuugcucuugaugccu

SEQ ID NO: 1487234 - RNA, 18 nt, Human
guacuugcucuugaugcc

SEQ ID NO: 1487235 - RNA, 16 nt, Human
guacuugcucuugaug

SEQ ID NO: 1487236 - RNA, 15 nt, Human
guacuugcucuugau

SEQ ID NO: 1487237 - RNA, 22 nt, Human
guacuugcucuugaugccuggc

SEQ ID NO: 1487238 - RNA, 14 nt, Human
guacuugcucuuga

SEQ ID NO: 1487239 - RNA, 13 nt, Human
guagaaaagcuau

SEQ ID NO: 1487240 - RNA, 23 nt, Human
guacuuuauuuucuauaauuuaa

SEQ ID NO: 1487241 - RNA, 17 nt, Human
guaccuagcuggcucug

SEQ ID NO: 1487242 - RNA, 13 nt, Human
guacuaaagccaa

SEQ ID NO: 1487243 - RNA, 22 nt, Human
guacuaacuccuaggaaaauac

SEQ ID NO: 1487244 - RNA, 20 nt, Human
ggccuguggaucaaauccag

SEQ ID NO: 1487245 - RNA, 22 nt, Human
ggcgcgaucucggcucacugca

SEQ ID NO: 1487246 - RNA, 16 nt, Human
ggcgcggcugggagga

SEQ ID NO: 1487247 - RNA, 11 nt, Human
ggccugugagc

SEQ ID NO: 1487248 - RNA, 14 nt, Human
ggccugggcaggag

SEQ ID NO: 1487249 - RNA, 13 nt, Human
ggccugggcagga

SEQ ID NO: 1487250 - RNA, 20 nt, Human
ggcuagagugcgguggcgcg

SEQ ID NO: 1487251 - RNA, 16 nt, Human
ggcuaggguggggaga

SEQ ID NO: 1487252 - RNA, 19 nt, Human
ggccucuuccgugacguca

SEQ ID NO: 1487253 - RNA, 19 nt, Human
ggccucaaaugcaccaugu

SEQ ID NO: 1487254 - RNA, 16 nt, Human
ggccuaucuaaacugg

SEQ ID NO: 1487255 - RNA, 23 nt, Human
ggccucaaagcaagcauucagaa

SEQ ID NO: 1487256 - RNA, 14 nt, Human
ggccuauguggucu

SEQ ID NO: 1487257 - RNA, 22 nt, Human
ggccuaaccugccgagagucca

SEQ ID NO: 1487258 - RNA, 21 nt, Human
ggccgugacgucuggguggcc

SEQ ID NO: 1487259 - RNA, 16 nt, Human
ggccgugacgucuggg

SEQ ID NO: 1487260 - RNA, 20 nt, Human
ggccgugacgucuggguggc

SEQ ID NO: 1487261 - RNA, 18 nt, Human
ggagaugaggccagacca

SEQ ID NO: 1487262 - RNA, 18 nt, Human
ggauacuuauauggaaau

SEQ ID NO: 1487263 - RNA, 18 nt, Human
ggauacuggcacagaggu

SEQ ID NO: 1487264 - RNA, 17 nt, Human
ggauacuggcacagagg

SEQ ID NO: 1487265 - RNA, 15 nt, Human
ggauacuggcacaga

SEQ ID NO: 1487266 - RNA, 16 nt, Human
ggauauguaaaacauu

SEQ ID NO: 1487267 - RNA, 16 nt, Human
ggauauaguuuuacuu

SEQ ID NO: 1487268 - RNA, 20 nt, Human
ggauauaguuuuacuuuuaa

SEQ ID NO: 1487269 - RNA, 16 nt, Human
ggauucuuccaucuga

SEQ ID NO: 1487270 - RNA, 19 nt, Human
ggcaaucauggugcucaga

SEQ ID NO: 1487271 - RNA, 15 nt, Human
ggcaaugauggcaau

SEQ ID NO: 1487272 - RNA, 12 nt, Human
ggccagcuccgc

SEQ ID NO: 1487273 - RNA, 20 nt, Human
ggccauucuuucccaacacc

SEQ ID NO: 1487274 - RNA, 16 nt, Human
ggagaugaggccagac

SEQ ID NO: 1487275 - RNA, 15 nt, Human
ggagaugaggccaga

SEQ ID NO: 1487276 - RNA, 14 nt, Human
ggagaugaggccag

SEQ ID NO: 1487277 - RNA, 16 nt, Human
ggagagguugucugug

SEQ ID NO: 1487278 - RNA, 17 nt, Human
ggacugugugcucagga

SEQ ID NO: 1487279 - RNA, 16 nt, Human
ggacauuugcucaugg

SEQ ID NO: 1487280 - RNA, 22 nt, Human
ggacacuacacccagcaauaga

SEQ ID NO: 1487281 - RNA, 20 nt, Human
ggaccacaacuauuuucaga

SEQ ID NO: 1487282 - RNA, 17 nt, Human
ggacgcccaggacccca

SEQ ID NO: 1487283 - RNA, 22 nt, Human
ggaaggaucccaugagcuccuu

SEQ ID NO: 1487284 - RNA, 21 nt, Human
ggaaggcagggaggaggcaga

SEQ ID NO: 1487285 - RNA, 17 nt, Human
ggaaggcagggaggagg

SEQ ID NO: 1487286 - RNA, 19 nt, Human
ggaaggcuuguugugcuuu

SEQ ID NO: 1487287 - RNA, 21 nt, Human
ggaaggcuuguugugcuuuua

SEQ ID NO: 1487288 - RNA, 18 nt, Human
ggaagugcuaauuuugaa

SEQ ID NO: 1487289 - RNA, 18 nt, Human
ggaaguggggcgggcuuc

SEQ ID NO: 1487290 - RNA, 16 nt, Human
ggaauuggagcucgug

SEQ ID NO: 1487291 - RNA, 22 nt, Human
ggaauuggagcucgugggacag

SEQ ID NO: 1487292 - RNA, 12 nt, Human
ggaauuguguuu

SEQ ID NO: 1487293 - RNA, 21 nt, Human
ggacacuacacccagcaauag

SEQ ID NO: 1487294 - RNA, 20 nt, Human
ggacacuacacccagcaaua

SEQ ID NO: 1487295 - RNA, 19 nt, Human
ggacacuacacccagcaau

SEQ ID NO: 1487296 - RNA, 18 nt, Human
ggacacuacacccagcaa

SEQ ID NO: 1487297 - RNA, 17 nt, Human
ggacacuacacccagca

SEQ ID NO: 1487298 - RNA, 16 nt, Human
ggacacuacacccagc

SEQ ID NO: 1487299 - RNA, 15 nt, Human
ggacacuacacccag

SEQ ID NO: 1487300 - RNA, 19 nt, Human
ggaauuuucaucuaggauu

SEQ ID NO: 1487301 - RNA, 16 nt, Human
ggacaaaauggaauac

SEQ ID NO: 1487302 - RNA, 17 nt, Human
ggacaaaauggaauacu

SEQ ID NO: 1487303 - RNA, 14 nt, Human
ggacaaagaaccuu

SEQ ID NO: 1487304 - RNA, 13 nt, Human
ggacaaagaaccu

SEQ ID NO: 1487305 - RNA, 19 nt, Human
ggaauuacgugcucugugg

SEQ ID NO: 1487306 - RNA, 21 nt, Human
ggaauggaggggcagagccag

SEQ ID NO: 1487307 - RNA, 17 nt, Human
ggaauggaggggcagag

SEQ ID NO: 1487308 - RNA, 16 nt, Human
ggaauggaggggcaga

SEQ ID NO: 1487309 - RNA, 14 nt, Human
ggaauggaggggca

SEQ ID NO: 1487310 - RNA, 13 nt, Human
gcuuucagagccu

SEQ ID NO: 1487311 - RNA, 13 nt, Human
gcuuucagggagg

SEQ ID NO: 1487312 - RNA, 14 nt, Human
gcuuuguggcacug

SEQ ID NO: 1487313 - RNA, 22 nt, Human
gcuuuguggcacuggggcaggg

SEQ ID NO: 1487314 - RNA, 15 nt, Human
ggaaaacauuccauc

SEQ ID NO: 1487315 - RNA, 16 nt, Human
gcuuuucccaaaagcc

SEQ ID NO: 1487316 - RNA, 15 nt, Human
ggaaaaauguaggag

SEQ ID NO: 1487317 - RNA, 18 nt, Human
ggaacauaaaaaggacau

SEQ ID NO: 1487318 - RNA, 13 nt, Human
ggaacauaaaaag

SEQ ID NO: 1487319 - RNA, 16 nt, Human
ggaaaucaacuugcuu

SEQ ID NO: 1487320 - RNA, 21 nt, Human
gcuguucaugaaagauucaau

SEQ ID NO: 1487321 - RNA, 12 nt, Human
gcuguucaugaa

SEQ ID NO: 1487322 - RNA, 20 nt, Human
gcugucuacacuaagagaga

SEQ ID NO: 1487323 - RNA, 14 nt, Human
gcuguccuuucuag

SEQ ID NO: 1487324 - RNA, 23 nt, Human
gcuguccuggaggggcuggggac

SEQ ID NO: 1487325 - RNA, 16 nt, Human
gcuguccuggaggggc

SEQ ID NO: 1487326 - RNA, 15 nt, Human
gcuguccuggagggg

SEQ ID NO: 1487327 - RNA, 17 nt, Human
gcuuauaauaaaggacu

SEQ ID NO: 1487328 - RNA, 18 nt, Human
gcuuaugacaucacuugu

SEQ ID NO: 1487329 - RNA, 22 nt, Human
gcuuaugacaucacuuguacaa

SEQ ID NO: 1487330 - RNA, 23 nt, Human
gcuuaugacaucacuuguacaaa

SEQ ID NO: 1487331 - RNA, 18 nt, Human
gcuuaugcuuaaauucaa

SEQ ID NO: 1487332 - RNA, 15 nt, Human
gcuuaugguaccaga

SEQ ID NO: 1487333 - RNA, 17 nt, Human
gcuucauagagacuugg

SEQ ID NO: 1487334 - RNA, 14 nt, Human
gcuucauagagacu

SEQ ID NO: 1487335 - RNA, 22 nt, Human
gcuucucauccugcaggcagcu

SEQ ID NO: 1487336 - RNA, 14 nt, Human
gcuccaagaauuuc

SEQ ID NO: 1487337 - RNA, 20 nt, Human
gcuccauuuuuagugaaaua

SEQ ID NO: 1487338 - RNA, 16 nt, Human
gcucaguaauuugagg

SEQ ID NO: 1487339 - RNA, 21 nt, Human
gcucaguaauuugaggacaac

SEQ ID NO: 1487340 - RNA, 19 nt, Human
gcucagauagaaugacagu

SEQ ID NO: 1487341 - RNA, 15 nt, Human
gcucagauagaauga

SEQ ID NO: 1487342 - RNA, 21 nt, Human
gcucagaggguguccugcacc

SEQ ID NO: 1487343 - RNA, 15 nt, Human
gcuaagcuaggaaug

SEQ ID NO: 1487344 - RNA, 19 nt, Human
gcuaagcuaggaaugaaau

SEQ ID NO: 1487345 - RNA, 14 nt, Human
gcuaagcauuccaa

SEQ ID NO: 1487346 - RNA, 14 nt, Human
gcuacguauuuaau

SEQ ID NO: 1487347 - RNA, 12 nt, Human
gcuaucucccug

SEQ ID NO: 1487348 - RNA, 13 nt, Human
gcuaucucugugu

SEQ ID NO: 1487349 - RNA, 16 nt, Human
gcuaucucugugugca

SEQ ID NO: 1487350 - RNA, 20 nt, Human
gcuaucucugugugcacaaa

SEQ ID NO: 1487351 - RNA, 23 nt, Human
gccugugagcuaggaauuguguu

SEQ ID NO: 1487352 - RNA, 17 nt, Human
gcugauggagaaggaag

SEQ ID NO: 1487353 - RNA, 16 nt, Human
gcugauggagaaggaa

SEQ ID NO: 1487354 - RNA, 17 nt, Human
gcugauggagccuuccc

SEQ ID NO: 1487355 - RNA, 21 nt, Human
gcugcaguuuugcuaucuggg

SEQ ID NO: 1487356 - RNA, 17 nt, Human
gcugcaguuuugcuauc

SEQ ID NO: 1487357 - RNA, 17 nt, Human
gcucuugaugccuggcg

SEQ ID NO: 1487358 - RNA, 17 nt, Human
gcugacucacaccugaa

SEQ ID NO: 1487359 - RNA, 16 nt, Human
gcucuugaugccuggc

SEQ ID NO: 1487360 - RNA, 15 nt, Human
gcucuugaugccugg

SEQ ID NO: 1487361 - RNA, 14 nt, Human
gcucuugaugccug

SEQ ID NO: 1487362 - RNA, 17 nt, Human
gcucuccuccaccucaa

SEQ ID NO: 1487363 - RNA, 19 nt, Human
gcucucggguugugugucu

SEQ ID NO: 1487364 - RNA, 20 nt, Human
gcucucuccaggcaggucug

SEQ ID NO: 1487365 - RNA, 20 nt, Human
gccugagugacagagcaaga

SEQ ID NO: 1487366 - RNA, 17 nt, Human
gccugacccucaucuuu

SEQ ID NO: 1487367 - RNA, 23 nt, Human
gccugacccuacuucuuuugcuc

SEQ ID NO: 1487368 - RNA, 21 nt, Human
gccucucugcaggucccuaau

SEQ ID NO: 1487369 - RNA, 20 nt, Human
gccucucugcaggucccuaa

SEQ ID NO: 1487370 - RNA, 23 nt, Human
gccucucugcaggucccuaauaa

SEQ ID NO: 1487371 - RNA, 22 nt, Human
gccucucgcuccucaaccccuc

SEQ ID NO: 1487372 - RNA, 16 nt, Human
gccugcacaauaaaaa

SEQ ID NO: 1487373 - RNA, 16 nt, Human
gccugcagacucacug

SEQ ID NO: 1487374 - RNA, 22 nt, Human
gccugcuuuuuauggccuguga

SEQ ID NO: 1487375 - RNA, 19 nt, Human
gccugcuuuuuauggccug

SEQ ID NO: 1487376 - RNA, 18 nt, Human
gccugcuuuuuauggccu

SEQ ID NO: 1487377 - RNA, 22 nt, Human
gccuggggcugaggcugaggca

SEQ ID NO: 1487378 - RNA, 15 nt, Human
gccugggucuccuaa

SEQ ID NO: 1487379 - RNA, 20 nt, Human
gccuguagccccagugacag

SEQ ID NO: 1487380 - RNA, 21 nt, Human
gccuguagccccagugacagc

SEQ ID NO: 1487381 - RNA, 19 nt, Human
gccucucugcaggucccua

SEQ ID NO: 1487382 - RNA, 19 nt, Human
gccucucgcuccucaaccc

SEQ ID NO: 1487383 - RNA, 19 nt, Human
gccucaccagcccuggcaa

SEQ ID NO: 1487384 - RNA, 15 nt, Human
gccucaaccucccaa

SEQ ID NO: 1487385 - RNA, 22 nt, Human
gccucacuuuuaaugaacaaau

SEQ ID NO: 1487386 - RNA, 23 nt, Human
gccucacuuuuaaugaacaaaug

SEQ ID NO: 1487387 - RNA, 20 nt, Human
gccuaucagaguugcugcaa

SEQ ID NO: 1487388 - RNA, 23 nt, Human
gccuaagggauccugccugcccc

SEQ ID NO: 1487389 - RNA, 21 nt, Human
gcccugggaggcucuggagcc

SEQ ID NO: 1487390 - RNA, 19 nt, Human
gcccugggaggcucuggag

SEQ ID NO: 1487391 - RNA, 18 nt, Human
gcccugggaggcucugga

SEQ ID NO: 1487392 - RNA, 17 nt, Human
gcccugggaggcucugg

SEQ ID NO: 1487393 - RNA, 23 nt, Human
gcccugggaggcucuggagccca

SEQ ID NO: 1487394 - RNA, 16 nt, Human
gcccugggaggcucug

SEQ ID NO: 1487395 - RNA, 15 nt, Human
gcccugggaggcucu

SEQ ID NO: 1487396 - RNA, 14 nt, Human
gcccugggaggcuc

SEQ ID NO: 1487397 - RNA, 13 nt, Human
gcccugggaggcu

SEQ ID NO: 1487398 - RNA, 14 nt, Human
gcccuuuugucucu

SEQ ID NO: 1487399 - RNA, 23 nt, Human
gcccuggugguggcucgggaggc

SEQ ID NO: 1487400 - RNA, 22 nt, Human
gcccuggacugugugcucagga

SEQ ID NO: 1487401 - RNA, 16 nt, Human
gcccuggacugugugc

SEQ ID NO: 1487402 - RNA, 12 nt, Human
gcccuggacugu

SEQ ID NO: 1487403 - RNA, 20 nt, Human
gcccugaggccuagacucug

SEQ ID NO: 1487404 - RNA, 17 nt, Human
gcccugcaccaugcugc

SEQ ID NO: 1487405 - RNA, 21 nt, Human
gcccugcaccaugcugcuggg

SEQ ID NO: 1487406 - RNA, 22 nt, Human
gcccugcaccaugcugcugggg

SEQ ID NO: 1487407 - RNA, 16 nt, Human
gcagacucagcucuga

SEQ ID NO: 1487408 - RNA, 13 nt, Human
gcagacucacugu

SEQ ID NO: 1487409 - RNA, 15 nt, Human
gcagacucagcucug

SEQ ID NO: 1487410 - RNA, 17 nt, Human
gcagaccuuuuuuagga

SEQ ID NO: 1487411 - RNA, 17 nt, Human
gaugggguuucaccaug

SEQ ID NO: 1487412 - RNA, 13 nt, Human
gaugggauucugg

SEQ ID NO: 1487413 - RNA, 17 nt, Human
gaugggauucuggacag

SEQ ID NO: 1487414 - RNA, 17 nt, Human
gaugcccaaauccuuag

SEQ ID NO: 1487415 - RNA, 23 nt, Human
gaugcccccuaauccccuucucc

SEQ ID NO: 1487416 - RNA, 22 nt, Human
gaugguucccuugaugaagaag

SEQ ID NO: 1487417 - RNA, 16 nt, Human
gauguuuaguaaucau

SEQ ID NO: 1487418 - RNA, 14 nt, Human
gauuacacacguga

SEQ ID NO: 1487419 - RNA, 14 nt, Human
gauuacaggcguga

SEQ ID NO: 1487420 - RNA, 21 nt, Human
gauucaaugccccugaauuua

SEQ ID NO: 1487421 - RNA, 13 nt, Human
gauucucauaacu

SEQ ID NO: 1487422 - RNA, 19 nt, Human
gauucaaugccccugaauu

SEQ ID NO: 1487423 - RNA, 20 nt, Human
gauucaaugccccugaauuu

SEQ ID NO: 1487424 - RNA, 20 nt, Human
gauucaaucuguaaacugug

SEQ ID NO: 1487425 - RNA, 21 nt, Human
gauucaaucuguaaacugugu

SEQ ID NO: 1487426 - RNA, 22 nt, Human
gauucaaucuguaaacugugua

SEQ ID NO: 1487427 - RNA, 12 nt, Human
gauuuccuucuu

SEQ ID NO: 1487428 - RNA, 18 nt, Human
gauuucuagguaggaaau

SEQ ID NO: 1487429 - RNA, 22 nt, Human
gauuggggaagagagccugcag

SEQ ID NO: 1487430 - RNA, 13 nt, Human
gcaacaauaaaua

SEQ ID NO: 1487431 - RNA, 14 nt, Human
gcaacaauuuauga

SEQ ID NO: 1487432 - RNA, 16 nt, Human
gcaaauugucacagga

SEQ ID NO: 1487433 - RNA, 16 nt, Human
gcaaagauaucucauc

SEQ ID NO: 1487434 - RNA, 21 nt, Human
gauuuugaaaucaugaagaua

SEQ ID NO: 1487435 - RNA, 21 nt, Human
gauuuugaaaccaugaagaga

SEQ ID NO: 1487436 - RNA, 14 nt, Human
gauuuuuacacaug

SEQ ID NO: 1487437 - RNA, 23 nt, Human
gauuuugaaccugaugaaaauaa

SEQ ID NO: 1487438 - RNA, 20 nt, Human
gauuuugcaguucuuuggcu

SEQ ID NO: 1487439 - RNA, 15 nt, Human
gcacuggggcagggg

SEQ ID NO: 1487440 - RNA, 18 nt, Human
gcacuggggcaggggccg

SEQ ID NO: 1487441 - RNA, 23 nt, Human
gcacuggggcaggggccgggggc

SEQ ID NO: 1487442 - RNA, 16 nt, Human
gcagaaggaaggcagg

SEQ ID NO: 1487443 - RNA, 22 nt, Human
gcagaaggaaggcagggaggag

SEQ ID NO: 1487444 - RNA, 15 nt, Human
gcagaaggaaggcag

SEQ ID NO: 1487445 - RNA, 13 nt, Human
gcagaaggaaggc

SEQ ID NO: 1487446 - RNA, 12 nt, Human
gcagaaggaagg

SEQ ID NO: 1487447 - RNA, 19 nt, Human
gcacuguggguagacacac

SEQ ID NO: 1487448 - RNA, 22 nt, Human
gcaccccagcuggggccaggcu

SEQ ID NO: 1487449 - RNA, 14 nt, Human
gcaccccccaagcu

SEQ ID NO: 1487450 - RNA, 15 nt, Human
gcaccugucccagaa

SEQ ID NO: 1487451 - RNA, 19 nt, Human
gcaccugucccagaaaaag

SEQ ID NO: 1487452 - RNA, 22 nt, Human
gcaccugucccagaaaaagcau

SEQ ID NO: 1487453 - RNA, 14 nt, Human
gcaccaaaagaagu

SEQ ID NO: 1487454 - RNA, 15 nt, Human
gcaccaaaagaagua

SEQ ID NO: 1487455 - RNA, 16 nt, Human
gcaccaaaagaaguaa

SEQ ID NO: 1487456 - RNA, 18 nt, Human
gcaccaaaagaaguaaaa

SEQ ID NO: 1487457 - RNA, 13 nt, Human
gcaacucugaagg

SEQ ID NO: 1487458 - RNA, 13 nt, Human
gcaauguaaauau

SEQ ID NO: 1487459 - RNA, 15 nt, Human
gcaauguaaauauuu

SEQ ID NO: 1487460 - RNA, 18 nt, Human
gcaauguaaauauuuuaa

SEQ ID NO: 1487461 - RNA, 19 nt, Human
gcaauguaaauauuuuaaa

SEQ ID NO: 1487462 - RNA, 19 nt, Human
gcaauuaauuccuucagca

SEQ ID NO: 1487463 - RNA, 20 nt, Human
gcaauuacaacggagucaaa

SEQ ID NO: 1487464 - RNA, 16 nt, Human
gcaauuaauuccuuca

SEQ ID NO: 1487465 - RNA, 23 nt, Human
gcaauguaaauauuuuaaagaau

SEQ ID NO: 1487466 - RNA, 18 nt, Human
gcaauuuaaauguuauga

SEQ ID NO: 1487467 - RNA, 13 nt, Human
gcaauuuaaaugu

SEQ ID NO: 1487468 - RNA, 18 nt, Human
gcaauuuccuuuuuuguu

SEQ ID NO: 1487469 - RNA, 14 nt, Human
gcaauuuuguaacg

SEQ ID NO: 1487470 - RNA, 13 nt, Human
gcacaaauauuua

SEQ ID NO: 1487471 - RNA, 23 nt, Human
gcacaaauucugucucuggauua

SEQ ID NO: 1487472 - RNA, 14 nt, Human
gcacaaauauuuau

SEQ ID NO: 1487473 - RNA, 15 nt, Human
gcacaaauauuuauu

SEQ ID NO: 1487474 - RNA, 16 nt, Human
gcacaaauauuuauuu

SEQ ID NO: 1487475 - RNA, 23 nt, Human
gagugugcgugguggucccuggg

SEQ ID NO: 1487476 - RNA, 13 nt, Human
gaguggggguggg

SEQ ID NO: 1487477 - RNA, 14 nt, Human
gaguggguggggag

SEQ ID NO: 1487478 - RNA, 15 nt, Human
gaguggguggggagu

SEQ ID NO: 1487479 - RNA, 13 nt, Human
gaguguacaagua

SEQ ID NO: 1487480 - RNA, 18 nt, Human
gaguguagcaacuacagu

SEQ ID NO: 1487481 - RNA, 15 nt, Human
gauaaaugauagaca

SEQ ID NO: 1487482 - RNA, 22 nt, Human
gauaaauggcuuccuggcaaua

SEQ ID NO: 1487483 - RNA, 17 nt, Human
gauauaaguguguguuu

SEQ ID NO: 1487484 - RNA, 15 nt, Human
gauauaagugugugu

SEQ ID NO: 1487485 - RNA, 14 nt, Human
gauaugauucaaau

SEQ ID NO: 1487486 - RNA, 22 nt, Human
gauaugauucaaaugucuauaa

SEQ ID NO: 1487487 - RNA, 24 nt, Human
gauaugauucaaaugucuauaaac

SEQ ID NO: 1487488 - RNA, 22 nt, Human
gaucacuuucucaguuuucaua

SEQ ID NO: 1487489 - RNA, 20 nt, Human
gauaacugaaaauuauuuaa

SEQ ID NO: 1487490 - RNA, 21 nt, Human
gauaacugaaaauuauuuaaa

SEQ ID NO: 1487491 - RNA, 22 nt, Human
gauagauuuucugcuacuuugc

SEQ ID NO: 1487492 - RNA, 21 nt, Human
gagucuauuuacggaacucaa

SEQ ID NO: 1487493 - RNA, 15 nt, Human
gagucuaucaaucaa

SEQ ID NO: 1487494 - RNA, 23 nt, Human
gagucuggugaagcucacuucug

SEQ ID NO: 1487495 - RNA, 20 nt, Human
gagucuugcucugucgccca

SEQ ID NO: 1487496 - RNA, 21 nt, Human
gagucccugccuggaccagcc

SEQ ID NO: 1487497 - RNA, 23 nt, Human
gagucccugccuggaccagccuc

SEQ ID NO: 1487498 - RNA, 22 nt, Human
gaguaauccaagcaaaugugaa

SEQ ID NO: 1487499 - RNA, 16 nt, Human
gaguaauaugccugcu

SEQ ID NO: 1487500 - RNA, 18 nt, Human
gagguugaaaaacaaaau

SEQ ID NO: 1487501 - RNA, 23 nt, Human
gaggucagcaugucuauucagcu

SEQ ID NO: 1487502 - RNA, 12 nt, Human
gagguaaguuuu

SEQ ID NO: 1487503 - RNA, 22 nt, Human
gaggguuucauugucugugaag

SEQ ID NO: 1487504 - RNA, 13 nt, Human
gaggguguccugc

SEQ ID NO: 1487505 - RNA, 19 nt, Human
gagguauuuaucuuuacuu

SEQ ID NO: 1487506 - RNA, 13 nt, Human
gaggguaggcagg

SEQ ID NO: 1487507 - RNA, 14 nt, Human
gaggguaggcagga

SEQ ID NO: 1487508 - RNA, 15 nt, Human
gaggguaggcaggau

SEQ ID NO: 1487509 - RNA, 22 nt, Human
gaggguaggcaggauuggggaa

SEQ ID NO: 1487510 - RNA, 18 nt, Human
gaggguaggcaggauugg

SEQ ID NO: 1487511 - RNA, 22 nt, Human
gaggcugggaauggaggggcag

SEQ ID NO: 1487512 - RNA, 23 nt, Human
gaggggcuggggacuugugucug

SEQ ID NO: 1487513 - RNA, 14 nt, Human
gagggggagagggc

SEQ ID NO: 1487514 - RNA, 21 nt, Human
gaggcgcaugaauuugugaag

SEQ ID NO: 1487515 - RNA, 21 nt, Human
gaggcgaagcguuguccucag

SEQ ID NO: 1487516 - RNA, 22 nt, Human
gaggccuuucccuaagccagcu

SEQ ID NO: 1487517 - RNA, 19 nt, Human
gaggccuuucccuaagcca

SEQ ID NO: 1487518 - RNA, 20 nt, Human
gaggcgaagcguuguccuca

SEQ ID NO: 1487519 - RNA, 18 nt, Human
gaggccugacugccaagc

SEQ ID NO: 1487520 - RNA, 19 nt, Human
gaggccugacugccaagcc

SEQ ID NO: 1487521 - RNA, 15 nt, Human
gaggccuagacucug

SEQ ID NO: 1487522 - RNA, 19 nt, Human
gaggccauugugugagccu

SEQ ID NO: 1487523 - RNA, 18 nt, Human
gaggcagagaagaaagaa

SEQ ID NO: 1487524 - RNA, 14 nt, Human
gaggcagggaagga

SEQ ID NO: 1487525 - RNA, 16 nt, Human
gaggcagagaagaaag

SEQ ID NO: 1487526 - RNA, 22 nt, Human
gagcccuucuauacccacccag

SEQ ID NO: 1487527 - RNA, 21 nt, Human
gagcccuucuauacccaccca

SEQ ID NO: 1487528 - RNA, 14 nt, Human
gagaugaggccaga

SEQ ID NO: 1487529 - RNA, 13 nt, Human
gagaugaggccag

SEQ ID NO: 1487530 - RNA, 15 nt, Human
gagaugaggccagac

SEQ ID NO: 1487531 - RNA, 18 nt, Human
gagaucccaacacugcca

SEQ ID NO: 1487532 - RNA, 19 nt, Human
gagaucccaacacugccag

SEQ ID NO: 1487533 - RNA, 20 nt, Human
gagaucccaacacugccagc

SEQ ID NO: 1487534 - RNA, 18 nt, Human
gagauccagggcaaggcc

SEQ ID NO: 1487535 - RNA, 21 nt, Human
gagaucaccaguguguggcuu

SEQ ID NO: 1487536 - RNA, 20 nt, Human
gagcaagaccccaucucaaa

SEQ ID NO: 1487537 - RNA, 18 nt, Human
gagcaagcaggaaucaga

SEQ ID NO: 1487538 - RNA, 18 nt, Human
gagccaaggggcuucagg

SEQ ID NO: 1487539 - RNA, 20 nt, Human
gagaaugagagacacacuga

SEQ ID NO: 1487540 - RNA, 21 nt, Human
gagaaugagagacacacugaa

SEQ ID NO: 1487541 - RNA, 20 nt, Human
gagaaugcccuucuccuuau

SEQ ID NO: 1487542 - RNA, 16 nt, Human
gagacaguucaagaaa

SEQ ID NO: 1487543 - RNA, 18 nt, Human
gagacaguucaagaaagc

SEQ ID NO: 1487544 - RNA, 15 nt, Human
gagacuggguaggaa

SEQ ID NO: 1487545 - RNA, 11 nt, Human
gagagugugac

SEQ ID NO: 1487546 - RNA, 20 nt, Human
gagaguggcuggggcaugga

SEQ ID NO: 1487547 - RNA, 17 nt, Human
gagaguggcuggggcau

SEQ ID NO: 1487548 - RNA, 14 nt, Human
gagaguggcugggg

SEQ ID NO: 1487549 - RNA, 13 nt, Human
gagagacgggccc

SEQ ID NO: 1487550 - RNA, 12 nt, Human
gagagacuuguu

SEQ ID NO: 1487551 - RNA, 20 nt, Human
gagagacuuguuuuggaugc

SEQ ID NO: 1487552 - RNA, 19 nt, Human
gagagcccugaggccuaga

SEQ ID NO: 1487553 - RNA, 14 nt, Human
gagagcccugaggc

SEQ ID NO: 1487554 - RNA, 14 nt, Human
gagagccugcagga

SEQ ID NO: 1487555 - RNA, 17 nt, Human
gagagccugcaggaucu

SEQ ID NO: 1487556 - RNA, 17 nt, Human
gagaaugagagacacac

SEQ ID NO: 1487557 - RNA, 22 nt, Human
gagaacuuccagauccuggaaa

SEQ ID NO: 1487558 - RNA, 23 nt, Human
gagaacuuccagauccuggaaau

SEQ ID NO: 1487559 - RNA, 21 nt, Human
gagaaccuggguugcagacag

SEQ ID NO: 1487560 - RNA, 21 nt, Human
gagaagaaagaacggaagaag

SEQ ID NO: 1487561 - RNA, 16 nt, Human
gagaagaaagaacgga

SEQ ID NO: 1487562 - RNA, 13 nt, Human
gagaagaacugaa

SEQ ID NO: 1487563 - RNA, 14 nt, Human
gagaaauuuauaaa

SEQ ID NO: 1487564 - RNA, 23 nt, Human
gagaaccuggguugcagacagga

SEQ ID NO: 1487565 - RNA, 21 nt, Human
gagaaccuagggugauauuaa

SEQ ID NO: 1487566 - RNA, 22 nt, Human
gagaaccuagggugauauuaac

SEQ ID NO: 1487567 - RNA, 21 nt, Human
gagaaaugaaaaaauauauau

SEQ ID NO: 1487568 - RNA, 15 nt, Human
gacuuggccccugcc

SEQ ID NO: 1487569 - RNA, 16 nt, Human
gacuugacaguggaac

SEQ ID NO: 1487570 - RNA, 17 nt, Human
gacuggguaggaaagag

SEQ ID NO: 1487571 - RNA, 13 nt, Human
gacuggacagcuu

SEQ ID NO: 1487572 - RNA, 14 nt, Human
gacuggacagcuug

SEQ ID NO: 1487573 - RNA, 21 nt, Human
gacuggacagcuuguggcaag

SEQ ID NO: 1487574 - RNA, 15 nt, Human
gacuggacagcuugu

SEQ ID NO: 1487575 - RNA, 15 nt, Human
gacuggaacacuaga

SEQ ID NO: 1487576 - RNA, 12 nt, Human
gacugcuguggc

SEQ ID NO: 1487577 - RNA, 15 nt, Human
gacugcuguggccag

SEQ ID NO: 1487578 - RNA, 16 nt, Human
gacugcuguggccagg

SEQ ID NO: 1487579 - RNA, 17 nt, Human
gacugcuguggccagga

SEQ ID NO: 1487580 - RNA, 18 nt, Human
gacugcuguggccaggag

SEQ ID NO: 1487581 - RNA, 20 nt, Human
gacugcuguggccaggaggu

SEQ ID NO: 1487582 - RNA, 19 nt, Human
gacugcuguggccaggagg

SEQ ID NO: 1487583 - RNA, 24 nt, Human
gacugcauuauauuuauuacugua

SEQ ID NO: 1487584 - RNA, 14 nt, Human
gacugcauuauauu

SEQ ID NO: 1487585 - RNA, 16 nt, Human
gacugcauuauauuua

SEQ ID NO: 1487586 - RNA, 12 nt, Human
gacucagcucug

SEQ ID NO: 1487587 - RNA, 17 nt, Human
gaauggcuauguuuuua

SEQ ID NO: 1487588 - RNA, 19 nt, Human
gaauggcuauguuuuuaau

SEQ ID NO: 1487589 - RNA, 19 nt, Human
gaaugugauaaggaaauca

SEQ ID NO: 1487590 - RNA, 18 nt, Human
gaaugugauaaggaaauc

SEQ ID NO: 1487591 - RNA, 22 nt, Human
gaauguggccccugaacaagaa

SEQ ID NO: 1487592 - RNA, 20 nt, Human
gaauguuaagacuugacagu

SEQ ID NO: 1487593 - RNA, 16 nt, Human
gaauuggagcucgugg

SEQ ID NO: 1487594 - RNA, 14 nt, Human
gaauugcagaguac

SEQ ID NO: 1487595 - RNA, 20 nt, Human
gaauguugauuacagugcag

SEQ ID NO: 1487596 - RNA, 23 nt, Human
gaaugaaauccugcuucagugua

SEQ ID NO: 1487597 - RNA, 17 nt, Human
gaaucuauauuuaacaa

SEQ ID NO: 1487598 - RNA, 22 nt, Human
gaauccugucgauuagacugga

SEQ ID NO: 1487599 - RNA, 14 nt, Human
gaauccugucgauu

SEQ ID NO: 1487600 - RNA, 13 nt, Human
gaaucuauauuua

SEQ ID NO: 1487601 - RNA, 20 nt, Human
gaauuugugaagguggaaau

SEQ ID NO: 1487602 - RNA, 20 nt, Human
gaauuugauaugugaacagu

SEQ ID NO: 1487603 - RNA, 19 nt, Human
gaauuucuaggacugaauu

SEQ ID NO: 1487604 - RNA, 20 nt, Human
gaauuucuaggacugaauua

SEQ ID NO: 1487605 - RNA, 14 nt, Human
gaauuucccucucu

SEQ ID NO: 1487606 - RNA, 17 nt, Human
gaauugggagcuuggga

SEQ ID NO: 1487607 - RNA, 16 nt, Human
gaauugggagcuuggg

SEQ ID NO: 1487608 - RNA, 22 nt, Human
gacaacauuucuauagccaaaa

SEQ ID NO: 1487609 - RNA, 20 nt, Human
gacaacagguaaaacagggc

SEQ ID NO: 1487610 - RNA, 12 nt, Human
gacaacuggcag

SEQ ID NO: 1487611 - RNA, 13 nt, Human
gacaacuggcagg

SEQ ID NO: 1487612 - RNA, 15 nt, Human
gacaacuggcaggca

SEQ ID NO: 1487613 - RNA, 16 nt, Human
gacaacuggcaggcag

SEQ ID NO: 1487614 - RNA, 18 nt, Human
gacaacuggcaggcaggc

SEQ ID NO: 1487615 - RNA, 17 nt, Human
gacaacuggcaggcagg

SEQ ID NO: 1487616 - RNA, 16 nt, Human
gacaaggaaaaaauaa

SEQ ID NO: 1487617 - RNA, 19 nt, Human
gacacaaacacacacaaaa

SEQ ID NO: 1487618 - RNA, 15 nt, Human
gacacaaacacacac

SEQ ID NO: 1487619 - RNA, 16 nt, Human
gaccaccucucaauau

SEQ ID NO: 1487620 - RNA, 17 nt, Human
gacaugggacauuugcu

SEQ ID NO: 1487621 - RNA, 16 nt, Human
gacaugggacauuugc

SEQ ID NO: 1487622 - RNA, 16 nt, Human
gaccauugucucagag

SEQ ID NO: 1487623 - RNA, 14 nt, Human
gaccagccucucca

SEQ ID NO: 1487624 - RNA, 22 nt, Human
gaccagccgugagcauguuugg

SEQ ID NO: 1487625 - RNA, 21 nt, Human
gacagcuuguggcaagugaau

SEQ ID NO: 1487626 - RNA, 21 nt, Human
gacagcccaggauacuggcac

SEQ ID NO: 1487627 - RNA, 23 nt, Human
gacaguguugaaaauguucagaa

SEQ ID NO: 1487628 - RNA, 17 nt, Human
cuuuuuauggccuguga

SEQ ID NO: 1487629 - RNA, 14 nt, Human
cuuuguggcacugg

SEQ ID NO: 1487630 - RNA, 17 nt, Human
cuuuuugggagagacuu

SEQ ID NO: 1487631 - RNA, 20 nt, Human
cuuuuugggagagacuuguu

SEQ ID NO: 1487632 - RNA, 19 nt, Human
cuuuuugggagagacuugu

SEQ ID NO: 1487633 - RNA, 13 nt, Human
gaaaaagcgaaaa

SEQ ID NO: 1487634 - RNA, 23 nt, Human
gaaaaguuuagccccugaaagcc

SEQ ID NO: 1487635 - RNA, 15 nt, Human
gaaaauauuguuuua

SEQ ID NO: 1487636 - RNA, 22 nt, Human
gaaaauauuguuuuacaauagu

SEQ ID NO: 1487637 - RNA, 18 nt, Human
gaaaaucuuauaauuuaa

SEQ ID NO: 1487638 - RNA, 11 nt, Human
gaaaaucauau

SEQ ID NO: 1487639 - RNA, 14 nt, Human
gaaaaguugaauuu

SEQ ID NO: 1487640 - RNA, 15 nt, Human
gaaaaguugaauuuu

SEQ ID NO: 1487641 - RNA, 22 nt, Human
gaaagcgccuccaacccuagca

SEQ ID NO: 1487642 - RNA, 17 nt, Human
gaaagcgccuccaaccc

SEQ ID NO: 1487643 - RNA, 14 nt, Human
gaaagccuucuuuu

SEQ ID NO: 1487644 - RNA, 19 nt, Human
gaaagcuauauaagacaag

SEQ ID NO: 1487645 - RNA, 17 nt, Human
gaaagcuucaaacugca

SEQ ID NO: 1487646 - RNA, 16 nt, Human
gaaagcuucagugcug

SEQ ID NO: 1487647 - RNA, 18 nt, Human
gaaagcuucagugcugcc

SEQ ID NO: 1487648 - RNA, 17 nt, Human
gaaagcugccugguaua

SEQ ID NO: 1487649 - RNA, 18 nt, Human
gaaagcaguugagacaag

SEQ ID NO: 1487650 - RNA, 21 nt, Human
gaaagaguacucuuguuuccu

SEQ ID NO: 1487651 - RNA, 13 nt, Human
gaaagaggaagca

SEQ ID NO: 1487652 - RNA, 13 nt, Human
gaaagagaaacac

SEQ ID NO: 1487653 - RNA, 17 nt, Human
gaaagagaacuuccaga

SEQ ID NO: 1487654 - RNA, 14 nt, Human
gaaaccuuccaccc

SEQ ID NO: 1487655 - RNA, 19 nt, Human
gaaacuaggugcauauuua

SEQ ID NO: 1487656 - RNA, 23 nt, Human
gaaacucguuaauuuguaguguu

SEQ ID NO: 1487657 - RNA, 21 nt, Human
gaaacccugcacccauuagca

SEQ ID NO: 1487658 - RNA, 13 nt, Human
gaaaccuacugcc

SEQ ID NO: 1487659 - RNA, 19 nt, Human
gaaaccuacugcccaggca

SEQ ID NO: 1487660 - RNA, 16 nt, Human
gaaacacaacuauauu

SEQ ID NO: 1487661 - RNA, 17 nt, Human
cuuguacuuuauuuucu

SEQ ID NO: 1487662 - RNA, 23 nt, Human
cuugucaauaaaauccauacauu

SEQ ID NO: 1487663 - RNA, 17 nt, Human
cuuguauaucuuguuuu

SEQ ID NO: 1487664 - RNA, 13 nt, Human
cuugucacgccag

SEQ ID NO: 1487665 - RNA, 16 nt, Human
cuugucacgccagacu

SEQ ID NO: 1487666 - RNA, 18 nt, Human
cuugucacgccagacuuc

SEQ ID NO: 1487667 - RNA, 12 nt, Human
cuugucaugugu

SEQ ID NO: 1487668 - RNA, 13 nt, Human
cuugucaugugua

SEQ ID NO: 1487669 - RNA, 14 nt, Human
cuugucauguguau

SEQ ID NO: 1487670 - RNA, 15 nt, Human
cuugucauguguaua

SEQ ID NO: 1487671 - RNA, 16 nt, Human
cuugucauguguauaa

SEQ ID NO: 1487672 - RNA, 17 nt, Human
cuugucauguguauaaa

SEQ ID NO: 1487673 - RNA, 18 nt, Human
cuugucauguguauaaaa

SEQ ID NO: 1487674 - RNA, 22 nt, Human
cuugucauuguuauauaaucau

SEQ ID NO: 1487675 - RNA, 19 nt, Human
cuugucauguguauaaaaa

SEQ ID NO: 1487676 - RNA, 19 nt, Human
cuugaguuuaaauuguaau

SEQ ID NO: 1487677 - RNA, 21 nt, Human
cuuuaucuugaauaauguaag

SEQ ID NO: 1487678 - RNA, 18 nt, Human
cuuuaucuugaauaaugu

SEQ ID NO: 1487679 - RNA, 23 nt, Human
cuuuaucuugaauaauguaagac

SEQ ID NO: 1487680 - RNA, 15 nt, Human
cuuuauagaucagcc

SEQ ID NO: 1487681 - RNA, 13 nt, Human
cuuuauaugaaga

SEQ ID NO: 1487682 - RNA, 22 nt, Human
cuuuauaugaagaaaaucacuu

SEQ ID NO: 1487683 - RNA, 20 nt, Human
cuuuaaaauuacaacuaagu

SEQ ID NO: 1487684 - RNA, 19 nt, Human
cuuuaaaauuacaacuaag

SEQ ID NO: 1487685 - RNA, 17 nt, Human
cuuuaaaauuacaacua

SEQ ID NO: 1487686 - RNA, 16 nt, Human
cuuuaaaauguaaagc

SEQ ID NO: 1487687 - RNA, 19 nt, Human
cuuuaaaauguaaagccau

SEQ ID NO: 1487688 - RNA, 17 nt, Human
cuuuaaaaggaaagaaa

SEQ ID NO: 1487689 - RNA, 18 nt, Human
cuuuaaaaggaaagaaaa

SEQ ID NO: 1487690 - RNA, 16 nt, Human
cuuuaaaaggaaagaa

SEQ ID NO: 1487691 - RNA, 18 nt, Human
cuuuaaaagaugcuuuua

SEQ ID NO: 1487692 - RNA, 16 nt, Human
cuugugucaaacagua

SEQ ID NO: 1487693 - RNA, 21 nt, Human
cuuuaaaauguaaagccaugc

SEQ ID NO: 1487694 - RNA, 16 nt, Human
cuuuaccuuuuuucuu

SEQ ID NO: 1487695 - RNA, 15 nt, Human
cuuuccugaauccaa

SEQ ID NO: 1487696 - RNA, 22 nt, Human
cuuuccugaauccaaacuaauc

SEQ ID NO: 1487697 - RNA, 16 nt, Human
cuuucuguaaccauaa

SEQ ID NO: 1487698 - RNA, 13 nt, Human
cuuucccugccuc

SEQ ID NO: 1487699 - RNA, 18 nt, Human
cuuucccuccuuggugau

SEQ ID NO: 1487700 - RNA, 15 nt, Human
cuuucccuccuuggu

SEQ ID NO: 1487701 - RNA, 14 nt, Human
cuuucccuccuugg

SEQ ID NO: 1487702 - RNA, 13 nt, Human
cuuucccuccuug

SEQ ID NO: 1487703 - RNA, 20 nt, Human
cuuuauguaguuuuuauaug

SEQ ID NO: 1487704 - RNA, 13 nt, Human
cuuuaugcuugca

SEQ ID NO: 1487705 - RNA, 19 nt, Human
cuuuauguaguuuuuauau

SEQ ID NO: 1487706 - RNA, 21 nt, Human
cuuuaugucuguggauuuuuu

SEQ ID NO: 1487707 - RNA, 13 nt, Human
cuuucccaacacc

SEQ ID NO: 1487708 - RNA, 18 nt, Human
cuuucccuaagccagcug

SEQ ID NO: 1487709 - RNA, 17 nt, Human
cuuucccuaagccagcu

SEQ ID NO: 1487710 - RNA, 12 nt, Human
cuuucccuaagc

SEQ ID NO: 1487711 - RNA, 16 nt, Human
cuuuggcugcaugcga

SEQ ID NO: 1487712 - RNA, 22 nt, Human
cuuuguauuguauauuacaaug

SEQ ID NO: 1487713 - RNA, 14 nt, Human
cuuuggcugcaugc

SEQ ID NO: 1487714 - RNA, 22 nt, Human
cuuuggcugaaaggaagcugug

SEQ ID NO: 1487715 - RNA, 14 nt, Human
cuuugugcauucug

SEQ ID NO: 1487716 - RNA, 13 nt, Human
cuuugugcauucu

SEQ ID NO: 1487717 - RNA, 22 nt, Human
cuuugcauaacguauaaaagcc

SEQ ID NO: 1487718 - RNA, 18 nt, Human
cuuugaccugccucccuu

SEQ ID NO: 1487719 - RNA, 15 nt, Human
cuuugaccugccucc

SEQ ID NO: 1487720 - RNA, 14 nt, Human
cuuugaccugccuc

SEQ ID NO: 1487721 - RNA, 13 nt, Human
cuuauauuaugga

SEQ ID NO: 1487722 - RNA, 19 nt, Human
cuuauaucuauauuuuaca

SEQ ID NO: 1487723 - RNA, 21 nt, Human
cuuauauuaauauuccucagu

SEQ ID NO: 1487724 - RNA, 16 nt, Human
cuuauacgaguaauau

SEQ ID NO: 1487725 - RNA, 23 nt, Human
cuuaguucaaguccugccucuua

SEQ ID NO: 1487726 - RNA, 22 nt, Human
cuuagaugcaguucugaagaag

SEQ ID NO: 1487727 - RNA, 15 nt, Human
cuucaaaguuuaaua

SEQ ID NO: 1487728 - RNA, 16 nt, Human
cuucaaaguuuaauaa

SEQ ID NO: 1487729 - RNA, 17 nt, Human
cuuauuucaugaaaauu

SEQ ID NO: 1487730 - RNA, 21 nt, Human
cuuauuuauucauauuuucuu

SEQ ID NO: 1487731 - RNA, 23 nt, Human
cuuaucuaaucaugaaacucccu

SEQ ID NO: 1487732 - RNA, 18 nt, Human
cuuaucuacuuccaaacu

SEQ ID NO: 1487733 - RNA, 15 nt, Human
cuuaucgaaacucau

SEQ ID NO: 1487734 - RNA, 14 nt, Human
cuucccuuuccuga

SEQ ID NO: 1487735 - RNA, 19 nt, Human
cuuccuaaauauuaugaga

SEQ ID NO: 1487736 - RNA, 22 nt, Human
cuuccuaaauauuaugagaugc

SEQ ID NO: 1487737 - RNA, 20 nt, Human
cuucccuuuccugaguccca

SEQ ID NO: 1487738 - RNA, 21 nt, Human
cuuccaggggagguucaguga

SEQ ID NO: 1487739 - RNA, 14 nt, Human
cuuccacccagugc

SEQ ID NO: 1487740 - RNA, 12 nt, Human
cuuccacccagu

SEQ ID NO: 1487741 - RNA, 19 nt, Human
cuuccacguacugcagccu

SEQ ID NO: 1487742 - RNA, 20 nt, Human
cuuccacguacugcagccuc

SEQ ID NO: 1487743 - RNA, 21 nt, Human
cuucauucaagucagcucuuc

SEQ ID NO: 1487744 - RNA, 18 nt, Human
cuugaaaauuaacaugaa

SEQ ID NO: 1487745 - RNA, 13 nt, Human
cuugaaaauuaac

SEQ ID NO: 1487746 - RNA, 12 nt, Human
cuugaaaauuaa

SEQ ID NO: 1487747 - RNA, 15 nt, Human
cuugaaauuuuaacc

SEQ ID NO: 1487748 - RNA, 16 nt, Human
cuugaaauuuuaaccu

SEQ ID NO: 1487749 - RNA, 17 nt, Human
cuugaaauuuuaaccua

SEQ ID NO: 1487750 - RNA, 18 nt, Human
cuugaaaaaugcauguug

SEQ ID NO: 1487751 - RNA, 12 nt, Human
cuugaaaaaugc

SEQ ID NO: 1487752 - RNA, 16 nt, Human
cuucuuggccauggga

SEQ ID NO: 1487753 - RNA, 18 nt, Human
cuucuuggccaugggagg

SEQ ID NO: 1487754 - RNA, 13 nt, Human
cuugacccugagc

SEQ ID NO: 1487755 - RNA, 15 nt, Human
cuugacccugagcug

SEQ ID NO: 1487756 - RNA, 14 nt, Human
cuugacccugagcu

SEQ ID NO: 1487757 - RNA, 20 nt, Human
cuuccuggggcaucuggcga

SEQ ID NO: 1487758 - RNA, 23 nt, Human
cuuccuggggcaucuggcgaauc

SEQ ID NO: 1487759 - RNA, 13 nt, Human
cuucuccccugca

SEQ ID NO: 1487760 - RNA, 14 nt, Human
cuucuccccugcac

SEQ ID NO: 1487761 - RNA, 16 nt, Human
cuucuccccugcacug

SEQ ID NO: 1487762 - RNA, 17 nt, Human
cuucuccccugcacugu

SEQ ID NO: 1487763 - RNA, 18 nt, Human
cuucuccccugcacugua

SEQ ID NO: 1487764 - RNA, 19 nt, Human
cuucuccccugcacuguaa

SEQ ID NO: 1487765 - RNA, 20 nt, Human
cuucuccccugcacuguaaa

SEQ ID NO: 1487766 - RNA, 21 nt, Human
cuucuccccugcacuguaaaa

SEQ ID NO: 1487767 - RNA, 23 nt, Human
cuucuccccugcacuguaaaaug

SEQ ID NO: 1487768 - RNA, 22 nt, Human
cuucuccccugcacuguaaaau

SEQ ID NO: 1487769 - RNA, 14 nt, Human
cuucucuccagugc

SEQ ID NO: 1487770 - RNA, 21 nt, Human
cuucugggcuucaucuggcaa

SEQ ID NO: 1487771 - RNA, 22 nt, Human
cuucugggcuucaucuggcaac

SEQ ID NO: 1487772 - RNA, 15 nt, Human
cuguguggcagucug

SEQ ID NO: 1487773 - RNA, 12 nt, Human
cuguguggagag

SEQ ID NO: 1487774 - RNA, 15 nt, Human
cuguguggagaggga

SEQ ID NO: 1487775 - RNA, 16 nt, Human
cuguguggagagggaa

SEQ ID NO: 1487776 - RNA, 22 nt, Human
cuguguggagagggaaugugaa

SEQ ID NO: 1487777 - RNA, 23 nt, Human
cuguguggagagggaaugugaaa

SEQ ID NO: 1487778 - RNA, 23 nt, Human
cugugugcucaggagcccuggga

SEQ ID NO: 1487779 - RNA, 21 nt, Human
cugugugcucaggagcccugg

SEQ ID NO: 1487780 - RNA, 20 nt, Human
cugugugcucaggagcccug

SEQ ID NO: 1487781 - RNA, 16 nt, Human
cugugugcucaggagc

SEQ ID NO: 1487782 - RNA, 19 nt, Human
cugugugcucaggagcccu

SEQ ID NO: 1487783 - RNA, 15 nt, Human
cugugggcuggcagu

SEQ ID NO: 1487784 - RNA, 16 nt, Human
cuguguuuggcuuuca

SEQ ID NO: 1487785 - RNA, 17 nt, Human
cuguguuuggcuuucag

SEQ ID NO: 1487786 - RNA, 18 nt, Human
cuguguuuggcuuucagg

SEQ ID NO: 1487787 - RNA, 23 nt, Human
cuguguuuggcuuucagggaggc

SEQ ID NO: 1487788 - RNA, 22 nt, Human
cuguguuuggcuuucagggagg

SEQ ID NO: 1487789 - RNA, 22 nt, Human
cuguucauuccuccagguauuc

SEQ ID NO: 1487790 - RNA, 14 nt, Human
cuguucauuuccuc

SEQ ID NO: 1487791 - RNA, 17 nt, Human
cuguucauuuccucaaa

SEQ ID NO: 1487792 - RNA, 17 nt, Human
cuguucauuccuccagg

SEQ ID NO: 1487793 - RNA, 16 nt, Human
cuguucauuccuccag

SEQ ID NO: 1487794 - RNA, 15 nt, Human
cuguucauuccucca

SEQ ID NO: 1487795 - RNA, 17 nt, Human
cuguucaugaaagauuc

SEQ ID NO: 1487796 - RNA, 18 nt, Human
cuguucaugaaagauuca

SEQ ID NO: 1487797 - RNA, 23 nt, Human
cuguucaugaaagauucaaugcc

SEQ ID NO: 1487798 - RNA, 20 nt, Human
cuguucuacauagaugcuua

SEQ ID NO: 1487799 - RNA, 19 nt, Human
cuguucuacauagaugcuu

SEQ ID NO: 1487800 - RNA, 22 nt, Human
cugucuccuaagcuggagugca

SEQ ID NO: 1487801 - RNA, 21 nt, Human
cugucucccuccucugcccgg

SEQ ID NO: 1487802 - RNA, 16 nt, Human
cugugcaaggccuggu

SEQ ID NO: 1487803 - RNA, 20 nt, Human
cugugcaagguauuacacuc

SEQ ID NO: 1487804 - RNA, 15 nt, Human
cugugccauguguuu

SEQ ID NO: 1487805 - RNA, 13 nt, Human
cugugccuccuca

SEQ ID NO: 1487806 - RNA, 15 nt, Human
cugugccuccucacc

SEQ ID NO: 1487807 - RNA, 16 nt, Human
cugugccuccucaccc

SEQ ID NO: 1487808 - RNA, 16 nt, Human
cugugcuuaugguacc

SEQ ID NO: 1487809 - RNA, 17 nt, Human
cugugcuuuuaaaugca

SEQ ID NO: 1487810 - RNA, 23 nt, Human
cuguggauuuuuuccuucaaagu

SEQ ID NO: 1487811 - RNA, 13 nt, Human
cuguacacugcac

SEQ ID NO: 1487812 - RNA, 15 nt, Human
cuguacacugcacga

SEQ ID NO: 1487813 - RNA, 20 nt, Human
cuguagugucacucaaggcg

SEQ ID NO: 1487814 - RNA, 22 nt, Human
cuguauuuuaaaagaaugauua

SEQ ID NO: 1487815 - RNA, 20 nt, Human
cuguauuuuaaaagaaugau

SEQ ID NO: 1487816 - RNA, 20 nt, Human
cugucuacuugcucagguac

SEQ ID NO: 1487817 - RNA, 14 nt, Human
cugucuaccugguc

SEQ ID NO: 1487818 - RNA, 18 nt, Human
cugucuacuugcucaggu

SEQ ID NO: 1487819 - RNA, 13 nt, Human
cugucuauucuag

SEQ ID NO: 1487820 - RNA, 21 nt, Human
cuguccguucacauguguggu

SEQ ID NO: 1487821 - RNA, 15 nt, Human
cuguaauguuaauau

SEQ ID NO: 1487822 - RNA, 17 nt, Human
cuguaauguuaauauug

SEQ ID NO: 1487823 - RNA, 18 nt, Human
cuguaauguuaauauuga

SEQ ID NO: 1487824 - RNA, 19 nt, Human
cuguaauguuaauauugau

SEQ ID NO: 1487825 - RNA, 14 nt, Human
cuguaauguuaaua

SEQ ID NO: 1487826 - RNA, 15 nt, Human
cugggcuucaucugg

SEQ ID NO: 1487827 - RNA, 19 nt, Human
cugggcuucaucuggcaac

SEQ ID NO: 1487828 - RNA, 12 nt, Human
cugggggguggc

SEQ ID NO: 1487829 - RNA, 13 nt, Human
cugggggguggcc

SEQ ID NO: 1487830 - RNA, 18 nt, Human
cuggguaaugaaacaaag

SEQ ID NO: 1487831 - RNA, 14 nt, Human
cuggagugcagugg

SEQ ID NO: 1487832 - RNA, 22 nt, Human
cuggcaguccuggaagccagcu

SEQ ID NO: 1487833 - RNA, 20 nt, Human
cuggcaguuuauauuuaacu

SEQ ID NO: 1487834 - RNA, 22 nt, Human
cuggcaguuuauauuuaacucu

SEQ ID NO: 1487835 - RNA, 12 nt, Human
cuggccccaccc

SEQ ID NO: 1487836 - RNA, 23 nt, Human
cuggccccacccucguggacacc

SEQ ID NO: 1487837 - RNA, 19 nt, Human
cuggagaugaggccagacc

SEQ ID NO: 1487838 - RNA, 20 nt, Human
cuggagaugaggccagacca

SEQ ID NO: 1487839 - RNA, 18 nt, Human
cuggagaugaggccagac

SEQ ID NO: 1487840 - RNA, 17 nt, Human
cuggagaugaggccaga

SEQ ID NO: 1487841 - RNA, 16 nt, Human
cuggagaugaggccag

SEQ ID NO: 1487842 - RNA, 13 nt, Human
cuggaauuugaaa

SEQ ID NO: 1487843 - RNA, 14 nt, Human
cuggaccagccucu

SEQ ID NO: 1487844 - RNA, 18 nt, Human
cuggaccagccucuccac

SEQ ID NO: 1487845 - RNA, 15 nt, Human
cuggagaucaccagu

SEQ ID NO: 1487846 - RNA, 13 nt, Human
cuggaccucacca

SEQ ID NO: 1487847 - RNA, 16 nt, Human
cugcugcuacaauguc

SEQ ID NO: 1487848 - RNA, 14 nt, Human
cugcugcccucccc

SEQ ID NO: 1487849 - RNA, 15 nt, Human
cugcugcugccugcc

SEQ ID NO: 1487850 - RNA, 14 nt, Human
cugcugcugccugc

SEQ ID NO: 1487851 - RNA, 20 nt, Human
cugcuggggaagacaguggc

SEQ ID NO: 1487852 - RNA, 21 nt, Human
cugcuggggaagacaguggcc

SEQ ID NO: 1487853 - RNA, 22 nt, Human
cugcuggggaagacaguggccc

SEQ ID NO: 1487854 - RNA, 14 nt, Human
cugcuggggaagac

SEQ ID NO: 1487855 - RNA, 15 nt, Human
cugcuggggaagaca

SEQ ID NO: 1487856 - RNA, 17 nt, Human
cugcuggggaagacagu

SEQ ID NO: 1487857 - RNA, 18 nt, Human
cugcuggggaagacagug

SEQ ID NO: 1487858 - RNA, 19 nt, Human
cugcuggggaagacagugg

SEQ ID NO: 1487859 - RNA, 13 nt, Human
cugcugcccuccc

SEQ ID NO: 1487860 - RNA, 19 nt, Human
cucccuucaugcauggaaa

SEQ ID NO: 1487861 - RNA, 15 nt, Human
cugcccuuccugcag

SEQ ID NO: 1487862 - RNA, 16 nt, Human
cugccggcuccuuggu

SEQ ID NO: 1487863 - RNA, 23 nt, Human
cugccgguucuuaaauccauccu

SEQ ID NO: 1487864 - RNA, 13 nt, Human
cugccgucagugc

SEQ ID NO: 1487865 - RNA, 19 nt, Human
cugccgucagugcugugcu

SEQ ID NO: 1487866 - RNA, 20 nt, Human
cugccgucagugcugugcug

SEQ ID NO: 1487867 - RNA, 22 nt, Human
cugccgagaguccaucagccuc

SEQ ID NO: 1487868 - RNA, 23 nt, Human
cugccgagaguccaucagccucc

SEQ ID NO: 1487869 - RNA, 21 nt, Human
cugccucucugcaggucccua

SEQ ID NO: 1487870 - RNA, 20 nt, Human
cugccucucugcaggucccu

SEQ ID NO: 1487871 - RNA, 22 nt, Human
cugccucucugcaggucccuaa

SEQ ID NO: 1487872 - RNA, 18 nt, Human
cuagaguuuagcuggaaa

SEQ ID NO: 1487873 - RNA, 19 nt, Human
cuagaguuuagcuggaaaa

SEQ ID NO: 1487874 - RNA, 24 nt, Human
cuagagugacucacuaauucauua

SEQ ID NO: 1487875 - RNA, 14 nt, Human
cuagagcacugcca

SEQ ID NO: 1487876 - RNA, 15 nt, Human
cuagagcacugccac

SEQ ID NO: 1487877 - RNA, 18 nt, Human
cuagagcacugccaccag

SEQ ID NO: 1487878 - RNA, 18 nt, Human
cuagaggcuuccuucauu

SEQ ID NO: 1487879 - RNA, 19 nt, Human
cuagaggcuuccuucauuu

SEQ ID NO: 1487880 - RNA, 21 nt, Human
cuagaggcuuccuucauuucc

SEQ ID NO: 1487881 - RNA, 23 nt, Human
cuagaggcuuccuucauuuccuc

SEQ ID NO: 1487882 - RNA, 21 nt, Human
cuagaggccugacugccaagc

SEQ ID NO: 1487883 - RNA, 23 nt, Human
cuagaggccugacugccaagcca

SEQ ID NO: 1487884 - RNA, 22 nt, Human
cuacuuacaugcauuacugcau

SEQ ID NO: 1487885 - RNA, 22 nt, Human
cuaccuccaaagcuucccacgg

SEQ ID NO: 1487886 - RNA, 21 nt, Human
cuacugccgucagugcugugc

SEQ ID NO: 1487887 - RNA, 15 nt, Human
cuacugcccaggcac

SEQ ID NO: 1487888 - RNA, 21 nt, Human
cuacugcccaggcacugcaaa

SEQ ID NO: 1487889 - RNA, 14 nt, Human
cuacugauuccgca

SEQ ID NO: 1487890 - RNA, 14 nt, Human
cuaggaaauauuua

SEQ ID NO: 1487891 - RNA, 15 nt, Human
cuaggaaauauuuau

SEQ ID NO: 1487892 - RNA, 19 nt, Human
cuaggaaauauuuauuuua

SEQ ID NO: 1487893 - RNA, 20 nt, Human
cuaggaaauauuuauuuuaa

SEQ ID NO: 1487894 - RNA, 12 nt, Human
cuaggaaaauac

SEQ ID NO: 1487895 - RNA, 13 nt, Human
cuagcuggcucug

SEQ ID NO: 1487896 - RNA, 14 nt, Human
cuagcuggcucugu

SEQ ID NO: 1487897 - RNA, 22 nt, Human
cuagccuuaaucagguccucag

SEQ ID NO: 1487898 - RNA, 17 nt, Human
cuagcgcuaucucccug

SEQ ID NO: 1487899 - RNA, 20 nt, Human
cuagcgcuaucucccugccu

SEQ ID NO: 1487900 - RNA, 23 nt, Human
cuauguaggaaagaccauuuuuc

SEQ ID NO: 1487901 - RNA, 22 nt, Human
cuauguaggaaagaccauuuuu

SEQ ID NO: 1487902 - RNA, 16 nt, Human
cuauuauccccauuuc

SEQ ID NO: 1487903 - RNA, 17 nt, Human
cuauuauccccauuucu

SEQ ID NO: 1487904 - RNA, 20 nt, Human
cuauuauuuucacuguagaa

SEQ ID NO: 1487905 - RNA, 22 nt, Human
cuauuauuuucacuguagaaug

SEQ ID NO: 1487906 - RNA, 23 nt, Human
cuauucagcuucguuuauuuuca

SEQ ID NO: 1487907 - RNA, 14 nt, Human
cuauucuugaugua

SEQ ID NO: 1487908 - RNA, 16 nt, Human
cuauucuugauguaaa

SEQ ID NO: 1487909 - RNA, 17 nt, Human
cuauucuugauguaaaa

SEQ ID NO: 1487910 - RNA, 18 nt, Human
cuauucuugauguaaaau

SEQ ID NO: 1487911 - RNA, 19 nt, Human
cuauucuugauguaaaauc

SEQ ID NO: 1487912 - RNA, 20 nt, Human
cuauucuugauguaaaaucu

SEQ ID NO: 1487913 - RNA, 22 nt, Human
cuauucuugauguaaaaucuug

SEQ ID NO: 1487914 - RNA, 22 nt, Human
cuaugaaguuuuuuuuauacag

SEQ ID NO: 1487915 - RNA, 13 nt, Human
cuaugaaggcugu

SEQ ID NO: 1487916 - RNA, 19 nt, Human
cuaugaacucuguuuucuu

SEQ ID NO: 1487917 - RNA, 17 nt, Human
cuauagcuaaguacaca

SEQ ID NO: 1487918 - RNA, 15 nt, Human
cuauagcuaaguaca

SEQ ID NO: 1487919 - RNA, 12 nt, Human
cuauacugcuug

SEQ ID NO: 1487920 - RNA, 21 nt, Human
cuauaguccagcuuuguucuu

SEQ ID NO: 1487921 - RNA, 19 nt, Human
cuauauaagacaagaacuc

SEQ ID NO: 1487922 - RNA, 20 nt, Human
cuauaguuauuaaguucuuu

SEQ ID NO: 1487923 - RNA, 14 nt, Human
cuauauaccaaagc

SEQ ID NO: 1487924 - RNA, 21 nt, Human
cuauauacucacuuucuagau

SEQ ID NO: 1487925 - RNA, 19 nt, Human
cuaugaaauauuauguuaa

SEQ ID NO: 1487926 - RNA, 19 nt, Human
cuauauaccaaagcacauu

SEQ ID NO: 1487927 - RNA, 19 nt, Human
cuauauagcugaucaguuu

SEQ ID NO: 1487928 - RNA, 16 nt, Human
cuauacccacccagaa

SEQ ID NO: 1487929 - RNA, 15 nt, Human
cuauacccacccaga

SEQ ID NO: 1487930 - RNA, 16 nt, Human
cuauaccaauaaagug

SEQ ID NO: 1487931 - RNA, 15 nt, Human
cuauaccaauaaagu

SEQ ID NO: 1487932 - RNA, 17 nt, Human
cuauacugcauacuuuu

SEQ ID NO: 1487933 - RNA, 19 nt, Human
cuauacugcauacuuuuua

SEQ ID NO: 1487934 - RNA, 21 nt, Human
cuauacugcauacuuuuuaaa

SEQ ID NO: 1487935 - RNA, 23 nt, Human
cuauacugcuuggagcugagcaa

SEQ ID NO: 1487936 - RNA, 13 nt, Human
cuauaauuuaaau

SEQ ID NO: 1487937 - RNA, 12 nt, Human
cuauaauuuaaa

SEQ ID NO: 1487938 - RNA, 23 nt, Human
cucaacuccgugcuuaaccaaag

SEQ ID NO: 1487939 - RNA, 19 nt, Human
cucaaccccuccccuccau

SEQ ID NO: 1487940 - RNA, 21 nt, Human
cucaaccccuccccuccaucc

SEQ ID NO: 1487941 - RNA, 23 nt, Human
cucaaccccuccccuccaucccu

SEQ ID NO: 1487942 - RNA, 16 nt, Human
cuauuucuuaaacacu

SEQ ID NO: 1487943 - RNA, 18 nt, Human
cuauuucuuaaacacuug

SEQ ID NO: 1487944 - RNA, 17 nt, Human
cucaaggcggugcuuga

SEQ ID NO: 1487945 - RNA, 23 nt, Human
cucaaggcggugcuugauagaaa

SEQ ID NO: 1487946 - RNA, 15 nt, Human
cucacaccugaacug

SEQ ID NO: 1487947 - RNA, 23 nt, Human
cucacacucaugcauuguccucu

SEQ ID NO: 1487948 - RNA, 22 nt, Human
cucacacucaugcauuguccuc

SEQ ID NO: 1487949 - RNA, 19 nt, Human
cuauugcauuuauauguac

SEQ ID NO: 1487950 - RNA, 17 nt, Human
cuauugccucugagagc

SEQ ID NO: 1487951 - RNA, 13 nt, Human
cuauugccucuga

SEQ ID NO: 1487952 - RNA, 11 nt, Human
cuauugccucu

SEQ ID NO: 1487953 - RNA, 17 nt, Human
cuauugcauuuauaugu

SEQ ID NO: 1487954 - RNA, 14 nt, Human
cuauugcauuuaua

SEQ ID NO: 1487955 - RNA, 14 nt, Human
cuauugccucugag

SEQ ID NO: 1487956 - RNA, 13 nt, Human
cuauuuaacugac

SEQ ID NO: 1487957 - RNA, 14 nt, Human
cuauuuaacugacu

SEQ ID NO: 1487958 - RNA, 15 nt, Human
cuauuuaacugacua

SEQ ID NO: 1487959 - RNA, 17 nt, Human
cucccucaaccucaucc

SEQ ID NO: 1487960 - RNA, 13 nt, Human
cucccucaaccuc

SEQ ID NO: 1487961 - RNA, 22 nt, Human
cuccccuggaacugucucucau

SEQ ID NO: 1487962 - RNA, 19 nt, Human
cuccccugcacuguaaaau

SEQ ID NO: 1487963 - RNA, 12 nt, Human
cucccuggauga

SEQ ID NO: 1487964 - RNA, 13 nt, Human
cucccuggauuuu

SEQ ID NO: 1487965 - RNA, 24 nt, Human
cucccuggauuuuuaccagucuca

SEQ ID NO: 1487966 - RNA, 19 nt, Human
cucccuggauuuuuaccag

SEQ ID NO: 1487967 - RNA, 12 nt, Human
cuccccugcacu

SEQ ID NO: 1487968 - RNA, 13 nt, Human
cuccccugcacug

SEQ ID NO: 1487969 - RNA, 14 nt, Human
cuccccugcacugu

SEQ ID NO: 1487970 - RNA, 15 nt, Human
cuccccugcacugua

SEQ ID NO: 1487971 - RNA, 16 nt, Human
cuccccugcacuguaa

SEQ ID NO: 1487972 - RNA, 17 nt, Human
cuccccugcacuguaaa

SEQ ID NO: 1487973 - RNA, 18 nt, Human
cuccccugcacuguaaaa

SEQ ID NO: 1487974 - RNA, 21 nt, Human
cuccccugcacuguaaaaugu

SEQ ID NO: 1487975 - RNA, 20 nt, Human
cuccccacgucagcugggac

SEQ ID NO: 1487976 - RNA, 19 nt, Human
cuccauggcccugccaugc

SEQ ID NO: 1487977 - RNA, 16 nt, Human
cuccauggcccugcca

SEQ ID NO: 1487978 - RNA, 15 nt, Human
cuccauggcccugcc

SEQ ID NO: 1487979 - RNA, 13 nt, Human
cucccaauucauc

SEQ ID NO: 1487980 - RNA, 17 nt, Human
cuccaccgcagaaggaa

SEQ ID NO: 1487981 - RNA, 16 nt, Human
cuccaccgcagaagga

SEQ ID NO: 1487982 - RNA, 22 nt, Human
cuccaccaucgucuucuuggcc

SEQ ID NO: 1487983 - RNA, 16 nt, Human
cuccaccaucgucuuc

SEQ ID NO: 1487984 - RNA, 18 nt, Human
cuccaccgcagaaggaag

SEQ ID NO: 1487985 - RNA, 16 nt, Human
cuccacucaugugacu

SEQ ID NO: 1487986 - RNA, 22 nt, Human
cuccacucaugugacucuuucc

SEQ ID NO: 1487987 - RNA, 21 nt, Human
cuccagagaguaucugaggca

SEQ ID NO: 1487988 - RNA, 23 nt, Human
cuccagccaucaagagacugagu

SEQ ID NO: 1487989 - RNA, 13 nt, Human
cucaguugcagcc

SEQ ID NO: 1487990 - RNA, 15 nt, Human
cucaguugauuuucu

SEQ ID NO: 1487991 - RNA, 16 nt, Human
cucaguugauuuucug

SEQ ID NO: 1487992 - RNA, 18 nt, Human
cucaguugauuuucugga

SEQ ID NO: 1487993 - RNA, 20 nt, Human
cucaguugauuuucuggauu

SEQ ID NO: 1487994 - RNA, 13 nt, Human
cucaguuuucaua

SEQ ID NO: 1487995 - RNA, 14 nt, Human
cucaguuuucauaa

SEQ ID NO: 1487996 - RNA, 22 nt, Human
cuccaaaccacuuuuugcagcu

SEQ ID NO: 1487997 - RNA, 13 nt, Human
cuccaaaccacuu

SEQ ID NO: 1487998 - RNA, 22 nt, Human
cuccaaaauguuggucauuuua

SEQ ID NO: 1487999 - RNA, 18 nt, Human
cucauuuuaggcaaauau

SEQ ID NO: 1488000 - RNA, 22 nt, Human
cucauuuuuccguaaaaaugau

SEQ ID NO: 1488001 - RNA, 13 nt, Human
cucauuuuuuaaa

SEQ ID NO: 1488002 - RNA, 19 nt, Human
cuccaaggaggggcuguaa

SEQ ID NO: 1488003 - RNA, 20 nt, Human
cuccaaggaggggcuguaaa

SEQ ID NO: 1488004 - RNA, 21 nt, Human
cuccaaggaggggcuguaaaa

SEQ ID NO: 1488005 - RNA, 22 nt, Human
cuccaaggaggggcuguaaaau

SEQ ID NO: 1488006 - RNA, 13 nt, Human
cucauuucaggau

SEQ ID NO: 1488007 - RNA, 12 nt, Human
cucauuucagga

SEQ ID NO: 1488008 - RNA, 12 nt, Human
cucauuuccaag

SEQ ID NO: 1488009 - RNA, 13 nt, Human
cucauuuccaagc

SEQ ID NO: 1488010 - RNA, 14 nt, Human
cucauuuccaagca

SEQ ID NO: 1488011 - RNA, 17 nt, Human
cucauuuccaagcaagu

SEQ ID NO: 1488012 - RNA, 21 nt, Human
cucauuuccaagcaaguauua

SEQ ID NO: 1488013 - RNA, 23 nt, Human
cucaggagcccugggaggcucug

SEQ ID NO: 1488014 - RNA, 22 nt, Human
cucaggagcccugggaggcucu

SEQ ID NO: 1488015 - RNA, 21 nt, Human
cucaggagcccugggaggcuc

SEQ ID NO: 1488016 - RNA, 20 nt, Human
cucaggagcccugggaggcu

SEQ ID NO: 1488017 - RNA, 17 nt, Human
cucaggagcccugggag

SEQ ID NO: 1488018 - RNA, 16 nt, Human
cucaggagcccuggga

SEQ ID NO: 1488019 - RNA, 15 nt, Human
cucaggagcccuggg

SEQ ID NO: 1488020 - RNA, 14 nt, Human
cucaggagcccugg

SEQ ID NO: 1488021 - RNA, 13 nt, Human
cucaggagcccug

SEQ ID NO: 1488022 - RNA, 12 nt, Human
cucaggagcccu

SEQ ID NO: 1488023 - RNA, 20 nt, Human
cucagcucucaguugcagcc

SEQ ID NO: 1488024 - RNA, 23 nt, Human
cucagcucugacauucugauucg

SEQ ID NO: 1488025 - RNA, 17 nt, Human
cucaggaaccgaggcag

SEQ ID NO: 1488026 - RNA, 18 nt, Human
cucaggaaccgaggcagg

SEQ ID NO: 1488027 - RNA, 19 nt, Human
cucaggaaccgaggcaggg

SEQ ID NO: 1488028 - RNA, 14 nt, Human
cucagcuuucuaag

SEQ ID NO: 1488029 - RNA, 24 nt, Human
cucaggagcccugggaggcucugg

SEQ ID NO: 1488030 - RNA, 17 nt, Human
cucagccccgcguggaa

SEQ ID NO: 1488031 - RNA, 20 nt, Human
cucagcucacugcaaccucc

SEQ ID NO: 1488032 - RNA, 14 nt, Human
cucagcucacugca

SEQ ID NO: 1488033 - RNA, 20 nt, Human
cucagcucacuacaaccucc

SEQ ID NO: 1488034 - RNA, 15 nt, Human
cucagcucacugcaa

SEQ ID NO: 1488035 - RNA, 18 nt, Human
cucacugcuugaacuagg

SEQ ID NO: 1488036 - RNA, 16 nt, Human
cucacugcuugaacua

SEQ ID NO: 1488037 - RNA, 16 nt, Human
cucagaggguguccug

SEQ ID NO: 1488038 - RNA, 22 nt, Human
cuaggaaauauuuauuuuaaua

SEQ ID NO: 1488039 - RNA, 20 nt, Human
cuaccaaggucuucuuaaua

SEQ ID NO: 1488040 - RNA, 15 nt, Human
cuaccaaagcaccuu

SEQ ID NO: 1488041 - RNA, 12 nt, Human
cuaccauuucag

SEQ ID NO: 1488042 - RNA, 13 nt, Human
cuaccauuucaga

SEQ ID NO: 1488043 - RNA, 14 nt, Human
cuaccaaagcaccu

SEQ ID NO: 1488044 - RNA, 17 nt, Human
cuacccccagcugugcu

SEQ ID NO: 1488045 - RNA, 13 nt, Human
cuacccuggacuu

SEQ ID NO: 1488046 - RNA, 17 nt, Human
cuacccuggacuugccu

SEQ ID NO: 1488047 - RNA, 16 nt, Human
cuacccuaaccaaguu

SEQ ID NO: 1488048 - RNA, 19 nt, Human
cuacccccagcugugcuua

SEQ ID NO: 1488049 - RNA, 18 nt, Human
cuacccccagcugugcuu

SEQ ID NO: 1488050 - RNA, 12 nt, Human
cuacaggccuca

SEQ ID NO: 1488051 - RNA, 16 nt, Human
cuacaggccucacaca

SEQ ID NO: 1488052 - RNA, 20 nt, Human
cuacaggccucacacacaau

SEQ ID NO: 1488053 - RNA, 21 nt, Human
cuacaggcgugagccaccaug

SEQ ID NO: 1488054 - RNA, 17 nt, Human
cuacuggucuuguggaa

SEQ ID NO: 1488055 - RNA, 22 nt, Human
cuaauagggcaauuaauuccuu

SEQ ID NO: 1488056 - RNA, 23 nt, Human
cuaauaguuuuauuaauaaacau

SEQ ID NO: 1488057 - RNA, 19 nt, Human
cuaauacagcaacaauuua

SEQ ID NO: 1488058 - RNA, 23 nt, Human
cuaauacagcaacaauuuaugaa

SEQ ID NO: 1488059 - RNA, 21 nt, Human
cuaagcuucacuguaaaauaa

SEQ ID NO: 1488060 - RNA, 16 nt, Human
cuacacccagcaauag

SEQ ID NO: 1488061 - RNA, 14 nt, Human
cuacacccagcaau

SEQ ID NO: 1488062 - RNA, 13 nt, Human
cuacacccagcaa

SEQ ID NO: 1488063 - RNA, 12 nt, Human
cuacacccagca

SEQ ID NO: 1488064 - RNA, 11 nt, Human
cuacacccagc

SEQ ID NO: 1488065 - RNA, 23 nt, Human
cuacacgagauacagaauuuuau

SEQ ID NO: 1488066 - RNA, 14 nt, Human
cuacacuaagagag

SEQ ID NO: 1488067 - RNA, 17 nt, Human
cuaauauggcaaccauu

SEQ ID NO: 1488068 - RNA, 14 nt, Human
cuaaucaugaaacu

SEQ ID NO: 1488069 - RNA, 18 nt, Human
cuaaugccuuacucuucu

SEQ ID NO: 1488070 - RNA, 14 nt, Human
cuaauggcaugaga

SEQ ID NO: 1488071 - RNA, 16 nt, Human
cuaauggcaugagaaa

SEQ ID NO: 1488072 - RNA, 18 nt, Human
cuaauggcaugagaaaua

SEQ ID NO: 1488073 - RNA, 18 nt, Human
cuaauuauauaauauuuu

SEQ ID NO: 1488074 - RNA, 16 nt, Human
cuaauuauauaauauu

SEQ ID NO: 1488075 - RNA, 15 nt, Human
cuaauucaauucaaa

SEQ ID NO: 1488076 - RNA, 13 nt, Human
cguuuucaaaauu

SEQ ID NO: 1488077 - RNA, 19 nt, Human
cuaaauucuuucauuuuag

SEQ ID NO: 1488078 - RNA, 20 nt, Human
cuaaaucuuuuauaggauuu

SEQ ID NO: 1488079 - RNA, 16 nt, Human
cuaacaaccaaagacu

SEQ ID NO: 1488080 - RNA, 12 nt, Human
cuaaccaaguuc

SEQ ID NO: 1488081 - RNA, 10 nt, Human
cuaaccaagu

SEQ ID NO: 1488082 - RNA, 14 nt, Human
cuaagagagaauga

SEQ ID NO: 1488083 - RNA, 15 nt, Human
cuaagagagaaugag

SEQ ID NO: 1488084 - RNA, 19 nt, Human
cuaacccagguauccaaaa

SEQ ID NO: 1488085 - RNA, 14 nt, Human
cuaaaauauuuauu

SEQ ID NO: 1488086 - RNA, 15 nt, Human
cuaaaauauuuauuu

SEQ ID NO: 1488087 - RNA, 23 nt, Human
cuaaaauauuuauuuuuuuuaag

SEQ ID NO: 1488088 - RNA, 17 nt, Human
cuaaauauauuuuaaga

SEQ ID NO: 1488089 - RNA, 20 nt, Human
cuaaacugagacaaugccuu

SEQ ID NO: 1488090 - RNA, 19 nt, Human
cuaaauaccucaaucaguc

SEQ ID NO: 1488091 - RNA, 16 nt, Human
cuaaauaaagauauug

SEQ ID NO: 1488092 - RNA, 18 nt, Human
cguuuggugcuucucaga

SEQ ID NO: 1488093 - RNA, 11 nt, Human
cuaaaaauaaa

SEQ ID NO: 1488094 - RNA, 14 nt, Human
cuaaaauaaagaaa

SEQ ID NO: 1488095 - RNA, 16 nt, Human
cuaaaauaaagaaaua

SEQ ID NO: 1488096 - RNA, 22 nt, Human
cuaaaauaaagaaauagaacaa

SEQ ID NO: 1488097 - RNA, 20 nt, Human
cgggaauuuucaucuaggau

SEQ ID NO: 1488098 - RNA, 18 nt, Human
cgggaauuuucaucuagg

SEQ ID NO: 1488099 - RNA, 18 nt, Human
cgggacaccuaggcuagg

SEQ ID NO: 1488100 - RNA, 19 nt, Human
cgggacaccuaggcuaggg

SEQ ID NO: 1488101 - RNA, 16 nt, Human
cggcuugccacacccc

SEQ ID NO: 1488102 - RNA, 15 nt, Human
cgggaaaaagcccac

SEQ ID NO: 1488103 - RNA, 18 nt, Human
cggagugaguuuuuuagu

SEQ ID NO: 1488104 - RNA, 22 nt, Human
cggccuccguccaggagccugg

SEQ ID NO: 1488105 - RNA, 21 nt, Human
cggccuccguccaggagccug

SEQ ID NO: 1488106 - RNA, 15 nt, Human
cgcuaaaagaaacuu

SEQ ID NO: 1488107 - RNA, 13 nt, Human
cgcuaaaagaaac

SEQ ID NO: 1488108 - RNA, 11 nt, Human
cgcggcuggga

SEQ ID NO: 1488109 - RNA, 12 nt, Human
cgcggcugggag

SEQ ID NO: 1488110 - RNA, 16 nt, Human
cgcggcugggaggagg

SEQ ID NO: 1488111 - RNA, 14 nt, Human
cgcuuuccugaauc

SEQ ID NO: 1488112 - RNA, 20 nt, Human
cgcuuaucaacuaaugauuu

SEQ ID NO: 1488113 - RNA, 16 nt, Human
cgcacggcagccacag

SEQ ID NO: 1488114 - RNA, 18 nt, Human
ccuguggaucaaauccag

SEQ ID NO: 1488115 - RNA, 15 nt, Human
ccugugccugacccu

SEQ ID NO: 1488116 - RNA, 21 nt, Human
ccuucaugcauggaaauuccc

SEQ ID NO: 1488117 - RNA, 12 nt, Human
ccuucaugcaug

SEQ ID NO: 1488118 - RNA, 15 nt, Human
ccuucaugcauggaa

SEQ ID NO: 1488119 - RNA, 12 nt, Human
ccuucauuuccu

SEQ ID NO: 1488120 - RNA, 13 nt, Human
ccuucauuuccuc

SEQ ID NO: 1488121 - RNA, 14 nt, Human
ccuucauuuccucc

SEQ ID NO: 1488122 - RNA, 15 nt, Human
ccuucauuuccuccg

SEQ ID NO: 1488123 - RNA, 19 nt, Human
ccuucuccauggcccugcc

SEQ ID NO: 1488124 - RNA, 22 nt, Human
ccuucuccauggcccugccaug

SEQ ID NO: 1488125 - RNA, 13 nt, Human
ccuucuccccugc

SEQ ID NO: 1488126 - RNA, 15 nt, Human
ccuucuccccugcac

SEQ ID NO: 1488127 - RNA, 16 nt, Human
ccuucuccccugcacu

SEQ ID NO: 1488128 - RNA, 17 nt, Human
ccuucuccccugcacug

SEQ ID NO: 1488129 - RNA, 22 nt, Human
ccuucuccccugcacuguaaaa

SEQ ID NO: 1488130 - RNA, 24 nt, Human
ccuucuccccugcacuguaaaaug

SEQ ID NO: 1488131 - RNA, 23 nt, Human
ccuucuccccugcacuguaaaau

SEQ ID NO: 1488132 - RNA, 22 nt, Human
ccuuccuguuuuucacauuuuc

SEQ ID NO: 1488133 - RNA, 19 nt, Human
ccuuccuggggcaucuggc

SEQ ID NO: 1488134 - RNA, 17 nt, Human
ccuuccuguuuuucaca

SEQ ID NO: 1488135 - RNA, 19 nt, Human
ccuuccuguuuuucacauu

SEQ ID NO: 1488136 - RNA, 21 nt, Human
ccuugggcuccgugugggaga

SEQ ID NO: 1488137 - RNA, 13 nt, Human
ccuugguuccuaa

SEQ ID NO: 1488138 - RNA, 22 nt, Human
ccuugguucuugaggggaccag

SEQ ID NO: 1488139 - RNA, 23 nt, Human
cgaaggaaaagggcuuucucaau

SEQ ID NO: 1488140 - RNA, 12 nt, Human
cgaaugacacug

SEQ ID NO: 1488141 - RNA, 16 nt, Human
cgaaugacacuguuca

SEQ ID NO: 1488142 - RNA, 13 nt, Human
cgaaugacacugu

SEQ ID NO: 1488143 - RNA, 15 nt, Human
cgaagcguuguccuc

SEQ ID NO: 1488144 - RNA, 16 nt, Human
cgaagcguuguccuca

SEQ ID NO: 1488145 - RNA, 17 nt, Human
cgaagcguuguccucag

SEQ ID NO: 1488146 - RNA, 21 nt, Human
cgaagcguuguccucagcccc

SEQ ID NO: 1488147 - RNA, 20 nt, Human
ccuugugaaucaagggucag

SEQ ID NO: 1488148 - RNA, 13 nt, Human
ccuugugcugggg

SEQ ID NO: 1488149 - RNA, 17 nt, Human
ccugcccugccaccugu

SEQ ID NO: 1488150 - RNA, 15 nt, Human
ccugcccugccaccu

SEQ ID NO: 1488151 - RNA, 14 nt, Human
ccugcccugccacc

SEQ ID NO: 1488152 - RNA, 12 nt, Human
ccugcccugcca

SEQ ID NO: 1488153 - RNA, 11 nt, Human
ccugcccugcc

SEQ ID NO: 1488154 - RNA, 17 nt, Human
ccugcccugcccugcca

SEQ ID NO: 1488155 - RNA, 16 nt, Human
ccugcccugcccugcc

SEQ ID NO: 1488156 - RNA, 15 nt, Human
ccugcccugcccugc

SEQ ID NO: 1488157 - RNA, 18 nt, Human
ccugcccugccaccuguc

SEQ ID NO: 1488158 - RNA, 21 nt, Human
ccugcccugccaccugucugu

SEQ ID NO: 1488159 - RNA, 14 nt, Human
ccugccgagagucc

SEQ ID NO: 1488160 - RNA, 22 nt, Human
ccugccgagaguccaucagccu

SEQ ID NO: 1488161 - RNA, 23 nt, Human
ccugccgagaguccaucagccuc

SEQ ID NO: 1488162 - RNA, 17 nt, Human
ccugccaccugucuguc

SEQ ID NO: 1488163 - RNA, 16 nt, Human
ccugccaccugucugu

SEQ ID NO: 1488164 - RNA, 15 nt, Human
ccugccaccugucug

SEQ ID NO: 1488165 - RNA, 14 nt, Human
ccugccaccugucu

SEQ ID NO: 1488166 - RNA, 13 nt, Human
ccugccaccuguc

SEQ ID NO: 1488167 - RNA, 12 nt, Human
ccugccaccugu

SEQ ID NO: 1488168 - RNA, 17 nt, Human
ccugccaccuccugccu

SEQ ID NO: 1488169 - RNA, 22 nt, Human
ccugccaggaggacccagggcu

SEQ ID NO: 1488170 - RNA, 15 nt, Human
ccugccaggaggacc

SEQ ID NO: 1488171 - RNA, 19 nt, Human
ccugccaggaggacccagg

SEQ ID NO: 1488172 - RNA, 23 nt, Human
ccugccaggaggacccagggcuc

SEQ ID NO: 1488173 - RNA, 23 nt, Human
ccucuuccuucccugcugugaaa

SEQ ID NO: 1488174 - RNA, 17 nt, Human
ccucuucuauuuuguaa

SEQ ID NO: 1488175 - RNA, 18 nt, Human
ccucuucuauuuuguaaa

SEQ ID NO: 1488176 - RNA, 22 nt, Human
ccugaaaagguuuaugaaaaag

SEQ ID NO: 1488177 - RNA, 20 nt, Human
ccuaucuuugccacccucau

SEQ ID NO: 1488178 - RNA, 19 nt, Human
ccuaucuuugccacccuca

SEQ ID NO: 1488179 - RNA, 15 nt, Human
ccuaucuuugccacc

SEQ ID NO: 1488180 - RNA, 13 nt, Human
ccuaucuuugcca

SEQ ID NO: 1488181 - RNA, 12 nt, Human
ccuaucuuugcc

SEQ ID NO: 1488182 - RNA, 12 nt, Human
ccucuuccaguc

SEQ ID NO: 1488183 - RNA, 14 nt, Human
ccucuuccagucuu

SEQ ID NO: 1488184 - RNA, 17 nt, Human
ccuaugauauuuucugu

SEQ ID NO: 1488185 - RNA, 20 nt, Human
ccugaagcuaucguaaaauu

SEQ ID NO: 1488186 - RNA, 19 nt, Human
ccugccaccuccugccuca

SEQ ID NO: 1488187 - RNA, 16 nt, Human
ccugccaccuccugcc

SEQ ID NO: 1488188 - RNA, 14 nt, Human
ccugccaccuccug

SEQ ID NO: 1488189 - RNA, 18 nt, Human
ccugaggccuagacucug

SEQ ID NO: 1488190 - RNA, 16 nt, Human
ccugcacuguaaaaug

SEQ ID NO: 1488191 - RNA, 15 nt, Human
ccugcacuguaaaau

SEQ ID NO: 1488192 - RNA, 15 nt, Human
ccugcaccggggccu

SEQ ID NO: 1488193 - RNA, 19 nt, Human
ccugcaccaugcugcuggg

SEQ ID NO: 1488194 - RNA, 17 nt, Human
ccugcaccggggccugg

SEQ ID NO: 1488195 - RNA, 11 nt, Human
ccugcacugua

SEQ ID NO: 1488196 - RNA, 12 nt, Human
ccugcacuguaa

SEQ ID NO: 1488197 - RNA, 13 nt, Human
ccugcacuguaaa

SEQ ID NO: 1488198 - RNA, 14 nt, Human
ccugcacuguaaaa

SEQ ID NO: 1488199 - RNA, 20 nt, Human
ccugcacaauaaaaauguuu

SEQ ID NO: 1488200 - RNA, 19 nt, Human
ccugcacaauaaaaauguu

SEQ ID NO: 1488201 - RNA, 17 nt, Human
ccugagcugaccagccg

SEQ ID NO: 1488202 - RNA, 19 nt, Human
ccugaggccuagacucugu

SEQ ID NO: 1488203 - RNA, 16 nt, Human
ccuguaugucuccagu

SEQ ID NO: 1488204 - RNA, 20 nt, Human
ccuguagccccagugacagc

SEQ ID NO: 1488205 - RNA, 22 nt, Human
ccuguagccccagugacagcua

SEQ ID NO: 1488206 - RNA, 22 nt, Human
ccuggucugguugggcagccag

SEQ ID NO: 1488207 - RNA, 14 nt, Human
ccuguaccccagca

SEQ ID NO: 1488208 - RNA, 17 nt, Human
ccuguaccccagcacuu

SEQ ID NO: 1488209 - RNA, 18 nt, Human
ccuguggauguaaaguga

SEQ ID NO: 1488210 - RNA, 21 nt, Human
ccuggcuccguccaggagccu

SEQ ID NO: 1488211 - RNA, 22 nt, Human
ccugggagaaaucuggcuucug

SEQ ID NO: 1488212 - RNA, 18 nt, Human
ccuggguagcgggggagg

SEQ ID NO: 1488213 - RNA, 19 nt, Human
ccuggacuuggccccugcc

SEQ ID NO: 1488214 - RNA, 11 nt, Human
ccuaaccaagu

SEQ ID NO: 1488215 - RNA, 12 nt, Human
ccuaaccugccg

SEQ ID NO: 1488216 - RNA, 13 nt, Human
ccuaaccugccga

SEQ ID NO: 1488217 - RNA, 23 nt, Human
ccguggcuguggcauccagaguc

SEQ ID NO: 1488218 - RNA, 14 nt, Human
ccguucacaugugu

SEQ ID NO: 1488219 - RNA, 14 nt, Human
ccguucacauuuuu

SEQ ID NO: 1488220 - RNA, 16 nt, Human
ccuacuagucaccaga

SEQ ID NO: 1488221 - RNA, 16 nt, Human
ccuacuccaaaauguu

SEQ ID NO: 1488222 - RNA, 14 nt, Human
ccuacccuggacuu

SEQ ID NO: 1488223 - RNA, 16 nt, Human
ccuaggcuaggguggg

SEQ ID NO: 1488224 - RNA, 16 nt, Human
ccggggggucucuucu

SEQ ID NO: 1488225 - RNA, 21 nt, Human
ccgggggcagucugagagagg

SEQ ID NO: 1488226 - RNA, 20 nt, Human
ccggggccugggcaggaggg

SEQ ID NO: 1488227 - RNA, 20 nt, Human
ccgccucgaccucucucaaa

SEQ ID NO: 1488228 - RNA, 17 nt, Human
ccgccugggucuccuaa

SEQ ID NO: 1488229 - RNA, 20 nt, Human
ccgacugaaaauauuguuuu

SEQ ID NO: 1488230 - RNA, 21 nt, Human
ccgagaguccaucagccucca

SEQ ID NO: 1488231 - RNA, 20 nt, Human
ccgagaguccaucagccucc

SEQ ID NO: 1488232 - RNA, 18 nt, Human
ccgccucagccucccaaa

SEQ ID NO: 1488233 - RNA, 18 nt, Human
ccgcagaaggaaggcagg

SEQ ID NO: 1488234 - RNA, 15 nt, Human
ccgcagaaggaaggc

SEQ ID NO: 1488235 - RNA, 13 nt, Human
ccgcagaaggaag

SEQ ID NO: 1488236 - RNA, 14 nt, Human
cccugccucucugc

SEQ ID NO: 1488237 - RNA, 13 nt, Human
cccugccucucug

SEQ ID NO: 1488238 - RNA, 22 nt, Human
cccugccucucaucaacugaau

SEQ ID NO: 1488239 - RNA, 17 nt, Human
cccugccuccugccggc

SEQ ID NO: 1488240 - RNA, 16 nt, Human
cccugccucucugcag

SEQ ID NO: 1488241 - RNA, 15 nt, Human
cccugccucucugca

SEQ ID NO: 1488242 - RNA, 16 nt, Human
cccugcucaguaaagc

SEQ ID NO: 1488243 - RNA, 17 nt, Human
cccugcucccacagaac

SEQ ID NO: 1488244 - RNA, 13 nt, Human
cccugcugcugcc

SEQ ID NO: 1488245 - RNA, 13 nt, Human
cccugcugcccuc

SEQ ID NO: 1488246 - RNA, 15 nt, Human
cccuugaugaagaag

SEQ ID NO: 1488247 - RNA, 17 nt, Human
cccuuaugacugccaag

SEQ ID NO: 1488248 - RNA, 19 nt, Human
cccuuauugcuguccugga

SEQ ID NO: 1488249 - RNA, 12 nt, Human
cccuuauuuuca

SEQ ID NO: 1488250 - RNA, 21 nt, Human
cccuggugcacuggccccacc

SEQ ID NO: 1488251 - RNA, 18 nt, Human
cccugcugcugccugccu

SEQ ID NO: 1488252 - RNA, 17 nt, Human
cccugcugcugccugcc

SEQ ID NO: 1488253 - RNA, 16 nt, Human
cccugcugcugccugc

SEQ ID NO: 1488254 - RNA, 23 nt, Human
cccucguggacaccugcccugcc

SEQ ID NO: 1488255 - RNA, 22 nt, Human
cccucguggacaccugcccugc

SEQ ID NO: 1488256 - RNA, 19 nt, Human
cccucguggacaccugccc

SEQ ID NO: 1488257 - RNA, 18 nt, Human
cccucguggacaccugcc

SEQ ID NO: 1488258 - RNA, 17 nt, Human
cccucguggacaccugc

SEQ ID NO: 1488259 - RNA, 16 nt, Human
cccucguggacaccug

SEQ ID NO: 1488260 - RNA, 16 nt, Human
cccucccuacccuaac

SEQ ID NO: 1488261 - RNA, 15 nt, Human
cccucccuacccuaa

SEQ ID NO: 1488262 - RNA, 13 nt, Human
cccucuuccuucc

SEQ ID NO: 1488263 - RNA, 20 nt, Human
cccucucccaaaaaacuacu

SEQ ID NO: 1488264 - RNA, 23 nt, Human
ccccuggugcacuggccccaccc

SEQ ID NO: 1488265 - RNA, 18 nt, Human
ccccuggucccucugcag

SEQ ID NO: 1488266 - RNA, 17 nt, Human
ccccuggucccucugca

SEQ ID NO: 1488267 - RNA, 14 nt, Human
ccccugugccuugu

SEQ ID NO: 1488268 - RNA, 19 nt, Human
ccccugccucucugcaggu

SEQ ID NO: 1488269 - RNA, 17 nt, Human
ccccugccucucugcag

SEQ ID NO: 1488270 - RNA, 16 nt, Human
ccccugccucucugca

SEQ ID NO: 1488271 - RNA, 15 nt, Human
ccccugccucucugc

SEQ ID NO: 1488272 - RNA, 14 nt, Human
ccccugccucucug

SEQ ID NO: 1488273 - RNA, 15 nt, Human
ccccuagccugccuc

SEQ ID NO: 1488274 - RNA, 20 nt, Human
ccccuagcgcuaucucccug

SEQ ID NO: 1488275 - RNA, 13 nt, Human
cccccucccugga

SEQ ID NO: 1488276 - RNA, 16 nt, Human
cccccucccuggauga

SEQ ID NO: 1488277 - RNA, 14 nt, Human
cccccucccuggau

SEQ ID NO: 1488278 - RNA, 16 nt, Human
cccccagagccacagu

SEQ ID NO: 1488279 - RNA, 17 nt, Human
ccccuccacucuuucuu

SEQ ID NO: 1488280 - RNA, 12 nt, Human
ccccuccacucu

SEQ ID NO: 1488281 - RNA, 14 nt, Human
ccccucccuggaug

SEQ ID NO: 1488282 - RNA, 17 nt, Human
cccccacugccuuugac

SEQ ID NO: 1488283 - RNA, 15 nt, Human
cccccaccuggcuca

SEQ ID NO: 1488284 - RNA, 20 nt, Human
cccccaccuggcucaccuug

SEQ ID NO: 1488285 - RNA, 22 nt, Human
cccccagaaaagaaagcuacag

SEQ ID NO: 1488286 - RNA, 15 nt, Human
cccccagagccacag

SEQ ID NO: 1488287 - RNA, 17 nt, Human
ccccaucauugguaccc

SEQ ID NO: 1488288 - RNA, 18 nt, Human
ccccaguaucucuucagu

SEQ ID NO: 1488289 - RNA, 13 nt, Human
ccccagacacugg

SEQ ID NO: 1488290 - RNA, 15 nt, Human
ccccagugacagcua

SEQ ID NO: 1488291 - RNA, 20 nt, Human
cccagaaugagacauccagc

SEQ ID NO: 1488292 - RNA, 13 nt, Human
cccaugagcuccu

SEQ ID NO: 1488293 - RNA, 14 nt, Human
cccaugagcuccuu

SEQ ID NO: 1488294 - RNA, 15 nt, Human
cccaugagcuccuua

SEQ ID NO: 1488295 - RNA, 22 nt, Human
cccaugagcuccuuaaggcucu

SEQ ID NO: 1488296 - RNA, 23 nt, Human
ccccacccucguggacaccugcc

SEQ ID NO: 1488297 - RNA, 22 nt, Human
ccccacccucguggacaccugc

SEQ ID NO: 1488298 - RNA, 21 nt, Human
ccccacccucguggacaccug

SEQ ID NO: 1488299 - RNA, 21 nt, Human
cccauucauuccauucuggaa

SEQ ID NO: 1488300 - RNA, 22 nt, Human
cccauucauuccauucuggaag

SEQ ID NO: 1488301 - RNA, 18 nt, Human
cccauucauuccauucug

SEQ ID NO: 1488302 - RNA, 14 nt, Human
ccccaccuggcuca

SEQ ID NO: 1488303 - RNA, 16 nt, Human
ccccacgccacagccc

SEQ ID NO: 1488304 - RNA, 14 nt, Human
ccccacgccacagc

SEQ ID NO: 1488305 - RNA, 13 nt, Human
ccccacgccacag

SEQ ID NO: 1488306 - RNA, 14 nt, Human
ccccacuguaucua

SEQ ID NO: 1488307 - RNA, 15 nt, Human
ccccacgccacagcc

SEQ ID NO: 1488308 - RNA, 18 nt, Human
cccagaaugagacaucca

SEQ ID NO: 1488309 - RNA, 12 nt, Human
cccagaaugaga

SEQ ID NO: 1488310 - RNA, 15 nt, Human
cccacggcuccucga

SEQ ID NO: 1488311 - RNA, 15 nt, Human
cccacggccuuucua

SEQ ID NO: 1488312 - RNA, 15 nt, Human
cccacgucagcuggg

SEQ ID NO: 1488313 - RNA, 21 nt, Human
cccacacucagauccuccuca

SEQ ID NO: 1488314 - RNA, 22 nt, Human
cccacacucagauccuccucau

SEQ ID NO: 1488315 - RNA, 18 nt, Human
cccaaccauuuccucaga

SEQ ID NO: 1488316 - RNA, 17 nt, Human
cccaaccauuuccucag

SEQ ID NO: 1488317 - RNA, 14 nt, Human
cccaacacugccag

SEQ ID NO: 1488318 - RNA, 15 nt, Human
cccaacacugccagc

SEQ ID NO: 1488319 - RNA, 16 nt, Human
cccaacacugccagca

SEQ ID NO: 1488320 - RNA, 11 nt, Human
ccauuuuuccu

SEQ ID NO: 1488321 - RNA, 20 nt, Human
ccauguuaaccccuccacuc

SEQ ID NO: 1488322 - RNA, 18 nt, Human
ccauguuagccaggcugg

SEQ ID NO: 1488323 - RNA, 22 nt, Human
ccauuaaccagaucuagucaau

SEQ ID NO: 1488324 - RNA, 18 nt, Human
ccaucucugauuuucaaa

SEQ ID NO: 1488325 - RNA, 23 nt, Human
ccaucucugauuuucaaagcuuu

SEQ ID NO: 1488326 - RNA, 19 nt, Human
ccaucuugcccgcucaggc

SEQ ID NO: 1488327 - RNA, 21 nt, Human
ccaucuugcccgcucaggcug

SEQ ID NO: 1488328 - RNA, 16 nt, Human
ccauuugcuuuuucac

SEQ ID NO: 1488329 - RNA, 13 nt, Human
ccauucuccugag

SEQ ID NO: 1488330 - RNA, 20 nt, Human
ccauuauaaccuuaauuuau

SEQ ID NO: 1488331 - RNA, 24 nt, Human
ccaggcugggucgcccuggacugu

SEQ ID NO: 1488332 - RNA, 23 nt, Human
ccaggcugggucgcccuggacug

SEQ ID NO: 1488333 - RNA, 22 nt, Human
ccaggcugggucgcccuggacu

SEQ ID NO: 1488334 - RNA, 21 nt, Human
ccaggcugggucgcccuggac

SEQ ID NO: 1488335 - RNA, 16 nt, Human
ccaggcugggucgccc

SEQ ID NO: 1488336 - RNA, 12 nt, Human
ccaggcuggguc

SEQ ID NO: 1488337 - RNA, 17 nt, Human
ccaggguggcagcaaca

SEQ ID NO: 1488338 - RNA, 16 nt, Human
ccaggguggcagcaac

SEQ ID NO: 1488339 - RNA, 14 nt, Human
ccaggguggcagca

SEQ ID NO: 1488340 - RNA, 20 nt, Human
ccagguagaggguguguaag

SEQ ID NO: 1488341 - RNA, 20 nt, Human
ccaucaucuauagaaagcua

SEQ ID NO: 1488342 - RNA, 21 nt, Human
ccagguauucguuaucuaaua

SEQ ID NO: 1488343 - RNA, 20 nt, Human
ccagguauucguuaucuaau

SEQ ID NO: 1488344 - RNA, 22 nt, Human
ccagguauccaaaaauguguaa

SEQ ID NO: 1488345 - RNA, 19 nt, Human
ccagguauccaaaaaugug

SEQ ID NO: 1488346 - RNA, 12 nt, Human
ccagugacagcu

SEQ ID NO: 1488347 - RNA, 14 nt, Human
ccagugacagcuag

SEQ ID NO: 1488348 - RNA, 16 nt, Human
ccagugaccaaccuuu

SEQ ID NO: 1488349 - RNA, 20 nt, Human
ccagugcacuugcuggaaga

SEQ ID NO: 1488350 - RNA, 16 nt, Human
ccagugcacuugcugg

SEQ ID NO: 1488351 - RNA, 16 nt, Human
ccagaaugagacaucc

SEQ ID NO: 1488352 - RNA, 14 nt, Human
ccagaccauggaca

SEQ ID NO: 1488353 - RNA, 13 nt, Human
ccagagccaaggg

SEQ ID NO: 1488354 - RNA, 15 nt, Human
ccagagccacaguuc

SEQ ID NO: 1488355 - RNA, 14 nt, Human
ccagagccacaguu

SEQ ID NO: 1488356 - RNA, 13 nt, Human
ccagagccacagu

SEQ ID NO: 1488357 - RNA, 12 nt, Human
ccagagccacag

SEQ ID NO: 1488358 - RNA, 18 nt, Human
ccagaaaccuuuguuugc

SEQ ID NO: 1488359 - RNA, 16 nt, Human
ccacuuuuugcagcuu

SEQ ID NO: 1488360 - RNA, 16 nt, Human
ccagaaaacaaaacug

SEQ ID NO: 1488361 - RNA, 13 nt, Human
ccagaaaacaaaa

SEQ ID NO: 1488362 - RNA, 17 nt, Human
ccacuuuuugcagcuuu

SEQ ID NO: 1488363 - RNA, 15 nt, Human
ccacuuuuugcagcu

SEQ ID NO: 1488364 - RNA, 14 nt, Human
ccacuuuuugcagc

SEQ ID NO: 1488365 - RNA, 20 nt, Human
ccagaacuugacccugagcu

SEQ ID NO: 1488366 - RNA, 13 nt, Human
ccacuuuuugcag

SEQ ID NO: 1488367 - RNA, 18 nt, Human
ccacugcugauauuuucu

SEQ ID NO: 1488368 - RNA, 19 nt, Human
ccacugcugauauuuucuc

SEQ ID NO: 1488369 - RNA, 22 nt, Human
ccacugcugauauuuucucuag

SEQ ID NO: 1488370 - RNA, 20 nt, Human
ccacugcugauauuuucucu

SEQ ID NO: 1488371 - RNA, 19 nt, Human
ccacccucguggacaccug

SEQ ID NO: 1488372 - RNA, 18 nt, Human
ccacccucguggacaccu

SEQ ID NO: 1488373 - RNA, 17 nt, Human
ccacccucguggacacc

SEQ ID NO: 1488374 - RNA, 23 nt, Human
ccaccucucaauauucaauaaag

SEQ ID NO: 1488375 - RNA, 14 nt, Human
ccaccucucaauau

SEQ ID NO: 1488376 - RNA, 13 nt, Human
ccaccucucaaua

SEQ ID NO: 1488377 - RNA, 21 nt, Human
ccaccucgcagguucaagcaa

SEQ ID NO: 1488378 - RNA, 20 nt, Human
ccaccucgcagguucaagca

SEQ ID NO: 1488379 - RNA, 12 nt, Human
ccaccuggcuca

SEQ ID NO: 1488380 - RNA, 21 nt, Human
ccagccuggggcugaggcuga

SEQ ID NO: 1488381 - RNA, 19 nt, Human
ccagcuccgcgccaggaug

SEQ ID NO: 1488382 - RNA, 18 nt, Human
ccagccaucaagagacug

SEQ ID NO: 1488383 - RNA, 23 nt, Human
ccagccaucaccuuagaccacca

SEQ ID NO: 1488384 - RNA, 20 nt, Human
ccagccaucaagagacugag

SEQ ID NO: 1488385 - RNA, 22 nt, Human
ccagauuuuuuaaaauuuauau

SEQ ID NO: 1488386 - RNA, 21 nt, Human
ccagauuugcuaauuuauccu

SEQ ID NO: 1488387 - RNA, 16 nt, Human
ccagauuuuuacacau

SEQ ID NO: 1488388 - RNA, 15 nt, Human
agacauacccucccu

SEQ ID NO: 1488389 - RNA, 19 nt, Human
aaaaaugcacccuuucccu

SEQ ID NO: 1488390 - RNA, 19 nt, Human
uuggagcucgugggacagu

SEQ ID NO: 1488391 - RNA, 15 nt, Human
gccccugccucucug

SEQ ID NO: 1488392 - RNA, 23 nt, Human
gcccccaacagcacccucuccag

SEQ ID NO: 1488393 - RNA, 16 nt, Human
ggccccugccucucug

SEQ ID NO: 1488394 - RNA, 19 nt, Human
uuggagcucguggaacagu

SEQ ID NO: 1488395 - RNA, 19 nt, Human
auaaaaggugucuuucccu

SEQ ID NO: 1488396 - RNA, 22 nt, Human
accccaacagcacccucuccag

SEQ ID NO: 1488397 - RNA, 16 nt, Hepatitis E virus
acuuucgaugacuucu

SEQ ID NO: 1488398 - RNA, 13 nt, Hepatitis E virus
caccacuagccug

SEQ ID NO: 1488399 - RNA, 17 nt, Hepatitis E virus
uggcgagccgacuguua

SEQ ID NO: 1488400 - RNA, 14 nt, Hepatitis E virus
guugcuauuuccac

SEQ ID NO: 1488401 - RNA, 18 nt, Hepatitis E virus
gccucacgucguagaccu

SEQ ID NO: 1488402 - RNA, 22 nt, Hepatitis E virus
accucuggucuuguuaugcuuu

SEQ ID NO: 1488403 - RNA, 22 nt, Hepatitis E virus
ucucgccccgucgucucagcca

SEQ ID NO: 1488404 - RNA, 17 nt, Hepatitis E virus
gcuuauuucucauuucu

SEQ ID NO: 1488405 - RNA, 15 nt, Hepatitis E virus
cccgucaccgccuuc

SEQ ID NO: 1488406 - RNA, 17 nt, Hepatitis E virus
cuaccacagcuggggcc

SEQ ID NO: 1488407 - RNA, 18 nt, Hepatitis E virus
gugccgcccccuuggccu

SEQ ID NO: 1488408 - RNA, 17 nt, Hepatitis E virus
acaccccgccagugccu

SEQ ID NO: 1488409 - RNA, 17 nt, Hepatitis E virus
ucgucucagccaauggc

SEQ ID NO: 1488410 - RNA, 20 nt, Hepatitis E virus
cgaccaugcgcccucggccu

SEQ ID NO: 1488411 - RNA, 14 nt, Hepatitis E virus
cgccccgccgcugc

SEQ ID NO: 1488412 - RNA, 14 nt, Hepatitis E virus
ucuuccguggccac

SEQ ID NO: 1488413 - RNA, 15 nt, Hepatitis E virus
gccuauuuugcuguu

SEQ ID NO: 1488414 - RNA, 18 nt, Hepatitis E virus
gcuuggcgugaccaggcc

SEQ ID NO: 1488415 - RNA, 16 nt, Hepatitis E virus
caccacuagccugggu

SEQ ID NO: 1488416 - RNA, 19 nt, Hepatitis E virus
caccuuccccagccccauc

SEQ ID NO: 1488417 - RNA, 19 nt, Hepatitis E virus
accucuuccguggccaccg

SEQ ID NO: 1488418 - RNA, 18 nt, Hepatitis E virus
uuuccacuuacaccacua

SEQ ID NO: 1488419 - RNA, 15 nt, Hepatitis E virus
agccuccgagcaugu

SEQ ID NO: 1488420 - RNA, 20 nt, Hepatitis E virus
ggagugccgcccccuuggcc

SEQ ID NO: 1488421 - RNA, 19 nt, Hepatitis E virus
uaaccuaucaacaucuccc

SEQ ID NO: 1488422 - RNA, 22 nt, Hepatitis E virus
cucggccuauuuugcuguugcu

SEQ ID NO: 1488423 - RNA, 12 nt, Hepatitis E virus
ucguucuggcca

SEQ ID NO: 1488424 - RNA, 16 nt, Hepatitis E virus
gucagccgucuggccg

SEQ ID NO: 1488425 - RNA, 22 nt, Hepatitis E virus
cucauuucugcguuccgcgcuc

SEQ ID NO: 1488426 - RNA, 14 nt, Hepatitis E virus
augacaccccgcca

SEQ ID NO: 1488427 - RNA, 19 nt, Hepatitis E virus
uaccucuuccguggccacc

SEQ ID NO: 1488428 - RNA, 17 nt, Hepatitis E virus
ccagucuaugucucuga

SEQ ID NO: 1488429 - RNA, 17 nt, Hepatitis E virus
uaucaacaucuccccuu

SEQ ID NO: 1488430 - RNA, 14 nt, Hepatitis E virus
ccacuuacaccacu

SEQ ID NO: 1488431 - RNA, 13 nt, Hepatitis E virus
uggccagcuguuc

SEQ ID NO: 1488432 - RNA, 16 nt, Hepatitis E virus
guagaccuaccacagc

SEQ ID NO: 1488433 - RNA, 20 nt, Hepatitis E virus
gcccgcuucuaccccuccag

SEQ ID NO: 1488434 - RNA, 15 nt, Hepatitis E virus
uaccccuccaggacg

SEQ ID NO: 1488435 - RNA, 16 nt, Hepatitis E virus
gcccucgggcuguugg

SEQ ID NO: 1488436 - RNA, 14 nt, Hepatitis E virus
cuaccccuccagga

SEQ ID NO: 1488437 - RNA, 16 nt, Hepatitis E virus
cuugugccccccuucu

SEQ ID NO: 1488438 - RNA, 22 nt, Hepatitis E virus
accaacugcucguugagaaugc

SEQ ID NO: 1488439 - RNA, 18 nt, Hepatitis E virus
gguucgcgaccaugcgcc

SEQ ID NO: 1488440 - RNA, 14 nt, Hepatitis E virus
cgucgucucagcca

SEQ ID NO: 1488441 - RNA, 12 nt, Hepatitis E virus
cgcucccugaaa

SEQ ID NO: 1488442 - RNA, 20 nt, Hepatitis E virus
uuucuguugcuuauuucuca

SEQ ID NO: 1488443 - RNA, 20 nt, Hepatitis E virus
gucgcucgacuggaccaagg

SEQ ID NO: 1488444 - RNA, 20 nt, Hepatitis E virus
cagucuacugucgcugagcu

SEQ ID NO: 1488445 - RNA, 21 nt, Hepatitis E virus
caccuuccccagccccaucgc

SEQ ID NO: 1488446 - RNA, 12 nt, Hepatitis E virus
acuggaccaagg

SEQ ID NO: 1488447 - RNA, 13 nt, Hepatitis E virus
agugccgcccccu

SEQ ID NO: 1488448 - RNA, 20 nt, Hepatitis E virus
cuccagggcugugcuuuuca

SEQ ID NO: 1488449 - RNA, 23 nt, Hepatitis E virus
gcccaugacaccccgccagugcc

SEQ ID NO: 1488450 - RNA, 18 nt, Hepatitis E virus
uucucauuucugcguucc

SEQ ID NO: 1488451 - RNA, 13 nt, Hepatitis E virus
cauuucugcguuc

SEQ ID NO: 1488452 - RNA, 17 nt, Hepatitis E virus
gcccgcgccaccgcccg

SEQ ID NO: 1488453 - RNA, 14 nt, Hepatitis E virus
ccccuucuuucugu

SEQ ID NO: 1488454 - RNA, 20 nt, Hepatitis E virus
ucucccguuacuccagcacu

SEQ ID NO: 1488455 - RNA, 13 nt, Hepatitis E virus
cucucgccccguc

SEQ ID NO: 1488456 - RNA, 14 nt, Hepatitis E virus
uccucauguuucug

SEQ ID NO: 1488457 - RNA, 18 nt, Hepatitis E virus
gcucaccaccacggcugc

SEQ ID NO: 1488458 - RNA, 14 nt, Hepatitis E virus
ccaagugagcgccu

SEQ ID NO: 1488459 - RNA, 19 nt, Hepatitis E virus
gccgagcucaccaccacgg

SEQ ID NO: 1488460 - RNA, 11 nt, Hepatitis E virus
caccgcugccg

SEQ ID NO: 1488461 - RNA, 21 nt, Hepatitis E virus
cuuucuguugcuuauuucuca

SEQ ID NO: 1488462 - RNA, 22 nt, Hepatitis E virus
ccagcacugcccgucaccgccu

SEQ ID NO: 1488463 - RNA, 22 nt, Hepatitis E virus
cuccagggcugugcuuuucagu

SEQ ID NO: 1488464 - RNA, 18 nt, Hepatitis E virus
ugcggccggggcuggacc

SEQ ID NO: 1488465 - RNA, 16 nt, Hepatitis E virus
ucgacuggaccaaggu

SEQ ID NO: 1488466 - RNA, 15 nt, Hepatitis E virus
gcuugugccccccuu

SEQ ID NO: 1488467 - RNA, 14 nt, Hepatitis E virus
gacucugugaccuu

SEQ ID NO: 1488468 - RNA, 16 nt, Hepatitis E virus
ccgucuggccgccgcc

SEQ ID NO: 1488469 - RNA, 21 nt, Hepatitis E virus
caggaccgaccgacaccuucc

SEQ ID NO: 1488470 - RNA, 13 nt, Hepatitis E virus
cccagcgccccgc

SEQ ID NO: 1488471 - RNA, 14 nt, Hepatitis E virus
caccgcccggucag

SEQ ID NO: 1488472 - RNA, 14 nt, Hepatitis E virus
acucuuauacuaau

SEQ ID NO: 1488473 - RNA, 13 nt, Hepatitis E virus
gccugggugcugg

SEQ ID NO: 1488474 - RNA, 14 nt, Hepatitis E virus
cuuggcgugaccag

SEQ ID NO: 1488475 - RNA, 19 nt, Hepatitis E virus
ggguugcuauuuccacuua

SEQ ID NO: 1488476 - RNA, 13 nt, Hepatitis E virus
auggacuacccug

SEQ ID NO: 1488477 - RNA, 14 nt, Hepatitis E virus
uacuccagcacugc

SEQ ID NO: 1488478 - RNA, 19 nt, Hepatitis E virus
accgcugcggccggggcug

SEQ ID NO: 1488479 - RNA, 17 nt, Hepatitis E virus
cggucagccgucuggcc

SEQ ID NO: 1488480 - RNA, 14 nt, Hepatitis E virus
cuagcauugcuuga

SEQ ID NO: 1488481 - RNA, 17 nt, Hepatitis E virus
acugcuagugaccaacu

SEQ ID NO: 1488482 - RNA, 20 nt, Hepatitis E virus
gacaccuuccccagccccau

SEQ ID NO: 1488483 - RNA, 15 nt, Hepatitis E virus
cacagaccaccacca

SEQ ID NO: 1488484 - RNA, 16 nt, Hepatitis E virus
ggcccagcgccccgcc

SEQ ID NO: 1488485 - RNA, 12 nt, Hepatitis E virus
ucgucucagcca

SEQ ID NO: 1488486 - RNA, 21 nt, Hepatitis E virus
ccaccgcccggucagccgucu

SEQ ID NO: 1488487 - RNA, 20 nt, Hepatitis E virus
cccggucagccgucuggccg

SEQ ID NO: 1488488 - RNA, 23 nt, Hepatitis E virus
ucacacuugauggucgcccccuu

SEQ ID NO: 1488489 - RNA, 14 nt, Hepatitis E virus
gcuccggcccauga

SEQ ID NO: 1488490 - RNA, 12 nt, Hepatitis E virus
uccugccgcucc

SEQ ID NO: 1488491 - RNA, 17 nt, Hepatitis E virus
ccaauggcgagccgacu

SEQ ID NO: 1488492 - RNA, 18 nt, Hepatitis E virus
acagcuggggccgcgccg

SEQ ID NO: 1488493 - RNA, 15 nt, Hepatitis E virus
ucuaccccuccagga

SEQ ID NO: 1488494 - RNA, 14 nt, Hepatitis E virus
gcccgucaccgccu

SEQ ID NO: 1488495 - RNA, 18 nt, Hepatitis E virus
uuccaccacccagcagua

SEQ ID NO: 1488496 - RNA, 15 nt, Hepatitis E virus
gcccggagugccgcc

SEQ ID NO: 1488497 - RNA, 19 nt, Hepatitis E virus
gccuccagggcugugcuuu

SEQ ID NO: 1488498 - RNA, 21 nt, Hepatitis E virus
ggccgcgccgcuaaccgcggu

SEQ ID NO: 1488499 - RNA, 14 nt, Hepatitis E virus
cuucugcugcgccc

SEQ ID NO: 1488500 - RNA, 17 nt, Hepatitis E virus
uacgccgcuccucuuag

SEQ ID NO: 1488501 - RNA, 18 nt, Hepatitis E virus
cagcgccccgccgcugcc

SEQ ID NO: 1488502 - RNA, 24 nt, Hepatitis E virus
acuuacaccacuagccugggugcu

SEQ ID NO: 1488503 - RNA, 22 nt, Hepatitis E virus
caguauucaaagaccuucuuug

SEQ ID NO: 1488504 - RNA, 22 nt, Hepatitis E virus
gccccgucucuauuuccgcggu

SEQ ID NO: 1488505 - RNA, 16 nt, Hepatitis E virus
ccgcggucgcuccggc

SEQ ID NO: 1488506 - RNA, 19 nt, Hepatitis E virus
auuucgucggcugguggcc

SEQ ID NO: 1488507 - RNA, 16 nt, Hepatitis E virus
uacaaacuugguucuu

SEQ ID NO: 1488508 - RNA, 17 nt, Hepatitis E virus
ugaccaggcccagcgcc

SEQ ID NO: 1488509 - RNA, 20 nt, Hepatitis E virus
ucuguagagaaugcucagca

SEQ ID NO: 1488510 - RNA, 15 nt, Hepatitis E virus
accucgacugauguu

SEQ ID NO: 1488511 - RNA, 20 nt, Hepatitis E virus
ccggcccaugacaccccgcc

SEQ ID NO: 1488512 - RNA, 17 nt, Hepatitis E virus
ccuccagggcugugcuu

SEQ ID NO: 1488513 - RNA, 15 nt, Hepatitis E virus
auagcgcuuacccug

SEQ ID NO: 1488514 - RNA, 16 nt, Hepatitis E virus
cgucuggccgccgccg

SEQ ID NO: 1488515 - RNA, 22 nt, Hepatitis E virus
gcccccgaugucaccgcugcgg

SEQ ID NO: 1488516 - RNA, 13 nt, Hepatitis E virus
aggauaccaugga

SEQ ID NO: 1488517 - RNA, 16 nt, Hepatitis E virus
cugccgagcucaccac

SEQ ID NO: 1488518 - RNA, 20 nt, Hepatitis E virus
cgcccccgaugucaccgcug

SEQ ID NO: 1488519 - RNA, 12 nt, Hepatitis E virus
uugcuauuucca

SEQ ID NO: 1488520 - RNA, 14 nt, Hepatitis E virus
ugcuccucauguuu

SEQ ID NO: 1488521 - RNA, 16 nt, Hepatitis E virus
gccacagaccaccacc

SEQ ID NO: 1488522 - RNA, 18 nt, Hepatitis E virus
cgggcugauucucagccc

SEQ ID NO: 1488523 - RNA, 16 nt, Hepatitis E virus
cugcccgcgccaccgc

SEQ ID NO: 1488524 - RNA, 14 nt, Hepatitis E virus
cggucgcucgacug

SEQ ID NO: 1488525 - RNA, 19 nt, Hepatitis E virus
cgcccccuuggccuccagg

SEQ ID NO: 1488526 - RNA, 13 nt, Hepatitis E virus
cguagaccuacca

SEQ ID NO: 1488527 - RNA, 17 nt, Hepatitis E virus
gcucgacuggaccaagg

SEQ ID NO: 1488528 - RNA, 18 nt, Hepatitis E virus
accaugcgcccucggccu

SEQ ID NO: 1488529 - RNA, 22 nt, Hepatitis E virus
uugcuugugccccccuucuuuc

SEQ ID NO: 1488530 - RNA, 18 nt, Hepatitis E virus
cuauuuccacuuacacca

SEQ ID NO: 1488531 - RNA, 23 nt, Hepatitis E virus
ucugcccggagugccgcccccuu

SEQ ID NO: 1488532 - RNA, 19 nt, Hepatitis E virus
ucuggggugaccgggcuga

SEQ ID NO: 1488533 - RNA, 15 nt, Hepatitis E virus
caugucuucugcugc

SEQ ID NO: 1488534 - RNA, 20 nt, Hepatitis E virus
cuguagagaaugcucagcag

SEQ ID NO: 1488535 - RNA, 14 nt, Hepatitis E virus
cugugcuuuucagu

SEQ ID NO: 1488536 - RNA, 14 nt, Hepatitis E virus
cagcacugcccguc

SEQ ID NO: 1488537 - RNA, 17 nt, Hepatitis E virus
gcccccuuuccaccacc

SEQ ID NO: 1488538 - RNA, 23 nt, Hepatitis E virus
accucuauuuuacuaguacuaau

SEQ ID NO: 1488539 - RNA, 19 nt, Hepatitis E virus
aguauucaaagaccuucuu

SEQ ID NO: 1488540 - RNA, 18 nt, Hepatitis E virus
ccuaugcugcccgcgcca

SEQ ID NO: 1488541 - RNA, 13 nt, Hepatitis E virus
gagcucaccacca

SEQ ID NO: 1488542 - RNA, 15 nt, Hepatitis E virus
uggggugaccgggcu

SEQ ID NO: 1488543 - RNA, 22 nt, Hepatitis E virus
cccgcggcgccauccugcgccg

SEQ ID NO: 1488544 - RNA, 16 nt, Hepatitis E virus
cuuucucucaccgcug

SEQ ID NO: 1488545 - RNA, 14 nt, Hepatitis E virus
cccuucuuucuguu

SEQ ID NO: 1488546 - RNA, 16 nt, Hepatitis E virus
cacugcuagugaccaa

SEQ ID NO: 1488547 - RNA, 12 nt, Hepatitis E virus
agcauugcuuga

SEQ ID NO: 1488548 - RNA, 20 nt, Hepatitis E virus
agcuucuaauuaugcccagu

SEQ ID NO: 1488549 - RNA, 15 nt, Hepatitis E virus
cacucggcuccgcuu

SEQ ID NO: 1488550 - RNA, 21 nt, Hepatitis E virus
cuauuuugcuguugcuccuca

SEQ ID NO: 1488551 - RNA, 20 nt, Hepatitis E virus
accgggcugauucucagccc

SEQ ID NO: 1488552 - RNA, 14 nt, Hepatitis E virus
ugaccaggcccagc

SEQ ID NO: 1488553 - RNA, 20 nt, Hepatitis E virus
accgccuucgucgcggugca

SEQ ID NO: 1488554 - RNA, 16 nt, Hepatitis E virus
gaaucucguguaguua

SEQ ID NO: 1488555 - RNA, 13 nt, Hepatitis E virus
auggucgcccccu

SEQ ID NO: 1488556 - RNA, 18 nt, Hepatitis E virus
ggcggaggaggaggccac

SEQ ID NO: 1488557 - RNA, 19 nt, Hepatitis E virus
gggcuguuggacuuugccc

SEQ ID NO: 1488558 - RNA, 14 nt, Hepatitis E virus
cuguccuccgagcu

SEQ ID NO: 1488559 - RNA, 17 nt, Hepatitis E virus
acaucuguagagaaugc

SEQ ID NO: 1488560 - RNA, 14 nt, Hepatitis E virus
uacgccgcuccucu

SEQ ID NO: 1488561 - RNA, 19 nt, Hepatitis E virus
cggaggaggaggccaccuc

SEQ ID NO: 1488562 - RNA, 20 nt, Hepatitis E virus
cugacucugugaccuugguu

SEQ ID NO: 1488563 - RNA, 18 nt, Hepatitis E virus
gcuuucucucaccgcugc

SEQ ID NO: 1488564 - RNA, 18 nt, Hepatitis E virus
cagccccaucgcgccccu

SEQ ID NO: 1488565 - RNA, 16 nt, Hepatitis E virus
gcgccccgccgcugcc

SEQ ID NO: 1488566 - RNA, 23 nt, Hepatitis E virus
cauacuuucgaugacuucugccc

SEQ ID NO: 1488567 - RNA, 14 nt, Hepatitis E virus
ugccuaugcugccc

SEQ ID NO: 1488568 - RNA, 16 nt, Hepatitis E virus
cuuacaccacuagccu

SEQ ID NO: 1488569 - RNA, 17 nt, Hepatitis E virus
ccccuuggccuccaggg

SEQ ID NO: 1488570 - RNA, 18 nt, Hepatitis E virus
ccuauuuugcuguugcuc

SEQ ID NO: 1488571 - RNA, 18 nt, Hepatitis E virus
agcgccccgccgcugccu

SEQ ID NO: 1488572 - RNA, 15 nt, Hepatitis E virus
ccgagcucaccacca

SEQ ID NO: 1488573 - RNA, 13 nt, Hepatitis E virus
cccgccgcugccu

SEQ ID NO: 1488574 - RNA, 17 nt, Hepatitis E virus
gcgugaccaggcccagc

SEQ ID NO: 1488575 - RNA, 15 nt, Hepatitis E virus
gaccaccaccacccc

SEQ ID NO: 1488576 - RNA, 12 nt, Hepatitis E virus
cacucugcgcua

SEQ ID NO: 1488577 - RNA, 20 nt, Hepatitis E virus
ucagccgucuggccgccgcc

SEQ ID NO: 1488578 - RNA, 19 nt, Hepatitis E virus
ucugcugcgcccauggguu

SEQ ID NO: 1488579 - RNA, 17 nt, Hepatitis E virus
cuccagcacugcccguc

SEQ ID NO: 1488580 - RNA, 22 nt, Hepatitis E virus
gauaaccaacaugagcaggacc

SEQ ID NO: 1488581 - RNA, 22 nt, Hepatitis E virus
uccagcccggcauagccuccga

SEQ ID NO: 1488582 - RNA, 23 nt, Hepatitis E virus
guaaaacucgggaguuauaguuu

SEQ ID NO: 1488583 - RNA, 15 nt, Hepatitis E virus
cugccuaugcugccc

SEQ ID NO: 1488584 - RNA, 18 nt, Hepatitis E virus
gucagccgucuggccgcc

SEQ ID NO: 1488585 - RNA, 13 nt, Hepatitis E virus
ccauggacuaccc

SEQ ID NO: 1488586 - RNA, 18 nt, Hepatitis E virus
uguagagaaugcucagca

SEQ ID NO: 1488587 - RNA, 16 nt, Hepatitis E virus
ccucauguuucugccu

SEQ ID NO: 1488588 - RNA, 23 nt, Hepatitis E virus
cuggccacagaccaccaccaccc

SEQ ID NO: 1488589 - RNA, 23 nt, Hepatitis E virus
cguucuggccacagaccaccacc

SEQ ID NO: 1488590 - RNA, 14 nt, Hepatitis E virus
uauuucucauuucu

SEQ ID NO: 1488591 - RNA, 15 nt, Hepatitis E virus
cugguggccagcugu

SEQ ID NO: 1488592 - RNA, 22 nt, Hepatitis E virus
cgcccccuuggccuccagggcu

SEQ ID NO: 1488593 - RNA, 20 nt, Hepatitis E virus
cccagccccaucgcgccccu

SEQ ID NO: 1488594 - RNA, 13 nt, Hepatitis E virus
cacagaccaccac

SEQ ID NO: 1488595 - RNA, 20 nt, Hepatitis E virus
ucugcccggagugccgcccc

SEQ ID NO: 1488596 - RNA, 18 nt, Hepatitis E virus
ugacucugugaccuuggu

SEQ ID NO: 1488597 - RNA, 13 nt, Hepatitis E virus
gccuaugcugccc

SEQ ID NO: 1488598 - RNA, 13 nt, Hepatitis E virus
cgaccaugcgccc

SEQ ID NO: 1488599 - RNA, 19 nt, Hepatitis E virus
guuccgcaaccucaccccc

SEQ ID NO: 1488600 - RNA, 10 nt, Hepatitis E virus
uccaccaccc

SEQ ID NO: 1488601 - RNA, 23 nt, Hepatitis E virus
cuggccgccgccgugggcggcgc

SEQ ID NO: 1488602 - RNA, 22 nt, Hepatitis E virus
cuugaguuccgcaaccucaccc

SEQ ID NO: 1488603 - RNA, 19 nt, Hepatitis E virus
gcuacaauucgcuaccgcc

SEQ ID NO: 1488604 - RNA, 17 nt, Hepatitis E virus
ccgcgguaagcucuccu

SEQ ID NO: 1488605 - RNA, 22 nt, Hepatitis E virus
gcuaaccgcggucgcuccggcc

SEQ ID NO: 1488606 - RNA, 16 nt, Hepatitis E virus
cagaccaccaccaccc

SEQ ID NO: 1488607 - RNA, 20 nt, Hepatitis E virus
ggcccaugacaccccgccag

SEQ ID NO: 1488608 - RNA, 16 nt, Hepatitis E virus
gcccagcgccccgccg

SEQ ID NO: 1488609 - RNA, 14 nt, Hepatitis E virus
caccaccacggcug

SEQ ID NO: 1488610 - RNA, 17 nt, Hepatitis E virus
cuggccacagaccacca

SEQ ID NO: 1488611 - RNA, 14 nt, Hepatitis E virus
ugccgcccccuugg

SEQ ID NO: 1488612 - RNA, 18 nt, Hepatitis E virus
aggcccagcgccccgccg

SEQ ID NO: 1488613 - RNA, 22 nt, Hepatitis E virus
agugccugauguugacucccgc

SEQ ID NO: 1488614 - RNA, 15 nt, Hepatitis E virus
ccccuuuccaccacc

SEQ ID NO: 1488615 - RNA, 14 nt, Hepatitis E virus
ugcgcccauggguu

SEQ ID NO: 1488616 - RNA, 12 nt, Hepatitis E virus
ugcuugugcccc

SEQ ID NO: 1488617 - RNA, 20 nt, Hepatitis E virus
acacccugcuuggcggucua

SEQ ID NO: 1488618 - RNA, 19 nt, Hepatitis E virus
augacaccccgccagugcc

SEQ ID NO: 1488619 - RNA, 20 nt, Hepatitis E virus
gaauucaauaaccucgacug

SEQ ID NO: 1488620 - RNA, 22 nt, Hepatitis E virus
caccgccuucgucgcggugcag

SEQ ID NO: 1488621 - RNA, 14 nt, Hepatitis E virus
cgcuccucuuagcc

SEQ ID NO: 1488622 - RNA, 18 nt, Hepatitis E virus
uacaccacuagccugggu

SEQ ID NO: 1488623 - RNA, 20 nt, Hepatitis E virus
cggccuauuuugcuguugcu

SEQ ID NO: 1488624 - RNA, 17 nt, Hepatitis E virus
ccccuauauucauccaa

SEQ ID NO: 1488625 - RNA, 23 nt, Hepatitis E virus
ucugccuaugcugcccgcgccac

SEQ ID NO: 1488626 - RNA, 20 nt, Hepatitis E virus
gccgcccccuuggccuccag

SEQ ID NO: 1488627 - RNA, 15 nt, Hepatitis E virus
cccgcugguccccaa

SEQ ID NO: 1488628 - RNA, 13 nt, Hepatitis E virus
cugauucucagcc

SEQ ID NO: 1488629 - RNA, 21 nt, Hepatitis E virus
cccagcgccccgccgcugccu

SEQ ID NO: 1488630 - RNA, 20 nt, Hepatitis E virus
cccaucgcgccccuuuucug

SEQ ID NO: 1488631 - RNA, 19 nt, Hepatitis E virus
cuccucuuagcccgcuucu

SEQ ID NO: 1488632 - RNA, 18 nt, Hepatitis E virus
augacaucgaccucgggg

SEQ ID NO: 1488633 - RNA, 19 nt, Hepatitis E virus
gcucuucgaccggcccagu

SEQ ID NO: 1488634 - RNA, 18 nt, Hepatitis E virus
ggacugccgagcucacca

SEQ ID NO: 1488635 - RNA, 15 nt, Hepatitis E virus
gaggaggaggccacc

SEQ ID NO: 1488636 - RNA, 19 nt, Hepatitis E virus
accaaccccuucgcccccg

SEQ ID NO: 1488637 - RNA, 21 nt, Hepatitis E virus
gucucccguuacuccagcacu

SEQ ID NO: 1488638 - RNA, 13 nt, Hepatitis E virus
ugauucucagccc

SEQ ID NO: 1488639 - RNA, 14 nt, Hepatitis E virus
ccgccgcugccuca

SEQ ID NO: 1488640 - RNA, 18 nt, Hepatitis E virus
gcgaccggcgcgcaggcc

SEQ ID NO: 1488641 - RNA, 18 nt, Hepatitis E virus
cagucuaugucucugacu

SEQ ID NO: 1488642 - RNA, 12 nt, Hepatitis E virus
ucugcugcgccc

SEQ ID NO: 1488643 - RNA, 11 nt, Hepatitis E virus
ucgcccccuuu

SEQ ID NO: 1488644 - RNA, 19 nt, Hepatitis E virus
cgaguaugaccaguccacu

SEQ ID NO: 1488645 - RNA, 16 nt, Hepatitis E virus
cuccaucucguucugg

SEQ ID NO: 1488646 - RNA, 14 nt, Hepatitis E virus
cccgcccgaccacu

SEQ ID NO: 1488647 - RNA, 17 nt, Hepatitis E virus
auuuugcuguugcuccu

SEQ ID NO: 1488648 - RNA, 15 nt, Hepatitis E virus
cuuagcccgcuucua

SEQ ID NO: 1488649 - RNA, 16 nt, Hepatitis E virus
ugcccaguaccggguu

SEQ ID NO: 1488650 - RNA, 12 nt, Hepatitis E virus
uaguccagcccg

SEQ ID NO: 1488651 - RNA, 20 nt, Hepatitis E virus
uccaucucguucuggccaca

SEQ ID NO: 1488652 - RNA, 15 nt, Hepatitis E virus
acgcuguugguggcu

SEQ ID NO: 1488653 - RNA, 19 nt, Hepatitis E virus
gcuccgcuuggcgugacca

SEQ ID NO: 1488654 - RNA, 17 nt, Hepatitis E virus
ccccuuuucuguccucc

SEQ ID NO: 1488655 - RNA, 17 nt, Hepatitis E virus
cugcccggagugccgcc

SEQ ID NO: 1488656 - RNA, 22 nt, Hepatitis E virus
cccgaugucaccgcugcggccg

SEQ ID NO: 1488657 - RNA, 22 nt, Hepatitis E virus
ccccaucgcgccccuuuucugu

SEQ ID NO: 1488658 - RNA, 15 nt, Hepatitis E virus
ggccaccucuggucu

SEQ ID NO: 1488659 - RNA, 15 nt, Hepatitis E virus
gacucccgcggcgcc

SEQ ID NO: 1488660 - RNA, 16 nt, Hepatitis E virus
cagcgccccgccgcug

SEQ ID NO: 1488661 - RNA, 12 nt, Hepatitis E virus
uuccccagcccc

SEQ ID NO: 1488662 - RNA, 20 nt, Hepatitis E virus
auaccggugcccucgggcug

SEQ ID NO: 1488663 - RNA, 16 nt, Hepatitis E virus
uugcuguugcuccuca

SEQ ID NO: 1488664 - RNA, 20 nt, Hepatitis E virus
cuugcugacacccugcuugg

SEQ ID NO: 1488665 - RNA, 16 nt, Hepatitis E virus
uucgaccggcccaguc

SEQ ID NO: 1488666 - RNA, 13 nt, Hepatitis E virus
cuuauuucucauu

SEQ ID NO: 1488667 - RNA, 15 nt, Hepatitis E virus
acucugugaccuugg

SEQ ID NO: 1488668 - RNA, 12 nt, Hepatitis E virus
aacaccacugcu

SEQ ID NO: 1488669 - RNA, 15 nt, Hepatitis E virus
cgaccaugcgcccuc

SEQ ID NO: 1488670 - RNA, 14 nt, Hepatitis E virus
caccacugcuagug

SEQ ID NO: 1488671 - RNA, 21 nt, Hepatitis E virus
aguaccggguuguucgugcua

SEQ ID NO: 1488672 - RNA, 17 nt, Hepatitis E virus
gucuuguuaugcuuugc

SEQ ID NO: 1488673 - RNA, 17 nt, Hepatitis E virus
uuuacgccgcuccucuu

SEQ ID NO: 1488674 - RNA, 20 nt, Hepatitis E virus
cccccuuggccuccagggcu

SEQ ID NO: 1488675 - RNA, 13 nt, Hepatitis E virus
ccagcacugcccg

SEQ ID NO: 1488676 - RNA, 19 nt, Hepatitis E virus
gaguaugaccaguccacuu

SEQ ID NO: 1488677 - RNA, 20 nt, Hepatitis E virus
gcgccaccgcccggucagcc

SEQ ID NO: 1488678 - RNA, 16 nt, Hepatitis E virus
gccgucuggccgccgc

SEQ ID NO: 1488679 - RNA, 16 nt, Hepatitis E virus
cuucuaccccuccagg

SEQ ID NO: 1488680 - RNA, 17 nt, Hepatitis E virus
ccccuucuuucuguugc

SEQ ID NO: 1488681 - RNA, 18 nt, Hepatitis E virus
ugcuguuuuagcccccca

SEQ ID NO: 1488682 - RNA, 12 nt, Hepatitis E virus
ccacagaccacc

SEQ ID NO: 1488683 - RNA, 22 nt, Hepatitis E virus
caugcgcccucggccuauuuug

SEQ ID NO: 1488684 - RNA, 14 nt, Hepatitis E virus
ccuaccacagcugg

SEQ ID NO: 1488685 - RNA, 14 nt, Hepatitis E virus
augggacugccgag

SEQ ID NO: 1488686 - RNA, 18 nt, Hepatitis E virus
auuugcuugugccccccu

SEQ ID NO: 1488687 - RNA, 15 nt, Hepatitis E virus
acuccagcacugccc

SEQ ID NO: 1488688 - RNA, 14 nt, Hepatitis E virus
uaacaccacugcua

SEQ ID NO: 1488689 - RNA, 23 nt, Hepatitis E virus
ccgagcucaccaccacggcugcu

SEQ ID NO: 1488690 - RNA, 14 nt, Hepatitis E virus
cgucucuauuuccg

SEQ ID NO: 1488691 - RNA, 10 nt, Hepatitis E virus
uggcuacaga

SEQ ID NO: 1488692 - RNA, 20 nt, Hepatitis E virus
cuucuaauuaugcccaguac

SEQ ID NO: 1488693 - RNA, 11 nt, Hepatitis E virus
ccgcccccuug

SEQ ID NO: 1488694 - RNA, 14 nt, Hepatitis E virus
agcuguucuacucu

SEQ ID NO: 1488695 - RNA, 15 nt, Hepatitis E virus
ugcuugugccccccu

SEQ ID NO: 1488696 - RNA, 13 nt, Hepatitis E virus
uagccccccacuc

SEQ ID NO: 1488697 - RNA, 20 nt, Hepatitis E virus
ugcccggagugccgcccccu

SEQ ID NO: 1488698 - RNA, 19 nt, Hepatitis E virus
cugcguuccgcgcucccug

SEQ ID NO: 1488699 - RNA, 17 nt, Hepatitis E virus
uuuccaccacccagcag

SEQ ID NO: 1488700 - RNA, 14 nt, Hepatitis E virus
cccccacucugcgc

SEQ ID NO: 1488701 - RNA, 16 nt, Hepatitis E virus
ccggagugccgccccc

SEQ ID NO: 1488702 - RNA, 11 nt, Hepatitis E virus
aucgcgccccu

SEQ ID NO: 1488703 - RNA, 17 nt, Hepatitis E virus
ccucauguuucugccua

SEQ ID NO: 1488704 - RNA, 12 nt, Hepatitis E virus
gauucucagccc

SEQ ID NO: 1488705 - RNA, 15 nt, Hepatitis E virus
cagcgccccgccgcu

SEQ ID NO: 1488706 - RNA, 21 nt, Hepatitis E virus
aauacucauauaauggcuaca

SEQ ID NO: 1488707 - RNA, 13 nt, Hepatitis E virus
ccuuccccagccc

SEQ ID NO: 1488708 - RNA, 18 nt, Hepatitis E virus
caugacaccccgccagug

SEQ ID NO: 1488709 - RNA, 19 nt, Hepatitis E virus
cagcccuucgcaauccccu

SEQ ID NO: 1488710 - RNA, 17 nt, Hepatitis E virus
caucggguugcuauuuc

SEQ ID NO: 1488711 - RNA, 16 nt, Hepatitis E virus
guccugccgcuccgcg

SEQ ID NO: 1488712 - RNA, 14 nt, Hepatitis E virus
cacucggcuccgcu

SEQ ID NO: 1488713 - RNA, 23 nt, Hepatitis E virus
ccacagcuggggccgcgccgcua

SEQ ID NO: 1488714 - RNA, 21 nt, Hepatitis E virus
ucuccaucucguucuggccac

SEQ ID NO: 1488715 - RNA, 16 nt, Hepatitis E virus
cgcggcgccauccugc

SEQ ID NO: 1488716 - RNA, 18 nt, Hepatitis E virus
ccuuuccaccacccagca

SEQ ID NO: 1488717 - RNA, 21 nt, Hepatitis E virus
ucguugagaaugccgcugggc

SEQ ID NO: 1488718 - RNA, 12 nt, Hepatitis E virus
ugaccuugguua

SEQ ID NO: 1488719 - RNA, 13 nt, Hepatitis E virus
ggcgagccgacug

SEQ ID NO: 1488720 - RNA, 18 nt, Hepatitis E virus
ggguuguucgugcuacaa

SEQ ID NO: 1488721 - RNA, 19 nt, Hepatitis E virus
ccccgguaauaccaacacg

SEQ ID NO: 1488722 - RNA, 15 nt, Hepatitis E virus
uucuguugcuuauuu

SEQ ID NO: 1488723 - RNA, 22 nt, Hepatitis E virus
gaguuauaguuuauuugcuugu

SEQ ID NO: 1488724 - RNA, 15 nt, Hepatitis E virus
cugcgcccauggguu

SEQ ID NO: 1488725 - RNA, 15 nt, Hepatitis E virus
accacuagccugggu

SEQ ID NO: 1488726 - RNA, 18 nt, Hepatitis E virus
cggcgguuccggcggugg

SEQ ID NO: 1488727 - RNA, 15 nt, Hepatitis E virus
ccgcggucgcuccgg

SEQ ID NO: 1488728 - RNA, 18 nt, Hepatitis E virus
ugugccccccuucuuucu

SEQ ID NO: 1488729 - RNA, 22 nt, Hepatitis E virus
gccuacacuaucguaaccaagg

SEQ ID NO: 1488730 - RNA, 15 nt, Hepatitis E virus
cgccaccgcccgguc

SEQ ID NO: 1488731 - RNA, 17 nt, Hepatitis E virus
gccccgucgucucagcc

SEQ ID NO: 1488732 - RNA, 14 nt, Hepatitis E virus
auaacaccacugcu

SEQ ID NO: 1488733 - RNA, 17 nt, Hepatitis E virus
cccuucuuucuguugcu

SEQ ID NO: 1488734 - RNA, 17 nt, Hepatitis E virus
ucuaauuaugcccagua

SEQ ID NO: 1488735 - RNA, 17 nt, Hepatitis E virus
cuguugcuuauuucuca

SEQ ID NO: 1488736 - RNA, 16 nt, Hepatitis E virus
uccgcgcucccugaaa

SEQ ID NO: 1488737 - RNA, 16 nt, Hepatitis E virus
cuucuuucuguugcuu

SEQ ID NO: 1488738 - RNA, 13 nt, Hepatitis E virus
ccgcgccaccgcc

SEQ ID NO: 1488739 - RNA, 18 nt, Hepatitis E virus
ucugcguuccgcgcuccc

SEQ ID NO: 1488740 - RNA, 14 nt, Hepatitis E virus
cccuuggccuccag

SEQ ID NO: 1488741 - RNA, 19 nt, Hepatitis E virus
acugccgagcucaccacca

SEQ ID NO: 1488742 - RNA, 22 nt, Hepatitis E virus
cccgcugguccccaacgcuguu

SEQ ID NO: 1488743 - RNA, 17 nt, Hepatitis E virus
aucuccccuuaccucuu

SEQ ID NO: 1488744 - RNA, 17 nt, Hepatitis E virus
ucucccguuacuccagc

SEQ ID NO: 1488745 - RNA, 12 nt, Hepatitis E virus
gcgcccucggcc

SEQ ID NO: 1488746 - RNA, 16 nt, Hepatitis E virus
ccaaccaaccccuucg

SEQ ID NO: 1488747 - RNA, 16 nt, Hepatitis E virus
cccgucgucucagcca

SEQ ID NO: 1488748 - RNA, 14 nt, Hepatitis E virus
uccgcgcucccuga

SEQ ID NO: 1488749 - RNA, 21 nt, Hepatitis E virus
ggcgcucuguugagaccuccg

SEQ ID NO: 1488750 - RNA, 12 nt, Hepatitis E virus
cgcccccuuggc

SEQ ID NO: 1488751 - RNA, 21 nt, Hepatitis E virus
gcagaugggacugccgagcuc

SEQ ID NO: 1488752 - RNA, 16 nt, Hepatitis E virus
cggcccaugacacccc

SEQ ID NO: 1488753 - RNA, 20 nt, Hepatitis E virus
ccgaguaugaccaguccacu

SEQ ID NO: 1488754 - RNA, 12 nt, Hepatitis E virus
ugacaccccgcc

SEQ ID NO: 1488755 - RNA, 21 nt, Hepatitis E virus
gcccggcauagccuccgagca

SEQ ID NO: 1488756 - RNA, 19 nt, Hepatitis E virus
gaccaggcccagcgccccg

SEQ ID NO: 1488757 - RNA, 19 nt, Hepatitis E virus
gucguagaccuaccacagc

SEQ ID NO: 1488758 - RNA, 21 nt, Hepatitis E virus
auggucgcccccuuuccacca

SEQ ID NO: 1488759 - RNA, 19 nt, Hepatitis E virus
cgcaugacaucgaccucgg

SEQ ID NO: 1488760 - RNA, 21 nt, Hepatitis E virus
cccgcuucuaccccuccagga

SEQ ID NO: 1488761 - RNA, 19 nt, Hepatitis E virus
gccugggugcuggccccgu

SEQ ID NO: 1488762 - RNA, 17 nt, Hepatitis E virus
gucggcugguggccagc

SEQ ID NO: 1488763 - RNA, 17 nt, Hepatitis E virus
ccggagugccgcccccu

SEQ ID NO: 1488764 - RNA, 19 nt, Hepatitis E virus
ccacucggcuccgcuuggc

SEQ ID NO: 1488765 - RNA, 13 nt, Hepatitis E virus
guccuccgagcua

SEQ ID NO: 1488766 - RNA, 15 nt, Hepatitis E virus
cuacagaagcuucua

SEQ ID NO: 1488767 - RNA, 21 nt, Hepatitis E virus
cccgcaugacaucgaccucgg

SEQ ID NO: 1488768 - RNA, 18 nt, Hepatitis E virus
gccuccagggcugugcuu

SEQ ID NO: 1488769 - RNA, 18 nt, Hepatitis E virus
ugcugacacccugcuugg

SEQ ID NO: 1488770 - RNA, 21 nt, Hepatitis E virus
gcuccucuuagcccgcuucua

SEQ ID NO: 1488771 - RNA, 17 nt, Hepatitis E virus
uagaccuaccacagcug

SEQ ID NO: 1488772 - RNA, 20 nt, Hepatitis E virus
ugaccgggcugauucucagc

SEQ ID NO: 1488773 - RNA, 13 nt, Hepatitis E virus
ccacuagccuggg

SEQ ID NO: 1488774 - RNA, 14 nt, Hepatitis E virus
uguugguggcuacg

SEQ ID NO: 1488775 - RNA, 19 nt, Hepatitis E virus
cuugugccccccuucuuuc

SEQ ID NO: 1488776 - RNA, 18 nt, Hepatitis E virus
gaggcagguacuacuaaa

SEQ ID NO: 1488777 - RNA, 16 nt, Hepatitis E virus
cccggcauagccuccg

SEQ ID NO: 1488778 - RNA, 21 nt, Hepatitis E virus
gcuaaccgcggucgcuccggc

SEQ ID NO: 1488779 - RNA, 15 nt, Hepatitis E virus
cgccaucuccaucuc

SEQ ID NO: 1488780 - RNA, 20 nt, Hepatitis E virus
gcggucgcuccggcccauga

SEQ ID NO: 1488781 - RNA, 15 nt, Hepatitis E virus
uggcgugaccaggcc

SEQ ID NO: 1488782 - RNA, 19 nt, Hepatitis E virus
cgagcuaaugaugugcuuu

SEQ ID NO: 1488783 - RNA, 14 nt, Hepatitis E virus
ucggcuccgcuugg

SEQ ID NO: 1488784 - RNA, 16 nt, Hepatitis E virus
gcugagcuucagcgcc

SEQ ID NO: 1488785 - RNA, 13 nt, Hepatitis E virus
accuuccccagcc

SEQ ID NO: 1488786 - RNA, 19 nt, Hepatitis E virus
ggcccaugacaccccgcca

SEQ ID NO: 1488787 - RNA, 18 nt, Hepatitis E virus
gcugcccgcgccaccgcc

SEQ ID NO: 1488788 - RNA, 22 nt, Hepatitis E virus
uagaccuaccacagcuggggcc

SEQ ID NO: 1488789 - RNA, 19 nt, Hepatitis E virus
ggcggaggaggaggccacc

SEQ ID NO: 1488790 - RNA, 22 nt, Hepatitis E virus
cucauguuucugccuaugcugc

SEQ ID NO: 1488791 - RNA, 13 nt, Hepatitis E virus
ccugggugcuggc

SEQ ID NO: 1488792 - RNA, 18 nt, Hepatitis E virus
uaccauggacuacccugc

SEQ ID NO: 1488793 - RNA, 19 nt, Hepatitis E virus
caucggguugcuauuucca

SEQ ID NO: 1488794 - RNA, 18 nt, Hepatitis E virus
ccgcggucgcuccggccc

SEQ ID NO: 1488795 - RNA, 18 nt, Hepatitis E virus
cugcguuccgcgcucccu

SEQ ID NO: 1488796 - RNA, 13 nt, Hepatitis E virus
acaaacuugguuc

SEQ ID NO: 1488797 - RNA, 11 nt, Hepatitis E virus
cuugugccccc

SEQ ID NO: 1488798 - RNA, 20 nt, Hepatitis E virus
gauggucgcccccuuuccac

SEQ ID NO: 1488799 - RNA, 16 nt, Hepatitis E virus
uugcuuauuucucauu

SEQ ID NO: 1488800 - RNA, 16 nt, Hepatitis E virus
gaccaggcccagcgcc

SEQ ID NO: 1488801 - RNA, 19 nt, Hepatitis E virus
caccgcugcggccggggcu

SEQ ID NO: 1488802 - RNA, 22 nt, Hepatitis E virus
gcuccgcgguaagcucuccuuu

SEQ ID NO: 1488803 - RNA, 14 nt, Hepatitis E virus
caccccgccagugc

SEQ ID NO: 1488804 - RNA, 22 nt, Hepatitis E virus
gccucacgucguagaccuacca

SEQ ID NO: 1488805 - RNA, 18 nt, Hepatitis E virus
ccauggguucgcgaccau

SEQ ID NO: 1488806 - RNA, 14 nt, Hepatitis E virus
gccacagaccacca

SEQ ID NO: 1488807 - RNA, 15 nt, Hepatitis E virus
cgaugacuucugccc

SEQ ID NO: 1488808 - RNA, 18 nt, Hepatitis E virus
cacuuacaccacuagccu

SEQ ID NO: 1488809 - RNA, 19 nt, Hepatitis E virus
aacaugucuucugcugcgc

SEQ ID NO: 1488810 - RNA, 16 nt, Hepatitis E virus
uacuccagcacugccc

SEQ ID NO: 1488811 - RNA, 15 nt, Hepatitis E virus
uaucguaaccaaggu

SEQ ID NO: 1488812 - RNA, 14 nt, Hepatitis E virus
gaggccaccucugg

SEQ ID NO: 1488813 - RNA, 11 nt, Hepatitis E virus
cucagcaggau

SEQ ID NO: 1488814 - RNA, 19 nt, Hepatitis E virus
cuccaucucguucuggcca

SEQ ID NO: 1488815 - RNA, 21 nt, Hepatitis E virus
ggucgcuccggcccaugacac

SEQ ID NO: 1488816 - RNA, 16 nt, Hepatitis E virus
accaccacggcugcua

SEQ ID NO: 1488817 - RNA, 15 nt, Hepatitis E virus
ccgucgucucagcca

SEQ ID NO: 1488818 - RNA, 15 nt, Hepatitis E virus
aucuguagagaaugc

SEQ ID NO: 1488819 - RNA, 19 nt, Hepatitis E virus
cagcuggggccgcgccgcu

SEQ ID NO: 1488820 - RNA, 23 nt, Hepatitis E virus
gugccccccuucuuucuguugcu

SEQ ID NO: 1488821 - RNA, 23 nt, Hepatitis E virus
cuagccugggugcuggccccguc

SEQ ID NO: 1488822 - RNA, 14 nt, Hepatitis E virus
ccccgccgcugccu

SEQ ID NO: 1488823 - RNA, 18 nt, Hepatitis E virus
ccgaccacucggcuccgc

SEQ ID NO: 1488824 - RNA, 14 nt, Hepatitis E virus
cgagcucaccacca

SEQ ID NO: 1488825 - RNA, 23 nt, Hepatitis E virus
uggucgcccccuuuccaccaccc

SEQ ID NO: 1488826 - RNA, 15 nt, Hepatitis E virus
gaguaugaccagucc

SEQ ID NO: 1488827 - RNA, 19 nt, Hepatitis E virus
cagccgucuggccgccgcc

SEQ ID NO: 1488828 - RNA, 15 nt, Hepatitis E virus
agccccccacucugc

SEQ ID NO: 1488829 - RNA, 18 nt, Hepatitis E virus
auaccggugcccucgggc

SEQ ID NO: 1488830 - RNA, 16 nt, Hepatitis E virus
gcuacccgcuucauga

SEQ ID NO: 1488831 - RNA, 17 nt, Hepatitis E virus
cccaugacaccccgcca

SEQ ID NO: 1488832 - RNA, 19 nt, Hepatitis E virus
ucuguugcuuauuucucau

SEQ ID NO: 1488833 - RNA, 12 nt, Hepatitis E virus
gccaccucuggu

SEQ ID NO: 1488834 - RNA, 15 nt, Hepatitis E virus
uuccgcgcucccuga

SEQ ID NO: 1488835 - RNA, 20 nt, Hepatitis E virus
ugcuuauuucucauuucugc

SEQ ID NO: 1488836 - RNA, 17 nt, Hepatitis E virus
ggcuacagaagcuucua

SEQ ID NO: 1488837 - RNA, 15 nt, Hepatitis E virus
cuccagggcugugcu

SEQ ID NO: 1488838 - RNA, 13 nt, Hepatitis E virus
ccgcgcucccuga

SEQ ID NO: 1488839 - RNA, 19 nt, Hepatitis E virus
ccccuuuucuguccuccga

SEQ ID NO: 1488840 - RNA, 17 nt, Hepatitis E virus
accucuuccguggccac

SEQ ID NO: 1488841 - RNA, 15 nt, Hepatitis E virus
ugcuguugcuccuca

SEQ ID NO: 1488842 - RNA, 16 nt, Hepatitis E virus
cuccucuuagcccgcu

SEQ ID NO: 1488843 - RNA, 20 nt, Hepatitis E virus
agaccuucuuuguccugccg

SEQ ID NO: 1488844 - RNA, 13 nt, Hepatitis E virus
ccaaccaaccccu

SEQ ID NO: 1488845 - RNA, 18 nt, Hepatitis E virus
cccagucuaugucucuga

SEQ ID NO: 1488846 - RNA, 22 nt, Hepatitis E virus
caaccaaccccuucgcccccga

SEQ ID NO: 1488847 - RNA, 14 nt, Hepatitis E virus
cuccagcacugccc

SEQ ID NO: 1488848 - RNA, 19 nt, Hepatitis E virus
ggacuacccugcccgcgcc

SEQ ID NO: 1488849 - RNA, 14 nt, Hepatitis E virus
cuuuucuguccucc

SEQ ID NO: 1488850 - RNA, 21 nt, Hepatitis E virus
ccuuauaauuauaacaccacu

SEQ ID NO: 1488851 - RNA, 16 nt, Hepatitis E virus
gaccacucggcuccgc

SEQ ID NO: 1488852 - RNA, 15 nt, Hepatitis E virus
ucucugacucuguga

SEQ ID NO: 1488853 - RNA, 16 nt, Hepatitis E virus
gccagugccugauguu

SEQ ID NO: 1488854 - RNA, 12 nt, Hepatitis E virus
aggaggccaccu

SEQ ID NO: 1488855 - RNA, 17 nt, Hepatitis E virus
gagcuaaugaugugcuu

SEQ ID NO: 1488856 - RNA, 22 nt, Hepatitis E virus
uuuauuugcuugugccccccuu

SEQ ID NO: 1488857 - RNA, 21 nt, Hepatitis E virus
augcugcccgcgccaccgccc

SEQ ID NO: 1488858 - RNA, 21 nt, Hepatitis E virus
ccgcuccucuuagcccgcuuc

SEQ ID NO: 1488859 - RNA, 18 nt, Hepatitis E virus
uacgccgcuccucuuagc

SEQ ID NO: 1488860 - RNA, 17 nt, Hepatitis E virus
gcuggggccgcgccgcu

SEQ ID NO: 1488861 - RNA, 22 nt, Hepatitis E virus
cgcugagcuucagcgccuuaag

SEQ ID NO: 1488862 - RNA, 13 nt, Hepatitis E virus
caccaccacggcu

SEQ ID NO: 1488863 - RNA, 16 nt, Hepatitis E virus
ccguuacuccagcacu

SEQ ID NO: 1488864 - RNA, 13 nt, Hepatitis E virus
ggcugguggccag

SEQ ID NO: 1488865 - RNA, 17 nt, Hepatitis E virus
ugcuugugccccccuuc

SEQ ID NO: 1488866 - RNA, 20 nt, Hepatitis E virus
caugaaggaccucuauuuua

SEQ ID NO: 1488867 - RNA, 16 nt, Hepatitis E virus
cccuuggccuccaggg

SEQ ID NO: 1488868 - RNA, 21 nt, Hepatitis E virus
ccuaucaacaucuccccuuac

SEQ ID NO: 1488869 - RNA, 23 nt, Hepatitis E virus
uacggcucuucgaccggcccagu

SEQ ID NO: 1488870 - RNA, 15 nt, Hepatitis E virus
uucuuucuguugcuu

SEQ ID NO: 1488871 - RNA, 18 nt, Hepatitis E virus
cuccaucucguucuggcc

SEQ ID NO: 1488872 - RNA, 20 nt, Hepatitis E virus
ccacggcugcuacccgcuuc

SEQ ID NO: 1488873 - RNA, 21 nt, Hepatitis E virus
ggcccaugacaccccgccagu

SEQ ID NO: 1488874 - RNA, 19 nt, Hepatitis E virus
gcccccuuuccaccaccca

SEQ ID NO: 1488875 - RNA, 20 nt, Hepatitis E virus
cgcccggucagccgucuggc

SEQ ID NO: 1488876 - RNA, 18 nt, Hepatitis E virus
gugccccccuucuuucug

SEQ ID NO: 1488877 - RNA, 12 nt, Hepatitis E virus
caugagcaggac

SEQ ID NO: 1488878 - RNA, 16 nt, Hepatitis E virus
cagcuggggccgcgcc

SEQ ID NO: 1488879 - RNA, 10 nt, Hepatitis E virus
caccacugcu

SEQ ID NO: 1488880 - RNA, 14 nt, Hepatitis E virus
ccucguguucgcca

SEQ ID NO: 1488881 - RNA, 17 nt, Hepatitis E virus
cgccgugggcggcgcag

SEQ ID NO: 1488882 - RNA, 17 nt, Hepatitis E virus
acgucguagaccuacca

SEQ ID NO: 1488883 - RNA, 18 nt, Hepatitis E virus
acaccacuagccugggug

SEQ ID NO: 1488884 - RNA, 15 nt, Hepatitis E virus
gcucguugagaaugc

SEQ ID NO: 1488885 - RNA, 19 nt, Hepatitis E virus
ccgggcugauucucagccc

SEQ ID NO: 1488886 - RNA, 14 nt, Hepatitis E virus
gccaccucuggucu

SEQ ID NO: 1488887 - RNA, 15 nt, Hepatitis E virus
acugucgcugagcuu

SEQ ID NO: 1488888 - RNA, 19 nt, Hepatitis E virus
ucucccguuacuccagcac

SEQ ID NO: 1488889 - RNA, 22 nt, Hepatitis E virus
ucacacuugauggucgcccccu

SEQ ID NO: 1488890 - RNA, 17 nt, Hepatitis E virus
ugucgcugagcuucagc

SEQ ID NO: 1488891 - RNA, 18 nt, Hepatitis E virus
ggccacagaccaccacca

SEQ ID NO: 1488892 - RNA, 20 nt, Hepatitis E virus
ccacagaccaccaccacccc

SEQ ID NO: 1488893 - RNA, 14 nt, Hepatitis E virus
gaccaguccacuua

SEQ ID NO: 1488894 - RNA, 15 nt, Hepatitis E virus
cgcuucuaccccucc

SEQ ID NO: 1488895 - RNA, 17 nt, Hepatitis E virus
gguugcuauuuccacuu

SEQ ID NO: 1488896 - RNA, 12 nt, Hepatitis E virus
auguugacuccc

SEQ ID NO: 1488897 - RNA, 17 nt, Hepatitis E virus
ggcccagcgccccgccg

SEQ ID NO: 1488898 - RNA, 14 nt, Hepatitis E virus
uccugccgcuccgc

SEQ ID NO: 1488899 - RNA, 17 nt, Hepatitis E virus
uaccauggacuacccug

SEQ ID NO: 1488900 - RNA, 17 nt, Hepatitis E virus
augcccaguaccggguu

SEQ ID NO: 1488901 - RNA, 21 nt, Hepatitis E virus
cagcacugcccgucaccgccu

SEQ ID NO: 1488902 - RNA, 20 nt, Hepatitis E virus
gaguaugaccaguccacuua

SEQ ID NO: 1488903 - RNA, 12 nt, Hepatitis E virus
ccacuagccugg

SEQ ID NO: 1488904 - RNA, 17 nt, Hepatitis E virus
ucugcguuccgcgcucc

SEQ ID NO: 1488905 - RNA, 21 nt, Hepatitis E virus
uacaccacuagccugggugcu

SEQ ID NO: 1488906 - RNA, 18 nt, Hepatitis E virus
gcuaaugaugugcuuugg

SEQ ID NO: 1488907 - RNA, 17 nt, Hepatitis E virus
ugcuguuuuagcccccc

SEQ ID NO: 1488908 - RNA, 23 nt, Hepatitis E virus
gcgggucucccguuacuccagca

SEQ ID NO: 1488909 - RNA, 14 nt, Hepatitis E virus
ucgaccggcccagu

SEQ ID NO: 1488910 - RNA, 14 nt, Hepatitis E virus
cugauucucagccc

SEQ ID NO: 1488911 - RNA, 20 nt, Hepatitis E virus
aucucguucuggccacagac

SEQ ID NO: 1488912 - RNA, 15 nt, Hepatitis E virus
cgagcucaccaccac

SEQ ID NO: 1488913 - RNA, 18 nt, Hepatitis E virus
gugaccaggcccagcgcc

SEQ ID NO: 1488914 - RNA, 21 nt, Hepatitis E virus
caugacaccccgccagugccu

SEQ ID NO: 1488915 - RNA, 19 nt, Hepatitis E virus
ggucgcccccuuuccacca

SEQ ID NO: 1488916 - RNA, 12 nt, Hepatitis E virus
accgcugccgag

SEQ ID NO: 1488917 - RNA, 20 nt, Hepatitis E virus
cguugagaaugccgcugggc

SEQ ID NO: 1488918 - RNA, 14 nt, Hepatitis E virus
cagggcugugcuuu

SEQ ID NO: 1488919 - RNA, 19 nt, Hepatitis E virus
uacggcucuucgaccggcc

SEQ ID NO: 1488920 - RNA, 15 nt, Hepatitis E virus
uagcgcuuacccugu

SEQ ID NO: 1488921 - RNA, 14 nt, Hepatitis E virus
uccaucucguucug

SEQ ID NO: 1488922 - RNA, 17 nt, Hepatitis E virus
gcugauucucagcccuu

SEQ ID NO: 1488923 - RNA, 19 nt, Hepatitis E virus
ggcgcgcaggccguugccc

SEQ ID NO: 1488924 - RNA, 13 nt, Hepatitis E virus
gccgcuccgcggu

SEQ ID NO: 1488925 - RNA, 16 nt, Hepatitis E virus
cuugauggucgccccc

SEQ ID NO: 1488926 - RNA, 18 nt, Hepatitis E virus
auuucucauuucugcguu

SEQ ID NO: 1488927 - RNA, 21 nt, Hepatitis E virus
acgucguagaccuaccacagc

SEQ ID NO: 1488928 - RNA, 16 nt, Hepatitis E virus
cuugcugacacccugc

SEQ ID NO: 1488929 - RNA, 21 nt, Hepatitis E virus
cugauguugacucccgcggcg

SEQ ID NO: 1488930 - RNA, 10 nt, Hepatitis E virus
ccuucuuucu

SEQ ID NO: 1488931 - RNA, 16 nt, Hepatitis E virus
cgcccggucagccguc

SEQ ID NO: 1488932 - RNA, 22 nt, Hepatitis E virus
cgugcuacaauucgcuaccgcc

SEQ ID NO: 1488933 - RNA, 15 nt, Hepatitis E virus
uugcuuauuucucau

SEQ ID NO: 1488934 - RNA, 13 nt, Hepatitis E virus
gauggucgccccc

SEQ ID NO: 1488935 - RNA, 23 nt, Hepatitis E virus
gguauugcaaucccgcaugacau

SEQ ID NO: 1488936 - RNA, 21 nt, Hepatitis E virus
gcuugugccccccuucuuucu

SEQ ID NO: 1488937 - RNA, 14 nt, Hepatitis E virus
acaauucgcuaccg

SEQ ID NO: 1488938 - RNA, 20 nt, Hepatitis E virus
cacugcccgucaccgccuuc

SEQ ID NO: 1488939 - RNA, 13 nt, Hepatitis E virus
gcugcgcccaugg

SEQ ID NO: 1488940 - RNA, 19 nt, Hepatitis E virus
gcugccgaguaugaccagu

SEQ ID NO: 1488941 - RNA, 19 nt, Hepatitis E virus
ccucauguuucugccuaug

SEQ ID NO: 1488942 - RNA, 23 nt, Hepatitis E virus
ugccgcccccuuggccuccaggg

SEQ ID NO: 1488943 - RNA, 18 nt, Hepatitis E virus
cguauuuuaguccagccc

SEQ ID NO: 1488944 - RNA, 12 nt, Hepatitis E virus
cccuuuucuguc

SEQ ID NO: 1488945 - RNA, 14 nt, Hepatitis E virus
gcuauuuccacuua

SEQ ID NO: 1488946 - RNA, 21 nt, Hepatitis E virus
ugccccccuucuuucuguugc

SEQ ID NO: 1488947 - RNA, 13 nt, Hepatitis E virus
gacucugugaccu

SEQ ID NO: 1488948 - RNA, 16 nt, Hepatitis E virus
ucuacugucgcugagc

SEQ ID NO: 1488949 - RNA, 19 nt, Hepatitis E virus
cgcccccuuuccaccaccc

SEQ ID NO: 1488950 - RNA, 17 nt, Hepatitis E virus
gaccaaggucacacuug

SEQ ID NO: 1488951 - RNA, 15 nt, Hepatitis E virus
ucaccaccacggcug

SEQ ID NO: 1488952 - RNA, 12 nt, Hepatitis E virus
cucaccgcugcc

SEQ ID NO: 1488953 - RNA, 20 nt, Hepatitis E virus
gcucgacuggaccaagguca

SEQ ID NO: 1488954 - RNA, 20 nt, Hepatitis E virus
accgcccggucagccgucug

SEQ ID NO: 1488955 - RNA, 21 nt, Hepatitis E virus
ugaccuugguuaauguagcga

SEQ ID NO: 1488956 - RNA, 21 nt, Hepatitis E virus
ucgcucgacuggaccaagguc

SEQ ID NO: 1488957 - RNA, 20 nt, Hepatitis E virus
cagcggcgguuccggcggug

SEQ ID NO: 1488958 - RNA, 19 nt, Hepatitis E virus
ccccgaugucaccgcugcg

SEQ ID NO: 1488959 - RNA, 13 nt, Hepatitis E virus
ccccgccgcugcc

SEQ ID NO: 1488960 - RNA, 16 nt, Human
cucuccccaugauguu

SEQ ID NO: 1488961 - RNA, 12 nt, Human
cucguggacacc

SEQ ID NO: 1488962 - RNA, 14 nt, Human
cucguggacaccug

SEQ ID NO: 1488963 - RNA, 15 nt, Human
cucguggacaccugc

SEQ ID NO: 1488964 - RNA, 16 nt, Human
cucguggacaccugcc

SEQ ID NO: 1488965 - RNA, 13 nt, Human
cucugcagguccc

SEQ ID NO: 1488966 - RNA, 18 nt, Human
cuaucucauuuccaagca

SEQ ID NO: 1488967 - RNA, 16 nt, Human
cucagccucucgaagu

SEQ ID NO: 1488968 - RNA, 15 nt, Human
ccugcugcugccugc

SEQ ID NO: 1488969 - RNA, 16 nt, Human
ccugcugcugccugcc

SEQ ID NO: 1488970 - RNA, 17 nt, Human
ccugcugcugccugccu

SEQ ID NO: 1488971 - RNA, 18 nt, Human
ccugcugcugccugccug

SEQ ID NO: 1488972 - RNA, 13 nt, Human
ccuucccugcugu

SEQ ID NO: 1488973 - RNA, 14 nt, Human
ccuugcauaauggu

SEQ ID NO: 1488974 - RNA, 12 nt, Human
ccuuuucccaac

SEQ ID NO: 1488975 - RNA, 19 nt, Human
cuaaguccaguguuucuuu

SEQ ID NO: 1488976 - RNA, 20 nt, Human
cuaaguacacaauaagcaaa

SEQ ID NO: 1488977 - RNA, 19 nt, Human
cuaaguacacaauaagcaa

SEQ ID NO: 1488978 - RNA, 23 nt, Human
cuaaaguaaaaacaaagaaauua

SEQ ID NO: 1488979 - RNA, 23 nt, Human
cguuaucuaauagggcaauuaau

SEQ ID NO: 1488980 - RNA, 23 nt, Human
ccgaaggugaggagcuugaaacc

SEQ ID NO: 1488981 - RNA, 20 nt, Human
cccugaauuuaaauagcuuu

SEQ ID NO: 1488982 - RNA, 15 nt, Human
cccugcccugccacc

SEQ ID NO: 1488983 - RNA, 17 nt, Human
cccugcccugccaccug

SEQ ID NO: 1488984 - RNA, 18 nt, Human
cccugcccugccaccugu

SEQ ID NO: 1488985 - RNA, 20 nt, Human
ccucucugcaggucccuaau

SEQ ID NO: 1488986 - RNA, 18 nt, Human
ccucucugcaggucccua

SEQ ID NO: 1488987 - RNA, 19 nt, Human
ccucucugcaggucccuaa

SEQ ID NO: 1488988 - RNA, 16 nt, Human
ccucucugcagguccc

SEQ ID NO: 1488989 - RNA, 17 nt, Human
ccucucugcaggucccu

SEQ ID NO: 1488990 - RNA, 18 nt, Human
ccucgccggaucugaggg

SEQ ID NO: 1488991 - RNA, 19 nt, Human
ccucgccggaucugaggga

SEQ ID NO: 1488992 - RNA, 17 nt, Human
ccugccucucugcaggu

SEQ ID NO: 1488993 - RNA, 20 nt, Human
ccugccucucugcagguccc

SEQ ID NO: 1488994 - RNA, 21 nt, Human
ccugccucucugcaggucccu

SEQ ID NO: 1488995 - RNA, 23 nt, Human
ccugccuggacuuggccccugcc

SEQ ID NO: 1488996 - RNA, 18 nt, Human
ccaugggcacugugggua

SEQ ID NO: 1488997 - RNA, 18 nt, Human
cccacuguacuugcucuu

SEQ ID NO: 1488998 - RNA, 19 nt, Human
cccacuguacuugcucuug

SEQ ID NO: 1488999 - RNA, 23 nt, Human
cccacuguacuugcucuugaugc

SEQ ID NO: 1489000 - RNA, 20 nt, Human
cccaagcaccugggauuaca

SEQ ID NO: 1489001 - RNA, 20 nt, Human
ccauugugccuaaguccagu

SEQ ID NO: 1489002 - RNA, 22 nt, Human
cccagcuggggccaggcugggu

SEQ ID NO: 1489003 - RNA, 23 nt, Human
cccagcuggggccaggcuggguc

SEQ ID NO: 1489004 - RNA, 17 nt, Human
ccccagccauccagggg

SEQ ID NO: 1489005 - RNA, 15 nt, Human
ccaggggccaugaau

SEQ ID NO: 1489006 - RNA, 18 nt, Human
ccaggcaggagcccuucu

SEQ ID NO: 1489007 - RNA, 15 nt, Human
ccacucuuucuuuca

SEQ ID NO: 1489008 - RNA, 14 nt, Human
ccagagacuuuagg

SEQ ID NO: 1489009 - RNA, 13 nt, Human
auuaugugacauu

SEQ ID NO: 1489010 - RNA, 19 nt, Human
auuaugugacauuuuacau

SEQ ID NO: 1489011 - RNA, 13 nt, Human
auuaugugccaga

SEQ ID NO: 1489012 - RNA, 21 nt, Human
auuaugugccagauuuaugca

SEQ ID NO: 1489013 - RNA, 23 nt, Human
auuaugugccagauuuaugcaua

SEQ ID NO: 1489014 - RNA, 20 nt, Human
auuaugugacauuuuacauu

SEQ ID NO: 1489015 - RNA, 12 nt, Human
auucaauaaagc

SEQ ID NO: 1489016 - RNA, 13 nt, Human
auucaauaaagcu

SEQ ID NO: 1489017 - RNA, 12 nt, Human
auucauuccauu

SEQ ID NO: 1489018 - RNA, 17 nt, Human
auucauuccauucugga

SEQ ID NO: 1489019 - RNA, 19 nt, Human
auucauuccauucuggaag

SEQ ID NO: 1489020 - RNA, 18 nt, Human
auucauuccauucuggaa

SEQ ID NO: 1489021 - RNA, 17 nt, Human
auucguuaucuaauagg

SEQ ID NO: 1489022 - RNA, 22 nt, Human
auugaggacacugauauggguc

SEQ ID NO: 1489023 - RNA, 21 nt, Human
auuaacaugaauauuuagugu

SEQ ID NO: 1489024 - RNA, 17 nt, Human
auuaaauuuuuuuuaca

SEQ ID NO: 1489025 - RNA, 18 nt, Human
auuaaauuuuuuuuacau

SEQ ID NO: 1489026 - RNA, 19 nt, Human
auuaaauuuuuuuuacauu

SEQ ID NO: 1489027 - RNA, 20 nt, Human
auuaaauuuuuuuuacauuu

SEQ ID NO: 1489028 - RNA, 22 nt, Human
auuuaauagguuuggacaaaau

SEQ ID NO: 1489029 - RNA, 14 nt, Human
auugagguaaguuu

SEQ ID NO: 1489030 - RNA, 16 nt, Human
auugagguaaguuuuu

SEQ ID NO: 1489031 - RNA, 22 nt, Human
auuuguguugaagagguuuuaa

SEQ ID NO: 1489032 - RNA, 18 nt, Human
auuuguguugaagagguu

SEQ ID NO: 1489033 - RNA, 15 nt, Human
auuuguguugaagag

SEQ ID NO: 1489034 - RNA, 14 nt, Human
auuuguguugaaga

SEQ ID NO: 1489035 - RNA, 19 nt, Human
auuuguucuauagcuuuuc

SEQ ID NO: 1489036 - RNA, 17 nt, Human
auuuucuauaauuuaaa

SEQ ID NO: 1489037 - RNA, 18 nt, Human
auuuucuauaauuuaaau

SEQ ID NO: 1489038 - RNA, 19 nt, Human
auuuucuauaauuuaaaua

SEQ ID NO: 1489039 - RNA, 13 nt, Human
auuuugaaaaacu

SEQ ID NO: 1489040 - RNA, 15 nt, Human
auuuugaaaaacugc

SEQ ID NO: 1489041 - RNA, 20 nt, Human
caaaccacuuuuugcagcuu

SEQ ID NO: 1489042 - RNA, 15 nt, Human
caaaagcccauucau

SEQ ID NO: 1489043 - RNA, 19 nt, Human
caaaagcccauucauucca

SEQ ID NO: 1489044 - RNA, 14 nt, Human
auuuuuuuuacauu

SEQ ID NO: 1489045 - RNA, 19 nt, Human
auuuuuuucccaauugaga

SEQ ID NO: 1489046 - RNA, 17 nt, Human
auuuuuuucugaaauuu

SEQ ID NO: 1489047 - RNA, 16 nt, Human
auuuuuuucugaaauu

SEQ ID NO: 1489048 - RNA, 15 nt, Human
auuuuuuucugaauu

SEQ ID NO: 1489049 - RNA, 19 nt, Human
auuuuuauauuugaaauau

SEQ ID NO: 1489050 - RNA, 14 nt, Human
caagcaaguauuag

SEQ ID NO: 1489051 - RNA, 14 nt, Human
caagcaauccuccc

SEQ ID NO: 1489052 - RNA, 15 nt, Human
caagcaaaugugaau

SEQ ID NO: 1489053 - RNA, 17 nt, Human
caagcaaaugugaauca

SEQ ID NO: 1489054 - RNA, 19 nt, Human
caagcaaaugugaaucauu

SEQ ID NO: 1489055 - RNA, 12 nt, Human
caacuccagaaa

SEQ ID NO: 1489056 - RNA, 14 nt, Human
caacuauggccugu

SEQ ID NO: 1489057 - RNA, 13 nt, Human
caacuauggccug

SEQ ID NO: 1489058 - RNA, 19 nt, Human
caacuaucucauuuccaag

SEQ ID NO: 1489059 - RNA, 19 nt, Human
caacuauauuguuugcuaa

SEQ ID NO: 1489060 - RNA, 17 nt, Human
caaucagccuaguugau

SEQ ID NO: 1489061 - RNA, 10 nt, Human
caaguaaaaa

SEQ ID NO: 1489062 - RNA, 15 nt, Human
caaguaaaaaggcua

SEQ ID NO: 1489063 - RNA, 20 nt, Human
caaguuauuuuuaauuuggu

SEQ ID NO: 1489064 - RNA, 21 nt, Human
caaguuccuuggccaugcaga

SEQ ID NO: 1489065 - RNA, 16 nt, Human
cacccagcaauagaga

SEQ ID NO: 1489066 - RNA, 20 nt, Human
cacccaggcuggacugcaau

SEQ ID NO: 1489067 - RNA, 20 nt, Human
cacccagguuggagugcagu

SEQ ID NO: 1489068 - RNA, 13 nt, Human
cacccagcaauag

SEQ ID NO: 1489069 - RNA, 16 nt, Human
cacaugaaguccaagc

SEQ ID NO: 1489070 - RNA, 23 nt, Human
cacugaagaagcaccaaucauga

SEQ ID NO: 1489071 - RNA, 14 nt, Human
caccugcccugccc

SEQ ID NO: 1489072 - RNA, 16 nt, Human
caccugcccugcccug

SEQ ID NO: 1489073 - RNA, 17 nt, Human
cacccucguggacaccu

SEQ ID NO: 1489074 - RNA, 18 nt, Human
cacccucguggacaccug

SEQ ID NO: 1489075 - RNA, 19 nt, Human
cacccucguggacaccugc

SEQ ID NO: 1489076 - RNA, 12 nt, Human
caccugcccugc

SEQ ID NO: 1489077 - RNA, 13 nt, Human
caccugcccugcc

SEQ ID NO: 1489078 - RNA, 20 nt, Human
caggaaagagaacuuccaga

SEQ ID NO: 1489079 - RNA, 16 nt, Human
caggaaagagaacuuc

SEQ ID NO: 1489080 - RNA, 20 nt, Human
cagcuuauugucuagugaaa

SEQ ID NO: 1489081 - RNA, 14 nt, Human
cagcuuauugucua

SEQ ID NO: 1489082 - RNA, 20 nt, Human
cagcuguaugauucccagcc

SEQ ID NO: 1489083 - RNA, 20 nt, Human
caggccggcuugccacaccc

SEQ ID NO: 1489084 - RNA, 22 nt, Human
cagggagacuggguaggaaaga

SEQ ID NO: 1489085 - RNA, 17 nt, Human
cagagacuuuagggggu

SEQ ID NO: 1489086 - RNA, 20 nt, Human
cagagcugauggagaaggaa

SEQ ID NO: 1489087 - RNA, 21 nt, Human
cagagcugauggagaaggaag

SEQ ID NO: 1489088 - RNA, 19 nt, Human
cagagcugauggagaagga

SEQ ID NO: 1489089 - RNA, 22 nt, Human
cagagcugauggagaaggaagg

SEQ ID NO: 1489090 - RNA, 14 nt, Human
cagauaugauucaa

SEQ ID NO: 1489091 - RNA, 13 nt, Human
cagauuuaugcau

SEQ ID NO: 1489092 - RNA, 14 nt, Human
cagauuuccagccu

SEQ ID NO: 1489093 - RNA, 14 nt, Human
cagauuucugagga

SEQ ID NO: 1489094 - RNA, 15 nt, Human
cagauuucugaggaa

SEQ ID NO: 1489095 - RNA, 17 nt, Human
cagauuucugaggaaau

SEQ ID NO: 1489096 - RNA, 21 nt, Human
cauguuaaccccuccacucuu

SEQ ID NO: 1489097 - RNA, 16 nt, Human
cauggcccugccaugc

SEQ ID NO: 1489098 - RNA, 16 nt, Human
caugaauuugugaagg

SEQ ID NO: 1489099 - RNA, 21 nt, Human
caugaauauuuaguguucaua

SEQ ID NO: 1489100 - RNA, 16 nt, Human
cauuuguauaaaauaa

SEQ ID NO: 1489101 - RNA, 14 nt, Human
cauuuguauaaaau

SEQ ID NO: 1489102 - RNA, 17 nt, Human
cauuuguauaaaauaau

SEQ ID NO: 1489103 - RNA, 12 nt, Human
ccaaaaaacuac

SEQ ID NO: 1489104 - RNA, 16 nt, Human
cauuggagauguuuag

SEQ ID NO: 1489105 - RNA, 19 nt, Human
ccaaaguccugggauuaca

SEQ ID NO: 1489106 - RNA, 16 nt, Human
ccaacuauggccugug

SEQ ID NO: 1489107 - RNA, 14 nt, Human
ccaacuauggccug

SEQ ID NO: 1489108 - RNA, 15 nt, Human
ccaacuauggccugu

SEQ ID NO: 1489109 - RNA, 20 nt, Human
ccaaaucacugaacuuugcu

SEQ ID NO: 1489110 - RNA, 21 nt, Human
ccaacuccagaaagugacaag

SEQ ID NO: 1489111 - RNA, 17 nt, Human
caguuauuauauuuaca

SEQ ID NO: 1489112 - RNA, 21 nt, Human
caguuauuauauuuacaaaug

SEQ ID NO: 1489113 - RNA, 19 nt, Human
cagucucuauaccaauaaa

SEQ ID NO: 1489114 - RNA, 20 nt, Human
cagucucuauaccaauaaag

SEQ ID NO: 1489115 - RNA, 21 nt, Human
cagucucuauaccaauaaagu

SEQ ID NO: 1489116 - RNA, 22 nt, Human
cagucucuauaccaauaaagug

SEQ ID NO: 1489117 - RNA, 23 nt, Human
cagucucuauaccaauaaaguga

SEQ ID NO: 1489118 - RNA, 17 nt, Human
cagucucuauaccaaua

SEQ ID NO: 1489119 - RNA, 22 nt, Human
caguuauuauauuuacaaaugg

SEQ ID NO: 1489120 - RNA, 15 nt, Human
caguucaaagcagga

SEQ ID NO: 1489121 - RNA, 18 nt, Human
caguuuauuugaaccaau

SEQ ID NO: 1489122 - RNA, 19 nt, Human
caguuuauuugaaccaaua

SEQ ID NO: 1489123 - RNA, 18 nt, Human
cauaauuauuauuuggcc

SEQ ID NO: 1489124 - RNA, 16 nt, Human
cauagguuuaauaauu

SEQ ID NO: 1489125 - RNA, 21 nt, Human
cauauuauuuuauguugcaua

SEQ ID NO: 1489126 - RNA, 16 nt, Human
caucuggauuccagag

SEQ ID NO: 1489127 - RNA, 19 nt, Human
caucagaaacacccucaca

SEQ ID NO: 1489128 - RNA, 17 nt, Human
caucagaaacacccuca

SEQ ID NO: 1489129 - RNA, 22 nt, Human
gccugccuccccugccucacca

SEQ ID NO: 1489130 - RNA, 22 nt, Human
gcccccaguaucucuucagucu

SEQ ID NO: 1489131 - RNA, 20 nt, Human
gccauucuccugccucagcc

SEQ ID NO: 1489132 - RNA, 21 nt, Human
gccagccacggggacucagcc

SEQ ID NO: 1489133 - RNA, 13 nt, Human
gccagaccaugga

SEQ ID NO: 1489134 - RNA, 16 nt, Human
gccagaccauggacac

SEQ ID NO: 1489135 - RNA, 17 nt, Human
gccagaccauggacacu

SEQ ID NO: 1489136 - RNA, 13 nt, Human
gccacccucaugc

SEQ ID NO: 1489137 - RNA, 15 nt, Human
gccacccucaugcug

SEQ ID NO: 1489138 - RNA, 16 nt, Human
gccacccucaugcugu

SEQ ID NO: 1489139 - RNA, 21 nt, Human
gcuaguaauuggaaaggcagc

SEQ ID NO: 1489140 - RNA, 14 nt, Human
gcucaggagcccug

SEQ ID NO: 1489141 - RNA, 21 nt, Human
gcucaggagcccugggaggcu

SEQ ID NO: 1489142 - RNA, 15 nt, Human
gcucaggagcccugg

SEQ ID NO: 1489143 - RNA, 18 nt, Human
gcucaggagcccugggag

SEQ ID NO: 1489144 - RNA, 23 nt, Human
gcucuggagcccacuguacuugc

SEQ ID NO: 1489145 - RNA, 12 nt, Human
gcugcugccugc

SEQ ID NO: 1489146 - RNA, 16 nt, Human
gcugcugccugccugg

SEQ ID NO: 1489147 - RNA, 12 nt, Human
gcuggagugcag

SEQ ID NO: 1489148 - RNA, 14 nt, Human
gcuggagugcagug

SEQ ID NO: 1489149 - RNA, 16 nt, Human
gcugggucgcccugga

SEQ ID NO: 1489150 - RNA, 17 nt, Human
gcugggucgcccuggac

SEQ ID NO: 1489151 - RNA, 18 nt, Human
gcugggucgcccuggacu

SEQ ID NO: 1489152 - RNA, 19 nt, Human
gcugggucgcccuggacug

SEQ ID NO: 1489153 - RNA, 19 nt, Human
gcuugaaacccguggcgcu

SEQ ID NO: 1489154 - RNA, 14 nt, Human
gcuucccuuuccug

SEQ ID NO: 1489155 - RNA, 23 nt, Human
ggaugguucccuugaugaagaag

SEQ ID NO: 1489156 - RNA, 22 nt, Human
ggaugguucccuugaugaagaa

SEQ ID NO: 1489157 - RNA, 20 nt, Human
ggcagagaagaaagaacgga

SEQ ID NO: 1489158 - RNA, 23 nt, Human
ggagcagagcugauggagaagga

SEQ ID NO: 1489159 - RNA, 15 nt, Human
ggagcccacuguacu

SEQ ID NO: 1489160 - RNA, 19 nt, Human
ggagcagagcugauggaga

SEQ ID NO: 1489161 - RNA, 21 nt, Human
ggaggcucuggagcccacugu

SEQ ID NO: 1489162 - RNA, 19 nt, Human
ggaggaaccagagugcuga

SEQ ID NO: 1489163 - RNA, 17 nt, Human
ggaggcucuggagccca

SEQ ID NO: 1489164 - RNA, 20 nt, Human
ggaggcucuggagcccacug

SEQ ID NO: 1489165 - RNA, 18 nt, Human
ggagcccacuguacuugc

SEQ ID NO: 1489166 - RNA, 22 nt, Human
ggagcccacuguacuugcucuu

SEQ ID NO: 1489167 - RNA, 22 nt, Human
ggacugugugcucaggagcccu

SEQ ID NO: 1489168 - RNA, 23 nt, Human
ggacugugugcucaggagcccug

SEQ ID NO: 1489169 - RNA, 17 nt, Human
ggaccccagccauccag

SEQ ID NO: 1489170 - RNA, 17 nt, Human
ggcuccuauucaacaca

SEQ ID NO: 1489171 - RNA, 23 nt, Human
ggcuccuccaggguggcagcaac

SEQ ID NO: 1489172 - RNA, 21 nt, Human
ggcugggaauggaggggcaga

SEQ ID NO: 1489173 - RNA, 22 nt, Human
ggcugggaauggaggggcagag

SEQ ID NO: 1489174 - RNA, 17 nt, Human
aaaacuacuucuuuuuu

SEQ ID NO: 1489175 - RNA, 19 nt, Human
aaaacugcucauaugaugu

SEQ ID NO: 1489176 - RNA, 19 nt, Human
aaaaauuaucuauagcuaa

SEQ ID NO: 1489177 - RNA, 21 nt, Human
aaaaauuaaaccggaccaucu

SEQ ID NO: 1489178 - RNA, 17 nt, Human
gggacugcggaggaagg

SEQ ID NO: 1489179 - RNA, 22 nt, Human
aaaagcuccauuuuuagugaaa

SEQ ID NO: 1489180 - RNA, 16 nt, Human
aaaagccuguuuaaga

SEQ ID NO: 1489181 - RNA, 18 nt, Human
aaaagccuguuuaagaga

SEQ ID NO: 1489182 - RNA, 23 nt, Human
aaaauaauuuuuauauuugaaau

SEQ ID NO: 1489183 - RNA, 21 nt, Human
aaaauaauuuuuauauuugaa

SEQ ID NO: 1489184 - RNA, 13 nt, Human
aaaauauauacua

SEQ ID NO: 1489185 - RNA, 17 nt, Human
aaaauauauacuaaaca

SEQ ID NO: 1489186 - RNA, 18 nt, Human
aaaauauauaucaaauau

SEQ ID NO: 1489187 - RNA, 14 nt, Human
aaaauauauacuaa

SEQ ID NO: 1489188 - RNA, 16 nt, Human
gggcagcaauuuaaau

SEQ ID NO: 1489189 - RNA, 13 nt, Human
gggcagagccagg

SEQ ID NO: 1489190 - RNA, 14 nt, Human
gggcagagccagga

SEQ ID NO: 1489191 - RNA, 16 nt, Human
gggcagagccaggaag

SEQ ID NO: 1489192 - RNA, 16 nt, Human
aaaagggacugagaaa

SEQ ID NO: 1489193 - RNA, 19 nt, Human
aaaagggacugagaaauuu

SEQ ID NO: 1489194 - RNA, 15 nt, Human
aaaggaaagaaaaca

SEQ ID NO: 1489195 - RNA, 16 nt, Human
aaaggaaagaaaacau

SEQ ID NO: 1489196 - RNA, 13 nt, Human
aaaggaauuuaaa

SEQ ID NO: 1489197 - RNA, 14 nt, Human
aaaggacaucagca

SEQ ID NO: 1489198 - RNA, 16 nt, Human
aaaggacaucagcaaa

SEQ ID NO: 1489199 - RNA, 15 nt, Human
aaaggacaucagcaa

SEQ ID NO: 1489200 - RNA, 17 nt, Human
aaagcuauauaagacaa

SEQ ID NO: 1489201 - RNA, 17 nt, Human
aaagcuacuuauuguag

SEQ ID NO: 1489202 - RNA, 16 nt, Human
aaagcuacuuauugua

SEQ ID NO: 1489203 - RNA, 17 nt, Human
ggugcacuggccccacc

SEQ ID NO: 1489204 - RNA, 17 nt, Human
gguauucguuaucuaau

SEQ ID NO: 1489205 - RNA, 16 nt, Human
aaagaaugauuaugaa

SEQ ID NO: 1489206 - RNA, 18 nt, Human
aaagagaacuuccagauc

SEQ ID NO: 1489207 - RNA, 15 nt, Human
aaacgucuuaaauau

SEQ ID NO: 1489208 - RNA, 15 nt, Human
aaacuacauauugua

SEQ ID NO: 1489209 - RNA, 21 nt, Human
aaaccacauuggagauguuua

SEQ ID NO: 1489210 - RNA, 19 nt, Human
aaacauguuuccacuauug

SEQ ID NO: 1489211 - RNA, 19 nt, Human
aaacauguuucuuuguaau

SEQ ID NO: 1489212 - RNA, 22 nt, Human
aaacauguuucuuuguaaugaa

SEQ ID NO: 1489213 - RNA, 23 nt, Human
aaacauguuucuuuguaaugaaa

SEQ ID NO: 1489214 - RNA, 18 nt, Human
aaaccaaaucacugaacu

SEQ ID NO: 1489215 - RNA, 23 nt, Human
ggggucucuucugaauaaagcaa

SEQ ID NO: 1489216 - RNA, 16 nt, Human
ggggccaggcuggguc

SEQ ID NO: 1489217 - RNA, 13 nt, Human
ggggccaggcugg

SEQ ID NO: 1489218 - RNA, 14 nt, Human
ggggccaggcuggg

SEQ ID NO: 1489219 - RNA, 21 nt, Human
aaacauauauaacaaugcugu

SEQ ID NO: 1489220 - RNA, 19 nt, Human
aaacauauauaacaaugcu

SEQ ID NO: 1489221 - RNA, 16 nt, Human
aaacauauauaacaau

SEQ ID NO: 1489222 - RNA, 13 nt, Human
aaacauauauaac

SEQ ID NO: 1489223 - RNA, 19 nt, Human
aaacaagucagucauucag

SEQ ID NO: 1489224 - RNA, 14 nt, Human
aaacacaacuauau

SEQ ID NO: 1489225 - RNA, 12 nt, Human
aaaauggaauac

SEQ ID NO: 1489226 - RNA, 17 nt, Human
aaacaaggaugaauuaa

SEQ ID NO: 1489227 - RNA, 13 nt, Human
aaacaaagaaauu

SEQ ID NO: 1489228 - RNA, 16 nt, Human
aaaauuuuuaaucuuu

SEQ ID NO: 1489229 - RNA, 22 nt, Human
aaaauuuuuucucuaggaaaua

SEQ ID NO: 1489230 - RNA, 19 nt, Human
aaaauuuuuucucuaggaa

SEQ ID NO: 1489231 - RNA, 19 nt, Human
aaaauuuuuaaucuuuaau

SEQ ID NO: 1489232 - RNA, 14 nt, Human
gaagcaaaauuuuu

SEQ ID NO: 1489233 - RNA, 20 nt, Human
gaagcaaguaaaaaggcuaa

SEQ ID NO: 1489234 - RNA, 20 nt, Human
gaagcaaugcuucaucccuu

SEQ ID NO: 1489235 - RNA, 14 nt, Human
gaacugaaaucaua

SEQ ID NO: 1489236 - RNA, 20 nt, Human
gaacccuaaauaauaaaaau

SEQ ID NO: 1489237 - RNA, 21 nt, Human
gaaguugacuuauaguacaug

SEQ ID NO: 1489238 - RNA, 23 nt, Human
gaaguugacuuauaguacaugau

SEQ ID NO: 1489239 - RNA, 20 nt, Human
gaagcuaucguaaaauuaag

SEQ ID NO: 1489240 - RNA, 14 nt, Human
gacugaauuaugaa

SEQ ID NO: 1489241 - RNA, 20 nt, Human
gacugaauuaugaaacuuuu

SEQ ID NO: 1489242 - RNA, 22 nt, Human
gacugugugcucaggagcccug

SEQ ID NO: 1489243 - RNA, 19 nt, Human
gacugaaaauauuguuuua

SEQ ID NO: 1489244 - RNA, 21 nt, Human
gacucuuaagaagacugcauu

SEQ ID NO: 1489245 - RNA, 15 nt, Human
gacucuuaagaagac

SEQ ID NO: 1489246 - RNA, 14 nt, Human
gacucuuaagaaga

SEQ ID NO: 1489247 - RNA, 16 nt, Human
gacacacugaagaagc

SEQ ID NO: 1489248 - RNA, 15 nt, Human
gacacacugaagaag

SEQ ID NO: 1489249 - RNA, 17 nt, Human
gacauuugcucauggaa

SEQ ID NO: 1489250 - RNA, 16 nt, Human
gacauuugcucaugga

SEQ ID NO: 1489251 - RNA, 23 nt, Human
gacauugaccuauuuccagaaau

SEQ ID NO: 1489252 - RNA, 20 nt, Human
gagcuggagaugaggccaga

SEQ ID NO: 1489253 - RNA, 12 nt, Human
gaggccagacca

SEQ ID NO: 1489254 - RNA, 18 nt, Human
gaggccagaccauggaca

SEQ ID NO: 1489255 - RNA, 16 nt, Human
gaguuuaaauuguaau

SEQ ID NO: 1489256 - RNA, 17 nt, Human
gagucacuacgccuggc

SEQ ID NO: 1489257 - RNA, 16 nt, Human
gaggugagaccaccuc

SEQ ID NO: 1489258 - RNA, 15 nt, Human
gaggugagaccaccu

SEQ ID NO: 1489259 - RNA, 21 nt, Human
gauuuuuuucccaauugagaa

SEQ ID NO: 1489260 - RNA, 22 nt, Human
gcaauagucaaauugugugaaa

SEQ ID NO: 1489261 - RNA, 18 nt, Human
gcaagucagaauagaaau

SEQ ID NO: 1489262 - RNA, 20 nt, Human
gcaaguauuagaauaccaca

SEQ ID NO: 1489263 - RNA, 12 nt, Human
gauggagaagga

SEQ ID NO: 1489264 - RNA, 13 nt, Human
gauggagaaggaa

SEQ ID NO: 1489265 - RNA, 14 nt, Human
gauggagaaggaag

SEQ ID NO: 1489266 - RNA, 16 nt, Human
gauggagaaggaaggc

SEQ ID NO: 1489267 - RNA, 15 nt, Human
gauggagaaggaagg

SEQ ID NO: 1489268 - RNA, 15 nt, Human
gauuuaccacuugug

SEQ ID NO: 1489269 - RNA, 16 nt, Human
gauuuaccacuugugu

SEQ ID NO: 1489270 - RNA, 14 nt, Human
gauuauauuaugaa

SEQ ID NO: 1489271 - RNA, 20 nt, Human
cuucuguuuuauaauuuugu

SEQ ID NO: 1489272 - RNA, 15 nt, Human
cuucuguuuuauaau

SEQ ID NO: 1489273 - RNA, 15 nt, Human
cuuggccaugcagaa

SEQ ID NO: 1489274 - RNA, 18 nt, Human
cuuggccaugcagaaagc

SEQ ID NO: 1489275 - RNA, 20 nt, Human
cuuuaaggggaggaaccaga

SEQ ID NO: 1489276 - RNA, 23 nt, Human
cuugugauccacucgccucagcc

SEQ ID NO: 1489277 - RNA, 23 nt, Human
cuucaugcugucuacacuaagag

SEQ ID NO: 1489278 - RNA, 21 nt, Human
cuucaugcauggaaauucccu

SEQ ID NO: 1489279 - RNA, 23 nt, Human
cuucaugcauggaaauucccuuc

SEQ ID NO: 1489280 - RNA, 15 nt, Human
cugcugugaaagaag

SEQ ID NO: 1489281 - RNA, 12 nt, Human
cugcuuaauuca

SEQ ID NO: 1489282 - RNA, 13 nt, Human
cugcuuaauucaa

SEQ ID NO: 1489283 - RNA, 19 nt, Human
cuggacugugugcucagga

SEQ ID NO: 1489284 - RNA, 22 nt, Human
cuggacugugugcucaggagcc

SEQ ID NO: 1489285 - RNA, 23 nt, Human
cuggacugugugcucaggagccc

SEQ ID NO: 1489286 - RNA, 17 nt, Human
cugggagaaaugaaaaa

SEQ ID NO: 1489287 - RNA, 18 nt, Human
cugggacuugcaaaaagg

SEQ ID NO: 1489288 - RNA, 16 nt, Human
cugggagaaaugaaaa

SEQ ID NO: 1489289 - RNA, 13 nt, Human
cugauggagaagg

SEQ ID NO: 1489290 - RNA, 14 nt, Human
cugauggagaagga

SEQ ID NO: 1489291 - RNA, 15 nt, Human
cugauggagaaggaa

SEQ ID NO: 1489292 - RNA, 16 nt, Human
cugauggagaaggaag

SEQ ID NO: 1489293 - RNA, 17 nt, Human
cugauggagaaggaagg

SEQ ID NO: 1489294 - RNA, 18 nt, Human
cucuuauaucuauauuuu

SEQ ID NO: 1489295 - RNA, 15 nt, Human
cucuuauaucuauau

SEQ ID NO: 1489296 - RNA, 14 nt, Human
cugcaaccuccacc

SEQ ID NO: 1489297 - RNA, 16 nt, Human
cugcaaccuccaccuc

SEQ ID NO: 1489298 - RNA, 18 nt, Human
aacauuugguaaggggaa

SEQ ID NO: 1489299 - RNA, 20 nt, Human
aacauuuguucuauagcuuu

SEQ ID NO: 1489300 - RNA, 22 nt, Human
aacauuuguucuauagcuuuuc

SEQ ID NO: 1489301 - RNA, 19 nt, Human
aacaguuguguuugaagca

SEQ ID NO: 1489302 - RNA, 23 nt, Human
aaauuuuuaaucuuuaauuuuac

SEQ ID NO: 1489303 - RNA, 17 nt, Human
aaauuuuuguaguagcg

SEQ ID NO: 1489304 - RNA, 21 nt, Human
aacaagccuccuuuuaaagua

SEQ ID NO: 1489305 - RNA, 15 nt, Human
aacaaggaugaauua

SEQ ID NO: 1489306 - RNA, 18 nt, Human
aacaagucagucauucag

SEQ ID NO: 1489307 - RNA, 15 nt, Human
aacaagucagucauu

SEQ ID NO: 1489308 - RNA, 14 nt, Human
aacaaugcuguauu

SEQ ID NO: 1489309 - RNA, 21 nt, Human
guccaagcauuuagauguaua

SEQ ID NO: 1489310 - RNA, 19 nt, Human
gucuuauauauuguagaua

SEQ ID NO: 1489311 - RNA, 14 nt, Human
gucuuccucugucu

SEQ ID NO: 1489312 - RNA, 18 nt, Human
aacucguuaauuuguagu

SEQ ID NO: 1489313 - RNA, 21 nt, Human
aacuccagaaagugacaagcu

SEQ ID NO: 1489314 - RNA, 14 nt, Human
aacuccagaaagug

SEQ ID NO: 1489315 - RNA, 20 nt, Human
aaccuagggugauauuaacc

SEQ ID NO: 1489316 - RNA, 20 nt, Human
aaccacauuggagauguuua

SEQ ID NO: 1489317 - RNA, 10 nt, Human
aaccaaguuc

SEQ ID NO: 1489318 - RNA, 20 nt, Human
gucuccuaagcuggagugca

SEQ ID NO: 1489319 - RNA, 14 nt, Human
gucaaaaauuaaac

SEQ ID NO: 1489320 - RNA, 13 nt, Human
gucaaaaauuaaa

SEQ ID NO: 1489321 - RNA, 23 nt, Human
gucaaaaauuaaaccggaccauc

SEQ ID NO: 1489322 - RNA, 19 nt, Human
gucaacucauauuuucaug

SEQ ID NO: 1489323 - RNA, 16 nt, Human
gucaaauugugugaaa

SEQ ID NO: 1489324 - RNA, 22 nt, Human
aaauuuccugggagcuuuugua

SEQ ID NO: 1489325 - RNA, 20 nt, Human
aaauuuaguauuuuguuuca

SEQ ID NO: 1489326 - RNA, 18 nt, Human
aaauucccuucaucugga

SEQ ID NO: 1489327 - RNA, 17 nt, Human
aaauuucagcagcugca

SEQ ID NO: 1489328 - RNA, 18 nt, Human
aaauuucagcagcugcag

SEQ ID NO: 1489329 - RNA, 16 nt, Human
aaauucccuucaucug

SEQ ID NO: 1489330 - RNA, 19 nt, Human
aaauucccuucaucuggaa

SEQ ID NO: 1489331 - RNA, 22 nt, Human
aaauguuaugacuauguaaacu

SEQ ID NO: 1489332 - RNA, 20 nt, Human
guauuuaauagguuuggaca

SEQ ID NO: 1489333 - RNA, 16 nt, Human
guauuuaauucauguu

SEQ ID NO: 1489334 - RNA, 17 nt, Human
guauaaaagccuguuua

SEQ ID NO: 1489335 - RNA, 18 nt, Human
guauaaaagccuguuuaa

SEQ ID NO: 1489336 - RNA, 21 nt, Human
guauaaaagccuguuuaagag

SEQ ID NO: 1489337 - RNA, 18 nt, Human
guauaaaagggacugaga

SEQ ID NO: 1489338 - RNA, 17 nt, Human
guauauuacaaugauca

SEQ ID NO: 1489339 - RNA, 15 nt, Human
guauauuacaaugau

SEQ ID NO: 1489340 - RNA, 18 nt, Human
guauauuacaaugaucac

SEQ ID NO: 1489341 - RNA, 22 nt, Human
guauauugauccagaaagaaaa

SEQ ID NO: 1489342 - RNA, 14 nt, Human
guaugauucccagc

SEQ ID NO: 1489343 - RNA, 21 nt, Human
guauggguuagggaaaacauu

SEQ ID NO: 1489344 - RNA, 14 nt, Human
aaaugcauuucuaa

SEQ ID NO: 1489345 - RNA, 19 nt, Human
aaauggcuuccuggcaaua

SEQ ID NO: 1489346 - RNA, 13 nt, Human
aaaugcauguugc

SEQ ID NO: 1489347 - RNA, 13 nt, Human
aaaugagaaaucu

SEQ ID NO: 1489348 - RNA, 14 nt, Human
aaaugagaaaucua

SEQ ID NO: 1489349 - RNA, 16 nt, Human
aaaugagaaaucuaaa

SEQ ID NO: 1489350 - RNA, 11 nt, Human
aaaugagaaau

SEQ ID NO: 1489351 - RNA, 14 nt, Human
aaauccuugaagau

SEQ ID NO: 1489352 - RNA, 13 nt, Human
aaaggacuguaau

SEQ ID NO: 1489353 - RNA, 16 nt, Human
guaggaaagaggaagc

SEQ ID NO: 1489354 - RNA, 18 nt, Human
aagaaugauuaugaauua

SEQ ID NO: 1489355 - RNA, 23 nt, Human
aagacaaaaagcuacuuauugua

SEQ ID NO: 1489356 - RNA, 20 nt, Human
aagacaaaaagcuacuuauu

SEQ ID NO: 1489357 - RNA, 16 nt, Human
aagaaugauuaugaau

SEQ ID NO: 1489358 - RNA, 15 nt, Human
gugcucaggagcccu

SEQ ID NO: 1489359 - RNA, 16 nt, Human
gugcucaggagcccug

SEQ ID NO: 1489360 - RNA, 15 nt, Human
aacuuguauuaugug

SEQ ID NO: 1489361 - RNA, 16 nt, Human
aacuuguauuaugugu

SEQ ID NO: 1489362 - RNA, 21 nt, Human
aagaaacuggggcuccuccag

SEQ ID NO: 1489363 - RNA, 17 nt, Human
aagaaacuuguccuucc

SEQ ID NO: 1489364 - RNA, 14 nt, Human
aagaaagaacggaa

SEQ ID NO: 1489365 - RNA, 16 nt, Human
aagaaagaacggaaga

SEQ ID NO: 1489366 - RNA, 13 nt, Human
aagaaauauaccu

SEQ ID NO: 1489367 - RNA, 18 nt, Human
gugcuaguaauuggaaag

SEQ ID NO: 1489368 - RNA, 13 nt, Human
aagaggaagcaaa

SEQ ID NO: 1489369 - RNA, 14 nt, Human
aagaggaagcaaau

SEQ ID NO: 1489370 - RNA, 14 nt, Human
guggguagacacac

SEQ ID NO: 1489371 - RNA, 19 nt, Human
guggcgcgaucucagcuca

SEQ ID NO: 1489372 - RNA, 21 nt, Human
gugggacagucaccucaugga

SEQ ID NO: 1489373 - RNA, 19 nt, Human
guggcgugaucucagcuca

SEQ ID NO: 1489374 - RNA, 17 nt, Human
gugggaggugagaccac

SEQ ID NO: 1489375 - RNA, 18 nt, Human
aagagguuuuaaagcuuc

SEQ ID NO: 1489376 - RNA, 14 nt, Human
aagagguuuuaaag

SEQ ID NO: 1489377 - RNA, 17 nt, Human
aagcuaucguaaaauua

SEQ ID NO: 1489378 - RNA, 23 nt, Human
guucugguaugaacuugaggaca

SEQ ID NO: 1489379 - RNA, 16 nt, Human
guucuuacugcuuaau

SEQ ID NO: 1489380 - RNA, 18 nt, Human
guugacaugggacauuug

SEQ ID NO: 1489381 - RNA, 14 nt, Human
guugacaugggaca

SEQ ID NO: 1489382 - RNA, 18 nt, Human
guguuuuaaaaugagaaa

SEQ ID NO: 1489383 - RNA, 19 nt, Human
aagccuccuuagaaaaaaa

SEQ ID NO: 1489384 - RNA, 13 nt, Human
aagguacuucaaa

SEQ ID NO: 1489385 - RNA, 22 nt, Human
aaguaaaaacaaagaaauuaug

SEQ ID NO: 1489386 - RNA, 13 nt, Human
aaguaaaaacaaa

SEQ ID NO: 1489387 - RNA, 20 nt, Human
aaguaaaaacaaagaaauua

SEQ ID NO: 1489388 - RNA, 17 nt, Human
aaggggaauugaggaca

SEQ ID NO: 1489389 - RNA, 21 nt, Human
guuucaaacauauauaacaau

SEQ ID NO: 1489390 - RNA, 11 nt, Human
guuuuacaaua

SEQ ID NO: 1489391 - RNA, 13 nt, Human
guuuuacaauagu

SEQ ID NO: 1489392 - RNA, 16 nt, Human
guuuuacaauaguucu

SEQ ID NO: 1489393 - RNA, 20 nt, Human
guuuuacaauaguucugugg

SEQ ID NO: 1489394 - RNA, 20 nt, Human
guuuucuuaaccagaucauu

SEQ ID NO: 1489395 - RNA, 21 nt, Human
acaaauucugucucuggauua

SEQ ID NO: 1489396 - RNA, 16 nt, Human
uagcuacuaauuuuaa

SEQ ID NO: 1489397 - RNA, 21 nt, Human
uagaugcaguucugaagaaga

SEQ ID NO: 1489398 - RNA, 17 nt, Human
uagauaggccaugggca

SEQ ID NO: 1489399 - RNA, 22 nt, Human
uagauaggucagugcaaauacu

SEQ ID NO: 1489400 - RNA, 12 nt, Human
aauuuuuuuuac

SEQ ID NO: 1489401 - RNA, 16 nt, Human
aauuuuuuuuacauuu

SEQ ID NO: 1489402 - RNA, 22 nt, Human
aauuuuuaaucuuuaauuuuac

SEQ ID NO: 1489403 - RNA, 21 nt, Human
aauuugguuuucacauuggaa

SEQ ID NO: 1489404 - RNA, 15 nt, Human
aauuugguuuucaca

SEQ ID NO: 1489405 - RNA, 13 nt, Human
aauuugguuuuca

SEQ ID NO: 1489406 - RNA, 15 nt, Human
aauuugaaacacuuu

SEQ ID NO: 1489407 - RNA, 19 nt, Human
uacuucuuaggguuaugau

SEQ ID NO: 1489408 - RNA, 20 nt, Human
uacuucuuuuuucaaaagaa

SEQ ID NO: 1489409 - RNA, 22 nt, Human
uacuucuuuuuucaaaagaaag

SEQ ID NO: 1489410 - RNA, 15 nt, Human
uacuugaaaauuaac

SEQ ID NO: 1489411 - RNA, 13 nt, Human
aauuuaguauuuu

SEQ ID NO: 1489412 - RNA, 15 nt, Human
aauuggagcucgugg

SEQ ID NO: 1489413 - RNA, 13 nt, Human
aauuuaaauguua

SEQ ID NO: 1489414 - RNA, 11 nt, Human
aauuuaaaugu

SEQ ID NO: 1489415 - RNA, 17 nt, Human
aauuucuaggacugaau

SEQ ID NO: 1489416 - RNA, 22 nt, Human
aauuucuaggacugaauuauga

SEQ ID NO: 1489417 - RNA, 18 nt, Human
aauuucuaggacugaauu

SEQ ID NO: 1489418 - RNA, 23 nt, Human
aauuucuaggacugaauuaugaa

SEQ ID NO: 1489419 - RNA, 22 nt, Human
aauuuauaaacuuuuuucuuac

SEQ ID NO: 1489420 - RNA, 18 nt, Human
uacuagggaaaugccuuu

SEQ ID NO: 1489421 - RNA, 19 nt, Human
aauugagaaaaauauauac

SEQ ID NO: 1489422 - RNA, 23 nt, Human
aauugagaaaaauauauacuaaa

SEQ ID NO: 1489423 - RNA, 18 nt, Human
aauugaggacacugauau

SEQ ID NO: 1489424 - RNA, 19 nt, Human
uacuguacagacagaaaaa

SEQ ID NO: 1489425 - RNA, 23 nt, Human
uacuguacagacagaaaaaacug

SEQ ID NO: 1489426 - RNA, 22 nt, Human
uacugaaauaaacgucuuaaau

SEQ ID NO: 1489427 - RNA, 19 nt, Human
uacugaaauaaacgucuua

SEQ ID NO: 1489428 - RNA, 20 nt, Human
uauauuuauuacuguaagaa

SEQ ID NO: 1489429 - RNA, 19 nt, Human
uauauuuauuacuguaaga

SEQ ID NO: 1489430 - RNA, 15 nt, Human
uauauuuauuacugu

SEQ ID NO: 1489431 - RNA, 23 nt, Human
acagagcuggagaugaggccaga

SEQ ID NO: 1489432 - RNA, 21 nt, Human
acagcccuucuuuccacagaa

SEQ ID NO: 1489433 - RNA, 20 nt, Human
acagcccuucuuuccacaga

SEQ ID NO: 1489434 - RNA, 12 nt, Human
uauauuuacaaa

SEQ ID NO: 1489435 - RNA, 14 nt, Human
acacugaagaagca

SEQ ID NO: 1489436 - RNA, 12 nt, Human
acacugaagaag

SEQ ID NO: 1489437 - RNA, 18 nt, Human
acaaugcuguauuuuaaa

SEQ ID NO: 1489438 - RNA, 17 nt, Human
acaaugcuguauuuuaa

SEQ ID NO: 1489439 - RNA, 14 nt, Human
acaaugcuguauuu

SEQ ID NO: 1489440 - RNA, 17 nt, Human
acacaacuauauuguuu

SEQ ID NO: 1489441 - RNA, 14 nt, Human
acacaacuauauug

SEQ ID NO: 1489442 - RNA, 13 nt, Human
acacacugaagaa

SEQ ID NO: 1489443 - RNA, 17 nt, Human
uaguguuggagaagaac

SEQ ID NO: 1489444 - RNA, 16 nt, Human
uaguguuggagaagaa

SEQ ID NO: 1489445 - RNA, 12 nt, Human
uaguguuggaga

SEQ ID NO: 1489446 - RNA, 14 nt, Human
acacacugaagaag

SEQ ID NO: 1489447 - RNA, 22 nt, Human
uagguuuggacaaaauggaaua

SEQ ID NO: 1489448 - RNA, 20 nt, Human
uauaaaaauaaaaaacacug

SEQ ID NO: 1489449 - RNA, 21 nt, Human
uauaaaaauaaaaaacacugg

SEQ ID NO: 1489450 - RNA, 19 nt, Human
acacaugcuucccuuuccu

SEQ ID NO: 1489451 - RNA, 21 nt, Human
acacaugcuucccuuuccuga

SEQ ID NO: 1489452 - RNA, 23 nt, Human
acacaugcuucccuuuccugagu

SEQ ID NO: 1489453 - RNA, 23 nt, Human
acacuacacccagcaauagagac

SEQ ID NO: 1489454 - RNA, 17 nt, Human
acacuacacccagcaau

SEQ ID NO: 1489455 - RNA, 17 nt, Human
acacuaagagagaauga

SEQ ID NO: 1489456 - RNA, 13 nt, Human
acacuacacccag

SEQ ID NO: 1489457 - RNA, 14 nt, Human
acacuacacccagc

SEQ ID NO: 1489458 - RNA, 15 nt, Human
acacuacacccagca

SEQ ID NO: 1489459 - RNA, 19 nt, Human
acacuaagagagaaugaga

SEQ ID NO: 1489460 - RNA, 18 nt, Human
acacuaagagagaaugag

SEQ ID NO: 1489461 - RNA, 13 nt, Human
acaccugcccugc

SEQ ID NO: 1489462 - RNA, 14 nt, Human
acaccugcccugcc

SEQ ID NO: 1489463 - RNA, 12 nt, Human
acaccugcccug

SEQ ID NO: 1489464 - RNA, 15 nt, Human
acaccugcccugccc

SEQ ID NO: 1489465 - RNA, 17 nt, Human
acaccugcccugcccug

SEQ ID NO: 1489466 - RNA, 18 nt, Human
acaccugcccugcccugc

SEQ ID NO: 1489467 - RNA, 20 nt, Human
acaccugcccugcccugcca

SEQ ID NO: 1489468 - RNA, 22 nt, Human
acaccugcccugcccugccacc

SEQ ID NO: 1489469 - RNA, 23 nt, Human
acacccagcaauagagacgggac

SEQ ID NO: 1489470 - RNA, 13 nt, Human
acacccagcaaua

SEQ ID NO: 1489471 - RNA, 12 nt, Human
aauaaagugacc

SEQ ID NO: 1489472 - RNA, 15 nt, Human
aauaacgauaaaaga

SEQ ID NO: 1489473 - RNA, 21 nt, Human
aauaacaaugaaaguugauaa

SEQ ID NO: 1489474 - RNA, 22 nt, Human
uaaagguucaugcaaacuuuau

SEQ ID NO: 1489475 - RNA, 19 nt, Human
uaaaguaaaaacaaagaaa

SEQ ID NO: 1489476 - RNA, 21 nt, Human
uaaaguaaaaacaaagaaauu

SEQ ID NO: 1489477 - RNA, 22 nt, Human
uaaaguaaaaacaaagaaauua

SEQ ID NO: 1489478 - RNA, 15 nt, Human
uaaauagacacgcac

SEQ ID NO: 1489479 - RNA, 22 nt, Human
uaaauguuaugacuauguaaac

SEQ ID NO: 1489480 - RNA, 23 nt, Human
uaaauguuaugacuauguaaacu

SEQ ID NO: 1489481 - RNA, 15 nt, Human
uaaauguugacaugg

SEQ ID NO: 1489482 - RNA, 24 nt, Human
uaaauguuuuuuuuuaaagacuuu

SEQ ID NO: 1489483 - RNA, 20 nt, Human
aauaauuuuuauauuugaaa

SEQ ID NO: 1489484 - RNA, 12 nt, Human
uaaauaaaguuu

SEQ ID NO: 1489485 - RNA, 21 nt, Human
uaaauaaaguuuguugaaaca

SEQ ID NO: 1489486 - RNA, 19 nt, Human
aauaauuuuuauauuugaa

SEQ ID NO: 1489487 - RNA, 17 nt, Human
aauaauuuuuauauuug

SEQ ID NO: 1489488 - RNA, 16 nt, Human
aauaauuuuuauauuu

SEQ ID NO: 1489489 - RNA, 11 nt, Human
aauaauuuuau

SEQ ID NO: 1489490 - RNA, 14 nt, Human
aauaauuuuaucuc

SEQ ID NO: 1489491 - RNA, 15 nt, Human
aauauuucagauaau

SEQ ID NO: 1489492 - RNA, 18 nt, Human
aauauuguuuuacaauag

SEQ ID NO: 1489493 - RNA, 17 nt, Human
aauauuguuuuacaaua

SEQ ID NO: 1489494 - RNA, 21 nt, Human
aauaucuccgucaacucauau

SEQ ID NO: 1489495 - RNA, 16 nt, Human
aauaucuccgucaacu

SEQ ID NO: 1489496 - RNA, 14 nt, Human
uaacaugauuuggg

SEQ ID NO: 1489497 - RNA, 16 nt, Human
uaaccucuaaauucuu

SEQ ID NO: 1489498 - RNA, 20 nt, Human
aauaucacuugucaauaaaa

SEQ ID NO: 1489499 - RNA, 15 nt, Human
aauaucacuugucaa

SEQ ID NO: 1489500 - RNA, 12 nt, Human
aauaucacuugu

SEQ ID NO: 1489501 - RNA, 24 nt, Human
aauagcuuuuuucucugauacaga

SEQ ID NO: 1489502 - RNA, 18 nt, Human
aauaggcguaacuaauuu

SEQ ID NO: 1489503 - RNA, 18 nt, Human
uaaguuuuuuuuuaaaaa

SEQ ID NO: 1489504 - RNA, 14 nt, Human
aaucagacuaugaa

SEQ ID NO: 1489505 - RNA, 17 nt, Human
aaucagacuaugaaguu

SEQ ID NO: 1489506 - RNA, 23 nt, Human
aaucaugaauuaguuuuauaugc

SEQ ID NO: 1489507 - RNA, 17 nt, Human
aaucaugaauuaguuuu

SEQ ID NO: 1489508 - RNA, 19 nt, Human
aaucaugaauuaguuuuau

SEQ ID NO: 1489509 - RNA, 17 nt, Human
aaucauggugcucagag

SEQ ID NO: 1489510 - RNA, 15 nt, Human
aaucaucaagucuuu

SEQ ID NO: 1489511 - RNA, 14 nt, Human
aaucuuauaauuua

SEQ ID NO: 1489512 - RNA, 16 nt, Human
aaucuuauaauuuaaa

SEQ ID NO: 1489513 - RNA, 13 nt, Human
aauccuugaagau

SEQ ID NO: 1489514 - RNA, 20 nt, Human
aauccucaguuuuugugaaa

SEQ ID NO: 1489515 - RNA, 16 nt, Human
uaaugauaacuggaaa

SEQ ID NO: 1489516 - RNA, 21 nt, Human
aaugagagacacacugaagaa

SEQ ID NO: 1489517 - RNA, 13 nt, Human
aaugagacaucca

SEQ ID NO: 1489518 - RNA, 14 nt, Human
aaugagacauccag

SEQ ID NO: 1489519 - RNA, 15 nt, Human
aaugagacauccagc

SEQ ID NO: 1489520 - RNA, 15 nt, Human
aaugaaaaccacauu

SEQ ID NO: 1489521 - RNA, 14 nt, Human
uaauagguuuggac

SEQ ID NO: 1489522 - RNA, 19 nt, Human
uaauagguuuggacaaaau

SEQ ID NO: 1489523 - RNA, 20 nt, Human
uaauagggcaauuaauuccu

SEQ ID NO: 1489524 - RNA, 19 nt, Human
uacauauaagugauugcug

SEQ ID NO: 1489525 - RNA, 22 nt, Human
uacauauaagugauugcugguu

SEQ ID NO: 1489526 - RNA, 19 nt, Human
aauggacuuuuguacauag

SEQ ID NO: 1489527 - RNA, 19 nt, Human
uacacuaagagagaaugag

SEQ ID NO: 1489528 - RNA, 21 nt, Human
aaugccccugaauuuaaauag

SEQ ID NO: 1489529 - RNA, 12 nt, Human
ucagcucaugga

SEQ ID NO: 1489530 - RNA, 19 nt, Human
ucaggaaagagaacuucca

SEQ ID NO: 1489531 - RNA, 13 nt, Human
ucaggaaagagaa

SEQ ID NO: 1489532 - RNA, 23 nt, Human
accccagcuggggccaggcuggg

SEQ ID NO: 1489533 - RNA, 23 nt, Human
accauuucuugagguaaaagcau

SEQ ID NO: 1489534 - RNA, 21 nt, Human
acccagauaaagguucaugca

SEQ ID NO: 1489535 - RNA, 19 nt, Human
ucacccaggcuggacugca

SEQ ID NO: 1489536 - RNA, 19 nt, Human
ucacccagguuggagugca

SEQ ID NO: 1489537 - RNA, 15 nt, Human
accaaucaugaauua

SEQ ID NO: 1489538 - RNA, 13 nt, Human
accaaucaugaau

SEQ ID NO: 1489539 - RNA, 15 nt, Human
ucaauucuugccaaa

SEQ ID NO: 1489540 - RNA, 17 nt, Human
ucaauucuucccuaucu

SEQ ID NO: 1489541 - RNA, 19 nt, Human
ucaauucuucccuaucuuu

SEQ ID NO: 1489542 - RNA, 23 nt, Human
ucaauucuucccuaucuuugcca

SEQ ID NO: 1489543 - RNA, 18 nt, Human
accacuuguguuuugcaa

SEQ ID NO: 1489544 - RNA, 13 nt, Human
accacuuuuugca

SEQ ID NO: 1489545 - RNA, 14 nt, Human
accacuuuuugcag

SEQ ID NO: 1489546 - RNA, 15 nt, Human
accacuuuuugcagc

SEQ ID NO: 1489547 - RNA, 16 nt, Human
accacuuuuugcagcu

SEQ ID NO: 1489548 - RNA, 17 nt, Human
accacuuuuugcagcuu

SEQ ID NO: 1489549 - RNA, 18 nt, Human
accacuuuuugcagcuuu

SEQ ID NO: 1489550 - RNA, 20 nt, Human
accacuuuuugcagcuuucu

SEQ ID NO: 1489551 - RNA, 19 nt, Human
acauauauaacaaugcugu

SEQ ID NO: 1489552 - RNA, 20 nt, Human
acauagugggacccugucuc

SEQ ID NO: 1489553 - RNA, 21 nt, Human
uaugaaauauuauguuaaaac

SEQ ID NO: 1489554 - RNA, 19 nt, Human
uaugaacuugaggacacau

SEQ ID NO: 1489555 - RNA, 20 nt, Human
uaugaacuugaggacacaug

SEQ ID NO: 1489556 - RNA, 21 nt, Human
uaugaacuugaggacacaugu

SEQ ID NO: 1489557 - RNA, 23 nt, Human
uaugaacuugaggacacaugucc

SEQ ID NO: 1489558 - RNA, 22 nt, Human
uaugaacuugaggacacauguc

SEQ ID NO: 1489559 - RNA, 21 nt, Human
acauguccagugggaggugag

SEQ ID NO: 1489560 - RNA, 22 nt, Human
acauuaaauuuuuuuuacauuu

SEQ ID NO: 1489561 - RNA, 22 nt, Human
ucaagaacacagcccugcuucu

SEQ ID NO: 1489562 - RNA, 20 nt, Human
ucaaauacgugggcauucaa

SEQ ID NO: 1489563 - RNA, 16 nt, Human
acaugaaguccaagca

SEQ ID NO: 1489564 - RNA, 14 nt, Human
ucaaagcugaaaug

SEQ ID NO: 1489565 - RNA, 21 nt, Human
ucaaaauaugccccauucaac

SEQ ID NO: 1489566 - RNA, 16 nt, Human
ucaaaauuguuacaaa

SEQ ID NO: 1489567 - RNA, 19 nt, Human
ucaaaauuguuacaaauug

SEQ ID NO: 1489568 - RNA, 21 nt, Human
ucaugaauuaguuuuauaugc

SEQ ID NO: 1489569 - RNA, 17 nt, Human
accucgugauccacccg

SEQ ID NO: 1489570 - RNA, 14 nt, Human
accucuaaauucuu

SEQ ID NO: 1489571 - RNA, 12 nt, Human
accucucaauau

SEQ ID NO: 1489572 - RNA, 19 nt, Human
accucucaauauucaauaa

SEQ ID NO: 1489573 - RNA, 20 nt, Human
accucucaauauucaauaaa

SEQ ID NO: 1489574 - RNA, 21 nt, Human
accucucaauauucaauaaag

SEQ ID NO: 1489575 - RNA, 23 nt, Human
accucucaauauucaauaaagcu

SEQ ID NO: 1489576 - RNA, 16 nt, Human
accucuccagccucag

SEQ ID NO: 1489577 - RNA, 18 nt, Human
accucuccagccucagcu

SEQ ID NO: 1489578 - RNA, 20 nt, Human
accucuccagccucagcucu

SEQ ID NO: 1489579 - RNA, 22 nt, Human
accucuccagccucagcucuca

SEQ ID NO: 1489580 - RNA, 17 nt, Human
accucccucaaccucau

SEQ ID NO: 1489581 - RNA, 19 nt, Human
accucccucaaccucaucc

SEQ ID NO: 1489582 - RNA, 22 nt, Human
ucauccucuccacagcugccuc

SEQ ID NO: 1489583 - RNA, 18 nt, Human
ucaucuagguaaauuaca

SEQ ID NO: 1489584 - RNA, 14 nt, Human
ucaucuaggauuuu

SEQ ID NO: 1489585 - RNA, 16 nt, Human
ucaugaauuaguuuua

SEQ ID NO: 1489586 - RNA, 13 nt, Human
ucaucucagcuca

SEQ ID NO: 1489587 - RNA, 21 nt, Human
accuagggugauauuaaccag

SEQ ID NO: 1489588 - RNA, 13 nt, Human
uccaacccuagca

SEQ ID NO: 1489589 - RNA, 14 nt, Human
uccaacccuagcaa

SEQ ID NO: 1489590 - RNA, 15 nt, Human
uccaacccuagcaaa

SEQ ID NO: 1489591 - RNA, 14 nt, Human
acgagaaaacaaua

SEQ ID NO: 1489592 - RNA, 12 nt, Human
ucccaucccugc

SEQ ID NO: 1489593 - RNA, 14 nt, Human
ucccaucccugcgu

SEQ ID NO: 1489594 - RNA, 20 nt, Human
acuacaggcacacaccacca

SEQ ID NO: 1489595 - RNA, 15 nt, Human
acuacaguuagggcu

SEQ ID NO: 1489596 - RNA, 20 nt, Human
uccauccuugagucaaaaaa

SEQ ID NO: 1489597 - RNA, 20 nt, Human
uccaucucuuguuuaaauuc

SEQ ID NO: 1489598 - RNA, 12 nt, Human
uccauucuggaa

SEQ ID NO: 1489599 - RNA, 13 nt, Human
uccauucuggaag

SEQ ID NO: 1489600 - RNA, 14 nt, Human
uccauucuggaagu

SEQ ID NO: 1489601 - RNA, 21 nt, Human
ucccaaagaaguucugguaug

SEQ ID NO: 1489602 - RNA, 14 nt, Human
ucccaaaaaacuac

SEQ ID NO: 1489603 - RNA, 20 nt, Human
ucccaaaagcccauucauuc

SEQ ID NO: 1489604 - RNA, 21 nt, Human
ucccaaaguccugggauuaca

SEQ ID NO: 1489605 - RNA, 20 nt, Human
ucccaaguagcugagacuac

SEQ ID NO: 1489606 - RNA, 18 nt, Human
acgggacugcggaggaag

SEQ ID NO: 1489607 - RNA, 22 nt, Human
acguauaaaagccuguuuaaga

SEQ ID NO: 1489608 - RNA, 20 nt, Human
acgugggcauucaaauguau

SEQ ID NO: 1489609 - RNA, 17 nt, Human
acgugggcauucaaaug

SEQ ID NO: 1489610 - RNA, 21 nt, Human
acuacuagggaaaugccuuug

SEQ ID NO: 1489611 - RNA, 19 nt, Human
uccuaaauauauuuuaaga

SEQ ID NO: 1489612 - RNA, 22 nt, Human
ucguuuucaaaauuguuacaaa

SEQ ID NO: 1489613 - RNA, 16 nt, Human
ucguaaaauuaagaaa

SEQ ID NO: 1489614 - RNA, 13 nt, Human
ucguaaaauuaag

SEQ ID NO: 1489615 - RNA, 18 nt, Human
acugggacaggggagaac

SEQ ID NO: 1489616 - RNA, 16 nt, Human
acugggagaaaugaaa

SEQ ID NO: 1489617 - RNA, 17 nt, Human
acugggagaaaugaaaa

SEQ ID NO: 1489618 - RNA, 18 nt, Human
acuguggguagacacaca

SEQ ID NO: 1489619 - RNA, 12 nt, Human
acugugugcuca

SEQ ID NO: 1489620 - RNA, 15 nt, Human
acugugugcucagga

SEQ ID NO: 1489621 - RNA, 19 nt, Human
acugugugcucaggagccc

SEQ ID NO: 1489622 - RNA, 20 nt, Human
acugugugcucaggagcccu

SEQ ID NO: 1489623 - RNA, 21 nt, Human
acugugugcucaggagcccug

SEQ ID NO: 1489624 - RNA, 14 nt, Human
acuuauaguacaug

SEQ ID NO: 1489625 - RNA, 15 nt, Human
acuuauaguacauga

SEQ ID NO: 1489626 - RNA, 17 nt, Human
acuuauaguacaugaua

SEQ ID NO: 1489627 - RNA, 18 nt, Human
acuuauaguacaugauaa

SEQ ID NO: 1489628 - RNA, 19 nt, Human
acuguuguagaagacaaaa

SEQ ID NO: 1489629 - RNA, 20 nt, Human
ucuaaagccauuguaguccu

SEQ ID NO: 1489630 - RNA, 14 nt, Human
acugcauccagccu

SEQ ID NO: 1489631 - RNA, 15 nt, Human
acugcauccagccug

SEQ ID NO: 1489632 - RNA, 14 nt, Human
acugcauuauauuu

SEQ ID NO: 1489633 - RNA, 15 nt, Human
acugcauuauauuua

SEQ ID NO: 1489634 - RNA, 16 nt, Human
acugccuauuuuaaua

SEQ ID NO: 1489635 - RNA, 21 nt, Human
acugccuauuuuaauaaacac

SEQ ID NO: 1489636 - RNA, 16 nt, Human
acugcuuaauucaaau

SEQ ID NO: 1489637 - RNA, 13 nt, Human
acugcuuaauuca

SEQ ID NO: 1489638 - RNA, 20 nt, Human
acugccuucucaacuccaaa

SEQ ID NO: 1489639 - RNA, 19 nt, Human
acugccuucucaacuccaa

SEQ ID NO: 1489640 - RNA, 13 nt, Human
acugccuucucaa

SEQ ID NO: 1489641 - RNA, 12 nt, Human
ucgaagugcuga

SEQ ID NO: 1489642 - RNA, 13 nt, Human
ucgaagugcugag

SEQ ID NO: 1489643 - RNA, 12 nt, Human
acuggccccacc

SEQ ID NO: 1489644 - RNA, 13 nt, Human
acuggccccaccc

SEQ ID NO: 1489645 - RNA, 21 nt, Human
ucucacagcuccaagaauuuc

SEQ ID NO: 1489646 - RNA, 11 nt, Human
acuugaggaca

SEQ ID NO: 1489647 - RNA, 12 nt, Human
acuugaggacac

SEQ ID NO: 1489648 - RNA, 13 nt, Human
acuugaggacaca

SEQ ID NO: 1489649 - RNA, 14 nt, Human
acuugaggacacau

SEQ ID NO: 1489650 - RNA, 16 nt, Human
acuugucaauaaaauc

SEQ ID NO: 1489651 - RNA, 15 nt, Human
acuugaggacacaug

SEQ ID NO: 1489652 - RNA, 14 nt, Human
acuugcucuugaug

SEQ ID NO: 1489653 - RNA, 20 nt, Human
ucuccauggcccugccaugc

SEQ ID NO: 1489654 - RNA, 24 nt, Human
ucuccauggcccugccaugcucuc

SEQ ID NO: 1489655 - RNA, 16 nt, Human
ucuccauggcccugcc

SEQ ID NO: 1489656 - RNA, 17 nt, Human
ucuccauggcccugcca

SEQ ID NO: 1489657 - RNA, 19 nt, Human
ucuccuaagcuggagugca

SEQ ID NO: 1489658 - RNA, 16 nt, Human
acuuguguuuugcaag

SEQ ID NO: 1489659 - RNA, 14 nt, Human
ucuccaaaccacuu

SEQ ID NO: 1489660 - RNA, 18 nt, Human
ucucagcucacugcaacc

SEQ ID NO: 1489661 - RNA, 15 nt, Human
ucucagcucacugca

SEQ ID NO: 1489662 - RNA, 16 nt, Human
ucucagcucacugcaa

SEQ ID NO: 1489663 - RNA, 18 nt, Human
ucucuuuaaaaggaaaga

SEQ ID NO: 1489664 - RNA, 19 nt, Human
ucucuuuaaaaggaaagaa

SEQ ID NO: 1489665 - RNA, 21 nt, Human
ucucuuuaaaaggaaagaaaa

SEQ ID NO: 1489666 - RNA, 17 nt, Human
agaaacacccucacacu

SEQ ID NO: 1489667 - RNA, 21 nt, Human
agaaaacuuguauuaugugug

SEQ ID NO: 1489668 - RNA, 19 nt, Human
ucucuggaauuugaaacac

SEQ ID NO: 1489669 - RNA, 15 nt, Human
ucucuggaauuugaa

SEQ ID NO: 1489670 - RNA, 15 nt, Human
ucucucauacccucc

SEQ ID NO: 1489671 - RNA, 21 nt, Human
ucucucacuuguuuuauuuaa

SEQ ID NO: 1489672 - RNA, 17 nt, Human
ucucucacuuguuuuau

SEQ ID NO: 1489673 - RNA, 12 nt, Human
ucugaagaagau

SEQ ID NO: 1489674 - RNA, 18 nt, Human
agaaaugaaaaaauauau

SEQ ID NO: 1489675 - RNA, 23 nt, Human
agaaaugaaaaaauauauaucaa

SEQ ID NO: 1489676 - RNA, 12 nt, Human
agaaaucuaaaa

SEQ ID NO: 1489677 - RNA, 15 nt, Human
agaaaucuaaaaaac

SEQ ID NO: 1489678 - RNA, 17 nt, Human
agaaaugaaaaaauaua

SEQ ID NO: 1489679 - RNA, 15 nt, Human
ucugcaggucccuaa

SEQ ID NO: 1489680 - RNA, 16 nt, Human
ucugcaggucccuaau

SEQ ID NO: 1489681 - RNA, 17 nt, Human
ucugcaggucccuaaua

SEQ ID NO: 1489682 - RNA, 18 nt, Human
ucugcaggucccuaauaa

SEQ ID NO: 1489683 - RNA, 13 nt, Human
agaaauuaugugc

SEQ ID NO: 1489684 - RNA, 21 nt, Human
agaaauuaugugccagauuua

SEQ ID NO: 1489685 - RNA, 22 nt, Human
agaaauuaugugccagauuuau

SEQ ID NO: 1489686 - RNA, 16 nt, Human
agaaauuuauaaacuu

SEQ ID NO: 1489687 - RNA, 17 nt, Human
agaaauuuauaaacuuu

SEQ ID NO: 1489688 - RNA, 13 nt, Human
ucugauacagaaa

SEQ ID NO: 1489689 - RNA, 14 nt, Human
ucuuuaauuuuaca

SEQ ID NO: 1489690 - RNA, 18 nt, Human
agacuggguaggaaagag

SEQ ID NO: 1489691 - RNA, 22 nt, Human
agacuggguaggaaagaggaag

SEQ ID NO: 1489692 - RNA, 20 nt, Human
agacauuuuaaaaaaugguc

SEQ ID NO: 1489693 - RNA, 15 nt, Human
agaccgaucggcggc

SEQ ID NO: 1489694 - RNA, 17 nt, Human
ucuucugaauaaagcaa

SEQ ID NO: 1489695 - RNA, 18 nt, Human
ucuucugaauaaagcaau

SEQ ID NO: 1489696 - RNA, 22 nt, Human
ucuucuuaauauguucuuuuaa

SEQ ID NO: 1489697 - RNA, 19 nt, Human
agacauuuuaaaaaauggu

SEQ ID NO: 1489698 - RNA, 22 nt, Human
agacauuuuaaaaaauggucac

SEQ ID NO: 1489699 - RNA, 23 nt, Human
ucuuagaugcaguucugaagaag

SEQ ID NO: 1489700 - RNA, 22 nt, Human
ucuuacugcuuaauucaaauaa

SEQ ID NO: 1489701 - RNA, 19 nt, Human
ucuuacugucuuuuuucua

SEQ ID NO: 1489702 - RNA, 17 nt, Human
agacacacugaagaagc

SEQ ID NO: 1489703 - RNA, 16 nt, Human
agacacacugaagaag

SEQ ID NO: 1489704 - RNA, 13 nt, Human
agacacgcacggc

SEQ ID NO: 1489705 - RNA, 15 nt, Human
agacacgcacggcag

SEQ ID NO: 1489706 - RNA, 20 nt, Human
agacacgcacggcagccaca

SEQ ID NO: 1489707 - RNA, 21 nt, Human
agacacgcacggcagccacag

SEQ ID NO: 1489708 - RNA, 22 nt, Human
agacacgcacggcagccacagc

SEQ ID NO: 1489709 - RNA, 12 nt, Human
agacagaaaaaa

SEQ ID NO: 1489710 - RNA, 22 nt, Human
ucugguaugaacuugaggacac

SEQ ID NO: 1489711 - RNA, 23 nt, Human
ucugguaugaacuugaggacaca

SEQ ID NO: 1489712 - RNA, 18 nt, Human
ugaaauauuauguuaaaa

SEQ ID NO: 1489713 - RNA, 15 nt, Human
ugaaauuguauuaca

SEQ ID NO: 1489714 - RNA, 23 nt, Human
ugaaauuuccugggagcuuuugu

SEQ ID NO: 1489715 - RNA, 12 nt, Human
agagcacugcuc

SEQ ID NO: 1489716 - RNA, 16 nt, Human
agagcacugcuccagu

SEQ ID NO: 1489717 - RNA, 21 nt, Human
ugaacuaggauuguaguccca

SEQ ID NO: 1489718 - RNA, 11 nt, Human
ugaacuuugcu

SEQ ID NO: 1489719 - RNA, 15 nt, Human
ugaacuuugcugagc

SEQ ID NO: 1489720 - RNA, 16 nt, Human
ugaacuuugcugagcc

SEQ ID NO: 1489721 - RNA, 21 nt, Human
agagcuggagaugaggccaga

SEQ ID NO: 1489722 - RNA, 23 nt, Human
agagcuggagaugaggccagacc

SEQ ID NO: 1489723 - RNA, 22 nt, Human
agagcuggagaugaggccagac

SEQ ID NO: 1489724 - RNA, 22 nt, Human
ugaagcacagugaucaaguuau

SEQ ID NO: 1489725 - RNA, 12 nt, Human
agagguuuuaaa

SEQ ID NO: 1489726 - RNA, 16 nt, Human
ugaauuuuacauggcu

SEQ ID NO: 1489727 - RNA, 17 nt, Human
agauaaagguucaugca

SEQ ID NO: 1489728 - RNA, 15 nt, Human
agauacugaaauaaa

SEQ ID NO: 1489729 - RNA, 13 nt, Human
agauacugaaaua

SEQ ID NO: 1489730 - RNA, 12 nt, Human
agauacugaaau

SEQ ID NO: 1489731 - RNA, 20 nt, Human
agaguugaugguuguacaua

SEQ ID NO: 1489732 - RNA, 17 nt, Human
agaguuuagcuggaaaa

SEQ ID NO: 1489733 - RNA, 16 nt, Human
agaguuuagcuggaaa

SEQ ID NO: 1489734 - RNA, 13 nt, Human
agaucaggaagag

SEQ ID NO: 1489735 - RNA, 17 nt, Human
agaucaggaagagaagg

SEQ ID NO: 1489736 - RNA, 18 nt, Human
agaucaggaagagaagga

SEQ ID NO: 1489737 - RNA, 19 nt, Human
agaucaggaagagaaggag

SEQ ID NO: 1489738 - RNA, 12 nt, Human
agaucauuguga

SEQ ID NO: 1489739 - RNA, 20 nt, Human
agaugcaguucugaagaaga

SEQ ID NO: 1489740 - RNA, 19 nt, Human
agaugcaguucugaagaag

SEQ ID NO: 1489741 - RNA, 18 nt, Human
agaugcaguucugaagaa

SEQ ID NO: 1489742 - RNA, 19 nt, Human
agccacggggacucagccc

SEQ ID NO: 1489743 - RNA, 15 nt, Human
agccacgguguucug

SEQ ID NO: 1489744 - RNA, 12 nt, Human
ugcaaauuucau

SEQ ID NO: 1489745 - RNA, 21 nt, Human
ugcaagccagauuuuccugaa

SEQ ID NO: 1489746 - RNA, 15 nt, Human
ugcaagccagauuuu

SEQ ID NO: 1489747 - RNA, 21 nt, Human
ugcaaggccugguguuucuug

SEQ ID NO: 1489748 - RNA, 23 nt, Human
ugcaaggccugguguuucuugau

SEQ ID NO: 1489749 - RNA, 17 nt, Human
agcccugggaggcucug

SEQ ID NO: 1489750 - RNA, 18 nt, Human
agcccugggaggcucugg

SEQ ID NO: 1489751 - RNA, 20 nt, Human
agcccugggaggcucuggag

SEQ ID NO: 1489752 - RNA, 19 nt, Human
ugcauggaaauucccuuca

SEQ ID NO: 1489753 - RNA, 23 nt, Human
ugcauggaaauucccuucaucug

SEQ ID NO: 1489754 - RNA, 11 nt, Human
ugcauggaaau

SEQ ID NO: 1489755 - RNA, 17 nt, Human
ugcauagaauaaaauuu

SEQ ID NO: 1489756 - RNA, 11 nt, Human
ugcaggucccu

SEQ ID NO: 1489757 - RNA, 22 nt, Human
ugcaggucccuaauaaagcugu

SEQ ID NO: 1489758 - RNA, 17 nt, Human
agccuccuuagaaaaaa

SEQ ID NO: 1489759 - RNA, 19 nt, Human
agcagucaggaaagagaac

SEQ ID NO: 1489760 - RNA, 18 nt, Human
agcagucaggaaagagaa

SEQ ID NO: 1489761 - RNA, 17 nt, Human
agcagucaggaaagaga

SEQ ID NO: 1489762 - RNA, 22 nt, Human
agcauuuagauguauagguuga

SEQ ID NO: 1489763 - RNA, 18 nt, Human
agcauuuguguugaagag

SEQ ID NO: 1489764 - RNA, 17 nt, Human
agcauuuguguugaaga

SEQ ID NO: 1489765 - RNA, 17 nt, Human
ugaucaccgacugaaaa

SEQ ID NO: 1489766 - RNA, 19 nt, Human
ugaucaccgacugaaaaua

SEQ ID NO: 1489767 - RNA, 13 nt, Human
agcauccuggaau

SEQ ID NO: 1489768 - RNA, 15 nt, Human
agcauccuggaauau

SEQ ID NO: 1489769 - RNA, 14 nt, Human
agcauccuggaaua

SEQ ID NO: 1489770 - RNA, 15 nt, Human
agcaucccucaccca

SEQ ID NO: 1489771 - RNA, 13 nt, Human
ugauccagaaaga

SEQ ID NO: 1489772 - RNA, 23 nt, Human
ugauccagaaagaaaacuuguau

SEQ ID NO: 1489773 - RNA, 16 nt, Human
ugauuaaguaaugaua

SEQ ID NO: 1489774 - RNA, 15 nt, Human
ugauuaaguaaugau

SEQ ID NO: 1489775 - RNA, 23 nt, Human
aggagcccuucuauacccaccca

SEQ ID NO: 1489776 - RNA, 15 nt, Human
aggaucaguuaacua

SEQ ID NO: 1489777 - RNA, 23 nt, Human
aggaucaguuaacuauugcauuu

SEQ ID NO: 1489778 - RNA, 17 nt, Human
aggaucaguuaacuauu

SEQ ID NO: 1489779 - RNA, 11 nt, Human
aggauccaggc

SEQ ID NO: 1489780 - RNA, 12 nt, Human
aggaggacccag

SEQ ID NO: 1489781 - RNA, 13 nt, Human
aggaggacccagg

SEQ ID NO: 1489782 - RNA, 14 nt, Human
aggaggacccagga

SEQ ID NO: 1489783 - RNA, 15 nt, Human
aggaggacccaggac

SEQ ID NO: 1489784 - RNA, 16 nt, Human
aggaggacccaggaca

SEQ ID NO: 1489785 - RNA, 17 nt, Human
aggaggacccaggacag

SEQ ID NO: 1489786 - RNA, 18 nt, Human
aggaggacccaggacagg

SEQ ID NO: 1489787 - RNA, 16 nt, Human
ugcuuuuuauggccug

SEQ ID NO: 1489788 - RNA, 14 nt, Human
uggaguugaaaauc

SEQ ID NO: 1489789 - RNA, 13 nt, Human
uggagugcagugg

SEQ ID NO: 1489790 - RNA, 12 nt, Human
uggauuccagag

SEQ ID NO: 1489791 - RNA, 23 nt, Human
aggcacacaccaccacgccuggc

SEQ ID NO: 1489792 - RNA, 21 nt, Human
uggagcucgugggacagucac

SEQ ID NO: 1489793 - RNA, 21 nt, Human
uggagcucguggaacaguuac

SEQ ID NO: 1489794 - RNA, 17 nt, Human
uggagcucguggaacag

SEQ ID NO: 1489795 - RNA, 22 nt, Human
ugccugcuuuuuauggccugug

SEQ ID NO: 1489796 - RNA, 20 nt, Human
ugccugcuuuuuauggccug

SEQ ID NO: 1489797 - RNA, 21 nt, Human
ugccugcuuuuuauggccugu

SEQ ID NO: 1489798 - RNA, 19 nt, Human
ugccuuuucccaacuccag

SEQ ID NO: 1489799 - RNA, 17 nt, Human
ugccuuuucccaacucc

SEQ ID NO: 1489800 - RNA, 16 nt, Human
ugcuaauuuugaaaaa

SEQ ID NO: 1489801 - RNA, 18 nt, Human
ugcuaauuuugaaaaacu

SEQ ID NO: 1489802 - RNA, 19 nt, Human
ugcuaauuuugaaaaacug

SEQ ID NO: 1489803 - RNA, 20 nt, Human
ugcuaauuuugaaaaacugc

SEQ ID NO: 1489804 - RNA, 19 nt, Human
aggaagcaaauagaagaga

SEQ ID NO: 1489805 - RNA, 18 nt, Human
aggaagaucccccagaaa

SEQ ID NO: 1489806 - RNA, 17 nt, Human
aggaagaucccccagaa

SEQ ID NO: 1489807 - RNA, 22 nt, Human
aggaaggaggacccaggacagg

SEQ ID NO: 1489808 - RNA, 16 nt, Human
aggaaggcagggagga

SEQ ID NO: 1489809 - RNA, 18 nt, Human
aggaaggcagggaggagg

SEQ ID NO: 1489810 - RNA, 20 nt, Human
aggaaggcagggaggaggca

SEQ ID NO: 1489811 - RNA, 22 nt, Human
aggaaggcagggaggaggcaga

SEQ ID NO: 1489812 - RNA, 16 nt, Human
aggaauuacgugcucu

SEQ ID NO: 1489813 - RNA, 23 nt, Human
ugcugagccuguaaaauaaaagg

SEQ ID NO: 1489814 - RNA, 16 nt, Human
aggaagaucccccaga

SEQ ID NO: 1489815 - RNA, 17 nt, Human
ugcucuugaugccuggc

SEQ ID NO: 1489816 - RNA, 23 nt, Human
aggaaaccaguuaggucucaaua

SEQ ID NO: 1489817 - RNA, 19 nt, Human
ugggccccauguuaacccc

SEQ ID NO: 1489818 - RNA, 20 nt, Human
ugggccccugccucucugca

SEQ ID NO: 1489819 - RNA, 15 nt, Human
ugggccccugccucu

SEQ ID NO: 1489820 - RNA, 19 nt, Human
ugggccccugccucucugc

SEQ ID NO: 1489821 - RNA, 20 nt, Human
agggaggaggcagagaagaa

SEQ ID NO: 1489822 - RNA, 23 nt, Human
uggggcuccuccaggguggcagc

SEQ ID NO: 1489823 - RNA, 16 nt, Human
agggggcaagaggaau

SEQ ID NO: 1489824 - RNA, 16 nt, Human
aggggaauugaggaca

SEQ ID NO: 1489825 - RNA, 20 nt, Human
uggucacguuuggugcuucu

SEQ ID NO: 1489826 - RNA, 16 nt, Human
ugggucgcccuggacu

SEQ ID NO: 1489827 - RNA, 18 nt, Human
ugggucgcccuggacugu

SEQ ID NO: 1489828 - RNA, 23 nt, Human
uggugcuucucagauuucugagg

SEQ ID NO: 1489829 - RNA, 19 nt, Human
aggucuucuuaauauguuc

SEQ ID NO: 1489830 - RNA, 14 nt, Human
aggugagaccaccu

SEQ ID NO: 1489831 - RNA, 15 nt, Human
aggugagaccaccuc

SEQ ID NO: 1489832 - RNA, 16 nt, Human
aggugagaccaccucu

SEQ ID NO: 1489833 - RNA, 18 nt, Human
aguagcguuuuuuaaaug

SEQ ID NO: 1489834 - RNA, 19 nt, Human
aguagcguuuuuuaaaugu

SEQ ID NO: 1489835 - RNA, 16 nt, Human
uguaguagcguuuuuu

SEQ ID NO: 1489836 - RNA, 21 nt, Human
uguaguagcguuuuuuaaaug

SEQ ID NO: 1489837 - RNA, 22 nt, Human
uguaguagcguuuuuuaaaugu

SEQ ID NO: 1489838 - RNA, 23 nt, Human
uguaguagcguuuuuuaaaugua

SEQ ID NO: 1489839 - RNA, 22 nt, Human
aguacaugauaaaugauagaca

SEQ ID NO: 1489840 - RNA, 17 nt, Human
aguaaaauaauaauuuu

SEQ ID NO: 1489841 - RNA, 17 nt, Human
aguaaugauaacuggaa

SEQ ID NO: 1489842 - RNA, 20 nt, Human
aguaaugauaacuggaaacu

SEQ ID NO: 1489843 - RNA, 18 nt, Human
aguaaugauaacuggaaa

SEQ ID NO: 1489844 - RNA, 13 nt, Human
aguaaaauccaca

SEQ ID NO: 1489845 - RNA, 22 nt, Human
uguacuugcucuugaugccugg

SEQ ID NO: 1489846 - RNA, 23 nt, Human
uguacuugcucuugaugccuggc

SEQ ID NO: 1489847 - RNA, 17 nt, Human
agucaccucauggaauu

SEQ ID NO: 1489848 - RNA, 15 nt, Human
agucaccucauggaa

SEQ ID NO: 1489849 - RNA, 14 nt, Human
agucaccucaugga

SEQ ID NO: 1489850 - RNA, 21 nt, Human
aguauuagaauaccacaggaa

SEQ ID NO: 1489851 - RNA, 22 nt, Human
aguauuucuaugaaauauuaug

SEQ ID NO: 1489852 - RNA, 18 nt, Human
aguauuucuaugaaauau

SEQ ID NO: 1489853 - RNA, 17 nt, Human
aguauuucuaugaaaua

SEQ ID NO: 1489854 - RNA, 18 nt, Human
aguauuagaauaccacag

SEQ ID NO: 1489855 - RNA, 13 nt, Human
uguauuacaaauc

SEQ ID NO: 1489856 - RNA, 22 nt, Human
uguauuacaaauccaaugaaau

SEQ ID NO: 1489857 - RNA, 16 nt, Human
uguaguguuggagaag

SEQ ID NO: 1489858 - RNA, 15 nt, Human
uguaguguuggagaa

SEQ ID NO: 1489859 - RNA, 14 nt, Human
uguaguguuggaga

SEQ ID NO: 1489860 - RNA, 17 nt, Human
agucuuuggaacccuaa

SEQ ID NO: 1489861 - RNA, 15 nt, Human
agucucuauaccaau

SEQ ID NO: 1489862 - RNA, 17 nt, Human
agucucuauaccaauaa

SEQ ID NO: 1489863 - RNA, 19 nt, Human
agucucuauaccaauaaag

SEQ ID NO: 1489864 - RNA, 20 nt, Human
agucucuauaccaauaaagu

SEQ ID NO: 1489865 - RNA, 21 nt, Human
agucucuauaccaauaaagug

SEQ ID NO: 1489866 - RNA, 22 nt, Human
agucucuauaccaauaaaguga

SEQ ID NO: 1489867 - RNA, 12 nt, Human
ugugaaauuauu

SEQ ID NO: 1489868 - RNA, 20 nt, Human
ugugaacaguuguguuugaa

SEQ ID NO: 1489869 - RNA, 15 nt, Human
agugaaagaaaauaa

SEQ ID NO: 1489870 - RNA, 17 nt, Human
agugaaagaaaauaaca

SEQ ID NO: 1489871 - RNA, 20 nt, Human
ugugccagauuuaugcauau

SEQ ID NO: 1489872 - RNA, 18 nt, Human
ugugccagauuuaugcau

SEQ ID NO: 1489873 - RNA, 14 nt, Human
uguuacaaauugua

SEQ ID NO: 1489874 - RNA, 13 nt, Human
aguggacaggagu

SEQ ID NO: 1489875 - RNA, 15 nt, Human
uguucugugauauaa

SEQ ID NO: 1489876 - RNA, 18 nt, Human
uguucugugauauaagug

SEQ ID NO: 1489877 - RNA, 15 nt, Human
uguuauaaucuuuca

SEQ ID NO: 1489878 - RNA, 15 nt, Human
agugcugaauuuccc

SEQ ID NO: 1489879 - RNA, 19 nt, Human
agugcugaauuucccucuc

SEQ ID NO: 1489880 - RNA, 18 nt, Human
uguguaagacaaaaagcu

SEQ ID NO: 1489881 - RNA, 13 nt, Human
uguguaaguagau

SEQ ID NO: 1489882 - RNA, 20 nt, Human
ugugugaaagguacuucaaa

SEQ ID NO: 1489883 - RNA, 13 nt, Human
uguguugaagagg

SEQ ID NO: 1489884 - RNA, 21 nt, Human
uguuuuauuuaaccucuaaau

SEQ ID NO: 1489885 - RNA, 19 nt, Human
aguucuuacugcuuaauuc

SEQ ID NO: 1489886 - RNA, 23 nt, Human
aguucuuacugcuuaauucaaau

SEQ ID NO: 1489887 - RNA, 14 nt, Human
uguuuugcaagcca

SEQ ID NO: 1489888 - RNA, 18 nt, Human
uguuucuuuguaaugaaa

SEQ ID NO: 1489889 - RNA, 19 nt, Human
uguuucuuuguaaugaaaa

SEQ ID NO: 1489890 - RNA, 19 nt, Human
uguugccuugcauaauggu

SEQ ID NO: 1489891 - RNA, 22 nt, Human
aguugcauagguuuaauaauuu

SEQ ID NO: 1489892 - RNA, 10 nt, Human
aguugcagcc

SEQ ID NO: 1489893 - RNA, 17 nt, Human
uuaaauuuuuuuuacau

SEQ ID NO: 1489894 - RNA, 18 nt, Human
uuaaauuuuuuuuacauu

SEQ ID NO: 1489895 - RNA, 19 nt, Human
uuaaauuuuuuuuacauuu

SEQ ID NO: 1489896 - RNA, 20 nt, Human
uuaaauuuuuuuuacauuuu

SEQ ID NO: 1489897 - RNA, 16 nt, Human
uuaaaauuacaacuaa

SEQ ID NO: 1489898 - RNA, 20 nt, Human
auaaaauuuuuaaucuuuaa

SEQ ID NO: 1489899 - RNA, 13 nt, Human
uuaauaaacacuc

SEQ ID NO: 1489900 - RNA, 17 nt, Human
uuaauaaacacucuuga

SEQ ID NO: 1489901 - RNA, 17 nt, Human
uuaauuccuucagcacu

SEQ ID NO: 1489902 - RNA, 19 nt, Human
uuaauuccuucagcacuuu

SEQ ID NO: 1489903 - RNA, 20 nt, Human
uuaauuccuucagcacuuua

SEQ ID NO: 1489904 - RNA, 22 nt, Human
uuaagaagacugcauuauauuu

SEQ ID NO: 1489905 - RNA, 18 nt, Human
uuaaguaaggaauuuuau

SEQ ID NO: 1489906 - RNA, 18 nt, Human
uuaaguaaugauaacugg

SEQ ID NO: 1489907 - RNA, 19 nt, Human
auaaaauccauacauuugu

SEQ ID NO: 1489908 - RNA, 18 nt, Human
auaaaauccauacauuug

SEQ ID NO: 1489909 - RNA, 22 nt, Human
auaaaauaauuuuuauauuuga

SEQ ID NO: 1489910 - RNA, 21 nt, Human
auaaaauaauuuuuauauuug

SEQ ID NO: 1489911 - RNA, 16 nt, Human
auaaaauaauuuuuau

SEQ ID NO: 1489912 - RNA, 20 nt, Human
auaaaaggucggaccagcuu

SEQ ID NO: 1489913 - RNA, 18 nt, Human
auaaacacucuugaaaaa

SEQ ID NO: 1489914 - RNA, 15 nt, Human
uuacuguaagaaaau

SEQ ID NO: 1489915 - RNA, 18 nt, Human
auagucaaauugugugaa

SEQ ID NO: 1489916 - RNA, 19 nt, Human
auauauaacaaugcuguau

SEQ ID NO: 1489917 - RNA, 18 nt, Human
auauauaacaaugcugua

SEQ ID NO: 1489918 - RNA, 17 nt, Human
auauauaacaaugcugu

SEQ ID NO: 1489919 - RNA, 15 nt, Human
auauaacaaugcugu

SEQ ID NO: 1489920 - RNA, 12 nt, Human
auauaacaaugc

SEQ ID NO: 1489921 - RNA, 19 nt, Human
auauaagcuuguauuccuu

SEQ ID NO: 1489922 - RNA, 17 nt, Human
auauaacaaugcuguau

SEQ ID NO: 1489923 - RNA, 13 nt, Human
auaugugaacagu

SEQ ID NO: 1489924 - RNA, 12 nt, Human
auaugauucaaa

SEQ ID NO: 1489925 - RNA, 22 nt, Human
auaugauucaaaugucuauaaa

SEQ ID NO: 1489926 - RNA, 13 nt, Human
auaugauucaaau

SEQ ID NO: 1489927 - RNA, 22 nt, Human
auaucuauauuuuacauaaauu

SEQ ID NO: 1489928 - RNA, 20 nt, Human
auaucuauauuuuacauaaa

SEQ ID NO: 1489929 - RNA, 16 nt, Human
auaucuauauuuuaca

SEQ ID NO: 1489930 - RNA, 17 nt, Human
auaucuauauuuuacau

SEQ ID NO: 1489931 - RNA, 18 nt, Human
auauauucagccuggcuu

SEQ ID NO: 1489932 - RNA, 12 nt, Human
uuauuucaauau

SEQ ID NO: 1489933 - RNA, 18 nt, Human
auagcuacuaauuuuaaa

SEQ ID NO: 1489934 - RNA, 14 nt, Human
auagcuacuaauuu

SEQ ID NO: 1489935 - RNA, 17 nt, Human
auagcuacuaauuuuaa

SEQ ID NO: 1489936 - RNA, 13 nt, Human
auagcuaaguaca

SEQ ID NO: 1489937 - RNA, 14 nt, Human
auagcuaaguacac

SEQ ID NO: 1489938 - RNA, 15 nt, Human
auagcuaaguacaca

SEQ ID NO: 1489939 - RNA, 18 nt, Human
auagcuaaguacacaaua

SEQ ID NO: 1489940 - RNA, 13 nt, Human
uucaauaaagcug

SEQ ID NO: 1489941 - RNA, 12 nt, Human
uucaauaaagcu

SEQ ID NO: 1489942 - RNA, 13 nt, Human
uucacauuggaaa

SEQ ID NO: 1489943 - RNA, 19 nt, Human
uucacauuguauucagagu

SEQ ID NO: 1489944 - RNA, 14 nt, Human
uucacauuggaaac

SEQ ID NO: 1489945 - RNA, 17 nt, Human
auaggcacaggaaacca

SEQ ID NO: 1489946 - RNA, 21 nt, Human
auagggcaauuaauuccuuca

SEQ ID NO: 1489947 - RNA, 22 nt, Human
auagggcaauuaauuccuucag

SEQ ID NO: 1489948 - RNA, 23 nt, Human
auagggcaauuaauuccuucagc

SEQ ID NO: 1489949 - RNA, 18 nt, Human
uucaagugcuucuccagc

SEQ ID NO: 1489950 - RNA, 15 nt, Human
uucaaacauauauaa

SEQ ID NO: 1489951 - RNA, 16 nt, Human
uucaaaauuguuacaa

SEQ ID NO: 1489952 - RNA, 21 nt, Human
uucugaaauuuccugggagcu

SEQ ID NO: 1489953 - RNA, 13 nt, Human
uucugaagaagau

SEQ ID NO: 1489954 - RNA, 12 nt, Human
uucugaagaaga

SEQ ID NO: 1489955 - RNA, 14 nt, Human
uucugaagaagaug

SEQ ID NO: 1489956 - RNA, 21 nt, Human
uucugguaugaacuugaggac

SEQ ID NO: 1489957 - RNA, 22 nt, Human
uucugguaugaacuugaggaca

SEQ ID NO: 1489958 - RNA, 20 nt, Human
uucucacagcuccaagaauu

SEQ ID NO: 1489959 - RNA, 18 nt, Human
uucucaacuccaaacuga

SEQ ID NO: 1489960 - RNA, 14 nt, Human
uucucaacuccaaa

SEQ ID NO: 1489961 - RNA, 14 nt, Human
aucauucauuuucu

SEQ ID NO: 1489962 - RNA, 14 nt, Human
auauuuuaagacga

SEQ ID NO: 1489963 - RNA, 18 nt, Human
uuccucugucuccuaagc

SEQ ID NO: 1489964 - RNA, 15 nt, Human
uuccugggagcuuuu

SEQ ID NO: 1489965 - RNA, 16 nt, Human
uuccugggagcuuuug

SEQ ID NO: 1489966 - RNA, 15 nt, Human
uuccuucagcacuuu

SEQ ID NO: 1489967 - RNA, 19 nt, Human
uuccuucagcacuuuagaa

SEQ ID NO: 1489968 - RNA, 16 nt, Human
uuccuucagcacuuua

SEQ ID NO: 1489969 - RNA, 21 nt, Human
auauuuucaugcuguucauga

SEQ ID NO: 1489970 - RNA, 18 nt, Human
auauuuucaugcuguuca

SEQ ID NO: 1489971 - RNA, 15 nt, Human
auauugauccagaaa

SEQ ID NO: 1489972 - RNA, 22 nt, Human
auauugauccagaaagaaaacu

SEQ ID NO: 1489973 - RNA, 23 nt, Human
auauucucacagcuccaagaauu

SEQ ID NO: 1489974 - RNA, 22 nt, Human
auauucucacagcuccaagaau

SEQ ID NO: 1489975 - RNA, 13 nt, Human
auauuugaaauau

SEQ ID NO: 1489976 - RNA, 23 nt, Human
auauuugaaauauugacuuuuua

SEQ ID NO: 1489977 - RNA, 19 nt, Human
auauuugaaauauugacuu

SEQ ID NO: 1489978 - RNA, 14 nt, Human
auauuugaaauauu

SEQ ID NO: 1489979 - RNA, 12 nt, Human
uugacuuuuuau

SEQ ID NO: 1489980 - RNA, 11 nt, Human
uugagaaaaau

SEQ ID NO: 1489981 - RNA, 19 nt, Human
uugagaaaaauauauacua

SEQ ID NO: 1489982 - RNA, 13 nt, Human
uugacaugggaca

SEQ ID NO: 1489983 - RNA, 16 nt, Human
aucucuuguuuaaauu

SEQ ID NO: 1489984 - RNA, 22 nt, Human
uugcaagccagauuuuccugaa

SEQ ID NO: 1489985 - RNA, 18 nt, Human
uugcaacuuuguauaaaa

SEQ ID NO: 1489986 - RNA, 16 nt, Human
uugcaacuuuguauaa

SEQ ID NO: 1489987 - RNA, 17 nt, Human
uugcaacuuuguauaaa

SEQ ID NO: 1489988 - RNA, 14 nt, Human
uugcucuugaugcc

SEQ ID NO: 1489989 - RNA, 17 nt, Human
uugcucuugaugccugg

SEQ ID NO: 1489990 - RNA, 18 nt, Human
uugcucuugaugccuggc

SEQ ID NO: 1489991 - RNA, 20 nt, Human
uugcuuuguauuguauauua

SEQ ID NO: 1489992 - RNA, 16 nt, Human
uugcuuuuaaaaucca

SEQ ID NO: 1489993 - RNA, 15 nt, Human
uuggagaagaacuga

SEQ ID NO: 1489994 - RNA, 22 nt, Human
uuggagaagaacugaaaucaua

SEQ ID NO: 1489995 - RNA, 17 nt, Human
uuggagaagaacugaaa

SEQ ID NO: 1489996 - RNA, 16 nt, Human
aucuuauaauuuaaaa

SEQ ID NO: 1489997 - RNA, 15 nt, Human
aucuuauaauuuaaa

SEQ ID NO: 1489998 - RNA, 15 nt, Human
augaagcaaugcuuc

SEQ ID NO: 1489999 - RNA, 14 nt, Human
augaagcaaugcuu

SEQ ID NO: 1490000 - RNA, 13 nt, Human
augaaauauuaug

SEQ ID NO: 1490001 - RNA, 13 nt, Human
uuggccaugcaga

SEQ ID NO: 1490002 - RNA, 19 nt, Human
uuggccaugcagaaagcau

SEQ ID NO: 1490003 - RNA, 20 nt, Human
uugguuuucacauuggaaac

SEQ ID NO: 1490004 - RNA, 22 nt, Human
uuguaagcaugcacaaauucug

SEQ ID NO: 1490005 - RNA, 12 nt, Human
uuguaaugaaaa

SEQ ID NO: 1490006 - RNA, 21 nt, Human
augcuucuguuuuauaauuuu

SEQ ID NO: 1490007 - RNA, 22 nt, Human
augcuguauuuuaaaagaauga

SEQ ID NO: 1490008 - RNA, 23 nt, Human
augcuguauuuuaaaagaaugau

SEQ ID NO: 1490009 - RNA, 19 nt, Human
uuucaugcuguucaugaaa

SEQ ID NO: 1490010 - RNA, 21 nt, Human
uuucaugcuguucaugaaaga

SEQ ID NO: 1490011 - RNA, 19 nt, Human
uuucaaacauauauaacaa

SEQ ID NO: 1490012 - RNA, 19 nt, Human
uuucacauuggaaacaagu

SEQ ID NO: 1490013 - RNA, 14 nt, Human
uuucacauuggaaa

SEQ ID NO: 1490014 - RNA, 13 nt, Human
uuucacauuggaa

SEQ ID NO: 1490015 - RNA, 17 nt, Human
uuuagggguagcauuug

SEQ ID NO: 1490016 - RNA, 21 nt, Human
uuuauaugcuucuguuuuaua

SEQ ID NO: 1490017 - RNA, 21 nt, Human
uuuauauguaccguaggcuuu

SEQ ID NO: 1490018 - RNA, 19 nt, Human
augcgagugcucauuucag

SEQ ID NO: 1490019 - RNA, 18 nt, Human
augcuacaggauuugaaa

SEQ ID NO: 1490020 - RNA, 22 nt, Human
augccuuuucccaacuccagaa

SEQ ID NO: 1490021 - RNA, 20 nt, Human
augccuuuucccaacuccag

SEQ ID NO: 1490022 - RNA, 20 nt, Human
augccccugaauuuaaauag

SEQ ID NO: 1490023 - RNA, 15 nt, Human
augccccugaauuua

SEQ ID NO: 1490024 - RNA, 16 nt, Human
augcagaaagcauccc

SEQ ID NO: 1490025 - RNA, 15 nt, Human
augcagaaagcaucc

SEQ ID NO: 1490026 - RNA, 18 nt, Human
uuuaaaaaaauuccaagu

SEQ ID NO: 1490027 - RNA, 14 nt, Human
uuuaagagacagcc

SEQ ID NO: 1490028 - RNA, 12 nt, Human
uuuaaauguaua

SEQ ID NO: 1490029 - RNA, 13 nt, Human
uuuaaauguauac

SEQ ID NO: 1490030 - RNA, 21 nt, Human
uuuaaauauaugcuaagucuu

SEQ ID NO: 1490031 - RNA, 20 nt, Human
uuuaaaaaagaaacauuugg

SEQ ID NO: 1490032 - RNA, 18 nt, Human
uuguagcauccuggaaua

SEQ ID NO: 1490033 - RNA, 16 nt, Human
uuguagcauccuggaa

SEQ ID NO: 1490034 - RNA, 20 nt, Human
uugucaauaaaauccauaca

SEQ ID NO: 1490035 - RNA, 20 nt, Human
uuuuugggcagcaauuuaaa

SEQ ID NO: 1490036 - RNA, 21 nt, Human
uuuuugggcagcaauuuaaau

SEQ ID NO: 1490037 - RNA, 23 nt, Human
uuuuugggcagcaauuuaaaugu

SEQ ID NO: 1490038 - RNA, 11 nt, Human
uuuuuguagua

SEQ ID NO: 1490039 - RNA, 17 nt, Human
uuuuuauauuugaaaua

SEQ ID NO: 1490040 - RNA, 13 nt, Human
uuuuucaaaagaa

SEQ ID NO: 1490041 - RNA, 16 nt, Human
uuuuugagacagaguc

SEQ ID NO: 1490042 - RNA, 14 nt, Human
uuuugugaagcaaa

SEQ ID NO: 1490043 - RNA, 11 nt, Human
uuuuuacauuu

SEQ ID NO: 1490044 - RNA, 16 nt, Human
auuacuguaagaaaau

SEQ ID NO: 1490045 - RNA, 15 nt, Human
auuacuguaagaaaa

SEQ ID NO: 1490046 - RNA, 17 nt, Human
auuccaagugauugaaa

SEQ ID NO: 1490047 - RNA, 14 nt, Human
auucagccuggcuu

SEQ ID NO: 1490048 - RNA, 20 nt, Human
auuauauggcuugaguuuaa

SEQ ID NO: 1490049 - RNA, 16 nt, Human
auucaaaaauuaucua

SEQ ID NO: 1490050 - RNA, 23 nt, Human
auucaaaaauuaucuauagcuaa

SEQ ID NO: 1490051 - RNA, 15 nt, Human
auucagccuggcuuc

SEQ ID NO: 1490052 - RNA, 18 nt, Human
uuugacaaagguaaauca

SEQ ID NO: 1490053 - RNA, 20 nt, Human
uuugagacagagucuuccuc

SEQ ID NO: 1490054 - RNA, 19 nt, Human
uuugcuaagcauuccaacu

SEQ ID NO: 1490055 - RNA, 21 nt, Human
uuugggcagcaauuuaaaugu

SEQ ID NO: 1490056 - RNA, 19 nt, Human
auguauacuauaguaccag

SEQ ID NO: 1490057 - RNA, 23 nt, Human
augucgucaaagcugaaauggac

SEQ ID NO: 1490058 - RNA, 17 nt, Human
uuuguaguagcguuuuu

SEQ ID NO: 1490059 - RNA, 17 nt, Human
uuuguaguguuggagaa

SEQ ID NO: 1490060 - RNA, 19 nt, Human
uuuguaguagcguuuuuua

SEQ ID NO: 1490061 - RNA, 15 nt, Human
uuuguaguagcguuu

SEQ ID NO: 1490062 - RNA, 21 nt, Human
uuuucuuaaccagaucauugu

SEQ ID NO: 1490063 - RNA, 15 nt, Human
auguuuuuuuuuaaa

SEQ ID NO: 1490064 - RNA, 19 nt, Human
uuuuaguugcaacuuugua

SEQ ID NO: 1490065 - RNA, 20 nt, Human
uuuucaggcuagauguaugu

SEQ ID NO: 1490066 - RNA, 17 nt, Human
uuuucucugauacagaa

SEQ ID NO: 1490067 - RNA, 16 nt, Human
uuuucuauaauuuaaa

SEQ ID NO: 1490068 - RNA, 20 nt, Human
auguucuuuuaaaugauuga

SEQ ID NO: 1490069 - RNA, 18 nt, Human
auguuaugacuauguaaa

SEQ ID NO: 1490070 - RNA, 24 nt, Human
auguuaugacuauguaaacuacuu

SEQ ID NO: 1490071 - RNA, 21 nt, Human
augugcuaguaauuggaaagg

SEQ ID NO: 1490072 - RNA, 15 nt, Human
auguguguuuuaaaa

SEQ ID NO: 1490073 - RNA, 19 nt, Human
auuggagcucgugggacag

SEQ ID NO: 1490074 - RNA, 17 nt, Human
auuggagcucgugggac

SEQ ID NO: 1490075 - RNA, 16 nt, Human
auuggagcucguggaa

SEQ ID NO: 1490076 - RNA, 14 nt, Human
auuggaaacaaguc

SEQ ID NO: 1490077 - RNA, 19 nt, Human
auuugauaugugaacaguu

SEQ ID NO: 1490078 - RNA, 18 nt, Human
auuugauaugugaacagu

SEQ ID NO: 1490079 - RNA, 14 nt, Human
auuugguuuucaca

SEQ ID NO: 1490080 - RNA, 12 nt, Human
auuugguuuuca

SEQ ID NO: 1490081 - RNA, 14 nt, Human
auuuccuaaauaua

SEQ ID NO: 1490082 - RNA, 21 nt, Human
auuuccuaaauauauuuuaag

SEQ ID NO: 1490083 - RNA, 21 nt, Human
auuuauuuuaauaauguuuca

SEQ ID NO: 1490084 - RNA, 20 nt, Human
auuuauuacuguaagaaaau

SEQ ID NO: 1490085 - RNA, 19 nt, Human
auuuauuacuguaagaaaa

SEQ ID NO: 1490086 - RNA, 16 nt, Human
auuuaguguucauaaa

SEQ ID NO: 1490087 - RNA, 16 nt, Human
auuuaguuguaaacca

SEQ ID NO: 1490088 - RNA, 17 nt, Human
auuuaguguucauaaau

SEQ ID NO: 1490089 - RNA, 15 nt, Human
auuuauaaacuuuuu

SEQ ID NO: 1490090 - RNA, 19 nt, Human
auuguuuuacaauaguucu

SEQ ID NO: 1490091 - RNA, 20 nt, Human
auuguagcauccuggaauau

SEQ ID NO: 1490092 - RNA, 17 nt, Human
auuguagcauccuggaa

SEQ ID NO: 1490093 - RNA, 16 nt, Human
auuguaguccuguaau

SEQ ID NO: 1490094 - RNA, 16 nt, Human
auuuaaauagcuuuuu

SEQ ID NO: 1490095 - RNA, 22 nt, Human
auuuaccacuuguguuuugcaa

SEQ ID NO: 1490096 - RNA, 15 nt, Human
auuuaccacuugugu

SEQ ID NO: 1490097 - RNA, 18 nt, Human
auaagcuuaugcuuaaau

SEQ ID NO: 1490098 - RNA, 17 nt, Human
agugcucauuucaggau

SEQ ID NO: 1490099 - RNA, 20 nt, Human
aguggcaucaucucagcuca

SEQ ID NO: 1490100 - RNA, 19 nt, Human
aguggcaucaucucagcuc

SEQ ID NO: 1490101 - RNA, 11 nt, Human
aguguuucuuu

SEQ ID NO: 1490102 - RNA, 15 nt, Human
aguuaacuauugcau

SEQ ID NO: 1490103 - RNA, 17 nt, Human
aguuaacuauugcauuu

SEQ ID NO: 1490104 - RNA, 19 nt, Human
aguuaacuauugcauuuau

SEQ ID NO: 1490105 - RNA, 24 nt, Human
aguuaacuauugcauuuauaugua

SEQ ID NO: 1490106 - RNA, 20 nt, Human
aguuaacuauugcauuuaua

SEQ ID NO: 1490107 - RNA, 16 nt, Human
auaaaagacagugaaa

SEQ ID NO: 1490108 - RNA, 15 nt, Human
auaaaagacagugaa

SEQ ID NO: 1490109 - RNA, 13 nt, Human
auaaaaagaauga

SEQ ID NO: 1490110 - RNA, 17 nt, Human
aguaacuacaguuaggg

SEQ ID NO: 1490111 - RNA, 19 nt, Human
aguaacuacaguuagggcu

SEQ ID NO: 1490112 - RNA, 22 nt, Human
aguauauugauccagaaagaaa

SEQ ID NO: 1490113 - RNA, 16 nt, Human
augcauggaaauuccc

SEQ ID NO: 1490114 - RNA, 24 nt, Human
augcauauuauuuuauguugcaua

SEQ ID NO: 1490115 - RNA, 23 nt, Human
auggcuuccuggcaauagucaaa

SEQ ID NO: 1490116 - RNA, 20 nt, Human
augggacauuugcucaugga

SEQ ID NO: 1490117 - RNA, 11 nt, Human
aucuaggauuu

SEQ ID NO: 1490118 - RNA, 19 nt, Human
aucuaggauuuuaagggaa

SEQ ID NO: 1490119 - RNA, 12 nt, Human
augaggccagac

SEQ ID NO: 1490120 - RNA, 13 nt, Human
augaggccagacc

SEQ ID NO: 1490121 - RNA, 14 nt, Human
augaggccagacca

SEQ ID NO: 1490122 - RNA, 17 nt, Human
augaggccagaccaugg

SEQ ID NO: 1490123 - RNA, 21 nt, Human
augaauacauuuccaaaaugg

SEQ ID NO: 1490124 - RNA, 14 nt, Human
augaauacauuucc

SEQ ID NO: 1490125 - RNA, 20 nt, Human
augaagccuccuuagaaaaa

SEQ ID NO: 1490126 - RNA, 16 nt, Human
augaaacuuuuggaag

SEQ ID NO: 1490127 - RNA, 18 nt, Human
auauuuuuuucugaaauu

SEQ ID NO: 1490128 - RNA, 16 nt, Human
auauuuuuuucugaaa

SEQ ID NO: 1490129 - RNA, 14 nt, Human
auauuuuuuucuga

SEQ ID NO: 1490130 - RNA, 19 nt, Human
auauuuuuuucugaaauuu

SEQ ID NO: 1490131 - RNA, 23 nt, Human
auccacuuuaucuugaauaaugu

SEQ ID NO: 1490132 - RNA, 23 nt, Human
auccagccuaacuuacauucuua

SEQ ID NO: 1490133 - RNA, 19 nt, Human
auccagccuggggcugagg

SEQ ID NO: 1490134 - RNA, 21 nt, Human
auccagccuggggcugaggcu

SEQ ID NO: 1490135 - RNA, 14 nt, Human
auccaggccggcuu

SEQ ID NO: 1490136 - RNA, 23 nt, Human
auccaggccggcuugccacaccc

SEQ ID NO: 1490137 - RNA, 12 nt, Human
auccuugaagau

SEQ ID NO: 1490138 - RNA, 17 nt, Human
auccagggggcaagagg

SEQ ID NO: 1490139 - RNA, 12 nt, Human
aucccccagaaa

SEQ ID NO: 1490140 - RNA, 17 nt, Human
aucccccagaaaagaaa

SEQ ID NO: 1490141 - RNA, 13 nt, Human
agaacaucccucc

SEQ ID NO: 1490142 - RNA, 17 nt, Human
agaacaucccuccuggg

SEQ ID NO: 1490143 - RNA, 21 nt, Human
agaagacugcauuauauuuau

SEQ ID NO: 1490144 - RNA, 19 nt, Human
agacaaggaaaaaauaaca

SEQ ID NO: 1490145 - RNA, 23 nt, Human
agacaauugagguaaguuuuuug

SEQ ID NO: 1490146 - RNA, 12 nt, Human
agaccaccucuc

SEQ ID NO: 1490147 - RNA, 17 nt, Human
agaccaccucucaauau

SEQ ID NO: 1490148 - RNA, 12 nt, Human
agaccauggaca

SEQ ID NO: 1490149 - RNA, 21 nt, Human
agaccauggacacuacaccca

SEQ ID NO: 1490150 - RNA, 22 nt, Human
agaccauggacacuacacccag

SEQ ID NO: 1490151 - RNA, 23 nt, Human
agaccauggacacuacacccagc

SEQ ID NO: 1490152 - RNA, 18 nt, Human
agacgaaacauuuguucu

SEQ ID NO: 1490153 - RNA, 13 nt, Human
agcaauuuaaaug

SEQ ID NO: 1490154 - RNA, 16 nt, Human
agcaauuuaaauguua

SEQ ID NO: 1490155 - RNA, 17 nt, Human
agcaauuuaaauguuau

SEQ ID NO: 1490156 - RNA, 19 nt, Human
agcaauuuaaauguuauga

SEQ ID NO: 1490157 - RNA, 17 nt, Human
agccaacuauggccugu

SEQ ID NO: 1490158 - RNA, 12 nt, Human
agcaacaauaaa

SEQ ID NO: 1490159 - RNA, 13 nt, Human
agcaacaauaaau

SEQ ID NO: 1490160 - RNA, 18 nt, Human
agcaacaauaaauagaca

SEQ ID NO: 1490161 - RNA, 23 nt, Human
agcaaaauuuuuucucuaggaaa

SEQ ID NO: 1490162 - RNA, 17 nt, Human
agauugagauguguuca

SEQ ID NO: 1490163 - RNA, 20 nt, Human
agauagauaggucagugcaa

SEQ ID NO: 1490164 - RNA, 16 nt, Human
agauaugauucaaaug

SEQ ID NO: 1490165 - RNA, 15 nt, Human
agauaugauucaaau

SEQ ID NO: 1490166 - RNA, 14 nt, Human
agauaugauucaaa

SEQ ID NO: 1490167 - RNA, 17 nt, Human
agccugcugccugcuuu

SEQ ID NO: 1490168 - RNA, 13 nt, Human
agcuacaaaugca

SEQ ID NO: 1490169 - RNA, 24 nt, Human
agcgauucuccugccucagccucc

SEQ ID NO: 1490170 - RNA, 23 nt, Human
agcuuuuuucucugauacagaaa

SEQ ID NO: 1490171 - RNA, 22 nt, Human
agcuuuuuucucugauacagaa

SEQ ID NO: 1490172 - RNA, 20 nt, Human
agcuuuuuucucugauacag

SEQ ID NO: 1490173 - RNA, 19 nt, Human
agcuuuuuucucugauaca

SEQ ID NO: 1490174 - RNA, 18 nt, Human
aggaaaaaauaacaauga

SEQ ID NO: 1490175 - RNA, 18 nt, Human
agcuguaugauucccagc

SEQ ID NO: 1490176 - RNA, 17 nt, Human
agcuguaugauucccag

SEQ ID NO: 1490177 - RNA, 22 nt, Human
aggcucuggagcccacuguacu

SEQ ID NO: 1490178 - RNA, 17 nt, Human
agggacugagaaauuua

SEQ ID NO: 1490179 - RNA, 15 nt, Human
agggacugagaaauu

SEQ ID NO: 1490180 - RNA, 13 nt, Human
agggacugagaaa

SEQ ID NO: 1490181 - RNA, 14 nt, Human
agggacugagaaau

SEQ ID NO: 1490182 - RNA, 22 nt, Human
aggcagaacucaucuagguaaa

SEQ ID NO: 1490183 - RNA, 23 nt, Human
aggcaugugucaccaugcccagc

SEQ ID NO: 1490184 - RNA, 18 nt, Human
aggaguuucguuuucaaa

SEQ ID NO: 1490185 - RNA, 21 nt, Human
acacgcacggcagccacagcu

SEQ ID NO: 1490186 - RNA, 11 nt, Human
aauuguaauag

SEQ ID NO: 1490187 - RNA, 15 nt, Human
aauuuccugggagcu

SEQ ID NO: 1490188 - RNA, 12 nt, Human
aauuuccuggga

SEQ ID NO: 1490189 - RNA, 17 nt, Human
aauuuccugggagcuuu

SEQ ID NO: 1490190 - RNA, 23 nt, Human
aauucuaccaaggucuucuuaau

SEQ ID NO: 1490191 - RNA, 18 nt, Human
aauuaugaaacuuuugga

SEQ ID NO: 1490192 - RNA, 23 nt, Human
aauuaucuauagcuaaguacaca

SEQ ID NO: 1490193 - RNA, 15 nt, Human
aauuaugaaacuuuu

SEQ ID NO: 1490194 - RNA, 13 nt, Human
aauuaugaaacuu

SEQ ID NO: 1490195 - RNA, 12 nt, Human
aauuaugaaacu

SEQ ID NO: 1490196 - RNA, 15 nt, Human
aauuaucuauagcua

SEQ ID NO: 1490197 - RNA, 22 nt, Human
aauuaucuauagcuaaguacac

SEQ ID NO: 1490198 - RNA, 20 nt, Human
acauaaguauuuaauucaug

SEQ ID NO: 1490199 - RNA, 20 nt, Human
acaucccuuaccugggaaag

SEQ ID NO: 1490200 - RNA, 21 nt, Human
acauuuguauaaaauaauuuu

SEQ ID NO: 1490201 - RNA, 19 nt, Human
acauuuguauaaaauaauu

SEQ ID NO: 1490202 - RNA, 16 nt, Human
acauuuguauaaaaua

SEQ ID NO: 1490203 - RNA, 16 nt, Human
acauuugcucauggaa

SEQ ID NO: 1490204 - RNA, 15 nt, Human
acauuugcucaugga

SEQ ID NO: 1490205 - RNA, 24 nt, Human
acaggaugguucccuugaugaaga

SEQ ID NO: 1490206 - RNA, 23 nt, Human
acagugaucaaguuauuuuuaau

SEQ ID NO: 1490207 - RNA, 22 nt, Human
acugucuuuuuucuaaaguaaa

SEQ ID NO: 1490208 - RNA, 23 nt, Human
acugucuuuuuucuaaaguaaaa

SEQ ID NO: 1490209 - RNA, 16 nt, Human
acugucuuuuuucuaa

SEQ ID NO: 1490210 - RNA, 15 nt, Human
acugccuauuuuaau

SEQ ID NO: 1490211 - RNA, 17 nt, Human
acuguaaaauaauaacu

SEQ ID NO: 1490212 - RNA, 19 nt, Human
acuucaaauccuugaagau

SEQ ID NO: 1490213 - RNA, 18 nt, Human
acuucaaauccuugaaga

SEQ ID NO: 1490214 - RNA, 17 nt, Human
acuucaaauccuugaag

SEQ ID NO: 1490215 - RNA, 21 nt, Human
acuucuuuuuucaaaagaaag

SEQ ID NO: 1490216 - RNA, 22 nt, Human
acuucuuuuuucaaaagaaagu

SEQ ID NO: 1490217 - RNA, 23 nt, Human
acuucuuuuuucaaaagaaaguc

SEQ ID NO: 1490218 - RNA, 12 nt, Human
acuugaaaauua

SEQ ID NO: 1490219 - RNA, 14 nt, Human
acuugaaaauuaac

SEQ ID NO: 1490220 - RNA, 16 nt, Human
acuugaaaauuaacau

SEQ ID NO: 1490221 - RNA, 17 nt, Human
acuucagcgguuuauau

SEQ ID NO: 1490222 - RNA, 20 nt, Human
acuccgugcuuaaccaaaga

SEQ ID NO: 1490223 - RNA, 19 nt, Human
acucguuaauuuguagugu

SEQ ID NO: 1490224 - RNA, 14 nt, Human
acucguuaauuugu

SEQ ID NO: 1490225 - RNA, 19 nt, Human
acugauaugggucuugaua

SEQ ID NO: 1490226 - RNA, 14 nt, Human
acugauuacugccu

SEQ ID NO: 1490227 - RNA, 20 nt, Human
acugaauuaugaaacuuuug

SEQ ID NO: 1490228 - RNA, 15 nt, Human
acugaauuaugaaac

SEQ ID NO: 1490229 - RNA, 14 nt, Human
acugaauuaugaaa

SEQ ID NO: 1490230 - RNA, 13 nt, Human
acugaauuaugaa

SEQ ID NO: 1490231 - RNA, 20 nt, Human
accuguggaacauaaaaagg

SEQ ID NO: 1490232 - RNA, 23 nt, Human
accuguggaacauaaaaaggaca

SEQ ID NO: 1490233 - RNA, 20 nt, Human
acuaauguguaagacaaaaa

SEQ ID NO: 1490234 - RNA, 18 nt, Human
acgugcucugugggucuc

SEQ ID NO: 1490235 - RNA, 14 nt, Human
acgucuuaaauauu

SEQ ID NO: 1490236 - RNA, 13 nt, Human
acgucuuaaauau

SEQ ID NO: 1490237 - RNA, 15 nt, Human
acccucacacuggga

SEQ ID NO: 1490238 - RNA, 16 nt, Human
acccuaaauaauaaaa

SEQ ID NO: 1490239 - RNA, 20 nt, Human
acccuaaauaauaaaaauaa

SEQ ID NO: 1490240 - RNA, 13 nt, Human
acccuaaccaagu

SEQ ID NO: 1490241 - RNA, 14 nt, Human
acccuaaccaaguu

SEQ ID NO: 1490242 - RNA, 15 nt, Human
acccuaaccaaguuc

SEQ ID NO: 1490243 - RNA, 16 nt, Human
acccuaaccaaguucc

SEQ ID NO: 1490244 - RNA, 17 nt, Human
acccuaaccaaguuccu

SEQ ID NO: 1490245 - RNA, 13 nt, Human
acccuagcaaaag

SEQ ID NO: 1490246 - RNA, 13 nt, Human
acccucaugcugu

SEQ ID NO: 1490247 - RNA, 12 nt, Human
acccucaugcug

SEQ ID NO: 1490248 - RNA, 16 nt, Human
aauauauaucaaauau

SEQ ID NO: 1490249 - RNA, 20 nt, Human
aaugaauacuuuauaaagga

SEQ ID NO: 1490250 - RNA, 20 nt, Human
aaugaagauacugaaauaaa

SEQ ID NO: 1490251 - RNA, 14 nt, Human
aaugaagcaaugcu

SEQ ID NO: 1490252 - RNA, 16 nt, Human
aaucucaauauuucag

SEQ ID NO: 1490253 - RNA, 17 nt, Human
aaucucaauucuucccu

SEQ ID NO: 1490254 - RNA, 11 nt, Human
aauaaagcaau

SEQ ID NO: 1490255 - RNA, 12 nt, Human
aauaaagcaauu

SEQ ID NO: 1490256 - RNA, 19 nt, Human
aauaaacacucuugaaaaa

SEQ ID NO: 1490257 - RNA, 11 nt, Human
aauaaacacuc

SEQ ID NO: 1490258 - RNA, 16 nt, Human
aauaaacacucuugaa

SEQ ID NO: 1490259 - RNA, 22 nt, Human
aagacaagaacuccccuuuuuu

SEQ ID NO: 1490260 - RNA, 15 nt, Human
aagaagacugcauua

SEQ ID NO: 1490261 - RNA, 20 nt, Human
aagaagacugcauuauauuu

SEQ ID NO: 1490262 - RNA, 21 nt, Human
aagacaaggaaaaaauaacaa

SEQ ID NO: 1490263 - RNA, 15 nt, Human
aagaacugaaaucau

SEQ ID NO: 1490264 - RNA, 13 nt, Human
aagaacugaaauc

SEQ ID NO: 1490265 - RNA, 12 nt, Human
aagaacugaaau

SEQ ID NO: 1490266 - RNA, 11 nt, Human
aagaacugaaa

SEQ ID NO: 1490267 - RNA, 14 nt, Human
aagaacggaagaag

SEQ ID NO: 1490268 - RNA, 15 nt, Human
aagagaucaggaaga

SEQ ID NO: 1490269 - RNA, 16 nt, Human
aagagaucaggaagag

SEQ ID NO: 1490270 - RNA, 22 nt, Human
aagagaucaggaagagaaggag

SEQ ID NO: 1490271 - RNA, 19 nt, Human
aaggcagggaggaggcaga

SEQ ID NO: 1490272 - RNA, 14 nt, Human
aaggcagggaggag

SEQ ID NO: 1490273 - RNA, 13 nt, Human
aagcuacuuauug

SEQ ID NO: 1490274 - RNA, 16 nt, Human
aaaucucaauucuucc

SEQ ID NO: 1490275 - RNA, 18 nt, Human
aaaucucaauauuucaga

SEQ ID NO: 1490276 - RNA, 14 nt, Human
aaaugaaaaaauau

SEQ ID NO: 1490277 - RNA, 21 nt, Human
aaauauuuauuuuaauaaugu

SEQ ID NO: 1490278 - RNA, 22 nt, Human
aaauauuguuuuacaauaguuc

SEQ ID NO: 1490279 - RNA, 23 nt, Human
aaauguugacaugggacauuugc

SEQ ID NO: 1490280 - RNA, 22 nt, Human
aaauguugacaugggacauuug

SEQ ID NO: 1490281 - RNA, 18 nt, Human
aaccuuuguuugcaucug

SEQ ID NO: 1490282 - RNA, 12 nt, Human
aacaucuuuaag

SEQ ID NO: 1490283 - RNA, 18 nt, Human
aacaucuuuaaggggagg

SEQ ID NO: 1490284 - RNA, 22 nt, Human
aaaccgaacugauguaaguaaa

SEQ ID NO: 1490285 - RNA, 18 nt, Human
aaaaguugaauuuuacau

SEQ ID NO: 1490286 - RNA, 11 nt, Human
aaaagaaugau

SEQ ID NO: 1490287 - RNA, 20 nt, Human
aaaagacaaggaaaaaauaa

SEQ ID NO: 1490288 - RNA, 15 nt, Human
aaaagaaaauuuuug

SEQ ID NO: 1490289 - RNA, 20 nt, Human
caccauguuggccaggcuug

SEQ ID NO: 1490290 - RNA, 21 nt, Human
caccauauuggccagucuggu

SEQ ID NO: 1490291 - RNA, 20 nt, Human
cacaugaaguccaagcauuu

SEQ ID NO: 1490292 - RNA, 17 nt, Human
cacaugaaguccaagca

SEQ ID NO: 1490293 - RNA, 14 nt, Human
caauauucaauaaa

SEQ ID NO: 1490294 - RNA, 15 nt, Human
caauauucaauaaag

SEQ ID NO: 1490295 - RNA, 16 nt, Human
caauauucaauaaagc

SEQ ID NO: 1490296 - RNA, 17 nt, Human
caauauucaauaaagcu

SEQ ID NO: 1490297 - RNA, 22 nt, Human
cacaccuacuagucaccagaga

SEQ ID NO: 1490298 - RNA, 12 nt, Human
caaagaaauuau

SEQ ID NO: 1490299 - RNA, 13 nt, Human
caaagaaauuaug

SEQ ID NO: 1490300 - RNA, 15 nt, Human
caaagaaauuaugug

SEQ ID NO: 1490301 - RNA, 19 nt, Human
auuuuaauaauguuucaaa

SEQ ID NO: 1490302 - RNA, 18 nt, Human
auuuuaauaauguuucaa

SEQ ID NO: 1490303 - RNA, 17 nt, Human
caaauuguaagcaugca

SEQ ID NO: 1490304 - RNA, 15 nt, Human
caaccucauccucuc

SEQ ID NO: 1490305 - RNA, 20 nt, Human
caaccuccgcauccgggguu

SEQ ID NO: 1490306 - RNA, 19 nt, Human
caagcauuuagauguauag

SEQ ID NO: 1490307 - RNA, 16 nt, Human
caagcauuuagaugua

SEQ ID NO: 1490308 - RNA, 16 nt, Human
caagaccgaucggcgg

SEQ ID NO: 1490309 - RNA, 14 nt, Human
cauuugcucaugga

SEQ ID NO: 1490310 - RNA, 13 nt, Human
cauuugcucaugg

SEQ ID NO: 1490311 - RNA, 19 nt, Human
cauuuuagggguagcauuu

SEQ ID NO: 1490312 - RNA, 23 nt, Human
cauuguauucagaguugaugguu

SEQ ID NO: 1490313 - RNA, 12 nt, Human
ccaacccuagca

SEQ ID NO: 1490314 - RNA, 22 nt, Human
ccaaacugacucuuaagaagac

SEQ ID NO: 1490315 - RNA, 21 nt, Human
ccaacaagauugcuuaauaaa

SEQ ID NO: 1490316 - RNA, 16 nt, Human
ccaaggucuucuuaau

SEQ ID NO: 1490317 - RNA, 20 nt, Human
ccaaguaacugggauuacag

SEQ ID NO: 1490318 - RNA, 20 nt, Human
ccaaguagcugagacuacag

SEQ ID NO: 1490319 - RNA, 17 nt, Human
ccaagcuauucaauucu

SEQ ID NO: 1490320 - RNA, 17 nt, Human
ccaagcauuuagaugua

SEQ ID NO: 1490321 - RNA, 14 nt, Human
ccaagcaaguauua

SEQ ID NO: 1490322 - RNA, 20 nt, Human
ccaagcaccugggauuacaa

SEQ ID NO: 1490323 - RNA, 14 nt, Human
ccacuucagccucc

SEQ ID NO: 1490324 - RNA, 22 nt, Human
ccaccugucugucugucugucc

SEQ ID NO: 1490325 - RNA, 11 nt, Human
ccaccugucug

SEQ ID NO: 1490326 - RNA, 12 nt, Human
ccaccugucugu

SEQ ID NO: 1490327 - RNA, 14 nt, Human
ccaccugucugucu

SEQ ID NO: 1490328 - RNA, 16 nt, Human
ccaccugucugucugu

SEQ ID NO: 1490329 - RNA, 17 nt, Human
ccacggggacucagccc

SEQ ID NO: 1490330 - RNA, 14 nt, Human
ccacgguguucugu

SEQ ID NO: 1490331 - RNA, 16 nt, Human
ccaccauggccagcua

SEQ ID NO: 1490332 - RNA, 20 nt, Human
ccacaggaaccacaagacug

SEQ ID NO: 1490333 - RNA, 19 nt, Human
ccaggcuuuuuuaucaugu

SEQ ID NO: 1490334 - RNA, 18 nt, Human
ccaguaucucuucagucu

SEQ ID NO: 1490335 - RNA, 20 nt, Human
ccaguaucucuucagucucu

SEQ ID NO: 1490336 - RNA, 20 nt, Human
ccaguaggggcuuauaauaa

SEQ ID NO: 1490337 - RNA, 15 nt, Human
ccaguaucucuucag

SEQ ID NO: 1490338 - RNA, 16 nt, Human
ccaguaucucuucagu

SEQ ID NO: 1490339 - RNA, 17 nt, Human
ccagcuggggccaggcu

SEQ ID NO: 1490340 - RNA, 18 nt, Human
ccagcuggggccaggcug

SEQ ID NO: 1490341 - RNA, 19 nt, Human
ccagcuggggccaggcugg

SEQ ID NO: 1490342 - RNA, 20 nt, Human
ccagcuggggccaggcuggg

SEQ ID NO: 1490343 - RNA, 21 nt, Human
ccagcuggggccaggcugggu

SEQ ID NO: 1490344 - RNA, 22 nt, Human
ccagcuggggccaggcuggguc

SEQ ID NO: 1490345 - RNA, 23 nt, Human
ccagcuggggccaggcugggucg

SEQ ID NO: 1490346 - RNA, 15 nt, Human
ccaggacaggaucca

SEQ ID NO: 1490347 - RNA, 17 nt, Human
ccaggacaggauccagg

SEQ ID NO: 1490348 - RNA, 19 nt, Human
ccaggacaggauccaggcc

SEQ ID NO: 1490349 - RNA, 13 nt, Human
ccaggacaggauc

SEQ ID NO: 1490350 - RNA, 12 nt, Human
ccauucuggaag

SEQ ID NO: 1490351 - RNA, 15 nt, Human
ccauucuggaaguga

SEQ ID NO: 1490352 - RNA, 16 nt, Human
ccaugauguuuagaaa

SEQ ID NO: 1490353 - RNA, 11 nt, Human
ccaugcagaaa

SEQ ID NO: 1490354 - RNA, 15 nt, Human
ccaugcagaaagcau

SEQ ID NO: 1490355 - RNA, 14 nt, Human
ccaugcagaaagca

SEQ ID NO: 1490356 - RNA, 18 nt, Human
ccaucaaggguacacugc

SEQ ID NO: 1490357 - RNA, 22 nt, Human
ccaucagaaacacccucacacu

SEQ ID NO: 1490358 - RNA, 23 nt, Human
ccaucagaaacacccucacacug

SEQ ID NO: 1490359 - RNA, 18 nt, Human
cccagguuggagugcagu

SEQ ID NO: 1490360 - RNA, 19 nt, Human
cccagguuggagugcagug

SEQ ID NO: 1490361 - RNA, 15 nt, Human
cccaguaucucuuca

SEQ ID NO: 1490362 - RNA, 16 nt, Human
cccaguaucucuucag

SEQ ID NO: 1490363 - RNA, 15 nt, Human
cccaauugagaaaaa

SEQ ID NO: 1490364 - RNA, 15 nt, Human
ccuacccuaaccaag

SEQ ID NO: 1490365 - RNA, 16 nt, Human
ccuacccuaaccaagu

SEQ ID NO: 1490366 - RNA, 18 nt, Human
ccuacccuaaccaaguuc

SEQ ID NO: 1490367 - RNA, 18 nt, Human
cccccaguaucucuucag

SEQ ID NO: 1490368 - RNA, 20 nt, Human
ccccuaaaagaaacccugca

SEQ ID NO: 1490369 - RNA, 16 nt, Human
cccuugaugaagaagu

SEQ ID NO: 1490370 - RNA, 16 nt, Human
cccuuuccugaguccc

SEQ ID NO: 1490371 - RNA, 23 nt, Human
ccucuuagaugcaguucugaaga

SEQ ID NO: 1490372 - RNA, 22 nt, Human
ccugaagcuaucguaaaauuaa

SEQ ID NO: 1490373 - RNA, 23 nt, Human
ccugaagcuaucguaaaauuaag

SEQ ID NO: 1490374 - RNA, 20 nt, Human
ccugaagcuaucguaaaauu

SEQ ID NO: 1490375 - RNA, 20 nt, Human
ccugaacaggauauucucac

SEQ ID NO: 1490376 - RNA, 20 nt, Human
ccucagaaaacaaggaugaa

SEQ ID NO: 1490377 - RNA, 22 nt, Human
ccucccuacccuaaccaaguuc

SEQ ID NO: 1490378 - RNA, 17 nt, Human
ccucccucaaccucauc

SEQ ID NO: 1490379 - RNA, 21 nt, Human
ccucccucaaccucauccucu

SEQ ID NO: 1490380 - RNA, 17 nt, Human
ccuccugggaaugaagc

SEQ ID NO: 1490381 - RNA, 16 nt, Human
ccucugcagucucuau

SEQ ID NO: 1490382 - RNA, 17 nt, Human
ccucugcagucucuaua

SEQ ID NO: 1490383 - RNA, 23 nt, Human
ccucugcagucucuauaccaaua

SEQ ID NO: 1490384 - RNA, 19 nt, Human
ccuguggaacauaaaaagg

SEQ ID NO: 1490385 - RNA, 23 nt, Human
ccuguggaacauaaaaaggacau

SEQ ID NO: 1490386 - RNA, 24 nt, Human
ccuguggaacauaaaaaggacauc

SEQ ID NO: 1490387 - RNA, 13 nt, Human
ccuucaucuggaa

SEQ ID NO: 1490388 - RNA, 20 nt, Human
ccuucaucuggauuccagag

SEQ ID NO: 1490389 - RNA, 14 nt, Human
ccuucaucuggaac

SEQ ID NO: 1490390 - RNA, 13 nt, Human
ccuuccacccagu

SEQ ID NO: 1490391 - RNA, 14 nt, Human
ccuugaugaagaag

SEQ ID NO: 1490392 - RNA, 22 nt, Human
ccugugagcuaggaauuguguu

SEQ ID NO: 1490393 - RNA, 20 nt, Human
ccugcuuuuuauggccugug

SEQ ID NO: 1490394 - RNA, 14 nt, Human
ccuggaaaccuucc

SEQ ID NO: 1490395 - RNA, 13 nt, Human
ccugggaggcucu

SEQ ID NO: 1490396 - RNA, 21 nt, Human
ccugggaggcucuggagccca

SEQ ID NO: 1490397 - RNA, 13 nt, Human
ccugggauuacag

SEQ ID NO: 1490398 - RNA, 12 nt, Human
ccuggcggggug

SEQ ID NO: 1490399 - RNA, 17 nt, Human
ccuggacugugugcuca

SEQ ID NO: 1490400 - RNA, 20 nt, Human
ccuggacugugugcucagga

SEQ ID NO: 1490401 - RNA, 17 nt, Human
ccuggaaaccuuccacc

SEQ ID NO: 1490402 - RNA, 18 nt, Human
ccuggaaaccuuccaccc

SEQ ID NO: 1490403 - RNA, 20 nt, Human
ccuggaaaccuuccacccag

SEQ ID NO: 1490404 - RNA, 15 nt, Human
cggaccccagccauc

SEQ ID NO: 1490405 - RNA, 21 nt, Human
cggaagaagagaucaggaaga

SEQ ID NO: 1490406 - RNA, 22 nt, Human
cggaagaagagaucaggaagag

SEQ ID NO: 1490407 - RNA, 13 nt, Human
cgcagaaggaagg

SEQ ID NO: 1490408 - RNA, 14 nt, Human
cgcgaucucagcuc

SEQ ID NO: 1490409 - RNA, 15 nt, Human
cgcgaucucagcuca

SEQ ID NO: 1490410 - RNA, 18 nt, Human
ccuuuggcaggugcagcc

SEQ ID NO: 1490411 - RNA, 19 nt, Human
ccuuuggcaggugcagccc

SEQ ID NO: 1490412 - RNA, 20 nt, Human
ccuuuggcaggugcagcccc

SEQ ID NO: 1490413 - RNA, 14 nt, Human
ccuuugacaaaggu

SEQ ID NO: 1490414 - RNA, 15 nt, Human
ccuuggccaugcaga

SEQ ID NO: 1490415 - RNA, 17 nt, Human
ccuuggccaugcagaaa

SEQ ID NO: 1490416 - RNA, 12 nt, Human
cgcagaaggaag

SEQ ID NO: 1490417 - RNA, 20 nt, Human
cgaucuugguucacugcaac

SEQ ID NO: 1490418 - RNA, 13 nt, Human
cgaucucagcuca

SEQ ID NO: 1490419 - RNA, 16 nt, Human
cguauaaaagccuguu

SEQ ID NO: 1490420 - RNA, 17 nt, Human
cguauaaaagccuguuu

SEQ ID NO: 1490421 - RNA, 21 nt, Human
cguauaaaagccuguuuaaga

SEQ ID NO: 1490422 - RNA, 22 nt, Human
cguauaaaagccuguuuaagag

SEQ ID NO: 1490423 - RNA, 20 nt, Human
cgucaacucauauuuucaug

SEQ ID NO: 1490424 - RNA, 16 nt, Human
cgucaacucauauuuu

SEQ ID NO: 1490425 - RNA, 17 nt, Human
cucuaaauucuuucauu

SEQ ID NO: 1490426 - RNA, 13 nt, Human
cucuaaauucuuu

SEQ ID NO: 1490427 - RNA, 13 nt, Human
cuccuuagaaaaa

SEQ ID NO: 1490428 - RNA, 12 nt, Human
cuccagccucag

SEQ ID NO: 1490429 - RNA, 15 nt, Human
cuccagccucagccu

SEQ ID NO: 1490430 - RNA, 17 nt, Human
cuccagccucagccucc

SEQ ID NO: 1490431 - RNA, 14 nt, Human
cuccagccucagcu

SEQ ID NO: 1490432 - RNA, 14 nt, Human
cuccacucuuucuu

SEQ ID NO: 1490433 - RNA, 15 nt, Human
cuccacagcugccuc

SEQ ID NO: 1490434 - RNA, 17 nt, Human
cguuuuuuaaauguaua

SEQ ID NO: 1490435 - RNA, 17 nt, Human
cucaucuccccaucauu

SEQ ID NO: 1490436 - RNA, 21 nt, Human
cucaucuagguaaauuacagu

SEQ ID NO: 1490437 - RNA, 14 nt, Human
cucauauuuucaug

SEQ ID NO: 1490438 - RNA, 20 nt, Human
cucugaggggcuaccaggaa

SEQ ID NO: 1490439 - RNA, 21 nt, Human
cucugaggggcuaccaggaaa

SEQ ID NO: 1490440 - RNA, 22 nt, Human
cucugcagucucuauaccaaua

SEQ ID NO: 1490441 - RNA, 23 nt, Human
cucugcaggucccuaauaaagcu

SEQ ID NO: 1490442 - RNA, 14 nt, Human
cucugcagucucua

SEQ ID NO: 1490443 - RNA, 14 nt, Human
cucuggaauuugaa

SEQ ID NO: 1490444 - RNA, 12 nt, Human
cucuggagccca

SEQ ID NO: 1490445 - RNA, 12 nt, Human
cucucugcaggu

SEQ ID NO: 1490446 - RNA, 13 nt, Human
cucucugcagguc

SEQ ID NO: 1490447 - RNA, 14 nt, Human
cucucugcaggucc

SEQ ID NO: 1490448 - RNA, 16 nt, Human
cucucugcaggucccu

SEQ ID NO: 1490449 - RNA, 17 nt, Human
cucucugcaggucccua

SEQ ID NO: 1490450 - RNA, 19 nt, Human
cucucugcaggucccuaau

SEQ ID NO: 1490451 - RNA, 22 nt, Human
cucucugcaggucccuaauaaa

SEQ ID NO: 1490452 - RNA, 13 nt, Human
cucucccaaaaaa

SEQ ID NO: 1490453 - RNA, 17 nt, Human
cucuccacagcugccuc

SEQ ID NO: 1490454 - RNA, 15 nt, Human
cucucaguugcagcc

SEQ ID NO: 1490455 - RNA, 19 nt, Human
cucucaguugcagcccugc

SEQ ID NO: 1490456 - RNA, 22 nt, Human
cucucaguugcagcccugcugc

SEQ ID NO: 1490457 - RNA, 15 nt, Human
cucucauacccuccc

SEQ ID NO: 1490458 - RNA, 15 nt, Human
cucuggagcccacug

SEQ ID NO: 1490459 - RNA, 19 nt, Human
cucuggagcccacuguacu

SEQ ID NO: 1490460 - RNA, 13 nt, Human
cucuuaagaagac

SEQ ID NO: 1490461 - RNA, 13 nt, Human
cucuucagucucu

SEQ ID NO: 1490462 - RNA, 23 nt, Human
cugaauuuaaauagcuuuuuucu

SEQ ID NO: 1490463 - RNA, 18 nt, Human
cugaauuuaaauagcuuu

SEQ ID NO: 1490464 - RNA, 14 nt, Human
cugaauuuaaauag

SEQ ID NO: 1490465 - RNA, 13 nt, Human
cugagucccaucc

SEQ ID NO: 1490466 - RNA, 18 nt, Human
cugccucuucccucuucc

SEQ ID NO: 1490467 - RNA, 19 nt, Human
cugccucuucccucuuccu

SEQ ID NO: 1490468 - RNA, 12 nt, Human
cugccucucugc

SEQ ID NO: 1490469 - RNA, 13 nt, Human
cugccucucugca

SEQ ID NO: 1490470 - RNA, 14 nt, Human
cugccucucugcag

SEQ ID NO: 1490471 - RNA, 11 nt, Human
cugcccugcca

SEQ ID NO: 1490472 - RNA, 13 nt, Human
cugcccugccacc

SEQ ID NO: 1490473 - RNA, 14 nt, Human
cugcccugccaccu

SEQ ID NO: 1490474 - RNA, 15 nt, Human
cugcccugccaccug

SEQ ID NO: 1490475 - RNA, 16 nt, Human
cugcccugccaccugu

SEQ ID NO: 1490476 - RNA, 17 nt, Human
cugcccugccaccuguc

SEQ ID NO: 1490477 - RNA, 18 nt, Human
cugcccugccaccugucu

SEQ ID NO: 1490478 - RNA, 20 nt, Human
cugcccugccaccugucugu

SEQ ID NO: 1490479 - RNA, 21 nt, Human
cugcccugccaccugucuguc

SEQ ID NO: 1490480 - RNA, 11 nt, Human
cugcccugccc

SEQ ID NO: 1490481 - RNA, 19 nt, Human
cuggguaggaaagaggaag

SEQ ID NO: 1490482 - RNA, 19 nt, Human
cugggccccugccucucug

SEQ ID NO: 1490483 - RNA, 14 nt, Human
cuggguaggaaaga

SEQ ID NO: 1490484 - RNA, 15 nt, Human
cuggguaggaaagag

SEQ ID NO: 1490485 - RNA, 17 nt, Human
cuggguaggaaagagga

SEQ ID NO: 1490486 - RNA, 12 nt, Human
cugggccccugc

SEQ ID NO: 1490487 - RNA, 16 nt, Human
cugggccccugccucu

SEQ ID NO: 1490488 - RNA, 17 nt, Human
cugggccccugccucuc

SEQ ID NO: 1490489 - RNA, 15 nt, Human
cugggaggcucugga

SEQ ID NO: 1490490 - RNA, 16 nt, Human
cugggaggcucuggag

SEQ ID NO: 1490491 - RNA, 16 nt, Human
cugggagcuuuuguag

SEQ ID NO: 1490492 - RNA, 21 nt, Human
cuggaagugcuaauuuugaaa

SEQ ID NO: 1490493 - RNA, 23 nt, Human
cuggaauaauccuaaacauauga

SEQ ID NO: 1490494 - RNA, 22 nt, Human
cuggagcuagaauuugauaugu

SEQ ID NO: 1490495 - RNA, 17 nt, Human
cuggagcuagaauuuga

SEQ ID NO: 1490496 - RNA, 16 nt, Human
cuggagcuagaauuug

SEQ ID NO: 1490497 - RNA, 21 nt, Human
cuggagcccacuguacuugcu

SEQ ID NO: 1490498 - RNA, 13 nt, Human
cuggagcccacug

SEQ ID NO: 1490499 - RNA, 15 nt, Human
cuggagcccacugua

SEQ ID NO: 1490500 - RNA, 16 nt, Human
cuggagcccacuguac

SEQ ID NO: 1490501 - RNA, 17 nt, Human
cuggagcccacuguacu

SEQ ID NO: 1490502 - RNA, 20 nt, Human
cuggagcccacuguacuugc

SEQ ID NO: 1490503 - RNA, 17 nt, Human
cuggauuauauuaugaa

SEQ ID NO: 1490504 - RNA, 21 nt, Human
cuggauuccagagcacugcuc

SEQ ID NO: 1490505 - RNA, 13 nt, Human
cuggauuccagag

SEQ ID NO: 1490506 - RNA, 12 nt, Human
cuuuuugcagcu

SEQ ID NO: 1490507 - RNA, 13 nt, Human
cuuuuugcagcuu

SEQ ID NO: 1490508 - RNA, 14 nt, Human
cuuuuugcagcuuu

SEQ ID NO: 1490509 - RNA, 13 nt, Human
gaaaacauuccau

SEQ ID NO: 1490510 - RNA, 17 nt, Human
gaaaacauuccauccuu

SEQ ID NO: 1490511 - RNA, 20 nt, Human
gaaaaguauguuagugcaaa

SEQ ID NO: 1490512 - RNA, 14 nt, Human
gaaaaguauguuag

SEQ ID NO: 1490513 - RNA, 19 nt, Human
gaaaauaacaauaaaagac

SEQ ID NO: 1490514 - RNA, 19 nt, Human
gaaaaauauauacuaaaca

SEQ ID NO: 1490515 - RNA, 14 nt, Human
gaaaacaaggauga

SEQ ID NO: 1490516 - RNA, 19 nt, Human
cuuugacaaagguaaauca

SEQ ID NO: 1490517 - RNA, 16 nt, Human
cuuugccacccucaug

SEQ ID NO: 1490518 - RNA, 17 nt, Human
cuuugccacccucaugc

SEQ ID NO: 1490519 - RNA, 18 nt, Human
cuuugccacccucaugcu

SEQ ID NO: 1490520 - RNA, 13 nt, Human
cuuuggcaggugc

SEQ ID NO: 1490521 - RNA, 24 nt, Human
cuuuggcaggugcagcccccacug

SEQ ID NO: 1490522 - RNA, 17 nt, Human
cuuugacaaagguaaau

SEQ ID NO: 1490523 - RNA, 13 nt, Human
cuuguuucauauu

SEQ ID NO: 1490524 - RNA, 18 nt, Human
cuuggggcugaugcaguu

SEQ ID NO: 1490525 - RNA, 16 nt, Human
cuuggggcugaugcag

SEQ ID NO: 1490526 - RNA, 13 nt, Human
cuugccacacccc

SEQ ID NO: 1490527 - RNA, 19 nt, Human
cuugccacaccccccaccc

SEQ ID NO: 1490528 - RNA, 23 nt, Human
cuugccacaccccccaccccuag

SEQ ID NO: 1490529 - RNA, 17 nt, Human
cuugcucuugaugccug

SEQ ID NO: 1490530 - RNA, 18 nt, Human
cuugcucuugaugccugg

SEQ ID NO: 1490531 - RNA, 19 nt, Human
cuugcucuugaugccuggc

SEQ ID NO: 1490532 - RNA, 20 nt, Human
cuugcuugauuguauggugg

SEQ ID NO: 1490533 - RNA, 20 nt, Human
cuuagaugcaguucugaaga

SEQ ID NO: 1490534 - RNA, 19 nt, Human
cuuagaugcaguucugaag

SEQ ID NO: 1490535 - RNA, 21 nt, Human
cuuaggguuaugauuaaguaa

SEQ ID NO: 1490536 - RNA, 13 nt, Human
cuuauaauuuaaa

SEQ ID NO: 1490537 - RNA, 14 nt, Human
cuuauaauaaagga

SEQ ID NO: 1490538 - RNA, 16 nt, Human
cuuauaauaaaggacu

SEQ ID NO: 1490539 - RNA, 20 nt, Human
cuuauaauaaaggacuguaa

SEQ ID NO: 1490540 - RNA, 17 nt, Human
cuuauaauaaaggacug

SEQ ID NO: 1490541 - RNA, 14 nt, Human
cuuauaauuuaaaa

SEQ ID NO: 1490542 - RNA, 13 nt, Human
cuuauaguacaug

SEQ ID NO: 1490543 - RNA, 17 nt, Human
cuuauaguacaugauaa

SEQ ID NO: 1490544 - RNA, 19 nt, Human
cuuauaguacaugauaaau

SEQ ID NO: 1490545 - RNA, 21 nt, Human
cuuaagaagacugcauuauau

SEQ ID NO: 1490546 - RNA, 14 nt, Human
cuguuuuuuuguua

SEQ ID NO: 1490547 - RNA, 19 nt, Human
cuguuuuauaauuuuguga

SEQ ID NO: 1490548 - RNA, 18 nt, Human
cuucagcgguuuauauaa

SEQ ID NO: 1490549 - RNA, 17 nt, Human
cuucuccauggcccugc

SEQ ID NO: 1490550 - RNA, 19 nt, Human
cuucuccauggcccugcca

SEQ ID NO: 1490551 - RNA, 14 nt, Human
cuucucagauuucu

SEQ ID NO: 1490552 - RNA, 19 nt, Human
cuucucagauuucugagga

SEQ ID NO: 1490553 - RNA, 22 nt, Human
cuucucagauuucugaggaaau

SEQ ID NO: 1490554 - RNA, 15 nt, Human
cuuccuucccugcug

SEQ ID NO: 1490555 - RNA, 16 nt, Human
cuuccuucccugcugu

SEQ ID NO: 1490556 - RNA, 13 nt, Human
gacugagaaauuu

SEQ ID NO: 1490557 - RNA, 11 nt, Human
gacugagaaau

SEQ ID NO: 1490558 - RNA, 16 nt, Human
gacuuauaguacauga

SEQ ID NO: 1490559 - RNA, 17 nt, Human
gacuuauaguacaugau

SEQ ID NO: 1490560 - RNA, 18 nt, Human
gacuuauaguacaugaua

SEQ ID NO: 1490561 - RNA, 15 nt, Human
gacugcggaggaagg

SEQ ID NO: 1490562 - RNA, 23 nt, Human
gacugcggaggaaggaggaccca

SEQ ID NO: 1490563 - RNA, 23 nt, Human
gacaggaugguucccuugaugaa

SEQ ID NO: 1490564 - RNA, 14 nt, Human
gacacgcacggcag

SEQ ID NO: 1490565 - RNA, 19 nt, Human
gacacgcacggcagccaca

SEQ ID NO: 1490566 - RNA, 20 nt, Human
gacacgcacggcagccacag

SEQ ID NO: 1490567 - RNA, 21 nt, Human
gacacgcacggcagccacagc

SEQ ID NO: 1490568 - RNA, 22 nt, Human
gacacgcacggcagccacagcu

SEQ ID NO: 1490569 - RNA, 14 nt, Human
gacacuacacccag

SEQ ID NO: 1490570 - RNA, 15 nt, Human
gacacuacacccagc

SEQ ID NO: 1490571 - RNA, 16 nt, Human
gacacuacacccagca

SEQ ID NO: 1490572 - RNA, 17 nt, Human
gacacuacacccagcaa

SEQ ID NO: 1490573 - RNA, 18 nt, Human
gacacuacacccagcaau

SEQ ID NO: 1490574 - RNA, 19 nt, Human
gacacuacacccagcaaua

SEQ ID NO: 1490575 - RNA, 20 nt, Human
gacacuacacccagcaauag

SEQ ID NO: 1490576 - RNA, 14 nt, Human
gacaucagcaaaca

SEQ ID NO: 1490577 - RNA, 13 nt, Human
gacauccagcaga

SEQ ID NO: 1490578 - RNA, 22 nt, Human
gacauccagcagauuuccagcc

SEQ ID NO: 1490579 - RNA, 15 nt, Human
gaccccagccaucca

SEQ ID NO: 1490580 - RNA, 19 nt, Human
gaauucuuuaaaauuacaa

SEQ ID NO: 1490581 - RNA, 22 nt, Human
gaauuuaaauagcuuuuuucuc

SEQ ID NO: 1490582 - RNA, 15 nt, Human
gaauuguguuuauaa

SEQ ID NO: 1490583 - RNA, 23 nt, Human
gaauuguguuuauaauuuuaaau

SEQ ID NO: 1490584 - RNA, 15 nt, Human
gaauggaggggcaga

SEQ ID NO: 1490585 - RNA, 16 nt, Human
gaauggaggggcagag

SEQ ID NO: 1490586 - RNA, 20 nt, Human
gaauggaggggcagagccag

SEQ ID NO: 1490587 - RNA, 21 nt, Human
gaauggaggggcagagccagg

SEQ ID NO: 1490588 - RNA, 22 nt, Human
gaauggaggggcagagccagga

SEQ ID NO: 1490589 - RNA, 19 nt, Human
gaaugaagauacugaaaua

SEQ ID NO: 1490590 - RNA, 21 nt, Human
gaaugaagauacugaaauaaa

SEQ ID NO: 1490591 - RNA, 18 nt, Human
gaaugaagauacugaaau

SEQ ID NO: 1490592 - RNA, 17 nt, Human
gaaugaagauacugaaa

SEQ ID NO: 1490593 - RNA, 20 nt, Human
gaauaauccuaaacauauga

SEQ ID NO: 1490594 - RNA, 20 nt, Human
gaauacucuuauaucuauau

SEQ ID NO: 1490595 - RNA, 22 nt, Human
gaaguccaagcauuuagaugua

SEQ ID NO: 1490596 - RNA, 12 nt, Human
gaaguccaagca

SEQ ID NO: 1490597 - RNA, 21 nt, Human
gaacuagaguuuagcuggaaa

SEQ ID NO: 1490598 - RNA, 14 nt, Human
gaacuacugaggau

SEQ ID NO: 1490599 - RNA, 14 nt, Human
gaacaucccuccug

SEQ ID NO: 1490600 - RNA, 18 nt, Human
gaaauuguauuacaaauc

SEQ ID NO: 1490601 - RNA, 16 nt, Human
gaaauuuauaaacuuu

SEQ ID NO: 1490602 - RNA, 17 nt, Human
gaaauuuauaaacuuuu

SEQ ID NO: 1490603 - RNA, 16 nt, Human
gaaauuguauuacaaa

SEQ ID NO: 1490604 - RNA, 14 nt, Human
gaacauaaaaagga

SEQ ID NO: 1490605 - RNA, 16 nt, Human
gaacauaaaaaggaca

SEQ ID NO: 1490606 - RNA, 18 nt, Human
gaacauaaaaaggacauc

SEQ ID NO: 1490607 - RNA, 22 nt, Human
gaacauaaaaaggacaucagca

SEQ ID NO: 1490608 - RNA, 20 nt, Human
gaagagguuuuaaagcuucc

SEQ ID NO: 1490609 - RNA, 15 nt, Human
gaagauacugaaaua

SEQ ID NO: 1490610 - RNA, 21 nt, Human
gaacucaucuagguaaauuac

SEQ ID NO: 1490611 - RNA, 20 nt, Human
gaacucaucuagguaaauua

SEQ ID NO: 1490612 - RNA, 22 nt, Human
gaacucaucuagguaaauuaca

SEQ ID NO: 1490613 - RNA, 19 nt, Human
gaacuuugcugagccugua

SEQ ID NO: 1490614 - RNA, 19 nt, Human
gaagacugcauuauauuua

SEQ ID NO: 1490615 - RNA, 12 nt, Human
gaagaacugaaa

SEQ ID NO: 1490616 - RNA, 12 nt, Human
gaagagaaggag

SEQ ID NO: 1490617 - RNA, 13 nt, Human
gaagagaaggagc

SEQ ID NO: 1490618 - RNA, 14 nt, Human
gaagagaaggagca

SEQ ID NO: 1490619 - RNA, 15 nt, Human
gaagagaaggagcag

SEQ ID NO: 1490620 - RNA, 17 nt, Human
gaagagaucaggaagag

SEQ ID NO: 1490621 - RNA, 16 nt, Human
gaagagaucaggaaga

SEQ ID NO: 1490622 - RNA, 12 nt, Human
gcaaaugugaau

SEQ ID NO: 1490623 - RNA, 23 nt, Human
gcaaaugugaaucauuuuaccuu

SEQ ID NO: 1490624 - RNA, 20 nt, Human
gcaaacuuuauuuuguguuu

SEQ ID NO: 1490625 - RNA, 18 nt, Human
gcaaacuuuauuuugugu

SEQ ID NO: 1490626 - RNA, 22 nt, Human
gcaacuuuguauaaaagggacu

SEQ ID NO: 1490627 - RNA, 23 nt, Human
gcaagauggggagugagaggcug

SEQ ID NO: 1490628 - RNA, 20 nt, Human
gcaauccucccacuucagcc

SEQ ID NO: 1490629 - RNA, 23 nt, Human
gcaauccucccacuucagccucc

SEQ ID NO: 1490630 - RNA, 14 nt, Human
gauuaaguaaugau

SEQ ID NO: 1490631 - RNA, 22 nt, Human
gauuaaguaaugauaacuggaa

SEQ ID NO: 1490632 - RNA, 16 nt, Human
gauugggaauccgccc

SEQ ID NO: 1490633 - RNA, 14 nt, Human
gauccuggaaauca

SEQ ID NO: 1490634 - RNA, 17 nt, Human
gauaggucagugcaaau

SEQ ID NO: 1490635 - RNA, 23 nt, Human
gaucagcuuauugucuagugaaa

SEQ ID NO: 1490636 - RNA, 12 nt, Human
gaucaggaagag

SEQ ID NO: 1490637 - RNA, 15 nt, Human
gaucaggaagagaag

SEQ ID NO: 1490638 - RNA, 16 nt, Human
gaucaggaagagaagg

SEQ ID NO: 1490639 - RNA, 18 nt, Human
gaucaggaagagaaggag

SEQ ID NO: 1490640 - RNA, 17 nt, Human
gaucaggaagagaagga

SEQ ID NO: 1490641 - RNA, 16 nt, Human
gauaucaugcaaauuu

SEQ ID NO: 1490642 - RNA, 23 nt, Human
gaucaccgacugaaaauauuguu

SEQ ID NO: 1490643 - RNA, 16 nt, Human
gcauuuuacuguacag

SEQ ID NO: 1490644 - RNA, 17 nt, Human
gcauuuuacuguacaga

SEQ ID NO: 1490645 - RNA, 15 nt, Human
gcaugaauuugugaa

SEQ ID NO: 1490646 - RNA, 17 nt, Human
gcaugaauuugugaagg

SEQ ID NO: 1490647 - RNA, 15 nt, Human
gcaugccuucaaauc

SEQ ID NO: 1490648 - RNA, 23 nt, Human
gcauggaaauucccuucaucugg

SEQ ID NO: 1490649 - RNA, 15 nt, Human
gcauuauaaaaagaa

SEQ ID NO: 1490650 - RNA, 23 nt, Human
gcauauuauuuuauguugcauag

SEQ ID NO: 1490651 - RNA, 18 nt, Human
gcauauuauuuuauguug

SEQ ID NO: 1490652 - RNA, 19 nt, Human
gcauauuuauaaaaauaaa

SEQ ID NO: 1490653 - RNA, 14 nt, Human
gcaguucugaagaa

SEQ ID NO: 1490654 - RNA, 13 nt, Human
gcaguucugaaga

SEQ ID NO: 1490655 - RNA, 12 nt, Human
gcaggucccuaa

SEQ ID NO: 1490656 - RNA, 13 nt, Human
gcaggucccuaau

SEQ ID NO: 1490657 - RNA, 10 nt, Human
gcaggucccu

SEQ ID NO: 1490658 - RNA, 11 nt, Human
gcaggucccua

SEQ ID NO: 1490659 - RNA, 20 nt, Human
gcacagccucuuagaugcag

SEQ ID NO: 1490660 - RNA, 11 nt, Human
gcagcaacaau

SEQ ID NO: 1490661 - RNA, 16 nt, Human
gcagcaacaauaaaua

SEQ ID NO: 1490662 - RNA, 20 nt, Human
gcaggaguuucguuuucaaa

SEQ ID NO: 1490663 - RNA, 21 nt, Human
gcaggaguuucguuuucaaaa

SEQ ID NO: 1490664 - RNA, 19 nt, Human
gccaggaagaucccccaga

SEQ ID NO: 1490665 - RNA, 16 nt, Human
gcccacagcuguauga

SEQ ID NO: 1490666 - RNA, 22 nt, Human
gcccaucugggggccucuucug

SEQ ID NO: 1490667 - RNA, 13 nt, Human
gccuucaaaucaa

SEQ ID NO: 1490668 - RNA, 18 nt, Human
gccuuggggcugaugcag

SEQ ID NO: 1490669 - RNA, 18 nt, Human
gcgccuccaacccuagca

SEQ ID NO: 1490670 - RNA, 13 nt, Human
gcuaccaggaaag

SEQ ID NO: 1490671 - RNA, 16 nt, Human
gcuacagaagaaacug

SEQ ID NO: 1490672 - RNA, 14 nt, Human
gccucccauguuca

SEQ ID NO: 1490673 - RNA, 10 nt, Human
gccucucugc

SEQ ID NO: 1490674 - RNA, 14 nt, Human
gccucucugcaggu

SEQ ID NO: 1490675 - RNA, 16 nt, Human
gccucucugcaggucc

SEQ ID NO: 1490676 - RNA, 17 nt, Human
gccucucugcagguccc

SEQ ID NO: 1490677 - RNA, 18 nt, Human
gccucucugcaggucccu

SEQ ID NO: 1490678 - RNA, 17 nt, Human
gccuauuuuaauaaaca

SEQ ID NO: 1490679 - RNA, 20 nt, Human
gcccuucuauacccacccag

SEQ ID NO: 1490680 - RNA, 19 nt, Human
gcccuucuuuccacagaag

SEQ ID NO: 1490681 - RNA, 21 nt, Human
gcccuucuauacccacccaga

SEQ ID NO: 1490682 - RNA, 22 nt, Human
gcccuucuauacccacccagaa

SEQ ID NO: 1490683 - RNA, 18 nt, Human
gcuagauguauguacuuc

SEQ ID NO: 1490684 - RNA, 12 nt, Human
gcuagcaaauag

SEQ ID NO: 1490685 - RNA, 16 nt, Human
gcuagcaaauaguaau

SEQ ID NO: 1490686 - RNA, 22 nt, Human
gcuguauuuuaaaagaaugauu

SEQ ID NO: 1490687 - RNA, 16 nt, Human
gcuggggccaggcugg

SEQ ID NO: 1490688 - RNA, 19 nt, Human
gcuggggccaggcuggguc

SEQ ID NO: 1490689 - RNA, 20 nt, Human
ggaaaaaauaacaaugaaag

SEQ ID NO: 1490690 - RNA, 18 nt, Human
ggaaauauuuauuuuaau

SEQ ID NO: 1490691 - RNA, 17 nt, Human
ggaaauauuuauuuuaa

SEQ ID NO: 1490692 - RNA, 15 nt, Human
ggaaauauuuauuuu

SEQ ID NO: 1490693 - RNA, 13 nt, Human
ggaaauauuuauu

SEQ ID NO: 1490694 - RNA, 12 nt, Human
ggaaauauuuau

SEQ ID NO: 1490695 - RNA, 18 nt, Human
ggaagaucccccagaaaa

SEQ ID NO: 1490696 - RNA, 22 nt, Human
ggaagaucccccagaaaagaaa

SEQ ID NO: 1490697 - RNA, 14 nt, Human
ggaagaucccccag

SEQ ID NO: 1490698 - RNA, 15 nt, Human
ggacugcggaggaag

SEQ ID NO: 1490699 - RNA, 16 nt, Human
ggacugcggaggaagg

SEQ ID NO: 1490700 - RNA, 12 nt, Human
ggagcccuggga

SEQ ID NO: 1490701 - RNA, 13 nt, Human
ggagcccugggag

SEQ ID NO: 1490702 - RNA, 16 nt, Human
ggaaggaggacccagg

SEQ ID NO: 1490703 - RNA, 19 nt, Human
ggaaggaggacccaggaca

SEQ ID NO: 1490704 - RNA, 15 nt, Human
ggaccagcuuuuccc

SEQ ID NO: 1490705 - RNA, 17 nt, Human
ggaccagcuuuucccaa

SEQ ID NO: 1490706 - RNA, 22 nt, Human
ggaccagcuuuucccaaaagcc

SEQ ID NO: 1490707 - RNA, 10 nt, Human
ggacccagga

SEQ ID NO: 1490708 - RNA, 13 nt, Human
ggacccaggacag

SEQ ID NO: 1490709 - RNA, 17 nt, Human
ggaggaggcagagaaga

SEQ ID NO: 1490710 - RNA, 18 nt, Human
ggaggaggcagagaagaa

SEQ ID NO: 1490711 - RNA, 16 nt, Human
ggcagcaauuuaaaug

SEQ ID NO: 1490712 - RNA, 17 nt, Human
ggcagcaacaauaaaua

SEQ ID NO: 1490713 - RNA, 22 nt, Human
ggcagcaacaauaaauagacac

SEQ ID NO: 1490714 - RNA, 15 nt, Human
ggcagcaauuuaaau

SEQ ID NO: 1490715 - RNA, 15 nt, Human
ggcagcaacaauaaa

SEQ ID NO: 1490716 - RNA, 21 nt, Human
ggaucaguuaacuauugcauu

SEQ ID NO: 1490717 - RNA, 18 nt, Human
ggccaggcugggucgccc

SEQ ID NO: 1490718 - RNA, 22 nt, Human
ggccaggcugggucgcccugga

SEQ ID NO: 1490719 - RNA, 20 nt, Human
ggccaggcaggagcccuucu

SEQ ID NO: 1490720 - RNA, 13 nt, Human
ggccccugccucu

SEQ ID NO: 1490721 - RNA, 20 nt, Human
ggccccugccaccuccugcc

SEQ ID NO: 1490722 - RNA, 13 nt, Human
ggcucuggagccc

SEQ ID NO: 1490723 - RNA, 14 nt, Human
ggcucuggagccca

SEQ ID NO: 1490724 - RNA, 15 nt, Human
ggcugcugcuacaau

SEQ ID NO: 1490725 - RNA, 22 nt, Human
ggcuugaguuuaaauuguaaua

SEQ ID NO: 1490726 - RNA, 20 nt, Human
gggaccggcggaccccagcc

SEQ ID NO: 1490727 - RNA, 22 nt, Human
gggacguucgugguccugcgcu

SEQ ID NO: 1490728 - RNA, 13 nt, Human
gggaaugaagaua

SEQ ID NO: 1490729 - RNA, 18 nt, Human
gggaggugagaccaccuc

SEQ ID NO: 1490730 - RNA, 12 nt, Human
gggacucagccc

SEQ ID NO: 1490731 - RNA, 13 nt, Human
gggacugagaaau

SEQ ID NO: 1490732 - RNA, 13 nt, Human
gggcaagaggaau

SEQ ID NO: 1490733 - RNA, 20 nt, Human
gggcaauuaauuccuucagc

SEQ ID NO: 1490734 - RNA, 21 nt, Human
gggcaauuaauuccuucagca

SEQ ID NO: 1490735 - RNA, 22 nt, Human
gggccccugccucucugcaggu

SEQ ID NO: 1490736 - RNA, 13 nt, Human
gggccccugccuc

SEQ ID NO: 1490737 - RNA, 15 nt, Human
gggccccugccucuc

SEQ ID NO: 1490738 - RNA, 17 nt, Human
gggccccugccucucug

SEQ ID NO: 1490739 - RNA, 18 nt, Human
gggccccugccucucugc

SEQ ID NO: 1490740 - RNA, 19 nt, Human
gggccccugccucucugca

SEQ ID NO: 1490741 - RNA, 21 nt, Human
gggccccugccucucugcagg

SEQ ID NO: 1490742 - RNA, 20 nt, Human
ggucacguuuggugcuucuc

SEQ ID NO: 1490743 - RNA, 18 nt, Human
gguagcauuuguguugaa

SEQ ID NO: 1490744 - RNA, 17 nt, Human
gggugcugggccccugc

SEQ ID NO: 1490745 - RNA, 18 nt, Human
gggugcugggccccugcc

SEQ ID NO: 1490746 - RNA, 14 nt, Human
ggggcuaccaggaa

SEQ ID NO: 1490747 - RNA, 18 nt, Human
ggggugcugggccccugc

SEQ ID NO: 1490748 - RNA, 20 nt, Human
gggguggggggggugcuggg

SEQ ID NO: 1490749 - RNA, 14 nt, Human
ggugagaccaccuc

SEQ ID NO: 1490750 - RNA, 15 nt, Human
ggugagaccaccucu

SEQ ID NO: 1490751 - RNA, 20 nt, Human
ggucucuucugaauaaagca

SEQ ID NO: 1490752 - RNA, 21 nt, Human
ggucucuucugaauaaagcaa

SEQ ID NO: 1490753 - RNA, 22 nt, Human
ggucucuucugaauaaagcaau

SEQ ID NO: 1490754 - RNA, 16 nt, Human
gguuagggaaaacauu

SEQ ID NO: 1490755 - RNA, 21 nt, Human
uacuugcucuugaugccuggc

SEQ ID NO: 1490756 - RNA, 11 nt, Human
uagaaagcuau

SEQ ID NO: 1490757 - RNA, 19 nt, Human
uaccuuugacaaagguaaa

SEQ ID NO: 1490758 - RNA, 21 nt, Human
uacaguuagggcuccuauuca

SEQ ID NO: 1490759 - RNA, 18 nt, Human
uacaguuccuagguauaa

SEQ ID NO: 1490760 - RNA, 11 nt, Human
uacauuugugu

SEQ ID NO: 1490761 - RNA, 17 nt, Human
uacauuuguauaaaaua

SEQ ID NO: 1490762 - RNA, 16 nt, Human
uacauuuguauaaaau

SEQ ID NO: 1490763 - RNA, 18 nt, Human
uaccaccagucugacugu

SEQ ID NO: 1490764 - RNA, 23 nt, Human
uaccacaggaaccacaagacugc

SEQ ID NO: 1490765 - RNA, 18 nt, Human
uaccaaggucuucuuaau

SEQ ID NO: 1490766 - RNA, 12 nt, Human
uaccaauaaagu

SEQ ID NO: 1490767 - RNA, 13 nt, Human
uaccaauaaagug

SEQ ID NO: 1490768 - RNA, 17 nt, Human
uaccaauaaagugaccc

SEQ ID NO: 1490769 - RNA, 14 nt, Human
uaccaauaaaguga

SEQ ID NO: 1490770 - RNA, 12 nt, Human
uacccacccaga

SEQ ID NO: 1490771 - RNA, 15 nt, Human
uacccaaauuaagag

SEQ ID NO: 1490772 - RNA, 14 nt, Human
uacacaauaagcaa

SEQ ID NO: 1490773 - RNA, 15 nt, Human
uacacaauaagcaaa

SEQ ID NO: 1490774 - RNA, 13 nt, Human
uaauuuugugaag

SEQ ID NO: 1490775 - RNA, 13 nt, Human
uaauuuugaaaaa

SEQ ID NO: 1490776 - RNA, 17 nt, Human
uaauuuugaaaaacugc

SEQ ID NO: 1490777 - RNA, 22 nt, Human
uacagaaaaguugaauuuuaca

SEQ ID NO: 1490778 - RNA, 18 nt, Human
uacagaaaaguugaauuu

SEQ ID NO: 1490779 - RNA, 13 nt, Human
uacagaauuuuau

SEQ ID NO: 1490780 - RNA, 11 nt, Human
uacagaacuac

SEQ ID NO: 1490781 - RNA, 14 nt, Human
uacagaagaaacug

SEQ ID NO: 1490782 - RNA, 12 nt, Human
uaucucuucagu

SEQ ID NO: 1490783 - RNA, 13 nt, Human
uaucucuucaguc

SEQ ID NO: 1490784 - RNA, 14 nt, Human
uaucucuucagucu

SEQ ID NO: 1490785 - RNA, 16 nt, Human
uaucucuucagucucu

SEQ ID NO: 1490786 - RNA, 17 nt, Human
uaucaugugaaaucauu

SEQ ID NO: 1490787 - RNA, 22 nt, Human
uaucaugugaaaucauucauuu

SEQ ID NO: 1490788 - RNA, 23 nt, Human
uauauuuauuacuguaagaaaau

SEQ ID NO: 1490789 - RNA, 19 nt, Human
uauauguaccguaggcuuu

SEQ ID NO: 1490790 - RNA, 20 nt, Human
uauauuugaaauauugacuu

SEQ ID NO: 1490791 - RNA, 14 nt, Human
uauauuugaaauau

SEQ ID NO: 1490792 - RNA, 13 nt, Human
uauauuugaaaua

SEQ ID NO: 1490793 - RNA, 13 nt, Human
uauauuuuaagac

SEQ ID NO: 1490794 - RNA, 14 nt, Human
uauauuuuaagacg

SEQ ID NO: 1490795 - RNA, 15 nt, Human
uauaauucaccuucu

SEQ ID NO: 1490796 - RNA, 15 nt, Human
uauacccacccagaa

SEQ ID NO: 1490797 - RNA, 14 nt, Human
uauacccacccaga

SEQ ID NO: 1490798 - RNA, 22 nt, Human
uauacccacccagaaugagaca

SEQ ID NO: 1490799 - RNA, 17 nt, Human
uauacuauaguaccagu

SEQ ID NO: 1490800 - RNA, 20 nt, Human
uauacuauaguaccaguagg

SEQ ID NO: 1490801 - RNA, 18 nt, Human
uauaacaaugcuguauuu

SEQ ID NO: 1490802 - RNA, 15 nt, Human
uaguuuuauaugcuu

SEQ ID NO: 1490803 - RNA, 18 nt, Human
uaguuguaaaccaaguga

SEQ ID NO: 1490804 - RNA, 18 nt, Human
uagucaaauugugugaaa

SEQ ID NO: 1490805 - RNA, 17 nt, Human
uaggaaguugacuuaua

SEQ ID NO: 1490806 - RNA, 14 nt, Human
uaggaauuguguuu

SEQ ID NO: 1490807 - RNA, 22 nt, Human
uaggaaguugacuuauaguaca

SEQ ID NO: 1490808 - RNA, 16 nt, Human
uaggaauuguguuuau

SEQ ID NO: 1490809 - RNA, 18 nt, Human
uagaguuuagcuggaaaa

SEQ ID NO: 1490810 - RNA, 17 nt, Human
uagaguuuagcuggaaa

SEQ ID NO: 1490811 - RNA, 20 nt, Human
uagauguauguacuucaugc

SEQ ID NO: 1490812 - RNA, 16 nt, Human
uagauguauguacuuc

SEQ ID NO: 1490813 - RNA, 17 nt, Human
uaagagagucuauuuac

SEQ ID NO: 1490814 - RNA, 15 nt, Human
uaaggcaaucauggu

SEQ ID NO: 1490815 - RNA, 15 nt, Human
uaagcaugcacaaau

SEQ ID NO: 1490816 - RNA, 20 nt, Human
uaagcauuccaacuaucuca

SEQ ID NO: 1490817 - RNA, 18 nt, Human
uaagcauuccaacuaucu

SEQ ID NO: 1490818 - RNA, 16 nt, Human
uaagcauuccaacuau

SEQ ID NO: 1490819 - RNA, 11 nt, Human
uaaccaaguuc

SEQ ID NO: 1490820 - RNA, 12 nt, Human
uaaccaaguucc

SEQ ID NO: 1490821 - RNA, 17 nt, Human
uaaccaggggccaugaa

SEQ ID NO: 1490822 - RNA, 22 nt, Human
uaaauuuaguauuuuguuucag

SEQ ID NO: 1490823 - RNA, 14 nt, Human
uaaauuuaguauuu

SEQ ID NO: 1490824 - RNA, 15 nt, Human
uaaucuuauuuagga

SEQ ID NO: 1490825 - RNA, 15 nt, Human
uaaucuucaauaguu

SEQ ID NO: 1490826 - RNA, 20 nt, Human
uaauauguucuuuuaaauga

SEQ ID NO: 1490827 - RNA, 11 nt, Human
uaauaaagcug

SEQ ID NO: 1490828 - RNA, 20 nt, Human
uaauaauuuuuaagaaauaa

SEQ ID NO: 1490829 - RNA, 15 nt, Human
uaauaauguuucaaa

SEQ ID NO: 1490830 - RNA, 23 nt, Human
uaauuuguaguguuggagaagaa

SEQ ID NO: 1490831 - RNA, 17 nt, Human
uaauuugguuuucacau

SEQ ID NO: 1490832 - RNA, 15 nt, Human
uaauuugguuuucac

SEQ ID NO: 1490833 - RNA, 18 nt, Human
uaauuugguuuucacauu

SEQ ID NO: 1490834 - RNA, 20 nt, Human
uaauuuguaguguuggagaa

SEQ ID NO: 1490835 - RNA, 22 nt, Human
uaauuggaaaggcagcucuaaa

SEQ ID NO: 1490836 - RNA, 15 nt, Human
uaauguuucaaacau

SEQ ID NO: 1490837 - RNA, 14 nt, Human
uaauguuucaaaca

SEQ ID NO: 1490838 - RNA, 14 nt, Human
uaaaguuuguugaa

SEQ ID NO: 1490839 - RNA, 17 nt, Human
uaaauaaaaauaauccu

SEQ ID NO: 1490840 - RNA, 12 nt, Human
uaaaggacugua

SEQ ID NO: 1490841 - RNA, 14 nt, Human
uaaaggacuguaau

SEQ ID NO: 1490842 - RNA, 20 nt, Human
uaaacuuuuuucuuacuguc

SEQ ID NO: 1490843 - RNA, 20 nt, Human
uaaaucagacuaugaaguuu

SEQ ID NO: 1490844 - RNA, 18 nt, Human
uaaauauaugcuaagucu

SEQ ID NO: 1490845 - RNA, 16 nt, Human
uaaauauauuuuaaga

SEQ ID NO: 1490846 - RNA, 22 nt, Human
uaaauauauuuuaagacgaaac

SEQ ID NO: 1490847 - RNA, 21 nt, Human
uaaacacucuugaaaaaugca

SEQ ID NO: 1490848 - RNA, 22 nt, Human
uaaaaauggaaacuauauugac

SEQ ID NO: 1490849 - RNA, 17 nt, Human
uaaaagggacugagaaa

SEQ ID NO: 1490850 - RNA, 19 nt, Human
uaaaagggacugagaaauu

SEQ ID NO: 1490851 - RNA, 20 nt, Human
uaaaagggacugagaaauuu

SEQ ID NO: 1490852 - RNA, 21 nt, Human
uaaaagggacugagaaauuua

SEQ ID NO: 1490853 - RNA, 19 nt, Human
uaaaauccauacauuugug

SEQ ID NO: 1490854 - RNA, 13 nt, Human
uaaaaugagaaau

SEQ ID NO: 1490855 - RNA, 15 nt, Human
uaaaaugagaaaucu

SEQ ID NO: 1490856 - RNA, 16 nt, Human
uaaaaugagaaaucua

SEQ ID NO: 1490857 - RNA, 18 nt, Human
guuuucaggcuagaugua

SEQ ID NO: 1490858 - RNA, 12 nt, Human
uaaaaaacacug

SEQ ID NO: 1490859 - RNA, 16 nt, Human
uaaaaaagaaacauuu

SEQ ID NO: 1490860 - RNA, 14 nt, Human
uaaaaaauggucac

SEQ ID NO: 1490861 - RNA, 17 nt, Human
uaaaaacaaagaaauua

SEQ ID NO: 1490862 - RNA, 11 nt, Human
uaaaaaacacu

SEQ ID NO: 1490863 - RNA, 14 nt, Human
guuucuuuguaaug

SEQ ID NO: 1490864 - RNA, 17 nt, Human
guuucuuuguaaugaaa

SEQ ID NO: 1490865 - RNA, 16 nt, Human
guuuccuuauauuaug

SEQ ID NO: 1490866 - RNA, 16 nt, Human
guuuaguaaucauauu

SEQ ID NO: 1490867 - RNA, 23 nt, Human
ucacaggacagcccuucuuucca

SEQ ID NO: 1490868 - RNA, 11 nt, Human
ucaaccucauc

SEQ ID NO: 1490869 - RNA, 19 nt, Human
ucaacuccaaacugacucu

SEQ ID NO: 1490870 - RNA, 21 nt, Human
uauuucuaugaaauauuaugu

SEQ ID NO: 1490871 - RNA, 22 nt, Human
uauuucuaugaaauauuauguu

SEQ ID NO: 1490872 - RNA, 13 nt, Human
uauuuauuacugu

SEQ ID NO: 1490873 - RNA, 18 nt, Human
ucaaacuacauauuguaa

SEQ ID NO: 1490874 - RNA, 17 nt, Human
uauuuuuuucugaaauu

SEQ ID NO: 1490875 - RNA, 16 nt, Human
uauuuuuuucugaaau

SEQ ID NO: 1490876 - RNA, 22 nt, Human
uauuuuuuucugaauuauuuuc

SEQ ID NO: 1490877 - RNA, 15 nt, Human
uauuuuauguugcau

SEQ ID NO: 1490878 - RNA, 16 nt, Human
uauuuuauguugcaua

SEQ ID NO: 1490879 - RNA, 17 nt, Human
ucacuugucaauaaaau

SEQ ID NO: 1490880 - RNA, 22 nt, Human
ucagaguugaugguuguacaua

SEQ ID NO: 1490881 - RNA, 15 nt, Human
ucagcaaacaggauc

SEQ ID NO: 1490882 - RNA, 21 nt, Human
ucagcaaacaggaucaguuaa

SEQ ID NO: 1490883 - RNA, 11 nt, Human
ucccuaauaaa

SEQ ID NO: 1490884 - RNA, 12 nt, Human
ucccuaauaaag

SEQ ID NO: 1490885 - RNA, 13 nt, Human
ucccuaauaaagc

SEQ ID NO: 1490886 - RNA, 14 nt, Human
ucccuaauaaagcu

SEQ ID NO: 1490887 - RNA, 14 nt, Human
uccauggcccugcc

SEQ ID NO: 1490888 - RNA, 20 nt, Human
ucccaaguaacugggauuac

SEQ ID NO: 1490889 - RNA, 21 nt, Human
ucccaaguaacugggauuaca

SEQ ID NO: 1490890 - RNA, 20 nt, Human
uccaagcauuuagauguaua

SEQ ID NO: 1490891 - RNA, 15 nt, Human
uccaagcaaauguga

SEQ ID NO: 1490892 - RNA, 14 nt, Human
uccaccucaacucc

SEQ ID NO: 1490893 - RNA, 15 nt, Human
uccaccgcagaagga

SEQ ID NO: 1490894 - RNA, 16 nt, Human
uccaccgcagaaggaa

SEQ ID NO: 1490895 - RNA, 17 nt, Human
uccaccgcagaaggaag

SEQ ID NO: 1490896 - RNA, 18 nt, Human
uccaccgcagaaggaagg

SEQ ID NO: 1490897 - RNA, 19 nt, Human
uccagaaauacaauuuuag

SEQ ID NO: 1490898 - RNA, 22 nt, Human
uccagcagauuuccagccuucu

SEQ ID NO: 1490899 - RNA, 14 nt, Human
uccagauccuggaa

SEQ ID NO: 1490900 - RNA, 17 nt, Human
uccagauccuggaaauc

SEQ ID NO: 1490901 - RNA, 16 nt, Human
uccagauccuggaaau

SEQ ID NO: 1490902 - RNA, 17 nt, Human
uccaagcauuuagaugu

SEQ ID NO: 1490903 - RNA, 13 nt, Human
uccaagcaaaugu

SEQ ID NO: 1490904 - RNA, 14 nt, Human
uccaagaauuucua

SEQ ID NO: 1490905 - RNA, 23 nt, Human
uccaaacugacucuuaagaagac

SEQ ID NO: 1490906 - RNA, 22 nt, Human
ucauucagauaugauucaaaug

SEQ ID NO: 1490907 - RNA, 15 nt, Human
ucauaauuauuauuu

SEQ ID NO: 1490908 - RNA, 12 nt, Human
ucaguugcagcc

SEQ ID NO: 1490909 - RNA, 21 nt, Human
ucagcacuuuagaauaugccu

SEQ ID NO: 1490910 - RNA, 14 nt, Human
ucugaaauuuccug

SEQ ID NO: 1490911 - RNA, 13 nt, Human
ucucuucagucuc

SEQ ID NO: 1490912 - RNA, 17 nt, Human
ucucuucagucucuaua

SEQ ID NO: 1490913 - RNA, 11 nt, Human
ucucugcaggu

SEQ ID NO: 1490914 - RNA, 19 nt, Human
ucucuucugaauaaagcaa

SEQ ID NO: 1490915 - RNA, 19 nt, Human
ucucuaggaaauauuuauu

SEQ ID NO: 1490916 - RNA, 13 nt, Human
ucucuaggaaaua

SEQ ID NO: 1490917 - RNA, 14 nt, Human
ucucuauaccaaua

SEQ ID NO: 1490918 - RNA, 16 nt, Human
ucucuauaccaauaaa

SEQ ID NO: 1490919 - RNA, 17 nt, Human
ucucuauaccaauaaag

SEQ ID NO: 1490920 - RNA, 19 nt, Human
ucucuauaccaauaaagug

SEQ ID NO: 1490921 - RNA, 15 nt, Human
ucucucgugaguaua

SEQ ID NO: 1490922 - RNA, 14 nt, Human
ucucaguugcagcc

SEQ ID NO: 1490923 - RNA, 16 nt, Human
ucucaaacuccugacc

SEQ ID NO: 1490924 - RNA, 15 nt, Human
ucucaacuccaaacu

SEQ ID NO: 1490925 - RNA, 21 nt, Human
ucuacacuaagagagaaugag

SEQ ID NO: 1490926 - RNA, 16 nt, Human
ucuaaauucuuucauu

SEQ ID NO: 1490927 - RNA, 17 nt, Human
uccuuggccaugcagaa

SEQ ID NO: 1490928 - RNA, 10 nt, Human
ucggaccagc

SEQ ID NO: 1490929 - RNA, 22 nt, Human
ugaacuuguaaaggaauuuaaa

SEQ ID NO: 1490930 - RNA, 22 nt, Human
ugaaguccaagcauuuagaugu

SEQ ID NO: 1490931 - RNA, 21 nt, Human
ugaaguccaagcauuuagaug

SEQ ID NO: 1490932 - RNA, 19 nt, Human
ugaagagguuuuaaagcuu

SEQ ID NO: 1490933 - RNA, 19 nt, Human
ugaaauggacuuuuguaca

SEQ ID NO: 1490934 - RNA, 13 nt, Human
ugaaagauucaau

SEQ ID NO: 1490935 - RNA, 17 nt, Human
ucuuucacauuuaaaua

SEQ ID NO: 1490936 - RNA, 16 nt, Human
ucuuuaaaaggaaaga

SEQ ID NO: 1490937 - RNA, 23 nt, Human
ucuggagcccacuguacuugcuc

SEQ ID NO: 1490938 - RNA, 18 nt, Human
ucuguaagcauaagcuua

SEQ ID NO: 1490939 - RNA, 14 nt, Human
ucuguaaaacuaag

SEQ ID NO: 1490940 - RNA, 21 nt, Human
ucuguaaaacuaagaaacuua

SEQ ID NO: 1490941 - RNA, 22 nt, Human
ucuguuuuauaauuuugugaag

SEQ ID NO: 1490942 - RNA, 22 nt, Human
ugccuaaguccaguguuucuuu

SEQ ID NO: 1490943 - RNA, 15 nt, Human
ugccuggcggggugg

SEQ ID NO: 1490944 - RNA, 21 nt, Human
ugcgcccuuaacugcauccag

SEQ ID NO: 1490945 - RNA, 22 nt, Human
ugccuucucaacuccaaacuga

SEQ ID NO: 1490946 - RNA, 14 nt, Human
ugcucaggagcccu

SEQ ID NO: 1490947 - RNA, 11 nt, Human
ugcucauggaa

SEQ ID NO: 1490948 - RNA, 15 nt, Human
ugcucaggagcccug

SEQ ID NO: 1490949 - RNA, 21 nt, Human
ugcauccagccuggggcugag

SEQ ID NO: 1490950 - RNA, 21 nt, Human
ugcauuauauuuauuacugua

SEQ ID NO: 1490951 - RNA, 20 nt, Human
ugcauuauauuuauuacugu

SEQ ID NO: 1490952 - RNA, 15 nt, Human
ugcauuauauuuauu

SEQ ID NO: 1490953 - RNA, 20 nt, Human
ugccaggcuggagugcagug

SEQ ID NO: 1490954 - RNA, 15 nt, Human
ugcacaucaaaauau

SEQ ID NO: 1490955 - RNA, 19 nt, Human
uggagaugaggccagacca

SEQ ID NO: 1490956 - RNA, 22 nt, Human
uggagaugaggccagaccaugg

SEQ ID NO: 1490957 - RNA, 18 nt, Human
uggagaugaggccagacc

SEQ ID NO: 1490958 - RNA, 24 nt, Human
uggagaugaggccagaccauggac

SEQ ID NO: 1490959 - RNA, 13 nt, Human
uggagauguuuag

SEQ ID NO: 1490960 - RNA, 14 nt, Human
ugcuucuguuuuau

SEQ ID NO: 1490961 - RNA, 19 nt, Human
uggaacccuaaauaauaaa

SEQ ID NO: 1490962 - RNA, 16 nt, Human
uggaauacucuuauau

SEQ ID NO: 1490963 - RNA, 18 nt, Human
uggcgcgaucucagcuca

SEQ ID NO: 1490964 - RNA, 17 nt, Human
ugggaauggaggggcag

SEQ ID NO: 1490965 - RNA, 19 nt, Human
ugggaauggaggggcagag

SEQ ID NO: 1490966 - RNA, 21 nt, Human
ugggacagucaccucauggaa

SEQ ID NO: 1490967 - RNA, 20 nt, Human
ugggacagucaccucaugga

SEQ ID NO: 1490968 - RNA, 18 nt, Human
ugggacagucaccucaug

SEQ ID NO: 1490969 - RNA, 23 nt, Human
ugggaauggaggggcagagccag

SEQ ID NO: 1490970 - RNA, 20 nt, Human
ugggacauuugcucauggaa

SEQ ID NO: 1490971 - RNA, 19 nt, Human
ugggacauuugcucaugga

SEQ ID NO: 1490972 - RNA, 16 nt, Human
ugggagcuuuuguaga

SEQ ID NO: 1490973 - RNA, 13 nt, Human
ugggcauucaaau

SEQ ID NO: 1490974 - RNA, 19 nt, Human
ugggguggggggggugcug

SEQ ID NO: 1490975 - RNA, 16 nt, Human
uggguagacacacaug

SEQ ID NO: 1490976 - RNA, 17 nt, Human
uggguagacacacauga

SEQ ID NO: 1490977 - RNA, 21 nt, Human
ugggguggggggggugcuggg

SEQ ID NO: 1490978 - RNA, 22 nt, Human
ugggguggggggggugcugggc

SEQ ID NO: 1490979 - RNA, 23 nt, Human
uggguaggaaagaggaagcaaau

SEQ ID NO: 1490980 - RNA, 18 nt, Human
uguuuuaaaaugagaaau

SEQ ID NO: 1490981 - RNA, 16 nt, Human
uguuucuauuuuuuga

SEQ ID NO: 1490982 - RNA, 22 nt, Human
uguuucuauuuuuugaaaagca

SEQ ID NO: 1490983 - RNA, 23 nt, Human
uguuuuaaaaugagaaaucuaaa

SEQ ID NO: 1490984 - RNA, 19 nt, Human
uuaaaagaaugauuaugaa

SEQ ID NO: 1490985 - RNA, 19 nt, Human
uuaaauagcuuuuuucucu

SEQ ID NO: 1490986 - RNA, 20 nt, Human
uuaaagcuuccauuguuguc

SEQ ID NO: 1490987 - RNA, 15 nt, Human
uuaaagcuuccauug

SEQ ID NO: 1490988 - RNA, 16 nt, Human
uuaauagguuuggaca

SEQ ID NO: 1490989 - RNA, 18 nt, Human
uuaauaauguuucaaaca

SEQ ID NO: 1490990 - RNA, 21 nt, Human
uuaauagguuuggacaaaaug

SEQ ID NO: 1490991 - RNA, 21 nt, Human
uuaccacuuguguuuugcaag

SEQ ID NO: 1490992 - RNA, 16 nt, Human
uuacggaacucaaaua

SEQ ID NO: 1490993 - RNA, 15 nt, Human
uuacaauaguucugu

SEQ ID NO: 1490994 - RNA, 17 nt, Human
uuacaauaguucugugg

SEQ ID NO: 1490995 - RNA, 23 nt, Human
uuacauggcuggagcuagaauuu

SEQ ID NO: 1490996 - RNA, 22 nt, Human
uuacauggcuggagcuagaauu

SEQ ID NO: 1490997 - RNA, 14 nt, Human
uuacauuuccuaaa

SEQ ID NO: 1490998 - RNA, 15 nt, Human
uuacauuuguauaaa

SEQ ID NO: 1490999 - RNA, 14 nt, Human
uuacauuuguauaa

SEQ ID NO: 1491000 - RNA, 21 nt, Human
uguucaagcgauucuccugcc

SEQ ID NO: 1491001 - RNA, 16 nt, Human
uguucacaauauauuu

SEQ ID NO: 1491002 - RNA, 12 nt, Human
uguuauaaucuu

SEQ ID NO: 1491003 - RNA, 22 nt, Human
uguguuuaggaacuacugagga

SEQ ID NO: 1491004 - RNA, 12 nt, Human
uguucuauagcu

SEQ ID NO: 1491005 - RNA, 13 nt, Human
uguucauaaauaa

SEQ ID NO: 1491006 - RNA, 14 nt, Human
uguucauuccucca

SEQ ID NO: 1491007 - RNA, 15 nt, Human
uguucauuccuccag

SEQ ID NO: 1491008 - RNA, 16 nt, Human
uguucauuccuccagg

SEQ ID NO: 1491009 - RNA, 20 nt, Human
uguucaugaaagauucaaug

SEQ ID NO: 1491010 - RNA, 21 nt, Human
uguuggagaagaacugaaauc

SEQ ID NO: 1491011 - RNA, 19 nt, Human
uguugaagagguuuuaaag

SEQ ID NO: 1491012 - RNA, 14 nt, Human
ugucuuuuuucuaa

SEQ ID NO: 1491013 - RNA, 13 nt, Human
ugugaaacauguu

SEQ ID NO: 1491014 - RNA, 16 nt, Human
ugugaaucauuuuacc

SEQ ID NO: 1491015 - RNA, 13 nt, Human
ugugauauaagug

SEQ ID NO: 1491016 - RNA, 19 nt, Human
uguauacuauaguaccagu

SEQ ID NO: 1491017 - RNA, 15 nt, Human
uguauacuauaguac

SEQ ID NO: 1491018 - RNA, 17 nt, Human
uguauacuauaguacca

SEQ ID NO: 1491019 - RNA, 14 nt, Human
uguauacuauagua

SEQ ID NO: 1491020 - RNA, 16 nt, Human
uguaugcacaguaaaa

SEQ ID NO: 1491021 - RNA, 16 nt, Human
uguauuguauauuaca

SEQ ID NO: 1491022 - RNA, 18 nt, Human
uguauuguauauuacaau

SEQ ID NO: 1491023 - RNA, 17 nt, Human
uguagauaauacaguuc

SEQ ID NO: 1491024 - RNA, 22 nt, Human
uuguauucaaaaauuaucuaua

SEQ ID NO: 1491025 - RNA, 14 nt, Human
uuguauucagaguu

SEQ ID NO: 1491026 - RNA, 21 nt, Human
uuguauucagaguugaugguu

SEQ ID NO: 1491027 - RNA, 16 nt, Human
uuguaaaggaauuuaa

SEQ ID NO: 1491028 - RNA, 12 nt, Human
uugguaaaccuu

SEQ ID NO: 1491029 - RNA, 14 nt, Human
uugguaaaccuuuu

SEQ ID NO: 1491030 - RNA, 16 nt, Human
uugccacccucaugcu

SEQ ID NO: 1491031 - RNA, 13 nt, Human
uugccacccucau

SEQ ID NO: 1491032 - RNA, 14 nt, Human
uugcauagaauaaa

SEQ ID NO: 1491033 - RNA, 13 nt, Human
uugaugaagaagu

SEQ ID NO: 1491034 - RNA, 12 nt, Human
uugaugaagaag

SEQ ID NO: 1491035 - RNA, 21 nt, Human
uugauuggugauuagguggug

SEQ ID NO: 1491036 - RNA, 15 nt, Human
uugaggacacugaua

SEQ ID NO: 1491037 - RNA, 14 nt, Human
uugaggacacugau

SEQ ID NO: 1491038 - RNA, 13 nt, Human
uugaggacacaug

SEQ ID NO: 1491039 - RNA, 14 nt, Human
uugaggacacaugu

SEQ ID NO: 1491040 - RNA, 15 nt, Human
uugaggacacauguc

SEQ ID NO: 1491041 - RNA, 16 nt, Human
uugaggacacaugucc

SEQ ID NO: 1491042 - RNA, 11 nt, Human
uugaggacaca

SEQ ID NO: 1491043 - RNA, 21 nt, Human
uugaccugccucccuucaugc

SEQ ID NO: 1491044 - RNA, 23 nt, Human
uugaccugccucccuucaugcau

SEQ ID NO: 1491045 - RNA, 22 nt, Human
uugaccugccucccuucaugca

SEQ ID NO: 1491046 - RNA, 14 nt, Human
uucugagcauuuaa

SEQ ID NO: 1491047 - RNA, 18 nt, Human
uucuccauggcccugcca

SEQ ID NO: 1491048 - RNA, 23 nt, Human
uucucuccucuccccaugauguu

SEQ ID NO: 1491049 - RNA, 17 nt, Human
uucucugauacagaaaa

SEQ ID NO: 1491050 - RNA, 16 nt, Human
uucucugauacagaaa

SEQ ID NO: 1491051 - RNA, 15 nt, Human
uucucugauacagaa

SEQ ID NO: 1491052 - RNA, 14 nt, Human
uucucugauacaga

SEQ ID NO: 1491053 - RNA, 15 nt, Human
uuccuucccugcugu

SEQ ID NO: 1491054 - RNA, 19 nt, Human
uuccuucccugcugugaaa

SEQ ID NO: 1491055 - RNA, 21 nt, Human
uuccuucccugcugugaaaga

SEQ ID NO: 1491056 - RNA, 20 nt, Human
uuccuagguauaauucacau

SEQ ID NO: 1491057 - RNA, 13 nt, Human
uucccuuuccuga

SEQ ID NO: 1491058 - RNA, 14 nt, Human
uucccuucaucugg

SEQ ID NO: 1491059 - RNA, 15 nt, Human
uucccuucaucugga

SEQ ID NO: 1491060 - RNA, 16 nt, Human
uucccuucaucuggaa

SEQ ID NO: 1491061 - RNA, 15 nt, Human
uucaucuaggauuuu

SEQ ID NO: 1491062 - RNA, 22 nt, Human
uucaguuuauuugaaccaauaa

SEQ ID NO: 1491063 - RNA, 18 nt, Human
uucaugaaagauucaaug

SEQ ID NO: 1491064 - RNA, 16 nt, Human
uucaugaccaguaaag

SEQ ID NO: 1491065 - RNA, 11 nt, Human
uucccaaaagc

SEQ ID NO: 1491066 - RNA, 21 nt, Human
uucccaaaagcccauucauuc

SEQ ID NO: 1491067 - RNA, 23 nt, Human
uucaaauuguaagcaugcacaaa

SEQ ID NO: 1491068 - RNA, 15 nt, Human
uuacgugcucugugg

SEQ ID NO: 1491069 - RNA, 19 nt, Human
uucaaugccccugaauuua

SEQ ID NO: 1491070 - RNA, 13 nt, Human
uuuuccugaaaac

SEQ ID NO: 1491071 - RNA, 16 nt, Human
uuuuaugauacuugaa

SEQ ID NO: 1491072 - RNA, 20 nt, Human
uuuuaugauacuugaaaauu

SEQ ID NO: 1491073 - RNA, 10 nt, Human
uuuuauauuu

SEQ ID NO: 1491074 - RNA, 20 nt, Human
uuuuauaugcuucuguuuua

SEQ ID NO: 1491075 - RNA, 15 nt, Human
uuuuauaugcuucug

SEQ ID NO: 1491076 - RNA, 14 nt, Human
uuuuacuguacaga

SEQ ID NO: 1491077 - RNA, 21 nt, Human
uuuuaauuugguuuucacauu

SEQ ID NO: 1491078 - RNA, 17 nt, Human
uuuuaauuugguuuuca

SEQ ID NO: 1491079 - RNA, 22 nt, Human
uuuuacauaaauuuaguauuuu

SEQ ID NO: 1491080 - RNA, 13 nt, Human
uuuuacauuaaau

SEQ ID NO: 1491081 - RNA, 15 nt, Human
uuuuaaaaugagaaa

SEQ ID NO: 1491082 - RNA, 22 nt, Human
uuuuaaaaugagaaaucuaaaa

SEQ ID NO: 1491083 - RNA, 21 nt, Human
uuuguauaaaauaauuuuuau

SEQ ID NO: 1491084 - RNA, 18 nt, Human
uuuggaacccuaaauaau

SEQ ID NO: 1491085 - RNA, 11 nt, Human
uuugcagcuuu

SEQ ID NO: 1491086 - RNA, 19 nt, Human
uuugcauaacguauaaaag

SEQ ID NO: 1491087 - RNA, 23 nt, Human
uuugcauaacguauaaaagccug

SEQ ID NO: 1491088 - RNA, 22 nt, Human
uuucuuacugucuuuuuucuaa

SEQ ID NO: 1491089 - RNA, 21 nt, Human
uuucagauaaucacaauacau

SEQ ID NO: 1491090 - RNA, 15 nt, Human
uuucagcagcugcag

SEQ ID NO: 1491091 - RNA, 15 nt, Human
uuucagauaaucaca

SEQ ID NO: 1491092 - RNA, 16 nt, Human
uuucuaggacugaauu

SEQ ID NO: 1491093 - RNA, 14 nt, Human
uuuaugcauauuau

SEQ ID NO: 1491094 - RNA, 18 nt, Human
uuguauuguauauuacaa

SEQ ID NO: 1491095 - RNA, 19 nt, Human
uuguauuguauauuacaau

SEQ ID NO: 1491096 - RNA, 17 nt, Human
uuuacauggcuggagcu

SEQ ID NO: 1491097 - RNA, 17 nt, Human
uuuacaauaguucugug

SEQ ID NO: 1491098 - RNA, 22 nt, Human
uuuacauggcuggagcuagaau

SEQ ID NO: 1491099 - RNA, 12 nt, Human
uuuagaaacaca

SEQ ID NO: 1491100 - RNA, 20 nt, Human
uuuagaaacacaacuauauu

SEQ ID NO: 1491101 - RNA, 17 nt, Human
uuuagaauaugccuugu

SEQ ID NO: 1491102 - RNA, 12 nt, Human
uuuuuucugaaa

SEQ ID NO: 1491103 - RNA, 20 nt, Human
uuuuuuauacaggaugauga

SEQ ID NO: 1491104 - RNA, 20 nt, Human
uuuugaaaagcagacauuuu

SEQ ID NO: 1491105 - RNA, 13 nt, Human
uuuugaaaaacug

SEQ ID NO: 1491106 - RNA, 13 nt, Human
uuuuuucuuacug

SEQ ID NO: 1491107 - RNA, 15 nt, Human
cucuccccaugaugu

SEQ ID NO: 1491108 - RNA, 18 nt, Human
cucucaauauucaauaaa

SEQ ID NO: 1491109 - RNA, 10 nt, Human
cucucaauau

SEQ ID NO: 1491110 - RNA, 19 nt, Human
cucucaauauucaauaaag

SEQ ID NO: 1491111 - RNA, 21 nt, Human
cucucacuuguuuuauuuaac

SEQ ID NO: 1491112 - RNA, 15 nt, Human
cucuuagaugcaguu

SEQ ID NO: 1491113 - RNA, 21 nt, Human
cucuuagaugcaguucugaag

SEQ ID NO: 1491114 - RNA, 20 nt, Human
cucuuagaugcaguucugaa

SEQ ID NO: 1491115 - RNA, 19 nt, Human
cuccaggguggcagcaaca

SEQ ID NO: 1491116 - RNA, 23 nt, Human
cuccagguauucguuaucuaaua

SEQ ID NO: 1491117 - RNA, 18 nt, Human
cucagccucccaaguaac

SEQ ID NO: 1491118 - RNA, 16 nt, Human
cuccaaagucucugga

SEQ ID NO: 1491119 - RNA, 18 nt, Human
cuccaacccuagcaaaag

SEQ ID NO: 1491120 - RNA, 15 nt, Human
cgagugcucauuuca

SEQ ID NO: 1491121 - RNA, 15 nt, Human
cgccggaucugaggg

SEQ ID NO: 1491122 - RNA, 17 nt, Human
cggagucaaaaauuaaa

SEQ ID NO: 1491123 - RNA, 23 nt, Human
cuaguugaucagcuuauugucua

SEQ ID NO: 1491124 - RNA, 16 nt, Human
cuacaaccuccgccuc

SEQ ID NO: 1491125 - RNA, 11 nt, Human
cuaauuuuugu

SEQ ID NO: 1491126 - RNA, 20 nt, Human
cuaauuuuuguauuuuuagu

SEQ ID NO: 1491127 - RNA, 13 nt, Human
cuaauuuuuuugu

SEQ ID NO: 1491128 - RNA, 18 nt, Human
cuaccucuccagccucag

SEQ ID NO: 1491129 - RNA, 16 nt, Human
cuaagaaacuuaaauu

SEQ ID NO: 1491130 - RNA, 16 nt, Human
ccuauuuccagaaaua

SEQ ID NO: 1491131 - RNA, 15 nt, Human
ccuauuuuaauaaac

SEQ ID NO: 1491132 - RNA, 16 nt, Human
ccguagguuauuuuca

SEQ ID NO: 1491133 - RNA, 18 nt, Human
ccuaagcuggagugcagu

SEQ ID NO: 1491134 - RNA, 19 nt, Human
ccuaagcuggagugcagug

SEQ ID NO: 1491135 - RNA, 14 nt, Human
ccuaauaaagcugu

SEQ ID NO: 1491136 - RNA, 23 nt, Human
ccuaauaaagcuguguggcaguc

SEQ ID NO: 1491137 - RNA, 11 nt, Human
cccucacccau

SEQ ID NO: 1491138 - RNA, 13 nt, Human
cccucacccaucc

SEQ ID NO: 1491139 - RNA, 17 nt, Human
cccucacccauccuaga

SEQ ID NO: 1491140 - RNA, 17 nt, Human
cccuucuuuccacagaa

SEQ ID NO: 1491141 - RNA, 23 nt, Human
ccucucugcaggucccuaauaaa

SEQ ID NO: 1491142 - RNA, 21 nt, Human
ccucucugcaggucccuaaua

SEQ ID NO: 1491143 - RNA, 22 nt, Human
ccucucugcaggucccuaauaa

SEQ ID NO: 1491144 - RNA, 13 nt, Human
ccucucugcaggu

SEQ ID NO: 1491145 - RNA, 15 nt, Human
ccucucugcaggucc

SEQ ID NO: 1491146 - RNA, 23 nt, Human
ccugacccuccaccgcagaagga

SEQ ID NO: 1491147 - RNA, 14 nt, Human
cccacugccuuuga

SEQ ID NO: 1491148 - RNA, 13 nt, Human
cccacuucagccu

SEQ ID NO: 1491149 - RNA, 15 nt, Human
cccacuucagccucc

SEQ ID NO: 1491150 - RNA, 22 nt, Human
cccacccucguggacaccugcc

SEQ ID NO: 1491151 - RNA, 23 nt, Human
cccacccucguggacaccugccc

SEQ ID NO: 1491152 - RNA, 20 nt, Human
cccacccucguggacaccug

SEQ ID NO: 1491153 - RNA, 14 nt, Human
cccauccuagaggc

SEQ ID NO: 1491154 - RNA, 18 nt, Human
ccagcagauuuccagccu

SEQ ID NO: 1491155 - RNA, 17 nt, Human
ccaggaagaucccccag

SEQ ID NO: 1491156 - RNA, 18 nt, Human
ccaggaagaucccccaga

SEQ ID NO: 1491157 - RNA, 19 nt, Human
ccaggaagaucccccagaa

SEQ ID NO: 1491158 - RNA, 20 nt, Human
ccaggaaagcgccuccaacc

SEQ ID NO: 1491159 - RNA, 15 nt, Human
ccagauccuggaaau

SEQ ID NO: 1491160 - RNA, 18 nt, Human
ccagagugcugaaggaau

SEQ ID NO: 1491161 - RNA, 12 nt, Human
ccaaauuaagag

SEQ ID NO: 1491162 - RNA, 18 nt, Human
ccaaagugcugggauuaa

SEQ ID NO: 1491163 - RNA, 22 nt, Human
cauggcuggagcuagaauuuga

SEQ ID NO: 1491164 - RNA, 12 nt, Human
cauuuccaagca

SEQ ID NO: 1491165 - RNA, 21 nt, Human
caugauugguuucuaggcagu

SEQ ID NO: 1491166 - RNA, 14 nt, Human
caugaauuugugaa

SEQ ID NO: 1491167 - RNA, 16 nt, Human
caugaauuaguuuuau

SEQ ID NO: 1491168 - RNA, 14 nt, Human
caugaccaguaaag

SEQ ID NO: 1491169 - RNA, 14 nt, Human
cauccuugagucaa

SEQ ID NO: 1491170 - RNA, 11 nt, Human
caucagcaaac

SEQ ID NO: 1491171 - RNA, 17 nt, Human
cagagcuggagaugagg

SEQ ID NO: 1491172 - RNA, 21 nt, Human
cagagcuggagaugaggccag

SEQ ID NO: 1491173 - RNA, 22 nt, Human
cagagcuggagaugaggccaga

SEQ ID NO: 1491174 - RNA, 23 nt, Human
cagagcuggagaugaggccagac

SEQ ID NO: 1491175 - RNA, 22 nt, Human
cagaucauugugaaauuauuca

SEQ ID NO: 1491176 - RNA, 16 nt, Human
cagaucauugugaaau

SEQ ID NO: 1491177 - RNA, 21 nt, Human
cagcccccacugccuuugacc

SEQ ID NO: 1491178 - RNA, 24 nt, Human
caggacagcccuucuuuccacaga

SEQ ID NO: 1491179 - RNA, 23 nt, Human
caggacagcccuucuuuccacag

SEQ ID NO: 1491180 - RNA, 21 nt, Human
cagggaggaggcagagaagaa

SEQ ID NO: 1491181 - RNA, 15 nt, Human
cagggaggaggcaga

SEQ ID NO: 1491182 - RNA, 12 nt, Human
caggguggcagc

SEQ ID NO: 1491183 - RNA, 15 nt, Human
caagcuauucaauuc

SEQ ID NO: 1491184 - RNA, 15 nt, Human
caauaaagcugcuga

SEQ ID NO: 1491185 - RNA, 17 nt, Human
caauaaagcugcugaga

SEQ ID NO: 1491186 - RNA, 23 nt, Human
caauaaagcugcugagaaucuag

SEQ ID NO: 1491187 - RNA, 22 nt, Human
caauaaagcugcugagaaucua

SEQ ID NO: 1491188 - RNA, 18 nt, Human
cacaagacugcacaucaa

SEQ ID NO: 1491189 - RNA, 15 nt, Human
caauucuugccaaau

SEQ ID NO: 1491190 - RNA, 21 nt, Human
caauucuucccuaucuuugcc

SEQ ID NO: 1491191 - RNA, 20 nt, Human
caauucuucccuaucuuugc

SEQ ID NO: 1491192 - RNA, 22 nt, Human
caauucuucccuaucuuugcca

SEQ ID NO: 1491193 - RNA, 19 nt, Human
caauucuuuuaacuguugu

SEQ ID NO: 1491194 - RNA, 11 nt, Human
caauuuaaaug

SEQ ID NO: 1491195 - RNA, 13 nt, Human
caauuuaaauguu

SEQ ID NO: 1491196 - RNA, 14 nt, Human
caauuuaaauguua

SEQ ID NO: 1491197 - RNA, 17 nt, Human
caaugcuguauuuuaaa

SEQ ID NO: 1491198 - RNA, 16 nt, Human
caaugcuguauuuuaa

SEQ ID NO: 1491199 - RNA, 15 nt, Human
caaugcuguauuuua

SEQ ID NO: 1491200 - RNA, 21 nt, Human
cacagccucuuagaugcaguu

SEQ ID NO: 1491201 - RNA, 17 nt, Human
cacagccucuuagaugc

SEQ ID NO: 1491202 - RNA, 21 nt, Human
cacaguaaaaauggaaacuau

SEQ ID NO: 1491203 - RNA, 22 nt, Human
cacacaugaaguccaagcauuu

SEQ ID NO: 1491204 - RNA, 17 nt, Human
cacacaugaaguccaag

SEQ ID NO: 1491205 - RNA, 13 nt, Human
cacccucaugcug

SEQ ID NO: 1491206 - RNA, 14 nt, Human
cacccucaugcugu

SEQ ID NO: 1491207 - RNA, 16 nt, Human
cacccucaugcugugu

SEQ ID NO: 1491208 - RNA, 21 nt, Human
cacccucaugcugugugacuc

SEQ ID NO: 1491209 - RNA, 21 nt, Human
cacccucguggacaccugccc

SEQ ID NO: 1491210 - RNA, 23 nt, Human
cacccucguggacaccugcccug

SEQ ID NO: 1491211 - RNA, 20 nt, Human
cacccucguggacaccugcc

SEQ ID NO: 1491212 - RNA, 17 nt, Human
caccugcccugcccugc

SEQ ID NO: 1491213 - RNA, 18 nt, Human
caccugcccugcccugcc

SEQ ID NO: 1491214 - RNA, 19 nt, Human
caccugcccugcccugcca

SEQ ID NO: 1491215 - RNA, 20 nt, Human
caccugcccugcccugccac

SEQ ID NO: 1491216 - RNA, 21 nt, Human
caccugcccugcccugccacc

SEQ ID NO: 1491217 - RNA, 22 nt, Human
caccugcccugcccugccaccu

SEQ ID NO: 1491218 - RNA, 23 nt, Human
caccugcccugcccugccaccug

SEQ ID NO: 1491219 - RNA, 14 nt, Human
cacuaguauuucua

SEQ ID NO: 1491220 - RNA, 14 nt, Human
cacucuuucuuuca

SEQ ID NO: 1491221 - RNA, 15 nt, Human
cacucuuucuuucaa

SEQ ID NO: 1491222 - RNA, 19 nt, Human
cacuuguguuuugcaagcc

SEQ ID NO: 1491223 - RNA, 16 nt, Human
cacuugucaauaaaau

SEQ ID NO: 1491224 - RNA, 22 nt, Human
cacuuguguuuugcaagccaga

SEQ ID NO: 1491225 - RNA, 18 nt, Human
cacugggagaaaugaaaa

SEQ ID NO: 1491226 - RNA, 17 nt, Human
cacugggacuugcaaaa

SEQ ID NO: 1491227 - RNA, 21 nt, Human
caaagucucuggaauuugaaa

SEQ ID NO: 1491228 - RNA, 14 nt, Human
caacacuaacauga

SEQ ID NO: 1491229 - RNA, 15 nt, Human
caaauccuugaagau

SEQ ID NO: 1491230 - RNA, 12 nt, Human
caacaauaaaua

SEQ ID NO: 1491231 - RNA, 20 nt, Human
caaacaggaucaguuaacua

SEQ ID NO: 1491232 - RNA, 17 nt, Human
auuugcucauggaauug

SEQ ID NO: 1491233 - RNA, 14 nt, Human
auuugcucauggaa

SEQ ID NO: 1491234 - RNA, 19 nt, Human
auuuuauagcuacuaauuu

SEQ ID NO: 1491235 - RNA, 21 nt, Human
auucauaauuauuauuuggcc

SEQ ID NO: 1491236 - RNA, 18 nt, Human
auuaugaaacuuuuggaa

SEQ ID NO: 1491237 - RNA, 17 nt, Human
auuaugaauuacauuug

SEQ ID NO: 1491238 - RNA, 14 nt, Human
auuaugaauuacau

SEQ ID NO: 1491239 - RNA, 18 nt, Human
auuaugaauuacauuugu

SEQ ID NO: 1491240 - RNA, 20 nt, Human
auucaaugccccugaauuua

SEQ ID NO: 1491241 - RNA, 18 nt, Human
auucaaugccccugaauu

SEQ ID NO: 1491242 - RNA, 18 nt, Human
auucaaauguauuacagu

SEQ ID NO: 1491243 - RNA, 16 nt, Human
auucaaauguauuaca

SEQ ID NO: 1491244 - RNA, 15 nt, Human
auuacaacggaguca

SEQ ID NO: 1491245 - RNA, 17 nt, Human
auuacaacggagucaaa

SEQ ID NO: 1491246 - RNA, 22 nt, Human
auuaauuccuucagcacuuuag

SEQ ID NO: 1491247 - RNA, 19 nt, Human
auuacaguggggaaugaag

SEQ ID NO: 1491248 - RNA, 18 nt, Human
auuagcagucccuccaca

SEQ ID NO: 1491249 - RNA, 23 nt, Human
ggccccacccucguggacaccug

SEQ ID NO: 1491250 - RNA, 18 nt, Human
ggccaggcuugucucgaa

SEQ ID NO: 1491251 - RNA, 16 nt, Human
ggcacuggcgaggaga

SEQ ID NO: 1491252 - RNA, 18 nt, Human
ggaggaaggaggacccag

SEQ ID NO: 1491253 - RNA, 12 nt, Human
ggaggacccagg

SEQ ID NO: 1491254 - RNA, 13 nt, Human
ggaggacccagga

SEQ ID NO: 1491255 - RNA, 17 nt, Human
ggaggugagaccaccuc

SEQ ID NO: 1491256 - RNA, 17 nt, Human
ggcaauuaauuccuuca

SEQ ID NO: 1491257 - RNA, 20 nt, Human
ggcaauuaauuccuucagca

SEQ ID NO: 1491258 - RNA, 19 nt, Human
ggcaauuaauuccuucagc

SEQ ID NO: 1491259 - RNA, 14 nt, Human
ggcacacaccacca

SEQ ID NO: 1491260 - RNA, 12 nt, Human
ggagugcagugg

SEQ ID NO: 1491261 - RNA, 16 nt, Human
aaaacauuccauccuu

SEQ ID NO: 1491262 - RNA, 15 nt, Human
aaaacccagauaaag

SEQ ID NO: 1491263 - RNA, 21 nt, Human
gggacauuugcucauggaauu

SEQ ID NO: 1491264 - RNA, 20 nt, Human
gggacauuugcucauggaau

SEQ ID NO: 1491265 - RNA, 15 nt, Human
aaaaauauauacuaa

SEQ ID NO: 1491266 - RNA, 22 nt, Human
gggaggcucuggagcccacugu

SEQ ID NO: 1491267 - RNA, 14 nt, Human
aaaagcagacauuu

SEQ ID NO: 1491268 - RNA, 13 nt, Human
aaaagcagacauu

SEQ ID NO: 1491269 - RNA, 19 nt, Human
aaaaguauguuagugcaaa

SEQ ID NO: 1491270 - RNA, 21 nt, Human
gggccaggcugggucgcccug

SEQ ID NO: 1491271 - RNA, 14 nt, Human
gggccaggcugggu

SEQ ID NO: 1491272 - RNA, 15 nt, Human
gggccaggcuggguc

SEQ ID NO: 1491273 - RNA, 12 nt, Human
gggcuaccagga

SEQ ID NO: 1491274 - RNA, 15 nt, Human
gggcuaccaggaaag

SEQ ID NO: 1491275 - RNA, 20 nt, Human
aaacaagcacuaaacaaaga

SEQ ID NO: 1491276 - RNA, 15 nt, Human
aaacacccucacacu

SEQ ID NO: 1491277 - RNA, 18 nt, Human
gguaaguuuuuugaaauu

SEQ ID NO: 1491278 - RNA, 18 nt, Human
ggguggggggggugcugg

SEQ ID NO: 1491279 - RNA, 23 nt, Human
gguaugaacuugaggacacaugu

SEQ ID NO: 1491280 - RNA, 21 nt, Human
gguaugaacuugaggacacau

SEQ ID NO: 1491281 - RNA, 22 nt, Human
gguaugaacuugaggacacaug

SEQ ID NO: 1491282 - RNA, 19 nt, Human
aaagcaggcagaacucauc

SEQ ID NO: 1491283 - RNA, 17 nt, Human
aaagcaggcagaacuca

SEQ ID NO: 1491284 - RNA, 12 nt, Human
aaagcaucccuc

SEQ ID NO: 1491285 - RNA, 15 nt, Human
aaagcaucccucacc

SEQ ID NO: 1491286 - RNA, 17 nt, Human
aaagcaucccucaccca

SEQ ID NO: 1491287 - RNA, 24 nt, Human
aaagcaucccucacccauccuaga

SEQ ID NO: 1491288 - RNA, 20 nt, Human
ggugcugggccccugccucu

SEQ ID NO: 1491289 - RNA, 13 nt, Human
ggucggaccagcu

SEQ ID NO: 1491290 - RNA, 14 nt, Human
ggucggaccagcuu

SEQ ID NO: 1491291 - RNA, 17 nt, Human
gguggggggggugcugg

SEQ ID NO: 1491292 - RNA, 16 nt, Human
aaagccuguuuaagag

SEQ ID NO: 1491293 - RNA, 18 nt, Human
aaagccuguuuaagagac

SEQ ID NO: 1491294 - RNA, 19 nt, Human
gguuucaccauguuggcca

SEQ ID NO: 1491295 - RNA, 16 nt, Human
aaaguuuguugaaaca

SEQ ID NO: 1491296 - RNA, 16 nt, Human
aaaguugaauuuuaca

SEQ ID NO: 1491297 - RNA, 20 nt, Human
gguuuggacaaaauggaaua

SEQ ID NO: 1491298 - RNA, 19 nt, Human
aaauaaugaauacauuucc

SEQ ID NO: 1491299 - RNA, 20 nt, Human
aaauaauuuuuauauuugaa

SEQ ID NO: 1491300 - RNA, 18 nt, Human
aaauaauuuuuauauuug

SEQ ID NO: 1491301 - RNA, 15 nt, Human
aaauaauuuuuauau

SEQ ID NO: 1491302 - RNA, 18 nt, Human
gcuggagaugaggccaga

SEQ ID NO: 1491303 - RNA, 20 nt, Human
gcuggagaugaggccagacc

SEQ ID NO: 1491304 - RNA, 21 nt, Human
gcuggagaugaggccagacca

SEQ ID NO: 1491305 - RNA, 15 nt, Human
gcucuggagcccacu

SEQ ID NO: 1491306 - RNA, 16 nt, Human
gcucuggagcccacug

SEQ ID NO: 1491307 - RNA, 17 nt, Human
gcucuggagcccacugu

SEQ ID NO: 1491308 - RNA, 17 nt, Human
gcugaauuucccucucu

SEQ ID NO: 1491309 - RNA, 24 nt, Human
gcugaauuucccucucucauaccc

SEQ ID NO: 1491310 - RNA, 20 nt, Human
gcuggagugcaguggcgcga

SEQ ID NO: 1491311 - RNA, 13 nt, Human
gcuguauuuuaaa

SEQ ID NO: 1491312 - RNA, 12 nt, Human
gcuguauuuuaa

SEQ ID NO: 1491313 - RNA, 13 nt, Human
gcuguuuuuuugu

SEQ ID NO: 1491314 - RNA, 14 nt, Human
gcuuaauucaaaua

SEQ ID NO: 1491315 - RNA, 15 nt, Human
gcuuaauucaaauaa

SEQ ID NO: 1491316 - RNA, 16 nt, Human
gcuucaaauuguaagc

SEQ ID NO: 1491317 - RNA, 19 nt, Human
gcuuccuggcaauagucaa

SEQ ID NO: 1491318 - RNA, 19 nt, Human
ggaaauucccuucaucugg

SEQ ID NO: 1491319 - RNA, 22 nt, Human
ggaaauucccuucaucuggaac

SEQ ID NO: 1491320 - RNA, 20 nt, Human
ggaaauucccuucaucugga

SEQ ID NO: 1491321 - RNA, 18 nt, Human
ggaaaccuuccacccagu

SEQ ID NO: 1491322 - RNA, 21 nt, Human
ggaaacuaggugcauauuuau

SEQ ID NO: 1491323 - RNA, 20 nt, Human
ggaagaagagaucaggaaga

SEQ ID NO: 1491324 - RNA, 21 nt, Human
ggaagaagagaucaggaagag

SEQ ID NO: 1491325 - RNA, 22 nt, Human
ggaagaagagaucaggaagaga

SEQ ID NO: 1491326 - RNA, 15 nt, Human
gcuuuuuuaucaugu

SEQ ID NO: 1491327 - RNA, 18 nt, Human
gcuuuuuuaucaugugaa

SEQ ID NO: 1491328 - RNA, 20 nt, Human
gcuuuuuuaucaugugaaau

SEQ ID NO: 1491329 - RNA, 17 nt, Human
ggaaaccuuccacccag

SEQ ID NO: 1491330 - RNA, 22 nt, Human
gcuuuuuucucugauacagaaa

SEQ ID NO: 1491331 - RNA, 19 nt, Human
gcgagauaccccaccuccc

SEQ ID NO: 1491332 - RNA, 23 nt, Human
gcgauucuccugccucagccucc

SEQ ID NO: 1491333 - RNA, 12 nt, Human
gcgugaucucag

SEQ ID NO: 1491334 - RNA, 15 nt, Human
gcgugaucucagcuc

SEQ ID NO: 1491335 - RNA, 16 nt, Human
gcgugaucucagcuca

SEQ ID NO: 1491336 - RNA, 23 nt, Human
gcggaggaaggaggacccaggac

SEQ ID NO: 1491337 - RNA, 18 nt, Human
gcuaauuuugaaaaacug

SEQ ID NO: 1491338 - RNA, 18 nt, Human
gcuacuguaaggcaauca

SEQ ID NO: 1491339 - RNA, 19 nt, Human
gcuacuguaaggcaaucau

SEQ ID NO: 1491340 - RNA, 16 nt, Human
gccuccaacccuagca

SEQ ID NO: 1491341 - RNA, 20 nt, Human
gccuccaacccuagcaaaag

SEQ ID NO: 1491342 - RNA, 16 nt, Human
gccauaugaaaaggcu

SEQ ID NO: 1491343 - RNA, 16 nt, Human
gcccauucauuccauu

SEQ ID NO: 1491344 - RNA, 19 nt, Human
gcccauucauuccauucug

SEQ ID NO: 1491345 - RNA, 23 nt, Human
gcccauucauuccauucuggaag

SEQ ID NO: 1491346 - RNA, 17 nt, Human
gccccugccucucugca

SEQ ID NO: 1491347 - RNA, 18 nt, Human
gccccugccucucugcag

SEQ ID NO: 1491348 - RNA, 15 nt, Human
gccccugccucucug

SEQ ID NO: 1491349 - RNA, 16 nt, Human
gccccugccucucugc

SEQ ID NO: 1491350 - RNA, 20 nt, Human
gccccacccucguggacacc

SEQ ID NO: 1491351 - RNA, 21 nt, Human
gccccacccucguggacaccu

SEQ ID NO: 1491352 - RNA, 22 nt, Human
gccccacccucguggacaccug

SEQ ID NO: 1491353 - RNA, 23 nt, Human
gccccacccucguggacaccugc

SEQ ID NO: 1491354 - RNA, 22 nt, Human
gccaugugcuaguaauuggaaa

SEQ ID NO: 1491355 - RNA, 14 nt, Human
gagauguagccccu

SEQ ID NO: 1491356 - RNA, 15 nt, Human
gacugaaaauauugu

SEQ ID NO: 1491357 - RNA, 17 nt, Human
gacuggguaggaaagag

SEQ ID NO: 1491358 - RNA, 21 nt, Human
gacuggguaggaaagaggaag

SEQ ID NO: 1491359 - RNA, 16 nt, Human
gacucuuaagaagacu

SEQ ID NO: 1491360 - RNA, 18 nt, Human
gacucuuaagaagacugc

SEQ ID NO: 1491361 - RNA, 17 nt, Human
gacucuuaagaagacug

SEQ ID NO: 1491362 - RNA, 23 nt, Human
gaaugagagacacacugaagaag

SEQ ID NO: 1491363 - RNA, 22 nt, Human
gaaugagagacacacugaagaa

SEQ ID NO: 1491364 - RNA, 13 nt, Human
gaaugagacaucc

SEQ ID NO: 1491365 - RNA, 15 nt, Human
gaaugagacauccag

SEQ ID NO: 1491366 - RNA, 20 nt, Human
gaaugagagacacacugaag

SEQ ID NO: 1491367 - RNA, 13 nt, Human
gaagggcaaguuu

SEQ ID NO: 1491368 - RNA, 13 nt, Human
gaagugacuuugg

SEQ ID NO: 1491369 - RNA, 15 nt, Human
gaagugacuuuggcu

SEQ ID NO: 1491370 - RNA, 20 nt, Human
gaagugacuuuggcugcaug

SEQ ID NO: 1491371 - RNA, 21 nt, Human
gaagugacuuuggcugcaugc

SEQ ID NO: 1491372 - RNA, 12 nt, Human
gacacacaugaa

SEQ ID NO: 1491373 - RNA, 13 nt, Human
gacacacugaaga

SEQ ID NO: 1491374 - RNA, 14 nt, Human
gacacacugaagaa

SEQ ID NO: 1491375 - RNA, 15 nt, Human
gacaaaauggaauac

SEQ ID NO: 1491376 - RNA, 12 nt, Human
gaauuaugaaac

SEQ ID NO: 1491377 - RNA, 11 nt, Human
gaauuaguuuu

SEQ ID NO: 1491378 - RNA, 17 nt, Human
gacagucaccucaugga

SEQ ID NO: 1491379 - RNA, 14 nt, Human
gacagugaaagaaa

SEQ ID NO: 1491380 - RNA, 14 nt, Human
gauaugugaacagu

SEQ ID NO: 1491381 - RNA, 13 nt, Human
gauaugugaacag

SEQ ID NO: 1491382 - RNA, 16 nt, Human
gauacuugaaaauuaa

SEQ ID NO: 1491383 - RNA, 17 nt, Human
gauacuugaaaauuaac

SEQ ID NO: 1491384 - RNA, 19 nt, Human
gagugcugaaggaauggaa

SEQ ID NO: 1491385 - RNA, 16 nt, Human
gaguuuagcuggaaaa

SEQ ID NO: 1491386 - RNA, 18 nt, Human
gauuacugccuauuuuaa

SEQ ID NO: 1491387 - RNA, 22 nt, Human
gauuacaggugugagccaccac

SEQ ID NO: 1491388 - RNA, 23 nt, Human
gauccaggccggcuugccacacc

SEQ ID NO: 1491389 - RNA, 18 nt, Human
gcagagcugauggagaag

SEQ ID NO: 1491390 - RNA, 16 nt, Human
gcagagccaggaagau

SEQ ID NO: 1491391 - RNA, 22 nt, Human
gcauaacguauaaaagccuguu

SEQ ID NO: 1491392 - RNA, 18 nt, Human
gcacuuuagaauaugccu

SEQ ID NO: 1491393 - RNA, 19 nt, Human
gcacuuuagaauaugccuu

SEQ ID NO: 1491394 - RNA, 20 nt, Human
gcacuuuagaauaugccuug

SEQ ID NO: 1491395 - RNA, 19 nt, Human
gcagaaagcaucccucacc

SEQ ID NO: 1491396 - RNA, 20 nt, Human
gcagaaagcaucccucaccc

SEQ ID NO: 1491397 - RNA, 14 nt, Human
gcagagccaggaag

SEQ ID NO: 1491398 - RNA, 15 nt, Human
gcagagccaggaaga

SEQ ID NO: 1491399 - RNA, 18 nt, Human
cuuuuggaagguauuuaa

SEQ ID NO: 1491400 - RNA, 19 nt, Human
cuuuuguagaagucacauu

SEQ ID NO: 1491401 - RNA, 15 nt, Human
cuuuuggcauuuuac

SEQ ID NO: 1491402 - RNA, 13 nt, Human
gaaaaaaaauuau

SEQ ID NO: 1491403 - RNA, 15 nt, Human
gaaacuuuuggaagg

SEQ ID NO: 1491404 - RNA, 13 nt, Human
gaaacuuuuggaa

SEQ ID NO: 1491405 - RNA, 17 nt, Human
gaaauauuuauuuuaau

SEQ ID NO: 1491406 - RNA, 22 nt, Human
gaaauauuuauuuuaauaaugu

SEQ ID NO: 1491407 - RNA, 18 nt, Human
gaaauauuuauuuuaaua

SEQ ID NO: 1491408 - RNA, 13 nt, Human
cuuuguaaugaaa

SEQ ID NO: 1491409 - RNA, 14 nt, Human
cuuuuaugugaaac

SEQ ID NO: 1491410 - RNA, 18 nt, Human
cuuuuaugugaaacaugu

SEQ ID NO: 1491411 - RNA, 18 nt, Human
cuuuccugagucccaucc

SEQ ID NO: 1491412 - RNA, 20 nt, Human
cuuuccugagucccaucccu

SEQ ID NO: 1491413 - RNA, 22 nt, Human
cuuuccugagucccaucccugc

SEQ ID NO: 1491414 - RNA, 12 nt, Human
cuugaugaagaa

SEQ ID NO: 1491415 - RNA, 13 nt, Human
cuugaugaagaag

SEQ ID NO: 1491416 - RNA, 12 nt, Human
cuugaugccugg

SEQ ID NO: 1491417 - RNA, 13 nt, Human
cuugaugccuggc

SEQ ID NO: 1491418 - RNA, 14 nt, Human
cuuaugcuuaaauu

SEQ ID NO: 1491419 - RNA, 14 nt, Human
cuuauuauuuuuga

SEQ ID NO: 1491420 - RNA, 16 nt, Human
cuuauuauuuuugaga

SEQ ID NO: 1491421 - RNA, 20 nt, Human
cuuauuguagcauccuggaa

SEQ ID NO: 1491422 - RNA, 23 nt, Human
cuuauuguagcauccuggaauau

SEQ ID NO: 1491423 - RNA, 13 nt, Human
cuucaugcaugga

SEQ ID NO: 1491424 - RNA, 15 nt, Human
cuucaugcauggaaa

SEQ ID NO: 1491425 - RNA, 11 nt, Human
cuucaucugga

SEQ ID NO: 1491426 - RNA, 12 nt, Human
cuucaucuggaa

SEQ ID NO: 1491427 - RNA, 13 nt, Human
cuucaucuggaac

SEQ ID NO: 1491428 - RNA, 15 nt, Human
cuucaucuggaacca

SEQ ID NO: 1491429 - RNA, 19 nt, Human
cuucaucuggauuccagag

SEQ ID NO: 1491430 - RNA, 15 nt, Human
cuucacuguaaaaua

SEQ ID NO: 1491431 - RNA, 16 nt, Human
cuggacugugugcuca

SEQ ID NO: 1491432 - RNA, 10 nt, Human
cugggacagg

SEQ ID NO: 1491433 - RNA, 18 nt, Human
cuggggccaggcuggguc

SEQ ID NO: 1491434 - RNA, 16 nt, Human
cuggugcacuggcccc

SEQ ID NO: 1491435 - RNA, 19 nt, Human
cuggugcacuggccccacc

SEQ ID NO: 1491436 - RNA, 22 nt, Human
cugucacccagguuggagugca

SEQ ID NO: 1491437 - RNA, 13 nt, Human
cuguaaaacuaag

SEQ ID NO: 1491438 - RNA, 17 nt, Human
cuguaaaauaaaagguc

SEQ ID NO: 1491439 - RNA, 22 nt, Human
cuguacuugcucuugaugccug

SEQ ID NO: 1491440 - RNA, 23 nt, Human
cuguacuugcucuugaugccugg

SEQ ID NO: 1491441 - RNA, 17 nt, Human
cugcuuuuuauggccug

SEQ ID NO: 1491442 - RNA, 18 nt, Human
cugcuuuuuauggccugu

SEQ ID NO: 1491443 - RNA, 21 nt, Human
cuggaaaucaggguuaguauu

SEQ ID NO: 1491444 - RNA, 15 nt, Human
cuggaaccaucagaa

SEQ ID NO: 1491445 - RNA, 16 nt, Human
cuggaaccaucagaaa

SEQ ID NO: 1491446 - RNA, 13 nt, Human
cuggacugugugc

SEQ ID NO: 1491447 - RNA, 15 nt, Human
cugcuacaauguccu

SEQ ID NO: 1491448 - RNA, 18 nt, Human
aacuuccagauccuggaa

SEQ ID NO: 1491449 - RNA, 19 nt, Human
aacugcuaaucuacuuucu

SEQ ID NO: 1491450 - RNA, 17 nt, Human
aacugggacaggggaga

SEQ ID NO: 1491451 - RNA, 16 nt, Human
aacuggggcuccucca

SEQ ID NO: 1491452 - RNA, 16 nt, Human
aacucuucaaggucug

SEQ ID NO: 1491453 - RNA, 19 nt, Human
aacucuucaaggucugcuu

SEQ ID NO: 1491454 - RNA, 13 nt, Human
aacugaaaucaua

SEQ ID NO: 1491455 - RNA, 12 nt, Human
aacugaaaucau

SEQ ID NO: 1491456 - RNA, 14 nt, Human
aacccagauaaagg

SEQ ID NO: 1491457 - RNA, 24 nt, Human
aaccucuaaauucuuucauuuuag

SEQ ID NO: 1491458 - RNA, 12 nt, Human
aaccucuaaauu

SEQ ID NO: 1491459 - RNA, 14 nt, Human
aaccucauccucuc

SEQ ID NO: 1491460 - RNA, 20 nt, Human
aaccaagugaucaaacuaca

SEQ ID NO: 1491461 - RNA, 21 nt, Human
aacuagaguuuagcuggaaaa

SEQ ID NO: 1491462 - RNA, 16 nt, Human
gucuuucacauuuaaa

SEQ ID NO: 1491463 - RNA, 14 nt, Human
gucugucugucugu

SEQ ID NO: 1491464 - RNA, 16 nt, Human
gucugucugucugucc

SEQ ID NO: 1491465 - RNA, 17 nt, Human
aacacaacuauauuguu

SEQ ID NO: 1491466 - RNA, 24 nt, Human
guccagugggaggugagaccaccu

SEQ ID NO: 1491467 - RNA, 15 nt, Human
guccaguguuucuuu

SEQ ID NO: 1491468 - RNA, 15 nt, Human
aacaaugcuguauuu

SEQ ID NO: 1491469 - RNA, 12 nt, Human
aacaauaaaaga

SEQ ID NO: 1491470 - RNA, 16 nt, Human
aacacaacuauauugu

SEQ ID NO: 1491471 - RNA, 15 nt, Human
aacacaacuauauug

SEQ ID NO: 1491472 - RNA, 22 nt, Human
aacaaugcuguauuuuaaaaga

SEQ ID NO: 1491473 - RNA, 17 nt, Human
aacaaugcuguauuuua

SEQ ID NO: 1491474 - RNA, 20 nt, Human
aaauuuuuguaguagcguuu

SEQ ID NO: 1491475 - RNA, 20 nt, Human
aaauuuuuucucuaggaaau

SEQ ID NO: 1491476 - RNA, 13 nt, Human
gucagaauagaaa

SEQ ID NO: 1491477 - RNA, 17 nt, Human
gucagaauagaaauuag

SEQ ID NO: 1491478 - RNA, 12 nt, Human
aaauuugccaag

SEQ ID NO: 1491479 - RNA, 20 nt, Human
aaauggucucuaacauuucc

SEQ ID NO: 1491480 - RNA, 20 nt, Human
guaguguuggagaagaacug

SEQ ID NO: 1491481 - RNA, 17 nt, Human
guaguugccuuaaaaua

SEQ ID NO: 1491482 - RNA, 19 nt, Human
guauaaaagggacugagaa

SEQ ID NO: 1491483 - RNA, 21 nt, Human
guauaaaauaauuuuuauauu

SEQ ID NO: 1491484 - RNA, 15 nt, Human
guauaaaauaauuuu

SEQ ID NO: 1491485 - RNA, 14 nt, Human
aaauuaagaaagga

SEQ ID NO: 1491486 - RNA, 15 nt, Human
aaauguauuacagug

SEQ ID NO: 1491487 - RNA, 18 nt, Human
guauguacuucaugcugu

SEQ ID NO: 1491488 - RNA, 17 nt, Human
gucaacacuaacaugau

SEQ ID NO: 1491489 - RNA, 22 nt, Human
aaauuuauuucaauauuagcaa

SEQ ID NO: 1491490 - RNA, 16 nt, Human
aaauucugucucugga

SEQ ID NO: 1491491 - RNA, 19 nt, Human
aaauuguaagcaugcacaa

SEQ ID NO: 1491492 - RNA, 18 nt, Human
aaauucugucucuggauu

SEQ ID NO: 1491493 - RNA, 20 nt, Human
aaauuguaagcaugcacaaa

SEQ ID NO: 1491494 - RNA, 17 nt, Human
aagacugcauuauauuu

SEQ ID NO: 1491495 - RNA, 16 nt, Human
aagacugcacaucaaa

SEQ ID NO: 1491496 - RNA, 19 nt, Human
aagaggaauuacgugcucu

SEQ ID NO: 1491497 - RNA, 16 nt, Human
aagcuagcaaauagua

SEQ ID NO: 1491498 - RNA, 20 nt, Human
aagcucacagaccuuugaac

SEQ ID NO: 1491499 - RNA, 14 nt, Human
aagcuccagguaga

SEQ ID NO: 1491500 - RNA, 13 nt, Human
aagcuccagguag

SEQ ID NO: 1491501 - RNA, 23 nt, Human
guuagggaaaacauuccauccuu

SEQ ID NO: 1491502 - RNA, 15 nt, Human
guuagggaaaacauu

SEQ ID NO: 1491503 - RNA, 20 nt, Human
guuagggaaaacauuccauc

SEQ ID NO: 1491504 - RNA, 16 nt, Human
aagcccauucauucca

SEQ ID NO: 1491505 - RNA, 21 nt, Human
aagcccauucauuccauucug

SEQ ID NO: 1491506 - RNA, 23 nt, Human
aagcccauucauuccauucugga

SEQ ID NO: 1491507 - RNA, 16 nt, Human
aagcauuuagauguau

SEQ ID NO: 1491508 - RNA, 13 nt, Human
aagcaucccucac

SEQ ID NO: 1491509 - RNA, 14 nt, Human
aagcaucccucacc

SEQ ID NO: 1491510 - RNA, 23 nt, Human
aagcaucccucacccauccuaga

SEQ ID NO: 1491511 - RNA, 15 nt, Human
guuuuucauaaagca

SEQ ID NO: 1491512 - RNA, 16 nt, Human
aagucuuucacauuua

SEQ ID NO: 1491513 - RNA, 19 nt, Human
aaguaaugauaacuggaaa

SEQ ID NO: 1491514 - RNA, 14 nt, Human
aaguaaugauaacu

SEQ ID NO: 1491515 - RNA, 13 nt, Human
aaguauuagaaua

SEQ ID NO: 1491516 - RNA, 21 nt, Human
aagugaucaaacuacauauug

SEQ ID NO: 1491517 - RNA, 20 nt, Human
uaaaauaauuuuuauauuug

SEQ ID NO: 1491518 - RNA, 22 nt, Human
uaaaauaauuuuaucucuuucu

SEQ ID NO: 1491519 - RNA, 20 nt, Human
uaaaagacagugaaagaaaa

SEQ ID NO: 1491520 - RNA, 18 nt, Human
uaaaaauaaaaaacacug

SEQ ID NO: 1491521 - RNA, 19 nt, Human
uaaaaauaaaaaacacugg

SEQ ID NO: 1491522 - RNA, 21 nt, Human
uaaaaauaaaaaacacuggga

SEQ ID NO: 1491523 - RNA, 16 nt, Human
uaaaaauaaacauguu

SEQ ID NO: 1491524 - RNA, 18 nt, Human
uaaaacgcaguugcaaac

SEQ ID NO: 1491525 - RNA, 12 nt, Human
uaaaagaaugau

SEQ ID NO: 1491526 - RNA, 11 nt, Human
aaggauaaagu

SEQ ID NO: 1491527 - RNA, 19 nt, Human
aaggcauuauaaaaagaau

SEQ ID NO: 1491528 - RNA, 12 nt, Human
aaggaaagaaaa

SEQ ID NO: 1491529 - RNA, 15 nt, Human
aaggaaagaaaacau

SEQ ID NO: 1491530 - RNA, 17 nt, Human
guuucuauuuuuugaaa

SEQ ID NO: 1491531 - RNA, 18 nt, Human
aagguauuuaauagguuu

SEQ ID NO: 1491532 - RNA, 16 nt, Human
aaguaaggaauuuuau

SEQ ID NO: 1491533 - RNA, 14 nt, Human
aagguacuucaaau

SEQ ID NO: 1491534 - RNA, 16 nt, Human
aaucagccuaguugau

SEQ ID NO: 1491535 - RNA, 15 nt, Human
aauauuuauuuuaau

SEQ ID NO: 1491536 - RNA, 21 nt, Human
uaagcauaagcuuaugcuuaa

SEQ ID NO: 1491537 - RNA, 22 nt, Human
uaaggaauuuuauuuuuuucug

SEQ ID NO: 1491538 - RNA, 20 nt, Human
uaaguaaugauaacuggaaa

SEQ ID NO: 1491539 - RNA, 18 nt, Human
uaaguacacaauaagcaa

SEQ ID NO: 1491540 - RNA, 17 nt, Human
uaaguguguguuuuuca

SEQ ID NO: 1491541 - RNA, 13 nt, Human
uaauaaaaauaaa

SEQ ID NO: 1491542 - RNA, 11 nt, Human
aaucuguaaaa

SEQ ID NO: 1491543 - RNA, 19 nt, Human
uaaauguuaugacuaugua

SEQ ID NO: 1491544 - RNA, 21 nt, Human
uaaauguuaugacuauguaaa

SEQ ID NO: 1491545 - RNA, 20 nt, Human
uaaauguuaugacuauguaa

SEQ ID NO: 1491546 - RNA, 13 nt, Human
uaacaaugcugua

SEQ ID NO: 1491547 - RNA, 23 nt, Human
aauacaucccuuaccugggaaag

SEQ ID NO: 1491548 - RNA, 23 nt, Human
aauaccacaggaaccacaagacu

SEQ ID NO: 1491549 - RNA, 21 nt, Human
aauauauucagccuggcuuca

SEQ ID NO: 1491550 - RNA, 21 nt, Human
aauauauuuuaagacgaaaca

SEQ ID NO: 1491551 - RNA, 20 nt, Human
uaacaugaauauuuaguguu

SEQ ID NO: 1491552 - RNA, 21 nt, Human
uaacaugaauauuuaguguuc

SEQ ID NO: 1491553 - RNA, 19 nt, Human
uaacaugaauauuuagugu

SEQ ID NO: 1491554 - RNA, 13 nt, Human
uaacguauaaaag

SEQ ID NO: 1491555 - RNA, 17 nt, Human
uaacguauaaaagccug

SEQ ID NO: 1491556 - RNA, 23 nt, Human
uaagacaaaaagcuacuuauugu

SEQ ID NO: 1491557 - RNA, 13 nt, Human
uaagacaaauaug

SEQ ID NO: 1491558 - RNA, 13 nt, Human
uacauuuccuaaa

SEQ ID NO: 1491559 - RNA, 18 nt, Human
aauguucacaauauauuu

SEQ ID NO: 1491560 - RNA, 19 nt, Human
aauguuaugacuauguaaa

SEQ ID NO: 1491561 - RNA, 22 nt, Human
aauguuaugacuauguaaacua

SEQ ID NO: 1491562 - RNA, 15 nt, Human
aauuaugugacauuu

SEQ ID NO: 1491563 - RNA, 17 nt, Human
aauuaugugacauuuua

SEQ ID NO: 1491564 - RNA, 20 nt, Human
aauuaugugacauuuuacau

SEQ ID NO: 1491565 - RNA, 22 nt, Human
aauuaugugccagauuuaugca

SEQ ID NO: 1491566 - RNA, 22 nt, Human
aauuaugugacauuuuacauua

SEQ ID NO: 1491567 - RNA, 14 nt, Human
aauuacauuuguau

SEQ ID NO: 1491568 - RNA, 13 nt, Human
aauuacauuugua

SEQ ID NO: 1491569 - RNA, 23 nt, Human
uaccugaagcuaucguaaaauua

SEQ ID NO: 1491570 - RNA, 14 nt, Human
uacccuaaccaagu

SEQ ID NO: 1491571 - RNA, 16 nt, Human
uacccuaaccaaguuc

SEQ ID NO: 1491572 - RNA, 17 nt, Human
uacccuaaccaaguucc

SEQ ID NO: 1491573 - RNA, 21 nt, Human
uaauuuuuuucaccuagauuu

SEQ ID NO: 1491574 - RNA, 21 nt, Human
aaugcuguauuuuaaaagaau

SEQ ID NO: 1491575 - RNA, 20 nt, Human
aaugcuguauuuuaaaagaa

SEQ ID NO: 1491576 - RNA, 22 nt, Human
aaugcuguauuuuaaaagaaug

SEQ ID NO: 1491577 - RNA, 19 nt, Human
aauggaggggcagagccag

SEQ ID NO: 1491578 - RNA, 20 nt, Human
aauggaggggcagagccagg

SEQ ID NO: 1491579 - RNA, 21 nt, Human
aauggaggggcagagccagga

SEQ ID NO: 1491580 - RNA, 22 nt, Human
aauggaggggcagagccaggaa

SEQ ID NO: 1491581 - RNA, 11 nt, Human
uacacccagca

SEQ ID NO: 1491582 - RNA, 12 nt, Human
uacacccagcaa

SEQ ID NO: 1491583 - RNA, 14 nt, Human
uacacccagcaaua

SEQ ID NO: 1491584 - RNA, 22 nt, Human
aaugagagacacacugaagaag

SEQ ID NO: 1491585 - RNA, 12 nt, Human
aaugagaaaucu

SEQ ID NO: 1491586 - RNA, 22 nt, Human
aaugagaaaucuaaaaaacgaa

SEQ ID NO: 1491587 - RNA, 22 nt, Human
uaauuccguagguuauuuucag

SEQ ID NO: 1491588 - RNA, 21 nt, Human
uaauuuuuauauuugaaauau

SEQ ID NO: 1491589 - RNA, 19 nt, Human
uaauuuuuauauuugaaau

SEQ ID NO: 1491590 - RNA, 18 nt, Human
uaauuuuuauauuugaaa

SEQ ID NO: 1491591 - RNA, 22 nt, Human
acaggaaccacaagacugcaca

SEQ ID NO: 1491592 - RNA, 23 nt, Human
acagcuguaugauucccagccag

SEQ ID NO: 1491593 - RNA, 20 nt, Human
acagcuguaugauucccagc

SEQ ID NO: 1491594 - RNA, 19 nt, Human
acagcuguaugauucccag

SEQ ID NO: 1491595 - RNA, 14 nt, Human
acagcuguaugauu

SEQ ID NO: 1491596 - RNA, 20 nt, Human
uaugaagcuuuuaugugaaa

SEQ ID NO: 1491597 - RNA, 22 nt, Human
uaugaagcuuuuaugugaaaca

SEQ ID NO: 1491598 - RNA, 23 nt, Human
uaugaagcuuuuaugugaaacau

SEQ ID NO: 1491599 - RNA, 19 nt, Human
acagcccuucuuuccacag

SEQ ID NO: 1491600 - RNA, 15 nt, Human
uaucuauauuuuaca

SEQ ID NO: 1491601 - RNA, 17 nt, Human
uaugauacuugaaaauu

SEQ ID NO: 1491602 - RNA, 17 nt, Human
uaugccauauaauucac

SEQ ID NO: 1491603 - RNA, 15 nt, Human
uaugccccauucaac

SEQ ID NO: 1491604 - RNA, 15 nt, Human
uagucaccagagacu

SEQ ID NO: 1491605 - RNA, 18 nt, Human
uagucaccagagacuuua

SEQ ID NO: 1491606 - RNA, 19 nt, Human
uauaagugauugcugguuu

SEQ ID NO: 1491607 - RNA, 21 nt, Human
uauaucuauauuuuacauaaa

SEQ ID NO: 1491608 - RNA, 20 nt, Human
uauauauuuuuuucugaaau

SEQ ID NO: 1491609 - RNA, 19 nt, Human
uauauauuuuuuucugaaa

SEQ ID NO: 1491610 - RNA, 21 nt, Human
uauauauguguaugcacagua

SEQ ID NO: 1491611 - RNA, 23 nt, Human
uauauauguguaugcacaguaaa

SEQ ID NO: 1491612 - RNA, 14 nt, Human
acagaccuuugaac

SEQ ID NO: 1491613 - RNA, 23 nt, Human
uauccaccaaaagggcucccuga

SEQ ID NO: 1491614 - RNA, 13 nt, Human
uaucuauagcuaa

SEQ ID NO: 1491615 - RNA, 21 nt, Human
acaaugaucaccgacugaaaa

SEQ ID NO: 1491616 - RNA, 13 nt, Human
acacaacuauauu

SEQ ID NO: 1491617 - RNA, 14 nt, Human
acacaauaagcaaa

SEQ ID NO: 1491618 - RNA, 13 nt, Human
acacaauaagcaa

SEQ ID NO: 1491619 - RNA, 12 nt, Human
uaguaaucauau

SEQ ID NO: 1491620 - RNA, 13 nt, Human
uagggaaaacauu

SEQ ID NO: 1491621 - RNA, 16 nt, Human
uagggaaaacauucca

SEQ ID NO: 1491622 - RNA, 18 nt, Human
uagggaaaacauuccauc

SEQ ID NO: 1491623 - RNA, 18 nt, Human
uagggcaauuaauuccuu

SEQ ID NO: 1491624 - RNA, 21 nt, Human
uagggcaauuaauuccuucag

SEQ ID NO: 1491625 - RNA, 23 nt, Human
uagggcaauuaauuccuucagca

SEQ ID NO: 1491626 - RNA, 21 nt, Human
uaggggcuuauaauaaaggac

SEQ ID NO: 1491627 - RNA, 22 nt, Human
uaggggcuuauaauaaaggacu

SEQ ID NO: 1491628 - RNA, 23 nt, Human
uaggggcuuauaauaaaggacug

SEQ ID NO: 1491629 - RNA, 16 nt, Human
uagcguuuuuuaaaug

SEQ ID NO: 1491630 - RNA, 17 nt, Human
uagcguuuuuuaaaugu

SEQ ID NO: 1491631 - RNA, 18 nt, Human
uagcguuuuuuaaaugua

SEQ ID NO: 1491632 - RNA, 23 nt, Human
uagcuuuuuucucugauacagaa

SEQ ID NO: 1491633 - RNA, 13 nt, Human
uagcuuuuuucuc

SEQ ID NO: 1491634 - RNA, 22 nt, Human
uagcguuuuuuaaauguauacu

SEQ ID NO: 1491635 - RNA, 14 nt, Human
uagcuaaguacaca

SEQ ID NO: 1491636 - RNA, 14 nt, Human
uagaggguguguaa

SEQ ID NO: 1491637 - RNA, 13 nt, Human
acaaauaauuuag

SEQ ID NO: 1491638 - RNA, 14 nt, Human
acaaauaauuuaga

SEQ ID NO: 1491639 - RNA, 16 nt, Human
acaaaaagcuacuuau

SEQ ID NO: 1491640 - RNA, 20 nt, Human
aauuuuacauggcuggagcu

SEQ ID NO: 1491641 - RNA, 12 nt, Human
aauuuuacauuu

SEQ ID NO: 1491642 - RNA, 16 nt, Human
uagacacgcacggcag

SEQ ID NO: 1491643 - RNA, 13 nt, Human
uagacacacauga

SEQ ID NO: 1491644 - RNA, 20 nt, Human
uagaauuugauaugugaaca

SEQ ID NO: 1491645 - RNA, 22 nt, Human
uagaauuugauaugugaacagu

SEQ ID NO: 1491646 - RNA, 15 nt, Human
uagaaaaaaaauuau

SEQ ID NO: 1491647 - RNA, 18 nt, Human
uagaagacaaaauguuca

SEQ ID NO: 1491648 - RNA, 15 nt, Human
uagaaacacaacuau

SEQ ID NO: 1491649 - RNA, 22 nt, Human
accugaagcuaucguaaaauua

SEQ ID NO: 1491650 - RNA, 16 nt, Human
ucauaauaaguugcau

SEQ ID NO: 1491651 - RNA, 22 nt, Human
accugccucccuucaugcaugg

SEQ ID NO: 1491652 - RNA, 21 nt, Human
accugccucccuucaugcaug

SEQ ID NO: 1491653 - RNA, 23 nt, Human
accugccucccuucaugcaugga

SEQ ID NO: 1491654 - RNA, 18 nt, Human
uccacauuucccccuagc

SEQ ID NO: 1491655 - RNA, 15 nt, Human
acggcagccacagcu

SEQ ID NO: 1491656 - RNA, 15 nt, Human
acggggacucagccc

SEQ ID NO: 1491657 - RNA, 16 nt, Human
ucccaauugagaaaaa

SEQ ID NO: 1491658 - RNA, 11 nt, Human
acuauguaaac

SEQ ID NO: 1491659 - RNA, 12 nt, Human
acuauguaaacu

SEQ ID NO: 1491660 - RNA, 14 nt, Human
acuauguaaacuac

SEQ ID NO: 1491661 - RNA, 16 nt, Human
acuauguaaacuacuu

SEQ ID NO: 1491662 - RNA, 13 nt, Human
acuacgccuggcu

SEQ ID NO: 1491663 - RNA, 14 nt, Human
acuacuagggaaau

SEQ ID NO: 1491664 - RNA, 23 nt, Human
acuacuucuuuuuucaaaagaaa

SEQ ID NO: 1491665 - RNA, 20 nt, Human
acuagaguuuagcuggaaaa

SEQ ID NO: 1491666 - RNA, 22 nt, Human
ucccucuuccuucccugcugug

SEQ ID NO: 1491667 - RNA, 21 nt, Human
ucccucuuccuucccugcugu

SEQ ID NO: 1491668 - RNA, 23 nt, Human
ucccucuuccuucccugcuguga

SEQ ID NO: 1491669 - RNA, 23 nt, Human
acucaucuagguaaauuacaguu

SEQ ID NO: 1491670 - RNA, 21 nt, Human
acuccaaacugacucuuaaga

SEQ ID NO: 1491671 - RNA, 14 nt, Human
uccgugcuuaacca

SEQ ID NO: 1491672 - RNA, 21 nt, Human
uccgugcuuaaccaaagaagc

SEQ ID NO: 1491673 - RNA, 18 nt, Human
acuccagaaagugacaag

SEQ ID NO: 1491674 - RNA, 14 nt, Human
acuccagaaaguga

SEQ ID NO: 1491675 - RNA, 20 nt, Human
acucuucaaggucugcuuuu

SEQ ID NO: 1491676 - RNA, 19 nt, Human
acucuucaaggucugcuuu

SEQ ID NO: 1491677 - RNA, 13 nt, Human
acucuugaaaaau

SEQ ID NO: 1491678 - RNA, 15 nt, Human
acucguguguuucua

SEQ ID NO: 1491679 - RNA, 23 nt, Human
acucguguguuucuauuuuuuga

SEQ ID NO: 1491680 - RNA, 21 nt, Human
acucuugaaaaaugcauguug

SEQ ID NO: 1491681 - RNA, 14 nt, Human
acucuugaaaaaug

SEQ ID NO: 1491682 - RNA, 19 nt, Human
acucuugaaaaaugcaugu

SEQ ID NO: 1491683 - RNA, 17 nt, Human
uccucuccccaugaugu

SEQ ID NO: 1491684 - RNA, 21 nt, Human
uccugaccccaaguuauccac

SEQ ID NO: 1491685 - RNA, 19 nt, Human
acucuuucuuucaauaaaa

SEQ ID NO: 1491686 - RNA, 18 nt, Human
acugaaaauauuguuuua

SEQ ID NO: 1491687 - RNA, 22 nt, Human
uccugaaaacccuugccaugug

SEQ ID NO: 1491688 - RNA, 21 nt, Human
uccugaaaacccuugccaugu

SEQ ID NO: 1491689 - RNA, 24 nt, Human
ucauaaagcaggcagaacucaucu

SEQ ID NO: 1491690 - RNA, 18 nt, Human
ucauaaauaaaguuuguu

SEQ ID NO: 1491691 - RNA, 21 nt, Human
accgaacugauguaaguaaac

SEQ ID NO: 1491692 - RNA, 11 nt, Human
acccucccucc

SEQ ID NO: 1491693 - RNA, 17 nt, Human
acccucccucccuaccc

SEQ ID NO: 1491694 - RNA, 20 nt, Human
acccucaugcugugugacuc

SEQ ID NO: 1491695 - RNA, 14 nt, Human
acccagcaauagag

SEQ ID NO: 1491696 - RNA, 16 nt, Human
ucagaauagaaauuag

SEQ ID NO: 1491697 - RNA, 17 nt, Human
acccaggacaggaucca

SEQ ID NO: 1491698 - RNA, 20 nt, Human
acccaggacaggauccaggc

SEQ ID NO: 1491699 - RNA, 14 nt, Human
acccaggacaggau

SEQ ID NO: 1491700 - RNA, 15 nt, Human
ucagauuucugagga

SEQ ID NO: 1491701 - RNA, 19 nt, Human
accccagcuggggccaggc

SEQ ID NO: 1491702 - RNA, 22 nt, Human
accccagcuggggccaggcugg

SEQ ID NO: 1491703 - RNA, 23 nt, Human
accauguuggccaggcuugucuc

SEQ ID NO: 1491704 - RNA, 21 nt, Human
accauggacacuacacccagc

SEQ ID NO: 1491705 - RNA, 22 nt, Human
accauggacacuacacccagca

SEQ ID NO: 1491706 - RNA, 23 nt, Human
accauggacacuacacccagcaa

SEQ ID NO: 1491707 - RNA, 24 nt, Human
accauggacacuacacccagcaau

SEQ ID NO: 1491708 - RNA, 20 nt, Human
accauggccagcuaauuuuu

SEQ ID NO: 1491709 - RNA, 18 nt, Human
ucacugcaaccucugccu

SEQ ID NO: 1491710 - RNA, 18 nt, Human
ucacugcaaccuccaccu

SEQ ID NO: 1491711 - RNA, 19 nt, Human
ucacauuccugaacaggau

SEQ ID NO: 1491712 - RNA, 16 nt, Human
ucaccagcccuggcaa

SEQ ID NO: 1491713 - RNA, 21 nt, Human
ucacugaacuuugcugagccu

SEQ ID NO: 1491714 - RNA, 16 nt, Human
accacaagacugcaca

SEQ ID NO: 1491715 - RNA, 23 nt, Human
accaaaaaucucaauauuucaga

SEQ ID NO: 1491716 - RNA, 20 nt, Human
ucacauuccugaacaggaua

SEQ ID NO: 1491717 - RNA, 17 nt, Human
ucacauuccugaacagg

SEQ ID NO: 1491718 - RNA, 13 nt, Human
ucacauuccugaa

SEQ ID NO: 1491719 - RNA, 19 nt, Human
ucacagcuccaagaauuuc

SEQ ID NO: 1491720 - RNA, 16 nt, Human
ucacagaccuuugaac

SEQ ID NO: 1491721 - RNA, 23 nt, Human
ucaauauuucagauaaucacaau

SEQ ID NO: 1491722 - RNA, 15 nt, Human
ucaaggucugcuuuu

SEQ ID NO: 1491723 - RNA, 14 nt, Human
ucaaggucugcuuu

SEQ ID NO: 1491724 - RNA, 15 nt, Human
acauuuuacauuaaa

SEQ ID NO: 1491725 - RNA, 18 nt, Human
acauuuuacauuaaauuu

SEQ ID NO: 1491726 - RNA, 14 nt, Human
acauuuuacauuaa

SEQ ID NO: 1491727 - RNA, 16 nt, Human
acauuggaaacaaguc

SEQ ID NO: 1491728 - RNA, 22 nt, Human
acauggcuggagcuagaauuug

SEQ ID NO: 1491729 - RNA, 23 nt, Human
ucaaauacgugggcauucaaaug

SEQ ID NO: 1491730 - RNA, 13 nt, Human
ucaaauauauuca

SEQ ID NO: 1491731 - RNA, 22 nt, Human
ucaaauacgugggcauucaaau

SEQ ID NO: 1491732 - RNA, 21 nt, Human
ucaaauacgugggcauucaaa

SEQ ID NO: 1491733 - RNA, 17 nt, Human
uauuuuguguuuaggaa

SEQ ID NO: 1491734 - RNA, 20 nt, Human
uauuuuguguuuaggaacua

SEQ ID NO: 1491735 - RNA, 13 nt, Human
uauuuuacauaaa

SEQ ID NO: 1491736 - RNA, 22 nt, Human
uauuuuaauaauguuucaaaca

SEQ ID NO: 1491737 - RNA, 19 nt, Human
uauuuuaauaauguuucaa

SEQ ID NO: 1491738 - RNA, 17 nt, Human
uauuuuaauaaacacuc

SEQ ID NO: 1491739 - RNA, 14 nt, Human
uauuuuaauaaaca

SEQ ID NO: 1491740 - RNA, 18 nt, Human
uauuuuaaaagaaugauu

SEQ ID NO: 1491741 - RNA, 14 nt, Human
uauuuuaaaagaau

SEQ ID NO: 1491742 - RNA, 14 nt, Human
uauuuuaagacgaa

SEQ ID NO: 1491743 - RNA, 22 nt, Human
uauuuuaagacgaaacauuugu

SEQ ID NO: 1491744 - RNA, 11 nt, Human
acaucuuuaag

SEQ ID NO: 1491745 - RNA, 20 nt, Human
acaucuuuaaggggaggaac

SEQ ID NO: 1491746 - RNA, 14 nt, Human
uaugugccagauuu

SEQ ID NO: 1491747 - RNA, 19 nt, Human
uaugugccagauuuaugca

SEQ ID NO: 1491748 - RNA, 17 nt, Human
ucuaccaaaaaucucaa

SEQ ID NO: 1491749 - RNA, 13 nt, Human
acuguggguagac

SEQ ID NO: 1491750 - RNA, 14 nt, Human
ucguuaucuaauag

SEQ ID NO: 1491751 - RNA, 15 nt, Human
acuguacuugcucuu

SEQ ID NO: 1491752 - RNA, 23 nt, Human
acuguacuugcucuugaugccug

SEQ ID NO: 1491753 - RNA, 18 nt, Human
acuguacagacagaaaaa

SEQ ID NO: 1491754 - RNA, 22 nt, Human
acugaagaagcaccaaucauga

SEQ ID NO: 1491755 - RNA, 18 nt, Human
ucgcccuggacugugugc

SEQ ID NO: 1491756 - RNA, 16 nt, Human
ucgccggaucugaggg

SEQ ID NO: 1491757 - RNA, 17 nt, Human
ucgccggaucugaggga

SEQ ID NO: 1491758 - RNA, 12 nt, Human
ucgccucagccu

SEQ ID NO: 1491759 - RNA, 20 nt, Human
ucuauuuuuugaaaagcaga

SEQ ID NO: 1491760 - RNA, 15 nt, Human
acuuguauuaugugu

SEQ ID NO: 1491761 - RNA, 13 nt, Human
acuuguauuaugu

SEQ ID NO: 1491762 - RNA, 14 nt, Human
acuuguauuaugug

SEQ ID NO: 1491763 - RNA, 16 nt, Human
acuugaggacacaugu

SEQ ID NO: 1491764 - RNA, 17 nt, Human
acuugaggacacauguc

SEQ ID NO: 1491765 - RNA, 18 nt, Human
acuugaggacacaugucc

SEQ ID NO: 1491766 - RNA, 19 nt, Human
acuugaggacacaugucca

SEQ ID NO: 1491767 - RNA, 21 nt, Human
acuucucuuguuagguaauuu

SEQ ID NO: 1491768 - RNA, 17 nt, Human
acuugaaaauuaacaug

SEQ ID NO: 1491769 - RNA, 18 nt, Human
acuugaaaauuaacauga

SEQ ID NO: 1491770 - RNA, 13 nt, Human
ucuauaauuuaaa

SEQ ID NO: 1491771 - RNA, 20 nt, Human
acuuccagauccuggaaauc

SEQ ID NO: 1491772 - RNA, 22 nt, Human
ucucugcaggucccuaauaaag

SEQ ID NO: 1491773 - RNA, 19 nt, Human
ucucugcaggucccuaaua

SEQ ID NO: 1491774 - RNA, 20 nt, Human
ucucugcaggucccuaauaa

SEQ ID NO: 1491775 - RNA, 21 nt, Human
ucucugcaggucccuaauaaa

SEQ ID NO: 1491776 - RNA, 15 nt, Human
agaaacauuugguaa

SEQ ID NO: 1491777 - RNA, 21 nt, Human
agaaacuuaaauuuuaguucu

SEQ ID NO: 1491778 - RNA, 16 nt, Human
agaaacacaacuauau

SEQ ID NO: 1491779 - RNA, 16 nt, Human
agaaaacaaggaugaa

SEQ ID NO: 1491780 - RNA, 17 nt, Human
agaaagcaucccucacc

SEQ ID NO: 1491781 - RNA, 19 nt, Human
agaaagcaucccucaccca

SEQ ID NO: 1491782 - RNA, 22 nt, Human
agaaagcaucccucacccaucc

SEQ ID NO: 1491783 - RNA, 20 nt, Human
ucugaaggguaauuauauag

SEQ ID NO: 1491784 - RNA, 16 nt, Human
agaaaugaaaaaauau

SEQ ID NO: 1491785 - RNA, 13 nt, Human
agaaaugaaaaaa

SEQ ID NO: 1491786 - RNA, 12 nt, Human
agaaaugaaaaa

SEQ ID NO: 1491787 - RNA, 19 nt, Human
acuuuguauaaaagggacu

SEQ ID NO: 1491788 - RNA, 22 nt, Human
acuuguuuuauuuaaccucuaa

SEQ ID NO: 1491789 - RNA, 17 nt, Human
acuuuagaauaugccuu

SEQ ID NO: 1491790 - RNA, 13 nt, Human
acuuuagggaagu

SEQ ID NO: 1491791 - RNA, 22 nt, Human
ucucucacuuguuuuauuuaac

SEQ ID NO: 1491792 - RNA, 19 nt, Human
agaagcaccaaucaugaau

SEQ ID NO: 1491793 - RNA, 13 nt, Human
agaagcaaguaaa

SEQ ID NO: 1491794 - RNA, 12 nt, Human
agaacggaagaa

SEQ ID NO: 1491795 - RNA, 13 nt, Human
agaacggaagaag

SEQ ID NO: 1491796 - RNA, 14 nt, Human
ucugaauaaagcaa

SEQ ID NO: 1491797 - RNA, 17 nt, Human
ucugaauaaagcaauua

SEQ ID NO: 1491798 - RNA, 21 nt, Human
ucugcaggucccuaauaaagc

SEQ ID NO: 1491799 - RNA, 19 nt, Human
ucugcaggucccuaauaaa

SEQ ID NO: 1491800 - RNA, 22 nt, Human
ucugcaggucccuaauaaagcu

SEQ ID NO: 1491801 - RNA, 23 nt, Human
ucugcaggucccuaauaaagcug

SEQ ID NO: 1491802 - RNA, 12 nt, Human
agaaauuaugug

SEQ ID NO: 1491803 - RNA, 13 nt, Human
agaaguugauaug

SEQ ID NO: 1491804 - RNA, 14 nt, Human
ucuggauuccagag

SEQ ID NO: 1491805 - RNA, 18 nt, Human
ucuggaagugacuuuggc

SEQ ID NO: 1491806 - RNA, 19 nt, Human
ucuggaagugacuuuggcu

SEQ ID NO: 1491807 - RNA, 22 nt, Human
ucuggaagugacuuuggcugca

SEQ ID NO: 1491808 - RNA, 22 nt, Human
ucuggauuccagagcacugcuc

SEQ ID NO: 1491809 - RNA, 21 nt, Human
ucuugaugccuggcggggugg

SEQ ID NO: 1491810 - RNA, 23 nt, Human
ugaaaaaauauauaucaaauaua

SEQ ID NO: 1491811 - RNA, 16 nt, Human
ugaaaauauuguuuua

SEQ ID NO: 1491812 - RNA, 20 nt, Human
ugaaaauauuguuuuacaau

SEQ ID NO: 1491813 - RNA, 23 nt, Human
ugaaaauauuguuuuacaauagu

SEQ ID NO: 1491814 - RNA, 20 nt, Human
ugaaaaucuuauaauuuaaa

SEQ ID NO: 1491815 - RNA, 19 nt, Human
ugaaacucguuaauuugua

SEQ ID NO: 1491816 - RNA, 18 nt, Human
agagcaagaccccaucuc

SEQ ID NO: 1491817 - RNA, 16 nt, Human
agagcugauggagaag

SEQ ID NO: 1491818 - RNA, 17 nt, Human
agagcugauggagaagg

SEQ ID NO: 1491819 - RNA, 18 nt, Human
agagcugauggagaagga

SEQ ID NO: 1491820 - RNA, 14 nt, Human
agagaucaggaaga

SEQ ID NO: 1491821 - RNA, 15 nt, Human
agagaucaggaagag

SEQ ID NO: 1491822 - RNA, 19 nt, Human
agagaucaggaagagaagg

SEQ ID NO: 1491823 - RNA, 20 nt, Human
agagaucaggaagagaagga

SEQ ID NO: 1491824 - RNA, 12 nt, Human
ugaaacuuuugg

SEQ ID NO: 1491825 - RNA, 13 nt, Human
ugaauuugugaag

SEQ ID NO: 1491826 - RNA, 21 nt, Human
ugaauuugugaagguggaaau

SEQ ID NO: 1491827 - RNA, 23 nt, Human
ugaauuugugaagguggaaauaa

SEQ ID NO: 1491828 - RNA, 20 nt, Human
ugacaaagguaaaucagacu

SEQ ID NO: 1491829 - RNA, 22 nt, Human
ugaaggguaauuauauaguuac

SEQ ID NO: 1491830 - RNA, 14 nt, Human
ugaauaaagcaauu

SEQ ID NO: 1491831 - RNA, 15 nt, Human
ugaauacuuuauaaa

SEQ ID NO: 1491832 - RNA, 18 nt, Human
ugaauauuuaguguucau

SEQ ID NO: 1491833 - RNA, 19 nt, Human
agagcugauggagaaggaa

SEQ ID NO: 1491834 - RNA, 20 nt, Human
agagcugauggagaaggaag

SEQ ID NO: 1491835 - RNA, 21 nt, Human
agagcugauggagaaggaagg

SEQ ID NO: 1491836 - RNA, 20 nt, Human
ugaagcuaucguaaaauuaa

SEQ ID NO: 1491837 - RNA, 14 nt, Human
agauuucugaggaa

SEQ ID NO: 1491838 - RNA, 15 nt, Human
agauuucugaggaaa

SEQ ID NO: 1491839 - RNA, 17 nt, Human
agcaagaccccaucuca

SEQ ID NO: 1491840 - RNA, 17 nt, Human
agaugcaguucugaaga

SEQ ID NO: 1491841 - RNA, 16 nt, Human
agaugcaguucugaag

SEQ ID NO: 1491842 - RNA, 20 nt, Human
agccaggaagaucccccaga

SEQ ID NO: 1491843 - RNA, 21 nt, Human
agccaggaagaucccccagaa

SEQ ID NO: 1491844 - RNA, 22 nt, Human
agccaggaagaucccccagaaa

SEQ ID NO: 1491845 - RNA, 15 nt, Human
ugauggugguauguu

SEQ ID NO: 1491846 - RNA, 17 nt, Human
ugaugaagaaguugaua

SEQ ID NO: 1491847 - RNA, 17 nt, Human
agcaugucgucaaagcu

SEQ ID NO: 1491848 - RNA, 20 nt, Human
agcaugucgucaaagcugaa

SEQ ID NO: 1491849 - RNA, 20 nt, Human
agcaucacaugaacuuguaa

SEQ ID NO: 1491850 - RNA, 19 nt, Human
ugaucaaaaucaauuaaaa

SEQ ID NO: 1491851 - RNA, 16 nt, Human
ugauaugugaacaguu

SEQ ID NO: 1491852 - RNA, 15 nt, Human
ugauaugugaacagu

SEQ ID NO: 1491853 - RNA, 12 nt, Human
ugauaugggucu

SEQ ID NO: 1491854 - RNA, 17 nt, Human
ugauagacaauugaggu

SEQ ID NO: 1491855 - RNA, 18 nt, Human
ugauagacaauugaggua

SEQ ID NO: 1491856 - RNA, 17 nt, Human
ugaguagaguugaucaa

SEQ ID NO: 1491857 - RNA, 14 nt, Human
ugaguagaguugau

SEQ ID NO: 1491858 - RNA, 22 nt, Human
ugaguaacugauuuguaacaag

SEQ ID NO: 1491859 - RNA, 21 nt, Human
agcauaauacuugcuuuggaa

SEQ ID NO: 1491860 - RNA, 23 nt, Human
agcauaaauguugacaugggaca

SEQ ID NO: 1491861 - RNA, 21 nt, Human
ugauacagaaaaguugaauuu

SEQ ID NO: 1491862 - RNA, 12 nt, Human
ugauacagaaaa

SEQ ID NO: 1491863 - RNA, 15 nt, Human
ugagucaaaaaaucu

SEQ ID NO: 1491864 - RNA, 20 nt, Human
ugcacaccuacuagucacca

SEQ ID NO: 1491865 - RNA, 22 nt, Human
ugcacaccuacuagucaccaga

SEQ ID NO: 1491866 - RNA, 17 nt, Human
agcccuucuuuccacag

SEQ ID NO: 1491867 - RNA, 23 nt, Human
agcccuucuauacccacccagaa

SEQ ID NO: 1491868 - RNA, 21 nt, Human
agcccuucuccauggcccugc

SEQ ID NO: 1491869 - RNA, 23 nt, Human
agcccuucuccauggcccugcca

SEQ ID NO: 1491870 - RNA, 19 nt, Human
agcccuucuauacccaccc

SEQ ID NO: 1491871 - RNA, 20 nt, Human
agcccuucuauacccaccca

SEQ ID NO: 1491872 - RNA, 22 nt, Human
agcccuucuauacccacccaga

SEQ ID NO: 1491873 - RNA, 23 nt, Human
ugcauaacguauaaaagccuguu

SEQ ID NO: 1491874 - RNA, 16 nt, Human
ugcagucucuauacca

SEQ ID NO: 1491875 - RNA, 18 nt, Human
ugcagucucuauaccaau

SEQ ID NO: 1491876 - RNA, 19 nt, Human
ugcagucucuauaccaaua

SEQ ID NO: 1491877 - RNA, 20 nt, Human
ugcagucucuauaccaauaa

SEQ ID NO: 1491878 - RNA, 21 nt, Human
ugcagucucuauaccaauaaa

SEQ ID NO: 1491879 - RNA, 23 nt, Human
ugcagucucuauaccaauaaagu

SEQ ID NO: 1491880 - RNA, 22 nt, Human
ugcagucucuauaccaauaaag

SEQ ID NO: 1491881 - RNA, 17 nt, Human
ugcaggucccuaauaaa

SEQ ID NO: 1491882 - RNA, 12 nt, Human
ugcaggucccua

SEQ ID NO: 1491883 - RNA, 14 nt, Human
ugcaggucccuaau

SEQ ID NO: 1491884 - RNA, 15 nt, Human
ugcaggucccuaaua

SEQ ID NO: 1491885 - RNA, 16 nt, Human
ugcaggucccuaauaa

SEQ ID NO: 1491886 - RNA, 14 nt, Human
ugcagcccugcugc

SEQ ID NO: 1491887 - RNA, 17 nt, Human
ugcagcccccacugccu

SEQ ID NO: 1491888 - RNA, 23 nt, Human
ugcagcccccacugccuuugacc

SEQ ID NO: 1491889 - RNA, 20 nt, Human
agccuuggggcugaugcagu

SEQ ID NO: 1491890 - RNA, 18 nt, Human
agcgccuccaacccuagc

SEQ ID NO: 1491891 - RNA, 19 nt, Human
agcgccuccaacccuagca

SEQ ID NO: 1491892 - RNA, 22 nt, Human
agcgccuccaacccuagcaaaa

SEQ ID NO: 1491893 - RNA, 23 nt, Human
agcgccuccaacccuagcaaaag

SEQ ID NO: 1491894 - RNA, 13 nt, Human
agccuguuuaaga

SEQ ID NO: 1491895 - RNA, 15 nt, Human
agccuguuuaagaga

SEQ ID NO: 1491896 - RNA, 16 nt, Human
agcuagaauuugauau

SEQ ID NO: 1491897 - RNA, 13 nt, Human
agcuagaauuuga

SEQ ID NO: 1491898 - RNA, 19 nt, Human
agcuacuaauuuuaaaaug

SEQ ID NO: 1491899 - RNA, 18 nt, Human
agcuaggaauuguguuua

SEQ ID NO: 1491900 - RNA, 21 nt, Human
ugcggaggaaggaggacccag

SEQ ID NO: 1491901 - RNA, 22 nt, Human
ugcggaggaaggaggacccagg

SEQ ID NO: 1491902 - RNA, 23 nt, Human
ugcggaggaaggaggacccagga

SEQ ID NO: 1491903 - RNA, 13 nt, Human
ugccuuugaccug

SEQ ID NO: 1491904 - RNA, 17 nt, Human
ugccuuugaccugccuc

SEQ ID NO: 1491905 - RNA, 23 nt, Human
ugccuuugaccugccucccuuca

SEQ ID NO: 1491906 - RNA, 12 nt, Human
ugcuacaauguc

SEQ ID NO: 1491907 - RNA, 15 nt, Human
ugccugcccuauucu

SEQ ID NO: 1491908 - RNA, 14 nt, Human
agcuguguggcagu

SEQ ID NO: 1491909 - RNA, 16 nt, Human
agcuguguggcagucu

SEQ ID NO: 1491910 - RNA, 23 nt, Human
ugcuguauuuuaaaagaaugauu

SEQ ID NO: 1491911 - RNA, 11 nt, Human
aggacacaugu

SEQ ID NO: 1491912 - RNA, 12 nt, Human
aggacacauguc

SEQ ID NO: 1491913 - RNA, 13 nt, Human
aggacacaugucc

SEQ ID NO: 1491914 - RNA, 14 nt, Human
aggaauggaagucc

SEQ ID NO: 1491915 - RNA, 13 nt, Human
ugcuguauuuuaa

SEQ ID NO: 1491916 - RNA, 22 nt, Human
ugcuguauuuuaaaagaaugau

SEQ ID NO: 1491917 - RNA, 21 nt, Human
ugcuguauuuuaaaagaauga

SEQ ID NO: 1491918 - RNA, 12 nt, Human
aggaaauauuua

SEQ ID NO: 1491919 - RNA, 13 nt, Human
aggaaauauuuau

SEQ ID NO: 1491920 - RNA, 14 nt, Human
ugcucauggaauug

SEQ ID NO: 1491921 - RNA, 14 nt, Human
ugcucauuucagga

SEQ ID NO: 1491922 - RNA, 17 nt, Human
uggauuauauuaugaag

SEQ ID NO: 1491923 - RNA, 13 nt, Human
uggagaagaacug

SEQ ID NO: 1491924 - RNA, 15 nt, Human
uggacugugugcuca

SEQ ID NO: 1491925 - RNA, 14 nt, Human
uggagaagaacuga

SEQ ID NO: 1491926 - RNA, 14 nt, Human
uggagcucguggaa

SEQ ID NO: 1491927 - RNA, 13 nt, Human
aggcaaucauggu

SEQ ID NO: 1491928 - RNA, 17 nt, Human
uggaagguauuuaauag

SEQ ID NO: 1491929 - RNA, 13 nt, Human
uggaagguauuua

SEQ ID NO: 1491930 - RNA, 23 nt, Human
aggacagcccuucuuuccacaga

SEQ ID NO: 1491931 - RNA, 14 nt, Human
ugggaguacaaaag

SEQ ID NO: 1491932 - RNA, 19 nt, Human
ugggaggugagaccaccuc

SEQ ID NO: 1491933 - RNA, 16 nt, Human
ugggauuuggucaaca

SEQ ID NO: 1491934 - RNA, 15 nt, Human
uggggaaugaagaua

SEQ ID NO: 1491935 - RNA, 14 nt, Human
uggggaaugaagau

SEQ ID NO: 1491936 - RNA, 23 nt, Human
agguauaauucacauuguauuca

SEQ ID NO: 1491937 - RNA, 23 nt, Human
agguacuucaaauccuugaagau

SEQ ID NO: 1491938 - RNA, 18 nt, Human
agguauucguuaucuaau

SEQ ID NO: 1491939 - RNA, 20 nt, Human
agguauucguuaucuaauag

SEQ ID NO: 1491940 - RNA, 17 nt, Human
aggguuaugauuaagua

SEQ ID NO: 1491941 - RNA, 17 nt, Human
aggggcuaccaggaaag

SEQ ID NO: 1491942 - RNA, 14 nt, Human
aggggcuaccagga

SEQ ID NO: 1491943 - RNA, 15 nt, Human
aggggcuaccaggaa

SEQ ID NO: 1491944 - RNA, 21 nt, Human
ugggucgcccuggacugugug

SEQ ID NO: 1491945 - RNA, 11 nt, Human
aggguggcagc

SEQ ID NO: 1491946 - RNA, 13 nt, Human
aggguggcagcaa

SEQ ID NO: 1491947 - RNA, 15 nt, Human
aggguggcagcaaca

SEQ ID NO: 1491948 - RNA, 16 nt, Human
aggguggcagcaacaa

SEQ ID NO: 1491949 - RNA, 20 nt, Human
ugguaaggggaauugaggac

SEQ ID NO: 1491950 - RNA, 16 nt, Human
agucaggaaagagaac

SEQ ID NO: 1491951 - RNA, 22 nt, Human
aguccaggcuuuuuuaucaugu

SEQ ID NO: 1491952 - RNA, 20 nt, Human
ugucaaucagccuaguugau

SEQ ID NO: 1491953 - RNA, 21 nt, Human
ugucaauaaaauccauacauu

SEQ ID NO: 1491954 - RNA, 17 nt, Human
uguauuuuuaguagaga

SEQ ID NO: 1491955 - RNA, 20 nt, Human
agucacauuccugaacagga

SEQ ID NO: 1491956 - RNA, 19 nt, Human
agucacauuccugaacagg

SEQ ID NO: 1491957 - RNA, 16 nt, Human
aguauuucuaugaaau

SEQ ID NO: 1491958 - RNA, 15 nt, Human
aguauuucuaugaaa

SEQ ID NO: 1491959 - RNA, 13 nt, Human
aguauuucuauga

SEQ ID NO: 1491960 - RNA, 19 nt, Human
aguagauaggccaugggca

SEQ ID NO: 1491961 - RNA, 22 nt, Human
aguagagacgagguuucacugu

SEQ ID NO: 1491962 - RNA, 19 nt, Human
aguacuuuuggcauuuuac

SEQ ID NO: 1491963 - RNA, 15 nt, Human
aguaauccaagcaaa

SEQ ID NO: 1491964 - RNA, 21 nt, Human
aguaauccaagcaaaugugaa

SEQ ID NO: 1491965 - RNA, 16 nt, Human
aguacacaauaagcaa

SEQ ID NO: 1491966 - RNA, 17 nt, Human
aguacacaauaagcaaa

SEQ ID NO: 1491967 - RNA, 18 nt, Human
aguacacaauaagcaaaa

SEQ ID NO: 1491968 - RNA, 21 nt, Human
aguacacaauaagcaaaaaca

SEQ ID NO: 1491969 - RNA, 22 nt, Human
aguacacaauaagcaaaaacaa

SEQ ID NO: 1491970 - RNA, 14 nt, Human
aguaaaaaggcuaa

SEQ ID NO: 1491971 - RNA, 23 nt, Human
aguaaggaauuuuauuuuuuucu

SEQ ID NO: 1491972 - RNA, 20 nt, Human
aggugcauauuuauaaaaau

SEQ ID NO: 1491973 - RNA, 21 nt, Human
agguggugguagagaagcaag

SEQ ID NO: 1491974 - RNA, 10 nt, Human
aggucccuaa

SEQ ID NO: 1491975 - RNA, 15 nt, Human
uguaaguaaacgguc

SEQ ID NO: 1491976 - RNA, 17 nt, Human
uguaagaaaauaucacu

SEQ ID NO: 1491977 - RNA, 21 nt, Human
agugcaaauugucacaggaca

SEQ ID NO: 1491978 - RNA, 18 nt, Human
agugcaaauugucacagg

SEQ ID NO: 1491979 - RNA, 22 nt, Human
agugcaaauugucacaggacag

SEQ ID NO: 1491980 - RNA, 14 nt, Human
agugcacuaaugug

SEQ ID NO: 1491981 - RNA, 20 nt, Human
agugcuggcauuacaggugu

SEQ ID NO: 1491982 - RNA, 19 nt, Human
aguucggugagcuacaaau

SEQ ID NO: 1491983 - RNA, 20 nt, Human
aguucggugagcuacaaaug

SEQ ID NO: 1491984 - RNA, 13 nt, Human
uguuuaguaauca

SEQ ID NO: 1491985 - RNA, 14 nt, Human
uguuuaguaaucau

SEQ ID NO: 1491986 - RNA, 17 nt, Human
uguuuaguaaucauauu

SEQ ID NO: 1491987 - RNA, 16 nt, Human
uguugucugcaacucu

SEQ ID NO: 1491988 - RNA, 13 nt, Human
uguugucugcaac

SEQ ID NO: 1491989 - RNA, 21 nt, Human
aguguucauaaauaaaguuug

SEQ ID NO: 1491990 - RNA, 16 nt, Human
aguguuggagaagaac

SEQ ID NO: 1491991 - RNA, 14 nt, Human
aguguuggagaaga

SEQ ID NO: 1491992 - RNA, 18 nt, Human
aguguuggagaagaacug

SEQ ID NO: 1491993 - RNA, 17 nt, Human
aguguuggagaagaacu

SEQ ID NO: 1491994 - RNA, 23 nt, Human
aguguuggagaagaacugaaauc

SEQ ID NO: 1491995 - RNA, 20 nt, Human
uuaagaagacugcauuauau

SEQ ID NO: 1491996 - RNA, 24 nt, Human
uuaaggggaggaaccagagugcug

SEQ ID NO: 1491997 - RNA, 15 nt, Human
auaaaauaauuuuua

SEQ ID NO: 1491998 - RNA, 22 nt, Human
auaaaauaauuuuaucucuuuc

SEQ ID NO: 1491999 - RNA, 12 nt, Human
auaaaauaauuu

SEQ ID NO: 1492000 - RNA, 18 nt, Human
auaaaagccuguuuaaga

SEQ ID NO: 1492001 - RNA, 13 nt, Human
auaaaagccuguu

SEQ ID NO: 1492002 - RNA, 14 nt, Human
aguuuaaauuguaa

SEQ ID NO: 1492003 - RNA, 19 nt, Human
uguuucaaacauauauaac

SEQ ID NO: 1492004 - RNA, 13 nt, Human
uguuucaaacaua

SEQ ID NO: 1492005 - RNA, 13 nt, Human
uuaccuuugacaa

SEQ ID NO: 1492006 - RNA, 20 nt, Human
uuaccuuugacaaagguaaa

SEQ ID NO: 1492007 - RNA, 22 nt, Human
auaacgauaaaagacagugaaa

SEQ ID NO: 1492008 - RNA, 14 nt, Human
auaacguauaaaag

SEQ ID NO: 1492009 - RNA, 13 nt, Human
auaaauaaaaaua

SEQ ID NO: 1492010 - RNA, 17 nt, Human
auaaagguucaugcaaa

SEQ ID NO: 1492011 - RNA, 15 nt, Human
auaaagguucaugca

SEQ ID NO: 1492012 - RNA, 14 nt, Human
auaaauaaaaauaa

SEQ ID NO: 1492013 - RNA, 18 nt, Human
auaauccuaaacauauga

SEQ ID NO: 1492014 - RNA, 11 nt, Human
auaauaaagga

SEQ ID NO: 1492015 - RNA, 13 nt, Human
auaauaaaggacu

SEQ ID NO: 1492016 - RNA, 18 nt, Human
auaauaaaggacuguaau

SEQ ID NO: 1492017 - RNA, 19 nt, Human
auaauacuugcuuuggaaa

SEQ ID NO: 1492018 - RNA, 14 nt, Human
auaauaauuaguaa

SEQ ID NO: 1492019 - RNA, 15 nt, Human
uuagggaaaacauuc

SEQ ID NO: 1492020 - RNA, 17 nt, Human
uuagggaaaacauucca

SEQ ID NO: 1492021 - RNA, 12 nt, Human
auauauuuuaag

SEQ ID NO: 1492022 - RNA, 13 nt, Human
auauauuuuaaga

SEQ ID NO: 1492023 - RNA, 19 nt, Human
uucauaauuauuauuuggc

SEQ ID NO: 1492024 - RNA, 21 nt, Human
auaucuccgucaacucauauu

SEQ ID NO: 1492025 - RNA, 20 nt, Human
auaucuccgucaacucauau

SEQ ID NO: 1492026 - RNA, 19 nt, Human
auaucuccgucaacucaua

SEQ ID NO: 1492027 - RNA, 14 nt, Human
auauauuuuaagac

SEQ ID NO: 1492028 - RNA, 15 nt, Human
auauauuuuaagacg

SEQ ID NO: 1492029 - RNA, 23 nt, Human
uucccaaaggcauuauaaaaaga

SEQ ID NO: 1492030 - RNA, 18 nt, Human
uucccaacuccagaaagu

SEQ ID NO: 1492031 - RNA, 23 nt, Human
uuccacccagugcugaauuuccc

SEQ ID NO: 1492032 - RNA, 16 nt, Human
uucauuccauucugga

SEQ ID NO: 1492033 - RNA, 12 nt, Human
uucauuccucca

SEQ ID NO: 1492034 - RNA, 13 nt, Human
uucauuccuccag

SEQ ID NO: 1492035 - RNA, 14 nt, Human
uucauuccuccagg

SEQ ID NO: 1492036 - RNA, 14 nt, Human
auagucucuuuaaa

SEQ ID NO: 1492037 - RNA, 21 nt, Human
auagucucuuuaaaaggaaag

SEQ ID NO: 1492038 - RNA, 14 nt, Human
auauauaacaaugc

SEQ ID NO: 1492039 - RNA, 21 nt, Human
auauauauuuuuuucugaaau

SEQ ID NO: 1492040 - RNA, 21 nt, Human
uucaagcgauucuccugccuc

SEQ ID NO: 1492041 - RNA, 17 nt, Human
uucaaggucugcuuuuc

SEQ ID NO: 1492042 - RNA, 18 nt, Human
uucaagcgauucuccugc

SEQ ID NO: 1492043 - RNA, 14 nt, Human
uucaagcaauccuc

SEQ ID NO: 1492044 - RNA, 16 nt, Human
uucaagcaauccuccc

SEQ ID NO: 1492045 - RNA, 21 nt, Human
uucaaaauuguuacaaauugu

SEQ ID NO: 1492046 - RNA, 13 nt, Human
uucaaaagaaagu

SEQ ID NO: 1492047 - RNA, 14 nt, Human
uucaaacauauaua

SEQ ID NO: 1492048 - RNA, 13 nt, Human
uuauuuuuuucug

SEQ ID NO: 1492049 - RNA, 17 nt, Human
uuauuuuuuucugaauu

SEQ ID NO: 1492050 - RNA, 12 nt, Human
uucaaaagaaag

SEQ ID NO: 1492051 - RNA, 17 nt, Human
auaggcguaacuaauuu

SEQ ID NO: 1492052 - RNA, 15 nt, Human
auagcuuuuuucucu

SEQ ID NO: 1492053 - RNA, 22 nt, Human
auagcuuuucccuuuuuuuaag

SEQ ID NO: 1492054 - RNA, 19 nt, Human
uugaaauauugacuuuuua

SEQ ID NO: 1492055 - RNA, 12 nt, Human
uugaaccaauaa

SEQ ID NO: 1492056 - RNA, 14 nt, Human
auccauacauuugu

SEQ ID NO: 1492057 - RNA, 14 nt, Human
aucaaguuauuuuu

SEQ ID NO: 1492058 - RNA, 14 nt, Human
uuccuucagcacuu

SEQ ID NO: 1492059 - RNA, 16 nt, Human
uucccuaucuuugcca

SEQ ID NO: 1492060 - RNA, 20 nt, Human
auauuuuacauaaauuuagu

SEQ ID NO: 1492061 - RNA, 16 nt, Human
auauuuuacauaaauu

SEQ ID NO: 1492062 - RNA, 15 nt, Human
auauuuuacauaaau

SEQ ID NO: 1492063 - RNA, 15 nt, Human
uucuaaaguaaaaac

SEQ ID NO: 1492064 - RNA, 15 nt, Human
uucucagauuucuga

SEQ ID NO: 1492065 - RNA, 20 nt, Human
uucucagauuucugaggaaa

SEQ ID NO: 1492066 - RNA, 16 nt, Human
uucucagauuucugag

SEQ ID NO: 1492067 - RNA, 16 nt, Human
aucagaaacacccuca

SEQ ID NO: 1492068 - RNA, 20 nt, Human
aucagaaacacccucacacu

SEQ ID NO: 1492069 - RNA, 19 nt, Human
aucagacuaugaaguuuuu

SEQ ID NO: 1492070 - RNA, 19 nt, Human
aucaggaagagaaggagca

SEQ ID NO: 1492071 - RNA, 13 nt, Human
uucuauaauuuaa

SEQ ID NO: 1492072 - RNA, 14 nt, Human
uucuauaauuuaaa

SEQ ID NO: 1492073 - RNA, 15 nt, Human
uucuaguguagaauu

SEQ ID NO: 1492074 - RNA, 17 nt, Human
augcaguucugaagaag

SEQ ID NO: 1492075 - RNA, 15 nt, Human
augcaguucugaaga

SEQ ID NO: 1492076 - RNA, 19 nt, Human
augcaguucugaagaagau

SEQ ID NO: 1492077 - RNA, 18 nt, Human
augcaguucugaagaaga

SEQ ID NO: 1492078 - RNA, 12 nt, Human
uuuaauuuuaca

SEQ ID NO: 1492079 - RNA, 14 nt, Human
uuuaaauguauacu

SEQ ID NO: 1492080 - RNA, 15 nt, Human
uuuaaauguauacua

SEQ ID NO: 1492081 - RNA, 14 nt, Human
uuuaaauguuuuuu

SEQ ID NO: 1492082 - RNA, 23 nt, Human
uugugugaaagguacuucaaauc

SEQ ID NO: 1492083 - RNA, 23 nt, Human
augagagacacacugaagaagca

SEQ ID NO: 1492084 - RNA, 21 nt, Human
augagagacacacugaagaag

SEQ ID NO: 1492085 - RNA, 20 nt, Human
augagagacacacugaagaa

SEQ ID NO: 1492086 - RNA, 22 nt, Human
augauuaugaauuacauuugua

SEQ ID NO: 1492087 - RNA, 15 nt, Human
uuguugucugcaacu

SEQ ID NO: 1492088 - RNA, 21 nt, Human
augauucaaaugucuauaaac

SEQ ID NO: 1492089 - RNA, 12 nt, Human
augauucccagc

SEQ ID NO: 1492090 - RNA, 17 nt, Human
uuucaugaccaguaaag

SEQ ID NO: 1492091 - RNA, 24 nt, Human
uuucaugaccaguaaaggcugcug

SEQ ID NO: 1492092 - RNA, 16 nt, Human
auggaauacucuuaua

SEQ ID NO: 1492093 - RNA, 17 nt, Human
auggaauacucuuauau

SEQ ID NO: 1492094 - RNA, 19 nt, Human
augcucuccaaaccacuuu

SEQ ID NO: 1492095 - RNA, 16 nt, Human
uuuauuacuguaagaa

SEQ ID NO: 1492096 - RNA, 22 nt, Human
augcugucuacacuaagagaga

SEQ ID NO: 1492097 - RNA, 23 nt, Human
augcugucuacacuaagagagaa

SEQ ID NO: 1492098 - RNA, 13 nt, Human
uuuauauaagcuu

SEQ ID NO: 1492099 - RNA, 22 nt, Human
uuuagcuggaaaaguauguuag

SEQ ID NO: 1492100 - RNA, 22 nt, Human
uuuaggaaguugacuuauagua

SEQ ID NO: 1492101 - RNA, 16 nt, Human
uuuaguaucuuuuuau

SEQ ID NO: 1492102 - RNA, 15 nt, Human
augagaaaucuaaaa

SEQ ID NO: 1492103 - RNA, 18 nt, Human
augagaaaucuaaaaaac

SEQ ID NO: 1492104 - RNA, 23 nt, Human
augagaaaucuaaaaaacgaaaa

SEQ ID NO: 1492105 - RNA, 19 nt, Human
augagagacacacugaaga

SEQ ID NO: 1492106 - RNA, 17 nt, Human
augagagacacacugaa

SEQ ID NO: 1492107 - RNA, 14 nt, Human
augagagacacacu

SEQ ID NO: 1492108 - RNA, 13 nt, Human
augagagacacac

SEQ ID NO: 1492109 - RNA, 19 nt, Human
uuguauaaaauaauuuuua

SEQ ID NO: 1492110 - RNA, 23 nt, Human
uuguaguguuggagaagaacuga

SEQ ID NO: 1492111 - RNA, 17 nt, Human
uuguauaaaauaauuuu

SEQ ID NO: 1492112 - RNA, 16 nt, Human
uuguauaaaauaauuu

SEQ ID NO: 1492113 - RNA, 21 nt, Human
uuguaguagcguuuuuuaaau

SEQ ID NO: 1492114 - RNA, 22 nt, Human
uuguaguagcguuuuuuaaaug

SEQ ID NO: 1492115 - RNA, 23 nt, Human
uuguaguagcguuuuuuaaaugu

SEQ ID NO: 1492116 - RNA, 22 nt, Human
aucuuuaauuuuacauuuccua

SEQ ID NO: 1492117 - RNA, 16 nt, Human
aucuuuaauuuuacau

SEQ ID NO: 1492118 - RNA, 21 nt, Human
aucuuuaauuuuacauuuccu

SEQ ID NO: 1492119 - RNA, 16 nt, Human
aucuuugccacccuca

SEQ ID NO: 1492120 - RNA, 15 nt, Human
aucuuugccacccuc

SEQ ID NO: 1492121 - RNA, 14 nt, Human
aucuuugccacccu

SEQ ID NO: 1492122 - RNA, 12 nt, Human
augaaagauuca

SEQ ID NO: 1492123 - RNA, 13 nt, Human
aucuuuuuauuca

SEQ ID NO: 1492124 - RNA, 15 nt, Human
uuggagugcaguggc

SEQ ID NO: 1492125 - RNA, 15 nt, Human
augaauuaaguuuuu

SEQ ID NO: 1492126 - RNA, 15 nt, Human
augaagauacugaaa

SEQ ID NO: 1492127 - RNA, 20 nt, Human
augaaauauuauguuaaaac

SEQ ID NO: 1492128 - RNA, 18 nt, Human
augaaauauuauguuaaa

SEQ ID NO: 1492129 - RNA, 17 nt, Human
augaaauauuauguuaa

SEQ ID NO: 1492130 - RNA, 17 nt, Human
augaagauacugaaaua

SEQ ID NO: 1492131 - RNA, 16 nt, Human
augaagauacugaaau

SEQ ID NO: 1492132 - RNA, 19 nt, Human
uugauggugguauguuuuc

SEQ ID NO: 1492133 - RNA, 18 nt, Human
uugauggugguauguuuu

SEQ ID NO: 1492134 - RNA, 15 nt, Human
uugaugggauuuggu

SEQ ID NO: 1492135 - RNA, 12 nt, Human
uugaugccuggc

SEQ ID NO: 1492136 - RNA, 12 nt, Human
aucucuucaguc

SEQ ID NO: 1492137 - RNA, 13 nt, Human
aucucuucagucu

SEQ ID NO: 1492138 - RNA, 21 nt, Human
aucucuucagucucuauacca

SEQ ID NO: 1492139 - RNA, 14 nt, Human
uugcaucugaaaau

SEQ ID NO: 1492140 - RNA, 14 nt, Human
aucucagcucacug

SEQ ID NO: 1492141 - RNA, 11 nt, Human
aucucagcuca

SEQ ID NO: 1492142 - RNA, 13 nt, Human
aucucagcucacu

SEQ ID NO: 1492143 - RNA, 15 nt, Human
aucucagcucacuac

SEQ ID NO: 1492144 - RNA, 13 nt, Human
aucucaauauuuc

SEQ ID NO: 1492145 - RNA, 14 nt, Human
aucucaauucuucc

SEQ ID NO: 1492146 - RNA, 16 nt, Human
aucucaauucuucccu

SEQ ID NO: 1492147 - RNA, 22 nt, Human
aucuccauugugccuaagucca

SEQ ID NO: 1492148 - RNA, 16 nt, Human
aucuccccaucauugg

SEQ ID NO: 1492149 - RNA, 23 nt, Human
aucucauuuccaagcaaguauua

SEQ ID NO: 1492150 - RNA, 21 nt, Human
aucucauuuccaagcaaguau

SEQ ID NO: 1492151 - RNA, 18 nt, Human
auuuuauguugcauagaa

SEQ ID NO: 1492152 - RNA, 21 nt, Human
auuuuauguugcauagaauaa

SEQ ID NO: 1492153 - RNA, 13 nt, Human
auuuuacauaaau

SEQ ID NO: 1492154 - RNA, 20 nt, Human
auuuuacuguacagacagaa

SEQ ID NO: 1492155 - RNA, 22 nt, Human
auuuuacuguacagacagaaaa

SEQ ID NO: 1492156 - RNA, 16 nt, Human
auuuuaauaauguuuc

SEQ ID NO: 1492157 - RNA, 15 nt, Human
auuuuaauaauguuu

SEQ ID NO: 1492158 - RNA, 14 nt, Human
auuuuaauaauguu

SEQ ID NO: 1492159 - RNA, 19 nt, Human
auuuguaguguuggagaag

SEQ ID NO: 1492160 - RNA, 23 nt, Human
auuugguaaggggaauugaggac

SEQ ID NO: 1492161 - RNA, 17 nt, Human
auuugguuuucacauug

SEQ ID NO: 1492162 - RNA, 15 nt, Human
auuugguuuucacau

SEQ ID NO: 1492163 - RNA, 22 nt, Human
auuugguuuucacauuggaaac

SEQ ID NO: 1492164 - RNA, 21 nt, Human
auuugguuuucacauuggaaa

SEQ ID NO: 1492165 - RNA, 18 nt, Human
auuuguaguguuggagaa

SEQ ID NO: 1492166 - RNA, 22 nt, Human
auuuauuacuguaagaaaauau

SEQ ID NO: 1492167 - RNA, 16 nt, Human
auuuaggaaguugacu

SEQ ID NO: 1492168 - RNA, 23 nt, Human
auuuaggaaguugacuuauagua

SEQ ID NO: 1492169 - RNA, 22 nt, Human
auuuccugggagcuuuuguaga

SEQ ID NO: 1492170 - RNA, 23 nt, Human
auuuccugggagcuuuuguagaa

SEQ ID NO: 1492171 - RNA, 15 nt, Human
auuguauauuacaau

SEQ ID NO: 1492172 - RNA, 17 nt, Human
auuguauauuacaauga

SEQ ID NO: 1492173 - RNA, 18 nt, Human
auuguauauuacaaugau

SEQ ID NO: 1492174 - RNA, 19 nt, Human
auuguauauuacaaugauc

SEQ ID NO: 1492175 - RNA, 20 nt, Human
auuguauauuacaaugauca

SEQ ID NO: 1492176 - RNA, 15 nt, Human
auugugaaauuauuc

SEQ ID NO: 1492177 - RNA, 14 nt, Human
auuguauuacaaau

SEQ ID NO: 1492178 - RNA, 15 nt, Human
auuguauuacaaauc

SEQ ID NO: 1492179 - RNA, 16 nt, Human
auuuacaaaugggaaa

SEQ ID NO: 1492180 - RNA, 18 nt, Human
auuuaaccucuaaauucu

SEQ ID NO: 1492181 - RNA, 16 nt, Human
auuuaaccucuaaauu

SEQ ID NO: 1492182 - RNA, 22 nt, Human
auucucacagcuccaagaauuu

SEQ ID NO: 1492183 - RNA, 21 nt, Human
auucucacagcuccaagaauu

SEQ ID NO: 1492184 - RNA, 19 nt, Human
auucucacagcuccaagaa

SEQ ID NO: 1492185 - RNA, 22 nt, Human
auugaccuauuuccagaaauac

SEQ ID NO: 1492186 - RNA, 14 nt, Human
auucagcucaugga

SEQ ID NO: 1492187 - RNA, 16 nt, Human
auucccuucaucugga

SEQ ID NO: 1492188 - RNA, 19 nt, Human
auucccuucaucuggaacc

SEQ ID NO: 1492189 - RNA, 21 nt, Human
auuccauucuggaagugacuu

SEQ ID NO: 1492190 - RNA, 16 nt, Human
auuacauuuguauaaa

SEQ ID NO: 1492191 - RNA, 15 nt, Human
auuacauuuguauaa

SEQ ID NO: 1492192 - RNA, 13 nt, Human
auuacauuuguau

SEQ ID NO: 1492193 - RNA, 20 nt, Human
auuaagagagucuauuuacg

SEQ ID NO: 1492194 - RNA, 23 nt, Human
uuuuuuaaaaaagaaacauuugg

SEQ ID NO: 1492195 - RNA, 21 nt, Human
auuaaguaaugauaacuggaa

SEQ ID NO: 1492196 - RNA, 15 nt, Human
auuaaguaaugauaa

SEQ ID NO: 1492197 - RNA, 13 nt, Human
auuaaguaaugau

SEQ ID NO: 1492198 - RNA, 16 nt, Human
auuauuuuauguugca

SEQ ID NO: 1492199 - RNA, 18 nt, Human
auuauuuuauguugcaua

SEQ ID NO: 1492200 - RNA, 17 nt, Human
auuauauuuacaaaugg

SEQ ID NO: 1492201 - RNA, 19 nt, Human
auuaucuauagcuaaguac

SEQ ID NO: 1492202 - RNA, 22 nt, Human
auuaucuauagcuaaguacaca

SEQ ID NO: 1492203 - RNA, 16 nt, Human
auuauauuuacaaaug

SEQ ID NO: 1492204 - RNA, 15 nt, Human
auguugacaugggac

SEQ ID NO: 1492205 - RNA, 15 nt, Human
auguugcauagaaua

SEQ ID NO: 1492206 - RNA, 14 nt, Human
uuuuauaauuuugu

SEQ ID NO: 1492207 - RNA, 19 nt, Human
uuuuauggcacuaguauuu

SEQ ID NO: 1492208 - RNA, 22 nt, Human
uuuuauggcacuaguauuucua

SEQ ID NO: 1492209 - RNA, 18 nt, Human
uuuuaugugaaacauguu

SEQ ID NO: 1492210 - RNA, 19 nt, Human
uuuuaugugaaacauguuu

SEQ ID NO: 1492211 - RNA, 22 nt, Human
uuuuauguugcauagaauaaaa

SEQ ID NO: 1492212 - RNA, 21 nt, Human
uuuuauucagcucauggacuu

SEQ ID NO: 1492213 - RNA, 21 nt, Human
auguuucaaacauauauaaca

SEQ ID NO: 1492214 - RNA, 18 nt, Human
auguuucaaacauauaua

SEQ ID NO: 1492215 - RNA, 13 nt, Human
uuuuaaaaaagaa

SEQ ID NO: 1492216 - RNA, 16 nt, Human
uuuuaaaaaaugguca

SEQ ID NO: 1492217 - RNA, 17 nt, Human
uuuuaaaaaauggucac

SEQ ID NO: 1492218 - RNA, 15 nt, Human
uuuuaaaagaaugau

SEQ ID NO: 1492219 - RNA, 14 nt, Human
uuuuaaaagaauga

SEQ ID NO: 1492220 - RNA, 16 nt, Human
uuuuaaguaaggaauu

SEQ ID NO: 1492221 - RNA, 17 nt, Human
uuuguagaagucacauu

SEQ ID NO: 1492222 - RNA, 13 nt, Human
uuugcucauggaa

SEQ ID NO: 1492223 - RNA, 12 nt, Human
uuugcucaugga

SEQ ID NO: 1492224 - RNA, 11 nt, Human
uuugcucaugg

SEQ ID NO: 1492225 - RNA, 22 nt, Human
augucuauaaaccgaacugaug

SEQ ID NO: 1492226 - RNA, 21 nt, Human
auaacaaugcuguauuuuaaa

SEQ ID NO: 1492227 - RNA, 20 nt, Human
auaacaaugcuguauuuuaa

SEQ ID NO: 1492228 - RNA, 19 nt, Human
auaacaaugcuguauuuua

SEQ ID NO: 1492229 - RNA, 17 nt, Human
auaacaaugcuguauuu

SEQ ID NO: 1492230 - RNA, 15 nt, Human
auaacaaugcuguau

SEQ ID NO: 1492231 - RNA, 14 nt, Human
auaacaaugaaagu

SEQ ID NO: 1492232 - RNA, 11 nt, Human
auaaagcaauu

SEQ ID NO: 1492233 - RNA, 11 nt, Human
auaaaaaggac

SEQ ID NO: 1492234 - RNA, 14 nt, Human
auaaaaaggacauc

SEQ ID NO: 1492235 - RNA, 19 nt, Human
auaaaaaggacaucagcaa

SEQ ID NO: 1492236 - RNA, 13 nt, Human
auaauguuucaaa

SEQ ID NO: 1492237 - RNA, 13 nt, Human
auaauggucagag

SEQ ID NO: 1492238 - RNA, 18 nt, Human
auaauguuucaaacauau

SEQ ID NO: 1492239 - RNA, 13 nt, Human
auacagaaaaguu

SEQ ID NO: 1492240 - RNA, 13 nt, Human
auauuauguuaaa

SEQ ID NO: 1492241 - RNA, 13 nt, Human
auauucaauaaag

SEQ ID NO: 1492242 - RNA, 15 nt, Human
auauucaauaaagcu

SEQ ID NO: 1492243 - RNA, 20 nt, Human
auauucaauaaagcugcuga

SEQ ID NO: 1492244 - RNA, 16 nt, Human
auauuauguuaaaacu

SEQ ID NO: 1492245 - RNA, 14 nt, Human
auauuauguuaaaa

SEQ ID NO: 1492246 - RNA, 15 nt, Human
auauuauuuuauguu

SEQ ID NO: 1492247 - RNA, 22 nt, Human
auauuauuuuauguugcauaga

SEQ ID NO: 1492248 - RNA, 18 nt, Human
auauauuuuuuucugaaa

SEQ ID NO: 1492249 - RNA, 12 nt, Human
auagaaagcuau

SEQ ID NO: 1492250 - RNA, 24 nt, Human
auagguuuggacaaaauggaauac

SEQ ID NO: 1492251 - RNA, 20 nt, Human
auaguacaugauaaaugaua

SEQ ID NO: 1492252 - RNA, 15 nt, Human
aguugacuuauagua

SEQ ID NO: 1492253 - RNA, 17 nt, Human
aguugacuuauaguaca

SEQ ID NO: 1492254 - RNA, 18 nt, Human
aguugacuuauaguacau

SEQ ID NO: 1492255 - RNA, 21 nt, Human
aguugacuuauaguacaugau

SEQ ID NO: 1492256 - RNA, 17 nt, Human
agugaucugcccgccuc

SEQ ID NO: 1492257 - RNA, 15 nt, Human
agugcuaauuuugaa

SEQ ID NO: 1492258 - RNA, 18 nt, Human
agugcuaauuuugaaaaa

SEQ ID NO: 1492259 - RNA, 20 nt, Human
agugcuaauuuugaaaaacu

SEQ ID NO: 1492260 - RNA, 15 nt, Human
agucaaaaauuaaac

SEQ ID NO: 1492261 - RNA, 14 nt, Human
aguauuuuguuuca

SEQ ID NO: 1492262 - RNA, 17 nt, Human
aguauuuuguuucagug

SEQ ID NO: 1492263 - RNA, 14 nt, Human
agugacccugcucu

SEQ ID NO: 1492264 - RNA, 17 nt, Human
agugacccugcucucac

SEQ ID NO: 1492265 - RNA, 23 nt, Human
augaaguccaagcauuuagaugu

SEQ ID NO: 1492266 - RNA, 20 nt, Human
augaaguccaagcauuuaga

SEQ ID NO: 1492267 - RNA, 13 nt, Human
augaccaguaaag

SEQ ID NO: 1492268 - RNA, 18 nt, Human
aucugggggccucuucug

SEQ ID NO: 1492269 - RNA, 13 nt, Human
aucuuauuuagga

SEQ ID NO: 1492270 - RNA, 15 nt, Human
aucuggauuccagag

SEQ ID NO: 1492271 - RNA, 20 nt, Human
aucuccgucaacucauauuu

SEQ ID NO: 1492272 - RNA, 14 nt, Human
aucuauauuuuaca

SEQ ID NO: 1492273 - RNA, 17 nt, Human
aucuauagaaagcuaua

SEQ ID NO: 1492274 - RNA, 16 nt, Human
aucuauagaaagcuau

SEQ ID NO: 1492275 - RNA, 21 nt, Human
aucaugaauuaguuuuauaug

SEQ ID NO: 1492276 - RNA, 17 nt, Human
aucaugaauuaguuuua

SEQ ID NO: 1492277 - RNA, 14 nt, Human
aucaugugaaauca

SEQ ID NO: 1492278 - RNA, 12 nt, Human
aucaugugaaau

SEQ ID NO: 1492279 - RNA, 13 nt, Human
aucagcuuauugu

SEQ ID NO: 1492280 - RNA, 14 nt, Human
aucaggaagagaag

SEQ ID NO: 1492281 - RNA, 17 nt, Human
aucaggaagagaaggag

SEQ ID NO: 1492282 - RNA, 22 nt, Human
aucaaauauauucagccuggcu

SEQ ID NO: 1492283 - RNA, 16 nt, Human
aucaccgacugaaaau

SEQ ID NO: 1492284 - RNA, 14 nt, Human
aucaaauauauuca

SEQ ID NO: 1492285 - RNA, 16 nt, Human
auccuugagucaaaaa

SEQ ID NO: 1492286 - RNA, 22 nt, Human
auccuucaucuggauuccagag

SEQ ID NO: 1492287 - RNA, 17 nt, Human
auccaccugccuuggcu

SEQ ID NO: 1492288 - RNA, 19 nt, Human
auccucaguuuuugugaaa

SEQ ID NO: 1492289 - RNA, 22 nt, Human
auggguuagggaaaacauucca

SEQ ID NO: 1492290 - RNA, 21 nt, Human
augucaaucagccuaguugau

SEQ ID NO: 1492291 - RNA, 14 nt, Human
augugaaacauguu

SEQ ID NO: 1492292 - RNA, 17 nt, Human
augugaaaucauucauu

SEQ ID NO: 1492293 - RNA, 18 nt, Human
augugaaaucauucauuu

SEQ ID NO: 1492294 - RNA, 15 nt, Human
auguguaugcacagu

SEQ ID NO: 1492295 - RNA, 19 nt, Human
auguguaugcacaguaaaa

SEQ ID NO: 1492296 - RNA, 19 nt, Human
auguguaagacaaaaagcu

SEQ ID NO: 1492297 - RNA, 17 nt, Human
auguguaagacaaaaag

SEQ ID NO: 1492298 - RNA, 14 nt, Human
auggaggggcagag

SEQ ID NO: 1492299 - RNA, 15 nt, Human
auggaggggcagagc

SEQ ID NO: 1492300 - RNA, 19 nt, Human
auggaggggcagagccagg

SEQ ID NO: 1492301 - RNA, 18 nt, Human
auggauaggcacaggaaa

SEQ ID NO: 1492302 - RNA, 17 nt, Human
auggauaggcacaggaa

SEQ ID NO: 1492303 - RNA, 18 nt, Human
augccuuguuucauauuu

SEQ ID NO: 1492304 - RNA, 23 nt, Human
augcacaaauucugucucuggau

SEQ ID NO: 1492305 - RNA, 15 nt, Human
augcacaaauucugu

SEQ ID NO: 1492306 - RNA, 22 nt, Human
augcacaaauucugucucugga

SEQ ID NO: 1492307 - RNA, 23 nt, Human
aggccaugggcacuguggguaga

SEQ ID NO: 1492308 - RNA, 21 nt, Human
aggccaugggcacugugggua

SEQ ID NO: 1492309 - RNA, 20 nt, Human
aggagagggcgcuccucucu

SEQ ID NO: 1492310 - RNA, 13 nt, Human
aggcagagaagaa

SEQ ID NO: 1492311 - RNA, 14 nt, Human
aggcagagaagaaa

SEQ ID NO: 1492312 - RNA, 15 nt, Human
aggcagagaagaaag

SEQ ID NO: 1492313 - RNA, 14 nt, Human
agggaccggcggac

SEQ ID NO: 1492314 - RNA, 19 nt, Human
aggccggcuugccacaccc

SEQ ID NO: 1492315 - RNA, 20 nt, Human
aggccggcuugccacacccc

SEQ ID NO: 1492316 - RNA, 21 nt, Human
aggccggcuugccacaccccc

SEQ ID NO: 1492317 - RNA, 17 nt, Human
agccuggggcugaggcu

SEQ ID NO: 1492318 - RNA, 17 nt, Human
agccuggcuucaaauug

SEQ ID NO: 1492319 - RNA, 18 nt, Human
agccuggcuucaaauugu

SEQ ID NO: 1492320 - RNA, 19 nt, Human
agcucacugcaaccuccac

SEQ ID NO: 1492321 - RNA, 12 nt, Human
agcuacaaaugc

SEQ ID NO: 1492322 - RNA, 11 nt, Human
agcguuuuuua

SEQ ID NO: 1492323 - RNA, 14 nt, Human
agcguuuuuuaaau

SEQ ID NO: 1492324 - RNA, 17 nt, Human
agcguuuuuuaaaugua

SEQ ID NO: 1492325 - RNA, 18 nt, Human
agcguuuuuuaaauguau

SEQ ID NO: 1492326 - RNA, 19 nt, Human
agcguuuuuuaaauguaua

SEQ ID NO: 1492327 - RNA, 20 nt, Human
agcguuuuuuaaauguauac

SEQ ID NO: 1492328 - RNA, 23 nt, Human
agcguuuuuuaaauguauacuau

SEQ ID NO: 1492329 - RNA, 18 nt, Human
agcuucacuguaaaauaa

SEQ ID NO: 1492330 - RNA, 18 nt, Human
aggaaguugacuuauagu

SEQ ID NO: 1492331 - RNA, 22 nt, Human
aggaaguugacuuauaguacau

SEQ ID NO: 1492332 - RNA, 23 nt, Human
aggaaguugacuuauaguacaug

SEQ ID NO: 1492333 - RNA, 15 nt, Human
agcuuuuaugugaaa

SEQ ID NO: 1492334 - RNA, 21 nt, Human
agcuuuuaugugaaacauguu

SEQ ID NO: 1492335 - RNA, 15 nt, Human
agcaauccucccacu

SEQ ID NO: 1492336 - RNA, 21 nt, Human
agcaauuacaacggagucaaa

SEQ ID NO: 1492337 - RNA, 24 nt, Human
agcaaaauuuuuucucuaggaaau

SEQ ID NO: 1492338 - RNA, 21 nt, Human
agauguagccccucuccugga

SEQ ID NO: 1492339 - RNA, 22 nt, Human
agacagccaacuauggccugug

SEQ ID NO: 1492340 - RNA, 14 nt, Human
agaaugagacaucc

SEQ ID NO: 1492341 - RNA, 17 nt, Human
agaaugauuaugaauua

SEQ ID NO: 1492342 - RNA, 22 nt, Human
agaaugagagacacacugaaga

SEQ ID NO: 1492343 - RNA, 17 nt, Human
agaaugagagacacacu

SEQ ID NO: 1492344 - RNA, 22 nt, Human
agaagucacauuccugaacagg

SEQ ID NO: 1492345 - RNA, 18 nt, Human
agaagacugcauuauauu

SEQ ID NO: 1492346 - RNA, 21 nt, Human
agaagucacauuccugaacag

SEQ ID NO: 1492347 - RNA, 20 nt, Human
agaagucacauuccugaaca

SEQ ID NO: 1492348 - RNA, 18 nt, Human
agaagucacauuccugaa

SEQ ID NO: 1492349 - RNA, 17 nt, Human
agaagagaucaggaaga

SEQ ID NO: 1492350 - RNA, 18 nt, Human
agaggaauuacgugcucu

SEQ ID NO: 1492351 - RNA, 17 nt, Human
aacacuaacaugauuug

SEQ ID NO: 1492352 - RNA, 17 nt, Human
aacacccucacacuggg

SEQ ID NO: 1492353 - RNA, 21 nt, Human
aacacccucacacugggacuu

SEQ ID NO: 1492354 - RNA, 22 nt, Human
aaauguuuuuuuuuaaagacuu

SEQ ID NO: 1492355 - RNA, 18 nt, Human
aaauugaugggauuuggu

SEQ ID NO: 1492356 - RNA, 18 nt, Human
aaauguuuuuuuuuaaag

SEQ ID NO: 1492357 - RNA, 21 nt, Human
aaauguuuuuuuuuaaagacu

SEQ ID NO: 1492358 - RNA, 15 nt, Human
aacguauaaaagccu

SEQ ID NO: 1492359 - RNA, 18 nt, Human
aacucauauuuucaugcu

SEQ ID NO: 1492360 - RNA, 16 nt, Human
aacucauauuuucaug

SEQ ID NO: 1492361 - RNA, 15 nt, Human
aacucauauuuucau

SEQ ID NO: 1492362 - RNA, 22 nt, Human
aacucaucuagguaaauuacag

SEQ ID NO: 1492363 - RNA, 20 nt, Human
aacaggaucaguuaacuauu

SEQ ID NO: 1492364 - RNA, 13 nt, Human
aaaauuaagaaag

SEQ ID NO: 1492365 - RNA, 20 nt, Human
aaaauuaagaaaggauaaag

SEQ ID NO: 1492366 - RNA, 19 nt, Human
aaaauccauacauuugugu

SEQ ID NO: 1492367 - RNA, 20 nt, Human
aaaauuaaaccggaccaucu

SEQ ID NO: 1492368 - RNA, 22 nt, Human
aaaauuaacaugaauauuuagu

SEQ ID NO: 1492369 - RNA, 12 nt, Human
aaaauuaagaaa

SEQ ID NO: 1492370 - RNA, 14 nt, Human
aaaauuacaacuaa

SEQ ID NO: 1492371 - RNA, 13 nt, Human
aaaauuaucuaua

SEQ ID NO: 1492372 - RNA, 21 nt, Human
aaaauccacuuuaucuugaau

SEQ ID NO: 1492373 - RNA, 15 nt, Human
aaaauaaaaaacacu

SEQ ID NO: 1492374 - RNA, 12 nt, Human
aaacaggaucag

SEQ ID NO: 1492375 - RNA, 19 nt, Human
aaacccuugccaugugcua

SEQ ID NO: 1492376 - RNA, 12 nt, Human
aaagaaaauuuu

SEQ ID NO: 1492377 - RNA, 19 nt, Human
aaagaaaauuuuuguagua

SEQ ID NO: 1492378 - RNA, 13 nt, Human
aaagaaacauuug

SEQ ID NO: 1492379 - RNA, 15 nt, Human
aaagaacggaagaag

SEQ ID NO: 1492380 - RNA, 19 nt, Human
aaagaacggaagaagagau

SEQ ID NO: 1492381 - RNA, 16 nt, Human
aaagcccauucauucc

SEQ ID NO: 1492382 - RNA, 17 nt, Human
aaagcccauucauucca

SEQ ID NO: 1492383 - RNA, 17 nt, Human
aaauaaacgucuuaaau

SEQ ID NO: 1492384 - RNA, 16 nt, Human
aaauaaacgucuuaaa

SEQ ID NO: 1492385 - RNA, 15 nt, Human
aaauaaacgucuuaa

SEQ ID NO: 1492386 - RNA, 15 nt, Human
aauggguuacuugau

SEQ ID NO: 1492387 - RNA, 22 nt, Human
aauggucacguuuggugcuucu

SEQ ID NO: 1492388 - RNA, 23 nt, Human
aauggucacguuuggugcuucuc

SEQ ID NO: 1492389 - RNA, 21 nt, Human
aaugauagacaauugagguaa

SEQ ID NO: 1492390 - RNA, 16 nt, Human
aaugauaacuggaaac

SEQ ID NO: 1492391 - RNA, 15 nt, Human
aaugauaacuggaaa

SEQ ID NO: 1492392 - RNA, 14 nt, Human
aaugauaacuggaa

SEQ ID NO: 1492393 - RNA, 17 nt, Human
aauccauacauuugugu

SEQ ID NO: 1492394 - RNA, 16 nt, Human
aauccauacauuugug

SEQ ID NO: 1492395 - RNA, 20 nt, Human
aauacgugggcauucaaaug

SEQ ID NO: 1492396 - RNA, 19 nt, Human
aauacgugggcauucaaau

SEQ ID NO: 1492397 - RNA, 22 nt, Human
aaguugauaugccuuuucccaa

SEQ ID NO: 1492398 - RNA, 15 nt, Human
aauaaacgucuuaaa

SEQ ID NO: 1492399 - RNA, 11 nt, Human
aauaaagcugu

SEQ ID NO: 1492400 - RNA, 19 nt, Human
aauaaagcuguguggcagu

SEQ ID NO: 1492401 - RNA, 14 nt, Human
aauaaagcugcuga

SEQ ID NO: 1492402 - RNA, 11 nt, Human
aauaaaggacu

SEQ ID NO: 1492403 - RNA, 18 nt, Human
aauaaaggacuguaaucu

SEQ ID NO: 1492404 - RNA, 22 nt, Human
aauaaaggacuguaaucuuauu

SEQ ID NO: 1492405 - RNA, 12 nt, Human
aauaaaauuuuu

SEQ ID NO: 1492406 - RNA, 12 nt, Human
aauaauguuuca

SEQ ID NO: 1492407 - RNA, 19 nt, Human
aauaauguuucaaacauau

SEQ ID NO: 1492408 - RNA, 14 nt, Human
aauaauguuucaaa

SEQ ID NO: 1492409 - RNA, 12 nt, Human
aaggaauuuuau

SEQ ID NO: 1492410 - RNA, 21 nt, Human
aagcugcugagaaucuagccu

SEQ ID NO: 1492411 - RNA, 17 nt, Human
aagcuggagugcagugg

SEQ ID NO: 1492412 - RNA, 15 nt, Human
aagggacugagaaau

SEQ ID NO: 1492413 - RNA, 17 nt, Human
aagggacugagaaauuu

SEQ ID NO: 1492414 - RNA, 12 nt, Human
aaggucugcuuu

SEQ ID NO: 1492415 - RNA, 21 nt, Human
aagauucaaugccccugaauu

SEQ ID NO: 1492416 - RNA, 20 nt, Human
aagauucaaugccccugaau

SEQ ID NO: 1492417 - RNA, 20 nt, Human
aagauacugaaauaaacguc

SEQ ID NO: 1492418 - RNA, 16 nt, Human
aagauacugaaauaaa

SEQ ID NO: 1492419 - RNA, 23 nt, Human
aagacagugaaagaaaauaacaa

SEQ ID NO: 1492420 - RNA, 18 nt, Human
aacuguuguagaagacaa

SEQ ID NO: 1492421 - RNA, 19 nt, Human
aacuguuguagaagacaaa

SEQ ID NO: 1492422 - RNA, 15 nt, Human
aagagaacuuccaga

SEQ ID NO: 1492423 - RNA, 15 nt, Human
aagacuuuuaugaua

SEQ ID NO: 1492424 - RNA, 13 nt, Human
aagagaaggagca

SEQ ID NO: 1492425 - RNA, 20 nt, Human
acucuuaagaagacugcauu

SEQ ID NO: 1492426 - RNA, 15 nt, Human
acucuuaagaagacu

SEQ ID NO: 1492427 - RNA, 14 nt, Human
acucuuaagaagac

SEQ ID NO: 1492428 - RNA, 15 nt, Human
acucuguucauuccu

SEQ ID NO: 1492429 - RNA, 16 nt, Human
acucuguucauuccuc

SEQ ID NO: 1492430 - RNA, 18 nt, Human
acucuguucauuccucca

SEQ ID NO: 1492431 - RNA, 19 nt, Human
acucuguucauuccuccag

SEQ ID NO: 1492432 - RNA, 15 nt, Human
acuuuauuuuguguu

SEQ ID NO: 1492433 - RNA, 19 nt, Human
acuucagcgguuuauauaa

SEQ ID NO: 1492434 - RNA, 18 nt, Human
acuucagcgguuuauaua

SEQ ID NO: 1492435 - RNA, 20 nt, Human
acuucaaauccuugaagauu

SEQ ID NO: 1492436 - RNA, 23 nt, Human
accggcggaccccagccauccag

SEQ ID NO: 1492437 - RNA, 20 nt, Human
accucugccucagaaaacaa

SEQ ID NO: 1492438 - RNA, 12 nt, Human
accugcccugcc

SEQ ID NO: 1492439 - RNA, 13 nt, Human
accugcccugccc

SEQ ID NO: 1492440 - RNA, 16 nt, Human
accugcccugcccugc

SEQ ID NO: 1492441 - RNA, 17 nt, Human
accugcccugcccugcc

SEQ ID NO: 1492442 - RNA, 18 nt, Human
accugcccugcccugcca

SEQ ID NO: 1492443 - RNA, 20 nt, Human
accugcccugcccugccacc

SEQ ID NO: 1492444 - RNA, 21 nt, Human
accugcccugcccugccaccu

SEQ ID NO: 1492445 - RNA, 22 nt, Human
accugcccugcccugccaccug

SEQ ID NO: 1492446 - RNA, 23 nt, Human
accugcccugcccugccaccugu

SEQ ID NO: 1492447 - RNA, 14 nt, Human
accugucugucugu

SEQ ID NO: 1492448 - RNA, 18 nt, Human
accugucugucugucugu

SEQ ID NO: 1492449 - RNA, 20 nt, Human
accugucugucugucugucc

SEQ ID NO: 1492450 - RNA, 18 nt, Human
accucugccucagaaaac

SEQ ID NO: 1492451 - RNA, 17 nt, Human
accucugccucagaaaa

SEQ ID NO: 1492452 - RNA, 22 nt, Human
acggaagaagagaucaggaaga

SEQ ID NO: 1492453 - RNA, 15 nt, Human
acgcacggcagccac

SEQ ID NO: 1492454 - RNA, 17 nt, Human
acgcacggcagccacag

SEQ ID NO: 1492455 - RNA, 15 nt, Human
acuauugcauuuaua

SEQ ID NO: 1492456 - RNA, 18 nt, Human
acuaguauuucuaugaaa

SEQ ID NO: 1492457 - RNA, 19 nt, Human
acuaguauuucuaugaaau

SEQ ID NO: 1492458 - RNA, 13 nt, Human
acacugggacuug

SEQ ID NO: 1492459 - RNA, 18 nt, Human
acacugggacuugcaaaa

SEQ ID NO: 1492460 - RNA, 19 nt, Human
acacugggacuugcaaaaa

SEQ ID NO: 1492461 - RNA, 20 nt, Human
acacugggagaaaugaaaaa

SEQ ID NO: 1492462 - RNA, 16 nt, Human
acagaagcuccaggua

SEQ ID NO: 1492463 - RNA, 18 nt, Human
aauuuugugaagcaaaau

SEQ ID NO: 1492464 - RNA, 17 nt, Human
aauuuugugaagcaaaa

SEQ ID NO: 1492465 - RNA, 18 nt, Human
aauuuucaucuaggauuu

SEQ ID NO: 1492466 - RNA, 14 nt, Human
acaaaauggaauac

SEQ ID NO: 1492467 - RNA, 13 nt, Human
acaaaauggaaua

SEQ ID NO: 1492468 - RNA, 12 nt, Human
acaaagaaauua

SEQ ID NO: 1492469 - RNA, 14 nt, Human
acaaagaaauuaug

SEQ ID NO: 1492470 - RNA, 16 nt, Human
acaaagaaauuaugug

SEQ ID NO: 1492471 - RNA, 21 nt, Human
acaaggaugaauuaaguuuuu

SEQ ID NO: 1492472 - RNA, 21 nt, Human
aauuuccugggagcuuuugua

SEQ ID NO: 1492473 - RNA, 18 nt, Human
aauuuccugggagcuuuu

SEQ ID NO: 1492474 - RNA, 14 nt, Human
acagcugccucuuc

SEQ ID NO: 1492475 - RNA, 15 nt, Human
acagcugccucuucc

SEQ ID NO: 1492476 - RNA, 21 nt, Human
acagggccuuuggcaggugca

SEQ ID NO: 1492477 - RNA, 19 nt, Human
acaguggggaaugaagaua

SEQ ID NO: 1492478 - RNA, 15 nt, Human
acaguggggaaugaa

SEQ ID NO: 1492479 - RNA, 18 nt, Human
acauuuccuuacagaacu

SEQ ID NO: 1492480 - RNA, 16 nt, Human
acauuuccuaaauaua

SEQ ID NO: 1492481 - RNA, 17 nt, Human
acauuuccuaaauauau

SEQ ID NO: 1492482 - RNA, 12 nt, Human
acccacccagaa

SEQ ID NO: 1492483 - RNA, 15 nt, Human
acccacccagaauga

SEQ ID NO: 1492484 - RNA, 22 nt, Human
accaucaccagaauuaauuuua

SEQ ID NO: 1492485 - RNA, 20 nt, Human
accaucagaaacacccucac

SEQ ID NO: 1492486 - RNA, 23 nt, Human
accaucagaaacacccucacacu

SEQ ID NO: 1492487 - RNA, 15 nt, Human
accaucucuccaacu

SEQ ID NO: 1492488 - RNA, 13 nt, Human
cacaggaaaccag

SEQ ID NO: 1492489 - RNA, 15 nt, Human
cacagcugccucuuc

SEQ ID NO: 1492490 - RNA, 22 nt, Human
cacagcugccucuucccucuuc

SEQ ID NO: 1492491 - RNA, 16 nt, Human
caaacugacucuuaag

SEQ ID NO: 1492492 - RNA, 21 nt, Human
caaacugacucuuaagaagac

SEQ ID NO: 1492493 - RNA, 17 nt, Human
caaacugacucuuaaga

SEQ ID NO: 1492494 - RNA, 16 nt, Human
caaaaucaauuaaaau

SEQ ID NO: 1492495 - RNA, 20 nt, Human
caaaucaaucuguaaaacua

SEQ ID NO: 1492496 - RNA, 23 nt, Human
caaauauauucagccuggcuuca

SEQ ID NO: 1492497 - RNA, 17 nt, Human
caaaucaaucuguaaaa

SEQ ID NO: 1492498 - RNA, 23 nt, Human
caacauagugggacccugucucu

SEQ ID NO: 1492499 - RNA, 14 nt, Human
cacacugaagaagc

SEQ ID NO: 1492500 - RNA, 13 nt, Human
cacacugaagaag

SEQ ID NO: 1492501 - RNA, 14 nt, Human
cacagcugccucuu

SEQ ID NO: 1492502 - RNA, 13 nt, Human
cacaauaagcaaa

SEQ ID NO: 1492503 - RNA, 19 nt, Human
caauagucaaauuguguga

SEQ ID NO: 1492504 - RNA, 17 nt, Human
caauagucaaauugugu

SEQ ID NO: 1492505 - RNA, 12 nt, Human
caauaagcaaaa

SEQ ID NO: 1492506 - RNA, 21 nt, Human
caauaaagugacccugcucuc

SEQ ID NO: 1492507 - RNA, 14 nt, Human
caauaaagugaccc

SEQ ID NO: 1492508 - RNA, 13 nt, Human
caauaaauagaca

SEQ ID NO: 1492509 - RNA, 17 nt, Human
caauaaauagacacgca

SEQ ID NO: 1492510 - RNA, 18 nt, Human
caaggaaaaaauaacaau

SEQ ID NO: 1492511 - RNA, 20 nt, Human
caaggaaaaaauaacaauga

SEQ ID NO: 1492512 - RNA, 21 nt, Human
ccccagcuggggccaggcugg

SEQ ID NO: 1492513 - RNA, 22 nt, Human
ccccagcuggggccaggcuggg

SEQ ID NO: 1492514 - RNA, 20 nt, Human
cccuaaaagaaacccugcac

SEQ ID NO: 1492515 - RNA, 19 nt, Human
cccuaaauaauaaaaauaa

SEQ ID NO: 1492516 - RNA, 15 nt, Human
cccuaaccaaguucc

SEQ ID NO: 1492517 - RNA, 12 nt, Human
cccuaauaaagc

SEQ ID NO: 1492518 - RNA, 13 nt, Human
cccuaauaaagcu

SEQ ID NO: 1492519 - RNA, 14 nt, Human
cccuaauaaagcug

SEQ ID NO: 1492520 - RNA, 15 nt, Human
cccuaauaaagcugu

SEQ ID NO: 1492521 - RNA, 18 nt, Human
cccuaauaaagcugugug

SEQ ID NO: 1492522 - RNA, 12 nt, Human
cccucaugcugu

SEQ ID NO: 1492523 - RNA, 16 nt, Human
cccugggaggcucugg

SEQ ID NO: 1492524 - RNA, 17 nt, Human
cccugggaggcucugga

SEQ ID NO: 1492525 - RNA, 18 nt, Human
cccugggaggcucuggag

SEQ ID NO: 1492526 - RNA, 15 nt, Human
cccuggaaaccuucc

SEQ ID NO: 1492527 - RNA, 16 nt, Human
cccuggaaaccuucca

SEQ ID NO: 1492528 - RNA, 19 nt, Human
cccuggaaaccuuccaccc

SEQ ID NO: 1492529 - RNA, 21 nt, Human
cccuggaaaccuuccacccag

SEQ ID NO: 1492530 - RNA, 22 nt, Human
cccuggaaaccuuccacccagu

SEQ ID NO: 1492531 - RNA, 21 nt, Human
cccugccucucugcagguccc

SEQ ID NO: 1492532 - RNA, 22 nt, Human
cccugccucucugcaggucccu

SEQ ID NO: 1492533 - RNA, 14 nt, Human
cccugccaccuccu

SEQ ID NO: 1492534 - RNA, 17 nt, Human
cccugccaccuccugcc

SEQ ID NO: 1492535 - RNA, 11 nt, Human
cccugccucuc

SEQ ID NO: 1492536 - RNA, 18 nt, Human
cccugccucucugcaggu

SEQ ID NO: 1492537 - RNA, 22 nt, Human
ccuagguauaauucacauugua

SEQ ID NO: 1492538 - RNA, 13 nt, Human
ccuaaacauauga

SEQ ID NO: 1492539 - RNA, 16 nt, Human
cccuucaugcauggaa

SEQ ID NO: 1492540 - RNA, 14 nt, Human
cccuucaucuggaa

SEQ ID NO: 1492541 - RNA, 16 nt, Human
cccuucaucuggaacc

SEQ ID NO: 1492542 - RNA, 16 nt, Human
ccggaucugagggaga

SEQ ID NO: 1492543 - RNA, 12 nt, Human
ccucacacuggg

SEQ ID NO: 1492544 - RNA, 13 nt, Human
ccucacacuggga

SEQ ID NO: 1492545 - RNA, 15 nt, Human
ccucacacugggacu

SEQ ID NO: 1492546 - RNA, 21 nt, Human
ccuauucaacacacacaugcu

SEQ ID NO: 1492547 - RNA, 23 nt, Human
ccuauucaacacacacaugcuuc

SEQ ID NO: 1492548 - RNA, 18 nt, Human
ccucaccagcccuggcaa

SEQ ID NO: 1492549 - RNA, 15 nt, Human
ccucguggacaccug

SEQ ID NO: 1492550 - RNA, 16 nt, Human
ccucguggacaccugc

SEQ ID NO: 1492551 - RNA, 17 nt, Human
ccucguggacaccugcc

SEQ ID NO: 1492552 - RNA, 18 nt, Human
ccucguggacaccugccc

SEQ ID NO: 1492553 - RNA, 20 nt, Human
ccucguggacaccugcccug

SEQ ID NO: 1492554 - RNA, 21 nt, Human
ccucguggacaccugcccugc

SEQ ID NO: 1492555 - RNA, 22 nt, Human
ccucguggacaccugcccugcc

SEQ ID NO: 1492556 - RNA, 20 nt, Human
ccuccacucuuucuuucaau

SEQ ID NO: 1492557 - RNA, 15 nt, Human
ccuccacucuuucuu

SEQ ID NO: 1492558 - RNA, 20 nt, Human
ccuccaggguggcagcaaca

SEQ ID NO: 1492559 - RNA, 21 nt, Human
ccuccaggguggcagcaacaa

SEQ ID NO: 1492560 - RNA, 19 nt, Human
ccauggacacuacacccag

SEQ ID NO: 1492561 - RNA, 20 nt, Human
ccauggacacuacacccagc

SEQ ID NO: 1492562 - RNA, 21 nt, Human
ccauggacacuacacccagca

SEQ ID NO: 1492563 - RNA, 22 nt, Human
ccauggacacuacacccagcaa

SEQ ID NO: 1492564 - RNA, 23 nt, Human
ccauggacacuacacccagcaau

SEQ ID NO: 1492565 - RNA, 18 nt, Human
ccauucauuccauucugg

SEQ ID NO: 1492566 - RNA, 20 nt, Human
ccauucauuccauucuggaa

SEQ ID NO: 1492567 - RNA, 17 nt, Human
cccaggacaggauccag

SEQ ID NO: 1492568 - RNA, 10 nt, Human
cccaggacag

SEQ ID NO: 1492569 - RNA, 14 nt, Human
ccagggaccggcgg

SEQ ID NO: 1492570 - RNA, 12 nt, Human
ccagugcugaau

SEQ ID NO: 1492571 - RNA, 22 nt, Human
ccagugcugaauuucccucucu

SEQ ID NO: 1492572 - RNA, 20 nt, Human
ccagugggaggugagaccac

SEQ ID NO: 1492573 - RNA, 23 nt, Human
ccagugggaggugagaccaccuc

SEQ ID NO: 1492574 - RNA, 20 nt, Human
ccaucagaaacacccucaca

SEQ ID NO: 1492575 - RNA, 18 nt, Human
ccaucagaaacacccuca

SEQ ID NO: 1492576 - RNA, 18 nt, Human
cauuugcucauggaauug

SEQ ID NO: 1492577 - RNA, 16 nt, Human
cauuugcucauggaau

SEQ ID NO: 1492578 - RNA, 15 nt, Human
cauuugcucauggaa

SEQ ID NO: 1492579 - RNA, 15 nt, Human
cauuuccuaaauaua

SEQ ID NO: 1492580 - RNA, 15 nt, Human
cauugaccuauuucc

SEQ ID NO: 1492581 - RNA, 21 nt, Human
cauugaccuauuuccagaaau

SEQ ID NO: 1492582 - RNA, 15 nt, Human
caugcauggaaauuc

SEQ ID NO: 1492583 - RNA, 17 nt, Human
caugcauggaaauuccc

SEQ ID NO: 1492584 - RNA, 20 nt, Human
caugcuguucaugaaagauu

SEQ ID NO: 1492585 - RNA, 23 nt, Human
caugcugucuacacuaagagaga

SEQ ID NO: 1492586 - RNA, 15 nt, Human
caugcuucccuuucc

SEQ ID NO: 1492587 - RNA, 21 nt, Human
cauggacacuacacccagcaa

SEQ ID NO: 1492588 - RNA, 22 nt, Human
cauggacacuacacccagcaau

SEQ ID NO: 1492589 - RNA, 23 nt, Human
cauggacacuacacccagcaaua

SEQ ID NO: 1492590 - RNA, 22 nt, Human
cauguuucuuuguaaugaaaac

SEQ ID NO: 1492591 - RNA, 21 nt, Human
cauguuucuuuguaaugaaaa

SEQ ID NO: 1492592 - RNA, 15 nt, Human
caugugaaaucauuc

SEQ ID NO: 1492593 - RNA, 16 nt, Human
caugugaaaucauuca

SEQ ID NO: 1492594 - RNA, 17 nt, Human
caugugaaaucauucau

SEQ ID NO: 1492595 - RNA, 13 nt, Human
caucccucaccca

SEQ ID NO: 1492596 - RNA, 14 nt, Human
caucccucacccau

SEQ ID NO: 1492597 - RNA, 20 nt, Human
caucccucacccauccuaga

SEQ ID NO: 1492598 - RNA, 23 nt, Human
cauccagcagauuuccagccuuc

SEQ ID NO: 1492599 - RNA, 13 nt, Human
cauccagggggca

SEQ ID NO: 1492600 - RNA, 19 nt, Human
caucucagcucacugcaac

SEQ ID NO: 1492601 - RNA, 20 nt, Human
caucucagcucacugcaacc

SEQ ID NO: 1492602 - RNA, 22 nt, Human
caucuagugagcagucaggaaa

SEQ ID NO: 1492603 - RNA, 17 nt, Human
caucuauagaaagcuau

SEQ ID NO: 1492604 - RNA, 11 nt, Human
cauccucucca

SEQ ID NO: 1492605 - RNA, 12 nt, Human
caucuaggauuu

SEQ ID NO: 1492606 - RNA, 14 nt, Human
caucuagugagcag

SEQ ID NO: 1492607 - RNA, 18 nt, Human
caucuagguaaauuacag

SEQ ID NO: 1492608 - RNA, 17 nt, Human
caucuagguaaauuaca

SEQ ID NO: 1492609 - RNA, 16 nt, Human
caucucuuguuuaaau

SEQ ID NO: 1492610 - RNA, 15 nt, Human
cauaugauguacaug

SEQ ID NO: 1492611 - RNA, 17 nt, Human
cauaugauguacaugua

SEQ ID NO: 1492612 - RNA, 21 nt, Human
cauaugauguacauguacuga

SEQ ID NO: 1492613 - RNA, 14 nt, Human
cauagaauaaaauu

SEQ ID NO: 1492614 - RNA, 20 nt, Human
cauagaauaaaauuuuuaau

SEQ ID NO: 1492615 - RNA, 12 nt, Human
cauauuuauaaa

SEQ ID NO: 1492616 - RNA, 17 nt, Human
cauauuuauaaaaauaa

SEQ ID NO: 1492617 - RNA, 22 nt, Human
caucaagucuuucacauuuaaa

SEQ ID NO: 1492618 - RNA, 12 nt, Human
cauauuuucaug

SEQ ID NO: 1492619 - RNA, 11 nt, Human
caguugcagcc

SEQ ID NO: 1492620 - RNA, 22 nt, Human
cauaaaaaggacaucagcaaac

SEQ ID NO: 1492621 - RNA, 13 nt, Human
cauaaaaaggaca

SEQ ID NO: 1492622 - RNA, 19 nt, Human
cauaaaaaggacaucagca

SEQ ID NO: 1492623 - RNA, 20 nt, Human
cauaaaaaggacaucagcaa

SEQ ID NO: 1492624 - RNA, 21 nt, Human
cauaaaaaggacaucagcaaa

SEQ ID NO: 1492625 - RNA, 14 nt, Human
cauaaagcaggcag

SEQ ID NO: 1492626 - RNA, 16 nt, Human
cauaaagcaggcagaa

SEQ ID NO: 1492627 - RNA, 20 nt, Human
cauaaauuuaguauuuuguu

SEQ ID NO: 1492628 - RNA, 19 nt, Human
cauaaauuuaguauuuugu

SEQ ID NO: 1492629 - RNA, 18 nt, Human
cauaagcuuaugcuuaaa

SEQ ID NO: 1492630 - RNA, 17 nt, Human
cauaauccaguaaaaua

SEQ ID NO: 1492631 - RNA, 18 nt, Human
cauaauccaguaaaauaa

SEQ ID NO: 1492632 - RNA, 15 nt, Human
cauaauacuugcuuu

SEQ ID NO: 1492633 - RNA, 22 nt, Human
caguucggugagcuacaaaugc

SEQ ID NO: 1492634 - RNA, 12 nt, Human
caguucugaaga

SEQ ID NO: 1492635 - RNA, 14 nt, Human
caguucugaagaag

SEQ ID NO: 1492636 - RNA, 13 nt, Human
caguucugaagaa

SEQ ID NO: 1492637 - RNA, 22 nt, Human
caguucugaagaagaugguacc

SEQ ID NO: 1492638 - RNA, 16 nt, Human
caguucugaagaagau

SEQ ID NO: 1492639 - RNA, 15 nt, Human
caguucugaagaaga

SEQ ID NO: 1492640 - RNA, 21 nt, Human
caguuaccucugccucagaaa

SEQ ID NO: 1492641 - RNA, 21 nt, Human
caguuaacuauugcauuuaua

SEQ ID NO: 1492642 - RNA, 24 nt, Human
caguuaacuauugcauuuauaugu

SEQ ID NO: 1492643 - RNA, 21 nt, Human
caguggcaucaucucagcuca

SEQ ID NO: 1492644 - RNA, 21 nt, Human
caguggcgcgaucucagcuca

SEQ ID NO: 1492645 - RNA, 21 nt, Human
caguggcgugaucucagcuca

SEQ ID NO: 1492646 - RNA, 16 nt, Human
cgcccuggacugugug

SEQ ID NO: 1492647 - RNA, 17 nt, Human
cggcccacaauuaauuu

SEQ ID NO: 1492648 - RNA, 13 nt, Human
cgggacugcggag

SEQ ID NO: 1492649 - RNA, 14 nt, Human
cggggacucagccc

SEQ ID NO: 1492650 - RNA, 17 nt, Human
cggugagcuacaaaugc

SEQ ID NO: 1492651 - RNA, 12 nt, Human
cguggacaccug

SEQ ID NO: 1492652 - RNA, 13 nt, Human
cguggacaccugc

SEQ ID NO: 1492653 - RNA, 14 nt, Human
cguggacaccugcc

SEQ ID NO: 1492654 - RNA, 15 nt, Human
cguggacaccugccc

SEQ ID NO: 1492655 - RNA, 17 nt, Human
cguggacaccugcccug

SEQ ID NO: 1492656 - RNA, 18 nt, Human
cguggacaccugcccugc

SEQ ID NO: 1492657 - RNA, 19 nt, Human
cguggacaccugcccugcc

SEQ ID NO: 1492658 - RNA, 18 nt, Human
cuaaauauauuuuaagac

SEQ ID NO: 1492659 - RNA, 20 nt, Human
cuaaauauauuuuaagacga

SEQ ID NO: 1492660 - RNA, 15 nt, Human
cuaacaugauuuggg

SEQ ID NO: 1492661 - RNA, 18 nt, Human
cuauuuuaauaaacacuc

SEQ ID NO: 1492662 - RNA, 22 nt, Human
cuauuuuaauaaacacucuuga

SEQ ID NO: 1492663 - RNA, 17 nt, Human
cucacccauccuagagg

SEQ ID NO: 1492664 - RNA, 14 nt, Human
cucacccauccuag

SEQ ID NO: 1492665 - RNA, 15 nt, Human
cucacccauccuaga

SEQ ID NO: 1492666 - RNA, 13 nt, Human
cucacauuuauau

SEQ ID NO: 1492667 - RNA, 19 nt, Human
cuauauuguuugcuaagca

SEQ ID NO: 1492668 - RNA, 18 nt, Human
cuaugaaauauuauguua

SEQ ID NO: 1492669 - RNA, 21 nt, Human
cuaucuuugccacccucaugc

SEQ ID NO: 1492670 - RNA, 13 nt, Human
cuaugaaauauua

SEQ ID NO: 1492671 - RNA, 14 nt, Human
cuaucuuugccacc

SEQ ID NO: 1492672 - RNA, 15 nt, Human
cuaucuuugccaccc

SEQ ID NO: 1492673 - RNA, 18 nt, Human
cuaucuuugccacccuca

SEQ ID NO: 1492674 - RNA, 19 nt, Human
cuaucuuugccacccucau

SEQ ID NO: 1492675 - RNA, 12 nt, Human
cuaucuuugcca

SEQ ID NO: 1492676 - RNA, 13 nt, Human
cuaguguagaauu

SEQ ID NO: 1492677 - RNA, 20 nt, Human
cuaguguagaauugugcaac

SEQ ID NO: 1492678 - RNA, 20 nt, Human
cuaggcaguucaaagcagga

SEQ ID NO: 1492679 - RNA, 20 nt, Human
cuaguauuucuaugaaauau

SEQ ID NO: 1492680 - RNA, 19 nt, Human
cuaguauuucuaugaaaua

SEQ ID NO: 1492681 - RNA, 22 nt, Human
cuaguauuucuaugaaauauua

SEQ ID NO: 1492682 - RNA, 22 nt, Human
cuaggacugaauuaugaaacuu

SEQ ID NO: 1492683 - RNA, 17 nt, Human
cuagcaaaagugcaaga

SEQ ID NO: 1492684 - RNA, 16 nt, Human
cuagcaaaagugcaag

SEQ ID NO: 1492685 - RNA, 15 nt, Human
cuacccuaaccaagu

SEQ ID NO: 1492686 - RNA, 21 nt, Human
cuacuguaaggcaaucauggu

SEQ ID NO: 1492687 - RNA, 22 nt, Human
cuacuuauuguagcauccugga

SEQ ID NO: 1492688 - RNA, 22 nt, Human
cuacuuucugugucuauggauu

SEQ ID NO: 1492689 - RNA, 23 nt, Human
cuacuucuuuuuucaaaagaaag

SEQ ID NO: 1492690 - RNA, 12 nt, Human
cuaauaaagcug

SEQ ID NO: 1492691 - RNA, 13 nt, Human
cuaauaaagcugu

SEQ ID NO: 1492692 - RNA, 14 nt, Human
cuaauaaagcugug

SEQ ID NO: 1492693 - RNA, 16 nt, Human
cuaaucuacuuucugu

SEQ ID NO: 1492694 - RNA, 23 nt, Human
cuaauguggaccuuagaauacag

SEQ ID NO: 1492695 - RNA, 12 nt, Human
cuaccaggaaag

SEQ ID NO: 1492696 - RNA, 13 nt, Human
cucccuacccuaa

SEQ ID NO: 1492697 - RNA, 21 nt, Human
cucccaaagugcugggauuaa

SEQ ID NO: 1492698 - RNA, 22 nt, Human
cucccaagcaccugggauuaca

SEQ ID NO: 1492699 - RNA, 20 nt, Human
cuccauggcccugccaugcu

SEQ ID NO: 1492700 - RNA, 19 nt, Human
cuccauggcccugccaugc

SEQ ID NO: 1492701 - RNA, 15 nt, Human
cuccuccaccucaac

SEQ ID NO: 1492702 - RNA, 14 nt, Human
cuccuccaccucaa

SEQ ID NO: 1492703 - RNA, 21 nt, Human
cuccuccaggguggcagcaac

SEQ ID NO: 1492704 - RNA, 22 nt, Human
cuccuccaggguggcagcaaca

SEQ ID NO: 1492705 - RNA, 13 nt, Human
cucuaacauuucc

SEQ ID NO: 1492706 - RNA, 17 nt, Human
cucuaggaaauauuuau

SEQ ID NO: 1492707 - RNA, 15 nt, Human
cucuaggaaauauuu

SEQ ID NO: 1492708 - RNA, 15 nt, Human
cucuauaccaauaaa

SEQ ID NO: 1492709 - RNA, 16 nt, Human
cucuauaccaauaaag

SEQ ID NO: 1492710 - RNA, 17 nt, Human
cucuauaccaauaaagu

SEQ ID NO: 1492711 - RNA, 15 nt, Human
cucuccaaaccacuu

SEQ ID NO: 1492712 - RNA, 16 nt, Human
cucuccaaaccacuuu

SEQ ID NO: 1492713 - RNA, 18 nt, Human
cucuccagccucagcucu

SEQ ID NO: 1492714 - RNA, 21 nt, Human
cucucucauacccucccuccc

SEQ ID NO: 1492715 - RNA, 17 nt, Human
cugacucuuaagaagac

SEQ ID NO: 1492716 - RNA, 11 nt, Human
cugagaaauuu

SEQ ID NO: 1492717 - RNA, 14 nt, Human
cugagaaauuuaua

SEQ ID NO: 1492718 - RNA, 17 nt, Human
cugaggaucagaguaau

SEQ ID NO: 1492719 - RNA, 19 nt, Human
cugaggaucagaguaaucc

SEQ ID NO: 1492720 - RNA, 15 nt, Human
cucuguucauuccuc

SEQ ID NO: 1492721 - RNA, 17 nt, Human
cucuguucauuccucca

SEQ ID NO: 1492722 - RNA, 18 nt, Human
cucuguucauuccuccag

SEQ ID NO: 1492723 - RNA, 19 nt, Human
cucuguucauuccuccagg

SEQ ID NO: 1492724 - RNA, 22 nt, Human
cucugucuccuaagcuggagug

SEQ ID NO: 1492725 - RNA, 23 nt, Human
cugaagaagcaccaaucaugaau

SEQ ID NO: 1492726 - RNA, 16 nt, Human
cugaaauuuccuggga

SEQ ID NO: 1492727 - RNA, 23 nt, Human
cugaaauuuccugggagcuuuug

SEQ ID NO: 1492728 - RNA, 13 nt, Human
cugaaauuuccug

SEQ ID NO: 1492729 - RNA, 17 nt, Human
cucuuucuuucaauaaa

SEQ ID NO: 1492730 - RNA, 21 nt, Human
cugaaauaaacgucuuaaaua

SEQ ID NO: 1492731 - RNA, 14 nt, Human
cucuucccucuucc

SEQ ID NO: 1492732 - RNA, 20 nt, Human
cucuuuaaaaggaaagaaaa

SEQ ID NO: 1492733 - RNA, 23 nt, Human
cucuuuaaaaggaaagaaaacau

SEQ ID NO: 1492734 - RNA, 19 nt, Human
cucuuuaaaaggaaagaaa

SEQ ID NO: 1492735 - RNA, 13 nt, Human
cugcugccugccu

SEQ ID NO: 1492736 - RNA, 15 nt, Human
cugcugcugccugcc

SEQ ID NO: 1492737 - RNA, 19 nt, Human
cugcuucugacauaaucca

SEQ ID NO: 1492738 - RNA, 15 nt, Human
cuggaagugacuuug

SEQ ID NO: 1492739 - RNA, 18 nt, Human
cuggaagugacuuuggcu

SEQ ID NO: 1492740 - RNA, 14 nt, Human
cugcccugcccugc

SEQ ID NO: 1492741 - RNA, 15 nt, Human
cugcccugcccugcc

SEQ ID NO: 1492742 - RNA, 22 nt, Human
cugcccucucccaaaaaacuac

SEQ ID NO: 1492743 - RNA, 22 nt, Human
cugcgcccuuaacugcauccag

SEQ ID NO: 1492744 - RNA, 22 nt, Human
cugccugcuuuuuauggccugu

SEQ ID NO: 1492745 - RNA, 11 nt, Human
cugcugccugc

SEQ ID NO: 1492746 - RNA, 14 nt, Human
cugcugccugcuuu

SEQ ID NO: 1492747 - RNA, 23 nt, Human
cugcugccugcuuuuuauggccu

SEQ ID NO: 1492748 - RNA, 11 nt, Human
cugcagguccc

SEQ ID NO: 1492749 - RNA, 12 nt, Human
cugcaggucccu

SEQ ID NO: 1492750 - RNA, 13 nt, Human
cugcaggucccua

SEQ ID NO: 1492751 - RNA, 14 nt, Human
cugcaggucccuaa

SEQ ID NO: 1492752 - RNA, 15 nt, Human
cugcaggucccuaau

SEQ ID NO: 1492753 - RNA, 16 nt, Human
cugcaggucccuaaua

SEQ ID NO: 1492754 - RNA, 17 nt, Human
cugcaggucccuaauaa

SEQ ID NO: 1492755 - RNA, 18 nt, Human
cugcaggucccuaauaaa

SEQ ID NO: 1492756 - RNA, 17 nt, Human
cugcagucucuauacca

SEQ ID NO: 1492757 - RNA, 21 nt, Human
cugcagucucuauaccaauaa

SEQ ID NO: 1492758 - RNA, 23 nt, Human
cugcagucucuauaccaauaaag

SEQ ID NO: 1492759 - RNA, 19 nt, Human
cugcaggucccuaauaaag

SEQ ID NO: 1492760 - RNA, 20 nt, Human
cugcaggucccuaauaaagc

SEQ ID NO: 1492761 - RNA, 21 nt, Human
cugcaggucccuaauaaagcu

SEQ ID NO: 1492762 - RNA, 22 nt, Human
cugcaggucccuaauaaagcug

SEQ ID NO: 1492763 - RNA, 23 nt, Human
cugcaggucccuaauaaagcugu

SEQ ID NO: 1492764 - RNA, 23 nt, Human
cuggcauuacaggugugagccac

SEQ ID NO: 1492765 - RNA, 20 nt, Human
cuggaagugcuaauuuugaa

SEQ ID NO: 1492766 - RNA, 10 nt, Human
cugggccccu

SEQ ID NO: 1492767 - RNA, 23 nt, Human
cugggauuacaggugugagccac

SEQ ID NO: 1492768 - RNA, 17 nt, Human
cugggaggcucuggagc

SEQ ID NO: 1492769 - RNA, 22 nt, Human
cugggaggcucuggagcccacu

SEQ ID NO: 1492770 - RNA, 18 nt, Human
cugggaggcucuggagcc

SEQ ID NO: 1492771 - RNA, 20 nt, Human
cugggaggcucuggagccca

SEQ ID NO: 1492772 - RNA, 21 nt, Human
cugggaggcucuggagcccac

SEQ ID NO: 1492773 - RNA, 13 nt, Human
cugguguuucuug

SEQ ID NO: 1492774 - RNA, 14 nt, Human
cugguguuucuuga

SEQ ID NO: 1492775 - RNA, 18 nt, Human
cuguaaggcaaucauggu

SEQ ID NO: 1492776 - RNA, 17 nt, Human
cugggucgcccuggacu

SEQ ID NO: 1492777 - RNA, 18 nt, Human
cugggucgcccuggacug

SEQ ID NO: 1492778 - RNA, 22 nt, Human
cugggucgcccuggacugugug

SEQ ID NO: 1492779 - RNA, 19 nt, Human
cuguauuuuaaaagaauga

SEQ ID NO: 1492780 - RNA, 16 nt, Human
cuguauuuuaaaagaa

SEQ ID NO: 1492781 - RNA, 13 nt, Human
cuguauuuuaaaa

SEQ ID NO: 1492782 - RNA, 15 nt, Human
cuguaugauucccag

SEQ ID NO: 1492783 - RNA, 12 nt, Human
cuugaggacaca

SEQ ID NO: 1492784 - RNA, 13 nt, Human
cuugaggacacau

SEQ ID NO: 1492785 - RNA, 14 nt, Human
cuugaggacacaug

SEQ ID NO: 1492786 - RNA, 15 nt, Human
cuugaggacacaugu

SEQ ID NO: 1492787 - RNA, 16 nt, Human
cuugaggacacauguc

SEQ ID NO: 1492788 - RNA, 17 nt, Human
cuugaggacacaugucc

SEQ ID NO: 1492789 - RNA, 18 nt, Human
cuugaggacacaugucca

SEQ ID NO: 1492790 - RNA, 19 nt, Human
cuucuuuuuucaaaagaaa

SEQ ID NO: 1492791 - RNA, 20 nt, Human
cuucuuuuuucaaaagaaag

SEQ ID NO: 1492792 - RNA, 19 nt, Human
cuucuuuccacagaagcuc

SEQ ID NO: 1492793 - RNA, 13 nt, Human
cuucuuuccacag

SEQ ID NO: 1492794 - RNA, 15 nt, Human
cuugcuuuuaaaauc

SEQ ID NO: 1492795 - RNA, 17 nt, Human
cuugccaaauauaaaua

SEQ ID NO: 1492796 - RNA, 18 nt, Human
cuuguaaaggaauuuaaa

SEQ ID NO: 1492797 - RNA, 18 nt, Human
cuuguauuauguguguuu

SEQ ID NO: 1492798 - RNA, 13 nt, Human
cuuguauuaugug

SEQ ID NO: 1492799 - RNA, 19 nt, Human
cuuuauuuuguguuuagga

SEQ ID NO: 1492800 - RNA, 21 nt, Human
cuuugccacccucaugcugug

SEQ ID NO: 1492801 - RNA, 21 nt, Human
cuuucuuucaauaaaacgcag

SEQ ID NO: 1492802 - RNA, 19 nt, Human
cuuuuuuaucaugugaaau

SEQ ID NO: 1492803 - RNA, 16 nt, Human
cuuuuuucaaaagaaa

SEQ ID NO: 1492804 - RNA, 22 nt, Human
cuuuuaacuguuguagaagaca

SEQ ID NO: 1492805 - RNA, 22 nt, Human
cuuuuaaaugauugaauuauau

SEQ ID NO: 1492806 - RNA, 15 nt, Human
gaaaccuuccaccca

SEQ ID NO: 1492807 - RNA, 17 nt, Human
gaaaccuuccacccagu

SEQ ID NO: 1492808 - RNA, 20 nt, Human
gaaacuaggugcauauuuau

SEQ ID NO: 1492809 - RNA, 20 nt, Human
gaaagucagccauaucucca

SEQ ID NO: 1492810 - RNA, 17 nt, Human
gaacaggauauucucac

SEQ ID NO: 1492811 - RNA, 20 nt, Human
gaacaguuguguuugaagca

SEQ ID NO: 1492812 - RNA, 24 nt, Human
gaacaguuaccucugccucagaaa

SEQ ID NO: 1492813 - RNA, 22 nt, Human
gaacaguuguguuugaagcaca

SEQ ID NO: 1492814 - RNA, 21 nt, Human
gaaauuuccugggagcuuuug

SEQ ID NO: 1492815 - RNA, 23 nt, Human
gaaauuaguacuccccuccuuga

SEQ ID NO: 1492816 - RNA, 22 nt, Human
gaaauuaugugacauuuuacau

SEQ ID NO: 1492817 - RNA, 23 nt, Human
gaaauuaugugacauuuuacauu

SEQ ID NO: 1492818 - RNA, 17 nt, Human
gaaauucccuucaucug

SEQ ID NO: 1492819 - RNA, 21 nt, Human
gaaauucccuucaucuggaac

SEQ ID NO: 1492820 - RNA, 22 nt, Human
gaaauucccuucaucuggaacc

SEQ ID NO: 1492821 - RNA, 13 nt, Human
gaaauauuuauuu

SEQ ID NO: 1492822 - RNA, 16 nt, Human
gaaauauuuauuuuaa

SEQ ID NO: 1492823 - RNA, 15 nt, Human
gaaauauuuauuuua

SEQ ID NO: 1492824 - RNA, 21 nt, Human
gaaauaaacgucuuaaauauu

SEQ ID NO: 1492825 - RNA, 18 nt, Human
gaaauaaacgucuuaaau

SEQ ID NO: 1492826 - RNA, 17 nt, Human
gaaauaaacgucuuaaa

SEQ ID NO: 1492827 - RNA, 16 nt, Human
gaaauaaacgucuuaa

SEQ ID NO: 1492828 - RNA, 14 nt, Human
gaaauaaacgucuu

SEQ ID NO: 1492829 - RNA, 13 nt, Human
gaaggaggaccca

SEQ ID NO: 1492830 - RNA, 14 nt, Human
gaaggaggacccag

SEQ ID NO: 1492831 - RNA, 15 nt, Human
gaaggaggacccagg

SEQ ID NO: 1492832 - RNA, 16 nt, Human
gaaggaggacccagga

SEQ ID NO: 1492833 - RNA, 17 nt, Human
gaaggaggacccaggac

SEQ ID NO: 1492834 - RNA, 18 nt, Human
gaaggaggacccaggaca

SEQ ID NO: 1492835 - RNA, 19 nt, Human
gaaggaggacccaggacag

SEQ ID NO: 1492836 - RNA, 18 nt, Human
gaaggaaggcagggagga

SEQ ID NO: 1492837 - RNA, 19 nt, Human
gaaggaaggcagggaggag

SEQ ID NO: 1492838 - RNA, 20 nt, Human
gaaggaaggcagggaggagg

SEQ ID NO: 1492839 - RNA, 22 nt, Human
gaaggaaggcuccaucuccagu

SEQ ID NO: 1492840 - RNA, 21 nt, Human
gaaggugaggagcuugaaacc

SEQ ID NO: 1492841 - RNA, 14 nt, Human
gaaguaacuacagu

SEQ ID NO: 1492842 - RNA, 20 nt, Human
gaagucacauuccugaacag

SEQ ID NO: 1492843 - RNA, 16 nt, Human
gaagucacauuccuga

SEQ ID NO: 1492844 - RNA, 21 nt, Human
gaagucacauuccugaacagg

SEQ ID NO: 1492845 - RNA, 23 nt, Human
gaaguccaagcauuuagauguau

SEQ ID NO: 1492846 - RNA, 20 nt, Human
gaagaaagaacggaagaaga

SEQ ID NO: 1492847 - RNA, 19 nt, Human
gaaccaauaaaauaauuuu

SEQ ID NO: 1492848 - RNA, 15 nt, Human
gaaccacaagacugc

SEQ ID NO: 1492849 - RNA, 14 nt, Human
gaaccacaagacug

SEQ ID NO: 1492850 - RNA, 17 nt, Human
gaagauugagauguguu

SEQ ID NO: 1492851 - RNA, 22 nt, Human
gaagauugagauguguucacaa

SEQ ID NO: 1492852 - RNA, 14 nt, Human
gaagaucccccaga

SEQ ID NO: 1492853 - RNA, 15 nt, Human
gaagaucccccagaa

SEQ ID NO: 1492854 - RNA, 18 nt, Human
gaagaucccccagaaaag

SEQ ID NO: 1492855 - RNA, 22 nt, Human
gacagccaacuauggccugugg

SEQ ID NO: 1492856 - RNA, 19 nt, Human
gacagccaacuauggccug

SEQ ID NO: 1492857 - RNA, 18 nt, Human
gacaggauccaggccggc

SEQ ID NO: 1492858 - RNA, 13 nt, Human
gacaggauccagg

SEQ ID NO: 1492859 - RNA, 15 nt, Human
gacaggauccaggcc

SEQ ID NO: 1492860 - RNA, 22 nt, Human
gacaugggacauuugcucaugg

SEQ ID NO: 1492861 - RNA, 22 nt, Human
gacaauugagguaaguuuuuug

SEQ ID NO: 1492862 - RNA, 15 nt, Human
gacaagcucacagac

SEQ ID NO: 1492863 - RNA, 13 nt, Human
gacaccugcccug

SEQ ID NO: 1492864 - RNA, 14 nt, Human
gacaccugcccugc

SEQ ID NO: 1492865 - RNA, 15 nt, Human
gacaccugcccugcc

SEQ ID NO: 1492866 - RNA, 16 nt, Human
gacaccugcccugccc

SEQ ID NO: 1492867 - RNA, 22 nt, Human
gacaccugcccugcccugccac

SEQ ID NO: 1492868 - RNA, 23 nt, Human
gacaccugcccugcccugccacc

SEQ ID NO: 1492869 - RNA, 9 nt, Human
gacaccugc

SEQ ID NO: 1492870 - RNA, 10 nt, Human
gacaccugcc

SEQ ID NO: 1492871 - RNA, 11 nt, Human
gacaccugccc

SEQ ID NO: 1492872 - RNA, 12 nt, Human
gacaccugcccu

SEQ ID NO: 1492873 - RNA, 12 nt, Human
gacccaggacag

SEQ ID NO: 1492874 - RNA, 13 nt, Human
gacccaggacagg

SEQ ID NO: 1492875 - RNA, 22 nt, Human
gacccaggacaggauccaggcc

SEQ ID NO: 1492876 - RNA, 23 nt, Human
gaccugauuucugagcauuuaau

SEQ ID NO: 1492877 - RNA, 11 nt, Human
gaccugccucc

SEQ ID NO: 1492878 - RNA, 22 nt, Human
gaccugccucccuucaugcaug

SEQ ID NO: 1492879 - RNA, 19 nt, Human
gaccggcggaccccagcca

SEQ ID NO: 1492880 - RNA, 20 nt, Human
gaccggcggaccccagccau

SEQ ID NO: 1492881 - RNA, 16 nt, Human
gacggguuucaccaug

SEQ ID NO: 1492882 - RNA, 12 nt, Human
gagaccaccucu

SEQ ID NO: 1492883 - RNA, 11 nt, Human
gagacauccag

SEQ ID NO: 1492884 - RNA, 12 nt, Human
gagacauccagc

SEQ ID NO: 1492885 - RNA, 17 nt, Human
gagauacagaauuuuau

SEQ ID NO: 1492886 - RNA, 19 nt, Human
gagagacacacugaagaag

SEQ ID NO: 1492887 - RNA, 17 nt, Human
gagagagguugaaaaac

SEQ ID NO: 1492888 - RNA, 19 nt, Human
gagagagguugaaaaacaa

SEQ ID NO: 1492889 - RNA, 12 nt, Human
gagaaaugaaaa

SEQ ID NO: 1492890 - RNA, 18 nt, Human
gagacacacugaagaagc

SEQ ID NO: 1492891 - RNA, 16 nt, Human
gagacagccaacuaug

SEQ ID NO: 1492892 - RNA, 16 nt, Human
gagaagaacugaaauc

SEQ ID NO: 1492893 - RNA, 14 nt, Human
gagaagaacugaaa

SEQ ID NO: 1492894 - RNA, 20 nt, Human
gagcagagcugauggagaag

SEQ ID NO: 1492895 - RNA, 23 nt, Human
gagcagagcugauggagaaggaa

SEQ ID NO: 1492896 - RNA, 20 nt, Human
gagccaggaagaucccccag

SEQ ID NO: 1492897 - RNA, 21 nt, Human
gagccaggaagaucccccaga

SEQ ID NO: 1492898 - RNA, 18 nt, Human
gagcccacuguacuugcu

SEQ ID NO: 1492899 - RNA, 21 nt, Human
gagcccacuguacuugcucuu

SEQ ID NO: 1492900 - RNA, 23 nt, Human
gagcccacuguacuugcucuuga

SEQ ID NO: 1492901 - RNA, 23 nt, Human
gagcccuucuauacccacccaga

SEQ ID NO: 1492902 - RNA, 14 nt, Human
gagcuuuuguagaa

SEQ ID NO: 1492903 - RNA, 15 nt, Human
gagcugauggagaag

SEQ ID NO: 1492904 - RNA, 16 nt, Human
gagcugauggagaagg

SEQ ID NO: 1492905 - RNA, 16 nt, Human
gagcucgugggacagu

SEQ ID NO: 1492906 - RNA, 21 nt, Human
gaucaaguuauuuuuaauuug

SEQ ID NO: 1492907 - RNA, 14 nt, Human
gaucaguuaacuau

SEQ ID NO: 1492908 - RNA, 14 nt, Human
gaucauugugaaau

SEQ ID NO: 1492909 - RNA, 20 nt, Human
gaucauugugaaauuauuca

SEQ ID NO: 1492910 - RNA, 12 nt, Human
gaucccccagaa

SEQ ID NO: 1492911 - RNA, 19 nt, Human
gauaaaguugguaaaccuu

SEQ ID NO: 1492912 - RNA, 23 nt, Human
gauagauaggucagugcaaauac

SEQ ID NO: 1492913 - RNA, 11 nt, Human
gauacagaaaa

SEQ ID NO: 1492914 - RNA, 13 nt, Human
gauccuggaaauc

SEQ ID NO: 1492915 - RNA, 12 nt, Human
gaucucagcuca

SEQ ID NO: 1492916 - RNA, 17 nt, Human
gaucucagcucacuaca

SEQ ID NO: 1492917 - RNA, 17 nt, Human
gaucucagcucacugca

SEQ ID NO: 1492918 - RNA, 19 nt, Human
gaucucagcucacugcaac

SEQ ID NO: 1492919 - RNA, 10 nt, Human
gcaagccaga

SEQ ID NO: 1492920 - RNA, 20 nt, Human
gcaaggccugguguuucuug

SEQ ID NO: 1492921 - RNA, 21 nt, Human
gcaaacaggaucaguuaacua

SEQ ID NO: 1492922 - RNA, 18 nt, Human
gauggggguuucaccaua

SEQ ID NO: 1492923 - RNA, 19 nt, Human
gauuccagagcacugcucc

SEQ ID NO: 1492924 - RNA, 15 nt, Human
gauuuuccugaaaac

SEQ ID NO: 1492925 - RNA, 22 nt, Human
gauuuggucaacacuaacauga

SEQ ID NO: 1492926 - RNA, 14 nt, Human
gauuucugaggaaa

SEQ ID NO: 1492927 - RNA, 15 nt, Human
gauuuccagccuucu

SEQ ID NO: 1492928 - RNA, 14 nt, Human
gcacggcagccaca

SEQ ID NO: 1492929 - RNA, 16 nt, Human
gcacggcagccacagc

SEQ ID NO: 1492930 - RNA, 20 nt, Human
gcagcccugcugcugccugc

SEQ ID NO: 1492931 - RNA, 21 nt, Human
gcagcccugcugcugccugcc

SEQ ID NO: 1492932 - RNA, 17 nt, Human
gcagcaauuuaaauguu

SEQ ID NO: 1492933 - RNA, 12 nt, Human
gcagcaauuuaa

SEQ ID NO: 1492934 - RNA, 15 nt, Human
gcagcaauuuaaaug

SEQ ID NO: 1492935 - RNA, 16 nt, Human
gcagcaauuuaaaugu

SEQ ID NO: 1492936 - RNA, 17 nt, Human
gcagacauuuuaaaaaa

SEQ ID NO: 1492937 - RNA, 15 nt, Human
gcaguucugaagaag

SEQ ID NO: 1492938 - RNA, 17 nt, Human
gcaguucugaagaagau

SEQ ID NO: 1492939 - RNA, 13 nt, Human
gcauagaaguaaa

SEQ ID NO: 1492940 - RNA, 18 nt, Human
gcaguggcgcgaucucag

SEQ ID NO: 1492941 - RNA, 22 nt, Human
gcaguggcgcgaucucagcuca

SEQ ID NO: 1492942 - RNA, 17 nt, Human
gcauagguuuaauaauu

SEQ ID NO: 1492943 - RNA, 22 nt, Human
gcaguggcaucaucucagcuca

SEQ ID NO: 1492944 - RNA, 13 nt, Human
gcauuauauuuau

SEQ ID NO: 1492945 - RNA, 16 nt, Human
gcaucugaaaauugau

SEQ ID NO: 1492946 - RNA, 16 nt, Human
gcauuuguguugaaga

SEQ ID NO: 1492947 - RNA, 19 nt, Human
gcauucaaauguauuacag

SEQ ID NO: 1492948 - RNA, 20 nt, Human
gccccuggucccucugcagu

SEQ ID NO: 1492949 - RNA, 23 nt, Human
gccaggcugggucgcccuggacu

SEQ ID NO: 1492950 - RNA, 17 nt, Human
gccaggcugggucgccc

SEQ ID NO: 1492951 - RNA, 18 nt, Human
gcccugcugcugccugcc

SEQ ID NO: 1492952 - RNA, 14 nt, Human
gccucccagguuca

SEQ ID NO: 1492953 - RNA, 15 nt, Human
gccucccuucaugca

SEQ ID NO: 1492954 - RNA, 18 nt, Human
gccucccuucaugcaugg

SEQ ID NO: 1492955 - RNA, 20 nt, Human
gccucccuucaugcauggaa

SEQ ID NO: 1492956 - RNA, 22 nt, Human
gccucccuucaugcauggaaau

SEQ ID NO: 1492957 - RNA, 23 nt, Human
gccucccuucaugcauggaaauu

SEQ ID NO: 1492958 - RNA, 12 nt, Human
gccuguuuaaga

SEQ ID NO: 1492959 - RNA, 13 nt, Human
gccuguuuaagag

SEQ ID NO: 1492960 - RNA, 13 nt, Human
gccuuuggcaggu

SEQ ID NO: 1492961 - RNA, 15 nt, Human
gccuuuggcaggugc

SEQ ID NO: 1492962 - RNA, 16 nt, Human
gccuuugaccugccuc

SEQ ID NO: 1492963 - RNA, 15 nt, Human
gcgcgaucucagcuc

SEQ ID NO: 1492964 - RNA, 16 nt, Human
gcgcgaucucagcuca

SEQ ID NO: 1492965 - RNA, 18 nt, Human
uuuuggucuggagggaag

SEQ ID NO: 1492966 - RNA, 14 nt, Human
uuuuccugaaaacc

SEQ ID NO: 1492967 - RNA, 18 nt, Human
uuuucuaaaguaaaaaca

SEQ ID NO: 1492968 - RNA, 18 nt, Human
uuuuuaaaaaagaaacau

SEQ ID NO: 1492969 - RNA, 12 nt, Human
uuuuuaaagacu

SEQ ID NO: 1492970 - RNA, 13 nt, Human
uuuuuaaagacuu

SEQ ID NO: 1492971 - RNA, 18 nt, Human
uuuuuaaagacuuuuaug

SEQ ID NO: 1492972 - RNA, 23 nt, Human
uuuuucucugauacagaaaaguu

SEQ ID NO: 1492973 - RNA, 19 nt, Human
uuuuucucuaggaaauauu

SEQ ID NO: 1492974 - RNA, 15 nt, Human
uuuuugaagcuguau

SEQ ID NO: 1492975 - RNA, 10 nt, Human
uuuuuugaga

SEQ ID NO: 1492976 - RNA, 16 nt, Human
uuuuuugggcagcaau

SEQ ID NO: 1492977 - RNA, 20 nt, Human
uuuuugaaaagcagacauuu

SEQ ID NO: 1492978 - RNA, 12 nt, Human
uuuuaaauguau

SEQ ID NO: 1492979 - RNA, 16 nt, Human
uuuuaaauguauacua

SEQ ID NO: 1492980 - RNA, 18 nt, Human
uuuuaaagacuuuuauga

SEQ ID NO: 1492981 - RNA, 21 nt, Human
uuuuaaaagaaugauuaugaa

SEQ ID NO: 1492982 - RNA, 15 nt, Human
uuugcaucugaaaau

SEQ ID NO: 1492983 - RNA, 19 nt, Human
uuugguuuucacauuggaa

SEQ ID NO: 1492984 - RNA, 21 nt, Human
uuuggugcuucucagauuucu

SEQ ID NO: 1492985 - RNA, 16 nt, Human
uuuguauaaaauaauu

SEQ ID NO: 1492986 - RNA, 14 nt, Human
uuuguauaaaauaa

SEQ ID NO: 1492987 - RNA, 13 nt, Human
uuuguauaaaaua

SEQ ID NO: 1492988 - RNA, 19 nt, Human
uuuggacaaaauggaauac

SEQ ID NO: 1492989 - RNA, 18 nt, Human
uuugaaucaucaagucuu

SEQ ID NO: 1492990 - RNA, 21 nt, Human
uuacauuuuuugggcagcaau

SEQ ID NO: 1492991 - RNA, 12 nt, Human
uuucuaaaguaa

SEQ ID NO: 1492992 - RNA, 14 nt, Human
uuucuaaaguaaaa

SEQ ID NO: 1492993 - RNA, 21 nt, Human
uuucugaaauuuccugggagc

SEQ ID NO: 1492994 - RNA, 18 nt, Human
uuucucugauacagaaaa

SEQ ID NO: 1492995 - RNA, 17 nt, Human
uuucucugauacagaaa

SEQ ID NO: 1492996 - RNA, 16 nt, Human
uuucucugauacagaa

SEQ ID NO: 1492997 - RNA, 15 nt, Human
uuucucugauacaga

SEQ ID NO: 1492998 - RNA, 13 nt, Human
guauauuacaaug

SEQ ID NO: 1492999 - RNA, 14 nt, Human
guauauuacaauga

SEQ ID NO: 1493000 - RNA, 12 nt, Human
guaucucuucag

SEQ ID NO: 1493001 - RNA, 13 nt, Human
guaucucuucagu

SEQ ID NO: 1493002 - RNA, 17 nt, Human
guaucucuucagucucu

SEQ ID NO: 1493003 - RNA, 19 nt, Human
guaugaacuugaggacaca

SEQ ID NO: 1493004 - RNA, 20 nt, Human
guaugaacuugaggacacau

SEQ ID NO: 1493005 - RNA, 22 nt, Human
guaugaacuugaggacacaugu

SEQ ID NO: 1493006 - RNA, 23 nt, Human
guaugaacuugaggacacauguc

SEQ ID NO: 1493007 - RNA, 17 nt, Human
guaugaaccaccgcgcc

SEQ ID NO: 1493008 - RNA, 15 nt, Human
guaugaacuugagga

SEQ ID NO: 1493009 - RNA, 16 nt, Human
guaugaacuugaggac

SEQ ID NO: 1493010 - RNA, 17 nt, Human
guauguuagugcaaauu

SEQ ID NO: 1493011 - RNA, 21 nt, Human
guagcauuuguguugaagagg

SEQ ID NO: 1493012 - RNA, 16 nt, Human
guagcauccuggaaua

SEQ ID NO: 1493013 - RNA, 19 nt, Human
guagaguugaucaaaauca

SEQ ID NO: 1493014 - RNA, 22 nt, Human
guaggggcuuauaauaaaggac

SEQ ID NO: 1493015 - RNA, 22 nt, Human
guaguagcguuuuuuaaaugua

SEQ ID NO: 1493016 - RNA, 17 nt, Human
guaguguuggagaagaa

SEQ ID NO: 1493017 - RNA, 15 nt, Human
guaguguuggagaag

SEQ ID NO: 1493018 - RNA, 14 nt, Human
guaguguuggagaa

SEQ ID NO: 1493019 - RNA, 17 nt, Human
guauaauucacauugua

SEQ ID NO: 1493020 - RNA, 15 nt, Human
guauacuauaguacc

SEQ ID NO: 1493021 - RNA, 16 nt, Human
gucacuacgccuggcu

SEQ ID NO: 1493022 - RNA, 19 nt, Human
gucacguuuggugcuucuc

SEQ ID NO: 1493023 - RNA, 22 nt, Human
gucaauaaaauccauacauuug

SEQ ID NO: 1493024 - RNA, 23 nt, Human
gucaauaaaauccauacauuugu

SEQ ID NO: 1493025 - RNA, 13 nt, Human
gucaccagagacu

SEQ ID NO: 1493026 - RNA, 16 nt, Human
gucaccagagacuuua

SEQ ID NO: 1493027 - RNA, 20 nt, Human
guauuuuaaaagaaugauua

SEQ ID NO: 1493028 - RNA, 13 nt, Human
gucaggaaagaga

SEQ ID NO: 1493029 - RNA, 21 nt, Human
gucauucagauaugauucaaa

SEQ ID NO: 1493030 - RNA, 15 nt, Human
gucccaucccugcgu

SEQ ID NO: 1493031 - RNA, 16 nt, Human
gucccuaauaaagcug

SEQ ID NO: 1493032 - RNA, 17 nt, Human
gucccuaauaaagcugu

SEQ ID NO: 1493033 - RNA, 18 nt, Human
gucccuaauaaagcugug

SEQ ID NO: 1493034 - RNA, 20 nt, Human
gucccuaauaaagcugugug

SEQ ID NO: 1493035 - RNA, 19 nt, Human
gucucuucugaauaaagca

SEQ ID NO: 1493036 - RNA, 20 nt, Human
gucucuucugaauaaagcaa

SEQ ID NO: 1493037 - RNA, 21 nt, Human
gucucuucugaauaaagcaau

SEQ ID NO: 1493038 - RNA, 22 nt, Human
gucucuucugaauaaagcaauu

SEQ ID NO: 1493039 - RNA, 23 nt, Human
gucucuucugaauaaagcaauua

SEQ ID NO: 1493040 - RNA, 21 nt, Human
gucucuggauuauauuaugaa

SEQ ID NO: 1493041 - RNA, 19 nt, Human
gucucugaggggcuaccag

SEQ ID NO: 1493042 - RNA, 17 nt, Human
gucucuggaauuugaaa

SEQ ID NO: 1493043 - RNA, 17 nt, Human
gucucuauaccaauaaa

SEQ ID NO: 1493044 - RNA, 18 nt, Human
gucucuauaccaauaaag

SEQ ID NO: 1493045 - RNA, 19 nt, Human
gucucuauaccaauaaagu

SEQ ID NO: 1493046 - RNA, 18 nt, Human
gucgucaaagcugaaaug

SEQ ID NO: 1493047 - RNA, 19 nt, Human
gugauauaaguguguguuu

SEQ ID NO: 1493048 - RNA, 14 nt, Human
gugagcuacaaaug

SEQ ID NO: 1493049 - RNA, 18 nt, Human
gugaggagcuugaaaccc

SEQ ID NO: 1493050 - RNA, 24 nt, Human
gugcaguggcgugaucucagcuca

SEQ ID NO: 1493051 - RNA, 19 nt, Human
gugcagcccccacugccuu

SEQ ID NO: 1493052 - RNA, 20 nt, Human
gugauccacccgccucagcc

SEQ ID NO: 1493053 - RNA, 24 nt, Human
gugauccacccgccucagccuccc

SEQ ID NO: 1493054 - RNA, 13 nt, Human
gugcacuggcccc

SEQ ID NO: 1493055 - RNA, 16 nt, Human
gugcacuggccccacc

SEQ ID NO: 1493056 - RNA, 17 nt, Human
gugcacuggccccaccc

SEQ ID NO: 1493057 - RNA, 18 nt, Human
gugcacuggccccacccu

SEQ ID NO: 1493058 - RNA, 13 nt, Human
gugcuaauuuuga

SEQ ID NO: 1493059 - RNA, 15 nt, Human
gugcuaauuuugaaa

SEQ ID NO: 1493060 - RNA, 15 nt, Human
gugggcauucaaaug

SEQ ID NO: 1493061 - RNA, 13 nt, Human
gugguagagaagc

SEQ ID NO: 1493062 - RNA, 21 nt, Human
guguaaguagauaggccaugg

SEQ ID NO: 1493063 - RNA, 17 nt, Human
guguaagacaaaaagcu

SEQ ID NO: 1493064 - RNA, 14 nt, Human
guguaugcacagua

SEQ ID NO: 1493065 - RNA, 13 nt, Human
guguguuuuaaaa

SEQ ID NO: 1493066 - RNA, 16 nt, Human
guguguuuuaaaauga

SEQ ID NO: 1493067 - RNA, 19 nt, Human
guguguuuuaaaaugagaa

SEQ ID NO: 1493068 - RNA, 14 nt, Human
guguguuuuucaua

SEQ ID NO: 1493069 - RNA, 13 nt, Human
guguucugugaua

SEQ ID NO: 1493070 - RNA, 18 nt, Human
guguuuuucauaaagcag

SEQ ID NO: 1493071 - RNA, 17 nt, Human
guuaacuauugcauuua

SEQ ID NO: 1493072 - RNA, 18 nt, Human
gugugcucaggagcccug

SEQ ID NO: 1493073 - RNA, 19 nt, Human
gugugcucaggagcccugg

SEQ ID NO: 1493074 - RNA, 16 nt, Human
gugugcucaggagccc

SEQ ID NO: 1493075 - RNA, 17 nt, Human
gugugcucaggagcccu

SEQ ID NO: 1493076 - RNA, 12 nt, Human
guguguuuuaaa

SEQ ID NO: 1493077 - RNA, 13 nt, Human
guucauuccucca

SEQ ID NO: 1493078 - RNA, 14 nt, Human
guucauuccuccag

SEQ ID NO: 1493079 - RNA, 15 nt, Human
guucauuccuccagg

SEQ ID NO: 1493080 - RNA, 12 nt, Human
guucaugaaaga

SEQ ID NO: 1493081 - RNA, 17 nt, Human
guuauuauauuuacaaa

SEQ ID NO: 1493082 - RNA, 17 nt, Human
guuaugacuauguaaac

SEQ ID NO: 1493083 - RNA, 15 nt, Human
guuaugacuauguaa

SEQ ID NO: 1493084 - RNA, 20 nt, Human
guuauccaccugccuuggcu

SEQ ID NO: 1493085 - RNA, 19 nt, Human
guuaucuaauagggcaauu

SEQ ID NO: 1493086 - RNA, 16 nt, Human
guuacccaaauuaaga

SEQ ID NO: 1493087 - RNA, 23 nt, Human
guuaccucugccucagaaaacaa

SEQ ID NO: 1493088 - RNA, 14 nt, Human
guuggagugcagug

SEQ ID NO: 1493089 - RNA, 15 nt, Human
guuggagugcagugg

SEQ ID NO: 1493090 - RNA, 23 nt, Human
guugcagcccugcugcugccugc

SEQ ID NO: 1493091 - RNA, 16 nt, Human
guugcaacuuuguaua

SEQ ID NO: 1493092 - RNA, 14 nt, Human
guugcaacuuugua

SEQ ID NO: 1493093 - RNA, 18 nt, Human
guugaagagguuuuaaag

SEQ ID NO: 1493094 - RNA, 21 nt, Human
guugauggugguauguuuuca

SEQ ID NO: 1493095 - RNA, 20 nt, Human
guugauggugguauguuuuc

SEQ ID NO: 1493096 - RNA, 15 nt, Human
guucugaagaagaug

SEQ ID NO: 1493097 - RNA, 14 nt, Human
guucugaagaagau

SEQ ID NO: 1493098 - RNA, 13 nt, Human
guucugaagaaga

SEQ ID NO: 1493099 - RNA, 12 nt, Human
guucugaagaag

SEQ ID NO: 1493100 - RNA, 18 nt, Human
guuccuuggccaugcaga

SEQ ID NO: 1493101 - RNA, 18 nt, Human
uaaaauccauacauuugu

SEQ ID NO: 1493102 - RNA, 15 nt, Human
uaaacacucuugaaa

SEQ ID NO: 1493103 - RNA, 17 nt, Human
uaaacacucuugaaaaa

SEQ ID NO: 1493104 - RNA, 18 nt, Human
uaaacacucuugaaaaau

SEQ ID NO: 1493105 - RNA, 18 nt, Human
uaaagcaggcagaacuca

SEQ ID NO: 1493106 - RNA, 14 nt, Human
uaaaguguuugaaa

SEQ ID NO: 1493107 - RNA, 14 nt, Human
uaaaggaauuuaaa

SEQ ID NO: 1493108 - RNA, 22 nt, Human
uaaaacaagcacuaaacaaaga

SEQ ID NO: 1493109 - RNA, 21 nt, Human
uaaaaacaaagaaauuaugug

SEQ ID NO: 1493110 - RNA, 15 nt, Human
uaaaaggaaagaaaa

SEQ ID NO: 1493111 - RNA, 21 nt, Human
uaaaaggaaagaaaacaucuu

SEQ ID NO: 1493112 - RNA, 17 nt, Human
uaaaauccauacauuug

SEQ ID NO: 1493113 - RNA, 15 nt, Human
uaaaauccauacauu

SEQ ID NO: 1493114 - RNA, 13 nt, Human
guuuggugcuucu

SEQ ID NO: 1493115 - RNA, 19 nt, Human
guuucuuuguaaugaaaac

SEQ ID NO: 1493116 - RNA, 18 nt, Human
guuucuuuguaaugaaaa

SEQ ID NO: 1493117 - RNA, 17 nt, Human
guuuccuccaagcuauu

SEQ ID NO: 1493118 - RNA, 15 nt, Human
guuuuaaaaugagaa

SEQ ID NO: 1493119 - RNA, 16 nt, Human
guuuuaaaaugagaaa

SEQ ID NO: 1493120 - RNA, 20 nt, Human
guuuucaaaauuguuacaaa

SEQ ID NO: 1493121 - RNA, 17 nt, Human
guuuuaaaaugagaaau

SEQ ID NO: 1493122 - RNA, 19 nt, Human
guugucugcaacucugaag

SEQ ID NO: 1493123 - RNA, 20 nt, Human
guuuauauaagcuuguauuc

SEQ ID NO: 1493124 - RNA, 19 nt, Human
guuuaggaacuacugagga

SEQ ID NO: 1493125 - RNA, 21 nt, Human
guuuagcuggaaaaguauguu

SEQ ID NO: 1493126 - RNA, 20 nt, Human
guuuagcuggaaaaguaugu

SEQ ID NO: 1493127 - RNA, 22 nt, Human
guuucauauuuuucauagcuaa

SEQ ID NO: 1493128 - RNA, 13 nt, Human
uaaccagaucauu

SEQ ID NO: 1493129 - RNA, 15 nt, Human
uaacuauugcauuua

SEQ ID NO: 1493130 - RNA, 16 nt, Human
uaacuauugcauuuau

SEQ ID NO: 1493131 - RNA, 21 nt, Human
uaacuauugcauuuauaugua

SEQ ID NO: 1493132 - RNA, 23 nt, Human
uaacuauugcauuuauauguacc

SEQ ID NO: 1493133 - RNA, 15 nt, Human
uaacuggaaacuuca

SEQ ID NO: 1493134 - RNA, 21 nt, Human
uaagaaaauaucacuugucaa

SEQ ID NO: 1493135 - RNA, 13 nt, Human
uaagagagaauga

SEQ ID NO: 1493136 - RNA, 23 nt, Human
uaagagagaaugagagacacacu

SEQ ID NO: 1493137 - RNA, 14 nt, Human
uaagagagaaugag

SEQ ID NO: 1493138 - RNA, 16 nt, Human
uaaaguugguaaaccu

SEQ ID NO: 1493139 - RNA, 17 nt, Human
uaaaguugguaaaccuu

SEQ ID NO: 1493140 - RNA, 20 nt, Human
uaaauggcuuccuggcaaua

SEQ ID NO: 1493141 - RNA, 15 nt, Human
uaaauguauacuaua

SEQ ID NO: 1493142 - RNA, 17 nt, Human
uaaauguauacuauagu

SEQ ID NO: 1493143 - RNA, 20 nt, Human
uaaauguauacuauaguacc

SEQ ID NO: 1493144 - RNA, 12 nt, Human
uaaauguauacu

SEQ ID NO: 1493145 - RNA, 13 nt, Human
uaaauguauacua

SEQ ID NO: 1493146 - RNA, 13 nt, Human
uaaauucuuucau

SEQ ID NO: 1493147 - RNA, 22 nt, Human
uaauguuucaaacauauauaac

SEQ ID NO: 1493148 - RNA, 23 nt, Human
uaaugauaacuggaaacuucagc

SEQ ID NO: 1493149 - RNA, 22 nt, Human
uaaugauaacuggaaacuucag

SEQ ID NO: 1493150 - RNA, 17 nt, Human
uaaugauaacuggaaac

SEQ ID NO: 1493151 - RNA, 14 nt, Human
uaauaauguuucaa

SEQ ID NO: 1493152 - RNA, 19 nt, Human
uaaggggaggaaccagagu

SEQ ID NO: 1493153 - RNA, 14 nt, Human
uaaggcaaucaugg

SEQ ID NO: 1493154 - RNA, 12 nt, Human
uaauaaagcugu

SEQ ID NO: 1493155 - RNA, 12 nt, Human
uaauaaaggacu

SEQ ID NO: 1493156 - RNA, 13 nt, Human
uaauaaaggacug

SEQ ID NO: 1493157 - RNA, 16 nt, Human
uaauaaaggacuguaa

SEQ ID NO: 1493158 - RNA, 20 nt, Human
uaauaaaggacuguaaucuu

SEQ ID NO: 1493159 - RNA, 22 nt, Human
uaagugauugcugguuuuaguu

SEQ ID NO: 1493160 - RNA, 12 nt, Human
uaaguccagugu

SEQ ID NO: 1493161 - RNA, 15 nt, Human
uacuccccuccuuga

SEQ ID NO: 1493162 - RNA, 14 nt, Human
uacugccuauuuua

SEQ ID NO: 1493163 - RNA, 21 nt, Human
uacugccuauuuuaauaaaca

SEQ ID NO: 1493164 - RNA, 20 nt, Human
uacuugcucuugaugccugg

SEQ ID NO: 1493165 - RNA, 13 nt, Human
uacuugcucuuga

SEQ ID NO: 1493166 - RNA, 14 nt, Human
uacuugcucuugau

SEQ ID NO: 1493167 - RNA, 18 nt, Human
uacuugcucuugaugccu

SEQ ID NO: 1493168 - RNA, 19 nt, Human
uacuugcucuugaugccug

SEQ ID NO: 1493169 - RNA, 13 nt, Human
uacugcuuaauuc

SEQ ID NO: 1493170 - RNA, 19 nt, Human
uacugcuuaauucaaauaa

SEQ ID NO: 1493171 - RNA, 20 nt, Human
uacugcuuaauucaaauaau

SEQ ID NO: 1493172 - RNA, 15 nt, Human
uacugcucuccucca

SEQ ID NO: 1493173 - RNA, 23 nt, Human
uaccucuccagccucagcucuca

SEQ ID NO: 1493174 - RNA, 20 nt, Human
uaccguaggcuuuguauuca

SEQ ID NO: 1493175 - RNA, 20 nt, Human
uacauuuuuugggcagcaau

SEQ ID NO: 1493176 - RNA, 22 nt, Human
uaccaaaaaucucaauauuuca

SEQ ID NO: 1493177 - RNA, 17 nt, Human
uaauuuuuauauuugaa

SEQ ID NO: 1493178 - RNA, 16 nt, Human
uaauuuuuauauuuga

SEQ ID NO: 1493179 - RNA, 12 nt, Human
uaauuuuuauau

SEQ ID NO: 1493180 - RNA, 18 nt, Human
uaauuuugugaagcaaaa

SEQ ID NO: 1493181 - RNA, 14 nt, Human
uaauuccuucagca

SEQ ID NO: 1493182 - RNA, 21 nt, Human
uaauuccuucagcacuuuaga

SEQ ID NO: 1493183 - RNA, 20 nt, Human
uaauuccuucagcacuuuag

SEQ ID NO: 1493184 - RNA, 15 nt, Human
uacaacggagucaaa

SEQ ID NO: 1493185 - RNA, 22 nt, Human
uacaacggagucaaaaauuaaa

SEQ ID NO: 1493186 - RNA, 15 nt, Human
uacaaccuccgccuc

SEQ ID NO: 1493187 - RNA, 14 nt, Human
uacaggauuugaaa

SEQ ID NO: 1493188 - RNA, 20 nt, Human
uacaggaugaugacuaugga

SEQ ID NO: 1493189 - RNA, 23 nt, Human
uacaguucggugagcuacaaaug

SEQ ID NO: 1493190 - RNA, 18 nt, Human
uacaguuuugaguagagu

SEQ ID NO: 1493191 - RNA, 21 nt, Human
uacauggcuggagcuagaauu

SEQ ID NO: 1493192 - RNA, 13 nt, Human
uagagaagcaagu

SEQ ID NO: 1493193 - RNA, 16 nt, Human
uagagaagcaaguaaa

SEQ ID NO: 1493194 - RNA, 23 nt, Human
uagaauaccacaggaaccacaag

SEQ ID NO: 1493195 - RNA, 23 nt, Human
uagaauacaguuuugaguagagu

SEQ ID NO: 1493196 - RNA, 13 nt, Human
uagaauaugccuu

SEQ ID NO: 1493197 - RNA, 16 nt, Human
uagccccucuccugga

SEQ ID NO: 1493198 - RNA, 14 nt, Human
uagauaggccaugg

SEQ ID NO: 1493199 - RNA, 18 nt, Human
uagcauccuggaauaucu

SEQ ID NO: 1493200 - RNA, 16 nt, Human
uagcauccuggaauau

SEQ ID NO: 1493201 - RNA, 15 nt, Human
uagcauccuggaaua

SEQ ID NO: 1493202 - RNA, 13 nt, Human
uagcauccuggaa

SEQ ID NO: 1493203 - RNA, 19 nt, Human
uaguagcguuuuuuaaaug

SEQ ID NO: 1493204 - RNA, 21 nt, Human
uaguagcguuuuuuaaaugua

SEQ ID NO: 1493205 - RNA, 23 nt, Human
uaguagcguuuuuuaaauguaua

SEQ ID NO: 1493206 - RNA, 17 nt, Human
uaguucuuacugcuuaa

SEQ ID NO: 1493207 - RNA, 17 nt, Human
uaguauuguccaggucu

SEQ ID NO: 1493208 - RNA, 18 nt, Human
uauaaaccgaacugaugu

SEQ ID NO: 1493209 - RNA, 16 nt, Human
uauaugcuucuguuuu

SEQ ID NO: 1493210 - RNA, 14 nt, Human
uauaugcuucuguu

SEQ ID NO: 1493211 - RNA, 20 nt, Human
uauauuuuuuucugaaauuu

SEQ ID NO: 1493212 - RNA, 19 nt, Human
uauauuuuuuucugaaauu

SEQ ID NO: 1493213 - RNA, 16 nt, Human
uauauuuuuuucugaa

SEQ ID NO: 1493214 - RNA, 19 nt, Human
uauauaacaaugcuguauu

SEQ ID NO: 1493215 - RNA, 17 nt, Human
uauauaacaaugcugua

SEQ ID NO: 1493216 - RNA, 12 nt, Human
uauaguacauga

SEQ ID NO: 1493217 - RNA, 13 nt, Human
uauaguacaugau

SEQ ID NO: 1493218 - RNA, 14 nt, Human
uauaguacaugaua

SEQ ID NO: 1493219 - RNA, 16 nt, Human
uauaguacaugauaaa

SEQ ID NO: 1493220 - RNA, 13 nt, Human
uauagaaagcuau

SEQ ID NO: 1493221 - RNA, 24 nt, Human
uauagaaagcuauauaagacaaga

SEQ ID NO: 1493222 - RNA, 22 nt, Human
ucagucucuauaccaauaaagu

SEQ ID NO: 1493223 - RNA, 23 nt, Human
ucagucucuauaccaauaaagug

SEQ ID NO: 1493224 - RNA, 16 nt, Human
ucaguuaacuauugca

SEQ ID NO: 1493225 - RNA, 20 nt, Human
ucaguuaacuauugcauuua

SEQ ID NO: 1493226 - RNA, 22 nt, Human
ucauauuuuucauagcuaaaaa

SEQ ID NO: 1493227 - RNA, 13 nt, Human
ucaucuggaacca

SEQ ID NO: 1493228 - RNA, 17 nt, Human
ucaucuggauuccagag

SEQ ID NO: 1493229 - RNA, 12 nt, Human
ucaucuggaacc

SEQ ID NO: 1493230 - RNA, 18 nt, Human
ucaucuggaaccaucaga

SEQ ID NO: 1493231 - RNA, 19 nt, Human
ucauggaauuggagcucgu

SEQ ID NO: 1493232 - RNA, 13 nt, Human
ucaugaaagauuc

SEQ ID NO: 1493233 - RNA, 15 nt, Human
ucaugaaagauucaa

SEQ ID NO: 1493234 - RNA, 21 nt, Human
ucauggaauuggagcucgugg

SEQ ID NO: 1493235 - RNA, 24 nt, Human
ucauggacuucugccagcauaaua

SEQ ID NO: 1493236 - RNA, 19 nt, Human
ucagcucucaguugcagcc

SEQ ID NO: 1493237 - RNA, 18 nt, Human
ucagauaugauucaaaug

SEQ ID NO: 1493238 - RNA, 17 nt, Human
ucagauaugauucaaau

SEQ ID NO: 1493239 - RNA, 23 nt, Human
uccacagcugccucuucccucuu

SEQ ID NO: 1493240 - RNA, 17 nt, Human
uccaagcaaaugugaau

SEQ ID NO: 1493241 - RNA, 15 nt, Human
uccacuuuaucuuga

SEQ ID NO: 1493242 - RNA, 17 nt, Human
uccacuuuaucuugaau

SEQ ID NO: 1493243 - RNA, 17 nt, Human
uccagagcacugcucca

SEQ ID NO: 1493244 - RNA, 21 nt, Human
ucccacuucagccucccaagc

SEQ ID NO: 1493245 - RNA, 21 nt, Human
ucccaagcaccugggauuaca

SEQ ID NO: 1493246 - RNA, 20 nt, Human
ucccaagcaccugggauuac

SEQ ID NO: 1493247 - RNA, 12 nt, Human
uccauacauuug

SEQ ID NO: 1493248 - RNA, 22 nt, Human
ucccucugcagucucuauacca

SEQ ID NO: 1493249 - RNA, 16 nt, Human
ucccucugcagucucu

SEQ ID NO: 1493250 - RNA, 19 nt, Human
ucccuacccuaaccaaguu

SEQ ID NO: 1493251 - RNA, 13 nt, Human
ucuaugaaauauu

SEQ ID NO: 1493252 - RNA, 14 nt, Human
ucucagauuucuga

SEQ ID NO: 1493253 - RNA, 21 nt, Human
ucucaguugcagcccugcugc

SEQ ID NO: 1493254 - RNA, 17 nt, Human
ucucagauuucugagga

SEQ ID NO: 1493255 - RNA, 18 nt, Human
ucucagauuucugaggaa

SEQ ID NO: 1493256 - RNA, 21 nt, Human
ucuaggcaguucaaagcagga

SEQ ID NO: 1493257 - RNA, 15 nt, Human
ucuagguaaauuaca

SEQ ID NO: 1493258 - RNA, 13 nt, Human
ucuauauuuuaca

SEQ ID NO: 1493259 - RNA, 14 nt, Human
ucugcagucucuau

SEQ ID NO: 1493260 - RNA, 18 nt, Human
ucugcagucucuauacca

SEQ ID NO: 1493261 - RNA, 20 nt, Human
ucugcagucucuauaccaau

SEQ ID NO: 1493262 - RNA, 21 nt, Human
ucugcagucucuauaccaaua

SEQ ID NO: 1493263 - RNA, 14 nt, Human
ucuggaauuugaaa

SEQ ID NO: 1493264 - RNA, 12 nt, Human
ucuggagcccac

SEQ ID NO: 1493265 - RNA, 16 nt, Human
ucuggagcccacugua

SEQ ID NO: 1493266 - RNA, 22 nt, Human
ucuggagcccacuguacuugcu

SEQ ID NO: 1493267 - RNA, 18 nt, Human
ugaaaaccacauuggaga

SEQ ID NO: 1493268 - RNA, 15 nt, Human
ugaaacacuuugcau

SEQ ID NO: 1493269 - RNA, 21 nt, Human
ucuuugccacccucaugcugu

SEQ ID NO: 1493270 - RNA, 22 nt, Human
ucuuugccacccucaugcugug

SEQ ID NO: 1493271 - RNA, 17 nt, Human
ucuuuccacagaagcuc

SEQ ID NO: 1493272 - RNA, 19 nt, Human
ucuugccaaauauaaauaa

SEQ ID NO: 1493273 - RNA, 13 nt, Human
ucuuauaauuuaa

SEQ ID NO: 1493274 - RNA, 14 nt, Human
ucuuauaauuuaaa

SEQ ID NO: 1493275 - RNA, 15 nt, Human
ugagcagucaggaaa

SEQ ID NO: 1493276 - RNA, 19 nt, Human
ugaggaucagaguaaucca

SEQ ID NO: 1493277 - RNA, 13 nt, Human
ugaggaucagagu

SEQ ID NO: 1493278 - RNA, 17 nt, Human
ugaggaucagaguaauc

SEQ ID NO: 1493279 - RNA, 15 nt, Human
ugaggcacuggcgag

SEQ ID NO: 1493280 - RNA, 19 nt, Human
ugagaggcugggaauggag

SEQ ID NO: 1493281 - RNA, 13 nt, Human
ugagacauccagc

SEQ ID NO: 1493282 - RNA, 10 nt, Human
ugagacaucc

SEQ ID NO: 1493283 - RNA, 12 nt, Human
ugagacauccag

SEQ ID NO: 1493284 - RNA, 18 nt, Human
ugagaaaaauauauacua

SEQ ID NO: 1493285 - RNA, 16 nt, Human
ugacucuuaagaagac

SEQ ID NO: 1493286 - RNA, 15 nt, Human
ugacucuuaagaaga

SEQ ID NO: 1493287 - RNA, 14 nt, Human
ugacucuuaagaag

SEQ ID NO: 1493288 - RNA, 16 nt, Human
ugacuuuggcugcaug

SEQ ID NO: 1493289 - RNA, 14 nt, Human
ugaauuacauuugu

SEQ ID NO: 1493290 - RNA, 13 nt, Human
ugaauuacauuug

SEQ ID NO: 1493291 - RNA, 14 nt, Human
ugaauuaaguuuuu

SEQ ID NO: 1493292 - RNA, 16 nt, Human
ugaauuuaaauagcuu

SEQ ID NO: 1493293 - RNA, 21 nt, Human
ugaacuugaggacacaugucc

SEQ ID NO: 1493294 - RNA, 22 nt, Human
ugaacuugaggacacaugucca

SEQ ID NO: 1493295 - RNA, 17 nt, Human
ugaacuugaggacacau

SEQ ID NO: 1493296 - RNA, 18 nt, Human
ugaacuugaggacacaug

SEQ ID NO: 1493297 - RNA, 19 nt, Human
ugaacuugaggacacaugu

SEQ ID NO: 1493298 - RNA, 20 nt, Human
ugaacuugaggacacauguc

SEQ ID NO: 1493299 - RNA, 16 nt, Human
ugaacuugaggacaca

SEQ ID NO: 1493300 - RNA, 16 nt, Human
ugaaacacuuugcaua

SEQ ID NO: 1493301 - RNA, 13 nt, Human
ugaaacauguuuc

SEQ ID NO: 1493302 - RNA, 21 nt, Human
ugaagcuuuuaugugaaacau

SEQ ID NO: 1493303 - RNA, 16 nt, Human
ugaagcuuuuauguga

SEQ ID NO: 1493304 - RNA, 21 nt, Human
ugaagagguuuuaaagcuucc

SEQ ID NO: 1493305 - RNA, 20 nt, Human
ugaagagguuuuaaagcuuc

SEQ ID NO: 1493306 - RNA, 9 nt, Human
ugccucucu

SEQ ID NO: 1493307 - RNA, 20 nt, Human
ugcgagugcucauuucagga

SEQ ID NO: 1493308 - RNA, 17 nt, Human
ugccuucucaacuccaa

SEQ ID NO: 1493309 - RNA, 15 nt, Human
ugccuucucaacucc

SEQ ID NO: 1493310 - RNA, 17 nt, Human
ugcucagagcaguguuu

SEQ ID NO: 1493311 - RNA, 19 nt, Human
ugcuaagcauuccaacuau

SEQ ID NO: 1493312 - RNA, 15 nt, Human
ugcuaagcauuccaa

SEQ ID NO: 1493313 - RNA, 22 nt, Human
ugcaguucugaagaagauggua

SEQ ID NO: 1493314 - RNA, 19 nt, Human
ugcaguucugaagaagaug

SEQ ID NO: 1493315 - RNA, 22 nt, Human
ugcaguggcaucaucucagcuc

SEQ ID NO: 1493316 - RNA, 22 nt, Human
ugcaguggcgcgaucucagcuc

SEQ ID NO: 1493317 - RNA, 22 nt, Human
ugcaguggcgugaucucagcuc

SEQ ID NO: 1493318 - RNA, 18 nt, Human
ugcaguucugaagaagau

SEQ ID NO: 1493319 - RNA, 17 nt, Human
ugcaguucugaagaaga

SEQ ID NO: 1493320 - RNA, 16 nt, Human
ugcaguucugaagaag

SEQ ID NO: 1493321 - RNA, 15 nt, Human
ugcaguucugaagaa

SEQ ID NO: 1493322 - RNA, 15 nt, Human
ugcacuggccccacc

SEQ ID NO: 1493323 - RNA, 16 nt, Human
ugcacuggccccaccc

SEQ ID NO: 1493324 - RNA, 17 nt, Human
ugcacuggccccacccu

SEQ ID NO: 1493325 - RNA, 19 nt, Human
ugccaaauauaaauaaaaa

SEQ ID NO: 1493326 - RNA, 22 nt, Human
ugccaaauauaaauaaaaauaa

SEQ ID NO: 1493327 - RNA, 17 nt, Human
ugccaaauauaaauaaa

SEQ ID NO: 1493328 - RNA, 18 nt, Human
ugccaaauauaaauaaaa

SEQ ID NO: 1493329 - RNA, 20 nt, Human
ugcauauuuauaaaaauaaa

SEQ ID NO: 1493330 - RNA, 21 nt, Human
ugcauauuuauaaaaauaaaa

SEQ ID NO: 1493331 - RNA, 16 nt, Human
ugccacccucaugcug

SEQ ID NO: 1493332 - RNA, 17 nt, Human
ugccacccucaugcugu

SEQ ID NO: 1493333 - RNA, 11 nt, Human
uggagggaagc

SEQ ID NO: 1493334 - RNA, 15 nt, Human
uggcaggugcagccc

SEQ ID NO: 1493335 - RNA, 14 nt, Human
uggaaagaguacuc

SEQ ID NO: 1493336 - RNA, 23 nt, Human
uggaaacuucagcgguuuauaua

SEQ ID NO: 1493337 - RNA, 17 nt, Human
uggaaacaagucaguca

SEQ ID NO: 1493338 - RNA, 22 nt, Human
uggaauaauccuaaacauauga

SEQ ID NO: 1493339 - RNA, 16 nt, Human
uggaauaucuccguca

SEQ ID NO: 1493340 - RNA, 21 nt, Human
uggcuugaguuuaaauuguaa

SEQ ID NO: 1493341 - RNA, 16 nt, Human
uggcuuccuggcaaua

SEQ ID NO: 1493342 - RNA, 22 nt, Human
uggccccacccucguggacacc

SEQ ID NO: 1493343 - RNA, 19 nt, Human
ugguaugaacuugaggaca

SEQ ID NO: 1493344 - RNA, 21 nt, Human
ugguaugaacuugaggacaca

SEQ ID NO: 1493345 - RNA, 22 nt, Human
ugguaugaacuugaggacacau

SEQ ID NO: 1493346 - RNA, 23 nt, Human
ugguaugaacuugaggacacaug

SEQ ID NO: 1493347 - RNA, 16 nt, Human
uggguuagggaaaaca

SEQ ID NO: 1493348 - RNA, 18 nt, Human
uggguuagggaaaacauu

SEQ ID NO: 1493349 - RNA, 19 nt, Human
uggguuagggaaaacauuc

SEQ ID NO: 1493350 - RNA, 21 nt, Human
uggguuagggaaaacauucca

SEQ ID NO: 1493351 - RNA, 16 nt, Human
uguaugauucccagcc

SEQ ID NO: 1493352 - RNA, 21 nt, Human
uguauuguauauuacaaugau

SEQ ID NO: 1493353 - RNA, 15 nt, Human
uguaugauucccagc

SEQ ID NO: 1493354 - RNA, 22 nt, Human
uguauaaaagggacugagaaau

SEQ ID NO: 1493355 - RNA, 22 nt, Human
ugucacccagguuggagugcag

SEQ ID NO: 1493356 - RNA, 22 nt, Human
uguaccguaggcuuuguauuca

SEQ ID NO: 1493357 - RNA, 20 nt, Human
uguaaucuuauuuaggaagu

SEQ ID NO: 1493358 - RNA, 18 nt, Human
uguagcauccuggaauau

SEQ ID NO: 1493359 - RNA, 17 nt, Human
uguagcauccuggaaua

SEQ ID NO: 1493360 - RNA, 16 nt, Human
uguagcauccuggaau

SEQ ID NO: 1493361 - RNA, 14 nt, Human
uguagcauccugga

SEQ ID NO: 1493362 - RNA, 18 nt, Human
uguagccccucuccugga

SEQ ID NO: 1493363 - RNA, 15 nt, Human
ugugacauuuuacau

SEQ ID NO: 1493364 - RNA, 17 nt, Human
ugugacauuuuacauua

SEQ ID NO: 1493365 - RNA, 18 nt, Human
ugugacauuuuacauuaa

SEQ ID NO: 1493366 - RNA, 16 nt, Human
ugugauauaagugugu

SEQ ID NO: 1493367 - RNA, 19 nt, Human
ugugcuaguaauuggaaag

SEQ ID NO: 1493368 - RNA, 20 nt, Human
ugugcucaggagcccuggga

SEQ ID NO: 1493369 - RNA, 17 nt, Human
ugugcucaggagcccug

SEQ ID NO: 1493370 - RNA, 15 nt, Human
ugugcucaggagccc

SEQ ID NO: 1493371 - RNA, 16 nt, Human
ugugcucaggagcccu

SEQ ID NO: 1493372 - RNA, 16 nt, Human
uguggaacauaaaaag

SEQ ID NO: 1493373 - RNA, 21 nt, Human
uguggaacauaaaaaggacau

SEQ ID NO: 1493374 - RNA, 19 nt, Human
uguggaacauaaaaaggac

SEQ ID NO: 1493375 - RNA, 20 nt, Human
uuacauuuguauaaaauaau

SEQ ID NO: 1493376 - RNA, 16 nt, Human
uuacaacggagucaaa

SEQ ID NO: 1493377 - RNA, 19 nt, Human
uuacaacggagucaaaaau

SEQ ID NO: 1493378 - RNA, 23 nt, Human
uuacaacggagucaaaaauuaaa

SEQ ID NO: 1493379 - RNA, 12 nt, Human
uuaaauguauac

SEQ ID NO: 1493380 - RNA, 14 nt, Human
uuaaauguauacua

SEQ ID NO: 1493381 - RNA, 19 nt, Human
uuaaauguauacuauagua

SEQ ID NO: 1493382 - RNA, 16 nt, Human
uuaaauguuaugacua

SEQ ID NO: 1493383 - RNA, 20 nt, Human
uuaaauguuaugacuaugua

SEQ ID NO: 1493384 - RNA, 12 nt, Human
uuaagaguaaaa

SEQ ID NO: 1493385 - RNA, 16 nt, Human
uuaauaauguuucaaa

SEQ ID NO: 1493386 - RNA, 20 nt, Human
uguuggagaagaacugaaau

SEQ ID NO: 1493387 - RNA, 19 nt, Human
uguuggagaagaacugaaa

SEQ ID NO: 1493388 - RNA, 17 nt, Human
uguuggagaagaacuga

SEQ ID NO: 1493389 - RNA, 16 nt, Human
uguuggagaagaacug

SEQ ID NO: 1493390 - RNA, 14 nt, Human
uguuggagaagaac

SEQ ID NO: 1493391 - RNA, 12 nt, Human
uguuuaagagac

SEQ ID NO: 1493392 - RNA, 14 nt, Human
uguucaugaaagau

SEQ ID NO: 1493393 - RNA, 13 nt, Human
uguucaugaaaga

SEQ ID NO: 1493394 - RNA, 20 nt, Human
uguucuuuuaaaugauugaa

SEQ ID NO: 1493395 - RNA, 20 nt, Human
uguugacaugggacauuugc

SEQ ID NO: 1493396 - RNA, 14 nt, Human
uguuagugcaaauu

SEQ ID NO: 1493397 - RNA, 17 nt, Human
uguucauaaauaaaguu

SEQ ID NO: 1493398 - RNA, 13 nt, Human
uguguuugaagca

SEQ ID NO: 1493399 - RNA, 19 nt, Human
uguguuuugcaagccagau

SEQ ID NO: 1493400 - RNA, 13 nt, Human
uguguuuugcaag

SEQ ID NO: 1493401 - RNA, 15 nt, Human
uguguuuuucauaaa

SEQ ID NO: 1493402 - RNA, 18 nt, Human
uguguuuuucauaaagca

SEQ ID NO: 1493403 - RNA, 22 nt, Human
ugugugaaagguacuucaaauc

SEQ ID NO: 1493404 - RNA, 21 nt, Human
ugugugaaagguacuucaaau

SEQ ID NO: 1493405 - RNA, 12 nt, Human
uuuuuuguuauu

SEQ ID NO: 1493406 - RNA, 17 nt, Human
aaaaagaaugaagccuc

SEQ ID NO: 1493407 - RNA, 17 nt, Human
aaaacaaggaugaauua

SEQ ID NO: 1493408 - RNA, 14 nt, Human
aaaacaaggaugaa

SEQ ID NO: 1493409 - RNA, 15 nt, Human
acagaagaaacuggg

SEQ ID NO: 1493410 - RNA, 13 nt, Human
acaacuauauugu

SEQ ID NO: 1493411 - RNA, 20 nt, Human
acaaaauggaauacucuuau

SEQ ID NO: 1493412 - RNA, 19 nt, Human
acaaaauggaauacucuua

SEQ ID NO: 1493413 - RNA, 15 nt, Human
acaaaauggaauacu

SEQ ID NO: 1493414 - RNA, 13 nt, Human
aauuuugaaaaac

SEQ ID NO: 1493415 - RNA, 20 nt, Human
acaagucagucauucagaua

SEQ ID NO: 1493416 - RNA, 13 nt, Human
accacgccuggcu

SEQ ID NO: 1493417 - RNA, 20 nt, Human
accacgccuggcuaauuuuu

SEQ ID NO: 1493418 - RNA, 14 nt, Human
acauuuguauaaaa

SEQ ID NO: 1493419 - RNA, 18 nt, Human
acauuugcucauggaauu

SEQ ID NO: 1493420 - RNA, 20 nt, Human
acauaaauuuaguauuuugu

SEQ ID NO: 1493421 - RNA, 12 nt, Human
acauccagcaga

SEQ ID NO: 1493422 - RNA, 14 nt, Human
acauaaaaaggaca

SEQ ID NO: 1493423 - RNA, 20 nt, Human
acauaaaaaggacaucagca

SEQ ID NO: 1493424 - RNA, 21 nt, Human
acauaaaaaggacaucagcaa

SEQ ID NO: 1493425 - RNA, 22 nt, Human
acauaaaaaggacaucagcaaa

SEQ ID NO: 1493426 - RNA, 15 nt, Human
acauaaaaaggacau

SEQ ID NO: 1493427 - RNA, 12 nt, Human
accccuaggacu

SEQ ID NO: 1493428 - RNA, 21 nt, Human
accccuaaaagaaacccugca

SEQ ID NO: 1493429 - RNA, 22 nt, Human
accccuaaaagaaacccugcac

SEQ ID NO: 1493430 - RNA, 16 nt, Human
agaaaggauaaaguug

SEQ ID NO: 1493431 - RNA, 23 nt, Human
acuuuagggaaguacuuuuggca

SEQ ID NO: 1493432 - RNA, 19 nt, Human
acuuuagggggugggauuc

SEQ ID NO: 1493433 - RNA, 14 nt, Human
agaaaauaacaaua

SEQ ID NO: 1493434 - RNA, 16 nt, Human
agaaaauuuuuguagu

SEQ ID NO: 1493435 - RNA, 20 nt, Human
agaaaauuuuuguaguagcg

SEQ ID NO: 1493436 - RNA, 22 nt, Human
agaaaauuuuuguaguagcguu

SEQ ID NO: 1493437 - RNA, 21 nt, Human
agaaaaguugaauuuuacaug

SEQ ID NO: 1493438 - RNA, 18 nt, Human
agaaaaguugaauuuuac

SEQ ID NO: 1493439 - RNA, 15 nt, Human
acuggguaggaaaga

SEQ ID NO: 1493440 - RNA, 22 nt, Human
acuucugccagcauaauacuug

SEQ ID NO: 1493441 - RNA, 19 nt, Human
acuuguaaaggaauuuaaa

SEQ ID NO: 1493442 - RNA, 20 nt, Human
acuuguaaaggaauuuaaaa

SEQ ID NO: 1493443 - RNA, 23 nt, Human
acuuauuguagcauccuggaaua

SEQ ID NO: 1493444 - RNA, 20 nt, Human
acuuauuguagcauccugga

SEQ ID NO: 1493445 - RNA, 16 nt, Human
acuaagagagaaugag

SEQ ID NO: 1493446 - RNA, 21 nt, Human
acucuguucauuccuccaggu

SEQ ID NO: 1493447 - RNA, 20 nt, Human
acucuguucauuccuccagg

SEQ ID NO: 1493448 - RNA, 19 nt, Human
acucaaaccaaaucacuga

SEQ ID NO: 1493449 - RNA, 20 nt, Human
acucaaaccaaaucacugaa

SEQ ID NO: 1493450 - RNA, 12 nt, Human
acuccccuccuu

SEQ ID NO: 1493451 - RNA, 14 nt, Human
acuagcuauggugu

SEQ ID NO: 1493452 - RNA, 18 nt, Human
aaauugcuuuguauugua

SEQ ID NO: 1493453 - RNA, 15 nt, Human
aacaaagaaauuaug

SEQ ID NO: 1493454 - RNA, 17 nt, Human
aacaaagaaauuaugug

SEQ ID NO: 1493455 - RNA, 13 nt, Human
aacaugauuuggg

SEQ ID NO: 1493456 - RNA, 22 nt, Human
aaccacuggaaaguuuaugguu

SEQ ID NO: 1493457 - RNA, 14 nt, Human
aaccagaucauugu

SEQ ID NO: 1493458 - RNA, 17 nt, Human
aacugauccagcaauua

SEQ ID NO: 1493459 - RNA, 15 nt, Human
aacuuugcugagccu

SEQ ID NO: 1493460 - RNA, 17 nt, Human
aaagaguacucuuguuu

SEQ ID NO: 1493461 - RNA, 12 nt, Human
aaagaguacucu

SEQ ID NO: 1493462 - RNA, 13 nt, Human
aaagaaauuaugu

SEQ ID NO: 1493463 - RNA, 15 nt, Human
aaagaaauuaugugc

SEQ ID NO: 1493464 - RNA, 11 nt, Human
aaagaacaucc

SEQ ID NO: 1493465 - RNA, 17 nt, Human
aaacugacucuuaagaa

SEQ ID NO: 1493466 - RNA, 16 nt, Human
aaacugacucuuaaga

SEQ ID NO: 1493467 - RNA, 16 nt, Human
aaagaaaagaaaauuu

SEQ ID NO: 1493468 - RNA, 12 nt, Human
aaagaaaacuug

SEQ ID NO: 1493469 - RNA, 20 nt, Human
aaagaaaacuuguauuaugu

SEQ ID NO: 1493470 - RNA, 14 nt, Human
aaacacucuugaaa

SEQ ID NO: 1493471 - RNA, 17 nt, Human
aaacacucuugaaaaau

SEQ ID NO: 1493472 - RNA, 13 nt, Human
aaacacucuugaa

SEQ ID NO: 1493473 - RNA, 23 nt, Human
aaauagucucuuuaaaaggaaag

SEQ ID NO: 1493474 - RNA, 16 nt, Human
aaauagaagagagagg

SEQ ID NO: 1493475 - RNA, 13 nt, Human
aaauggaaacuau

SEQ ID NO: 1493476 - RNA, 17 nt, Human
aaauggaauacucuuau

SEQ ID NO: 1493477 - RNA, 18 nt, Human
aaauggcuuccuggcaau

SEQ ID NO: 1493478 - RNA, 14 nt, Human
aaagugacccuguu

SEQ ID NO: 1493479 - RNA, 12 nt, Human
aaauaacaauga

SEQ ID NO: 1493480 - RNA, 20 nt, Human
aaagggacugagaaauuuau

SEQ ID NO: 1493481 - RNA, 16 nt, Human
aaagggacugagaaau

SEQ ID NO: 1493482 - RNA, 19 nt, Human
aaagucucuggaauuugaa

SEQ ID NO: 1493483 - RNA, 20 nt, Human
aaagucucuggaauuugaaa

SEQ ID NO: 1493484 - RNA, 22 nt, Human
aaagucucuggaauuugaaaca

SEQ ID NO: 1493485 - RNA, 16 nt, Human
aagcagacauuuuaaa

SEQ ID NO: 1493486 - RNA, 19 nt, Human
aagccagauuuuccugaaa

SEQ ID NO: 1493487 - RNA, 13 nt, Human
aagccagauuuuc

SEQ ID NO: 1493488 - RNA, 16 nt, Human
aagauuuaccacuugu

SEQ ID NO: 1493489 - RNA, 19 nt, Human
aagauugcuuaauaaauug

SEQ ID NO: 1493490 - RNA, 13 nt, Human
aagaaauuaugug

SEQ ID NO: 1493491 - RNA, 22 nt, Human
aagaaauuaugugccagauuua

SEQ ID NO: 1493492 - RNA, 20 nt, Human
aagcuggagugcaguggcau

SEQ ID NO: 1493493 - RNA, 14 nt, Human
aaggacuguaaucu

SEQ ID NO: 1493494 - RNA, 19 nt, Human
aagucucuggaauuugaaa

SEQ ID NO: 1493495 - RNA, 14 nt, Human
aaguacuuuuggca

SEQ ID NO: 1493496 - RNA, 15 nt, Human
aaguacuuuuggcau

SEQ ID NO: 1493497 - RNA, 23 nt, Human
aaguccaggcuuuuuuaucaugu

SEQ ID NO: 1493498 - RNA, 20 nt, Human
aaguccaguguuucuuuuuu

SEQ ID NO: 1493499 - RNA, 12 nt, Human
aauaauguaaga

SEQ ID NO: 1493500 - RNA, 19 nt, Human
aauaauguaagacaaauau

SEQ ID NO: 1493501 - RNA, 21 nt, Human
aauaauccuaaacauaugaau

SEQ ID NO: 1493502 - RNA, 19 nt, Human
aauaaacuauuuguaaagu

SEQ ID NO: 1493503 - RNA, 16 nt, Human
aauaaacgucuuaaau

SEQ ID NO: 1493504 - RNA, 17 nt, Human
aauaaacgucuuaaaua

SEQ ID NO: 1493505 - RNA, 16 nt, Human
aauauuauguuaaaac

SEQ ID NO: 1493506 - RNA, 14 nt, Human
aauauucaauaaag

SEQ ID NO: 1493507 - RNA, 15 nt, Human
aauauucaauaaagc

SEQ ID NO: 1493508 - RNA, 16 nt, Human
aauauucaauaaagcu

SEQ ID NO: 1493509 - RNA, 13 nt, Human
aaucacaauacau

SEQ ID NO: 1493510 - RNA, 14 nt, Human
aauccauacauuug

SEQ ID NO: 1493511 - RNA, 13 nt, Human
aauccauacauuu

SEQ ID NO: 1493512 - RNA, 17 nt, Human
aaugaagauacugaaau

SEQ ID NO: 1493513 - RNA, 20 nt, Human
aaugauaacuggaaacuuca

SEQ ID NO: 1493514 - RNA, 17 nt, Human
aaugauaacuggaaacu

SEQ ID NO: 1493515 - RNA, 12 nt, Human
aaugaagauacu

SEQ ID NO: 1493516 - RNA, 20 nt, Human
aauuaguuuuauaugcuucu

SEQ ID NO: 1493517 - RNA, 17 nt, Human
aauuaguuuuauaugcu

SEQ ID NO: 1493518 - RNA, 14 nt, Human
aauuaguuuuauau

SEQ ID NO: 1493519 - RNA, 22 nt, Human
agaugaggccagaccauggaca

SEQ ID NO: 1493520 - RNA, 13 nt, Human
agaugaggccaga

SEQ ID NO: 1493521 - RNA, 14 nt, Human
agaugaggccagac

SEQ ID NO: 1493522 - RNA, 16 nt, Human
agaugaggccagacca

SEQ ID NO: 1493523 - RNA, 21 nt, Human
agaugaggccagaccauggac

SEQ ID NO: 1493524 - RNA, 21 nt, Human
agauaggucagugcaaauacu

SEQ ID NO: 1493525 - RNA, 21 nt, Human
agacugcauuauauuuauuac

SEQ ID NO: 1493526 - RNA, 17 nt, Human
agacugcauuauauuua

SEQ ID NO: 1493527 - RNA, 15 nt, Human
agagaagcaaguaaa

SEQ ID NO: 1493528 - RNA, 13 nt, Human
agagaaggagcag

SEQ ID NO: 1493529 - RNA, 23 nt, Human
agacuacaggcacacaccaccac

SEQ ID NO: 1493530 - RNA, 12 nt, Human
agcacugcucca

SEQ ID NO: 1493531 - RNA, 14 nt, Human
agcaugcacaaauu

SEQ ID NO: 1493532 - RNA, 19 nt, Human
agccagauuuuccugaaaa

SEQ ID NO: 1493533 - RNA, 15 nt, Human
agccagauuuuccug

SEQ ID NO: 1493534 - RNA, 13 nt, Human
agguaaguuuuuu

SEQ ID NO: 1493535 - RNA, 23 nt, Human
aggucccuaauaaagcugugugg

SEQ ID NO: 1493536 - RNA, 20 nt, Human
aggucccuaauaaagcugug

SEQ ID NO: 1493537 - RNA, 18 nt, Human
aggucccuaauaaagcug

SEQ ID NO: 1493538 - RNA, 19 nt, Human
aggucccuaauaaagcugu

SEQ ID NO: 1493539 - RNA, 17 nt, Human
aggucccuaauaaagcu

SEQ ID NO: 1493540 - RNA, 19 nt, Human
agguucaagcaauccuccc

SEQ ID NO: 1493541 - RNA, 17 nt, Human
agguucaugcaaacuuu

SEQ ID NO: 1493542 - RNA, 15 nt, Human
agguggaaauaaacu

SEQ ID NO: 1493543 - RNA, 19 nt, Human
agggcaauuaauuccuuca

SEQ ID NO: 1493544 - RNA, 22 nt, Human
agggcaauuaauuccuucagca

SEQ ID NO: 1493545 - RNA, 18 nt, Human
agggcaauuaauuccuuc

SEQ ID NO: 1493546 - RNA, 13 nt, Human
aggggcagagcca

SEQ ID NO: 1493547 - RNA, 14 nt, Human
aggggcagagccag

SEQ ID NO: 1493548 - RNA, 15 nt, Human
aggggcagagccagg

SEQ ID NO: 1493549 - RNA, 16 nt, Human
aggggcagagccagga

SEQ ID NO: 1493550 - RNA, 17 nt, Human
aggggcagagccaggaa

SEQ ID NO: 1493551 - RNA, 15 nt, Human
agcuuuucccuuuuu

SEQ ID NO: 1493552 - RNA, 18 nt, Human
agcuuuucccaaaagccc

SEQ ID NO: 1493553 - RNA, 14 nt, Human
agcuguaugauucc

SEQ ID NO: 1493554 - RNA, 15 nt, Human
aggaacuacugagga

SEQ ID NO: 1493555 - RNA, 12 nt, Human
aucccucaccca

SEQ ID NO: 1493556 - RNA, 19 nt, Human
aucccucacccauccuaga

SEQ ID NO: 1493557 - RNA, 20 nt, Human
auccacccgccucagccucc

SEQ ID NO: 1493558 - RNA, 15 nt, Human
aucaucuauagaaag

SEQ ID NO: 1493559 - RNA, 19 nt, Human
aucaucuauagaaagcuau

SEQ ID NO: 1493560 - RNA, 13 nt, Human
aucaucucagcuc

SEQ ID NO: 1493561 - RNA, 14 nt, Human
aucaucucagcuca

SEQ ID NO: 1493562 - RNA, 19 nt, Human
aucaucucagcucacugca

SEQ ID NO: 1493563 - RNA, 22 nt, Human
aucuuauaauuuaaaauaugcu

SEQ ID NO: 1493564 - RNA, 18 nt, Human
augaagcuuuuaugugaa

SEQ ID NO: 1493565 - RNA, 19 nt, Human
augaagcuuuuaugugaaa

SEQ ID NO: 1493566 - RNA, 20 nt, Human
augaagcuuuuaugugaaac

SEQ ID NO: 1493567 - RNA, 21 nt, Human
augaagcuuuuaugugaaaca

SEQ ID NO: 1493568 - RNA, 15 nt, Human
augacuauguaaacu

SEQ ID NO: 1493569 - RNA, 16 nt, Human
augacuauguaaacua

SEQ ID NO: 1493570 - RNA, 14 nt, Human
augaaaaaauauau

SEQ ID NO: 1493571 - RNA, 17 nt, Human
augaaaaaauauauauc

SEQ ID NO: 1493572 - RNA, 22 nt, Human
augaaaaaauauauaucaaaua

SEQ ID NO: 1493573 - RNA, 23 nt, Human
augaaaaaauauauaucaaauau

SEQ ID NO: 1493574 - RNA, 17 nt, Human
augcacaguaaaaaugg

SEQ ID NO: 1493575 - RNA, 12 nt, Human
augcauggaaau

SEQ ID NO: 1493576 - RNA, 14 nt, Human
augccuuuucccaa

SEQ ID NO: 1493577 - RNA, 21 nt, Human
augccuuuguacuuuagggaa

SEQ ID NO: 1493578 - RNA, 20 nt, Human
auggaaauucccuucaucug

SEQ ID NO: 1493579 - RNA, 18 nt, Human
auggcuggagcuagaauu

SEQ ID NO: 1493580 - RNA, 16 nt, Human
augucaaucagccuag

SEQ ID NO: 1493581 - RNA, 17 nt, Human
auguacauguacugauu

SEQ ID NO: 1493582 - RNA, 16 nt, Human
auguaaguaaacgguc

SEQ ID NO: 1493583 - RNA, 20 nt, Human
auguguaugcacaguaaaaa

SEQ ID NO: 1493584 - RNA, 18 nt, Human
auguuucuuuguaaugaa

SEQ ID NO: 1493585 - RNA, 14 nt, Human
auacccucccuccc

SEQ ID NO: 1493586 - RNA, 16 nt, Human
auacccucccucccua

SEQ ID NO: 1493587 - RNA, 22 nt, Human
auacccucccucccuacccuaa

SEQ ID NO: 1493588 - RNA, 19 nt, Human
auaaguguguguuuuucau

SEQ ID NO: 1493589 - RNA, 22 nt, Human
auaaguguguguuuuucauaaa

SEQ ID NO: 1493590 - RNA, 19 nt, Human
auaaguauuuaauucaugu

SEQ ID NO: 1493591 - RNA, 19 nt, Human
auacuugaaaauuaacaug

SEQ ID NO: 1493592 - RNA, 15 nt, Human
auacuugaaaauuaa

SEQ ID NO: 1493593 - RNA, 16 nt, Human
auacuugaaaauuaac

SEQ ID NO: 1493594 - RNA, 15 nt, Human
auauaagugauugcu

SEQ ID NO: 1493595 - RNA, 15 nt, Human
auauaaguguguguu

SEQ ID NO: 1493596 - RNA, 12 nt, Human
auauaauucuua

SEQ ID NO: 1493597 - RNA, 22 nt, Human
auauuuauuacuguaagaaaau

SEQ ID NO: 1493598 - RNA, 18 nt, Human
auauuuauuuuaauaaug

SEQ ID NO: 1493599 - RNA, 19 nt, Human
auauuuauuacuguaagaa

SEQ ID NO: 1493600 - RNA, 14 nt, Human
auauuuauuacugu

SEQ ID NO: 1493601 - RNA, 18 nt, Human
auauuuaguguucauaaa

SEQ ID NO: 1493602 - RNA, 16 nt, Human
auauuuauaaaaauaa

SEQ ID NO: 1493603 - RNA, 23 nt, Human
auauuucagauaaucacaauaca

SEQ ID NO: 1493604 - RNA, 18 nt, Human
auaucacuugucaauaaa

SEQ ID NO: 1493605 - RNA, 14 nt, Human
agugaucaaacuac

SEQ ID NO: 1493606 - RNA, 13 nt, Human
agucaaauugugu

SEQ ID NO: 1493607 - RNA, 17 nt, Human
agucaaauugugugaaa

SEQ ID NO: 1493608 - RNA, 15 nt, Human
agucaaauuguguga

SEQ ID NO: 1493609 - RNA, 23 nt, Human
agucauucagauaugauucaaau

SEQ ID NO: 1493610 - RNA, 20 nt, Human
agucauucagauaugauuca

SEQ ID NO: 1493611 - RNA, 15 nt, Human
agucauucagauaug

SEQ ID NO: 1493612 - RNA, 21 nt, Human
aguccaagcauuuagauguau

SEQ ID NO: 1493613 - RNA, 16 nt, Human
aguccaagcauuuaga

SEQ ID NO: 1493614 - RNA, 15 nt, Human
aguugaauuuuacau

SEQ ID NO: 1493615 - RNA, 18 nt, Human
cucugcaggucccuaaua

SEQ ID NO: 1493616 - RNA, 14 nt, Human
cucugcaggucccu

SEQ ID NO: 1493617 - RNA, 15 nt, Human
cucugcaggucccua

SEQ ID NO: 1493618 - RNA, 16 nt, Human
cucugcaggucccuaa

SEQ ID NO: 1493619 - RNA, 17 nt, Human
cucugcaggucccuaau

SEQ ID NO: 1493620 - RNA, 22 nt, Human
cucuuagaugcaguucugaaga

SEQ ID NO: 1493621 - RNA, 21 nt, Human
cugaagcuaucguaaaauuaa

SEQ ID NO: 1493622 - RNA, 22 nt, Human
cugaagcuaucguaaaauuaag

SEQ ID NO: 1493623 - RNA, 22 nt, Human
cugaaaauugaugggauuuggu

SEQ ID NO: 1493624 - RNA, 13 nt, Human
cucuugaugccug

SEQ ID NO: 1493625 - RNA, 15 nt, Human
cucuugaugccuggc

SEQ ID NO: 1493626 - RNA, 16 nt, Human
cucuugaugccuggcg

SEQ ID NO: 1493627 - RNA, 21 nt, Human
cucuugaugccuggcggggug

SEQ ID NO: 1493628 - RNA, 14 nt, Human
cucguuaauuugua

SEQ ID NO: 1493629 - RNA, 14 nt, Human
cucguguguuucua

SEQ ID NO: 1493630 - RNA, 21 nt, Human
cucucaauauucaauaaagcu

SEQ ID NO: 1493631 - RNA, 19 nt, Human
cucuauaccaauaaaguga

SEQ ID NO: 1493632 - RNA, 18 nt, Human
cucuauaccaauaaagug

SEQ ID NO: 1493633 - RNA, 14 nt, Human
cuccaagaauuucu

SEQ ID NO: 1493634 - RNA, 13 nt, Human
cuccaagaauuuc

SEQ ID NO: 1493635 - RNA, 14 nt, Human
cguaaaauuaagaa

SEQ ID NO: 1493636 - RNA, 13 nt, Human
cgugauccacccg

SEQ ID NO: 1493637 - RNA, 17 nt, Human
cgugauccacccgccuc

SEQ ID NO: 1493638 - RNA, 24 nt, Human
cgugauccacccgccucagccucc

SEQ ID NO: 1493639 - RNA, 14 nt, Human
cgugaucucagcuc

SEQ ID NO: 1493640 - RNA, 15 nt, Human
cgugaucucagcuca

SEQ ID NO: 1493641 - RNA, 19 nt, Human
cggaggaaggaggacccag

SEQ ID NO: 1493642 - RNA, 20 nt, Human
cggaggaaggaggacccagg

SEQ ID NO: 1493643 - RNA, 21 nt, Human
cggaggaaggaggacccagga

SEQ ID NO: 1493644 - RNA, 23 nt, Human
cggaggaaggaggacccaggaca

SEQ ID NO: 1493645 - RNA, 16 nt, Human
cgccuccaacccuagc

SEQ ID NO: 1493646 - RNA, 17 nt, Human
cgccuccaacccuagca

SEQ ID NO: 1493647 - RNA, 18 nt, Human
cgacugaaaauauuguuu

SEQ ID NO: 1493648 - RNA, 17 nt, Human
cgacugaaaauauuguu

SEQ ID NO: 1493649 - RNA, 14 nt, Human
cucaauucuucccu

SEQ ID NO: 1493650 - RNA, 19 nt, Human
cucaauucuucccuaucuu

SEQ ID NO: 1493651 - RNA, 16 nt, Human
cucaauauucaauaaa

SEQ ID NO: 1493652 - RNA, 17 nt, Human
cucaauauucaauaaag

SEQ ID NO: 1493653 - RNA, 18 nt, Human
cucaauauucaauaaagc

SEQ ID NO: 1493654 - RNA, 19 nt, Human
cucaauauucaauaaagcu

SEQ ID NO: 1493655 - RNA, 18 nt, Human
cucaaaccaaaucacuga

SEQ ID NO: 1493656 - RNA, 19 nt, Human
cucaaaccaaaucacugaa

SEQ ID NO: 1493657 - RNA, 22 nt, Human
cucaaaccaaaucacugaacuu

SEQ ID NO: 1493658 - RNA, 17 nt, Human
cuaucguaaaauuaaga

SEQ ID NO: 1493659 - RNA, 18 nt, Human
cuaucguaaaauuaagaa

SEQ ID NO: 1493660 - RNA, 23 nt, Human
cuagaauuugauaugugaacagu

SEQ ID NO: 1493661 - RNA, 14 nt, Human
cuaauucuaaugug

SEQ ID NO: 1493662 - RNA, 11 nt, Human
ccugaguccca

SEQ ID NO: 1493663 - RNA, 16 nt, Human
ccugagucccaucccu

SEQ ID NO: 1493664 - RNA, 16 nt, Human
ccugccuccccugccu

SEQ ID NO: 1493665 - RNA, 16 nt, Human
ccugccucccuucaug

SEQ ID NO: 1493666 - RNA, 20 nt, Human
ccugucugucugucuguccc

SEQ ID NO: 1493667 - RNA, 21 nt, Human
ccugucugucugucuguccca

SEQ ID NO: 1493668 - RNA, 22 nt, Human
ccugucugucugucugucccaa

SEQ ID NO: 1493669 - RNA, 19 nt, Human
ccuccaacccuagcaaaag

SEQ ID NO: 1493670 - RNA, 18 nt, Human
ccuccaacccuagcaaaa

SEQ ID NO: 1493671 - RNA, 18 nt, Human
ccucccauguucaagcga

SEQ ID NO: 1493672 - RNA, 23 nt, Human
ccucauggaauuggagcucgugg

SEQ ID NO: 1493673 - RNA, 14 nt, Human
cccuaucuuugcca

SEQ ID NO: 1493674 - RNA, 16 nt, Human
cccuaucuuugccacc

SEQ ID NO: 1493675 - RNA, 19 nt, Human
cccuaucuuugccacccuc

SEQ ID NO: 1493676 - RNA, 21 nt, Human
cccuaucuuugccacccucau

SEQ ID NO: 1493677 - RNA, 10 nt, Human
cccucacacu

SEQ ID NO: 1493678 - RNA, 12 nt, Human
cccucacacugg

SEQ ID NO: 1493679 - RNA, 13 nt, Human
cccucacacuggg

SEQ ID NO: 1493680 - RNA, 14 nt, Human
cccucacacuggga

SEQ ID NO: 1493681 - RNA, 15 nt, Human
ccagcuaauuuuugu

SEQ ID NO: 1493682 - RNA, 15 nt, Human
ccagggggcaagagg

SEQ ID NO: 1493683 - RNA, 14 nt, Human
ccauacauuugugu

SEQ ID NO: 1493684 - RNA, 13 nt, Human
ccauacauuugug

SEQ ID NO: 1493685 - RNA, 12 nt, Human
ccaucccugcgu

SEQ ID NO: 1493686 - RNA, 17 nt, Human
caauucuucccuaucuu

SEQ ID NO: 1493687 - RNA, 23 nt, Human
caaugcuguauuuuaaaagaaug

SEQ ID NO: 1493688 - RNA, 14 nt, Human
caaugcuguauuuu

SEQ ID NO: 1493689 - RNA, 21 nt, Human
caauauuucagauaaucacaa

SEQ ID NO: 1493690 - RNA, 20 nt, Human
caauauuucagauaaucaca

SEQ ID NO: 1493691 - RNA, 12 nt, Human
caauauuucaga

SEQ ID NO: 1493692 - RNA, 16 nt, Human
cacaagacugcacauc

SEQ ID NO: 1493693 - RNA, 20 nt, Human
caaguauuagaauaccacag

SEQ ID NO: 1493694 - RNA, 14 nt, Human
caaguauuagaaua

SEQ ID NO: 1493695 - RNA, 21 nt, Human
cacagggccuuuggcaggugc

SEQ ID NO: 1493696 - RNA, 14 nt, Human
cacuacacccagca

SEQ ID NO: 1493697 - RNA, 15 nt, Human
cacuacacccagcaa

SEQ ID NO: 1493698 - RNA, 16 nt, Human
cacuacacccagcaau

SEQ ID NO: 1493699 - RNA, 17 nt, Human
cacuacacccagcaaua

SEQ ID NO: 1493700 - RNA, 23 nt, Human
cacuacgccuggcugauuuuugu

SEQ ID NO: 1493701 - RNA, 20 nt, Human
cacggcagccacagcuuggg

SEQ ID NO: 1493702 - RNA, 14 nt, Human
cacuacaaccuccg

SEQ ID NO: 1493703 - RNA, 13 nt, Human
cacuacaaccucc

SEQ ID NO: 1493704 - RNA, 12 nt, Human
cacuacacccag

SEQ ID NO: 1493705 - RNA, 13 nt, Human
cacggcagccaca

SEQ ID NO: 1493706 - RNA, 17 nt, Human
cacucuugaaaaaugca

SEQ ID NO: 1493707 - RNA, 11 nt, Human
cacugaagaag

SEQ ID NO: 1493708 - RNA, 20 nt, Human
cacugaacuuugcugagccu

SEQ ID NO: 1493709 - RNA, 17 nt, Human
auuuuauagcuacuaau

SEQ ID NO: 1493710 - RNA, 20 nt, Human
caaaagcccauucauuccau

SEQ ID NO: 1493711 - RNA, 22 nt, Human
caaaagcccauucauuccauuc

SEQ ID NO: 1493712 - RNA, 17 nt, Human
caaaccaaaucacugaa

SEQ ID NO: 1493713 - RNA, 19 nt, Human
caaaccacuuuuugcagcu

SEQ ID NO: 1493714 - RNA, 17 nt, Human
caaaccacuuuuugcag

SEQ ID NO: 1493715 - RNA, 21 nt, Human
caacuaucucauuuccaagca

SEQ ID NO: 1493716 - RNA, 23 nt, Human
caagaauuucuaggacugaauua

SEQ ID NO: 1493717 - RNA, 22 nt, Human
caaauccagccugcugccugcu

SEQ ID NO: 1493718 - RNA, 16 nt, Human
auuucagcagcugcag

SEQ ID NO: 1493719 - RNA, 20 nt, Human
auuucuaugaaauauuaugu

SEQ ID NO: 1493720 - RNA, 18 nt, Human
auuucuaugaaauauuau

SEQ ID NO: 1493721 - RNA, 15 nt, Human
auuucuaugaaauau

SEQ ID NO: 1493722 - RNA, 23 nt, Human
auuguaauaggcguaacuaauuu

SEQ ID NO: 1493723 - RNA, 18 nt, Human
auugaugggauuugguca

SEQ ID NO: 1493724 - RNA, 18 nt, Human
auugauccagaaagaaaa

SEQ ID NO: 1493725 - RNA, 19 nt, Human
auugauccagaaagaaaac

SEQ ID NO: 1493726 - RNA, 22 nt, Human
auugauccagaaagaaaacuug

SEQ ID NO: 1493727 - RNA, 15 nt, Human
auuauguguguuuua

SEQ ID NO: 1493728 - RNA, 20 nt, Human
auuauguguguuuuaaaaug

SEQ ID NO: 1493729 - RNA, 21 nt, Human
auuauguguguuuuaaaauga

SEQ ID NO: 1493730 - RNA, 17 nt, Human
auucuugccaaauauaa

SEQ ID NO: 1493731 - RNA, 13 nt, Human
auuccugaacagg

SEQ ID NO: 1493732 - RNA, 20 nt, Human
auugagaaaaauauauacua

SEQ ID NO: 1493733 - RNA, 16 nt, Human
auugauccagaaagaa

SEQ ID NO: 1493734 - RNA, 17 nt, Human
auugauccagaaagaaa

SEQ ID NO: 1493735 - RNA, 20 nt, Human
cauuuguguugaagagguuu

SEQ ID NO: 1493736 - RNA, 18 nt, Human
cauuuuuugggcagcaau

SEQ ID NO: 1493737 - RNA, 19 nt, Human
cauuuuuugggcagcaauu

SEQ ID NO: 1493738 - RNA, 22 nt, Human
cauuuuuugggcagcaauuuaa

SEQ ID NO: 1493739 - RNA, 16 nt, Human
cauuuguguugaagag

SEQ ID NO: 1493740 - RNA, 20 nt, Human
cauuuguauaaaauaauuuu

SEQ ID NO: 1493741 - RNA, 19 nt, Human
cauuuguauaaaauaauuu

SEQ ID NO: 1493742 - RNA, 14 nt, Human
ccacagcugccucu

SEQ ID NO: 1493743 - RNA, 15 nt, Human
ccaccgcagaaggaa

SEQ ID NO: 1493744 - RNA, 16 nt, Human
ccaccgcagaaggaag

SEQ ID NO: 1493745 - RNA, 12 nt, Human
cauccuggaaua

SEQ ID NO: 1493746 - RNA, 12 nt, Human
caucuggaacca

SEQ ID NO: 1493747 - RNA, 17 nt, Human
caucuggaaccaucaga

SEQ ID NO: 1493748 - RNA, 19 nt, Human
caucuggaaccaucagaaa

SEQ ID NO: 1493749 - RNA, 19 nt, Human
cauuauauuuauuacugua

SEQ ID NO: 1493750 - RNA, 13 nt, Human
cauuauaaaaaga

SEQ ID NO: 1493751 - RNA, 14 nt, Human
caugauguuuagaa

SEQ ID NO: 1493752 - RNA, 20 nt, Human
caugcucuccaaaccacuuu

SEQ ID NO: 1493753 - RNA, 13 nt, Human
cagcauaauacuu

SEQ ID NO: 1493754 - RNA, 21 nt, Human
cagaguaauccaagcaaaugu

SEQ ID NO: 1493755 - RNA, 12 nt, Human
cagauccuggaa

SEQ ID NO: 1493756 - RNA, 13 nt, Human
cagauccuggaaa

SEQ ID NO: 1493757 - RNA, 23 nt, Human
caguaaagaacaucccuccuggg

SEQ ID NO: 1493758 - RNA, 19 nt, Human
cagucaccucauggaauug

SEQ ID NO: 1493759 - RNA, 16 nt, Human
cagucaccucauggaa

SEQ ID NO: 1493760 - RNA, 21 nt, Human
cagugggaggugagaccaccu

SEQ ID NO: 1493761 - RNA, 14 nt, Human
caguggggaaugaa

SEQ ID NO: 1493762 - RNA, 22 nt, Human
cagugggaggugagaccaccuc

SEQ ID NO: 1493763 - RNA, 20 nt, Human
cagucugacuguuuccauca

SEQ ID NO: 1493764 - RNA, 16 nt, Human
caggcacacaccacca

SEQ ID NO: 1493765 - RNA, 18 nt, Human
ggcauuuuacuguacaga

SEQ ID NO: 1493766 - RNA, 16 nt, Human
ggccagaccauggaca

SEQ ID NO: 1493767 - RNA, 17 nt, Human
ggcaucaucucagcuca

SEQ ID NO: 1493768 - RNA, 23 nt, Human
ggcaucaucucagcucacugcaa

SEQ ID NO: 1493769 - RNA, 15 nt, Human
ggaggcucuggagcc

SEQ ID NO: 1493770 - RNA, 14 nt, Human
ggauuguaguccca

SEQ ID NO: 1493771 - RNA, 10 nt, Human
aaaaaacuac

SEQ ID NO: 1493772 - RNA, 16 nt, Human
aaaaaggacaucagca

SEQ ID NO: 1493773 - RNA, 14 nt, Human
aaaaauaaaaaaca

SEQ ID NO: 1493774 - RNA, 17 nt, Human
ggccccugccucucugc

SEQ ID NO: 1493775 - RNA, 18 nt, Human
ggccccugccucucugca

SEQ ID NO: 1493776 - RNA, 19 nt, Human
ggccccugccucucugcag

SEQ ID NO: 1493777 - RNA, 21 nt, Human
ggccccugccucucugcaggu

SEQ ID NO: 1493778 - RNA, 20 nt, Human
ggcuaagcuucacuguaaaa

SEQ ID NO: 1493779 - RNA, 23 nt, Human
ggcgugaucucagcucacugcaa

SEQ ID NO: 1493780 - RNA, 14 nt, Human
ggcuaccaggaaag

SEQ ID NO: 1493781 - RNA, 17 nt, Human
ggcuagacuagucucaa

SEQ ID NO: 1493782 - RNA, 13 nt, Human
gggccaggcuggg

SEQ ID NO: 1493783 - RNA, 15 nt, Human
aaaauggucucuaac

SEQ ID NO: 1493784 - RNA, 17 nt, Human
aaaaggacaucagcaaa

SEQ ID NO: 1493785 - RNA, 19 nt, Human
aaaaggacaucagcaaaca

SEQ ID NO: 1493786 - RNA, 12 nt, Human
aaaauacauugu

SEQ ID NO: 1493787 - RNA, 20 nt, Human
aaaauaauuuuuauauuuga

SEQ ID NO: 1493788 - RNA, 17 nt, Human
aaaauaauuuuuauauu

SEQ ID NO: 1493789 - RNA, 16 nt, Human
aaaauaauuuuuauau

SEQ ID NO: 1493790 - RNA, 11 nt, Human
aaaauaauuuu

SEQ ID NO: 1493791 - RNA, 11 nt, Human
aaaaugagaaa

SEQ ID NO: 1493792 - RNA, 12 nt, Human
aaaaugagaaau

SEQ ID NO: 1493793 - RNA, 20 nt, Human
aaaauauuguuuuacaauag

SEQ ID NO: 1493794 - RNA, 19 nt, Human
aaaauauuguuuuacaaua

SEQ ID NO: 1493795 - RNA, 16 nt, Human
aaaccuuccacccagu

SEQ ID NO: 1493796 - RNA, 23 nt, Human
aaaccuuccacccagugcugaau

SEQ ID NO: 1493797 - RNA, 20 nt, Human
aaaccacuuuuugcagcuuu

SEQ ID NO: 1493798 - RNA, 10 nt, Human
aaaccacuuu

SEQ ID NO: 1493799 - RNA, 22 nt, Human
gguaaaucagacuaugaaguuu

SEQ ID NO: 1493800 - RNA, 16 nt, Human
gguaugaacuugagga

SEQ ID NO: 1493801 - RNA, 19 nt, Human
gguaugaacuugaggacac

SEQ ID NO: 1493802 - RNA, 20 nt, Human
gguaugaacuugaggacaca

SEQ ID NO: 1493803 - RNA, 14 nt, Human
ggucagugcaaaua

SEQ ID NO: 1493804 - RNA, 15 nt, Human
guaauuuuuuucacc

SEQ ID NO: 1493805 - RNA, 13 nt, Human
guaaguuuuuuga

SEQ ID NO: 1493806 - RNA, 13 nt, Human
guaaaccuuuuau

SEQ ID NO: 1493807 - RNA, 21 nt, Human
guaaagcccauuuuuaaaaua

SEQ ID NO: 1493808 - RNA, 18 nt, Human
guacacaauaagcaaaaa

SEQ ID NO: 1493809 - RNA, 20 nt, Human
guacacaauaagcaaaaaca

SEQ ID NO: 1493810 - RNA, 16 nt, Human
aaauauauacuaaaca

SEQ ID NO: 1493811 - RNA, 12 nt, Human
aaauauauacua

SEQ ID NO: 1493812 - RNA, 21 nt, Human
aaauacgugggcauucaaaug

SEQ ID NO: 1493813 - RNA, 20 nt, Human
aaauacgugggcauucaaau

SEQ ID NO: 1493814 - RNA, 22 nt, Human
aaauaucacuugucaauaaaau

SEQ ID NO: 1493815 - RNA, 16 nt, Human
aaauauauuuuaagac

SEQ ID NO: 1493816 - RNA, 22 nt, Human
aaauauauuuuaagacgaaaca

SEQ ID NO: 1493817 - RNA, 18 nt, Human
aaauauaugcuaagucuu

SEQ ID NO: 1493818 - RNA, 14 nt, Human
aaauauauaucaaa

SEQ ID NO: 1493819 - RNA, 17 nt, Human
aaagcagccuggccaac

SEQ ID NO: 1493820 - RNA, 14 nt, Human
aaagcuguguggca

SEQ ID NO: 1493821 - RNA, 14 nt, Human
gguggcagcaacaa

SEQ ID NO: 1493822 - RNA, 13 nt, Human
gguggcagcaaca

SEQ ID NO: 1493823 - RNA, 22 nt, Human
aaagggcuguuauaaucuuuca

SEQ ID NO: 1493824 - RNA, 20 nt, Human
aaagggcuguuauaaucuuu

SEQ ID NO: 1493825 - RNA, 18 nt, Human
aaagguucaugcaaacuu

SEQ ID NO: 1493826 - RNA, 21 nt, Human
aaaguaaaaacaaagaaauua

SEQ ID NO: 1493827 - RNA, 17 nt, Human
aaaguauguuagugcaa

SEQ ID NO: 1493828 - RNA, 17 nt, Human
gguuuucacauuggaaa

SEQ ID NO: 1493829 - RNA, 21 nt, Human
gcuuuucccuuuuuuuaagua

SEQ ID NO: 1493830 - RNA, 20 nt, Human
gcuuuucccuuuuuuuaagu

SEQ ID NO: 1493831 - RNA, 16 nt, Human
gcuuuucccaaaagcc

SEQ ID NO: 1493832 - RNA, 16 nt, Human
ggaaaaaauaacaaug

SEQ ID NO: 1493833 - RNA, 19 nt, Human
ggaaagcagccuggccaac

SEQ ID NO: 1493834 - RNA, 23 nt, Human
ggaaagcgccuccaacccuagca

SEQ ID NO: 1493835 - RNA, 19 nt, Human
ggaaagcgccuccaacccu

SEQ ID NO: 1493836 - RNA, 19 nt, Human
ggaaaucaggguuaguauu

SEQ ID NO: 1493837 - RNA, 19 nt, Human
ggaauacucuuauaucuau

SEQ ID NO: 1493838 - RNA, 12 nt, Human
ggacacaugucc

SEQ ID NO: 1493839 - RNA, 13 nt, Human
ggacacaugucca

SEQ ID NO: 1493840 - RNA, 19 nt, Human
ggacacauguccaguggga

SEQ ID NO: 1493841 - RNA, 14 nt, Human
ggacaccugcccug

SEQ ID NO: 1493842 - RNA, 15 nt, Human
ggacaccugcccugc

SEQ ID NO: 1493843 - RNA, 13 nt, Human
ggacaccugcccu

SEQ ID NO: 1493844 - RNA, 10 nt, Human
ggacaccugc

SEQ ID NO: 1493845 - RNA, 11 nt, Human
ggacaccugcc

SEQ ID NO: 1493846 - RNA, 12 nt, Human
ggacaccugccc

SEQ ID NO: 1493847 - RNA, 21 nt, Human
ggacagucaccucauggaauu

SEQ ID NO: 1493848 - RNA, 18 nt, Human
ggacagucaccucaugga

SEQ ID NO: 1493849 - RNA, 17 nt, Human
ggacagucaccucaugg

SEQ ID NO: 1493850 - RNA, 12 nt, Human
ggacaucagcaa

SEQ ID NO: 1493851 - RNA, 14 nt, Human
ggacaucagcaaac

SEQ ID NO: 1493852 - RNA, 15 nt, Human
ggacaucagcaaaca

SEQ ID NO: 1493853 - RNA, 18 nt, Human
gcugggccccugccucuc

SEQ ID NO: 1493854 - RNA, 20 nt, Human
gcugggccccugccucucug

SEQ ID NO: 1493855 - RNA, 12 nt, Human
gcugggccccug

SEQ ID NO: 1493856 - RNA, 13 nt, Human
gcugggccccugc

SEQ ID NO: 1493857 - RNA, 14 nt, Human
gcugggccccugcc

SEQ ID NO: 1493858 - RNA, 21 nt, Human
gcugggaauggaggggcagag

SEQ ID NO: 1493859 - RNA, 21 nt, Human
gcuguauuuuaaaagaaugau

SEQ ID NO: 1493860 - RNA, 18 nt, Human
gcuguauuuuaaaagaau

SEQ ID NO: 1493861 - RNA, 20 nt, Human
gcuguauuuuaaaagaauga

SEQ ID NO: 1493862 - RNA, 18 nt, Human
gcugccucuucccucuuc

SEQ ID NO: 1493863 - RNA, 14 nt, Human
gcugccucuucccu

SEQ ID NO: 1493864 - RNA, 20 nt, Human
gcugccccuggugcacuggc

SEQ ID NO: 1493865 - RNA, 19 nt, Human
gccuucucuaaacauuuca

SEQ ID NO: 1493866 - RNA, 20 nt, Human
gcuaaguacacaauaagcaa

SEQ ID NO: 1493867 - RNA, 21 nt, Human
gcuaaguacacaauaagcaaa

SEQ ID NO: 1493868 - RNA, 22 nt, Human
gcuaaguacacaauaagcaaaa

SEQ ID NO: 1493869 - RNA, 21 nt, Human
gcuaggaauuguguuuauaau

SEQ ID NO: 1493870 - RNA, 22 nt, Human
gcucaggagcccugggaggcuc

SEQ ID NO: 1493871 - RNA, 23 nt, Human
gcucaggagcccugggaggcucu

SEQ ID NO: 1493872 - RNA, 16 nt, Human
gcucagagcaguguuu

SEQ ID NO: 1493873 - RNA, 20 nt, Human
gcccugccaccugucugucu

SEQ ID NO: 1493874 - RNA, 18 nt, Human
gcccugccaccugucugu

SEQ ID NO: 1493875 - RNA, 15 nt, Human
gccggaucugaggga

SEQ ID NO: 1493876 - RNA, 17 nt, Human
gccggaucugagggaga

SEQ ID NO: 1493877 - RNA, 15 nt, Human
gcccacuguacuugc

SEQ ID NO: 1493878 - RNA, 20 nt, Human
gcccacuguacuugcucuug

SEQ ID NO: 1493879 - RNA, 22 nt, Human
gcccacuguacuugcucuugau

SEQ ID NO: 1493880 - RNA, 12 nt, Human
gcauuuagaugu

SEQ ID NO: 1493881 - RNA, 13 nt, Human
gcauuuagaugua

SEQ ID NO: 1493882 - RNA, 20 nt, Human
gacauuuuaaaaaaugguca

SEQ ID NO: 1493883 - RNA, 13 nt, Human
gacauuuuacauu

SEQ ID NO: 1493884 - RNA, 14 nt, Human
gacauuuuacauua

SEQ ID NO: 1493885 - RNA, 15 nt, Human
gacauuuuacauuaa

SEQ ID NO: 1493886 - RNA, 21 nt, Human
gacauuuuacauuaaauuuuu

SEQ ID NO: 1493887 - RNA, 18 nt, Human
gacagucaccucauggaa

SEQ ID NO: 1493888 - RNA, 22 nt, Human
gaauaucuccgucaacucauau

SEQ ID NO: 1493889 - RNA, 11 nt, Human
gaauaugccuu

SEQ ID NO: 1493890 - RNA, 14 nt, Human
gaauuaugaaacuu

SEQ ID NO: 1493891 - RNA, 14 nt, Human
gacaaaaagcuacu

SEQ ID NO: 1493892 - RNA, 20 nt, Human
gaauuacauuuguauaaaau

SEQ ID NO: 1493893 - RNA, 15 nt, Human
gaauuacgugcucug

SEQ ID NO: 1493894 - RNA, 19 nt, Human
gaauuacgugcucuguggg

SEQ ID NO: 1493895 - RNA, 18 nt, Human
gaauuacauuuguauaaa

SEQ ID NO: 1493896 - RNA, 15 nt, Human
gaauuacauuuguau

SEQ ID NO: 1493897 - RNA, 13 nt, Human
gaauuacauuugu

SEQ ID NO: 1493898 - RNA, 22 nt, Human
gaaugauuaugaauuacauuug

SEQ ID NO: 1493899 - RNA, 14 nt, Human
gaaugauuaugaau

SEQ ID NO: 1493900 - RNA, 22 nt, Human
gagcuggagaugaggccagacc

SEQ ID NO: 1493901 - RNA, 23 nt, Human
gagcuggagaugaggccagacca

SEQ ID NO: 1493902 - RNA, 21 nt, Human
gagcuggagaugaggccagac

SEQ ID NO: 1493903 - RNA, 14 nt, Human
gagcagucaggaaa

SEQ ID NO: 1493904 - RNA, 12 nt, Human
gagcccugggag

SEQ ID NO: 1493905 - RNA, 16 nt, Human
gagcccugggaggcuc

SEQ ID NO: 1493906 - RNA, 18 nt, Human
gagcccugggaggcucug

SEQ ID NO: 1493907 - RNA, 19 nt, Human
gagcccugggaggcucugg

SEQ ID NO: 1493908 - RNA, 20 nt, Human
gagcccugggaggcucugga

SEQ ID NO: 1493909 - RNA, 13 nt, Human
gaggggcagagcc

SEQ ID NO: 1493910 - RNA, 20 nt, Human
gaggggcagagccaggaaga

SEQ ID NO: 1493911 - RNA, 16 nt, Human
gaggggcagagccagg

SEQ ID NO: 1493912 - RNA, 20 nt, Human
gaggcucuggagcccacugu

SEQ ID NO: 1493913 - RNA, 14 nt, Human
gaggacccaggaca

SEQ ID NO: 1493914 - RNA, 15 nt, Human
gaggacccaggacag

SEQ ID NO: 1493915 - RNA, 22 nt, Human
gacuuuuuauggcacuaguauu

SEQ ID NO: 1493916 - RNA, 13 nt, Human
gagaaggagcaga

SEQ ID NO: 1493917 - RNA, 23 nt, Human
gagacgggacugcggaggaagga

SEQ ID NO: 1493918 - RNA, 19 nt, Human
gcagagcugauggagaagg

SEQ ID NO: 1493919 - RNA, 21 nt, Human
gcagagcugauggagaaggaa

SEQ ID NO: 1493920 - RNA, 22 nt, Human
gcagagcugauggagaaggaag

SEQ ID NO: 1493921 - RNA, 23 nt, Human
gcagagcugauggagaaggaagg

SEQ ID NO: 1493922 - RNA, 17 nt, Human
gcagucucuauaccaau

SEQ ID NO: 1493923 - RNA, 18 nt, Human
gcagucucuauaccaaua

SEQ ID NO: 1493924 - RNA, 20 nt, Human
gcagucucuauaccaauaaa

SEQ ID NO: 1493925 - RNA, 21 nt, Human
gcagucucuauaccaauaaag

SEQ ID NO: 1493926 - RNA, 22 nt, Human
gcagucucuauaccaauaaagu

SEQ ID NO: 1493927 - RNA, 23 nt, Human
gcagucucuauaccaauaaagug

SEQ ID NO: 1493928 - RNA, 22 nt, Human
gcaguuguugcccacagcugua

SEQ ID NO: 1493929 - RNA, 11 nt, Human
gcauccagccu

SEQ ID NO: 1493930 - RNA, 21 nt, Human
gcaucccucacccauccuaga

SEQ ID NO: 1493931 - RNA, 20 nt, Human
gcaucuagcaugucgucaaa

SEQ ID NO: 1493932 - RNA, 12 nt, Human
gauacugaaaua

SEQ ID NO: 1493933 - RNA, 12 nt, Human
gauccacccgcc

SEQ ID NO: 1493934 - RNA, 13 nt, Human
gaucugagggaga

SEQ ID NO: 1493935 - RNA, 18 nt, Human
gauccacucgccucagcc

SEQ ID NO: 1493936 - RNA, 21 nt, Human
gauccacccgccucagccucc

SEQ ID NO: 1493937 - RNA, 15 nt, Human
gcaaaaacaaaaaga

SEQ ID NO: 1493938 - RNA, 20 nt, Human
gcaaaaacaaaaagaaaaga

SEQ ID NO: 1493939 - RNA, 21 nt, Human
gcaaaaacaaaaagaaaagaa

SEQ ID NO: 1493940 - RNA, 23 nt, Human
cuggaaaaguauguuagugcaaa

SEQ ID NO: 1493941 - RNA, 17 nt, Human
cuggaaaccuuccaccc

SEQ ID NO: 1493942 - RNA, 20 nt, Human
cuggaaaccuuccacccagu

SEQ ID NO: 1493943 - RNA, 21 nt, Human
cuguacuugcucuugaugccu

SEQ ID NO: 1493944 - RNA, 16 nt, Human
cuguacuugcucuuga

SEQ ID NO: 1493945 - RNA, 19 nt, Human
cuguacuugcucuugaugc

SEQ ID NO: 1493946 - RNA, 20 nt, Human
cuguacuugcucuugaugcc

SEQ ID NO: 1493947 - RNA, 20 nt, Human
cuguaagaaaauaucacuug

SEQ ID NO: 1493948 - RNA, 20 nt, Human
cugucuacacuaagagagaa

SEQ ID NO: 1493949 - RNA, 22 nt, Human
cuuaaaauaaugaauacauuuc

SEQ ID NO: 1493950 - RNA, 23 nt, Human
gaaacuucagcgguuuauauaag

SEQ ID NO: 1493951 - RNA, 16 nt, Human
gaaagaacggaagaag

SEQ ID NO: 1493952 - RNA, 19 nt, Human
cuuuuaugugaaacauguu

SEQ ID NO: 1493953 - RNA, 13 nt, Human
gaaaauuuuugua

SEQ ID NO: 1493954 - RNA, 16 nt, Human
gaaaauuuuuguagua

SEQ ID NO: 1493955 - RNA, 18 nt, Human
gaaaacuuguauuaugug

SEQ ID NO: 1493956 - RNA, 14 nt, Human
gaaaauuaacauga

SEQ ID NO: 1493957 - RNA, 15 nt, Human
gaaaagcagacauuu

SEQ ID NO: 1493958 - RNA, 16 nt, Human
gaaaagcagacauuuu

SEQ ID NO: 1493959 - RNA, 14 nt, Human
gaaaaaauauauau

SEQ ID NO: 1493960 - RNA, 15 nt, Human
cuucuauacccaccc

SEQ ID NO: 1493961 - RNA, 18 nt, Human
cuucuauacccacccaga

SEQ ID NO: 1493962 - RNA, 17 nt, Human
cuucuauacccacccag

SEQ ID NO: 1493963 - RNA, 23 nt, Human
cuucccaaaguccugggauuaca

SEQ ID NO: 1493964 - RNA, 11 nt, Human
aaauguauacu

SEQ ID NO: 1493965 - RNA, 16 nt, Human
aaaucauucauuuucu

SEQ ID NO: 1493966 - RNA, 17 nt, Human
aaauuccaagugauuga

SEQ ID NO: 1493967 - RNA, 17 nt, Human
aaauuguauuacaaauc

SEQ ID NO: 1493968 - RNA, 12 nt, Human
aaauuacaacua

SEQ ID NO: 1493969 - RNA, 13 nt, Human
aaauuacaacuaa

SEQ ID NO: 1493970 - RNA, 16 nt, Human
aaauuaucuauagcua

SEQ ID NO: 1493971 - RNA, 17 nt, Human
aaauuaugugacauuuu

SEQ ID NO: 1493972 - RNA, 20 nt, Human
aaauuaugugacauuuuaca

SEQ ID NO: 1493973 - RNA, 22 nt, Human
aaauuaugugacauuuuacauu

SEQ ID NO: 1493974 - RNA, 23 nt, Human
aaauuaugugccagauuuaugca

SEQ ID NO: 1493975 - RNA, 14 nt, Human
gucaggaaagagaa

SEQ ID NO: 1493976 - RNA, 18 nt, Human
gucacauuccugaacagg

SEQ ID NO: 1493977 - RNA, 12 nt, Human
aacauauauaac

SEQ ID NO: 1493978 - RNA, 15 nt, Human
aacauaaaaaggaca

SEQ ID NO: 1493979 - RNA, 19 nt, Human
aacauaaaaaggacaucag

SEQ ID NO: 1493980 - RNA, 20 nt, Human
aacauaaaaaggacaucagc

SEQ ID NO: 1493981 - RNA, 22 nt, Human
aacauaaaaaggacaucagcaa

SEQ ID NO: 1493982 - RNA, 10 nt, Human
aacauuccau

SEQ ID NO: 1493983 - RNA, 13 nt, Human
aacauuccauccu

SEQ ID NO: 1493984 - RNA, 14 nt, Human
aacauuccauccuu

SEQ ID NO: 1493985 - RNA, 23 nt, Human
aacauuccauccuugagucaaaa

SEQ ID NO: 1493986 - RNA, 20 nt, Human
gucuauuuacggaacucaaa

SEQ ID NO: 1493987 - RNA, 12 nt, Human
aacacucaccau

SEQ ID NO: 1493988 - RNA, 21 nt, Human
aacacugggagaaaugaaaaa

SEQ ID NO: 1493989 - RNA, 15 nt, Human
gucccuaauaaagcu

SEQ ID NO: 1493990 - RNA, 12 nt, Human
gucccuaauaaa

SEQ ID NO: 1493991 - RNA, 18 nt, Human
gugacuuuggcugcaugc

SEQ ID NO: 1493992 - RNA, 20 nt, Human
gugacuuuggcugcaugcga

SEQ ID NO: 1493993 - RNA, 13 nt, Human
gugagaccaccuc

SEQ ID NO: 1493994 - RNA, 14 nt, Human
gugagaccaccucu

SEQ ID NO: 1493995 - RNA, 20 nt, Human
gugagaccaccucucaauau

SEQ ID NO: 1493996 - RNA, 21 nt, Human
aacuaggugcauauuuauaaa

SEQ ID NO: 1493997 - RNA, 12 nt, Human
aacuauggccug

SEQ ID NO: 1493998 - RNA, 15 nt, Human
aacgucuuaaauauu

SEQ ID NO: 1493999 - RNA, 14 nt, Human
aacgucuuaaauau

SEQ ID NO: 1494000 - RNA, 12 nt, Human
aacgucuuaaau

SEQ ID NO: 1494001 - RNA, 13 nt, Human
aaccuuccaccca

SEQ ID NO: 1494002 - RNA, 15 nt, Human
aaccuuccacccagu

SEQ ID NO: 1494003 - RNA, 19 nt, Human
gugccagauuuaugcauau

SEQ ID NO: 1494004 - RNA, 22 nt, Human
aagaaaauuuuuguaguagcgu

SEQ ID NO: 1494005 - RNA, 11 nt, Human
aagaaacauuu

SEQ ID NO: 1494006 - RNA, 22 nt, Human
aagaagcaccaaucaugaauua

SEQ ID NO: 1494007 - RNA, 18 nt, Human
gugcucaggagcccuggg

SEQ ID NO: 1494008 - RNA, 19 nt, Human
gugcucaggagcccuggga

SEQ ID NO: 1494009 - RNA, 16 nt, Human
gugcucauuucaggau

SEQ ID NO: 1494010 - RNA, 21 nt, Human
aacuucagcgguuuauauaag

SEQ ID NO: 1494011 - RNA, 18 nt, Human
aacuucagcgguuuauau

SEQ ID NO: 1494012 - RNA, 12 nt, Human
aacuugaggaca

SEQ ID NO: 1494013 - RNA, 13 nt, Human
aacuugaggacac

SEQ ID NO: 1494014 - RNA, 14 nt, Human
aacuugaggacaca

SEQ ID NO: 1494015 - RNA, 15 nt, Human
aacuugaggacacau

SEQ ID NO: 1494016 - RNA, 16 nt, Human
aacuugaggacacaug

SEQ ID NO: 1494017 - RNA, 17 nt, Human
aacuugaggacacaugu

SEQ ID NO: 1494018 - RNA, 18 nt, Human
aacuugaggacacauguc

SEQ ID NO: 1494019 - RNA, 19 nt, Human
aacuugaggacacaugucc

SEQ ID NO: 1494020 - RNA, 20 nt, Human
aacuugaggacacaugucca

SEQ ID NO: 1494021 - RNA, 13 nt, Human
gugcaccugcccc

SEQ ID NO: 1494022 - RNA, 14 nt, Human
gugaucucagcuca

SEQ ID NO: 1494023 - RNA, 11 nt, Human
uaaaacuaaga

SEQ ID NO: 1494024 - RNA, 11 nt, Human
uaaaaaggaca

SEQ ID NO: 1494025 - RNA, 18 nt, Human
uaaaaaggacaucagcaa

SEQ ID NO: 1494026 - RNA, 19 nt, Human
uaaaaaggacaucagcaaa

SEQ ID NO: 1494027 - RNA, 21 nt, Human
uaaaaaggacaucagcaaaca

SEQ ID NO: 1494028 - RNA, 17 nt, Human
uaaaaaggcuaaaugga

SEQ ID NO: 1494029 - RNA, 18 nt, Human
uaaaauagucucuuuaaa

SEQ ID NO: 1494030 - RNA, 16 nt, Human
uaaaagaaacccugca

SEQ ID NO: 1494031 - RNA, 17 nt, Human
uaaaagaaacccugcac

SEQ ID NO: 1494032 - RNA, 22 nt, Human
uaaaauaauuuuuauauuugaa

SEQ ID NO: 1494033 - RNA, 19 nt, Human
aaguuauuuuuaauuuggu

SEQ ID NO: 1494034 - RNA, 21 nt, Human
aaguucaccagacucuauaaa

SEQ ID NO: 1494035 - RNA, 20 nt, Human
aaguuccuuggccaugcaga

SEQ ID NO: 1494036 - RNA, 16 nt, Human
aaguuuccaucaucua

SEQ ID NO: 1494037 - RNA, 12 nt, Human
aaguguguguuu

SEQ ID NO: 1494038 - RNA, 16 nt, Human
aaguguguguuuuuca

SEQ ID NO: 1494039 - RNA, 21 nt, Human
aaguguguguuuuucauaaag

SEQ ID NO: 1494040 - RNA, 17 nt, Human
aagggcuguuauaaucu

SEQ ID NO: 1494041 - RNA, 15 nt, Human
aagggcuguuauaau

SEQ ID NO: 1494042 - RNA, 23 nt, Human
aaguaacugggauuacaggcaug

SEQ ID NO: 1494043 - RNA, 15 nt, Human
guuuuaaagcuucca

SEQ ID NO: 1494044 - RNA, 19 nt, Human
guuuggacaaaauggaaua

SEQ ID NO: 1494045 - RNA, 19 nt, Human
aaguacacaauaagcaaaa

SEQ ID NO: 1494046 - RNA, 16 nt, Human
aaguacacaauaagca

SEQ ID NO: 1494047 - RNA, 17 nt, Human
aaguacacaauaagcaa

SEQ ID NO: 1494048 - RNA, 18 nt, Human
aaguacacaauaagcaaa

SEQ ID NO: 1494049 - RNA, 21 nt, Human
aaguauguuagugcaaauugu

SEQ ID NO: 1494050 - RNA, 19 nt, Human
aaguauguuagugcaaauu

SEQ ID NO: 1494051 - RNA, 18 nt, Human
aaguauguuagugcaaau

SEQ ID NO: 1494052 - RNA, 19 nt, Human
guugacuuauaguacauga

SEQ ID NO: 1494053 - RNA, 24 nt, Human
guugacuuauaguacaugauaaau

SEQ ID NO: 1494054 - RNA, 18 nt, Human
guucccuugaugaagaag

SEQ ID NO: 1494055 - RNA, 19 nt, Human
aagcuuuuaugugaaacau

SEQ ID NO: 1494056 - RNA, 21 nt, Human
aagcuuuuaugugaaacaugu

SEQ ID NO: 1494057 - RNA, 23 nt, Human
aagcuuguauuccuuuuucucuc

SEQ ID NO: 1494058 - RNA, 18 nt, Human
aagcuuaugcuuaaauuc

SEQ ID NO: 1494059 - RNA, 22 nt, Human
aagccauucuccugccucagcc

SEQ ID NO: 1494060 - RNA, 19 nt, Human
guuauuauauuuacaaaug

SEQ ID NO: 1494061 - RNA, 20 nt, Human
guuauuauauuuacaaaugg

SEQ ID NO: 1494062 - RNA, 15 nt, Human
aagccuguuuaagag

SEQ ID NO: 1494063 - RNA, 18 nt, Human
aagccuguuuaagagaca

SEQ ID NO: 1494064 - RNA, 21 nt, Human
aagccuuggggcugaugcagu

SEQ ID NO: 1494065 - RNA, 23 nt, Human
aagcaugcacaaauucugucucu

SEQ ID NO: 1494066 - RNA, 16 nt, Human
aagcacuaaacaaaga

SEQ ID NO: 1494067 - RNA, 12 nt, Human
guguuugaagca

SEQ ID NO: 1494068 - RNA, 15 nt, Human
uagaugcaguucuga

SEQ ID NO: 1494069 - RNA, 16 nt, Human
uagaugcaguucugaa

SEQ ID NO: 1494070 - RNA, 18 nt, Human
uagcaugucgucaaagcu

SEQ ID NO: 1494071 - RNA, 14 nt, Human
uagccaagugcagg

SEQ ID NO: 1494072 - RNA, 18 nt, Human
acaaaaggauaaugaaua

SEQ ID NO: 1494073 - RNA, 21 nt, Human
aauuguguuuauaauuuuaaa

SEQ ID NO: 1494074 - RNA, 16 nt, Human
aauuguuacaaauugu

SEQ ID NO: 1494075 - RNA, 20 nt, Human
uagauaucaugcaaauuuca

SEQ ID NO: 1494076 - RNA, 15 nt, Human
uagcuaaguacacaa

SEQ ID NO: 1494077 - RNA, 22 nt, Human
uagcuaaguacacaauaagcaa

SEQ ID NO: 1494078 - RNA, 23 nt, Human
acaauacaucccuuaccugggaa

SEQ ID NO: 1494079 - RNA, 13 nt, Human
acaauaaauagac

SEQ ID NO: 1494080 - RNA, 15 nt, Human
acaauaagcaaaaac

SEQ ID NO: 1494081 - RNA, 16 nt, Human
acaauaagcaaaaaca

SEQ ID NO: 1494082 - RNA, 14 nt, Human
acaagacugcacau

SEQ ID NO: 1494083 - RNA, 13 nt, Human
acaagacugcaca

SEQ ID NO: 1494084 - RNA, 18 nt, Human
uaggaaauauuuauuuua

SEQ ID NO: 1494085 - RNA, 19 nt, Human
uaggaaauauuuauuuuaa

SEQ ID NO: 1494086 - RNA, 23 nt, Human
uaguguuggagaagaacugaaau

SEQ ID NO: 1494087 - RNA, 22 nt, Human
uagugaaacucguuaauuugua

SEQ ID NO: 1494088 - RNA, 22 nt, Human
acaaugcuguauuuuaaaagaa

SEQ ID NO: 1494089 - RNA, 19 nt, Human
acaauggauaggcacagga

SEQ ID NO: 1494090 - RNA, 22 nt, Human
acaauguccuaacugaaagaug

SEQ ID NO: 1494091 - RNA, 17 nt, Human
acacaccaccacgccug

SEQ ID NO: 1494092 - RNA, 20 nt, Human
acacaccaccacgccuggcu

SEQ ID NO: 1494093 - RNA, 19 nt, Human
uauaaaaauaaaaaacacu

SEQ ID NO: 1494094 - RNA, 20 nt, Human
uauaaaagccuguuuaagag

SEQ ID NO: 1494095 - RNA, 22 nt, Human
uauaaaagggacugagaaauuu

SEQ ID NO: 1494096 - RNA, 15 nt, Human
acacaugaaguccaa

SEQ ID NO: 1494097 - RNA, 16 nt, Human
acacccucacacuggg

SEQ ID NO: 1494098 - RNA, 13 nt, Human
acacccucacacu

SEQ ID NO: 1494099 - RNA, 23 nt, Human
acaccugcccugcccugccaccu

SEQ ID NO: 1494100 - RNA, 14 nt, Human
acacuaagagagaa

SEQ ID NO: 1494101 - RNA, 13 nt, Human
acacuaagagaga

SEQ ID NO: 1494102 - RNA, 15 nt, Human
uauaaguguguguuu

SEQ ID NO: 1494103 - RNA, 14 nt, Human
uauuacuguaagaa

SEQ ID NO: 1494104 - RNA, 15 nt, Human
uauuagaauaccaca

SEQ ID NO: 1494105 - RNA, 23 nt, Human
uauucaaaaauuaucuauagcua

SEQ ID NO: 1494106 - RNA, 14 nt, Human
uauucauaauuauu

SEQ ID NO: 1494107 - RNA, 12 nt, Human
uauucaauaaag

SEQ ID NO: 1494108 - RNA, 13 nt, Human
uauucaauaaagc

SEQ ID NO: 1494109 - RNA, 14 nt, Human
uauucaauaaagcu

SEQ ID NO: 1494110 - RNA, 16 nt, Human
uauucaauucuuuuaa

SEQ ID NO: 1494111 - RNA, 21 nt, Human
uauucagcucauggacuucug

SEQ ID NO: 1494112 - RNA, 18 nt, Human
acagucaccucauggaau

SEQ ID NO: 1494113 - RNA, 17 nt, Human
acagucaccucauggaa

SEQ ID NO: 1494114 - RNA, 16 nt, Human
acagucaccucaugga

SEQ ID NO: 1494115 - RNA, 16 nt, Human
acaggcaugugucacc

SEQ ID NO: 1494116 - RNA, 19 nt, Human
acaggcaugugucaccaug

SEQ ID NO: 1494117 - RNA, 14 nt, Human
uaugugaaacaugu

SEQ ID NO: 1494118 - RNA, 21 nt, Human
uaugugacauuuuacauuaaa

SEQ ID NO: 1494119 - RNA, 19 nt, Human
uaugugacauuuuacauua

SEQ ID NO: 1494120 - RNA, 23 nt, Human
uaugugccagauuuaugcauauu

SEQ ID NO: 1494121 - RNA, 22 nt, Human
uaugugaacaguuguguuugaa

SEQ ID NO: 1494122 - RNA, 12 nt, Human
uaugugaacagu

SEQ ID NO: 1494123 - RNA, 17 nt, Human
uaugugaaacauguuuc

SEQ ID NO: 1494124 - RNA, 14 nt, Human
uaugugacauuuua

SEQ ID NO: 1494125 - RNA, 18 nt, Human
uaugugacauuuuacauu

SEQ ID NO: 1494126 - RNA, 20 nt, Human
uauguguaugcacaguaaaa

SEQ ID NO: 1494127 - RNA, 12 nt, Human
uauauuacaaug

SEQ ID NO: 1494128 - RNA, 13 nt, Human
uauauuacaauga

SEQ ID NO: 1494129 - RNA, 17 nt, Human
uauauuacaaugaucac

SEQ ID NO: 1494130 - RNA, 15 nt, Human
uauauuguuugcuaa

SEQ ID NO: 1494131 - RNA, 16 nt, Human
uauauuuaguaucuuu

SEQ ID NO: 1494132 - RNA, 17 nt, Human
uauaaguguguguuuuu

SEQ ID NO: 1494133 - RNA, 23 nt, Human
uauaaguguguguuuuucauaaa

SEQ ID NO: 1494134 - RNA, 23 nt, Human
uaucuauauuuuacauaaauuua

SEQ ID NO: 1494135 - RNA, 11 nt, Human
uaucuuugcca

SEQ ID NO: 1494136 - RNA, 14 nt, Human
uaucuuugccaccc

SEQ ID NO: 1494137 - RNA, 16 nt, Human
uaucuuugccacccuc

SEQ ID NO: 1494138 - RNA, 22 nt, Human
uaucuuugccacccucaugcug

SEQ ID NO: 1494139 - RNA, 21 nt, Human
uaugauuaaguaaugauaacu

SEQ ID NO: 1494140 - RNA, 20 nt, Human
uaugauuaaguaaugauaac

SEQ ID NO: 1494141 - RNA, 16 nt, Human
uaugauuaaguaauga

SEQ ID NO: 1494142 - RNA, 16 nt, Human
uaugaacuugaggaca

SEQ ID NO: 1494143 - RNA, 18 nt, Human
uaugaacuugaggacaca

SEQ ID NO: 1494144 - RNA, 16 nt, Human
uaugccuuguuucaua

SEQ ID NO: 1494145 - RNA, 19 nt, Human
uaugccccauucaacaucu

SEQ ID NO: 1494146 - RNA, 16 nt, Human
acagccucuuagaugc

SEQ ID NO: 1494147 - RNA, 12 nt, Human
uacuauaguacc

SEQ ID NO: 1494148 - RNA, 13 nt, Human
uacuauaguacca

SEQ ID NO: 1494149 - RNA, 16 nt, Human
uacuauaguaccagua

SEQ ID NO: 1494150 - RNA, 19 nt, Human
uacuguaaggcaaucaugg

SEQ ID NO: 1494151 - RNA, 14 nt, Human
uacuguaagaaaau

SEQ ID NO: 1494152 - RNA, 18 nt, Human
uacuguaaggcaaucaug

SEQ ID NO: 1494153 - RNA, 19 nt, Human
aauugaugggauuugguca

SEQ ID NO: 1494154 - RNA, 18 nt, Human
aauuccaagugauugaaa

SEQ ID NO: 1494155 - RNA, 16 nt, Human
aauuauuauuuggccc

SEQ ID NO: 1494156 - RNA, 14 nt, Human
aauuacaacuaagu

SEQ ID NO: 1494157 - RNA, 16 nt, Human
aauuacaacuaaguga

SEQ ID NO: 1494158 - RNA, 18 nt, Human
aauuacaacggagucaaa

SEQ ID NO: 1494159 - RNA, 14 nt, Human
aauuacgugcucug

SEQ ID NO: 1494160 - RNA, 16 nt, Human
aaugcuguauuuuaaa

SEQ ID NO: 1494161 - RNA, 16 nt, Human
aaugcuucaucccuuu

SEQ ID NO: 1494162 - RNA, 18 nt, Human
uacacuaagagagaauga

SEQ ID NO: 1494163 - RNA, 14 nt, Human
uacacuaagagaga

SEQ ID NO: 1494164 - RNA, 15 nt, Human
aauuaagagagucua

SEQ ID NO: 1494165 - RNA, 21 nt, Human
aauuaagaaaggauaaaguug

SEQ ID NO: 1494166 - RNA, 17 nt, Human
aauuaauuccuucagca

SEQ ID NO: 1494167 - RNA, 20 nt, Human
uacaucccuuaccugggaaa

SEQ ID NO: 1494168 - RNA, 22 nt, Human
aauguauuacaguggggaauga

SEQ ID NO: 1494169 - RNA, 19 nt, Human
aauguauacuauaguacca

SEQ ID NO: 1494170 - RNA, 12 nt, Human
aauccgcccauc

SEQ ID NO: 1494171 - RNA, 19 nt, Human
aaucuuauaauuuaaaaua

SEQ ID NO: 1494172 - RNA, 19 nt, Human
uaaguaaugauaacuggaa

SEQ ID NO: 1494173 - RNA, 16 nt, Human
uaagcuuguauuccuu

SEQ ID NO: 1494174 - RNA, 15 nt, Human
uaagcuuaugcuuaa

SEQ ID NO: 1494175 - RNA, 15 nt, Human
aaucaugaauuaguu

SEQ ID NO: 1494176 - RNA, 12 nt, Human
aaucaugaauua

SEQ ID NO: 1494177 - RNA, 12 nt, Human
uaauaaacacuc

SEQ ID NO: 1494178 - RNA, 18 nt, Human
uaauaaacacucuugaaa

SEQ ID NO: 1494179 - RNA, 12 nt, Human
uaauccaguaaa

SEQ ID NO: 1494180 - RNA, 15 nt, Human
aaucuuuaauuuuac

SEQ ID NO: 1494181 - RNA, 16 nt, Human
aaucuuuaauuuuaca

SEQ ID NO: 1494182 - RNA, 23 nt, Human
uaagcaaaaacaaaaagaaaaga

SEQ ID NO: 1494183 - RNA, 16 nt, Human
uaagcuggagugcagu

SEQ ID NO: 1494184 - RNA, 21 nt, Human
aaucaggguuaguauugucca

SEQ ID NO: 1494185 - RNA, 16 nt, Human
aaucaggguuaguauu

SEQ ID NO: 1494186 - RNA, 22 nt, Human
aaucaggguuaguauuguccag

SEQ ID NO: 1494187 - RNA, 24 nt, Human
aauaugccccauucaacaucuagu

SEQ ID NO: 1494188 - RNA, 21 nt, Human
aauaugccccauucaacaucu

SEQ ID NO: 1494189 - RNA, 14 nt, Human
aauauuucagauaa

SEQ ID NO: 1494190 - RNA, 19 nt, Human
aauauuuauuuuaauaaug

SEQ ID NO: 1494191 - RNA, 18 nt, Human
aauauuuauuuuaauaau

SEQ ID NO: 1494192 - RNA, 12 nt, Human
aauauuuagugu

SEQ ID NO: 1494193 - RNA, 14 nt, Human
aauauauuuuaaga

SEQ ID NO: 1494194 - RNA, 15 nt, Human
aauauauuuuaagac

SEQ ID NO: 1494195 - RNA, 19 nt, Human
aauagucaaauugugugaa

SEQ ID NO: 1494196 - RNA, 16 nt, Human
aauagucaaauugugu

SEQ ID NO: 1494197 - RNA, 14 nt, Human
uaacaugaauauuu

SEQ ID NO: 1494198 - RNA, 22 nt, Human
aauaucacuugucaauaaaauc

SEQ ID NO: 1494199 - RNA, 18 nt, Human
aauauauuuuaagacgaa

SEQ ID NO: 1494200 - RNA, 20 nt, Human
uaacgauaaaagacagugaa

SEQ ID NO: 1494201 - RNA, 15 nt, Human
ucauauuuucaugcu

SEQ ID NO: 1494202 - RNA, 12 nt, Human
accgcagaagga

SEQ ID NO: 1494203 - RNA, 13 nt, Human
accgcagaaggaa

SEQ ID NO: 1494204 - RNA, 14 nt, Human
accgcagaaggaag

SEQ ID NO: 1494205 - RNA, 17 nt, Human
ucaguuuuugugaaaag

SEQ ID NO: 1494206 - RNA, 15 nt, Human
ucaguuuuugugaaa

SEQ ID NO: 1494207 - RNA, 13 nt, Human
ucaucuaggauuu

SEQ ID NO: 1494208 - RNA, 17 nt, Human
ucaugaaagauucaaug

SEQ ID NO: 1494209 - RNA, 16 nt, Human
ucaugaaagauucaau

SEQ ID NO: 1494210 - RNA, 14 nt, Human
ucaugcaaacuuua

SEQ ID NO: 1494211 - RNA, 14 nt, Human
ucaugcauggaaau

SEQ ID NO: 1494212 - RNA, 17 nt, Human
ucaugugaaaucauuca

SEQ ID NO: 1494213 - RNA, 16 nt, Human
ucaugugaaaucauuc

SEQ ID NO: 1494214 - RNA, 23 nt, Human
ucaugcaaacuuuauuuuguguu

SEQ ID NO: 1494215 - RNA, 15 nt, Human
accgcagaaggaagg

SEQ ID NO: 1494216 - RNA, 16 nt, Human
accuagggugauauua

SEQ ID NO: 1494217 - RNA, 16 nt, Human
accuauuuccagaaau

SEQ ID NO: 1494218 - RNA, 17 nt, Human
accuauuuccagaaaua

SEQ ID NO: 1494219 - RNA, 19 nt, Human
accuauuuccagaaauaca

SEQ ID NO: 1494220 - RNA, 15 nt, Human
acccucguggacacc

SEQ ID NO: 1494221 - RNA, 17 nt, Human
acccucguggacaccug

SEQ ID NO: 1494222 - RNA, 18 nt, Human
acccucguggacaccugc

SEQ ID NO: 1494223 - RNA, 19 nt, Human
acccucguggacaccugcc

SEQ ID NO: 1494224 - RNA, 20 nt, Human
acccucguggacaccugccc

SEQ ID NO: 1494225 - RNA, 22 nt, Human
acccucguggacaccugcccug

SEQ ID NO: 1494226 - RNA, 23 nt, Human
acccucguggacaccugcccugc

SEQ ID NO: 1494227 - RNA, 16 nt, Human
ucagauuucugaggaa

SEQ ID NO: 1494228 - RNA, 15 nt, Human
ucaauauucaauaaa

SEQ ID NO: 1494229 - RNA, 16 nt, Human
ucaauauucaauaaag

SEQ ID NO: 1494230 - RNA, 17 nt, Human
ucaauauucaauaaagc

SEQ ID NO: 1494231 - RNA, 19 nt, Human
ucaauauuucagauaauca

SEQ ID NO: 1494232 - RNA, 15 nt, Human
ucaauauuucagaua

SEQ ID NO: 1494233 - RNA, 20 nt, Human
acaugaauauuuaguguuca

SEQ ID NO: 1494234 - RNA, 13 nt, Human
acaugcuucccuu

SEQ ID NO: 1494235 - RNA, 16 nt, Human
acaugcuucccuuucc

SEQ ID NO: 1494236 - RNA, 18 nt, Human
acaugcuucccuuuccug

SEQ ID NO: 1494237 - RNA, 19 nt, Human
acaugcuucccuuuccuga

SEQ ID NO: 1494238 - RNA, 14 nt, Human
acaugggacauuug

SEQ ID NO: 1494239 - RNA, 11 nt, Human
acaugggacau

SEQ ID NO: 1494240 - RNA, 21 nt, Human
acaugggacauuugcucaugg

SEQ ID NO: 1494241 - RNA, 20 nt, Human
acaugggacauuugcucaug

SEQ ID NO: 1494242 - RNA, 15 nt, Human
acaugggacauuugc

SEQ ID NO: 1494243 - RNA, 13 nt, Human
acauuccauccuu

SEQ ID NO: 1494244 - RNA, 15 nt, Human
acauuccugaacagg

SEQ ID NO: 1494245 - RNA, 14 nt, Human
acauuccugaacag

SEQ ID NO: 1494246 - RNA, 18 nt, Human
ucaaauugugugaaaggu

SEQ ID NO: 1494247 - RNA, 20 nt, Human
accaguaggggcuuauaaua

SEQ ID NO: 1494248 - RNA, 14 nt, Human
accagucugacugu

SEQ ID NO: 1494249 - RNA, 14 nt, Human
ucaccucauggaau

SEQ ID NO: 1494250 - RNA, 13 nt, Human
ucaccucauggaa

SEQ ID NO: 1494251 - RNA, 12 nt, Human
ucaccucaugga

SEQ ID NO: 1494252 - RNA, 21 nt, Human
ucacguuuggugcuucucaga

SEQ ID NO: 1494253 - RNA, 17 nt, Human
ucacguuuggugcuucu

SEQ ID NO: 1494254 - RNA, 24 nt, Human
accacauuggagauguuuaguaau

SEQ ID NO: 1494255 - RNA, 16 nt, Human
accaccacgccuggcu

SEQ ID NO: 1494256 - RNA, 16 nt, Human
ucaauucuugccaaau

SEQ ID NO: 1494257 - RNA, 11 nt, Human
ucacacuggga

SEQ ID NO: 1494258 - RNA, 22 nt, Human
acuauauuguuugcuaagcauu

SEQ ID NO: 1494259 - RNA, 22 nt, Human
acuauaggcaugcgccaccaug

SEQ ID NO: 1494260 - RNA, 17 nt, Human
acuauauuguuugcuaa

SEQ ID NO: 1494261 - RNA, 20 nt, Human
acuauaggcaugcgccacca

SEQ ID NO: 1494262 - RNA, 15 nt, Human
acuaucucauuucca

SEQ ID NO: 1494263 - RNA, 17 nt, Human
acuaucucauuuccaag

SEQ ID NO: 1494264 - RNA, 16 nt, Human
acuaucucauuuccaa

SEQ ID NO: 1494265 - RNA, 15 nt, Human
acuaauuuuaaaaug

SEQ ID NO: 1494266 - RNA, 13 nt, Human
acuacacccagca

SEQ ID NO: 1494267 - RNA, 14 nt, Human
acuacacccagcaa

SEQ ID NO: 1494268 - RNA, 16 nt, Human
acuacacccagcaaua

SEQ ID NO: 1494269 - RNA, 15 nt, Human
acuacacccagcaau

SEQ ID NO: 1494270 - RNA, 21 nt, Human
acggagucucacucugucacc

SEQ ID NO: 1494271 - RNA, 23 nt, Human
acgcgccucgccggaucugaggg

SEQ ID NO: 1494272 - RNA, 23 nt, Human
uccagugggaggugagaccaccu

SEQ ID NO: 1494273 - RNA, 16 nt, Human
uccacucguguguuuc

SEQ ID NO: 1494274 - RNA, 18 nt, Human
uccacucguguguuucua

SEQ ID NO: 1494275 - RNA, 20 nt, Human
accuuuuggucuggagggaa

SEQ ID NO: 1494276 - RNA, 14 nt, Human
uccacucguguguu

SEQ ID NO: 1494277 - RNA, 15 nt, Human
uccacucguguguuu

SEQ ID NO: 1494278 - RNA, 12 nt, Human
ucauuccuccag

SEQ ID NO: 1494279 - RNA, 13 nt, Human
ucauuccuccagg

SEQ ID NO: 1494280 - RNA, 14 nt, Human
ucauuccuccaggu

SEQ ID NO: 1494281 - RNA, 19 nt, Human
ucauuccauucuggaagug

SEQ ID NO: 1494282 - RNA, 17 nt, Human
accuuugacaaagguaa

SEQ ID NO: 1494283 - RNA, 18 nt, Human
accuuugacaaagguaaa

SEQ ID NO: 1494284 - RNA, 22 nt, Human
accuuuguuugcaucugaaaau

SEQ ID NO: 1494285 - RNA, 14 nt, Human
uccagccucagcuc

SEQ ID NO: 1494286 - RNA, 20 nt, Human
uccagccugcugccugcuuu

SEQ ID NO: 1494287 - RNA, 20 nt, Human
uccucccacuucagccuccc

SEQ ID NO: 1494288 - RNA, 19 nt, Human
acucuuauaucuauauuuu

SEQ ID NO: 1494289 - RNA, 22 nt, Human
acucuuauaucuauauuuuaca

SEQ ID NO: 1494290 - RNA, 18 nt, Human
acucuuauaucuauauuu

SEQ ID NO: 1494291 - RNA, 17 nt, Human
acucuuauaucuauauu

SEQ ID NO: 1494292 - RNA, 16 nt, Human
acucuuauaucuauau

SEQ ID NO: 1494293 - RNA, 21 nt, Human
acucuuaagaagacugcauua

SEQ ID NO: 1494294 - RNA, 16 nt, Human
ucccuuuuuuuaagua

SEQ ID NO: 1494295 - RNA, 21 nt, Human
ucccuuuuuuuaaguaaggaa

SEQ ID NO: 1494296 - RNA, 13 nt, Human
ucccuuuuuuuaa

SEQ ID NO: 1494297 - RNA, 15 nt, Human
acucuuguuuccuua

SEQ ID NO: 1494298 - RNA, 16 nt, Human
acugaacuuugcugag

SEQ ID NO: 1494299 - RNA, 19 nt, Human
acugaacuuugcugagccu

SEQ ID NO: 1494300 - RNA, 12 nt, Human
acugagaaauuu

SEQ ID NO: 1494301 - RNA, 17 nt, Human
acugagaaauuuauaaa

SEQ ID NO: 1494302 - RNA, 21 nt, Human
acugagaaauuuauaaacuuu

SEQ ID NO: 1494303 - RNA, 20 nt, Human
acugacucuuaagaagacug

SEQ ID NO: 1494304 - RNA, 18 nt, Human
acugacucuuaagaagac

SEQ ID NO: 1494305 - RNA, 17 nt, Human
acugacucuuaagaaga

SEQ ID NO: 1494306 - RNA, 16 nt, Human
acugacucuuaagaag

SEQ ID NO: 1494307 - RNA, 15 nt, Human
acugacucuuaagaa

SEQ ID NO: 1494308 - RNA, 14 nt, Human
acugacucuuaaga

SEQ ID NO: 1494309 - RNA, 13 nt, Human
acugacucuuaag

SEQ ID NO: 1494310 - RNA, 12 nt, Human
acugaagaagca

SEQ ID NO: 1494311 - RNA, 21 nt, Human
acugaacuuugcugagccugu

SEQ ID NO: 1494312 - RNA, 15 nt, Human
uccugggagcuuuug

SEQ ID NO: 1494313 - RNA, 16 nt, Human
uccuggaaaucagggu

SEQ ID NO: 1494314 - RNA, 22 nt, Human
uccuggaauaucuccgucaacu

SEQ ID NO: 1494315 - RNA, 23 nt, Human
uccuggaagugcuaauuuugaaa

SEQ ID NO: 1494316 - RNA, 15 nt, Human
ucucauuuccaagca

SEQ ID NO: 1494317 - RNA, 23 nt, Human
acuugcaaaaagggucaguaugg

SEQ ID NO: 1494318 - RNA, 17 nt, Human
acuugcaaaaaggguca

SEQ ID NO: 1494319 - RNA, 16 nt, Human
acuugcucuugaugcc

SEQ ID NO: 1494320 - RNA, 17 nt, Human
acuugcucuugaugccu

SEQ ID NO: 1494321 - RNA, 18 nt, Human
acuugcucuugaugccug

SEQ ID NO: 1494322 - RNA, 20 nt, Human
acuugcucuugaugccuggc

SEQ ID NO: 1494323 - RNA, 15 nt, Human
acuugucaauaaaau

SEQ ID NO: 1494324 - RNA, 18 nt, Human
acuuguauuauguguguu

SEQ ID NO: 1494325 - RNA, 19 nt, Human
acuuguauuauguguguuu

SEQ ID NO: 1494326 - RNA, 14 nt, Human
acuugcuuuuaaaa

SEQ ID NO: 1494327 - RNA, 13 nt, Human
acuuuggcugcau

SEQ ID NO: 1494328 - RNA, 22 nt, Human
acuuuuuauggcacuaguauuu

SEQ ID NO: 1494329 - RNA, 13 nt, Human
acuuaaauuuuag

SEQ ID NO: 1494330 - RNA, 14 nt, Human
ucuauaccaauaaa

SEQ ID NO: 1494331 - RNA, 15 nt, Human
ucuauaccaauaaag

SEQ ID NO: 1494332 - RNA, 16 nt, Human
ucuauaccaauaaagu

SEQ ID NO: 1494333 - RNA, 17 nt, Human
ucuauaccaauaaagug

SEQ ID NO: 1494334 - RNA, 18 nt, Human
ucuauaccaauaaaguga

SEQ ID NO: 1494335 - RNA, 15 nt, Human
ucuauacccacccag

SEQ ID NO: 1494336 - RNA, 17 nt, Human
ucuauacccacccagaa

SEQ ID NO: 1494337 - RNA, 16 nt, Human
ucuauacccacccaga

SEQ ID NO: 1494338 - RNA, 13 nt, Human
ucuauaaaccgaa

SEQ ID NO: 1494339 - RNA, 16 nt, Human
ucuaggaaauauuuau

SEQ ID NO: 1494340 - RNA, 17 nt, Human
ucuaggaaauauuuauu

SEQ ID NO: 1494341 - RNA, 10 nt, Human
ucugaauuau

SEQ ID NO: 1494342 - RNA, 15 nt, Human
ucugaauuauuuucu

SEQ ID NO: 1494343 - RNA, 11 nt, Human
ucugcaggucc

SEQ ID NO: 1494344 - RNA, 12 nt, Human
ucugcagguccc

SEQ ID NO: 1494345 - RNA, 13 nt, Human
ucugcaggucccu

SEQ ID NO: 1494346 - RNA, 14 nt, Human
ucugcaggucccua

SEQ ID NO: 1494347 - RNA, 14 nt, Human
agaagaacugaaau

SEQ ID NO: 1494348 - RNA, 13 nt, Human
agaagaacugaaa

SEQ ID NO: 1494349 - RNA, 18 nt, Human
agaagaugguaccaccag

SEQ ID NO: 1494350 - RNA, 12 nt, Human
agaagacaaaau

SEQ ID NO: 1494351 - RNA, 15 nt, Human
agacacacaugaagu

SEQ ID NO: 1494352 - RNA, 12 nt, Human
agacacacauga

SEQ ID NO: 1494353 - RNA, 21 nt, Human
agaauuugauaugugaacagu

SEQ ID NO: 1494354 - RNA, 22 nt, Human
agaauuugauaugugaacaguu

SEQ ID NO: 1494355 - RNA, 12 nt, Human
agaauaugccuu

SEQ ID NO: 1494356 - RNA, 12 nt, Human
agaauaaaauuu

SEQ ID NO: 1494357 - RNA, 14 nt, Human
agaauaaaauuuuu

SEQ ID NO: 1494358 - RNA, 17 nt, Human
agaauaaaauuuuuaau

SEQ ID NO: 1494359 - RNA, 20 nt, Human
ugaagauuuaccacuugugu

SEQ ID NO: 1494360 - RNA, 17 nt, Human
ugaagauuuaccacuug

SEQ ID NO: 1494361 - RNA, 23 nt, Human
ugaauaauguaagacaaauaugu

SEQ ID NO: 1494362 - RNA, 15 nt, Human
ugaauacauuuccaa

SEQ ID NO: 1494363 - RNA, 23 nt, Human
agaggccaggcaggagcccuucu

SEQ ID NO: 1494364 - RNA, 18 nt, Human
agaguaauccaagcaaau

SEQ ID NO: 1494365 - RNA, 20 nt, Human
agaguaauccaagcaaaugu

SEQ ID NO: 1494366 - RNA, 22 nt, Human
agaguaauccaagcaaauguga

SEQ ID NO: 1494367 - RNA, 12 nt, Human
ugaaccaccgcg

SEQ ID NO: 1494368 - RNA, 23 nt, Human
ugaacuagaguuuagcuggaaaa

SEQ ID NO: 1494369 - RNA, 23 nt, Human
ugaaauaaacgucuuaaauauuc

SEQ ID NO: 1494370 - RNA, 22 nt, Human
ugaaauaaacgucuuaaauauu

SEQ ID NO: 1494371 - RNA, 18 nt, Human
ugaaauaaacgucuuaaa

SEQ ID NO: 1494372 - RNA, 13 nt, Human
ugaaauaaacguc

SEQ ID NO: 1494373 - RNA, 21 nt, Human
ugaaauuuccugggagcuuuu

SEQ ID NO: 1494374 - RNA, 15 nt, Human
ugaaauuuccuggga

SEQ ID NO: 1494375 - RNA, 13 nt, Human
ugaaagaaaauaa

SEQ ID NO: 1494376 - RNA, 14 nt, Human
ugaaaauuaacaug

SEQ ID NO: 1494377 - RNA, 12 nt, Human
agacuuuuauga

SEQ ID NO: 1494378 - RNA, 15 nt, Human
agacuuuuaugauac

SEQ ID NO: 1494379 - RNA, 16 nt, Human
ucuuuguaaugaaaac

SEQ ID NO: 1494380 - RNA, 16 nt, Human
agagacacacugaaga

SEQ ID NO: 1494381 - RNA, 21 nt, Human
ucuuuuuucuaaaguaaaaac

SEQ ID NO: 1494382 - RNA, 22 nt, Human
ucuuuuuucuaaaguaaaaaca

SEQ ID NO: 1494383 - RNA, 16 nt, Human
ucuuuuuucaaaagaa

SEQ ID NO: 1494384 - RNA, 17 nt, Human
ucuuuuuucaaaagaaa

SEQ ID NO: 1494385 - RNA, 13 nt, Human
ugacuauguaaac

SEQ ID NO: 1494386 - RNA, 12 nt, Human
ugacuauguaaa

SEQ ID NO: 1494387 - RNA, 17 nt, Human
ugaccugccucccuuca

SEQ ID NO: 1494388 - RNA, 19 nt, Human
ugaccugccucccuucaug

SEQ ID NO: 1494389 - RNA, 23 nt, Human
ugaccugccucccuucaugcaug

SEQ ID NO: 1494390 - RNA, 21 nt, Human
ugaccugccucccuucaugca

SEQ ID NO: 1494391 - RNA, 22 nt, Human
agauguauguacuucaugcugu

SEQ ID NO: 1494392 - RNA, 16 nt, Human
ugaccugccucccuuc

SEQ ID NO: 1494393 - RNA, 13 nt, Human
ugacuuauaguac

SEQ ID NO: 1494394 - RNA, 14 nt, Human
ugacuuauaguaca

SEQ ID NO: 1494395 - RNA, 15 nt, Human
ugacuuauaguacau

SEQ ID NO: 1494396 - RNA, 17 nt, Human
ugacuuauaguacauga

SEQ ID NO: 1494397 - RNA, 19 nt, Human
ugacuuauaguacaugaua

SEQ ID NO: 1494398 - RNA, 14 nt, Human
agauccuggaaauc

SEQ ID NO: 1494399 - RNA, 13 nt, Human
agauccuggaaau

SEQ ID NO: 1494400 - RNA, 13 nt, Human
agaucccccagaa

SEQ ID NO: 1494401 - RNA, 19 nt, Human
agaucccccagaaaagaaa

SEQ ID NO: 1494402 - RNA, 15 nt, Human
agaucccccagaaaa

SEQ ID NO: 1494403 - RNA, 22 nt, Human
agauguagccccucuccuggaa

SEQ ID NO: 1494404 - RNA, 21 nt, Human
agaugcaguucugaagaagau

SEQ ID NO: 1494405 - RNA, 18 nt, Human
agcaaguaaaaaggcuaa

SEQ ID NO: 1494406 - RNA, 13 nt, Human
agcaaguaaaaag

SEQ ID NO: 1494407 - RNA, 15 nt, Human
agcaagucagaauag

SEQ ID NO: 1494408 - RNA, 16 nt, Human
agauuuuccugaaaac

SEQ ID NO: 1494409 - RNA, 15 nt, Human
agauuuuccugaaaa

SEQ ID NO: 1494410 - RNA, 20 nt, Human
ugagagacacacugaagaag

SEQ ID NO: 1494411 - RNA, 19 nt, Human
ugagagacacacugaagaa

SEQ ID NO: 1494412 - RNA, 17 nt, Human
ugagagacacacugaag

SEQ ID NO: 1494413 - RNA, 16 nt, Human
ugagagacacacugaa

SEQ ID NO: 1494414 - RNA, 19 nt, Human
ugagacagaaucucagucu

SEQ ID NO: 1494415 - RNA, 23 nt, Human
ugagauguagccccucuccugga

SEQ ID NO: 1494416 - RNA, 14 nt, Human
ugagauguguucac

SEQ ID NO: 1494417 - RNA, 22 nt, Human
ugagagacacacugaagaagca

SEQ ID NO: 1494418 - RNA, 21 nt, Human
ugagagacacacugaagaagc

SEQ ID NO: 1494419 - RNA, 11 nt, Human
aggaauuuaaa

SEQ ID NO: 1494420 - RNA, 18 nt, Human
aggaaggaggacccagga

SEQ ID NO: 1494421 - RNA, 21 nt, Human
aggaaggaggacccaggacag

SEQ ID NO: 1494422 - RNA, 23 nt, Human
aggaauuguguuuauaauuuuaa

SEQ ID NO: 1494423 - RNA, 19 nt, Human
aggaaggaggacccaggac

SEQ ID NO: 1494424 - RNA, 20 nt, Human
aggaaggaggacccaggaca

SEQ ID NO: 1494425 - RNA, 15 nt, Human
agcuggagugcagug

SEQ ID NO: 1494426 - RNA, 19 nt, Human
agcuggagugcaguggcau

SEQ ID NO: 1494427 - RNA, 14 nt, Human
aggacaggauccag

SEQ ID NO: 1494428 - RNA, 20 nt, Human
aggacaggauccaggccggc

SEQ ID NO: 1494429 - RNA, 17 nt, Human
aggacacugauaugggu

SEQ ID NO: 1494430 - RNA, 12 nt, Human
aggacaucagca

SEQ ID NO: 1494431 - RNA, 13 nt, Human
aggacaucagcaa

SEQ ID NO: 1494432 - RNA, 14 nt, Human
aggacaucagcaaa

SEQ ID NO: 1494433 - RNA, 15 nt, Human
aggacaucagcaaac

SEQ ID NO: 1494434 - RNA, 16 nt, Human
aggacaucagcaaaca

SEQ ID NO: 1494435 - RNA, 22 nt, Human
aggacaucagcaaacaggauca

SEQ ID NO: 1494436 - RNA, 14 nt, Human
aggacacugauaug

SEQ ID NO: 1494437 - RNA, 14 nt, Human
ugcuucaucccuuu

SEQ ID NO: 1494438 - RNA, 20 nt, Human
aggaauuuuauuuuuuucug

SEQ ID NO: 1494439 - RNA, 12 nt, Human
ugcuuuguauug

SEQ ID NO: 1494440 - RNA, 14 nt, Human
ugcuuuucauccuu

SEQ ID NO: 1494441 - RNA, 13 nt, Human
uggaaaggcagcu

SEQ ID NO: 1494442 - RNA, 19 nt, Human
aggagcccugggaggcucu

SEQ ID NO: 1494443 - RNA, 23 nt, Human
aggagcccugggaggcucuggag

SEQ ID NO: 1494444 - RNA, 18 nt, Human
aggagcccugggaggcuc

SEQ ID NO: 1494445 - RNA, 20 nt, Human
aggacugaauuaugaaacuu

SEQ ID NO: 1494446 - RNA, 19 nt, Human
aggacugaauuaugaaacu

SEQ ID NO: 1494447 - RNA, 17 nt, Human
uggaaauucccuucauc

SEQ ID NO: 1494448 - RNA, 22 nt, Human
uggaaauucccuucaucuggaa

SEQ ID NO: 1494449 - RNA, 18 nt, Human
uggaaauucccuucaucu

SEQ ID NO: 1494450 - RNA, 14 nt, Human
aggaggcagagaag

SEQ ID NO: 1494451 - RNA, 18 nt, Human
uggaauuggagcucgugg

SEQ ID NO: 1494452 - RNA, 20 nt, Human
uggccaggcuugucucgaac

SEQ ID NO: 1494453 - RNA, 20 nt, Human
uggccagucuggucucgaac

SEQ ID NO: 1494454 - RNA, 16 nt, Human
aggccagaccauggac

SEQ ID NO: 1494455 - RNA, 17 nt, Human
aggccagaccauggaca

SEQ ID NO: 1494456 - RNA, 18 nt, Human
aggccagaccauggacac

SEQ ID NO: 1494457 - RNA, 18 nt, Human
uggacgagaaaacaauaa

SEQ ID NO: 1494458 - RNA, 17 nt, Human
aggccugguguuucuug

SEQ ID NO: 1494459 - RNA, 13 nt, Human
aggcucuggagcc

SEQ ID NO: 1494460 - RNA, 14 nt, Human
aggcucuggagccc

SEQ ID NO: 1494461 - RNA, 15 nt, Human
aggcucuggagccca

SEQ ID NO: 1494462 - RNA, 18 nt, Human
aggcucuggagcccacug

SEQ ID NO: 1494463 - RNA, 19 nt, Human
aggcucuggagcccacugu

SEQ ID NO: 1494464 - RNA, 22 nt, Human
aggcugggaauggaggggcaga

SEQ ID NO: 1494465 - RNA, 12 nt, Human
uggcugcaugcg

SEQ ID NO: 1494466 - RNA, 18 nt, Human
ugauuaaguaaugauaac

SEQ ID NO: 1494467 - RNA, 23 nt, Human
ugauuaaguaaugauaacuggaa

SEQ ID NO: 1494468 - RNA, 12 nt, Human
ugaugaagaagu

SEQ ID NO: 1494469 - RNA, 11 nt, Human
ugaugaagaag

SEQ ID NO: 1494470 - RNA, 12 nt, Human
ugauggagaagg

SEQ ID NO: 1494471 - RNA, 13 nt, Human
ugauggagaagga

SEQ ID NO: 1494472 - RNA, 14 nt, Human
ugauggagaaggaa

SEQ ID NO: 1494473 - RNA, 15 nt, Human
ugauggagaaggaag

SEQ ID NO: 1494474 - RNA, 16 nt, Human
ugauggagaaggaagg

SEQ ID NO: 1494475 - RNA, 14 nt, Human
ugaugggauuuggu

SEQ ID NO: 1494476 - RNA, 17 nt, Human
ugauggagaaggaaggc

SEQ ID NO: 1494477 - RNA, 14 nt, Human
agcccacuguacuu

SEQ ID NO: 1494478 - RNA, 16 nt, Human
agcccacuguacuugc

SEQ ID NO: 1494479 - RNA, 20 nt, Human
agcccugcugcugccugccu

SEQ ID NO: 1494480 - RNA, 18 nt, Human
agcccugcugcugccugc

SEQ ID NO: 1494481 - RNA, 19 nt, Human
agcccugcugcugccugcc

SEQ ID NO: 1494482 - RNA, 14 nt, Human
agcccauucauucc

SEQ ID NO: 1494483 - RNA, 17 nt, Human
agcccauucauuccauu

SEQ ID NO: 1494484 - RNA, 22 nt, Human
agcccauucauuccauucugga

SEQ ID NO: 1494485 - RNA, 23 nt, Human
agcccauucauuccauucuggaa

SEQ ID NO: 1494486 - RNA, 23 nt, Human
agccucagcucucaguugcagcc

SEQ ID NO: 1494487 - RNA, 16 nt, Human
ugccccauucaacauc

SEQ ID NO: 1494488 - RNA, 17 nt, Human
agcuaucguaaaauuaa

SEQ ID NO: 1494489 - RNA, 18 nt, Human
agcuccaagaauuucuag

SEQ ID NO: 1494490 - RNA, 15 nt, Human
agcuccaagaauuuc

SEQ ID NO: 1494491 - RNA, 13 nt, Human
ugcauuuauaugu

SEQ ID NO: 1494492 - RNA, 14 nt, Human
ugcauuuauaugua

SEQ ID NO: 1494493 - RNA, 16 nt, Human
ugcauuuauauguacc

SEQ ID NO: 1494494 - RNA, 14 nt, Human
ugcccugccaccug

SEQ ID NO: 1494495 - RNA, 15 nt, Human
ugcccugccaccugu

SEQ ID NO: 1494496 - RNA, 16 nt, Human
ugcccugccaccuguc

SEQ ID NO: 1494497 - RNA, 17 nt, Human
ugcccugccaccugucu

SEQ ID NO: 1494498 - RNA, 19 nt, Human
ugcccugccaccugucugu

SEQ ID NO: 1494499 - RNA, 20 nt, Human
ugcccugccaccugucuguc

SEQ ID NO: 1494500 - RNA, 21 nt, Human
ugcccugccaccugucugucu

SEQ ID NO: 1494501 - RNA, 22 nt, Human
ugcccugccaccugucugucug

SEQ ID NO: 1494502 - RNA, 18 nt, Human
ugccucagaaaacaagga

SEQ ID NO: 1494503 - RNA, 11 nt, Human
ugccucucugc

SEQ ID NO: 1494504 - RNA, 12 nt, Human
ugccucucugca

SEQ ID NO: 1494505 - RNA, 15 nt, Human
ugccucucugcaggu

SEQ ID NO: 1494506 - RNA, 23 nt, Human
ugccucucugcaggucccuaaua

SEQ ID NO: 1494507 - RNA, 13 nt, Human
agcuggaaaagua

SEQ ID NO: 1494508 - RNA, 18 nt, Human
agcuggagaugaggccag

SEQ ID NO: 1494509 - RNA, 14 nt, Human
agcuggagugcagu

SEQ ID NO: 1494510 - RNA, 19 nt, Human
agcuggagaugaggccaga

SEQ ID NO: 1494511 - RNA, 20 nt, Human
agcuggagaugaggccagac

SEQ ID NO: 1494512 - RNA, 21 nt, Human
agcuggagaugaggccagacc

SEQ ID NO: 1494513 - RNA, 22 nt, Human
agcuggagaugaggccagacca

SEQ ID NO: 1494514 - RNA, 23 nt, Human
agcuggagaugaggccagaccau

SEQ ID NO: 1494515 - RNA, 18 nt, Human
agucccaucccugcguga

SEQ ID NO: 1494516 - RNA, 21 nt, Human
agucagucauucagauaugau

SEQ ID NO: 1494517 - RNA, 15 nt, Human
agucagucauucaga

SEQ ID NO: 1494518 - RNA, 21 nt, Human
aguauguuagugcaaauuguc

SEQ ID NO: 1494519 - RNA, 18 nt, Human
aguauguuagugcaaauu

SEQ ID NO: 1494520 - RNA, 18 nt, Human
agucacauuccugaacag

SEQ ID NO: 1494521 - RNA, 16 nt, Human
aguauuguccaggucu

SEQ ID NO: 1494522 - RNA, 15 nt, Human
aguauuguccagguc

SEQ ID NO: 1494523 - RNA, 21 nt, Human
aguauuuaauucauguugccu

SEQ ID NO: 1494524 - RNA, 11 nt, Human
uguauuaugug

SEQ ID NO: 1494525 - RNA, 21 nt, Human
aguagcguuuuuuaaauguau

SEQ ID NO: 1494526 - RNA, 22 nt, Human
aguagcguuuuuuaaauguaua

SEQ ID NO: 1494527 - RNA, 20 nt, Human
aguagcguuuuuuaaaugua

SEQ ID NO: 1494528 - RNA, 23 nt, Human
agguuuggacaaaauggaauacu

SEQ ID NO: 1494529 - RNA, 22 nt, Human
ugugaacaguuguguuugaagc

SEQ ID NO: 1494530 - RNA, 22 nt, Human
ugucucuggauuauauuaugaa

SEQ ID NO: 1494531 - RNA, 14 nt, Human
ugugaagcaaaauu

SEQ ID NO: 1494532 - RNA, 16 nt, Human
agucucugaggggcua

SEQ ID NO: 1494533 - RNA, 22 nt, Human
agucucugaggggcuaccagga

SEQ ID NO: 1494534 - RNA, 23 nt, Human
agucucugaggggcuaccaggaa

SEQ ID NO: 1494535 - RNA, 19 nt, Human
agucuccaaagucucugga

SEQ ID NO: 1494536 - RNA, 18 nt, Human
agucuuacucuguugcca

SEQ ID NO: 1494537 - RNA, 20 nt, Human
agugaaacucguuaauuugu

SEQ ID NO: 1494538 - RNA, 21 nt, Human
agugagcagucaggaaagaga

SEQ ID NO: 1494539 - RNA, 18 nt, Human
uguaagaaaauaucacuu

SEQ ID NO: 1494540 - RNA, 15 nt, Human
uguaaggcaaucaug

SEQ ID NO: 1494541 - RNA, 21 nt, Human
uguagaagucacauuccugaa

SEQ ID NO: 1494542 - RNA, 15 nt, Human
uguacuugcucuuga

SEQ ID NO: 1494543 - RNA, 19 nt, Human
uguacuugcucuugaugcc

SEQ ID NO: 1494544 - RNA, 16 nt, Human
uguaaaggaauuuaaa

SEQ ID NO: 1494545 - RNA, 18 nt, Human
ugguuuuaguugcaacuu

SEQ ID NO: 1494546 - RNA, 15 nt, Human
aggucagugcaaaua

SEQ ID NO: 1494547 - RNA, 22 nt, Human
ugguccaugggccauaugaaaa

SEQ ID NO: 1494548 - RNA, 19 nt, Human
uggucacguuuggugcuuc

SEQ ID NO: 1494549 - RNA, 21 nt, Human
aggggcuuauaauaaaggacu

SEQ ID NO: 1494550 - RNA, 14 nt, Human
auaaugaauacuuu

SEQ ID NO: 1494551 - RNA, 21 nt, Human
auaaucuuucacaggggacag

SEQ ID NO: 1494552 - RNA, 17 nt, Human
auaauccaguaaaauaa

SEQ ID NO: 1494553 - RNA, 22 nt, Human
uuagaugcaguucugaagaaga

SEQ ID NO: 1494554 - RNA, 23 nt, Human
uuagaugcaguucugaagaagau

SEQ ID NO: 1494555 - RNA, 12 nt, Human
uuaccugggaaa

SEQ ID NO: 1494556 - RNA, 20 nt, Human
auaagcaaaaacaaaaagaa

SEQ ID NO: 1494557 - RNA, 12 nt, Human
auaacuggaaac

SEQ ID NO: 1494558 - RNA, 13 nt, Human
auaaauaaaguuu

SEQ ID NO: 1494559 - RNA, 19 nt, Human
auaaauaaaguuuguugaa

SEQ ID NO: 1494560 - RNA, 18 nt, Human
auaaagugacccugcucu

SEQ ID NO: 1494561 - RNA, 20 nt, Human
auaaagugacccugcucuca

SEQ ID NO: 1494562 - RNA, 18 nt, Human
auaaacgucuuaaauauu

SEQ ID NO: 1494563 - RNA, 16 nt, Human
auaaacgucuuaaaua

SEQ ID NO: 1494564 - RNA, 15 nt, Human
auaaacgucuuaaau

SEQ ID NO: 1494565 - RNA, 16 nt, Human
auaaaccgaacugaug

SEQ ID NO: 1494566 - RNA, 23 nt, Human
auaaacacucuugaaaaaugcau

SEQ ID NO: 1494567 - RNA, 22 nt, Human
auaauuuuuauauuugaaauau

SEQ ID NO: 1494568 - RNA, 21 nt, Human
auaauuuuuauauuugaaaua

SEQ ID NO: 1494569 - RNA, 19 nt, Human
auaauuuuuauauuugaaa

SEQ ID NO: 1494570 - RNA, 16 nt, Human
auaauuuuuauauuug

SEQ ID NO: 1494571 - RNA, 14 nt, Human
auaauuuuuauauu

SEQ ID NO: 1494572 - RNA, 20 nt, Human
auaauuuugugaagcaaaau

SEQ ID NO: 1494573 - RNA, 15 nt, Human
auaauuuugugaagc

SEQ ID NO: 1494574 - RNA, 14 nt, Human
auaauuuugugaag

SEQ ID NO: 1494575 - RNA, 13 nt, Human
auaauuuugugaa

SEQ ID NO: 1494576 - RNA, 22 nt, Human
uuauauauauuuuuuucugaaa

SEQ ID NO: 1494577 - RNA, 18 nt, Human
uuauauaagcuuguauuc

SEQ ID NO: 1494578 - RNA, 13 nt, Human
uuauaguacauga

SEQ ID NO: 1494579 - RNA, 16 nt, Human
uuauaguacaugauaa

SEQ ID NO: 1494580 - RNA, 17 nt, Human
uuauaguacaugauaaa

SEQ ID NO: 1494581 - RNA, 21 nt, Human
auacaguucggugagcuacaa

SEQ ID NO: 1494582 - RNA, 12 nt, Human
auaccaauaaag

SEQ ID NO: 1494583 - RNA, 13 nt, Human
auaccaauaaagu

SEQ ID NO: 1494584 - RNA, 20 nt, Human
auacauuguauauaugugua

SEQ ID NO: 1494585 - RNA, 20 nt, Human
auacaucccuuaccugggaa

SEQ ID NO: 1494586 - RNA, 22 nt, Human
auaccacaggaaccacaagacu

SEQ ID NO: 1494587 - RNA, 14 nt, Human
auaccaauaaagug

SEQ ID NO: 1494588 - RNA, 15 nt, Human
auaccaauaaaguga

SEQ ID NO: 1494589 - RNA, 21 nt, Human
auaccaauaaagugacccugc

SEQ ID NO: 1494590 - RNA, 17 nt, Human
uuaucaugugaaaucau

SEQ ID NO: 1494591 - RNA, 18 nt, Human
uuaucaugugaaaucauu

SEQ ID NO: 1494592 - RNA, 20 nt, Human
uuaucaugugaaaucauuca

SEQ ID NO: 1494593 - RNA, 22 nt, Human
uuaucaugugaaaucauucauu

SEQ ID NO: 1494594 - RNA, 18 nt, Human
uuaaaaaagaaacauuug

SEQ ID NO: 1494595 - RNA, 15 nt, Human
uuaaaaaagaaacau

SEQ ID NO: 1494596 - RNA, 19 nt, Human
uuaaaaaagaaacauuugg

SEQ ID NO: 1494597 - RNA, 15 nt, Human
aguuucguuuucaaa

SEQ ID NO: 1494598 - RNA, 16 nt, Human
aguuucguuuucaaaa

SEQ ID NO: 1494599 - RNA, 16 nt, Human
aguucugaagaagaug

SEQ ID NO: 1494600 - RNA, 15 nt, Human
aguucugaagaagau

SEQ ID NO: 1494601 - RNA, 14 nt, Human
aguucugaagaaga

SEQ ID NO: 1494602 - RNA, 13 nt, Human
aguucugaagaag

SEQ ID NO: 1494603 - RNA, 21 nt, Human
aguugauaugccuuuucccaa

SEQ ID NO: 1494604 - RNA, 19 nt, Human
aguugcaacuuuguauaaa

SEQ ID NO: 1494605 - RNA, 15 nt, Human
uguuugcaucugaaa

SEQ ID NO: 1494606 - RNA, 15 nt, Human
uguuugcuaagcauu

SEQ ID NO: 1494607 - RNA, 13 nt, Human
uguuuuacaauag

SEQ ID NO: 1494608 - RNA, 17 nt, Human
uguuuuacaauaguucu

SEQ ID NO: 1494609 - RNA, 22 nt, Human
uguuuuacaauaguucuguggg

SEQ ID NO: 1494610 - RNA, 21 nt, Human
uguuuuacaauaguucugugg

SEQ ID NO: 1494611 - RNA, 19 nt, Human
uguuugcuaagcauuccaa

SEQ ID NO: 1494612 - RNA, 20 nt, Human
uguuuuauaauuuugugaag

SEQ ID NO: 1494613 - RNA, 13 nt, Human
uguuuuauaauuu

SEQ ID NO: 1494614 - RNA, 14 nt, Human
uguuauuaaacaaa

SEQ ID NO: 1494615 - RNA, 15 nt, Human
aguggcaucaucuca

SEQ ID NO: 1494616 - RNA, 18 nt, Human
aguuacccaaauuaagag

SEQ ID NO: 1494617 - RNA, 17 nt, Human
aguuacccaaauuaaga

SEQ ID NO: 1494618 - RNA, 20 nt, Human
aguuauuauauuuacaaaug

SEQ ID NO: 1494619 - RNA, 12 nt, Human
aucguaaaauua

SEQ ID NO: 1494620 - RNA, 13 nt, Human
aucguaaaauuaa

SEQ ID NO: 1494621 - RNA, 14 nt, Human
aucguaaaauuaag

SEQ ID NO: 1494622 - RNA, 17 nt, Human
aucguaaaauuaagaaa

SEQ ID NO: 1494623 - RNA, 17 nt, Human
uucuguuuuauaauuuu

SEQ ID NO: 1494624 - RNA, 16 nt, Human
uucuguuuuauaauuu

SEQ ID NO: 1494625 - RNA, 22 nt, Human
uucuuaaccagaucauugugaa

SEQ ID NO: 1494626 - RNA, 23 nt, Human
uucuuaaccagaucauugugaaa

SEQ ID NO: 1494627 - RNA, 14 nt, Human
uucuuacugcuuaa

SEQ ID NO: 1494628 - RNA, 15 nt, Human
auccaguaaaauaau

SEQ ID NO: 1494629 - RNA, 18 nt, Human
auccaagcaaaugugaau

SEQ ID NO: 1494630 - RNA, 16 nt, Human
auccaagcaaauguga

SEQ ID NO: 1494631 - RNA, 14 nt, Human
uucugaauaaagca

SEQ ID NO: 1494632 - RNA, 15 nt, Human
uucugaauaaagcaa

SEQ ID NO: 1494633 - RNA, 16 nt, Human
uucugaauaaagcaau

SEQ ID NO: 1494634 - RNA, 17 nt, Human
uucugaauaaagcaauu

SEQ ID NO: 1494635 - RNA, 13 nt, Human
aucauugugaaau

SEQ ID NO: 1494636 - RNA, 15 nt, Human
aucauugugaaauua

SEQ ID NO: 1494637 - RNA, 19 nt, Human
aucauugugaaauuauuca

SEQ ID NO: 1494638 - RNA, 12 nt, Human
aucaguuaacua

SEQ ID NO: 1494639 - RNA, 18 nt, Human
aucaguuaacuauugcau

SEQ ID NO: 1494640 - RNA, 21 nt, Human
aucacucuguucauuccucca

SEQ ID NO: 1494641 - RNA, 22 nt, Human
aucacucuguucauuccuccag

SEQ ID NO: 1494642 - RNA, 23 nt, Human
aucacucuguucauuccuccagg

SEQ ID NO: 1494643 - RNA, 14 nt, Human
aucacugaacuuug

SEQ ID NO: 1494644 - RNA, 16 nt, Human
aucaaggguacacugc

SEQ ID NO: 1494645 - RNA, 18 nt, Human
uuccuuacagaacuacuu

SEQ ID NO: 1494646 - RNA, 19 nt, Human
aucacucuguucauuccuc

SEQ ID NO: 1494647 - RNA, 21 nt, Human
aucaaggguacacugccuucu

SEQ ID NO: 1494648 - RNA, 12 nt, Human
uuccugaacagg

SEQ ID NO: 1494649 - RNA, 21 nt, Human
uuccuaaauauauuuuaagac

SEQ ID NO: 1494650 - RNA, 15 nt, Human
uucccuuuuuuuaag

SEQ ID NO: 1494651 - RNA, 16 nt, Human
auauguucugacauaa

SEQ ID NO: 1494652 - RNA, 13 nt, Human
auauuacaaugau

SEQ ID NO: 1494653 - RNA, 15 nt, Human
auauuacaaugauca

SEQ ID NO: 1494654 - RNA, 16 nt, Human
auauuacaaugaucac

SEQ ID NO: 1494655 - RNA, 12 nt, Human
auauuacaauga

SEQ ID NO: 1494656 - RNA, 14 nt, Human
auauuguuugcuaa

SEQ ID NO: 1494657 - RNA, 13 nt, Human
auauuuacaaaug

SEQ ID NO: 1494658 - RNA, 19 nt, Human
auauuguuuuacaauaguu

SEQ ID NO: 1494659 - RNA, 21 nt, Human
auauucucacagcuccaagaa

SEQ ID NO: 1494660 - RNA, 18 nt, Human
auauucucacagcuccaa

SEQ ID NO: 1494661 - RNA, 22 nt, Human
uucaugcuguucaugaaagauu

SEQ ID NO: 1494662 - RNA, 22 nt, Human
auauguguaugcacaguaaaaa

SEQ ID NO: 1494663 - RNA, 18 nt, Human
uucagucucuauaccaau

SEQ ID NO: 1494664 - RNA, 21 nt, Human
uucagucucuauaccaauaaa

SEQ ID NO: 1494665 - RNA, 22 nt, Human
uucagucucuauaccaauaaag

SEQ ID NO: 1494666 - RNA, 23 nt, Human
uucagucucuauaccaauaaagu

SEQ ID NO: 1494667 - RNA, 24 nt, Human
uucagucucuauaccaauaaagug

SEQ ID NO: 1494668 - RNA, 21 nt, Human
uucauauuuuucauagcuaaa

SEQ ID NO: 1494669 - RNA, 13 nt, Human
auauaugcuaagu

SEQ ID NO: 1494670 - RNA, 17 nt, Human
uucagcgguuuauauaa

SEQ ID NO: 1494671 - RNA, 22 nt, Human
uucagcacuuuagaauaugccu

SEQ ID NO: 1494672 - RNA, 23 nt, Human
uucagcacuuuagaauaugccuu

SEQ ID NO: 1494673 - RNA, 19 nt, Human
uucagauaugauucaaaug

SEQ ID NO: 1494674 - RNA, 18 nt, Human
uucagauaugauucaaau

SEQ ID NO: 1494675 - RNA, 17 nt, Human
uucagauaugauucaaa

SEQ ID NO: 1494676 - RNA, 16 nt, Human
uucagauaugauucaa

SEQ ID NO: 1494677 - RNA, 21 nt, Human
augggacauuugcucauggaa

SEQ ID NO: 1494678 - RNA, 22 nt, Human
augggacauuugcucauggaau

SEQ ID NO: 1494679 - RNA, 13 nt, Human
uuugaaaagcaga

SEQ ID NO: 1494680 - RNA, 16 nt, Human
uuugaaaagcagacau

SEQ ID NO: 1494681 - RNA, 18 nt, Human
uuugaaaagcagacauuu

SEQ ID NO: 1494682 - RNA, 15 nt, Human
uuugaaauauugacu

SEQ ID NO: 1494683 - RNA, 14 nt, Human
uuugaaauauugac

SEQ ID NO: 1494684 - RNA, 17 nt, Human
uuugaaacacuuugcau

SEQ ID NO: 1494685 - RNA, 19 nt, Human
uuugaaacacuuugcauaa

SEQ ID NO: 1494686 - RNA, 20 nt, Human
uuucuaugaaauauuauguu

SEQ ID NO: 1494687 - RNA, 14 nt, Human
uuucuaugaaauau

SEQ ID NO: 1494688 - RNA, 13 nt, Human
uuucuaugaaaua

SEQ ID NO: 1494689 - RNA, 22 nt, Human
uuucuaggacugaauuaugaaa

SEQ ID NO: 1494690 - RNA, 17 nt, Human
uuucuaggacugaauua

SEQ ID NO: 1494691 - RNA, 21 nt, Human
uuucuaggacugaauuaugaa

SEQ ID NO: 1494692 - RNA, 19 nt, Human
augcuguauuuuaaaagaa

SEQ ID NO: 1494693 - RNA, 14 nt, Human
augcuguauuuuaa

SEQ ID NO: 1494694 - RNA, 19 nt, Human
uuuauuacuguaagaaaau

SEQ ID NO: 1494695 - RNA, 16 nt, Human
uuuauuuuaauaaugu

SEQ ID NO: 1494696 - RNA, 17 nt, Human
uuuauuuuuuucugaau

SEQ ID NO: 1494697 - RNA, 16 nt, Human
uuucaccuagauuuuu

SEQ ID NO: 1494698 - RNA, 12 nt, Human
uuucauaaagca

SEQ ID NO: 1494699 - RNA, 14 nt, Human
uuucauagcuaaaa

SEQ ID NO: 1494700 - RNA, 15 nt, Human
uuucauagcuaaaaa

SEQ ID NO: 1494701 - RNA, 18 nt, Human
uuucauauaaauggaauu

SEQ ID NO: 1494702 - RNA, 21 nt, Human
uuucaguuuauuugaaccaau

SEQ ID NO: 1494703 - RNA, 23 nt, Human
auggaauuggagcucgugggaca

SEQ ID NO: 1494704 - RNA, 20 nt, Human
uuuagcuggaaaaguauguu

SEQ ID NO: 1494705 - RNA, 14 nt, Human
uuuaugugaaacau

SEQ ID NO: 1494706 - RNA, 15 nt, Human
uuuaugugaaacaug

SEQ ID NO: 1494707 - RNA, 19 nt, Human
uuuauaugcuucuguuuua

SEQ ID NO: 1494708 - RNA, 17 nt, Human
uuuauaugcuucuguuu

SEQ ID NO: 1494709 - RNA, 16 nt, Human
uuuaaagcuuccauug

SEQ ID NO: 1494710 - RNA, 14 nt, Human
augauaacuggaaa

SEQ ID NO: 1494711 - RNA, 19 nt, Human
uuuaaaaaauagcagcuuu

SEQ ID NO: 1494712 - RNA, 16 nt, Human
uuuaaaaaauggucac

SEQ ID NO: 1494713 - RNA, 22 nt, Human
augcaaacuuuauuuuguguuu

SEQ ID NO: 1494714 - RNA, 18 nt, Human
augaucaccgacugaaaa

SEQ ID NO: 1494715 - RNA, 18 nt, Human
uugugaagcaaaauuuuu

SEQ ID NO: 1494716 - RNA, 17 nt, Human
uugugaagguggaaaua

SEQ ID NO: 1494717 - RNA, 18 nt, Human
uugugaagguggaaauaa

SEQ ID NO: 1494718 - RNA, 22 nt, Human
augaauuacauuuguauaaaau

SEQ ID NO: 1494719 - RNA, 19 nt, Human
augaauuacauuuguauaa

SEQ ID NO: 1494720 - RNA, 18 nt, Human
augaauuacauuuguaua

SEQ ID NO: 1494721 - RNA, 18 nt, Human
uugggcagcaauuuaaau

SEQ ID NO: 1494722 - RNA, 19 nt, Human
uugggcagcaauuuaaaug

SEQ ID NO: 1494723 - RNA, 23 nt, Human
augaauuaguuuuauaugcuucu

SEQ ID NO: 1494724 - RNA, 21 nt, Human
augaauuaguuuuauaugcuu

SEQ ID NO: 1494725 - RNA, 13 nt, Human
uuguauauuacaa

SEQ ID NO: 1494726 - RNA, 14 nt, Human
uuguauauuacaau

SEQ ID NO: 1494727 - RNA, 15 nt, Human
uuguauauuacaaug

SEQ ID NO: 1494728 - RNA, 16 nt, Human
uuguauauuacaauga

SEQ ID NO: 1494729 - RNA, 13 nt, Human
uuguaaugaaaac

SEQ ID NO: 1494730 - RNA, 15 nt, Human
uuguauaaaauaauu

SEQ ID NO: 1494731 - RNA, 13 nt, Human
uuguauaaaauaa

SEQ ID NO: 1494732 - RNA, 21 nt, Human
augaaauauuauguuaaaacu

SEQ ID NO: 1494733 - RNA, 11 nt, Human
uugcugagccu

SEQ ID NO: 1494734 - RNA, 12 nt, Human
uugcucauggaa

SEQ ID NO: 1494735 - RNA, 11 nt, Human
uugcucaugga

SEQ ID NO: 1494736 - RNA, 20 nt, Human
auucuccugccucagccucc

SEQ ID NO: 1494737 - RNA, 11 nt, Human
auuccauccuu

SEQ ID NO: 1494738 - RNA, 17 nt, Human
auucagaguugaugguu

SEQ ID NO: 1494739 - RNA, 18 nt, Human
auucagauaugauucaaa

SEQ ID NO: 1494740 - RNA, 20 nt, Human
auucagauaugauucaaaug

SEQ ID NO: 1494741 - RNA, 13 nt, Human
auuacgugcucug

SEQ ID NO: 1494742 - RNA, 19 nt, Human
uuuuugugaaaagcuccau

SEQ ID NO: 1494743 - RNA, 23 nt, Human
auuaaguaaugauaacuggaaac

SEQ ID NO: 1494744 - RNA, 16 nt, Human
uuuuuguuauuaaaca

SEQ ID NO: 1494745 - RNA, 21 nt, Human
auuacaguggggaaugaagau

SEQ ID NO: 1494746 - RNA, 20 nt, Human
auuacauuuguauaaaauaa

SEQ ID NO: 1494747 - RNA, 18 nt, Human
auuacauuuguauaaaau

SEQ ID NO: 1494748 - RNA, 17 nt, Human
auuacauuuguauaaaa

SEQ ID NO: 1494749 - RNA, 12 nt, Human
uuuugcagcuuu

SEQ ID NO: 1494750 - RNA, 12 nt, Human
uuuuuacauuuu

SEQ ID NO: 1494751 - RNA, 19 nt, Human
uuuuuauauuugaaauauu

SEQ ID NO: 1494752 - RNA, 12 nt, Human
uuuuuaucaugu

SEQ ID NO: 1494753 - RNA, 15 nt, Human
uuuuguuauuaaaca

SEQ ID NO: 1494754 - RNA, 17 nt, Human
auuaaaccggaccaucu

SEQ ID NO: 1494755 - RNA, 17 nt, Human
auguuuaguaaucauau

SEQ ID NO: 1494756 - RNA, 21 nt, Human
auguuuucaggcuagauguau

SEQ ID NO: 1494757 - RNA, 17 nt, Human
auguuuucaggcuagau

SEQ ID NO: 1494758 - RNA, 15 nt, Human
auguuuucaggcuag

SEQ ID NO: 1494759 - RNA, 22 nt, Human
uuuucaguuuauuugaaccaau

SEQ ID NO: 1494760 - RNA, 16 nt, Human
uuuucucuaggaaaua

SEQ ID NO: 1494761 - RNA, 14 nt, Human
uuuucucuaggaaa

SEQ ID NO: 1494762 - RNA, 17 nt, Human
auguugcauagaauaaa

SEQ ID NO: 1494763 - RNA, 18 nt, Human
auguugcauagaauaaaa

SEQ ID NO: 1494764 - RNA, 20 nt, Human
auguugcccuguugcugccu

SEQ ID NO: 1494765 - RNA, 16 nt, Human
auguucagauuauugg

SEQ ID NO: 1494766 - RNA, 14 nt, Human
uuuuaauaaacacu

SEQ ID NO: 1494767 - RNA, 14 nt, Human
uuuuaauaauguuu

SEQ ID NO: 1494768 - RNA, 13 nt, Human
uuuuaauaauguu

SEQ ID NO: 1494769 - RNA, 12 nt, Human
uuuuaauaaugu

SEQ ID NO: 1494770 - RNA, 16 nt, Human
uuuuaauaauguuuca

SEQ ID NO: 1494771 - RNA, 20 nt, Human
uuuuaauaauguuucaaaca

SEQ ID NO: 1494772 - RNA, 19 nt, Human
augugcuaguaauuggaaa

SEQ ID NO: 1494773 - RNA, 18 nt, Human
auguggaccuuagaauac

SEQ ID NO: 1494774 - RNA, 20 nt, Human
augugcuaguaauuggaaag

SEQ ID NO: 1494775 - RNA, 23 nt, Human
auguguguuuuaaaaugagaaau

SEQ ID NO: 1494776 - RNA, 17 nt, Human
auuuuaaaagaaugauu

SEQ ID NO: 1494777 - RNA, 21 nt, Human
auuuguauaaaauaauuuuua

SEQ ID NO: 1494778 - RNA, 19 nt, Human
auuuguauaaaauaauuuu

SEQ ID NO: 1494779 - RNA, 18 nt, Human
auuuguauaaaauaauuu

SEQ ID NO: 1494780 - RNA, 17 nt, Human
auuuuacauaaauuuag

SEQ ID NO: 1494781 - RNA, 16 nt, Human
auuuuacauaaauuua

SEQ ID NO: 1494782 - RNA, 12 nt, Human
auuuuacauuaa

SEQ ID NO: 1494783 - RNA, 15 nt, Human
auuuuacauuaaauu

SEQ ID NO: 1494784 - RNA, 17 nt, Human
auuuuaccuuugacaaa

SEQ ID NO: 1494785 - RNA, 22 nt, Human
auuuuaaaagaaugauuaugaa

SEQ ID NO: 1494786 - RNA, 18 nt, Human
auuuuaaaagaaugauua

SEQ ID NO: 1494787 - RNA, 16 nt, Human
auuuuaaaaaaugguc

SEQ ID NO: 1494788 - RNA, 17 nt, Human
auuuuaaaaaaugguca

SEQ ID NO: 1494789 - RNA, 22 nt, Human
auuuucaguuauuauauuuaca

SEQ ID NO: 1494790 - RNA, 21 nt, Human
auuuuauuuuuuucugaauua

SEQ ID NO: 1494791 - RNA, 23 nt, Human
auuuaaauguuaugacuauguaa

SEQ ID NO: 1494792 - RNA, 18 nt, Human
auuuaguauuuuguuuca

SEQ ID NO: 1494793 - RNA, 20 nt, Human
auuuaguaucuuuuuauuca

SEQ ID NO: 1494794 - RNA, 13 nt, Human
auuuaguguucau

SEQ ID NO: 1494795 - RNA, 13 nt, Human
auuuagauguaua

SEQ ID NO: 1494796 - RNA, 17 nt, Human
auuuauaaaaauaaaaa

SEQ ID NO: 1494797 - RNA, 22 nt, Human
auuuauaaaaauaaaaaacacu

SEQ ID NO: 1494798 - RNA, 23 nt, Human
auuuauaaaaauaaaaaacacug

SEQ ID NO: 1494799 - RNA, 17 nt, Human
auuuauuuuaauaaugu

SEQ ID NO: 1494800 - RNA, 20 nt, Human
auuuauuuuaauaauguuuc

SEQ ID NO: 1494801 - RNA, 19 nt, Human
auuuauuuuaauaauguuu

SEQ ID NO: 1494802 - RNA, 14 nt, Human
auuugaaauauuga

SEQ ID NO: 1494803 - RNA, 14 nt, Human
auuugaaccaauaa

SEQ ID NO: 1494804 - RNA, 24 nt, Human
auucugucucuggauuauauuaug

SEQ ID NO: 1494805 - RNA, 13 nt, Human
auuguauucagag

SEQ ID NO: 1494806 - RNA, 19 nt, Human
cacagugaucaaguuauuu

SEQ ID NO: 1494807 - RNA, 13 nt, Human
auuuuccugaaaa

SEQ ID NO: 1494808 - RNA, 14 nt, Human
caaaaacaaaaaga

SEQ ID NO: 1494809 - RNA, 20 nt, Human
caaaaagaaaagaaaauuuu

SEQ ID NO: 1494810 - RNA, 19 nt, Human
caaaaauuaucuauagcua

SEQ ID NO: 1494811 - RNA, 19 nt, Human
caaaaaucucaauauuuca

SEQ ID NO: 1494812 - RNA, 16 nt, Human
caaaauuguuacaaau

SEQ ID NO: 1494813 - RNA, 22 nt, Human
caaaauuuuuucucuaggaaau

SEQ ID NO: 1494814 - RNA, 21 nt, Human
caaaauuuuuucucuaggaaa

SEQ ID NO: 1494815 - RNA, 16 nt, Human
caaaauuuuuucucua

SEQ ID NO: 1494816 - RNA, 21 nt, Human
caaaggcauuauaaaaagaau

SEQ ID NO: 1494817 - RNA, 15 nt, Human
caaauugugugaaag

SEQ ID NO: 1494818 - RNA, 21 nt, Human
caaauuguaagcaugcacaaa

SEQ ID NO: 1494819 - RNA, 14 nt, Human
caaaugucuauaaa

SEQ ID NO: 1494820 - RNA, 15 nt, Human
caaaugucuauaaac

SEQ ID NO: 1494821 - RNA, 20 nt, Human
caaauacgugggcauucaaa

SEQ ID NO: 1494822 - RNA, 22 nt, Human
caaauacgugggcauucaaaug

SEQ ID NO: 1494823 - RNA, 21 nt, Human
caaauacgugggcauucaaau

SEQ ID NO: 1494824 - RNA, 17 nt, Human
caaaaauuaucuauagc

SEQ ID NO: 1494825 - RNA, 23 nt, Human
caauacaucccuuaccugggaaa

SEQ ID NO: 1494826 - RNA, 18 nt, Human
caaucuguaaaacuaaga

SEQ ID NO: 1494827 - RNA, 19 nt, Human
caauuacaacggagucaaa

SEQ ID NO: 1494828 - RNA, 18 nt, Human
caauuaauuccuucagca

SEQ ID NO: 1494829 - RNA, 15 nt, Human
caauuaauuccuuca

SEQ ID NO: 1494830 - RNA, 14 nt, Human
caauuaauuuuaga

SEQ ID NO: 1494831 - RNA, 13 nt, Human
caaggucugcuuu

SEQ ID NO: 1494832 - RNA, 21 nt, Human
caagccagauuuuccugaaaa

SEQ ID NO: 1494833 - RNA, 20 nt, Human
caagaacacagcccugcuuc

SEQ ID NO: 1494834 - RNA, 19 nt, Human
caagacugcacaucaaaau

SEQ ID NO: 1494835 - RNA, 17 nt, Human
caaauuucaugaccagu

SEQ ID NO: 1494836 - RNA, 13 nt, Human
caacggagucaaa

SEQ ID NO: 1494837 - RNA, 20 nt, Human
caaccucugccucccagguu

SEQ ID NO: 1494838 - RNA, 12 nt, Human
caccccuaggac

SEQ ID NO: 1494839 - RNA, 12 nt, Human
cacccucacacu

SEQ ID NO: 1494840 - RNA, 15 nt, Human
caccgacugaaaaua

SEQ ID NO: 1494841 - RNA, 13 nt, Human
caccgcagaagga

SEQ ID NO: 1494842 - RNA, 20 nt, Human
caccugggauuacaagcaug

SEQ ID NO: 1494843 - RNA, 11 nt, Human
caccugucugu

SEQ ID NO: 1494844 - RNA, 12 nt, Human
caccugucuguc

SEQ ID NO: 1494845 - RNA, 13 nt, Human
caccugucugucu

SEQ ID NO: 1494846 - RNA, 14 nt, Human
caccugucugucug

SEQ ID NO: 1494847 - RNA, 13 nt, Human
caccuccugccuc

SEQ ID NO: 1494848 - RNA, 15 nt, Human
caccuccugccucag

SEQ ID NO: 1494849 - RNA, 21 nt, Human
caccucccucaaccucauccu

SEQ ID NO: 1494850 - RNA, 19 nt, Human
caccucgcagguucaagca

SEQ ID NO: 1494851 - RNA, 21 nt, Human
caccucucaauauucaauaaa

SEQ ID NO: 1494852 - RNA, 22 nt, Human
caccucucaauauucaauaaag

SEQ ID NO: 1494853 - RNA, 23 nt, Human
caccucucaauauucaauaaagc

SEQ ID NO: 1494854 - RNA, 14 nt, Human
caccucauggaauu

SEQ ID NO: 1494855 - RNA, 12 nt, Human
caccucauggaa

SEQ ID NO: 1494856 - RNA, 11 nt, Human
caccucaugga

SEQ ID NO: 1494857 - RNA, 15 nt, Human
caccucccucaaccu

SEQ ID NO: 1494858 - RNA, 17 nt, Human
caccucccucaaccuca

SEQ ID NO: 1494859 - RNA, 19 nt, Human
caccucccucaaccucauc

SEQ ID NO: 1494860 - RNA, 14 nt, Human
caccgcagaaggaa

SEQ ID NO: 1494861 - RNA, 15 nt, Human
caccgcagaaggaag

SEQ ID NO: 1494862 - RNA, 13 nt, Human
caccucucaauau

SEQ ID NO: 1494863 - RNA, 19 nt, Human
cacuguggguagacacaca

SEQ ID NO: 1494864 - RNA, 24 nt, Human
cacuguggguagacacacaugaag

SEQ ID NO: 1494865 - RNA, 22 nt, Human
cacuguggguagacacacauga

SEQ ID NO: 1494866 - RNA, 13 nt, Human
cacuggccccacc

SEQ ID NO: 1494867 - RNA, 14 nt, Human
cacuggccccaccc

SEQ ID NO: 1494868 - RNA, 16 nt, Human
cacuggccccacccuc

SEQ ID NO: 1494869 - RNA, 13 nt, Human
cacuggcgaggag

SEQ ID NO: 1494870 - RNA, 15 nt, Human
cacuguacuugcucu

SEQ ID NO: 1494871 - RNA, 18 nt, Human
cacuguacuugcucuuga

SEQ ID NO: 1494872 - RNA, 19 nt, Human
cacuguacuugcucuugau

SEQ ID NO: 1494873 - RNA, 12 nt, Human
cacugccuuuga

SEQ ID NO: 1494874 - RNA, 20 nt, Human
cacugccuucucaacuccaa

SEQ ID NO: 1494875 - RNA, 13 nt, Human
cacugcaaccucc

SEQ ID NO: 1494876 - RNA, 14 nt, Human
cacugcaaccuccg

SEQ ID NO: 1494877 - RNA, 14 nt, Human
cacugcaaccucca

SEQ ID NO: 1494878 - RNA, 17 nt, Human
cacugcaaccuccaccu

SEQ ID NO: 1494879 - RNA, 19 nt, Human
cacugcaaccuccaccucg

SEQ ID NO: 1494880 - RNA, 14 nt, Human
cacugcaaccucug

SEQ ID NO: 1494881 - RNA, 16 nt, Human
caccugucugucuguc

SEQ ID NO: 1494882 - RNA, 22 nt, Human
caccugucugucugucuguccc

SEQ ID NO: 1494883 - RNA, 22 nt, Human
caccuguggaacauaaaaagga

SEQ ID NO: 1494884 - RNA, 13 nt, Human
cacgcacggcagc

SEQ ID NO: 1494885 - RNA, 16 nt, Human
cacgccuggcuaauuu

SEQ ID NO: 1494886 - RNA, 13 nt, Human
cacuaaacaaaga

SEQ ID NO: 1494887 - RNA, 19 nt, Human
cacuaguauuucuaugaaa

SEQ ID NO: 1494888 - RNA, 16 nt, Human
cacuaacaugauuugg

SEQ ID NO: 1494889 - RNA, 17 nt, Human
cacuaagagagaaugag

SEQ ID NO: 1494890 - RNA, 15 nt, Human
cacucguguguuucu

SEQ ID NO: 1494891 - RNA, 16 nt, Human
cacucguguguuucua

SEQ ID NO: 1494892 - RNA, 11 nt, Human
cagaaggaagg

SEQ ID NO: 1494893 - RNA, 15 nt, Human
cagaaggaaggcagg

SEQ ID NO: 1494894 - RNA, 20 nt, Human
cagaaggaaggcagggagga

SEQ ID NO: 1494895 - RNA, 22 nt, Human
cagaaggaaggcagggaggagg

SEQ ID NO: 1494896 - RNA, 13 nt, Human
cagaacuacuucu

SEQ ID NO: 1494897 - RNA, 14 nt, Human
cacuuuuugcagcu

SEQ ID NO: 1494898 - RNA, 18 nt, Human
cacuuuuugcagcuuucu

SEQ ID NO: 1494899 - RNA, 15 nt, Human
cacuuuuugcagcuu

SEQ ID NO: 1494900 - RNA, 12 nt, Human
cacuuugcauaa

SEQ ID NO: 1494901 - RNA, 22 nt, Human
cagaaaaguugaauuuuacaug

SEQ ID NO: 1494902 - RNA, 20 nt, Human
cagaaaaguugaauuuuaca

SEQ ID NO: 1494903 - RNA, 17 nt, Human
cagaaaaguugaauuuu

SEQ ID NO: 1494904 - RNA, 23 nt, Human
cagaaaagaaagcuacagaagaa

SEQ ID NO: 1494905 - RNA, 22 nt, Human
cagaaagcaucccucacccauc

SEQ ID NO: 1494906 - RNA, 18 nt, Human
cagaaacacccucacacu

SEQ ID NO: 1494907 - RNA, 20 nt, Human
cagaaacacccucacacugg

SEQ ID NO: 1494908 - RNA, 21 nt, Human
cagaaacacccucacacuggg

SEQ ID NO: 1494909 - RNA, 22 nt, Human
cagaaacacccucacacuggga

SEQ ID NO: 1494910 - RNA, 23 nt, Human
cagaaacacccucacacugggac

SEQ ID NO: 1494911 - RNA, 21 nt, Human
cagaaugagacauccagcaga

SEQ ID NO: 1494912 - RNA, 13 nt, Human
cagacauuuuaaa

SEQ ID NO: 1494913 - RNA, 14 nt, Human
cagaccauggacac

SEQ ID NO: 1494914 - RNA, 22 nt, Human
cagaccauggacacuacaccca

SEQ ID NO: 1494915 - RNA, 21 nt, Human
cagaccauggacacuacaccc

SEQ ID NO: 1494916 - RNA, 14 nt, Human
cagauccuggaaau

SEQ ID NO: 1494917 - RNA, 22 nt, Human
cagauaaagguucaugcaaacu

SEQ ID NO: 1494918 - RNA, 14 nt, Human
cagauaaucacaau

SEQ ID NO: 1494919 - RNA, 23 nt, Human
cagaggcgcaugaauuugugaag

SEQ ID NO: 1494920 - RNA, 17 nt, Human
cagagcaagaccccauc

SEQ ID NO: 1494921 - RNA, 13 nt, Human
cagagaagaaaga

SEQ ID NO: 1494922 - RNA, 14 nt, Human
cagagaagaaagaa

SEQ ID NO: 1494923 - RNA, 18 nt, Human
cagagaagaaagaacgga

SEQ ID NO: 1494924 - RNA, 19 nt, Human
cagagaagaaagaacggaa

SEQ ID NO: 1494925 - RNA, 13 nt, Human
cagagcacugcuc

SEQ ID NO: 1494926 - RNA, 15 nt, Human
cagagcacugcucca

SEQ ID NO: 1494927 - RNA, 14 nt, Human
cagagccaggaaga

SEQ ID NO: 1494928 - RNA, 15 nt, Human
cagagccaggaagau

SEQ ID NO: 1494929 - RNA, 17 nt, Human
cagagccaggaagaucc

SEQ ID NO: 1494930 - RNA, 21 nt, Human
cagagccaggaagauccccca

SEQ ID NO: 1494931 - RNA, 23 nt, Human
cagagccaggaagaucccccaga

SEQ ID NO: 1494932 - RNA, 13 nt, Human
cagagccaggaag

SEQ ID NO: 1494933 - RNA, 15 nt, Human
cagauuuuccugaaa

SEQ ID NO: 1494934 - RNA, 14 nt, Human
cagauuuuccugaa

SEQ ID NO: 1494935 - RNA, 14 nt, Human
cagcaacaauaaau

SEQ ID NO: 1494936 - RNA, 19 nt, Human
cagcaacaauaaauagaca

SEQ ID NO: 1494937 - RNA, 20 nt, Human
cagcaacaauaaauagacac

SEQ ID NO: 1494938 - RNA, 17 nt, Human
cagcaauagagacggga

SEQ ID NO: 1494939 - RNA, 15 nt, Human
cagcaauagagacgg

SEQ ID NO: 1494940 - RNA, 22 nt, Human
cagcaauuacaacggagucaaa

SEQ ID NO: 1494941 - RNA, 14 nt, Human
cagcaauuuaaaug

SEQ ID NO: 1494942 - RNA, 15 nt, Human
cagcaauuuaaaugu

SEQ ID NO: 1494943 - RNA, 16 nt, Human
cagcaauuuaaauguu

SEQ ID NO: 1494944 - RNA, 14 nt, Human
cagcacuuuagaau

SEQ ID NO: 1494945 - RNA, 22 nt, Human
cagcacuuuagaauaugccuug

SEQ ID NO: 1494946 - RNA, 21 nt, Human
cagccacggggacucagcccu

SEQ ID NO: 1494947 - RNA, 23 nt, Human
cagccauccagggggcaagagga

SEQ ID NO: 1494948 - RNA, 18 nt, Human
cagccaacuauggccugu

SEQ ID NO: 1494949 - RNA, 20 nt, Human
cagcccugcugcugccugcc

SEQ ID NO: 1494950 - RNA, 16 nt, Human
cagccuaguugaucag

SEQ ID NO: 1494951 - RNA, 21 nt, Human
cagcgagauaccccaccuccc

SEQ ID NO: 1494952 - RNA, 13 nt, Human
cagcucacugcaa

SEQ ID NO: 1494953 - RNA, 15 nt, Human
cagcucacugcaacc

SEQ ID NO: 1494954 - RNA, 16 nt, Human
cagccuucuacugcuc

SEQ ID NO: 1494955 - RNA, 18 nt, Human
cagcuggggccaggcugg

SEQ ID NO: 1494956 - RNA, 19 nt, Human
cagcuggggccaggcuggg

SEQ ID NO: 1494957 - RNA, 20 nt, Human
cagcuggggccaggcugggu

SEQ ID NO: 1494958 - RNA, 18 nt, Human
cagcuguaugauucccag

SEQ ID NO: 1494959 - RNA, 21 nt, Human
cagcuggggccaggcuggguc

SEQ ID NO: 1494960 - RNA, 22 nt, Human
cagcuggggccaggcugggucg

SEQ ID NO: 1494961 - RNA, 18 nt, Human
cagcucucaguugcagcc

SEQ ID NO: 1494962 - RNA, 21 nt, Human
cagcuuuauggagauauaauu

SEQ ID NO: 1494963 - RNA, 14 nt, Human
cagcuuuagccaag

SEQ ID NO: 1494964 - RNA, 18 nt, Human
caggaaccacaagacugc

SEQ ID NO: 1494965 - RNA, 18 nt, Human
cagcuuuucccaaaagcc

SEQ ID NO: 1494966 - RNA, 20 nt, Human
cagcuuuucccaaaagccca

SEQ ID NO: 1494967 - RNA, 19 nt, Human
cagcuguaugauucccagc

SEQ ID NO: 1494968 - RNA, 19 nt, Human
caggaagaucccccagaaa

SEQ ID NO: 1494969 - RNA, 14 nt, Human
caggaagagaagga

SEQ ID NO: 1494970 - RNA, 15 nt, Human
caggaagagaaggag

SEQ ID NO: 1494971 - RNA, 17 nt, Human
caggaagagaaggagca

SEQ ID NO: 1494972 - RNA, 17 nt, Human
caggaagaucccccaga

SEQ ID NO: 1494973 - RNA, 18 nt, Human
caggaagaucccccagaa

SEQ ID NO: 1494974 - RNA, 19 nt, Human
caggaguuucguuuucaaa

SEQ ID NO: 1494975 - RNA, 11 nt, Human
caggagcccug

SEQ ID NO: 1494976 - RNA, 14 nt, Human
caggagcccuggga

SEQ ID NO: 1494977 - RNA, 16 nt, Human
caggagcccugggagg

SEQ ID NO: 1494978 - RNA, 18 nt, Human
caggagcccugggaggcu

SEQ ID NO: 1494979 - RNA, 19 nt, Human
caggagcccugggaggcuc

SEQ ID NO: 1494980 - RNA, 21 nt, Human
caggagcccugggaggcucug

SEQ ID NO: 1494981 - RNA, 23 nt, Human
caggaugguucccuugaugaaga

SEQ ID NO: 1494982 - RNA, 21 nt, Human
caggaugguucccuugaugaa

SEQ ID NO: 1494983 - RNA, 18 nt, Human
caggauggucuccaucuc

SEQ ID NO: 1494984 - RNA, 22 nt, Human
caggaugaugacuauggaaaga

SEQ ID NO: 1494985 - RNA, 18 nt, Human
caggaugaugacuaugga

SEQ ID NO: 1494986 - RNA, 20 nt, Human
caggaugaugacuauggaaa

SEQ ID NO: 1494987 - RNA, 15 nt, Human
caggaucaguuaacu

SEQ ID NO: 1494988 - RNA, 21 nt, Human
caggauauucucacagcucca

SEQ ID NO: 1494989 - RNA, 17 nt, Human
caggaucaguuaacuau

SEQ ID NO: 1494990 - RNA, 13 nt, Human
caggauccaggcc

SEQ ID NO: 1494991 - RNA, 14 nt, Human
caggcaggagcccu

SEQ ID NO: 1494992 - RNA, 23 nt, Human
caggcuuuuuuaucaugugaaau

SEQ ID NO: 1494993 - RNA, 16 nt, Human
caggcuggagugcagu

SEQ ID NO: 1494994 - RNA, 23 nt, Human
caggcugggucgcccuggacugu

SEQ ID NO: 1494995 - RNA, 21 nt, Human
caggcugggucgcccuggacu

SEQ ID NO: 1494996 - RNA, 19 nt, Human
caggcuagauguauguacu

SEQ ID NO: 1494997 - RNA, 13 nt, Human
caggcuagaugua

SEQ ID NO: 1494998 - RNA, 23 nt, Human
cagggaccggcggaccccagcca

SEQ ID NO: 1494999 - RNA, 16 nt, Human
caggggacaggauggu

SEQ ID NO: 1495000 - RNA, 11 nt, Human
caggggacagg

SEQ ID NO: 1495001 - RNA, 15 nt, Human
cagggggcaagagga

SEQ ID NO: 1495002 - RNA, 16 nt, Human
cagugaaagaaaauaa

SEQ ID NO: 1495003 - RNA, 20 nt, Human
cagugaaagaaaauaacaau

SEQ ID NO: 1495004 - RNA, 13 nt, Human
cagucccuccaca

SEQ ID NO: 1495005 - RNA, 14 nt, Human
caguaucucuucag

SEQ ID NO: 1495006 - RNA, 15 nt, Human
caguaucucuucagu

SEQ ID NO: 1495007 - RNA, 16 nt, Human
caguaucucuucaguc

SEQ ID NO: 1495008 - RNA, 17 nt, Human
caguaucucuucagucu

SEQ ID NO: 1495009 - RNA, 19 nt, Human
caguaucucuucagucucu

SEQ ID NO: 1495010 - RNA, 22 nt, Human
caguaucucuucagucucuaua

SEQ ID NO: 1495011 - RNA, 19 nt, Human
caguaggggcuuauaauaa

SEQ ID NO: 1495012 - RNA, 22 nt, Human
caguaggggcuuauaauaaagg

SEQ ID NO: 1495013 - RNA, 20 nt, Human
cagucauucagauaugauuc

SEQ ID NO: 1495014 - RNA, 17 nt, Human
cagucauucagauauga

SEQ ID NO: 1495015 - RNA, 23 nt, Human
caguauggguuagggaaaacauu

SEQ ID NO: 1495016 - RNA, 16 nt, Human
caguauggguuaggga

SEQ ID NO: 1495017 - RNA, 21 nt, Human
caguauggguuagggaaaaca

SEQ ID NO: 1495018 - RNA, 22 nt, Human
cagucaggaaagagaacuucca

SEQ ID NO: 1495019 - RNA, 18 nt, Human
cagucaggaaagagaacu

SEQ ID NO: 1495020 - RNA, 15 nt, Human
cagucaggaaagaga

SEQ ID NO: 1495021 - RNA, 19 nt, Human
caggucccuaauaaagcug

SEQ ID NO: 1495022 - RNA, 20 nt, Human
caggucccuaauaaagcugu

SEQ ID NO: 1495023 - RNA, 21 nt, Human
caggucccuaauaaagcugug

SEQ ID NO: 1495024 - RNA, 22 nt, Human
caggucccuaauaaagcugugu

SEQ ID NO: 1495025 - RNA, 11 nt, Human
caggucccuaa

SEQ ID NO: 1495026 - RNA, 12 nt, Human
caggucccuaau

SEQ ID NO: 1495027 - RNA, 13 nt, Human
caggucccuaaua

SEQ ID NO: 1495028 - RNA, 14 nt, Human
caggucccuaauaa

SEQ ID NO: 1495029 - RNA, 15 nt, Human
caggucccuaauaaa

SEQ ID NO: 1495030 - RNA, 16 nt, Human
caggucccuaauaaag

SEQ ID NO: 1495031 - RNA, 17 nt, Human
caggucccuaauaaagc

SEQ ID NO: 1495032 - RNA, 18 nt, Human
caggucccuaauaaagcu

SEQ ID NO: 1495033 - RNA, 16 nt, Human
cauauaagugauugcu

SEQ ID NO: 1495034 - RNA, 13 nt, Human
cauauauaacaau

SEQ ID NO: 1495035 - RNA, 20 nt, Human
cauauauaacaaugcuguau

SEQ ID NO: 1495036 - RNA, 15 nt, Human
cauauauaacaaugc

SEQ ID NO: 1495037 - RNA, 13 nt, Human
cauauuguuacug

SEQ ID NO: 1495038 - RNA, 19 nt, Human
cauauuguuacugguacca

SEQ ID NO: 1495039 - RNA, 13 nt, Human
caucccuccuggg

SEQ ID NO: 1495040 - RNA, 18 nt, Human
caucccuuaccugggaaa

SEQ ID NO: 1495041 - RNA, 14 nt, Human
caucaucucagcuc

SEQ ID NO: 1495042 - RNA, 15 nt, Human
caucaucucagcuca

SEQ ID NO: 1495043 - RNA, 10 nt, Human
caucuuuaag

SEQ ID NO: 1495044 - RNA, 14 nt, Human
caugaaagauucaa

SEQ ID NO: 1495045 - RNA, 18 nt, Human
caugagucacuacgccug

SEQ ID NO: 1495046 - RNA, 13 nt, Human
caugauaaaugau

SEQ ID NO: 1495047 - RNA, 22 nt, Human
cauggacuucugccagcauaau

SEQ ID NO: 1495048 - RNA, 16 nt, Human
cauggacacuacaccc

SEQ ID NO: 1495049 - RNA, 17 nt, Human
cauggacacuacaccca

SEQ ID NO: 1495050 - RNA, 18 nt, Human
cauggacacuacacccag

SEQ ID NO: 1495051 - RNA, 19 nt, Human
cauggacacuacacccagc

SEQ ID NO: 1495052 - RNA, 20 nt, Human
cauggacacuacacccagca

SEQ ID NO: 1495053 - RNA, 20 nt, Human
caugcuucccuuuccugagu

SEQ ID NO: 1495054 - RNA, 22 nt, Human
caugcugugugacucaaaccaa

SEQ ID NO: 1495055 - RNA, 18 nt, Human
caugcuguucaugaaaga

SEQ ID NO: 1495056 - RNA, 16 nt, Human
caugcuguucaugaaa

SEQ ID NO: 1495057 - RNA, 20 nt, Human
cauggaauuggagcucgugg

SEQ ID NO: 1495058 - RNA, 21 nt, Human
cauggaaauucccuucaucug

SEQ ID NO: 1495059 - RNA, 14 nt, Human
caugcugugugacu

SEQ ID NO: 1495060 - RNA, 15 nt, Human
caugcuguucaugaa

SEQ ID NO: 1495061 - RNA, 17 nt, Human
caugcugugugacucaa

SEQ ID NO: 1495062 - RNA, 21 nt, Human
caugcugugugacucaaacca

SEQ ID NO: 1495063 - RNA, 14 nt, Human
caugcagaaagcau

SEQ ID NO: 1495064 - RNA, 20 nt, Human
cauguuucuuuguaaugaaa

SEQ ID NO: 1495065 - RNA, 20 nt, Human
caugugcuaguaauuggaaa

SEQ ID NO: 1495066 - RNA, 18 nt, Human
cauuuuacauuaaauuuu

SEQ ID NO: 1495067 - RNA, 23 nt, Human
cauuuuaccuuugacaaagguaa

SEQ ID NO: 1495068 - RNA, 13 nt, Human
cauucuggaauaa

SEQ ID NO: 1495069 - RNA, 12 nt, Human
cauucuggaagu

SEQ ID NO: 1495070 - RNA, 16 nt, Human
cauucuggaagugacu

SEQ ID NO: 1495071 - RNA, 14 nt, Human
cauuccugaacagg

SEQ ID NO: 1495072 - RNA, 12 nt, Human
cauuccuccagg

SEQ ID NO: 1495073 - RNA, 13 nt, Human
cauuccuccaggu

SEQ ID NO: 1495074 - RNA, 15 nt, Human
cauuccauucuggaa

SEQ ID NO: 1495075 - RNA, 14 nt, Human
cauuccauucugga

SEQ ID NO: 1495076 - RNA, 12 nt, Human
cauuccauccuu

SEQ ID NO: 1495077 - RNA, 14 nt, Human
cauuccauccuuga

SEQ ID NO: 1495078 - RNA, 22 nt, Human
cauuccaacuaucucauuucca

SEQ ID NO: 1495079 - RNA, 15 nt, Human
cauucauuccauucu

SEQ ID NO: 1495080 - RNA, 16 nt, Human
cauucauuccauucug

SEQ ID NO: 1495081 - RNA, 17 nt, Human
cauucauuccauucugg

SEQ ID NO: 1495082 - RNA, 19 nt, Human
cauucauuuucuggguguu

SEQ ID NO: 1495083 - RNA, 21 nt, Human
cauucagauaugauucaaaug

SEQ ID NO: 1495084 - RNA, 20 nt, Human
cauucaaauguauuacagug

SEQ ID NO: 1495085 - RNA, 11 nt, Human
ccaaaccacuu

SEQ ID NO: 1495086 - RNA, 14 nt, Human
ccaaaccacuuuuu

SEQ ID NO: 1495087 - RNA, 22 nt, Human
ccaaaccacuuuuugcagcuuu

SEQ ID NO: 1495088 - RNA, 22 nt, Human
ccacccagaaugagacauccag

SEQ ID NO: 1495089 - RNA, 21 nt, Human
ccacccucguggacaccugcc

SEQ ID NO: 1495090 - RNA, 22 nt, Human
ccacccucguggacaccugccc

SEQ ID NO: 1495091 - RNA, 20 nt, Human
ccacccucguggacaccugc

SEQ ID NO: 1495092 - RNA, 18 nt, Human
ccaccucccucaaccuca

SEQ ID NO: 1495093 - RNA, 20 nt, Human
ccaccucccucaaccucauc

SEQ ID NO: 1495094 - RNA, 14 nt, Human
ccacugccuuugac

SEQ ID NO: 1495095 - RNA, 22 nt, Human
ccacugccuuugaccugccucc

SEQ ID NO: 1495096 - RNA, 13 nt, Human
ccagauuuaugca

SEQ ID NO: 1495097 - RNA, 22 nt, Human
ccagauuuaugcauauuauuuu

SEQ ID NO: 1495098 - RNA, 16 nt, Human
ccagagcacugcucca

SEQ ID NO: 1495099 - RNA, 20 nt, Human
ccacuguacuugcucuugau

SEQ ID NO: 1495100 - RNA, 17 nt, Human
ccacuguacuugcucuu

SEQ ID NO: 1495101 - RNA, 18 nt, Human
ccacuguacuugcucuug

SEQ ID NO: 1495102 - RNA, 19 nt, Human
ccacuguacuugcucuuga

SEQ ID NO: 1495103 - RNA, 14 nt, Human
ccagaccauggaca

SEQ ID NO: 1495104 - RNA, 15 nt, Human
ccagaccauggacac

SEQ ID NO: 1495105 - RNA, 23 nt, Human
ccagcaauuacaacggagucaaa

SEQ ID NO: 1495106 - RNA, 14 nt, Human
ccagccucagcucu

SEQ ID NO: 1495107 - RNA, 23 nt, Human
ccagcauaauacuugcuuuggaa

SEQ ID NO: 1495108 - RNA, 18 nt, Human
ccagguuggagugcagug

SEQ ID NO: 1495109 - RNA, 13 nt, Human
ccauucauuccau

SEQ ID NO: 1495110 - RNA, 14 nt, Human
ccauucauuccauu

SEQ ID NO: 1495111 - RNA, 14 nt, Human
ccauauuggccagu

SEQ ID NO: 1495112 - RNA, 13 nt, Human
ccauggcccugcc

SEQ ID NO: 1495113 - RNA, 13 nt, Human
cccagaaaagaaa

SEQ ID NO: 1495114 - RNA, 20 nt, Human
cccagaaaagaaagcuacag

SEQ ID NO: 1495115 - RNA, 13 nt, Human
cccgccucagccu

SEQ ID NO: 1495116 - RNA, 18 nt, Human
cccuggucccucugcagu

SEQ ID NO: 1495117 - RNA, 21 nt, Human
cccuggacugugugcucagga

SEQ ID NO: 1495118 - RNA, 15 nt, Human
cccuggacugugugc

SEQ ID NO: 1495119 - RNA, 15 nt, Human
cccugggaggcucug

SEQ ID NO: 1495120 - RNA, 18 nt, Human
cccugccaccuccugccu

SEQ ID NO: 1495121 - RNA, 20 nt, Human
cccugccaccuccugccuca

SEQ ID NO: 1495122 - RNA, 13 nt, Human
cccugccaccugu

SEQ ID NO: 1495123 - RNA, 14 nt, Human
cccugccaccuguc

SEQ ID NO: 1495124 - RNA, 15 nt, Human
cccugccaccugucu

SEQ ID NO: 1495125 - RNA, 16 nt, Human
cccugccaccugucug

SEQ ID NO: 1495126 - RNA, 17 nt, Human
cccugccaccugucugu

SEQ ID NO: 1495127 - RNA, 18 nt, Human
cccugccaccugucuguc

SEQ ID NO: 1495128 - RNA, 19 nt, Human
cccuccaccgcagaaggaa

SEQ ID NO: 1495129 - RNA, 23 nt, Human
cccuccacauuucccccuagccu

SEQ ID NO: 1495130 - RNA, 21 nt, Human
cccuccaccgcagaaggaagg

SEQ ID NO: 1495131 - RNA, 18 nt, Human
cccuccaccgcagaagga

SEQ ID NO: 1495132 - RNA, 18 nt, Human
cccucucucauacccucc

SEQ ID NO: 1495133 - RNA, 22 nt, Human
cccucucucauacccucccucc

SEQ ID NO: 1495134 - RNA, 21 nt, Human
cccaccucccucaaccucauc

SEQ ID NO: 1495135 - RNA, 16 nt, Human
ccuaaauauauuuuaa

SEQ ID NO: 1495136 - RNA, 18 nt, Human
ccuaaauauauuuuaaga

SEQ ID NO: 1495137 - RNA, 19 nt, Human
ccuaaauaauaaaaauaaa

SEQ ID NO: 1495138 - RNA, 18 nt, Human
ccuaaaagaaacccugca

SEQ ID NO: 1495139 - RNA, 19 nt, Human
ccuaaaagaaacccugcac

SEQ ID NO: 1495140 - RNA, 17 nt, Human
ccggcuugccacacccc

SEQ ID NO: 1495141 - RNA, 21 nt, Human
ccucaucuccccaucauuggu

SEQ ID NO: 1495142 - RNA, 18 nt, Human
ccuccaccgcagaaggaa

SEQ ID NO: 1495143 - RNA, 12 nt, Human
ccuccaccucaa

SEQ ID NO: 1495144 - RNA, 22 nt, Human
ccucucaauauucaauaaagcu

SEQ ID NO: 1495145 - RNA, 18 nt, Human
ccucucaauauucaauaa

SEQ ID NO: 1495146 - RNA, 20 nt, Human
ccucucaauauucaauaaag

SEQ ID NO: 1495147 - RNA, 19 nt, Human
ccugcugugaaagaaguaa

SEQ ID NO: 1495148 - RNA, 23 nt, Human
ccuggaaaucaggguuaguauug

SEQ ID NO: 1495149 - RNA, 22 nt, Human
ccugccucaccagcccuggcaa

SEQ ID NO: 1495150 - RNA, 17 nt, Human
ccuggugcacuggcccc

SEQ ID NO: 1495151 - RNA, 19 nt, Human
ccuggugcacuggccccac

SEQ ID NO: 1495152 - RNA, 20 nt, Human
ccuggugcacuggccccacc

SEQ ID NO: 1495153 - RNA, 12 nt, Human
ccuguuuaagag

SEQ ID NO: 1495154 - RNA, 15 nt, Human
ccuguuuaagagaca

SEQ ID NO: 1495155 - RNA, 16 nt, Human
ccuuaacugcauccag

SEQ ID NO: 1495156 - RNA, 17 nt, Human
ccuuaagagucauccag

SEQ ID NO: 1495157 - RNA, 20 nt, Human
ccuucagcacuuuagaauau

SEQ ID NO: 1495158 - RNA, 18 nt, Human
ccuucuauacccacccag

SEQ ID NO: 1495159 - RNA, 20 nt, Human
ccuucuauacccacccagaa

SEQ ID NO: 1495160 - RNA, 19 nt, Human
ccuucuauacccacccaga

SEQ ID NO: 1495161 - RNA, 13 nt, Human
ccuugaacuagga

SEQ ID NO: 1495162 - RNA, 19 nt, Human
ccuuggggcugaugcaguu

SEQ ID NO: 1495163 - RNA, 15 nt, Human
ccuuugaccugccuc

SEQ ID NO: 1495164 - RNA, 16 nt, Human
ccuuugaccugccucc

SEQ ID NO: 1495165 - RNA, 21 nt, Human
ccuuguuucucuuccuuucuu

SEQ ID NO: 1495166 - RNA, 21 nt, Human
ccuuugaccugccucccuuca

SEQ ID NO: 1495167 - RNA, 22 nt, Human
ccuuugaccugccucccuucau

SEQ ID NO: 1495168 - RNA, 13 nt, Human
cgagauaccccac

SEQ ID NO: 1495169 - RNA, 20 nt, Human
cgagauaccccaccucccuc

SEQ ID NO: 1495170 - RNA, 17 nt, Human
cucauacccucccuccc

SEQ ID NO: 1495171 - RNA, 16 nt, Human
cucauacccucccucc

SEQ ID NO: 1495172 - RNA, 21 nt, Human
cuccaaacugacucuuaagaa

SEQ ID NO: 1495173 - RNA, 16 nt, Human
cuccccuuuuuuuccc

SEQ ID NO: 1495174 - RNA, 17 nt, Human
cuccugccucagccucc

SEQ ID NO: 1495175 - RNA, 14 nt, Human
cuccuuagaaaaaa

SEQ ID NO: 1495176 - RNA, 18 nt, Human
cucgccggaucugaggga

SEQ ID NO: 1495177 - RNA, 17 nt, Human
cucgccggaucugaggg

SEQ ID NO: 1495178 - RNA, 22 nt, Human
cuagguaaauuacaguuccuag

SEQ ID NO: 1495179 - RNA, 21 nt, Human
cuagugagcagucaggaaaga

SEQ ID NO: 1495180 - RNA, 20 nt, Human
cuagugaaacucguuaauuu

SEQ ID NO: 1495181 - RNA, 16 nt, Human
cuaguaauuggaaagg

SEQ ID NO: 1495182 - RNA, 14 nt, Human
cuagucaccagaga

SEQ ID NO: 1495183 - RNA, 13 nt, Human
cuauaccaauaaa

SEQ ID NO: 1495184 - RNA, 14 nt, Human
cuauaccaauaaag

SEQ ID NO: 1495185 - RNA, 18 nt, Human
cuauauuguuugcuaagc

SEQ ID NO: 1495186 - RNA, 17 nt, Human
cuauauuuuacauaaau

SEQ ID NO: 1495187 - RNA, 13 nt, Human
cuauguaaacuac

SEQ ID NO: 1495188 - RNA, 13 nt, Human
cuauggccugugg

SEQ ID NO: 1495189 - RNA, 16 nt, Human
cucagauuucugagga

SEQ ID NO: 1495190 - RNA, 17 nt, Human
cucagauuucugaggaa

SEQ ID NO: 1495191 - RNA, 12 nt, Human
cucaaccucauc

SEQ ID NO: 1495192 - RNA, 13 nt, Human
cucaaccucaucc

SEQ ID NO: 1495193 - RNA, 23 nt, Human
cucaaauacgugggcauucaaau

SEQ ID NO: 1495194 - RNA, 19 nt, Human
cucuggauuauauuaugaa

SEQ ID NO: 1495195 - RNA, 20 nt, Human
cucuggauuauauuaugaag

SEQ ID NO: 1495196 - RNA, 15 nt, Human
cucuuccuucccugc

SEQ ID NO: 1495197 - RNA, 19 nt, Human
cucuuccuucccugcugug

SEQ ID NO: 1495198 - RNA, 13 nt, Human
cucuuccuuucuu

SEQ ID NO: 1495199 - RNA, 21 nt, Human
cucuguugccaggcuggagug

SEQ ID NO: 1495200 - RNA, 19 nt, Human
cucuuaagaagacugcauu

SEQ ID NO: 1495201 - RNA, 19 nt, Human
cucugaaggguaauuauau

SEQ ID NO: 1495202 - RNA, 21 nt, Human
cucugcaggucccuaauaaag

SEQ ID NO: 1495203 - RNA, 22 nt, Human
cucugcaggucccuaauaaagc

SEQ ID NO: 1495204 - RNA, 19 nt, Human
cucugcaggucccuaauaa

SEQ ID NO: 1495205 - RNA, 20 nt, Human
cucugcaggucccuaauaaa

SEQ ID NO: 1495206 - RNA, 15 nt, Human
cucugauacagaaaa

SEQ ID NO: 1495207 - RNA, 10 nt, Human
cucuucugaa

SEQ ID NO: 1495208 - RNA, 16 nt, Human
cucuucugaauaaagc

SEQ ID NO: 1495209 - RNA, 19 nt, Human
cucuucugaauaaagcaau

SEQ ID NO: 1495210 - RNA, 20 nt, Human
cucuucugaauaaagcaauu

SEQ ID NO: 1495211 - RNA, 20 nt, Human
cugaaauaaacgucuuaaau

SEQ ID NO: 1495212 - RNA, 12 nt, Human
cugaacuuugcu

SEQ ID NO: 1495213 - RNA, 13 nt, Human
cugaacuuugcug

SEQ ID NO: 1495214 - RNA, 14 nt, Human
cugaacuuugcuga

SEQ ID NO: 1495215 - RNA, 21 nt, Human
cugaacuuugcugagccugua

SEQ ID NO: 1495216 - RNA, 14 nt, Human
cugaagaagauggu

SEQ ID NO: 1495217 - RNA, 13 nt, Human
cugaauaaagcaa

SEQ ID NO: 1495218 - RNA, 14 nt, Human
cugaauaaagcaau

SEQ ID NO: 1495219 - RNA, 15 nt, Human
cugaauaaagcaauu

SEQ ID NO: 1495220 - RNA, 12 nt, Human
cugaauuauuuu

SEQ ID NO: 1495221 - RNA, 15 nt, Human
cugaauuaugaaacu

SEQ ID NO: 1495222 - RNA, 14 nt, Human
cugaauuaugaaac

SEQ ID NO: 1495223 - RNA, 13 nt, Human
cugaauuaugaaa

SEQ ID NO: 1495224 - RNA, 13 nt, Human
cugaauuucccuc

SEQ ID NO: 1495225 - RNA, 16 nt, Human
cugaauuaugaaacuu

SEQ ID NO: 1495226 - RNA, 13 nt, Human
cugcauccagccu

SEQ ID NO: 1495227 - RNA, 23 nt, Human
cugcaugcgagugcucauuucag

SEQ ID NO: 1495228 - RNA, 14 nt, Human
cugccaccuccugc

SEQ ID NO: 1495229 - RNA, 16 nt, Human
cugccaccuccugccu

SEQ ID NO: 1495230 - RNA, 19 nt, Human
cugccaccuccugccucag

SEQ ID NO: 1495231 - RNA, 17 nt, Human
cugccaccugucugucu

SEQ ID NO: 1495232 - RNA, 11 nt, Human
cugccaccugu

SEQ ID NO: 1495233 - RNA, 12 nt, Human
cugccaccuguc

SEQ ID NO: 1495234 - RNA, 13 nt, Human
cugccaccugucu

SEQ ID NO: 1495235 - RNA, 14 nt, Human
cugccaccugucug

SEQ ID NO: 1495236 - RNA, 15 nt, Human
cugccaccugucugu

SEQ ID NO: 1495237 - RNA, 16 nt, Human
cugccaccugucuguc

SEQ ID NO: 1495238 - RNA, 18 nt, Human
cugccaccugucugucug

SEQ ID NO: 1495239 - RNA, 13 nt, Human
cugccuauuuuaa

SEQ ID NO: 1495240 - RNA, 15 nt, Human
cugccucucugcagg

SEQ ID NO: 1495241 - RNA, 16 nt, Human
cugccucucugcaggu

SEQ ID NO: 1495242 - RNA, 17 nt, Human
cugccucucugcagguc

SEQ ID NO: 1495243 - RNA, 18 nt, Human
cugccucucugcaggucc

SEQ ID NO: 1495244 - RNA, 23 nt, Human
cugcggaggaaggaggacccagg

SEQ ID NO: 1495245 - RNA, 19 nt, Human
cugccucucugcagguccc

SEQ ID NO: 1495246 - RNA, 22 nt, Human
cugccuggacuuggccccugcc

SEQ ID NO: 1495247 - RNA, 23 nt, Human
cugccuggacuuggccccugcca

SEQ ID NO: 1495248 - RNA, 12 nt, Human
cugaggcugagg

SEQ ID NO: 1495249 - RNA, 14 nt, Human
cugaggcugaggca

SEQ ID NO: 1495250 - RNA, 22 nt, Human
cugauacagaaaaguugaauuu

SEQ ID NO: 1495251 - RNA, 20 nt, Human
cugggccccugccucucugc

SEQ ID NO: 1495252 - RNA, 23 nt, Human
cugggccccugccucucugcagg

SEQ ID NO: 1495253 - RNA, 13 nt, Human
cugggucgcccug

SEQ ID NO: 1495254 - RNA, 15 nt, Human
cugggucgcccugga

SEQ ID NO: 1495255 - RNA, 16 nt, Human
cugggucgcccuggac

SEQ ID NO: 1495256 - RNA, 18 nt, Human
cugguaugaacuugagga

SEQ ID NO: 1495257 - RNA, 20 nt, Human
cugguaugaacuugaggaca

SEQ ID NO: 1495258 - RNA, 21 nt, Human
cugguaugaacuugaggacac

SEQ ID NO: 1495259 - RNA, 22 nt, Human
cugguaugaacuugaggacaca

SEQ ID NO: 1495260 - RNA, 16 nt, Human
cugggggccucuucug

SEQ ID NO: 1495261 - RNA, 23 nt, Human
cugguaugaacuugaggacacau

SEQ ID NO: 1495262 - RNA, 14 nt, Human
cugucugucugucc

SEQ ID NO: 1495263 - RNA, 15 nt, Human
cugucugucuguccc

SEQ ID NO: 1495264 - RNA, 16 nt, Human
cugucugucuguccca

SEQ ID NO: 1495265 - RNA, 17 nt, Human
cugucugucugucccaa

SEQ ID NO: 1495266 - RNA, 14 nt, Human
cugucugucugucu

SEQ ID NO: 1495267 - RNA, 15 nt, Human
cugucugucugucug

SEQ ID NO: 1495268 - RNA, 21 nt, Human
cugucuuuuuucuaaaguaaa

SEQ ID NO: 1495269 - RNA, 14 nt, Human
cuguggaucaaauc

SEQ ID NO: 1495270 - RNA, 24 nt, Human
cuguggaucaaauccagccugcug

SEQ ID NO: 1495271 - RNA, 18 nt, Human
cuguggaacauaaaaagg

SEQ ID NO: 1495272 - RNA, 21 nt, Human
cuguggaacauaaaaaggaca

SEQ ID NO: 1495273 - RNA, 18 nt, Human
cugugugacucaaaccaa

SEQ ID NO: 1495274 - RNA, 14 nt, Human
cugugugcucagga

SEQ ID NO: 1495275 - RNA, 15 nt, Human
cuguuuuauaauuuu

SEQ ID NO: 1495276 - RNA, 14 nt, Human
cuguuuuauaauuu

SEQ ID NO: 1495277 - RNA, 21 nt, Human
cuguugccaggcuggagugca

SEQ ID NO: 1495278 - RNA, 16 nt, Human
cuuagaauacaguuuu

SEQ ID NO: 1495279 - RNA, 13 nt, Human
cuuaauucaaaua

SEQ ID NO: 1495280 - RNA, 20 nt, Human
cuuaauaaauuguguuuccu

SEQ ID NO: 1495281 - RNA, 23 nt, Human
cuuaagaagacugcauuauauuu

SEQ ID NO: 1495282 - RNA, 17 nt, Human
cuuaaccagaucauugu

SEQ ID NO: 1495283 - RNA, 19 nt, Human
cuuccagauccuggaaauc

SEQ ID NO: 1495284 - RNA, 16 nt, Human
cuucccuaucuuugcc

SEQ ID NO: 1495285 - RNA, 17 nt, Human
cuucccuaucuuugcca

SEQ ID NO: 1495286 - RNA, 18 nt, Human
cuucccuaucuuugccac

SEQ ID NO: 1495287 - RNA, 22 nt, Human
cuucccucuuccuucccugcug

SEQ ID NO: 1495288 - RNA, 22 nt, Human
cuucccuaucuuugccacccuc

SEQ ID NO: 1495289 - RNA, 23 nt, Human
cuucccuaucuuugccacccuca

SEQ ID NO: 1495290 - RNA, 19 nt, Human
cuucccugcugugaaagaa

SEQ ID NO: 1495291 - RNA, 23 nt, Human
cuucccuggaaaccuuccaccca

SEQ ID NO: 1495292 - RNA, 22 nt, Human
cuucccuggaaaccuuccaccc

SEQ ID NO: 1495293 - RNA, 17 nt, Human
cuucaaauccuugaaga

SEQ ID NO: 1495294 - RNA, 14 nt, Human
cuucagcacuuuag

SEQ ID NO: 1495295 - RNA, 15 nt, Human
cuucagcacuuuaga

SEQ ID NO: 1495296 - RNA, 16 nt, Human
cuucagcacuuuagaa

SEQ ID NO: 1495297 - RNA, 16 nt, Human
cuucagcgguuuauau

SEQ ID NO: 1495298 - RNA, 13 nt, Human
cuucagucucuau

SEQ ID NO: 1495299 - RNA, 17 nt, Human
cuucagucucuauacca

SEQ ID NO: 1495300 - RNA, 21 nt, Human
cuucagucucuauaccaauaa

SEQ ID NO: 1495301 - RNA, 23 nt, Human
cuucagucucuauaccaauaaag

SEQ ID NO: 1495302 - RNA, 22 nt, Human
cuucagucucuauaccaauaaa

SEQ ID NO: 1495303 - RNA, 18 nt, Human
cuuugcugagccuguaaa

SEQ ID NO: 1495304 - RNA, 16 nt, Human
cuuuggcugcaugcga

SEQ ID NO: 1495305 - RNA, 20 nt, Human
cuuuuacguccaucucuugu

SEQ ID NO: 1495306 - RNA, 16 nt, Human
gaaacacuuugcauaa

SEQ ID NO: 1495307 - RNA, 20 nt, Human
gaaaaucuuauaauuuaaaa

SEQ ID NO: 1495308 - RNA, 18 nt, Human
gaaacacccucacacugg

SEQ ID NO: 1495309 - RNA, 19 nt, Human
gaaacacccucacacuggg

SEQ ID NO: 1495310 - RNA, 22 nt, Human
gaaacacccucacacugggacu

SEQ ID NO: 1495311 - RNA, 19 nt, Human
gaaaaucuuauaauuuaaa

SEQ ID NO: 1495312 - RNA, 12 nt, Human
gaaaauaucacu

SEQ ID NO: 1495313 - RNA, 19 nt, Human
gaaaauaacgauaaaagac

SEQ ID NO: 1495314 - RNA, 22 nt, Human
gaaaacaauaacgauaaaagac

SEQ ID NO: 1495315 - RNA, 22 nt, Human
cuuuuuucucugauacagaaaa

SEQ ID NO: 1495316 - RNA, 20 nt, Human
cuuuuuucucugauacagaa

SEQ ID NO: 1495317 - RNA, 14 nt, Human
cuuuuuucuaaagu

SEQ ID NO: 1495318 - RNA, 19 nt, Human
cuuguaaaggaauuuaaaa

SEQ ID NO: 1495319 - RNA, 16 nt, Human
cuuuagaauaugccuu

SEQ ID NO: 1495320 - RNA, 21 nt, Human
cuuuauuuucuauaauuuaaa

SEQ ID NO: 1495321 - RNA, 13 nt, Human
cuuuccacagaag

SEQ ID NO: 1495322 - RNA, 21 nt, Human
gaagccuuggggcugaugcag

SEQ ID NO: 1495323 - RNA, 18 nt, Human
gaagcuuuuaugugaaac

SEQ ID NO: 1495324 - RNA, 19 nt, Human
gaagccuccuuagaaaaaa

SEQ ID NO: 1495325 - RNA, 17 nt, Human
gaagacugcauuauauu

SEQ ID NO: 1495326 - RNA, 22 nt, Human
gaagccacgguguucugugaua

SEQ ID NO: 1495327 - RNA, 14 nt, Human
gaaggcagggagga

SEQ ID NO: 1495328 - RNA, 16 nt, Human
gaaggcagggaggagg

SEQ ID NO: 1495329 - RNA, 17 nt, Human
gaaggcagggaggaggc

SEQ ID NO: 1495330 - RNA, 18 nt, Human
gaaggcagggaggaggca

SEQ ID NO: 1495331 - RNA, 20 nt, Human
gaaggcagggaggaggcaga

SEQ ID NO: 1495332 - RNA, 12 nt, Human
gaauaaaauuuu

SEQ ID NO: 1495333 - RNA, 11 nt, Human
gaauaaagcaa

SEQ ID NO: 1495334 - RNA, 13 nt, Human
gaauaaagcaauu

SEQ ID NO: 1495335 - RNA, 14 nt, Human
gaauacuuuauaaa

SEQ ID NO: 1495336 - RNA, 11 nt, Human
gaaacauuugg

SEQ ID NO: 1495337 - RNA, 18 nt, Human
gaaauugcuuuguauugu

SEQ ID NO: 1495338 - RNA, 16 nt, Human
gaaauauuauguuaaa

SEQ ID NO: 1495339 - RNA, 13 nt, Human
gaaauauuauguu

SEQ ID NO: 1495340 - RNA, 21 nt, Human
gaacuuguaaaggaauuuaaa

SEQ ID NO: 1495341 - RNA, 21 nt, Human
gaagaagcaccaaucaugaau

SEQ ID NO: 1495342 - RNA, 16 nt, Human
gaagaaagaacggaag

SEQ ID NO: 1495343 - RNA, 19 nt, Human
gaagaaagaacggaagaag

SEQ ID NO: 1495344 - RNA, 22 nt, Human
gaacuuguaaaggaauuuaaaa

SEQ ID NO: 1495345 - RNA, 22 nt, Human
gaacuuccagauccuggaaauc

SEQ ID NO: 1495346 - RNA, 13 nt, Human
gaacuugaggaca

SEQ ID NO: 1495347 - RNA, 14 nt, Human
gaacuugaggacac

SEQ ID NO: 1495348 - RNA, 15 nt, Human
gaacuugaggacaca

SEQ ID NO: 1495349 - RNA, 16 nt, Human
gaacuugaggacacau

SEQ ID NO: 1495350 - RNA, 17 nt, Human
gaacuugaggacacaug

SEQ ID NO: 1495351 - RNA, 18 nt, Human
gaacuugaggacacaugu

SEQ ID NO: 1495352 - RNA, 19 nt, Human
gaacuugaggacacauguc

SEQ ID NO: 1495353 - RNA, 21 nt, Human
gaacuugaggacacaugucca

SEQ ID NO: 1495354 - RNA, 22 nt, Human
gaacuagaguuuagcuggaaaa

SEQ ID NO: 1495355 - RNA, 13 nt, Human
gagcacugcucca

SEQ ID NO: 1495356 - RNA, 13 nt, Human
gagaucaggaaga

SEQ ID NO: 1495357 - RNA, 20 nt, Human
gagaucaggaagagaaggag

SEQ ID NO: 1495358 - RNA, 12 nt, Human
gagcuacaaaug

SEQ ID NO: 1495359 - RNA, 13 nt, Human
gagcuacaaaugc

SEQ ID NO: 1495360 - RNA, 18 nt, Human
gagcugauggagaaggaa

SEQ ID NO: 1495361 - RNA, 19 nt, Human
gagcugauggagaaggaag

SEQ ID NO: 1495362 - RNA, 14 nt, Human
gagcuacaaaugca

SEQ ID NO: 1495363 - RNA, 23 nt, Human
gaggcugggaauggaggggcaga

SEQ ID NO: 1495364 - RNA, 18 nt, Human
gaggcuacuguaaggcaa

SEQ ID NO: 1495365 - RNA, 16 nt, Human
gagggagaacaagacc

SEQ ID NO: 1495366 - RNA, 22 nt, Human
gagcuugaaacccguggcgcuu

SEQ ID NO: 1495367 - RNA, 16 nt, Human
gaggaaggaggaccca

SEQ ID NO: 1495368 - RNA, 18 nt, Human
gaggaaggaggacccagg

SEQ ID NO: 1495369 - RNA, 21 nt, Human
gaggaaggaggacccaggaca

SEQ ID NO: 1495370 - RNA, 11 nt, Human
gaggacacaug

SEQ ID NO: 1495371 - RNA, 12 nt, Human
gaggacacaugu

SEQ ID NO: 1495372 - RNA, 13 nt, Human
gaggacacauguc

SEQ ID NO: 1495373 - RNA, 14 nt, Human
gaggacacaugucc

SEQ ID NO: 1495374 - RNA, 16 nt, Human
gaggaggcagagaaga

SEQ ID NO: 1495375 - RNA, 20 nt, Human
gaggaggcagagaagaaaga

SEQ ID NO: 1495376 - RNA, 21 nt, Human
gauauaaguguguguuuuuca

SEQ ID NO: 1495377 - RNA, 21 nt, Human
gaguugaaaaucuuauaauuu

SEQ ID NO: 1495378 - RNA, 15 nt, Human
gagucaaaaauuaaa

SEQ ID NO: 1495379 - RNA, 16 nt, Human
gagucucugaggggcu

SEQ ID NO: 1495380 - RNA, 21 nt, Human
gaugccuggcgggguggggug

SEQ ID NO: 1495381 - RNA, 18 nt, Human
gaugcaguucugaagaag

SEQ ID NO: 1495382 - RNA, 14 nt, Human
gaugacuauggaaa

SEQ ID NO: 1495383 - RNA, 21 nt, Human
gauuaacagguaugaaccacc

SEQ ID NO: 1495384 - RNA, 14 nt, Human
gcacuggccccacc

SEQ ID NO: 1495385 - RNA, 15 nt, Human
gcacuggccccaccc

SEQ ID NO: 1495386 - RNA, 15 nt, Human
gcacuggcgaggaga

SEQ ID NO: 1495387 - RNA, 16 nt, Human
gcacuggcgaggagag

SEQ ID NO: 1495388 - RNA, 18 nt, Human
gcacagccucuuagaugc

SEQ ID NO: 1495389 - RNA, 15 nt, Human
gcacagccucuuaga

SEQ ID NO: 1495390 - RNA, 15 nt, Human
gcaucaucucagcuc

SEQ ID NO: 1495391 - RNA, 22 nt, Human
gcaguggcgugaucucagcuca

SEQ ID NO: 1495392 - RNA, 23 nt, Human
gcaggucccuaauaaagcugugu

SEQ ID NO: 1495393 - RNA, 20 nt, Human
gcaggucccuaauaaagcug

SEQ ID NO: 1495394 - RNA, 21 nt, Human
gcaggucccuaauaaagcugu

SEQ ID NO: 1495395 - RNA, 16 nt, Human
gcaggucccuaauaaa

SEQ ID NO: 1495396 - RNA, 17 nt, Human
gcaggucccuaauaaag

SEQ ID NO: 1495397 - RNA, 18 nt, Human
gcaggucccuaauaaagc

SEQ ID NO: 1495398 - RNA, 19 nt, Human
gcaggucccuaauaaagcu

SEQ ID NO: 1495399 - RNA, 14 nt, Human
gcaggucccuaaua

SEQ ID NO: 1495400 - RNA, 15 nt, Human
gcaggucccuaauaa

SEQ ID NO: 1495401 - RNA, 19 nt, Human
gccagauuuuccugaaaac

SEQ ID NO: 1495402 - RNA, 16 nt, Human
gccaggcuggagugca

SEQ ID NO: 1495403 - RNA, 13 nt, Human
gccaggcuggguc

SEQ ID NO: 1495404 - RNA, 18 nt, Human
gccaggcuggagugcagu

SEQ ID NO: 1495405 - RNA, 19 nt, Human
gccaggcuggagugcagug

SEQ ID NO: 1495406 - RNA, 14 nt, Human
gccagggagcgagu

SEQ ID NO: 1495407 - RNA, 15 nt, Human
gccaugcagaaagca

SEQ ID NO: 1495408 - RNA, 19 nt, Human
gccaugggcacugugggua

SEQ ID NO: 1495409 - RNA, 18 nt, Human
gccacggggacucagccc

SEQ ID NO: 1495410 - RNA, 14 nt, Human
gccaccugucuguc

SEQ ID NO: 1495411 - RNA, 15 nt, Human
gccaccugucugucu

SEQ ID NO: 1495412 - RNA, 10 nt, Human
gccaccuguc

SEQ ID NO: 1495413 - RNA, 12 nt, Human
gccaccugucug

SEQ ID NO: 1495414 - RNA, 13 nt, Human
gccaccugucugu

SEQ ID NO: 1495415 - RNA, 21 nt, Human
gcgccucgccggaucugaggg

SEQ ID NO: 1495416 - RNA, 22 nt, Human
gcgcccuuaacugcauccagcc

SEQ ID NO: 1495417 - RNA, 13 nt, Human
gcuagauguaugu

SEQ ID NO: 1495418 - RNA, 16 nt, Human
gcuagauguauguacu

SEQ ID NO: 1495419 - RNA, 14 nt, Human
gcuagauguaugua

SEQ ID NO: 1495420 - RNA, 17 nt, Human
gcuauauaagacaagaa

SEQ ID NO: 1495421 - RNA, 12 nt, Human
gcuauccaccaa

SEQ ID NO: 1495422 - RNA, 17 nt, Human
gcuaucguaaaauuaag

SEQ ID NO: 1495423 - RNA, 15 nt, Human
gcuaucguaaaauua

SEQ ID NO: 1495424 - RNA, 16 nt, Human
gcuaucguaaaauuaa

SEQ ID NO: 1495425 - RNA, 18 nt, Human
gcucauggacuucugcca

SEQ ID NO: 1495426 - RNA, 14 nt, Human
gcucauuucaggau

SEQ ID NO: 1495427 - RNA, 21 nt, Human
gcuccuauucaacacacacau

SEQ ID NO: 1495428 - RNA, 21 nt, Human
gcuccuccaggguggcagcaa

SEQ ID NO: 1495429 - RNA, 22 nt, Human
gcuccuccaggguggcagcaac

SEQ ID NO: 1495430 - RNA, 21 nt, Human
gcuucucagauuucugaggaa

SEQ ID NO: 1495431 - RNA, 22 nt, Human
gcuucucagauuucugaggaaa

SEQ ID NO: 1495432 - RNA, 19 nt, Human
gcuucuguuuuauaauuuu

SEQ ID NO: 1495433 - RNA, 13 nt, Human
gcuuuuaugugaa

SEQ ID NO: 1495434 - RNA, 15 nt, Human
gcuuuuaugugaaac

SEQ ID NO: 1495435 - RNA, 16 nt, Human
gcuguguggcagucug

SEQ ID NO: 1495436 - RNA, 23 nt, Human
gcuggaaaaguauguuagugcaa

SEQ ID NO: 1495437 - RNA, 21 nt, Human
gcuggaaaaguauguuagugc

SEQ ID NO: 1495438 - RNA, 16 nt, Human
gcuggcauuacaggug

SEQ ID NO: 1495439 - RNA, 16 nt, Human
gcucuccaaaccacuu

SEQ ID NO: 1495440 - RNA, 17 nt, Human
gcucuccaaaccacuuu

SEQ ID NO: 1495441 - RNA, 22 nt, Human
gcucuccaaaccacuuuuugca

SEQ ID NO: 1495442 - RNA, 19 nt, Human
gcucuugaugccuggcggg

SEQ ID NO: 1495443 - RNA, 12 nt, Human
ggcagagccagg

SEQ ID NO: 1495444 - RNA, 13 nt, Human
ggcagagccagga

SEQ ID NO: 1495445 - RNA, 14 nt, Human
ggcagagccaggaa

SEQ ID NO: 1495446 - RNA, 16 nt, Human
ggcagagccaggaaga

SEQ ID NO: 1495447 - RNA, 17 nt, Human
ggcagagccaggaagau

SEQ ID NO: 1495448 - RNA, 18 nt, Human
ggaugaugacuauggaaa

SEQ ID NO: 1495449 - RNA, 12 nt, Human
ggauuauauuau

SEQ ID NO: 1495450 - RNA, 22 nt, Human
ggauuccacucguguguuucua

SEQ ID NO: 1495451 - RNA, 19 nt, Human
gcuuuuaugugaaacaugu

SEQ ID NO: 1495452 - RNA, 20 nt, Human
gcuuuuaugugaaacauguu

SEQ ID NO: 1495453 - RNA, 21 nt, Human
gcuuuuaugugaaacauguuu

SEQ ID NO: 1495454 - RNA, 20 nt, Human
ggacauuugcucauggaauu

SEQ ID NO: 1495455 - RNA, 17 nt, Human
ggacauuugcucaugga

SEQ ID NO: 1495456 - RNA, 19 nt, Human
ggacugaauuaugaaacuu

SEQ ID NO: 1495457 - RNA, 17 nt, Human
ggacugaauuaugaaac

SEQ ID NO: 1495458 - RNA, 14 nt, Human
ggacugagaaauuu

SEQ ID NO: 1495459 - RNA, 12 nt, Human
ggagaaggaagg

SEQ ID NO: 1495460 - RNA, 14 nt, Human
ggagaagaacugaa

SEQ ID NO: 1495461 - RNA, 11 nt, Human
ggagaagaacu

SEQ ID NO: 1495462 - RNA, 18 nt, Human
ggacugagaaauuuauaa

SEQ ID NO: 1495463 - RNA, 16 nt, Human
ggagucaaaaauuaaa

SEQ ID NO: 1495464 - RNA, 12 nt, Human
ggaggggcagag

SEQ ID NO: 1495465 - RNA, 13 nt, Human
ggaggggcagagc

SEQ ID NO: 1495466 - RNA, 15 nt, Human
ggaggggcagagcca

SEQ ID NO: 1495467 - RNA, 16 nt, Human
ggaggggcagagccag

SEQ ID NO: 1495468 - RNA, 15 nt, Human
ggaggacccaggaca

SEQ ID NO: 1495469 - RNA, 14 nt, Human
ggaggacccaggac

SEQ ID NO: 1495470 - RNA, 16 nt, Human
ggaggacccaggacag

SEQ ID NO: 1495471 - RNA, 14 nt, Human
ggaggcagagaaga

SEQ ID NO: 1495472 - RNA, 15 nt, Human
ggaggcagagaagaa

SEQ ID NO: 1495473 - RNA, 17 nt, Human
ggaggcaggaguuucgu

SEQ ID NO: 1495474 - RNA, 19 nt, Human
ggaggcagagaagaaagaa

SEQ ID NO: 1495475 - RNA, 16 nt, Human
ggagcccugggaggcu

SEQ ID NO: 1495476 - RNA, 19 nt, Human
ggagcccugggaggcucug

SEQ ID NO: 1495477 - RNA, 20 nt, Human
ggagcccugggaggcucugg

SEQ ID NO: 1495478 - RNA, 14 nt, Human
ggagcuagaauuug

SEQ ID NO: 1495479 - RNA, 16 nt, Human
ggcucuggagcccacu

SEQ ID NO: 1495480 - RNA, 17 nt, Human
ggcucuggagcccacug

SEQ ID NO: 1495481 - RNA, 19 nt, Human
ggcucuggagcccacugua

SEQ ID NO: 1495482 - RNA, 19 nt, Human
ggccggcuugccacacccc

SEQ ID NO: 1495483 - RNA, 23 nt, Human
ggcucuggagcccacuguacuug

SEQ ID NO: 1495484 - RNA, 18 nt, Human
ggcuggagcuagaauuug

SEQ ID NO: 1495485 - RNA, 20 nt, Human
ggcuggagugcaguggcgcg

SEQ ID NO: 1495486 - RNA, 14 nt, Human
ggcuugccacaccc

SEQ ID NO: 1495487 - RNA, 15 nt, Human
ggcuugccacacccc

SEQ ID NO: 1495488 - RNA, 15 nt, Human
gggacugagaaauuu

SEQ ID NO: 1495489 - RNA, 14 nt, Human
gggaauugaggaca

SEQ ID NO: 1495490 - RNA, 15 nt, Human
gggaggaggcagaga

SEQ ID NO: 1495491 - RNA, 17 nt, Human
ucaggcuagauguaugu

SEQ ID NO: 1495492 - RNA, 13 nt, Human
ucaggcuagaugu

SEQ ID NO: 1495493 - RNA, 19 nt, Human
ucaggagcccugggaggcu

SEQ ID NO: 1495494 - RNA, 18 nt, Human
ucaggagcccugggaggc

SEQ ID NO: 1495495 - RNA, 20 nt, Human
ucaggagcccugggaggcuc

SEQ ID NO: 1495496 - RNA, 23 nt, Human
ucaggagcccugggaggcucugg

SEQ ID NO: 1495497 - RNA, 20 nt, Human
ucagccucccgaguagcugg

SEQ ID NO: 1495498 - RNA, 16 nt, Human
ucagauaugauucaaa

SEQ ID NO: 1495499 - RNA, 15 nt, Human
ucagauaugauucaa

SEQ ID NO: 1495500 - RNA, 23 nt, Human
ucaccccuaaaagaaacccugca

SEQ ID NO: 1495501 - RNA, 20 nt, Human
ucacucuguucauuccucca

SEQ ID NO: 1495502 - RNA, 21 nt, Human
ucacucuguucauuccuccag

SEQ ID NO: 1495503 - RNA, 22 nt, Human
ucacucuguucauuccuccagg

SEQ ID NO: 1495504 - RNA, 20 nt, Human
ucacuuguuuuauuuaaccu

SEQ ID NO: 1495505 - RNA, 19 nt, Human
ucagaaacacccucacacu

SEQ ID NO: 1495506 - RNA, 21 nt, Human
ucagaaacacccucacacugg

SEQ ID NO: 1495507 - RNA, 22 nt, Human
ucagaaacacccucacacuggg

SEQ ID NO: 1495508 - RNA, 21 nt, Human
ucagaguaauccaagcaaaug

SEQ ID NO: 1495509 - RNA, 22 nt, Human
ucagaguaauccaagcaaaugu

SEQ ID NO: 1495510 - RNA, 19 nt, Human
uccacagaagcuccaggua

SEQ ID NO: 1495511 - RNA, 14 nt, Human
uccaggguggcagc

SEQ ID NO: 1495512 - RNA, 15 nt, Human
uccaggguggcagca

SEQ ID NO: 1495513 - RNA, 18 nt, Human
uccaggguggcagcaaca

SEQ ID NO: 1495514 - RNA, 20 nt, Human
uccaggguggcagcaacaau

SEQ ID NO: 1495515 - RNA, 14 nt, Human
ucauagcuaaaaaa

SEQ ID NO: 1495516 - RNA, 16 nt, Human
ucauuuccaagcaagu

SEQ ID NO: 1495517 - RNA, 13 nt, Human
ucauuuccaagca

SEQ ID NO: 1495518 - RNA, 12 nt, Human
ucauugugaaau

SEQ ID NO: 1495519 - RNA, 15 nt, Human
ucauugugaaauuau

SEQ ID NO: 1495520 - RNA, 17 nt, Human
ucauugugaaauuauuc

SEQ ID NO: 1495521 - RNA, 18 nt, Human
ucauugugaaauuauuca

SEQ ID NO: 1495522 - RNA, 16 nt, Human
ucauuccauucuggaa

SEQ ID NO: 1495523 - RNA, 12 nt, Human
ucauuucaggau

SEQ ID NO: 1495524 - RNA, 14 nt, Human
ucauuccauucugg

SEQ ID NO: 1495525 - RNA, 15 nt, Human
ucauuccauucugga

SEQ ID NO: 1495526 - RNA, 19 nt, Human
ucaccagagacuuuagggg

SEQ ID NO: 1495527 - RNA, 21 nt, Human
ucaauaaaauccauacauuug

SEQ ID NO: 1495528 - RNA, 22 nt, Human
ucaaugccccugaauuuaaaua

SEQ ID NO: 1495529 - RNA, 20 nt, Human
ucaaugccccugaauuuaaa

SEQ ID NO: 1495530 - RNA, 18 nt, Human
ucaaugccccugaauuua

SEQ ID NO: 1495531 - RNA, 17 nt, Human
ucaaugccccugaauuu

SEQ ID NO: 1495532 - RNA, 17 nt, Human
uauuuuauguugcauag

SEQ ID NO: 1495533 - RNA, 13 nt, Human
uauuuuuugaaaa

SEQ ID NO: 1495534 - RNA, 15 nt, Human
ucaaauugugugaaa

SEQ ID NO: 1495535 - RNA, 14 nt, Human
ucaaauugugugaa

SEQ ID NO: 1495536 - RNA, 17 nt, Human
ucaaauuguaagcaugc

SEQ ID NO: 1495537 - RNA, 20 nt, Human
ucaaauuguaagcaugcaca

SEQ ID NO: 1495538 - RNA, 15 nt, Human
ucaaauccuugaaga

SEQ ID NO: 1495539 - RNA, 12 nt, Human
ucaaaaauuaaa

SEQ ID NO: 1495540 - RNA, 20 nt, Human
ucaaaaauuaucuauagcua

SEQ ID NO: 1495541 - RNA, 23 nt, Human
ucaaaaauuaaaccggaccaucu

SEQ ID NO: 1495542 - RNA, 21 nt, Human
ucaaauauauucagccuggcu

SEQ ID NO: 1495543 - RNA, 22 nt, Human
ucaaauauauucagccuggcuu

SEQ ID NO: 1495544 - RNA, 23 nt, Human
ucaaauauauucagccuggcuuc

SEQ ID NO: 1495545 - RNA, 20 nt, Human
ucaaaucaaucuguaaaacu

SEQ ID NO: 1495546 - RNA, 16 nt, Human
uauguugcauagaaua

SEQ ID NO: 1495547 - RNA, 12 nt, Human
uauguugcauag

SEQ ID NO: 1495548 - RNA, 17 nt, Human
uauguacuucaugcugu

SEQ ID NO: 1495549 - RNA, 13 nt, Human
uauguacuucaug

SEQ ID NO: 1495550 - RNA, 14 nt, Human
uauuguuuuacaau

SEQ ID NO: 1495551 - RNA, 15 nt, Human
uauuguuuuacaaua

SEQ ID NO: 1495552 - RNA, 17 nt, Human
uauuguuuuacaauagu

SEQ ID NO: 1495553 - RNA, 20 nt, Human
uauuguuuuacaauaguucu

SEQ ID NO: 1495554 - RNA, 22 nt, Human
uauuguuuuacaauaguucugu

SEQ ID NO: 1495555 - RNA, 24 nt, Human
uauuuauaaaaauaaaaaacacug

SEQ ID NO: 1495556 - RNA, 22 nt, Human
uauuuaguuguaaaccaaguga

SEQ ID NO: 1495557 - RNA, 14 nt, Human
uauuacaaugauca

SEQ ID NO: 1495558 - RNA, 15 nt, Human
uauuacaaugaucac

SEQ ID NO: 1495559 - RNA, 17 nt, Human
uauucguuaucuaauag

SEQ ID NO: 1495560 - RNA, 16 nt, Human
ucccucucucauaccc

SEQ ID NO: 1495561 - RNA, 20 nt, Human
ucccuggaaaccuuccaccc

SEQ ID NO: 1495562 - RNA, 22 nt, Human
ucccuggaaaccuuccacccag

SEQ ID NO: 1495563 - RNA, 23 nt, Human
ucccuggaaaccuuccacccagu

SEQ ID NO: 1495564 - RNA, 21 nt, Human
ucccuucaucuggaaccauca

SEQ ID NO: 1495565 - RNA, 17 nt, Human
ucccuucaugcauggaa

SEQ ID NO: 1495566 - RNA, 18 nt, Human
ucccuucaugcauggaaa

SEQ ID NO: 1495567 - RNA, 16 nt, Human
ucccuugaugaagaag

SEQ ID NO: 1495568 - RNA, 15 nt, Human
ucccuugaugaagaa

SEQ ID NO: 1495569 - RNA, 15 nt, Human
ucccuaauaaagcug

SEQ ID NO: 1495570 - RNA, 19 nt, Human
ucccuaucuuugccacccu

SEQ ID NO: 1495571 - RNA, 16 nt, Human
ucccuaauaaagcugu

SEQ ID NO: 1495572 - RNA, 11 nt, Human
ucccuccuggg

SEQ ID NO: 1495573 - RNA, 19 nt, Human
ucccuccugggaaugaagc

SEQ ID NO: 1495574 - RNA, 14 nt, Human
uccugccucagccu

SEQ ID NO: 1495575 - RNA, 17 nt, Human
uccugccucagccuccc

SEQ ID NO: 1495576 - RNA, 16 nt, Human
uccuuggccaugcaga

SEQ ID NO: 1495577 - RNA, 18 nt, Human
ucuaugaaauauuauguu

SEQ ID NO: 1495578 - RNA, 17 nt, Human
ucuaugaaauauuaugu

SEQ ID NO: 1495579 - RNA, 14 nt, Human
ucuaugaaauauua

SEQ ID NO: 1495580 - RNA, 19 nt, Human
ucuagugagcagucaggaa

SEQ ID NO: 1495581 - RNA, 22 nt, Human
ucuagugagcagucaggaaaga

SEQ ID NO: 1495582 - RNA, 16 nt, Human
ucuaggacugaauuau

SEQ ID NO: 1495583 - RNA, 23 nt, Human
ucuaggacugaauuaugaaacuu

SEQ ID NO: 1495584 - RNA, 22 nt, Human
ucgugggacagucaccucaugg

SEQ ID NO: 1495585 - RNA, 21 nt, Human
ucguggaacaguuaccucugc

SEQ ID NO: 1495586 - RNA, 16 nt, Human
ucuaauagggcaauua

SEQ ID NO: 1495587 - RNA, 22 nt, Human
ucuaauagggcaauuaauuccu

SEQ ID NO: 1495588 - RNA, 13 nt, Human
ucguuaauuugua

SEQ ID NO: 1495589 - RNA, 21 nt, Human
ucguguguuucuauuuuuuga

SEQ ID NO: 1495590 - RNA, 14 nt, Human
ucugaaaauugaug

SEQ ID NO: 1495591 - RNA, 22 nt, Human
ucugaaaauugaugggauuugg

SEQ ID NO: 1495592 - RNA, 15 nt, Human
ucugacauaaguauu

SEQ ID NO: 1495593 - RNA, 13 nt, Human
ucugacauaaucc

SEQ ID NO: 1495594 - RNA, 19 nt, Human
ucugacauaauccaguaaa

SEQ ID NO: 1495595 - RNA, 23 nt, Human
ucugacauaauccaguaaaauaa

SEQ ID NO: 1495596 - RNA, 20 nt, Human
ucugaaauuuccugggagcu

SEQ ID NO: 1495597 - RNA, 18 nt, Human
ucugaaauuuccugggag

SEQ ID NO: 1495598 - RNA, 17 nt, Human
ucugaaauuuccuggga

SEQ ID NO: 1495599 - RNA, 15 nt, Human
ucugcaacucugaag

SEQ ID NO: 1495600 - RNA, 14 nt, Human
ucugcaacucugaa

SEQ ID NO: 1495601 - RNA, 19 nt, Human
ucuccugccucagccuccc

SEQ ID NO: 1495602 - RNA, 21 nt, Human
ucuccuggaagugcuaauuuu

SEQ ID NO: 1495603 - RNA, 18 nt, Human
ucucaauauucaauaaag

SEQ ID NO: 1495604 - RNA, 17 nt, Human
ucucaauauucaauaaa

SEQ ID NO: 1495605 - RNA, 20 nt, Human
ucucaauauucaauaaagcu

SEQ ID NO: 1495606 - RNA, 15 nt, Human
ucucugauacagaaa

SEQ ID NO: 1495607 - RNA, 21 nt, Human
ucucugaggggcuaccaggaa

SEQ ID NO: 1495608 - RNA, 22 nt, Human
ucucugaggggcuaccaggaaa

SEQ ID NO: 1495609 - RNA, 13 nt, Human
ucucugcaggucc

SEQ ID NO: 1495610 - RNA, 14 nt, Human
ucucugcagguccc

SEQ ID NO: 1495611 - RNA, 15 nt, Human
ucucugcaggucccu

SEQ ID NO: 1495612 - RNA, 16 nt, Human
ucucugcaggucccua

SEQ ID NO: 1495613 - RNA, 18 nt, Human
ucucugcaggucccuaau

SEQ ID NO: 1495614 - RNA, 23 nt, Human
ucucugaggggcuaccaggaaag

SEQ ID NO: 1495615 - RNA, 22 nt, Human
ucuuaggguuaugauuaaguaa

SEQ ID NO: 1495616 - RNA, 13 nt, Human
ucuugaaaaaugc

SEQ ID NO: 1495617 - RNA, 14 nt, Human
ucuuccuucccugc

SEQ ID NO: 1495618 - RNA, 15 nt, Human
ucuuccuucccugcu

SEQ ID NO: 1495619 - RNA, 17 nt, Human
ucuuccuucccugcugu

SEQ ID NO: 1495620 - RNA, 14 nt, Human
ucugucugucccaa

SEQ ID NO: 1495621 - RNA, 15 nt, Human
ucugucugucccaaa

SEQ ID NO: 1495622 - RNA, 16 nt, Human
ucugucugucccaaag

SEQ ID NO: 1495623 - RNA, 15 nt, Human
ucugucugucugucc

SEQ ID NO: 1495624 - RNA, 18 nt, Human
ucugucugucugucccaa

SEQ ID NO: 1495625 - RNA, 16 nt, Human
ucuuaaccagaucauu

SEQ ID NO: 1495626 - RNA, 17 nt, Human
ucuuaaccagaucauug

SEQ ID NO: 1495627 - RNA, 18 nt, Human
ucuuaagaagacugcauu

SEQ ID NO: 1495628 - RNA, 12 nt, Human
ucuuaagaagac

SEQ ID NO: 1495629 - RNA, 22 nt, Human
ucuuaaccagaucauugugaaa

SEQ ID NO: 1495630 - RNA, 22 nt, Human
ucugucucuggauuauauuaug

SEQ ID NO: 1495631 - RNA, 14 nt, Human
ugcacaguaaaaau

SEQ ID NO: 1495632 - RNA, 13 nt, Human
ugcaaccuccacc

SEQ ID NO: 1495633 - RNA, 15 nt, Human
ugcaaccuccaccuc

SEQ ID NO: 1495634 - RNA, 14 nt, Human
ugcaaccucugccu

SEQ ID NO: 1495635 - RNA, 22 nt, Human
ugcaacucugaaggguaauuau

SEQ ID NO: 1495636 - RNA, 18 nt, Human
ugcaacuuuguauaaaag

SEQ ID NO: 1495637 - RNA, 14 nt, Human
ugcaaaaaggguca

SEQ ID NO: 1495638 - RNA, 16 nt, Human
ugccucccuucaugca

SEQ ID NO: 1495639 - RNA, 14 nt, Human
ugccucuucccucu

SEQ ID NO: 1495640 - RNA, 14 nt, Human
ugcccugcccugcc

SEQ ID NO: 1495641 - RNA, 15 nt, Human
ugcccugcccugcca

SEQ ID NO: 1495642 - RNA, 18 nt, Human
ugcccugcccugccaccu

SEQ ID NO: 1495643 - RNA, 14 nt, Human
ugcauuauauuuau

SEQ ID NO: 1495644 - RNA, 18 nt, Human
ugaccucgugauccaccc

SEQ ID NO: 1495645 - RNA, 22 nt, Human
ugacccuccaccgcagaaggaa

SEQ ID NO: 1495646 - RNA, 23 nt, Human
ugacccuccaccgcagaaggaag

SEQ ID NO: 1495647 - RNA, 20 nt, Human
ugaccucaagugaucugccc

SEQ ID NO: 1495648 - RNA, 16 nt, Human
ucuugaauaauguaag

SEQ ID NO: 1495649 - RNA, 12 nt, Human
ugacucuuaaga

SEQ ID NO: 1495650 - RNA, 13 nt, Human
ugacucuuaagaa

SEQ ID NO: 1495651 - RNA, 17 nt, Human
ugagaaaucuaaaaaac

SEQ ID NO: 1495652 - RNA, 13 nt, Human
ugagaaaucuaaa

SEQ ID NO: 1495653 - RNA, 20 nt, Human
ugagcagucaggaaagagaa

SEQ ID NO: 1495654 - RNA, 17 nt, Human
ugagcagucaggaaaga

SEQ ID NO: 1495655 - RNA, 19 nt, Human
ugaucucagcucacugcaa

SEQ ID NO: 1495656 - RNA, 18 nt, Human
ugaucucagcucacugca

SEQ ID NO: 1495657 - RNA, 17 nt, Human
ugauauaaguguguguu

SEQ ID NO: 1495658 - RNA, 23 nt, Human
ugauauaaguguguguuuuucau

SEQ ID NO: 1495659 - RNA, 13 nt, Human
ugauguacaugua

SEQ ID NO: 1495660 - RNA, 23 nt, Human
uggaggggcagagccaggaagau

SEQ ID NO: 1495661 - RNA, 13 nt, Human
uggaggggcagag

SEQ ID NO: 1495662 - RNA, 14 nt, Human
uggaggggcagagc

SEQ ID NO: 1495663 - RNA, 16 nt, Human
uggaggggcagagcca

SEQ ID NO: 1495664 - RNA, 18 nt, Human
uggaggggcagagccagg

SEQ ID NO: 1495665 - RNA, 21 nt, Human
uggaggggcagagccaggaag

SEQ ID NO: 1495666 - RNA, 14 nt, Human
uggagaugaggcca

SEQ ID NO: 1495667 - RNA, 15 nt, Human
uggagaugaggccag

SEQ ID NO: 1495668 - RNA, 16 nt, Human
uggagaugaggccaga

SEQ ID NO: 1495669 - RNA, 17 nt, Human
uggagaugaggccagac

SEQ ID NO: 1495670 - RNA, 19 nt, Human
uggaucaaauccagccugc

SEQ ID NO: 1495671 - RNA, 15 nt, Human
ugcuuaauaaauugu

SEQ ID NO: 1495672 - RNA, 16 nt, Human
ugcuuaauucaaauaa

SEQ ID NO: 1495673 - RNA, 17 nt, Human
ugcuuaauucaaauaau

SEQ ID NO: 1495674 - RNA, 18 nt, Human
ugcuuaauucaaauaaua

SEQ ID NO: 1495675 - RNA, 20 nt, Human
ugcuuaauucaaauaauaau

SEQ ID NO: 1495676 - RNA, 16 nt, Human
ugcuucccuuuccuga

SEQ ID NO: 1495677 - RNA, 21 nt, Human
ugcuucucagauuucugagga

SEQ ID NO: 1495678 - RNA, 22 nt, Human
ugcuucucagauuucugaggaa

SEQ ID NO: 1495679 - RNA, 17 nt, Human
ugcuucuguuuuauaau

SEQ ID NO: 1495680 - RNA, 13 nt, Human
ugcuucuccagcc

SEQ ID NO: 1495681 - RNA, 19 nt, Human
uggaaaccuuccacccagu

SEQ ID NO: 1495682 - RNA, 16 nt, Human
uggaaaccuuccaccc

SEQ ID NO: 1495683 - RNA, 22 nt, Human
uggaaaaguauguuagugcaaa

SEQ ID NO: 1495684 - RNA, 18 nt, Human
uggaacauaaaaaggaca

SEQ ID NO: 1495685 - RNA, 20 nt, Human
uggaacauaaaaaggacauc

SEQ ID NO: 1495686 - RNA, 22 nt, Human
ugcuucuguuuuauaauuuugu

SEQ ID NO: 1495687 - RNA, 17 nt, Human
ugcuuuggaaaacccag

SEQ ID NO: 1495688 - RNA, 14 nt, Human
ugggaaugaagcaa

SEQ ID NO: 1495689 - RNA, 17 nt, Human
uggggccaggcuggguc

SEQ ID NO: 1495690 - RNA, 20 nt, Human
uggggccaggcugggucgcc

SEQ ID NO: 1495691 - RNA, 13 nt, Human
uggggggggugcu

SEQ ID NO: 1495692 - RNA, 17 nt, Human
ugggcagcaauuuaaau

SEQ ID NO: 1495693 - RNA, 12 nt, Human
ugggcagcaauu

SEQ ID NO: 1495694 - RNA, 18 nt, Human
ugggcagcaauuuaaaug

SEQ ID NO: 1495695 - RNA, 19 nt, Human
ugggcagcaauuuaaaugu

SEQ ID NO: 1495696 - RNA, 21 nt, Human
ugggcagcaauuuaaauguua

SEQ ID NO: 1495697 - RNA, 22 nt, Human
uguaguguuggagaagaacuga

SEQ ID NO: 1495698 - RNA, 13 nt, Human
uguauaaaauaau

SEQ ID NO: 1495699 - RNA, 14 nt, Human
uguauaaaauaauu

SEQ ID NO: 1495700 - RNA, 21 nt, Human
uguaguguuggagaagaacug

SEQ ID NO: 1495701 - RNA, 20 nt, Human
uguaguguuggagaagaacu

SEQ ID NO: 1495702 - RNA, 19 nt, Human
uguauuuuaaaagaaugau

SEQ ID NO: 1495703 - RNA, 18 nt, Human
uguauuuuaaaagaauga

SEQ ID NO: 1495704 - RNA, 20 nt, Human
ugucuauggauuugccuucu

SEQ ID NO: 1495705 - RNA, 20 nt, Human
ugucugagacagaaucucag

SEQ ID NO: 1495706 - RNA, 14 nt, Human
ugucugucuguccc

SEQ ID NO: 1495707 - RNA, 15 nt, Human
ugucugucuguccca

SEQ ID NO: 1495708 - RNA, 15 nt, Human
ugucugucugucugu

SEQ ID NO: 1495709 - RNA, 16 nt, Human
ugucugucugucuguc

SEQ ID NO: 1495710 - RNA, 22 nt, Human
ugucuacacuaagagagaauga

SEQ ID NO: 1495711 - RNA, 17 nt, Human
ugucuacacuaagagag

SEQ ID NO: 1495712 - RNA, 14 nt, Human
uggguagacacaca

SEQ ID NO: 1495713 - RNA, 14 nt, Human
uggugguagagaag

SEQ ID NO: 1495714 - RNA, 20 nt, Human
ugguucccuugaugaagaag

SEQ ID NO: 1495715 - RNA, 17 nt, Human
ugguucccuugaugaag

SEQ ID NO: 1495716 - RNA, 16 nt, Human
ugguucccuugaugaa

SEQ ID NO: 1495717 - RNA, 20 nt, Human
ugguuguacauauaagugau

SEQ ID NO: 1495718 - RNA, 11 nt, Human
uguaaugaaaa

SEQ ID NO: 1495719 - RNA, 12 nt, Human
uguaaugaaaac

SEQ ID NO: 1495720 - RNA, 13 nt, Human
uguaaugaaaacc

SEQ ID NO: 1495721 - RNA, 17 nt, Human
uguaaugaaaaccacau

SEQ ID NO: 1495722 - RNA, 15 nt, Human
uugucuagugaaacu

SEQ ID NO: 1495723 - RNA, 13 nt, Human
uugugaaauuauu

SEQ ID NO: 1495724 - RNA, 14 nt, Human
uuguauuacaaauc

SEQ ID NO: 1495725 - RNA, 18 nt, Human
uuguguuuugcaagccag

SEQ ID NO: 1495726 - RNA, 18 nt, Human
uuguuaaucuucaauagu

SEQ ID NO: 1495727 - RNA, 20 nt, Human
uuguguugaagagguuuuaa

SEQ ID NO: 1495728 - RNA, 13 nt, Human
uuuaauaauguuu

SEQ ID NO: 1495729 - RNA, 20 nt, Human
uuuaagacgaaacauuuguu

SEQ ID NO: 1495730 - RNA, 19 nt, Human
uuuaacucuauaauguguu

SEQ ID NO: 1495731 - RNA, 21 nt, Human
uuuauaaaaauaaaaaacacu

SEQ ID NO: 1495732 - RNA, 23 nt, Human
uuuauaaaaauaaaaaacacugg

SEQ ID NO: 1495733 - RNA, 21 nt, Human
uuuaauagguuuggacaaaau

SEQ ID NO: 1495734 - RNA, 14 nt, Human
uuuaauaauguuuc

SEQ ID NO: 1495735 - RNA, 13 nt, Human
uuuaccacuugug

SEQ ID NO: 1495736 - RNA, 22 nt, Human
uuuauaauuuugugaagcaaaa

SEQ ID NO: 1495737 - RNA, 23 nt, Human
uucaguuauuauauuuacaaaug

SEQ ID NO: 1495738 - RNA, 20 nt, Human
uucauaaauaaaguuuguug

SEQ ID NO: 1495739 - RNA, 19 nt, Human
uuccagauccuggaaauca

SEQ ID NO: 1495740 - RNA, 18 nt, Human
uuccagagcacugcucca

SEQ ID NO: 1495741 - RNA, 18 nt, Human
uuccagauccuggaaauc

SEQ ID NO: 1495742 - RNA, 20 nt, Human
uucaugcuguucaugaaaga

SEQ ID NO: 1495743 - RNA, 12 nt, Human
uucaucuggaac

SEQ ID NO: 1495744 - RNA, 23 nt, Human
uucaucuggaaccaucagaaaca

SEQ ID NO: 1495745 - RNA, 17 nt, Human
uucaucuggaaccauca

SEQ ID NO: 1495746 - RNA, 14 nt, Human
uucaugcauggaaa

SEQ ID NO: 1495747 - RNA, 15 nt, Human
uucaugcauggaaau

SEQ ID NO: 1495748 - RNA, 16 nt, Human
uucaugcauggaaauu

SEQ ID NO: 1495749 - RNA, 20 nt, Human
uuauuuuaauaauguuucaa

SEQ ID NO: 1495750 - RNA, 19 nt, Human
uuauuuuaauaauguuuca

SEQ ID NO: 1495751 - RNA, 18 nt, Human
uucaaauguauuacagug

SEQ ID NO: 1495752 - RNA, 18 nt, Human
uuaucuauagcuaaguac

SEQ ID NO: 1495753 - RNA, 16 nt, Human
uuaucuugaauaaugu

SEQ ID NO: 1495754 - RNA, 14 nt, Human
uuaucuugaauaau

SEQ ID NO: 1495755 - RNA, 15 nt, Human
uuauauuugaaauau

SEQ ID NO: 1495756 - RNA, 13 nt, Human
uuauauuugaaau

SEQ ID NO: 1495757 - RNA, 12 nt, Human
uuauauuugaaa

SEQ ID NO: 1495758 - RNA, 20 nt, Human
uuauauuuauuacuguaaga

SEQ ID NO: 1495759 - RNA, 16 nt, Human
uuauauuuacaaaugg

SEQ ID NO: 1495760 - RNA, 17 nt, Human
uuauguugcauagaaua

SEQ ID NO: 1495761 - RNA, 18 nt, Human
uuauaauaaaggacugua

SEQ ID NO: 1495762 - RNA, 19 nt, Human
uuauaauaaaggacuguaa

SEQ ID NO: 1495763 - RNA, 21 nt, Human
uuauaauaaaggacuguaauc

SEQ ID NO: 1495764 - RNA, 11 nt, Human
uuauaaucuuu

SEQ ID NO: 1495765 - RNA, 15 nt, Human
uuauaauuuugugaa

SEQ ID NO: 1495766 - RNA, 14 nt, Human
uuauaauuuuguga

SEQ ID NO: 1495767 - RNA, 17 nt, Human
uuauaauuuuaaauguu

SEQ ID NO: 1495768 - RNA, 21 nt, Human
uuauaauuuuaaauguuuuuu

SEQ ID NO: 1495769 - RNA, 12 nt, Human
uuauaauuuaaa

SEQ ID NO: 1495770 - RNA, 12 nt, Human
uuauaauuuuaa

SEQ ID NO: 1495771 - RNA, 23 nt, Human
uuauaucuauauuuuacauaaau

SEQ ID NO: 1495772 - RNA, 19 nt, Human
uuauaucuauauuuuacau

SEQ ID NO: 1495773 - RNA, 18 nt, Human
uuauaauuuugugaagca

SEQ ID NO: 1495774 - RNA, 17 nt, Human
uuauaauuuugugaagc

SEQ ID NO: 1495775 - RNA, 16 nt, Human
uuauaauuuugugaag

SEQ ID NO: 1495776 - RNA, 14 nt, Human
uuauauguaccgua

SEQ ID NO: 1495777 - RNA, 16 nt, Human
uuauauguaccguagg

SEQ ID NO: 1495778 - RNA, 16 nt, Human
uuauauuaugaagcuu

SEQ ID NO: 1495779 - RNA, 23 nt, Human
uugaugaagaaguugauaugccu

SEQ ID NO: 1495780 - RNA, 14 nt, Human
uugaugaagaaguu

SEQ ID NO: 1495781 - RNA, 12 nt, Human
uugaauuuuaca

SEQ ID NO: 1495782 - RNA, 15 nt, Human
uucuuuaaaauuaca

SEQ ID NO: 1495783 - RNA, 18 nt, Human
uucuuuccacagaagcuc

SEQ ID NO: 1495784 - RNA, 15 nt, Human
uugaaaaaugcaugu

SEQ ID NO: 1495785 - RNA, 17 nt, Human
uugaaaagcagacauuu

SEQ ID NO: 1495786 - RNA, 15 nt, Human
uugaaaagcagacau

SEQ ID NO: 1495787 - RNA, 21 nt, Human
uucuaugaaauauuauguuaa

SEQ ID NO: 1495788 - RNA, 14 nt, Human
uucuaugaaauauu

SEQ ID NO: 1495789 - RNA, 19 nt, Human
uucuccagccucagccucc

SEQ ID NO: 1495790 - RNA, 19 nt, Human
uucuaccaaggucuucuua

SEQ ID NO: 1495791 - RNA, 13 nt, Human
uucguuaucuaau

SEQ ID NO: 1495792 - RNA, 20 nt, Human
uucuacugcucuccuccacc

SEQ ID NO: 1495793 - RNA, 13 nt, Human
uucuacugcucuc

SEQ ID NO: 1495794 - RNA, 14 nt, Human
uucuauagcuuuuc

SEQ ID NO: 1495795 - RNA, 18 nt, Human
uucggugagcuacaaaug

SEQ ID NO: 1495796 - RNA, 22 nt, Human
uuccugagucccaucccugcgu

SEQ ID NO: 1495797 - RNA, 14 nt, Human
uuuuuuuguuauua

SEQ ID NO: 1495798 - RNA, 12 nt, Human
uuuuuuuacauu

SEQ ID NO: 1495799 - RNA, 11 nt, Human
uuuuuuacauu

SEQ ID NO: 1495800 - RNA, 12 nt, Human
uuuuuuacauuu

SEQ ID NO: 1495801 - RNA, 15 nt, Human
uuuuuaaauguauac

SEQ ID NO: 1495802 - RNA, 23 nt, Human
uuuuuaaauguauacuauaguac

SEQ ID NO: 1495803 - RNA, 13 nt, Human
uuuuuaaucuuua

SEQ ID NO: 1495804 - RNA, 17 nt, Human
uuuguauaaaauaauuu

SEQ ID NO: 1495805 - RNA, 19 nt, Human
uuuguauaaaauaauuuuu

SEQ ID NO: 1495806 - RNA, 18 nt, Human
uuuguauaaaauaauuuu

SEQ ID NO: 1495807 - RNA, 15 nt, Human
uuuggucaacacuaa

SEQ ID NO: 1495808 - RNA, 14 nt, Human
uuuguauuguauau

SEQ ID NO: 1495809 - RNA, 14 nt, Human
uuuuaaaauccacu

SEQ ID NO: 1495810 - RNA, 23 nt, Human
uuuuaaaauccacuuuaucuuga

SEQ ID NO: 1495811 - RNA, 20 nt, Human
uuuccuaaauauauuuuaag

SEQ ID NO: 1495812 - RNA, 15 nt, Human
uuuccacagaagcuc

SEQ ID NO: 1495813 - RNA, 18 nt, Human
uuugcauaacguauaaaa

SEQ ID NO: 1495814 - RNA, 20 nt, Human
uuuugaaauuaugugacauu

SEQ ID NO: 1495815 - RNA, 16 nt, Human
uuuucacauuggaaac

SEQ ID NO: 1495816 - RNA, 21 nt, Human
uuuucaaaauuguuacaaauu

SEQ ID NO: 1495817 - RNA, 21 nt, Human
uuuuauaauuuugugaagcaa

SEQ ID NO: 1495818 - RNA, 23 nt, Human
uuuuauaauuuugugaagcaaaa

SEQ ID NO: 1495819 - RNA, 19 nt, Human
uuuuacguccaucucuugu

SEQ ID NO: 1495820 - RNA, 21 nt, Human
uuuuaaaguaacccuacaaaa

SEQ ID NO: 1495821 - RNA, 18 nt, Human
uuuuauauuugaaauauu

SEQ ID NO: 1495822 - RNA, 13 nt, Human
uuuuauauuugaa

SEQ ID NO: 1495823 - RNA, 14 nt, Human
uuuucaaaagaaag

SEQ ID NO: 1495824 - RNA, 17 nt, Human
cucguggacaccugccc

SEQ ID NO: 1495825 - RNA, 19 nt, Human
cucguggacaccugcccug

SEQ ID NO: 1495826 - RNA, 20 nt, Human
cucguggacaccugcccugc

SEQ ID NO: 1495827 - RNA, 21 nt, Human
cucguggacaccugcccugcc

SEQ ID NO: 1495828 - RNA, 19 nt, Human
cuccccaugauguuuagaa

SEQ ID NO: 1495829 - RNA, 14 nt, Human
cuccgucaacucau

SEQ ID NO: 1495830 - RNA, 17 nt, Human
cugaaaauauuguuuua

SEQ ID NO: 1495831 - RNA, 20 nt, Human
cugaaaauauuguuuuacaa

SEQ ID NO: 1495832 - RNA, 22 nt, Human
cugaaaauauuguuuuacaaua

SEQ ID NO: 1495833 - RNA, 24 nt, Human
cugaaaauauuguuuuacaauagu

SEQ ID NO: 1495834 - RNA, 17 nt, Human
cugaggggcuaccagga

SEQ ID NO: 1495835 - RNA, 20 nt, Human
cugaggggcuaccaggaaag

SEQ ID NO: 1495836 - RNA, 18 nt, Human
cugaggggcuaccaggaa

SEQ ID NO: 1495837 - RNA, 21 nt, Human
cugaggaaauugcuuuguauu

SEQ ID NO: 1495838 - RNA, 18 nt, Human
cugacccuccaccgcaga

SEQ ID NO: 1495839 - RNA, 23 nt, Human
cugacccuccaccgcagaaggaa

SEQ ID NO: 1495840 - RNA, 18 nt, Human
cucacuuguuuuauuuaa

SEQ ID NO: 1495841 - RNA, 23 nt, Human
cucagaaaacaaggaugaauuaa

SEQ ID NO: 1495842 - RNA, 19 nt, Human
cucagaaaacaaggaugaa

SEQ ID NO: 1495843 - RNA, 20 nt, Human
cuacuagggaaaugccuuug

SEQ ID NO: 1495844 - RNA, 15 nt, Human
cgguuuauauaagcu

SEQ ID NO: 1495845 - RNA, 20 nt, Human
cccagcuggggccaggcugg

SEQ ID NO: 1495846 - RNA, 13 nt, Human
cccagccauccag

SEQ ID NO: 1495847 - RNA, 18 nt, Human
cccucaaccucauccucu

SEQ ID NO: 1495848 - RNA, 15 nt, Human
ccccugccaccuccu

SEQ ID NO: 1495849 - RNA, 17 nt, Human
ccccugccaccuccugc

SEQ ID NO: 1495850 - RNA, 13 nt, Human
ccccugaauuuaa

SEQ ID NO: 1495851 - RNA, 17 nt, Human
ccccugaauuuaaauag

SEQ ID NO: 1495852 - RNA, 13 nt, Human
ccagcuuuuccca

SEQ ID NO: 1495853 - RNA, 23 nt, Human
ccagcuuuucccaaaagcccauu

SEQ ID NO: 1495854 - RNA, 17 nt, Human
ccaggcuggagugcagu

SEQ ID NO: 1495855 - RNA, 18 nt, Human
ccaggcuggagugcagug

SEQ ID NO: 1495856 - RNA, 19 nt, Human
ccauucuggaagugacuuu

SEQ ID NO: 1495857 - RNA, 13 nt, Human
cccaccccuagga

SEQ ID NO: 1495858 - RNA, 13 nt, Human
cccaacuccagaa

SEQ ID NO: 1495859 - RNA, 13 nt, Human
cccuucuauaccc

SEQ ID NO: 1495860 - RNA, 18 nt, Human
cccuucuauacccaccca

SEQ ID NO: 1495861 - RNA, 19 nt, Human
cccuucuauacccacccag

SEQ ID NO: 1495862 - RNA, 20 nt, Human
cccuucuauacccacccaga

SEQ ID NO: 1495863 - RNA, 21 nt, Human
cccuucuauacccacccagaa

SEQ ID NO: 1495864 - RNA, 21 nt, Human
cccuucuccauggcccugcca

SEQ ID NO: 1495865 - RNA, 12 nt, Human
ccuaauaaagcu

SEQ ID NO: 1495866 - RNA, 13 nt, Human
ccuaauaaagcug

SEQ ID NO: 1495867 - RNA, 17 nt, Human
ccucagcucucaguugc

SEQ ID NO: 1495868 - RNA, 13 nt, Human
ccucaaccucauc

SEQ ID NO: 1495869 - RNA, 14 nt, Human
ccucaaccucaucc

SEQ ID NO: 1495870 - RNA, 23 nt, Human
ccugaccccaaguuauccaccug

SEQ ID NO: 1495871 - RNA, 16 nt, Human
ccugccucagccuccc

SEQ ID NO: 1495872 - RNA, 13 nt, Human
ccugccucucugc

SEQ ID NO: 1495873 - RNA, 14 nt, Human
ccugccucucugca

SEQ ID NO: 1495874 - RNA, 15 nt, Human
ccugccucucugcag

SEQ ID NO: 1495875 - RNA, 19 nt, Human
cagauaugauucaaauguc

SEQ ID NO: 1495876 - RNA, 17 nt, Human
cagauaugauucaaaug

SEQ ID NO: 1495877 - RNA, 16 nt, Human
cagauaugauucaaau

SEQ ID NO: 1495878 - RNA, 15 nt, Human
cagauaugauucaaa

SEQ ID NO: 1495879 - RNA, 22 nt, Human
cagcacagccucuuagaugcag

SEQ ID NO: 1495880 - RNA, 20 nt, Human
cagcccuucuuuccacagaa

SEQ ID NO: 1495881 - RNA, 19 nt, Human
cagcccuucuuuccacaga

SEQ ID NO: 1495882 - RNA, 15 nt, Human
cagcccuucuuucca

SEQ ID NO: 1495883 - RNA, 20 nt, Human
caggaaagcgccuccaaccc

SEQ ID NO: 1495884 - RNA, 19 nt, Human
caggaaagcgccuccaacc

SEQ ID NO: 1495885 - RNA, 19 nt, Human
cagcugccucuucccucuu

SEQ ID NO: 1495886 - RNA, 19 nt, Human
cagcuccaagaauuucuag

SEQ ID NO: 1495887 - RNA, 16 nt, Human
cagcuccaagaauuuc

SEQ ID NO: 1495888 - RNA, 18 nt, Human
caggugcagcccccacug

SEQ ID NO: 1495889 - RNA, 20 nt, Human
caggugcagcccccacugcc

SEQ ID NO: 1495890 - RNA, 23 nt, Human
caggugcagcccccacugccuuu

SEQ ID NO: 1495891 - RNA, 15 nt, Human
cagucaccucaugga

SEQ ID NO: 1495892 - RNA, 22 nt, Human
cagugcacuaauguguaagaca

SEQ ID NO: 1495893 - RNA, 18 nt, Human
ccacagaagcuccaggua

SEQ ID NO: 1495894 - RNA, 18 nt, Human
ccaccagucugacuguuu

SEQ ID NO: 1495895 - RNA, 16 nt, Human
ccacagaagcuccagg

SEQ ID NO: 1495896 - RNA, 13 nt, Human
cauuuauauguac

SEQ ID NO: 1495897 - RNA, 16 nt, Human
cauggccagcuaauuu

SEQ ID NO: 1495898 - RNA, 12 nt, Human
caugcacaaauu

SEQ ID NO: 1495899 - RNA, 23 nt, Human
cauccuucaucuggauuccagag

SEQ ID NO: 1495900 - RNA, 17 nt, Human
caaacauauauaacaau

SEQ ID NO: 1495901 - RNA, 21 nt, Human
caaaaggauaaugaauacuuu

SEQ ID NO: 1495902 - RNA, 16 nt, Human
auuuuuauauuugaaa

SEQ ID NO: 1495903 - RNA, 15 nt, Human
auuuuuauauuugaa

SEQ ID NO: 1495904 - RNA, 19 nt, Human
auuuuagggguagcauuug

SEQ ID NO: 1495905 - RNA, 14 nt, Human
auuuuauguugcau

SEQ ID NO: 1495906 - RNA, 19 nt, Human
caaaguccugggauuacag

SEQ ID NO: 1495907 - RNA, 14 nt, Human
caaagguaaaucag

SEQ ID NO: 1495908 - RNA, 22 nt, Human
caaagguaaaucagacuaugaa

SEQ ID NO: 1495909 - RNA, 15 nt, Human
caacacacacaugcu

SEQ ID NO: 1495910 - RNA, 23 nt, Human
caacacacacaugcuucccuuuc

SEQ ID NO: 1495911 - RNA, 18 nt, Human
caacacacacaugcuucc

SEQ ID NO: 1495912 - RNA, 20 nt, Human
caagaauuucuaggacugaa

SEQ ID NO: 1495913 - RNA, 22 nt, Human
caagauggggagugagaggcug

SEQ ID NO: 1495914 - RNA, 17 nt, Human
caacucauauuuucaug

SEQ ID NO: 1495915 - RNA, 16 nt, Human
auuuaugcauauuauu

SEQ ID NO: 1495916 - RNA, 22 nt, Human
auuuaugcauauuauuuuaugu

SEQ ID NO: 1495917 - RNA, 14 nt, Human
auuucuaugaaaua

SEQ ID NO: 1495918 - RNA, 16 nt, Human
auuguugucugcaacu

SEQ ID NO: 1495919 - RNA, 18 nt, Human
auuguaagcaugcacaaa

SEQ ID NO: 1495920 - RNA, 11 nt, Human
auuccuccagg

SEQ ID NO: 1495921 - RNA, 15 nt, Human
auuccuucagcacuu

SEQ ID NO: 1495922 - RNA, 17 nt, Human
auuccuucagcacuuua

SEQ ID NO: 1495923 - RNA, 22 nt, Human
auuaugaauuacauuuguauaa

SEQ ID NO: 1495924 - RNA, 20 nt, Human
auuaugaauuacauuuguau

SEQ ID NO: 1495925 - RNA, 19 nt, Human
auuaugaauuacauuugua

SEQ ID NO: 1495926 - RNA, 18 nt, Human
auuaguaagcuagcaaau

SEQ ID NO: 1495927 - RNA, 20 nt, Human
auuaguacuccccuccuuga

SEQ ID NO: 1495928 - RNA, 16 nt, Human
auucaaaugucuauaa

SEQ ID NO: 1495929 - RNA, 18 nt, Human
cacacaugcuucccuuuc

SEQ ID NO: 1495930 - RNA, 14 nt, Human
caauugagaaaaau

SEQ ID NO: 1495931 - RNA, 23 nt, Human
caauugagaaaaauauauacuaa

SEQ ID NO: 1495932 - RNA, 21 nt, Human
caagucagucauucagauaug

SEQ ID NO: 1495933 - RNA, 22 nt, Human
caaggccugguguuucuugaua

SEQ ID NO: 1495934 - RNA, 21 nt, Human
caaggccugguguuucuugau

SEQ ID NO: 1495935 - RNA, 23 nt, Human
caauaaaauccauacauuugugu

SEQ ID NO: 1495936 - RNA, 20 nt, Human
caauaaaauccauacauuug

SEQ ID NO: 1495937 - RNA, 14 nt, Human
cagaaauacaauuu

SEQ ID NO: 1495938 - RNA, 19 nt, Human
cacugggagaaaugaaaaa

SEQ ID NO: 1495939 - RNA, 17 nt, Human
cacuuguguuuugcaag

SEQ ID NO: 1495940 - RNA, 18 nt, Human
cacuuuagaauaugccuu

SEQ ID NO: 1495941 - RNA, 22 nt, Human
cacucuguucauuccuccaggu

SEQ ID NO: 1495942 - RNA, 18 nt, Human
cacuacacccagcaauag

SEQ ID NO: 1495943 - RNA, 21 nt, Human
cacuacacccagcaauagaga

SEQ ID NO: 1495944 - RNA, 17 nt, Human
cacucuguucauuccuc

SEQ ID NO: 1495945 - RNA, 18 nt, Human
cacucuguucauuccucc

SEQ ID NO: 1495946 - RNA, 19 nt, Human
cacucuguucauuccucca

SEQ ID NO: 1495947 - RNA, 20 nt, Human
cacucuguucauuccuccag

SEQ ID NO: 1495948 - RNA, 21 nt, Human
cacucuguucauuccuccagg

SEQ ID NO: 1495949 - RNA, 19 nt, Human
gggacauuugcucauggaa

SEQ ID NO: 1495950 - RNA, 14 nt, Human
aaaaggaaagaaaa

SEQ ID NO: 1495951 - RNA, 13 nt, Human
aaaaggaaagaaa

SEQ ID NO: 1495952 - RNA, 14 nt, Human
aaaaauaacaauga

SEQ ID NO: 1495953 - RNA, 14 nt, Human
ggcugggucgcccu

SEQ ID NO: 1495954 - RNA, 17 nt, Human
ggcugggucgcccugga

SEQ ID NO: 1495955 - RNA, 20 nt, Human
ggcugggucgcccuggacug

SEQ ID NO: 1495956 - RNA, 22 nt, Human
gggacagucaccucauggaauu

SEQ ID NO: 1495957 - RNA, 21 nt, Human
gggacagucaccucauggaau

SEQ ID NO: 1495958 - RNA, 20 nt, Human
gggacagucaccucauggaa

SEQ ID NO: 1495959 - RNA, 15 nt, Human
aaaauuuuuaaucuu

SEQ ID NO: 1495960 - RNA, 19 nt, Human
ggggaauugaggacacuga

SEQ ID NO: 1495961 - RNA, 13 nt, Human
ggguggcagcaac

SEQ ID NO: 1495962 - RNA, 14 nt, Human
aaacgucuuaaaua

SEQ ID NO: 1495963 - RNA, 18 nt, Human
aaacuaggugcauauuua

SEQ ID NO: 1495964 - RNA, 13 nt, Human
aaacgucuuaaau

SEQ ID NO: 1495965 - RNA, 22 nt, Human
aaacuaggugcauauuuauaaa

SEQ ID NO: 1495966 - RNA, 15 nt, Human
aaacucguuaauuug

SEQ ID NO: 1495967 - RNA, 18 nt, Human
aaaccuuuguuugcaucu

SEQ ID NO: 1495968 - RNA, 18 nt, Human
aaaccuuuuauauuuagu

SEQ ID NO: 1495969 - RNA, 19 nt, Human
gggggugcugggccccugc

SEQ ID NO: 1495970 - RNA, 13 nt, Human
gggucgcccugga

SEQ ID NO: 1495971 - RNA, 15 nt, Human
gggucgcccuggacu

SEQ ID NO: 1495972 - RNA, 15 nt, Human
ggguggggggggugc

SEQ ID NO: 1495973 - RNA, 23 nt, Human
aaacuucagcgguuuauauaagc

SEQ ID NO: 1495974 - RNA, 16 nt, Human
aaacuuguauuaugug

SEQ ID NO: 1495975 - RNA, 13 nt, Human
aaagacagugaaa

SEQ ID NO: 1495976 - RNA, 23 nt, Human
aaagcugcugagaaucuagccuc

SEQ ID NO: 1495977 - RNA, 14 nt, Human
aaagguacuucaaa

SEQ ID NO: 1495978 - RNA, 14 nt, Human
aaagguaaaucaga

SEQ ID NO: 1495979 - RNA, 14 nt, Human
ggucgcccuggacu

SEQ ID NO: 1495980 - RNA, 20 nt, Human
ggucgcccuggacugugugc

SEQ ID NO: 1495981 - RNA, 21 nt, Human
ggugcauauuuauaaaaauaa

SEQ ID NO: 1495982 - RNA, 11 nt, Human
ggugcugggcc

SEQ ID NO: 1495983 - RNA, 13 nt, Human
ggugcugggcccc

SEQ ID NO: 1495984 - RNA, 15 nt, Human
ggugcugggccccug

SEQ ID NO: 1495985 - RNA, 16 nt, Human
ggugcugggccccugc

SEQ ID NO: 1495986 - RNA, 19 nt, Human
ggugcugggccccugccuc

SEQ ID NO: 1495987 - RNA, 18 nt, Human
aaaguauguuagugcaaa

SEQ ID NO: 1495988 - RNA, 19 nt, Human
aaauaauuuuaucucuuuc

SEQ ID NO: 1495989 - RNA, 13 nt, Human
aaauaauaauuuu

SEQ ID NO: 1495990 - RNA, 16 nt, Human
aaaguugguaaaccuu

SEQ ID NO: 1495991 - RNA, 17 nt, Human
aaaguugguaaaccuuu

SEQ ID NO: 1495992 - RNA, 21 nt, Human
aaauaauuuuuauauuugaaa

SEQ ID NO: 1495993 - RNA, 23 nt, Human
guacacugccuucucaacuccaa

SEQ ID NO: 1495994 - RNA, 23 nt, Human
aaauaauuuuuauauuugaaaua

SEQ ID NO: 1495995 - RNA, 22 nt, Human
aaauaauuuuuauauuugaaau

SEQ ID NO: 1495996 - RNA, 18 nt, Human
aaauacauuguauauaug

SEQ ID NO: 1495997 - RNA, 22 nt, Human
aaauacgugggcauucaaaugu

SEQ ID NO: 1495998 - RNA, 21 nt, Human
guaauccaagcaaaugugaau

SEQ ID NO: 1495999 - RNA, 20 nt, Human
guaauaggcguaacuaauuu

SEQ ID NO: 1496000 - RNA, 15 nt, Human
aaauccacuuuaucu

SEQ ID NO: 1496001 - RNA, 17 nt, Human
aaauauuauguuaaaac

SEQ ID NO: 1496002 - RNA, 14 nt, Human
aaaucagacuauga

SEQ ID NO: 1496003 - RNA, 21 nt, Human
aaaucagacuaugaaguuuuu

SEQ ID NO: 1496004 - RNA, 20 nt, Human
guaccaagacuacuagggaa

SEQ ID NO: 1496005 - RNA, 23 nt, Human
guaccaagacuacuagggaaaug

SEQ ID NO: 1496006 - RNA, 18 nt, Human
aaauccauacauuugugu

SEQ ID NO: 1496007 - RNA, 15 nt, Human
aaauccauacauuug

SEQ ID NO: 1496008 - RNA, 15 nt, Human
guacuucaugcuguc

SEQ ID NO: 1496009 - RNA, 22 nt, Human
guacuucaaauccuugaagauu

SEQ ID NO: 1496010 - RNA, 21 nt, Human
guacuucaaauccuugaagau

SEQ ID NO: 1496011 - RNA, 12 nt, Human
gcugggucgccc

SEQ ID NO: 1496012 - RNA, 21 nt, Human
gcugggccccugccucucugc

SEQ ID NO: 1496013 - RNA, 22 nt, Human
gcugggccccugccucucugca

SEQ ID NO: 1496014 - RNA, 23 nt, Human
gcugggccccugccucucugcag

SEQ ID NO: 1496015 - RNA, 15 nt, Human
gcuggagugcagugg

SEQ ID NO: 1496016 - RNA, 12 nt, Human
ggaagagaagga

SEQ ID NO: 1496017 - RNA, 17 nt, Human
ggaagagaaggagcaga

SEQ ID NO: 1496018 - RNA, 16 nt, Human
ggacaccugcccugcc

SEQ ID NO: 1496019 - RNA, 17 nt, Human
ggacaccugcccugccc

SEQ ID NO: 1496020 - RNA, 19 nt, Human
ggaaugaagauacugaaau

SEQ ID NO: 1496021 - RNA, 18 nt, Human
ggaaugaagcaaugcuuc

SEQ ID NO: 1496022 - RNA, 18 nt, Human
ggaaguugacuuauagua

SEQ ID NO: 1496023 - RNA, 15 nt, Human
ggacaggauccaggc

SEQ ID NO: 1496024 - RNA, 19 nt, Human
ggacuugcaaaaaggguca

SEQ ID NO: 1496025 - RNA, 18 nt, Human
ggagaaaugaaaaaauau

SEQ ID NO: 1496026 - RNA, 13 nt, Human
gccucuucccucu

SEQ ID NO: 1496027 - RNA, 15 nt, Human
gccucuuagaugcag

SEQ ID NO: 1496028 - RNA, 19 nt, Human
gccuccuuagaaaaaaaau

SEQ ID NO: 1496029 - RNA, 14 nt, Human
gcgaucucagcuca

SEQ ID NO: 1496030 - RNA, 20 nt, Human
gccccugccucucugcaggu

SEQ ID NO: 1496031 - RNA, 23 nt, Human
gccccugccucucugcagguccc

SEQ ID NO: 1496032 - RNA, 23 nt, Human
gccccugccaccuccugccucag

SEQ ID NO: 1496033 - RNA, 19 nt, Human
gcccccacugccuuugacc

SEQ ID NO: 1496034 - RNA, 13 nt, Human
gcccugcccugcc

SEQ ID NO: 1496035 - RNA, 17 nt, Human
gcccugcccugccaccu

SEQ ID NO: 1496036 - RNA, 13 nt, Human
gcccugccaccug

SEQ ID NO: 1496037 - RNA, 14 nt, Human
gcccugccaccugu

SEQ ID NO: 1496038 - RNA, 15 nt, Human
gcccugccaccuguc

SEQ ID NO: 1496039 - RNA, 16 nt, Human
gcccugccaccugucu

SEQ ID NO: 1496040 - RNA, 17 nt, Human
gcccugccaccugucug

SEQ ID NO: 1496041 - RNA, 19 nt, Human
gcguuuuuuaaauguauac

SEQ ID NO: 1496042 - RNA, 20 nt, Human
gcucacugcaaccucugccu

SEQ ID NO: 1496043 - RNA, 17 nt, Human
cuggacuuggccccugc

SEQ ID NO: 1496044 - RNA, 18 nt, Human
cuggacuuggccccugcc

SEQ ID NO: 1496045 - RNA, 19 nt, Human
cuggacuuggccccugcca

SEQ ID NO: 1496046 - RNA, 15 nt, Human
cugccucccuucaug

SEQ ID NO: 1496047 - RNA, 17 nt, Human
cugccucccuucaugca

SEQ ID NO: 1496048 - RNA, 18 nt, Human
cugccucccuucaugcau

SEQ ID NO: 1496049 - RNA, 19 nt, Human
cugccucccuucaugcaug

SEQ ID NO: 1496050 - RNA, 21 nt, Human
cugccucccuucaugcaugga

SEQ ID NO: 1496051 - RNA, 23 nt, Human
cugccucccuucaugcauggaaa

SEQ ID NO: 1496052 - RNA, 14 nt, Human
cugccucccuucau

SEQ ID NO: 1496053 - RNA, 15 nt, Human
cuggggccaggcugg

SEQ ID NO: 1496054 - RNA, 20 nt, Human
cuggggcugaggcugaggca

SEQ ID NO: 1496055 - RNA, 13 nt, Human
cugggaauggagg

SEQ ID NO: 1496056 - RNA, 20 nt, Human
cugggaauggaggggcagag

SEQ ID NO: 1496057 - RNA, 23 nt, Human
cugggaauggaggggcagagcca

SEQ ID NO: 1496058 - RNA, 23 nt, Human
cugggacuauaggcaugcgccac

SEQ ID NO: 1496059 - RNA, 19 nt, Human
cuguuauaaucuuucacag

SEQ ID NO: 1496060 - RNA, 13 nt, Human
cuguuauaaucuu

SEQ ID NO: 1496061 - RNA, 15 nt, Human
cuguuguagaagaca

SEQ ID NO: 1496062 - RNA, 12 nt, Human
cuguuuaagaga

SEQ ID NO: 1496063 - RNA, 14 nt, Human
cuguuuaagagaca

SEQ ID NO: 1496064 - RNA, 16 nt, Human
cuugcaaaaaggguca

SEQ ID NO: 1496065 - RNA, 15 nt, Human
cuugcaaaaaggguc

SEQ ID NO: 1496066 - RNA, 13 nt, Human
cuucucacauuua

SEQ ID NO: 1496067 - RNA, 20 nt, Human
cuucucacauuuauauuuuu

SEQ ID NO: 1496068 - RNA, 16 nt, Human
cuucucuuguuaggua

SEQ ID NO: 1496069 - RNA, 15 nt, Human
cuucugaauaaagca

SEQ ID NO: 1496070 - RNA, 16 nt, Human
cuucugaauaaagcaa

SEQ ID NO: 1496071 - RNA, 18 nt, Human
cuucugaauaaagcaauu

SEQ ID NO: 1496072 - RNA, 22 nt, Human
cuucugaauaaagcaauuagca

SEQ ID NO: 1496073 - RNA, 19 nt, Human
cuucugacauaauccagua

SEQ ID NO: 1496074 - RNA, 23 nt, Human
cuuugaccugccucccuucaugc

SEQ ID NO: 1496075 - RNA, 20 nt, Human
cuuugaccugccucccuuca

SEQ ID NO: 1496076 - RNA, 16 nt, Human
cuuuguaaugaaaacc

SEQ ID NO: 1496077 - RNA, 14 nt, Human
cuuuguaaugaaaa

SEQ ID NO: 1496078 - RNA, 15 nt, Human
cuuuguaaugaaaac

SEQ ID NO: 1496079 - RNA, 13 nt, Human
cuuuguauucaaa

SEQ ID NO: 1496080 - RNA, 17 nt, Human
gaacugauguaaguaaa

SEQ ID NO: 1496081 - RNA, 13 nt, Human
gaacugaaaucau

SEQ ID NO: 1496082 - RNA, 12 nt, Human
gaaccaucagaa

SEQ ID NO: 1496083 - RNA, 17 nt, Human
gaagcacagugaucaag

SEQ ID NO: 1496084 - RNA, 11 nt, Human
gaaaugaaaaa

SEQ ID NO: 1496085 - RNA, 21 nt, Human
gaaaagaaaauuuuuguagua

SEQ ID NO: 1496086 - RNA, 15 nt, Human
gaaaagaaagcuaca

SEQ ID NO: 1496087 - RNA, 19 nt, Human
gaaaacuuguauuaugugu

SEQ ID NO: 1496088 - RNA, 22 nt, Human
gaaaacuuguauuauguguguu

SEQ ID NO: 1496089 - RNA, 21 nt, Human
gaaacaagucagucauucaga

SEQ ID NO: 1496090 - RNA, 14 nt, Human
gacucaaaccaaau

SEQ ID NO: 1496091 - RNA, 19 nt, Human
gacccuccaccgcagaagg

SEQ ID NO: 1496092 - RNA, 21 nt, Human
gacccuccaccgcagaaggaa

SEQ ID NO: 1496093 - RNA, 22 nt, Human
gacccuccaccgcagaaggaag

SEQ ID NO: 1496094 - RNA, 14 nt, Human
gacugugugcucag

SEQ ID NO: 1496095 - RNA, 16 nt, Human
gacugugugcucagga

SEQ ID NO: 1496096 - RNA, 17 nt, Human
gacugugugcucaggag

SEQ ID NO: 1496097 - RNA, 20 nt, Human
gacugugugcucaggagccc

SEQ ID NO: 1496098 - RNA, 19 nt, Human
gacuuuggcugcaugcgag

SEQ ID NO: 1496099 - RNA, 16 nt, Human
gacuuuggcugcaugc

SEQ ID NO: 1496100 - RNA, 21 nt, Human
gacagcccuucuuuccacaga

SEQ ID NO: 1496101 - RNA, 23 nt, Human
gaccauggacacuacacccagca

SEQ ID NO: 1496102 - RNA, 16 nt, Human
gaccauggacacuaca

SEQ ID NO: 1496103 - RNA, 21 nt, Human
gaccauggacacuacacccag

SEQ ID NO: 1496104 - RNA, 22 nt, Human
gaccagcuuuucccaaaagccc

SEQ ID NO: 1496105 - RNA, 14 nt, Human
gaggcucuggagcc

SEQ ID NO: 1496106 - RNA, 19 nt, Human
gaggcucuggagcccacug

SEQ ID NO: 1496107 - RNA, 14 nt, Human
gccaacuauggccu

SEQ ID NO: 1496108 - RNA, 15 nt, Human
gccaacuauggccug

SEQ ID NO: 1496109 - RNA, 19 nt, Human
gccaacuauggccugugga

SEQ ID NO: 1496110 - RNA, 18 nt, Human
gcaaguuuccaucaucua

SEQ ID NO: 1496111 - RNA, 18 nt, Human
gcaauagucaaauugugu

SEQ ID NO: 1496112 - RNA, 22 nt, Human
gcacacaccaccacgccuggcu

SEQ ID NO: 1496113 - RNA, 11 nt, Human
gcaauagagac

SEQ ID NO: 1496114 - RNA, 13 nt, Human
gcaaccuccaccu

SEQ ID NO: 1496115 - RNA, 14 nt, Human
gaugaugacuaugg

SEQ ID NO: 1496116 - RNA, 13 nt, Human
gaugaggccagac

SEQ ID NO: 1496117 - RNA, 15 nt, Human
gaugaggccagacca

SEQ ID NO: 1496118 - RNA, 22 nt, Human
gaugaggccagaccauggacac

SEQ ID NO: 1496119 - RNA, 22 nt, Human
gucucuuuaaaaggaaagaaaa

SEQ ID NO: 1496120 - RNA, 15 nt, Human
aacuaagaaacuuaa

SEQ ID NO: 1496121 - RNA, 19 nt, Human
aacuaagaaacuuaaauuu

SEQ ID NO: 1496122 - RNA, 22 nt, Human
aacuacuucucuuguuagguaa

SEQ ID NO: 1496123 - RNA, 23 nt, Human
aacuaucucauuuccaagcaagu

SEQ ID NO: 1496124 - RNA, 20 nt, Human
aacuaucucauuuccaagca

SEQ ID NO: 1496125 - RNA, 13 nt, Human
aacuauauuguuu

SEQ ID NO: 1496126 - RNA, 17 nt, Human
gugacauuuuacauuaa

SEQ ID NO: 1496127 - RNA, 19 nt, Human
gugacauuuuacauuaaau

SEQ ID NO: 1496128 - RNA, 20 nt, Human
gugacauuuuacauuaaauu

SEQ ID NO: 1496129 - RNA, 21 nt, Human
gugacauuuuacauuaaauuu

SEQ ID NO: 1496130 - RNA, 20 nt, Human
aacugaaaucauacuucuua

SEQ ID NO: 1496131 - RNA, 16 nt, Human
aacauauauaacaaug

SEQ ID NO: 1496132 - RNA, 13 nt, Human
guagcguuuuuua

SEQ ID NO: 1496133 - RNA, 17 nt, Human
guagcguuuuuuaaaug

SEQ ID NO: 1496134 - RNA, 18 nt, Human
guagcguuuuuuaaaugu

SEQ ID NO: 1496135 - RNA, 22 nt, Human
guagcguuuuuuaaauguauac

SEQ ID NO: 1496136 - RNA, 22 nt, Human
aaccaaaucacugaacuuugcu

SEQ ID NO: 1496137 - RNA, 14 nt, Human
gucgcccuggacug

SEQ ID NO: 1496138 - RNA, 18 nt, Human
gucgcccuggacugugug

SEQ ID NO: 1496139 - RNA, 13 nt, Human
aagaaaacaucuu

SEQ ID NO: 1496140 - RNA, 17 nt, Human
aagaaaacaucuuuaag

SEQ ID NO: 1496141 - RNA, 13 nt, Human
aagaaaauaucac

SEQ ID NO: 1496142 - RNA, 16 nt, Human
aagaaagucagccaua

SEQ ID NO: 1496143 - RNA, 19 nt, Human
aagaaaauuuuuguaguag

SEQ ID NO: 1496144 - RNA, 22 nt, Human
gugcacuaauguguaagacaaa

SEQ ID NO: 1496145 - RNA, 20 nt, Human
gugcacuaauguguaagaca

SEQ ID NO: 1496146 - RNA, 16 nt, Human
gugcugggccccugcc

SEQ ID NO: 1496147 - RNA, 19 nt, Human
gugcugggccccugccucu

SEQ ID NO: 1496148 - RNA, 11 nt, Human
guggacaccug

SEQ ID NO: 1496149 - RNA, 12 nt, Human
guggacaccugc

SEQ ID NO: 1496150 - RNA, 13 nt, Human
guggacaccugcc

SEQ ID NO: 1496151 - RNA, 14 nt, Human
guggacaccugccc

SEQ ID NO: 1496152 - RNA, 16 nt, Human
guggacaccugcccug

SEQ ID NO: 1496153 - RNA, 17 nt, Human
guggacaccugcccugc

SEQ ID NO: 1496154 - RNA, 18 nt, Human
guggacaccugcccugcc

SEQ ID NO: 1496155 - RNA, 19 nt, Human
guggacaccugcccugccc

SEQ ID NO: 1496156 - RNA, 13 nt, Human
guggcagcaacaa

SEQ ID NO: 1496157 - RNA, 16 nt, Human
aagacaaaaagcuacu

SEQ ID NO: 1496158 - RNA, 24 nt, Human
aagaauuucuaggacugaauuaug

SEQ ID NO: 1496159 - RNA, 18 nt, Human
guggggggggugcugggc

SEQ ID NO: 1496160 - RNA, 13 nt, Human
aagaugaucauuu

SEQ ID NO: 1496161 - RNA, 19 nt, Human
aagcaaaauuuuuucucua

SEQ ID NO: 1496162 - RNA, 13 nt, Human
aagcaaaugugaa

SEQ ID NO: 1496163 - RNA, 14 nt, Human
aagcaaaugugaau

SEQ ID NO: 1496164 - RNA, 20 nt, Human
aagcaaaugugaaucauuuu

SEQ ID NO: 1496165 - RNA, 16 nt, Human
aagcaaguauuagaau

SEQ ID NO: 1496166 - RNA, 20 nt, Human
aagcaaguaaaaaggcuaaa

SEQ ID NO: 1496167 - RNA, 19 nt, Human
aagcaaguaaaaaggcuaa

SEQ ID NO: 1496168 - RNA, 17 nt, Human
guuuuuuuuuaaagacu

SEQ ID NO: 1496169 - RNA, 13 nt, Human
uaaaauuacaacu

SEQ ID NO: 1496170 - RNA, 15 nt, Human
uaaaauuacaacuaa

SEQ ID NO: 1496171 - RNA, 17 nt, Human
uaaaauuacaacuaagu

SEQ ID NO: 1496172 - RNA, 19 nt, Human
uaaaauuacaacuaaguga

SEQ ID NO: 1496173 - RNA, 17 nt, Human
uaaaauuuuuaaucuuu

SEQ ID NO: 1496174 - RNA, 19 nt, Human
uaaaauuuuuaaucuuuaa

SEQ ID NO: 1496175 - RNA, 22 nt, Human
aaguuuaguuugaggaauucuu

SEQ ID NO: 1496176 - RNA, 16 nt, Human
uaaagacuuuuaugau

SEQ ID NO: 1496177 - RNA, 16 nt, Human
uaaaccggaccaucuc

SEQ ID NO: 1496178 - RNA, 17 nt, Human
uaaacgucuuaaauauu

SEQ ID NO: 1496179 - RNA, 13 nt, Human
uaaacgucuuaaa

SEQ ID NO: 1496180 - RNA, 17 nt, Human
uaacaaugcuguauuuu

SEQ ID NO: 1496181 - RNA, 15 nt, Human
uaacaaugcuguauu

SEQ ID NO: 1496182 - RNA, 20 nt, Human
uaaauguuuuuuuuuaaaga

SEQ ID NO: 1496183 - RNA, 23 nt, Human
uaaauguuuuuuuuuaaagacuu

SEQ ID NO: 1496184 - RNA, 12 nt, Human
uaaauagcuuuu

SEQ ID NO: 1496185 - RNA, 22 nt, Human
aauaaaauccauacauuugugu

SEQ ID NO: 1496186 - RNA, 12 nt, Human
aauaaaaauaau

SEQ ID NO: 1496187 - RNA, 17 nt, Human
uaaagugacccugcucu

SEQ ID NO: 1496188 - RNA, 20 nt, Human
uaaagugacccugcucucac

SEQ ID NO: 1496189 - RNA, 15 nt, Human
aauaacaauaaaaga

SEQ ID NO: 1496190 - RNA, 16 nt, Human
guuguaaaccaaguga

SEQ ID NO: 1496191 - RNA, 19 nt, Human
guuugcaucugaaaauuga

SEQ ID NO: 1496192 - RNA, 22 nt, Human
guuuuauaauuuugugaagcaa

SEQ ID NO: 1496193 - RNA, 15 nt, Human
guuuuauaauuuugu

SEQ ID NO: 1496194 - RNA, 22 nt, Human
aagucuuauauauuguagauaa

SEQ ID NO: 1496195 - RNA, 19 nt, Human
aagugacuuuggcugcaug

SEQ ID NO: 1496196 - RNA, 23 nt, Human
guuuuuuuuuaaaaaagaaacau

SEQ ID NO: 1496197 - RNA, 15 nt, Human
guuuuuuuuuaaaga

SEQ ID NO: 1496198 - RNA, 17 nt, Human
guuuuuuuguuauuaaa

SEQ ID NO: 1496199 - RNA, 23 nt, Human
aaguauguuagugcaaauuguca

SEQ ID NO: 1496200 - RNA, 20 nt, Human
aagucacauuccugaacagg

SEQ ID NO: 1496201 - RNA, 23 nt, Human
aaggagcagagcugauggagaag

SEQ ID NO: 1496202 - RNA, 13 nt, Human
aaggaggacccag

SEQ ID NO: 1496203 - RNA, 14 nt, Human
aaggaggacccagg

SEQ ID NO: 1496204 - RNA, 15 nt, Human
aaggaggacccagga

SEQ ID NO: 1496205 - RNA, 17 nt, Human
aaggaggacccaggaca

SEQ ID NO: 1496206 - RNA, 18 nt, Human
aaggaggacccaggacag

SEQ ID NO: 1496207 - RNA, 21 nt, Human
aaggaggacccaggacaggau

SEQ ID NO: 1496208 - RNA, 22 nt, Human
aaggaggacccaggacaggauc

SEQ ID NO: 1496209 - RNA, 13 nt, Human
aaggauaaugaau

SEQ ID NO: 1496210 - RNA, 23 nt, Human
aaggauaaaguugguaaaccuuu

SEQ ID NO: 1496211 - RNA, 21 nt, Human
aaggauaaaguugguaaaccu

SEQ ID NO: 1496212 - RNA, 17 nt, Human
aaggaaggcagggagga

SEQ ID NO: 1496213 - RNA, 17 nt, Human
aaggaaggcuccaucuc

SEQ ID NO: 1496214 - RNA, 22 nt, Human
aaggagcaagucagaauagaaa

SEQ ID NO: 1496215 - RNA, 20 nt, Human
aaggccugguguuucuugau

SEQ ID NO: 1496216 - RNA, 13 nt, Human
guugacaugggac

SEQ ID NO: 1496217 - RNA, 13 nt, Human
guugaauuuuaca

SEQ ID NO: 1496218 - RNA, 16 nt, Human
aaggaaaaaauaacaa

SEQ ID NO: 1496219 - RNA, 19 nt, Human
aaggaaaaaauaacaauga

SEQ ID NO: 1496220 - RNA, 16 nt, Human
aagcuuuuaugugaaa

SEQ ID NO: 1496221 - RNA, 19 nt, Human
uaacaaugcuguauuuuaa

SEQ ID NO: 1496222 - RNA, 18 nt, Human
uaauacuugcuuuggaaa

SEQ ID NO: 1496223 - RNA, 13 nt, Human
uaaucuuucacag

SEQ ID NO: 1496224 - RNA, 17 nt, Human
uaaucuuuaauuuuaca

SEQ ID NO: 1496225 - RNA, 22 nt, Human
uaauccaagcaaaugugaauca

SEQ ID NO: 1496226 - RNA, 15 nt, Human
uaauguaagacaaau

SEQ ID NO: 1496227 - RNA, 13 nt, Human
uaauucauguugc

SEQ ID NO: 1496228 - RNA, 13 nt, Human
aauguaagacaaa

SEQ ID NO: 1496229 - RNA, 20 nt, Human
uacaguggggaaugaagaua

SEQ ID NO: 1496230 - RNA, 23 nt, Human
uacauggcuggagcuagaauuug

SEQ ID NO: 1496231 - RNA, 17 nt, Human
uacauguacugauuacu

SEQ ID NO: 1496232 - RNA, 15 nt, Human
uacauuguauauaug

SEQ ID NO: 1496233 - RNA, 20 nt, Human
aauuaagaaaggauaaaguu

SEQ ID NO: 1496234 - RNA, 19 nt, Human
aauuaacaugaauauuuag

SEQ ID NO: 1496235 - RNA, 18 nt, Human
aauguugacaugggacau

SEQ ID NO: 1496236 - RNA, 23 nt, Human
uaccccaccucccucaaccucau

SEQ ID NO: 1496237 - RNA, 14 nt, Human
acaaaaagaaaaga

SEQ ID NO: 1496238 - RNA, 18 nt, Human
acaaaaagaaaagaaaau

SEQ ID NO: 1496239 - RNA, 19 nt, Human
uagaugcaguucugaagaa

SEQ ID NO: 1496240 - RNA, 17 nt, Human
uagaugcaguucugaag

SEQ ID NO: 1496241 - RNA, 20 nt, Human
uagaugcaguucugaagaag

SEQ ID NO: 1496242 - RNA, 21 nt, Human
uagcaugucgucaaagcugaa

SEQ ID NO: 1496243 - RNA, 18 nt, Human
acaagcacuaaacaaaga

SEQ ID NO: 1496244 - RNA, 18 nt, Human
acaaauucugucucugga

SEQ ID NO: 1496245 - RNA, 19 nt, Human
uagcauuuguguugaagag

SEQ ID NO: 1496246 - RNA, 20 nt, Human
aauuuuuuucaccuagauuu

SEQ ID NO: 1496247 - RNA, 19 nt, Human
acaaaaaaaaaauuugcca

SEQ ID NO: 1496248 - RNA, 13 nt, Human
aauuuuuguagua

SEQ ID NO: 1496249 - RNA, 22 nt, Human
aauuuuuucucuaggaaauauu

SEQ ID NO: 1496250 - RNA, 13 nt, Human
aauuuuuuucacc

SEQ ID NO: 1496251 - RNA, 19 nt, Human
aauuuuuucucuaggaaau

SEQ ID NO: 1496252 - RNA, 19 nt, Human
aauuuuuauauuugaaaua

SEQ ID NO: 1496253 - RNA, 15 nt, Human
uagacaauugaggua

SEQ ID NO: 1496254 - RNA, 18 nt, Human
uagacaauugagguaagu

SEQ ID NO: 1496255 - RNA, 19 nt, Human
uagaauuugauaugugaac

SEQ ID NO: 1496256 - RNA, 23 nt, Human
uagaagucacauuccugaacagg

SEQ ID NO: 1496257 - RNA, 16 nt, Human
uacuucaugcugucua

SEQ ID NO: 1496258 - RNA, 21 nt, Human
uacuucaaauccuugaagauu

SEQ ID NO: 1496259 - RNA, 14 nt, Human
uagaagagagaggu

SEQ ID NO: 1496260 - RNA, 22 nt, Human
uagaagagagagguugaaaaac

SEQ ID NO: 1496261 - RNA, 20 nt, Human
aauuguguuuauaauuuuaa

SEQ ID NO: 1496262 - RNA, 13 nt, Human
uacuguaagaaaa

SEQ ID NO: 1496263 - RNA, 23 nt, Human
aauugugugaaagguacuucaaa

SEQ ID NO: 1496264 - RNA, 16 nt, Human
aauuuaaauagcuuuu

SEQ ID NO: 1496265 - RNA, 15 nt, Human
aauuuaaauagcuuu

SEQ ID NO: 1496266 - RNA, 18 nt, Human
aauuugauaugugaacag

SEQ ID NO: 1496267 - RNA, 16 nt, Human
aauuugauaugugaac

SEQ ID NO: 1496268 - RNA, 15 nt, Human
aauuugauaugugaa

SEQ ID NO: 1496269 - RNA, 19 nt, Human
aauuugauaugugaacagu

SEQ ID NO: 1496270 - RNA, 19 nt, Human
uacuucaaauccuugaaga

SEQ ID NO: 1496271 - RNA, 14 nt, Human
uacuucaaauccuu

SEQ ID NO: 1496272 - RNA, 20 nt, Human
aauuugaaacacuuugcaua

SEQ ID NO: 1496273 - RNA, 18 nt, Human
uacgugcucugugggucu

SEQ ID NO: 1496274 - RNA, 20 nt, Human
uacuagucaccagagacuuu

SEQ ID NO: 1496275 - RNA, 21 nt, Human
uacuagucaccagagacuuua

SEQ ID NO: 1496276 - RNA, 22 nt, Human
uacuagucaccagagacuuuag

SEQ ID NO: 1496277 - RNA, 22 nt, Human
uacucuuauaucuauauuuuac

SEQ ID NO: 1496278 - RNA, 20 nt, Human
uacucuuauaucuauauuuu

SEQ ID NO: 1496279 - RNA, 21 nt, Human
aauucuugccaaauauaaaua

SEQ ID NO: 1496280 - RNA, 11 nt, Human
aauucuucccu

SEQ ID NO: 1496281 - RNA, 21 nt, Human
aauucuucccuaucuuugcca

SEQ ID NO: 1496282 - RNA, 19 nt, Human
aauucuuaugccauauaau

SEQ ID NO: 1496283 - RNA, 14 nt, Human
aauucuuucauuuu

SEQ ID NO: 1496284 - RNA, 17 nt, Human
aauucuuuaaaauuaca

SEQ ID NO: 1496285 - RNA, 22 nt, Human
aauucuuuaaaauuacaacuaa

SEQ ID NO: 1496286 - RNA, 23 nt, Human
uauaaaauaauuuuuauauuuga

SEQ ID NO: 1496287 - RNA, 19 nt, Human
uauaaaagccuguuuaaga

SEQ ID NO: 1496288 - RNA, 22 nt, Human
uauaaaauaauuuuuauauuug

SEQ ID NO: 1496289 - RNA, 21 nt, Human
uauaaaauaauuuuuauauuu

SEQ ID NO: 1496290 - RNA, 14 nt, Human
uauaaaagccuguu

SEQ ID NO: 1496291 - RNA, 17 nt, Human
uauaaaagccuguuuaa

SEQ ID NO: 1496292 - RNA, 12 nt, Human
uauaaaagccug

SEQ ID NO: 1496293 - RNA, 21 nt, Human
acaccuacuagucaccagaga

SEQ ID NO: 1496294 - RNA, 22 nt, Human
acaagcucacagaccuuugaac

SEQ ID NO: 1496295 - RNA, 22 nt, Human
uagugagcagucaggaaagaga

SEQ ID NO: 1496296 - RNA, 18 nt, Human
uagucucuuuaaaaggaa

SEQ ID NO: 1496297 - RNA, 16 nt, Human
uagucucuuuaaaagg

SEQ ID NO: 1496298 - RNA, 16 nt, Human
uaguuuuauaugcuuc

SEQ ID NO: 1496299 - RNA, 14 nt, Human
uauagcuaaguaca

SEQ ID NO: 1496300 - RNA, 23 nt, Human
uauauauuuuuuucugaaauuuc

SEQ ID NO: 1496301 - RNA, 22 nt, Human
uauauauuuuuuucugaaauuu

SEQ ID NO: 1496302 - RNA, 21 nt, Human
uauauauuuuuuucugaaauu

SEQ ID NO: 1496303 - RNA, 16 nt, Human
uauauauagcagcuuu

SEQ ID NO: 1496304 - RNA, 13 nt, Human
uauauaucaaaua

SEQ ID NO: 1496305 - RNA, 19 nt, Human
uauaauuuugugaagcaaa

SEQ ID NO: 1496306 - RNA, 12 nt, Human
uauaccaauaaa

SEQ ID NO: 1496307 - RNA, 13 nt, Human
uauaccaauaaag

SEQ ID NO: 1496308 - RNA, 15 nt, Human
uauaccaauaaagug

SEQ ID NO: 1496309 - RNA, 14 nt, Human
uauaccaauaaagu

SEQ ID NO: 1496310 - RNA, 14 nt, Human
uauaauuuugugaa

SEQ ID NO: 1496311 - RNA, 15 nt, Human
uaucuugaauaaugu

SEQ ID NO: 1496312 - RNA, 22 nt, Human
uauggccugugagcuaggaauu

SEQ ID NO: 1496313 - RNA, 14 nt, Human
uauggccuguggau

SEQ ID NO: 1496314 - RNA, 15 nt, Human
acagcuccaagaauu

SEQ ID NO: 1496315 - RNA, 15 nt, Human
uauauuuacaaaugg

SEQ ID NO: 1496316 - RNA, 14 nt, Human
uauauuuacaaaug

SEQ ID NO: 1496317 - RNA, 16 nt, Human
uauauugauccagaaa

SEQ ID NO: 1496318 - RNA, 23 nt, Human
acaguucggugagcuacaaaugc

SEQ ID NO: 1496319 - RNA, 19 nt, Human
acaguucggugagcuacaa

SEQ ID NO: 1496320 - RNA, 22 nt, Human
acaguucggugagcuacaaaug

SEQ ID NO: 1496321 - RNA, 14 nt, Human
uauuuaauucaugu

SEQ ID NO: 1496322 - RNA, 19 nt, Human
uauuuaguguucauaaaua

SEQ ID NO: 1496323 - RNA, 18 nt, Human
uauuuauuuuaauaaugu

SEQ ID NO: 1496324 - RNA, 16 nt, Human
uauuuauuuuaauaau

SEQ ID NO: 1496325 - RNA, 14 nt, Human
uauuuauuuuaaua

SEQ ID NO: 1496326 - RNA, 14 nt, Human
uauuuaauagguuu

SEQ ID NO: 1496327 - RNA, 18 nt, Human
uauuuaaccucuaaauuc

SEQ ID NO: 1496328 - RNA, 17 nt, Human
uauuuaaccucuaaauu

SEQ ID NO: 1496329 - RNA, 17 nt, Human
uauugucuagugaaacu

SEQ ID NO: 1496330 - RNA, 21 nt, Human
uauuguagcauccuggaauau

SEQ ID NO: 1496331 - RNA, 20 nt, Human
uauuguagcauccuggaaua

SEQ ID NO: 1496332 - RNA, 18 nt, Human
uauuguagcauccuggaa

SEQ ID NO: 1496333 - RNA, 17 nt, Human
uauuguagcauccugga

SEQ ID NO: 1496334 - RNA, 16 nt, Human
uauuguauauuacaau

SEQ ID NO: 1496335 - RNA, 17 nt, Human
uauuguauauuacaaug

SEQ ID NO: 1496336 - RNA, 19 nt, Human
uauuguauauuacaaugau

SEQ ID NO: 1496337 - RNA, 20 nt, Human
acagugaaagaaaauaacaa

SEQ ID NO: 1496338 - RNA, 21 nt, Human
acaguuaccucugccucagaa

SEQ ID NO: 1496339 - RNA, 11 nt, Human
uauucaauaaa

SEQ ID NO: 1496340 - RNA, 15 nt, Human
uauucagcucaugga

SEQ ID NO: 1496341 - RNA, 22 nt, Human
uauuagcccuucuccauggccc

SEQ ID NO: 1496342 - RNA, 23 nt, Human
uauuacaguggggaaugaagaua

SEQ ID NO: 1496343 - RNA, 21 nt, Human
uauguuuucaggcuagaugua

SEQ ID NO: 1496344 - RNA, 19 nt, Human
acccacuugcuuuuaaaau

SEQ ID NO: 1496345 - RNA, 18 nt, Human
acccagaaugagacaucc

SEQ ID NO: 1496346 - RNA, 20 nt, Human
acccagaaugagacauccag

SEQ ID NO: 1496347 - RNA, 19 nt, Human
acccagaaugagacaucca

SEQ ID NO: 1496348 - RNA, 23 nt, Human
accacuuguguuuugcaagccag

SEQ ID NO: 1496349 - RNA, 19 nt, Human
accacuuguguuuugcaag

SEQ ID NO: 1496350 - RNA, 19 nt, Human
ucagccuggcuucaaauug

SEQ ID NO: 1496351 - RNA, 10 nt, Human
acccaggaca

SEQ ID NO: 1496352 - RNA, 11 nt, Human
acccaggacag

SEQ ID NO: 1496353 - RNA, 19 nt, Human
acccagguuggagugcagu

SEQ ID NO: 1496354 - RNA, 20 nt, Human
acccagguuggagugcagug

SEQ ID NO: 1496355 - RNA, 18 nt, Human
acccuccaccgcagaagg

SEQ ID NO: 1496356 - RNA, 20 nt, Human
acccuccaccgcagaaggaa

SEQ ID NO: 1496357 - RNA, 21 nt, Human
acccuccaccgcagaaggaag

SEQ ID NO: 1496358 - RNA, 20 nt, Human
ucaggaagagaaggagcaga

SEQ ID NO: 1496359 - RNA, 15 nt, Human
ucaggaagagaagga

SEQ ID NO: 1496360 - RNA, 16 nt, Human
ucaggaagagaaggag

SEQ ID NO: 1496361 - RNA, 13 nt, Human
uccacucuuucuu

SEQ ID NO: 1496362 - RNA, 15 nt, Human
uccacucuuucuuuc

SEQ ID NO: 1496363 - RNA, 16 nt, Human
uccacucuuucuuuca

SEQ ID NO: 1496364 - RNA, 14 nt, Human
accuuagaauacag

SEQ ID NO: 1496365 - RNA, 12 nt, Human
accuuccaccca

SEQ ID NO: 1496366 - RNA, 14 nt, Human
accuuccacccagu

SEQ ID NO: 1496367 - RNA, 21 nt, Human
uccaacuaucucauuuccaag

SEQ ID NO: 1496368 - RNA, 23 nt, Human
uccaaagucucuggaauuugaaa

SEQ ID NO: 1496369 - RNA, 20 nt, Human
ucauuuuagggguagcauuu

SEQ ID NO: 1496370 - RNA, 13 nt, Human
accucaauguccc

SEQ ID NO: 1496371 - RNA, 12 nt, Human
accuagauuuuu

SEQ ID NO: 1496372 - RNA, 12 nt, Human
accggaccaucu

SEQ ID NO: 1496373 - RNA, 18 nt, Human
accucuaaauucuuucau

SEQ ID NO: 1496374 - RNA, 21 nt, Human
accucuaaauucuuucauuuu

SEQ ID NO: 1496375 - RNA, 14 nt, Human
ucaugugaaaucau

SEQ ID NO: 1496376 - RNA, 22 nt, Human
ucaugaauuaguuuuauaugcu

SEQ ID NO: 1496377 - RNA, 14 nt, Human
ucaugaccaguaaa

SEQ ID NO: 1496378 - RNA, 15 nt, Human
ucaugaccaguaaag

SEQ ID NO: 1496379 - RNA, 15 nt, Human
ucaugcauggaaauu

SEQ ID NO: 1496380 - RNA, 19 nt, Human
uccagccuggggcugaggc

SEQ ID NO: 1496381 - RNA, 22 nt, Human
acuaugaaguuuuuuuuauaca

SEQ ID NO: 1496382 - RNA, 18 nt, Human
ucccucaaccucauccuc

SEQ ID NO: 1496383 - RNA, 19 nt, Human
ucccucaaccucauccucu

SEQ ID NO: 1496384 - RNA, 12 nt, Human
ucccucacccau

SEQ ID NO: 1496385 - RNA, 18 nt, Human
ucccucacccauccuaga

SEQ ID NO: 1496386 - RNA, 14 nt, Human
ucccucacccaucc

SEQ ID NO: 1496387 - RNA, 16 nt, Human
acucaucuagguaaau

SEQ ID NO: 1496388 - RNA, 18 nt, Human
acucaucuagguaaauua

SEQ ID NO: 1496389 - RNA, 21 nt, Human
acucaucuagguaaauuacag

SEQ ID NO: 1496390 - RNA, 18 nt, Human
acuccugaccucaaguga

SEQ ID NO: 1496391 - RNA, 23 nt, Human
acucuuauaucuauauuuuacau

SEQ ID NO: 1496392 - RNA, 16 nt, Human
acugcaaccuccaccu

SEQ ID NO: 1496393 - RNA, 17 nt, Human
acugcaaccuccaccuc

SEQ ID NO: 1496394 - RNA, 20 nt, Human
acugcaaccuccaccucgca

SEQ ID NO: 1496395 - RNA, 14 nt, Human
acugaggaucagag

SEQ ID NO: 1496396 - RNA, 16 nt, Human
acugcaaccucugccu

SEQ ID NO: 1496397 - RNA, 22 nt, Human
acugccuucucaacuccaaacu

SEQ ID NO: 1496398 - RNA, 11 nt, Human
acugccuuuga

SEQ ID NO: 1496399 - RNA, 13 nt, Human
acugccuuugacc

SEQ ID NO: 1496400 - RNA, 23 nt, Human
acugcgcccuuaacugcauccag

SEQ ID NO: 1496401 - RNA, 15 nt, Human
acugcucuccuccac

SEQ ID NO: 1496402 - RNA, 21 nt, Human
acugcucuccuccaccucaac

SEQ ID NO: 1496403 - RNA, 18 nt, Human
uccuucagcacuuuagaa

SEQ ID NO: 1496404 - RNA, 15 nt, Human
uccuucagcacuuua

SEQ ID NO: 1496405 - RNA, 14 nt, Human
uccuucccugcugu

SEQ ID NO: 1496406 - RNA, 20 nt, Human
acuguacagacagaaaaaac

SEQ ID NO: 1496407 - RNA, 19 nt, Human
acuguaaucuuauuuagga

SEQ ID NO: 1496408 - RNA, 22 nt, Human
acuguaaucuuauuuaggaagu

SEQ ID NO: 1496409 - RNA, 16 nt, Human
acuguaaggcaaucau

SEQ ID NO: 1496410 - RNA, 20 nt, Human
agcacuuuagaauaugccuu

SEQ ID NO: 1496411 - RNA, 14 nt, Human
agcacuuuagaaua

SEQ ID NO: 1496412 - RNA, 21 nt, Human
agcacuuuagaauaugccuug

SEQ ID NO: 1496413 - RNA, 11 nt, Human
agcagacauuu

SEQ ID NO: 1496414 - RNA, 16 nt, Human
agcaccaaucaugaau

SEQ ID NO: 1496415 - RNA, 22 nt, Human
agcacagccucuuagaugcagu

SEQ ID NO: 1496416 - RNA, 15 nt, Human
agcacagugaucaag

SEQ ID NO: 1496417 - RNA, 12 nt, Human
ugaggacacaug

SEQ ID NO: 1496418 - RNA, 13 nt, Human
ugaggacacaugu

SEQ ID NO: 1496419 - RNA, 14 nt, Human
ugaggacacauguc

SEQ ID NO: 1496420 - RNA, 15 nt, Human
ugaggacacaugucc

SEQ ID NO: 1496421 - RNA, 15 nt, Human
ugaggacacugauau

SEQ ID NO: 1496422 - RNA, 16 nt, Human
ugaggacacaugucca

SEQ ID NO: 1496423 - RNA, 13 nt, Human
ugaggccagacca

SEQ ID NO: 1496424 - RNA, 13 nt, Human
ugagcuacaaaug

SEQ ID NO: 1496425 - RNA, 14 nt, Human
ugagcuacaaaugc

SEQ ID NO: 1496426 - RNA, 16 nt, Human
ugagcuacaaaugcau

SEQ ID NO: 1496427 - RNA, 14 nt, Human
ugagcuaggaauug

SEQ ID NO: 1496428 - RNA, 16 nt, Human
ugaggggcuaccagga

SEQ ID NO: 1496429 - RNA, 17 nt, Human
ugaggggcuaccaggaa

SEQ ID NO: 1496430 - RNA, 19 nt, Human
ugaggggcuaccaggaaag

SEQ ID NO: 1496431 - RNA, 17 nt, Human
agcagagcugauggaga

SEQ ID NO: 1496432 - RNA, 19 nt, Human
agcagagcugauggagaag

SEQ ID NO: 1496433 - RNA, 21 nt, Human
agcagagcugauggagaagga

SEQ ID NO: 1496434 - RNA, 22 nt, Human
agcagagcugauggagaaggaa

SEQ ID NO: 1496435 - RNA, 23 nt, Human
agcagagcugauggagaaggaag

SEQ ID NO: 1496436 - RNA, 15 nt, Human
ugagguaaguuuuuu

SEQ ID NO: 1496437 - RNA, 16 nt, Human
agauuuaccacuugug

SEQ ID NO: 1496438 - RNA, 14 nt, Human
agauuuaugcauau

SEQ ID NO: 1496439 - RNA, 14 nt, Human
agauuuuccugaaa

SEQ ID NO: 1496440 - RNA, 15 nt, Human
ugacuguuuccauca

SEQ ID NO: 1496441 - RNA, 22 nt, Human
agauucaaugccccugaauuua

SEQ ID NO: 1496442 - RNA, 21 nt, Human
agauucaaugccccugaauuu

SEQ ID NO: 1496443 - RNA, 23 nt, Human
agauuauauauauuuuuuucuga

SEQ ID NO: 1496444 - RNA, 15 nt, Human
agauguguucacaau

SEQ ID NO: 1496445 - RNA, 18 nt, Human
agauguguucacaaugga

SEQ ID NO: 1496446 - RNA, 12 nt, Human
ugacauuuuaca

SEQ ID NO: 1496447 - RNA, 14 nt, Human
ugacauuuuacauu

SEQ ID NO: 1496448 - RNA, 15 nt, Human
ugacauuuuacauua

SEQ ID NO: 1496449 - RNA, 16 nt, Human
ugacauuuuacauuaa

SEQ ID NO: 1496450 - RNA, 21 nt, Human
agaucauugugaaauuauuca

SEQ ID NO: 1496451 - RNA, 18 nt, Human
agagucuauuuacggaac

SEQ ID NO: 1496452 - RNA, 18 nt, Human
ugaagguggaaauaaacu

SEQ ID NO: 1496453 - RNA, 12 nt, Human
ucuuuguaauga

SEQ ID NO: 1496454 - RNA, 13 nt, Human
ucuuuguaaugaa

SEQ ID NO: 1496455 - RNA, 15 nt, Human
ucuuuguaaugaaaa

SEQ ID NO: 1496456 - RNA, 20 nt, Human
ugaagaagcaccaaucauga

SEQ ID NO: 1496457 - RNA, 14 nt, Human
ugaagaagauggua

SEQ ID NO: 1496458 - RNA, 22 nt, Human
ugaagaagcaccaaucaugaau

SEQ ID NO: 1496459 - RNA, 21 nt, Human
agaggcgcaugaauuugugaa

SEQ ID NO: 1496460 - RNA, 15 nt, Human
agagaaugagagaca

SEQ ID NO: 1496461 - RNA, 17 nt, Human
agagacacacugaagaa

SEQ ID NO: 1496462 - RNA, 20 nt, Human
agagacacacugaagaagca

SEQ ID NO: 1496463 - RNA, 18 nt, Human
agagacacacugaagaag

SEQ ID NO: 1496464 - RNA, 15 nt, Human
ucuuuaaaauuacaa

SEQ ID NO: 1496465 - RNA, 20 nt, Human
ucuuuaaaauuacaacuaag

SEQ ID NO: 1496466 - RNA, 18 nt, Human
ucuuuaaaaggaaagaaa

SEQ ID NO: 1496467 - RNA, 14 nt, Human
ucuugaugccuggc

SEQ ID NO: 1496468 - RNA, 20 nt, Human
ucuugaugccuggcggggug

SEQ ID NO: 1496469 - RNA, 21 nt, Human
ucuucccuggaaaccuuccac

SEQ ID NO: 1496470 - RNA, 22 nt, Human
ucuuagaugcaguucugaagaa

SEQ ID NO: 1496471 - RNA, 19 nt, Human
ucuuaauauguucuuuuaa

SEQ ID NO: 1496472 - RNA, 20 nt, Human
agaauuugauaugugaacag

SEQ ID NO: 1496473 - RNA, 19 nt, Human
agaauuugauaugugaaca

SEQ ID NO: 1496474 - RNA, 18 nt, Human
agaauuugauaugugaac

SEQ ID NO: 1496475 - RNA, 17 nt, Human
agaauuugauaugugaa

SEQ ID NO: 1496476 - RNA, 20 nt, Human
agacagaaucucagucuguc

SEQ ID NO: 1496477 - RNA, 11 nt, Human
agaaggaaggc

SEQ ID NO: 1496478 - RNA, 17 nt, Human
agaaggaaggcagggag

SEQ ID NO: 1496479 - RNA, 19 nt, Human
agaaggaaggcagggagga

SEQ ID NO: 1496480 - RNA, 20 nt, Human
agaaggaaggcagggaggag

SEQ ID NO: 1496481 - RNA, 21 nt, Human
agaaggaaggcagggaggagg

SEQ ID NO: 1496482 - RNA, 14 nt, Human
ucuggucucgaacu

SEQ ID NO: 1496483 - RNA, 16 nt, Human
ucuguucauuccucca

SEQ ID NO: 1496484 - RNA, 17 nt, Human
ucuguucauuccuccag

SEQ ID NO: 1496485 - RNA, 21 nt, Human
agaauuucuaggacugaauua

SEQ ID NO: 1496486 - RNA, 13 nt, Human
agaauuucuagga

SEQ ID NO: 1496487 - RNA, 18 nt, Human
ucuguuuuauaauuuugu

SEQ ID NO: 1496488 - RNA, 20 nt, Human
ucuguuuuauaauuuuguga

SEQ ID NO: 1496489 - RNA, 20 nt, Human
ucucuucugaauaaagcaau

SEQ ID NO: 1496490 - RNA, 17 nt, Human
agaaaaauauauacuaa

SEQ ID NO: 1496491 - RNA, 19 nt, Human
agaaaacaaggaugaauua

SEQ ID NO: 1496492 - RNA, 20 nt, Human
agaaagaacggaagaagaga

SEQ ID NO: 1496493 - RNA, 19 nt, Human
agaaaacuuguauuaugug

SEQ ID NO: 1496494 - RNA, 13 nt, Human
agaaacccugcac

SEQ ID NO: 1496495 - RNA, 18 nt, Human
ucucccaaaaaacuacuu

SEQ ID NO: 1496496 - RNA, 19 nt, Human
ucuccauugugccuaaguc

SEQ ID NO: 1496497 - RNA, 14 nt, Human
acuuuggcugcaug

SEQ ID NO: 1496498 - RNA, 17 nt, Human
acuuuggcugcaugcga

SEQ ID NO: 1496499 - RNA, 14 nt, Human
acuuuuggcauuuu

SEQ ID NO: 1496500 - RNA, 12 nt, Human
acuuuuugcagc

SEQ ID NO: 1496501 - RNA, 13 nt, Human
acuuuuugcagcu

SEQ ID NO: 1496502 - RNA, 15 nt, Human
acuuuuugcagcuuu

SEQ ID NO: 1496503 - RNA, 17 nt, Human
acuuuuugcagcuuucu

SEQ ID NO: 1496504 - RNA, 22 nt, Human
acuuuuuuuuuuuaagaguaaa

SEQ ID NO: 1496505 - RNA, 21 nt, Human
ucugacuguuuccaucaaggg

SEQ ID NO: 1496506 - RNA, 17 nt, Human
ucugauacagaaaaguu

SEQ ID NO: 1496507 - RNA, 16 nt, Human
ucugauacagaaaagu

SEQ ID NO: 1496508 - RNA, 19 nt, Human
ucugaggggcuaccaggaa

SEQ ID NO: 1496509 - RNA, 20 nt, Human
ucugaggggcuaccaggaaa

SEQ ID NO: 1496510 - RNA, 21 nt, Human
ucugaggggcuaccaggaaag

SEQ ID NO: 1496511 - RNA, 16 nt, Human
agaagaaagaacggaa

SEQ ID NO: 1496512 - RNA, 18 nt, Human
agaagaaagaacggaaga

SEQ ID NO: 1496513 - RNA, 21 nt, Human
agaagaacugaaaucauacuu

SEQ ID NO: 1496514 - RNA, 12 nt, Human
ucuggauuauau

SEQ ID NO: 1496515 - RNA, 18 nt, Human
ucuggauuauauuaugaa

SEQ ID NO: 1496516 - RNA, 14 nt, Human
agaagcuccaggua

SEQ ID NO: 1496517 - RNA, 19 nt, Human
agcuauggugucauaggcu

SEQ ID NO: 1496518 - RNA, 11 nt, Human
agcuauauaag

SEQ ID NO: 1496519 - RNA, 17 nt, Human
agcuauauaagacaaga

SEQ ID NO: 1496520 - RNA, 21 nt, Human
ugccacaccccccaccccuag

SEQ ID NO: 1496521 - RNA, 23 nt, Human
ugccacaccccccaccccuagga

SEQ ID NO: 1496522 - RNA, 13 nt, Human
ugcagaaagcauc

SEQ ID NO: 1496523 - RNA, 20 nt, Human
ugcagaaagcaucccucacc

SEQ ID NO: 1496524 - RNA, 19 nt, Human
agcccuucuuuccacagaa

SEQ ID NO: 1496525 - RNA, 18 nt, Human
agcccuucuuuccacaga

SEQ ID NO: 1496526 - RNA, 22 nt, Human
ugcagcccugcugcugccugcc

SEQ ID NO: 1496527 - RNA, 21 nt, Human
ugcaggucccuaauaaagcug

SEQ ID NO: 1496528 - RNA, 18 nt, Human
ugcaggucccuaauaaag

SEQ ID NO: 1496529 - RNA, 19 nt, Human
ugcaggucccuaauaaagc

SEQ ID NO: 1496530 - RNA, 20 nt, Human
ugcaggucccuaauaaagcu

SEQ ID NO: 1496531 - RNA, 22 nt, Human
ugcauaacguauaaaagccugu

SEQ ID NO: 1496532 - RNA, 15 nt, Human
ugcauaauggucaga

SEQ ID NO: 1496533 - RNA, 14 nt, Human
ugcuaguaauugga

SEQ ID NO: 1496534 - RNA, 17 nt, Human
aggaaagaggaagcaaa

SEQ ID NO: 1496535 - RNA, 16 nt, Human
ugcuaguaauuggaaa

SEQ ID NO: 1496536 - RNA, 19 nt, Human
aggaaagagaacuuccaga

SEQ ID NO: 1496537 - RNA, 13 nt, Human
aggaaagagaacu

SEQ ID NO: 1496538 - RNA, 12 nt, Human
aggaaagaaaac

SEQ ID NO: 1496539 - RNA, 13 nt, Human
aggaaagaaaaca

SEQ ID NO: 1496540 - RNA, 21 nt, Human
agcuuauugucuagugaaacu

SEQ ID NO: 1496541 - RNA, 22 nt, Human
aggaauuuuauuuuuuucugaa

SEQ ID NO: 1496542 - RNA, 12 nt, Human
aggaagagaagg

SEQ ID NO: 1496543 - RNA, 14 nt, Human
aggaagagaaggag

SEQ ID NO: 1496544 - RNA, 16 nt, Human
aggaagagaaggagca

SEQ ID NO: 1496545 - RNA, 17 nt, Human
aggaagagaaggagcag

SEQ ID NO: 1496546 - RNA, 24 nt, Human
aggaaagcgccuccaacccuagca

SEQ ID NO: 1496547 - RNA, 18 nt, Human
aggaaauauuuauuuuaa

SEQ ID NO: 1496548 - RNA, 14 nt, Human
aggaaauauuuauu

SEQ ID NO: 1496549 - RNA, 17 nt, Human
agcucucaguugcagcc

SEQ ID NO: 1496550 - RNA, 21 nt, Human
agcucucaguugcagcccugc

SEQ ID NO: 1496551 - RNA, 14 nt, Human
agcugauggagaag

SEQ ID NO: 1496552 - RNA, 15 nt, Human
agcugauggagaagg

SEQ ID NO: 1496553 - RNA, 16 nt, Human
agcugauggagaagga

SEQ ID NO: 1496554 - RNA, 17 nt, Human
agcugauggagaaggaa

SEQ ID NO: 1496555 - RNA, 19 nt, Human
agcugauggagaaggaagg

SEQ ID NO: 1496556 - RNA, 16 nt, Human
ugccucucugcagguc

SEQ ID NO: 1496557 - RNA, 18 nt, Human
ugccucucugcagguccc

SEQ ID NO: 1496558 - RNA, 19 nt, Human
ugccucucugcaggucccu

SEQ ID NO: 1496559 - RNA, 20 nt, Human
ugccucucugcaggucccua

SEQ ID NO: 1496560 - RNA, 17 nt, Human
agcuggggccaggcugg

SEQ ID NO: 1496561 - RNA, 21 nt, Human
ugccucucugcaggucccuaa

SEQ ID NO: 1496562 - RNA, 15 nt, Human
agcugccucuucccu

SEQ ID NO: 1496563 - RNA, 19 nt, Human
agcugccucuucccucuuc

SEQ ID NO: 1496564 - RNA, 13 nt, Human
ugccuuguuucau

SEQ ID NO: 1496565 - RNA, 20 nt, Human
agcuggggccaggcuggguc

SEQ ID NO: 1496566 - RNA, 13 nt, Human
uggcagcaacaau

SEQ ID NO: 1496567 - RNA, 18 nt, Human
uggcaucaucucagcuca

SEQ ID NO: 1496568 - RNA, 20 nt, Human
aggcaggaguuucguuuuca

SEQ ID NO: 1496569 - RNA, 22 nt, Human
aggcagggaggaggcagagaag

SEQ ID NO: 1496570 - RNA, 20 nt, Human
aggcagcucuaaaugucaau

SEQ ID NO: 1496571 - RNA, 18 nt, Human
aggcaguucaaagcagga

SEQ ID NO: 1496572 - RNA, 19 nt, Human
aggcaguucaaagcaggau

SEQ ID NO: 1496573 - RNA, 17 nt, Human
uggacaccugcccugcc

SEQ ID NO: 1496574 - RNA, 18 nt, Human
uggacaccugcccugccc

SEQ ID NO: 1496575 - RNA, 16 nt, Human
uggagaagaacugaaa

SEQ ID NO: 1496576 - RNA, 16 nt, Human
uggagcccacuguacu

SEQ ID NO: 1496577 - RNA, 19 nt, Human
uggagcccacuguacuugc

SEQ ID NO: 1496578 - RNA, 23 nt, Human
uggagcccacuguacuugcucuu

SEQ ID NO: 1496579 - RNA, 14 nt, Human
uggaauuugaaaca

SEQ ID NO: 1496580 - RNA, 10 nt, Human
uggacaccug

SEQ ID NO: 1496581 - RNA, 11 nt, Human
uggacaccugc

SEQ ID NO: 1496582 - RNA, 12 nt, Human
uggacaccugcc

SEQ ID NO: 1496583 - RNA, 13 nt, Human
uggacaccugccc

SEQ ID NO: 1496584 - RNA, 14 nt, Human
uggacaccugcccu

SEQ ID NO: 1496585 - RNA, 15 nt, Human
uggacaccugcccug

SEQ ID NO: 1496586 - RNA, 16 nt, Human
uggacaccugcccugc

SEQ ID NO: 1496587 - RNA, 14 nt, Human
uggacaaaauggaa

SEQ ID NO: 1496588 - RNA, 17 nt, Human
uggacaaaauggaauac

SEQ ID NO: 1496589 - RNA, 19 nt, Human
aggaguuucguuuucaaaa

SEQ ID NO: 1496590 - RNA, 14 nt, Human
uggaagugcuaauu

SEQ ID NO: 1496591 - RNA, 15 nt, Human
uggaagugacuuugg

SEQ ID NO: 1496592 - RNA, 17 nt, Human
uggaagugacuuuggcu

SEQ ID NO: 1496593 - RNA, 23 nt, Human
uggaagugacuuuggcugcaugc

SEQ ID NO: 1496594 - RNA, 15 nt, Human
agggcuccuauucaa

SEQ ID NO: 1496595 - RNA, 22 nt, Human
agggcuguuauaaucuuucaca

SEQ ID NO: 1496596 - RNA, 15 nt, Human
ugggagaaaugaaaa

SEQ ID NO: 1496597 - RNA, 13 nt, Human
agggaaauuucag

SEQ ID NO: 1496598 - RNA, 21 nt, Human
agggagacuggguaggaaaga

SEQ ID NO: 1496599 - RNA, 16 nt, Human
ugggagaaaugaaaaa

SEQ ID NO: 1496600 - RNA, 14 nt, Human
ugggaggcucugga

SEQ ID NO: 1496601 - RNA, 17 nt, Human
ugggaggcucuggagcc

SEQ ID NO: 1496602 - RNA, 23 nt, Human
ugggaggcucuggagcccacugu

SEQ ID NO: 1496603 - RNA, 14 nt, Human
ugggcauucaaaug

SEQ ID NO: 1496604 - RNA, 15 nt, Human
aggcuuuuuuaucau

SEQ ID NO: 1496605 - RNA, 18 nt, Human
aggcuuuuuuaucaugug

SEQ ID NO: 1496606 - RNA, 21 nt, Human
aggcuuuuuuaucaugugaaa

SEQ ID NO: 1496607 - RNA, 15 nt, Human
agggaaaacauucca

SEQ ID NO: 1496608 - RNA, 16 nt, Human
agggaaaacauuccau

SEQ ID NO: 1496609 - RNA, 18 nt, Human
agggaaaacauuccaucc

SEQ ID NO: 1496610 - RNA, 10 nt, Human
aggcuggguc

SEQ ID NO: 1496611 - RNA, 15 nt, Human
aggcugggucgcccu

SEQ ID NO: 1496612 - RNA, 18 nt, Human
aggcugggucgcccugga

SEQ ID NO: 1496613 - RNA, 20 nt, Human
aggcugggucgcccuggacu

SEQ ID NO: 1496614 - RNA, 21 nt, Human
aggcugggucgcccuggacug

SEQ ID NO: 1496615 - RNA, 18 nt, Human
ugggaaacaaaaggauaa

SEQ ID NO: 1496616 - RNA, 14 nt, Human
uguacauauaagug

SEQ ID NO: 1496617 - RNA, 20 nt, Human
agguuucacuguguuggcca

SEQ ID NO: 1496618 - RNA, 13 nt, Human
agguugaaaaaca

SEQ ID NO: 1496619 - RNA, 13 nt, Human
aguaauuggaaag

SEQ ID NO: 1496620 - RNA, 12 nt, Human
aguaauuggaaa

SEQ ID NO: 1496621 - RNA, 13 nt, Human
aguaaugauaacu

SEQ ID NO: 1496622 - RNA, 16 nt, Human
aguaaaaacaaagaaa

SEQ ID NO: 1496623 - RNA, 23 nt, Human
aguaaaaacaaagaaauuaugug

SEQ ID NO: 1496624 - RNA, 14 nt, Human
uguauauuacaaug

SEQ ID NO: 1496625 - RNA, 15 nt, Human
uguauauuacaauga

SEQ ID NO: 1496626 - RNA, 19 nt, Human
uguaguguuggagaagaac

SEQ ID NO: 1496627 - RNA, 18 nt, Human
uguaguguuggagaagaa

SEQ ID NO: 1496628 - RNA, 17 nt, Human
uguaguguuggagaaga

SEQ ID NO: 1496629 - RNA, 23 nt, Human
aguaccaguaggggcuuauaaua

SEQ ID NO: 1496630 - RNA, 15 nt, Human
agucaggaaagagaa

SEQ ID NO: 1496631 - RNA, 14 nt, Human
agucaggaaagaga

SEQ ID NO: 1496632 - RNA, 20 nt, Human
agucuauuuacggaacucaa

SEQ ID NO: 1496633 - RNA, 15 nt, Human
agucuauuuacggaa

SEQ ID NO: 1496634 - RNA, 19 nt, Human
uguauauuacaaugaucac

SEQ ID NO: 1496635 - RNA, 14 nt, Human
agucaccagagacu

SEQ ID NO: 1496636 - RNA, 16 nt, Human
agucuuucacauuuaa

SEQ ID NO: 1496637 - RNA, 18 nt, Human
agucuuucacauuuaaau

SEQ ID NO: 1496638 - RNA, 12 nt, Human
agugagaggcug

SEQ ID NO: 1496639 - RNA, 18 nt, Human
agugacuuuggcugcaug

SEQ ID NO: 1496640 - RNA, 21 nt, Human
uguggaucaaauccagccugc

SEQ ID NO: 1496641 - RNA, 21 nt, Human
ugugcucaggagcccugggag

SEQ ID NO: 1496642 - RNA, 14 nt, Human
agugcaaauuguca

SEQ ID NO: 1496643 - RNA, 23 nt, Human
agugcaguggcgcgaucucagcu

SEQ ID NO: 1496644 - RNA, 23 nt, Human
agugcaguggcgugaucucagcu

SEQ ID NO: 1496645 - RNA, 23 nt, Human
agugcaguggcaucaucucagcu

SEQ ID NO: 1496646 - RNA, 21 nt, Human
agugcacuaauguguaagaca

SEQ ID NO: 1496647 - RNA, 17 nt, Human
agugcacuaauguguaa

SEQ ID NO: 1496648 - RNA, 18 nt, Human
agugccagcaccugccca

SEQ ID NO: 1496649 - RNA, 22 nt, Human
uguugcccacagcuguaugauu

SEQ ID NO: 1496650 - RNA, 15 nt, Human
uguugcauagaauaa

SEQ ID NO: 1496651 - RNA, 18 nt, Human
aguguguguuuuucauaa

SEQ ID NO: 1496652 - RNA, 19 nt, Human
aguguguguuuuucauaaa

SEQ ID NO: 1496653 - RNA, 16 nt, Human
uguuaugacuauguaa

SEQ ID NO: 1496654 - RNA, 17 nt, Human
uguuaugacuauguaaa

SEQ ID NO: 1496655 - RNA, 18 nt, Human
uguuaugacuauguaaac

SEQ ID NO: 1496656 - RNA, 20 nt, Human
uguuaugacuauguaaacua

SEQ ID NO: 1496657 - RNA, 17 nt, Human
uguuacaaauuguagaa

SEQ ID NO: 1496658 - RNA, 18 nt, Human
uguuacaaauuguagaag

SEQ ID NO: 1496659 - RNA, 16 nt, Human
aguggggaaugaagau

SEQ ID NO: 1496660 - RNA, 14 nt, Human
auacuauaguacca

SEQ ID NO: 1496661 - RNA, 19 nt, Human
uuauauuugaaauauugac

SEQ ID NO: 1496662 - RNA, 19 nt, Human
auacgugggcauucaaaug

SEQ ID NO: 1496663 - RNA, 18 nt, Human
auacgugggcauucaaau

SEQ ID NO: 1496664 - RNA, 12 nt, Human
uuauaaacuuuu

SEQ ID NO: 1496665 - RNA, 16 nt, Human
uuauaaacuuuuuucu

SEQ ID NO: 1496666 - RNA, 22 nt, Human
uuauaaacuuuuuucuuacugu

SEQ ID NO: 1496667 - RNA, 22 nt, Human
auacauguaauucuaccaaggu

SEQ ID NO: 1496668 - RNA, 21 nt, Human
auacaggaugaugacuaugga

SEQ ID NO: 1496669 - RNA, 21 nt, Human
uuaugaauuacauuuguauaa

SEQ ID NO: 1496670 - RNA, 17 nt, Human
uuaugaauuacauuugu

SEQ ID NO: 1496671 - RNA, 16 nt, Human
uuaugaauuacauuug

SEQ ID NO: 1496672 - RNA, 14 nt, Human
uuaugaauuacauu

SEQ ID NO: 1496673 - RNA, 15 nt, Human
uuaugacuauguaaa

SEQ ID NO: 1496674 - RNA, 16 nt, Human
uuaugacuauguaaac

SEQ ID NO: 1496675 - RNA, 20 nt, Human
uuaugauacuugaaaauuaa

SEQ ID NO: 1496676 - RNA, 19 nt, Human
uuaugaaacuuuuggaagg

SEQ ID NO: 1496677 - RNA, 20 nt, Human
uuaugaagcuuuuaugugaa

SEQ ID NO: 1496678 - RNA, 18 nt, Human
uuaugaaacuuuuggaag

SEQ ID NO: 1496679 - RNA, 17 nt, Human
uuaugaaacuuuuggaa

SEQ ID NO: 1496680 - RNA, 14 nt, Human
uuaugaaacuuuug

SEQ ID NO: 1496681 - RNA, 22 nt, Human
uuaugauuaaguaaugauaacu

SEQ ID NO: 1496682 - RNA, 19 nt, Human
uuaugauuaaguaaugaua

SEQ ID NO: 1496683 - RNA, 15 nt, Human
uuaugugaaacaugu

SEQ ID NO: 1496684 - RNA, 14 nt, Human
uuaugugacauuuu

SEQ ID NO: 1496685 - RNA, 19 nt, Human
uuaugugacauuuuacauu

SEQ ID NO: 1496686 - RNA, 22 nt, Human
uuaugugccagauuuaugcaua

SEQ ID NO: 1496687 - RNA, 20 nt, Human
uuaugugacauuuuacauua

SEQ ID NO: 1496688 - RNA, 13 nt, Human
uuaugugaaacau

SEQ ID NO: 1496689 - RNA, 12 nt, Human
uuauucauaauu

SEQ ID NO: 1496690 - RNA, 15 nt, Human
uuauuauauuuacaa

SEQ ID NO: 1496691 - RNA, 19 nt, Human
uuauguuaaaacugggaca

SEQ ID NO: 1496692 - RNA, 14 nt, Human
uuauuauauuuaca

SEQ ID NO: 1496693 - RNA, 18 nt, Human
auacucuuauaucuauau

SEQ ID NO: 1496694 - RNA, 14 nt, Human
auacucuuauaucu

SEQ ID NO: 1496695 - RNA, 14 nt, Human
auagacaauugagg

SEQ ID NO: 1496696 - RNA, 21 nt, Human
auagacaauugagguaaguuu

SEQ ID NO: 1496697 - RNA, 12 nt, Human
auagacacgcac

SEQ ID NO: 1496698 - RNA, 14 nt, Human
auagaauaaaauuu

SEQ ID NO: 1496699 - RNA, 19 nt, Human
auagaauaaaauuuuuaau

SEQ ID NO: 1496700 - RNA, 22 nt, Human
auagaauaaaauuuuuaaucuu

SEQ ID NO: 1496701 - RNA, 13 nt, Human
auagaaguaaaaa

SEQ ID NO: 1496702 - RNA, 14 nt, Human
auagagacgggacu

SEQ ID NO: 1496703 - RNA, 18 nt, Human
auagauaggucagugcaa

SEQ ID NO: 1496704 - RNA, 15 nt, Human
aguuuguugaaacac

SEQ ID NO: 1496705 - RNA, 16 nt, Human
uuaaauuuuuuuuaca

SEQ ID NO: 1496706 - RNA, 12 nt, Human
uuaaaaugagaa

SEQ ID NO: 1496707 - RNA, 19 nt, Human
uuaaaaugagaaaucuaaa

SEQ ID NO: 1496708 - RNA, 16 nt, Human
aguuuagcuggaaaag

SEQ ID NO: 1496709 - RNA, 15 nt, Human
aguuuagcuggaaaa

SEQ ID NO: 1496710 - RNA, 17 nt, Human
aguuuaaauuguaauag

SEQ ID NO: 1496711 - RNA, 20 nt, Human
aguuuaaauuguaauaggcg

SEQ ID NO: 1496712 - RNA, 19 nt, Human
uuaagacgaaacauuuguu

SEQ ID NO: 1496713 - RNA, 22 nt, Human
auaaaagggacugagaaauuua

SEQ ID NO: 1496714 - RNA, 23 nt, Human
aguuuuuugaaauuaugugacau

SEQ ID NO: 1496715 - RNA, 19 nt, Human
auaaaagccuguuuaagag

SEQ ID NO: 1496716 - RNA, 20 nt, Human
auaaaagccuguuuaagaga

SEQ ID NO: 1496717 - RNA, 16 nt, Human
aguuuuauaugcuucu

SEQ ID NO: 1496718 - RNA, 21 nt, Human
aguuuuuugaaauuaugugac

SEQ ID NO: 1496719 - RNA, 15 nt, Human
aguuuuuuuuauaca

SEQ ID NO: 1496720 - RNA, 22 nt, Human
uuaagagagucuauuuacggaa

SEQ ID NO: 1496721 - RNA, 22 nt, Human
uuaagacgaaacauuuguucua

SEQ ID NO: 1496722 - RNA, 16 nt, Human
uuaauuugguuuucac

SEQ ID NO: 1496723 - RNA, 13 nt, Human
uuaaucuuuaauu

SEQ ID NO: 1496724 - RNA, 17 nt, Human
uuaaucuuuaauuuuac

SEQ ID NO: 1496725 - RNA, 23 nt, Human
uuacuguacagacagaaaaaacu

SEQ ID NO: 1496726 - RNA, 20 nt, Human
uuacugcuuaauucaaauaa

SEQ ID NO: 1496727 - RNA, 17 nt, Human
uuacaguggggaaugaa

SEQ ID NO: 1496728 - RNA, 15 nt, Human
uuauaaaaauaaaaa

SEQ ID NO: 1496729 - RNA, 19 nt, Human
uuaguacuccccuccuuga

SEQ ID NO: 1496730 - RNA, 21 nt, Human
uuauaaaaauaaaaaacacug

SEQ ID NO: 1496731 - RNA, 22 nt, Human
uuauaaaaauaaaaaacacugg

SEQ ID NO: 1496732 - RNA, 17 nt, Human
uuagguaauuuuuuuca

SEQ ID NO: 1496733 - RNA, 13 nt, Human
uuaguaaucauau

SEQ ID NO: 1496734 - RNA, 14 nt, Human
uuaguaaucauauu

SEQ ID NO: 1496735 - RNA, 16 nt, Human
uuaggguuaugauuaa

SEQ ID NO: 1496736 - RNA, 14 nt, Human
uuaggguuaugauu

SEQ ID NO: 1496737 - RNA, 14 nt, Human
auaaucuuucacag

SEQ ID NO: 1496738 - RNA, 23 nt, Human
auaauucacauuguauucagagu

SEQ ID NO: 1496739 - RNA, 14 nt, Human
auaauuuagauggu

SEQ ID NO: 1496740 - RNA, 12 nt, Human
auaauuuuaaau

SEQ ID NO: 1496741 - RNA, 13 nt, Human
auaauuuuaaaug

SEQ ID NO: 1496742 - RNA, 14 nt, Human
auaauuuuaaaugu

SEQ ID NO: 1496743 - RNA, 17 nt, Human
augaauuacauuuguau

SEQ ID NO: 1496744 - RNA, 16 nt, Human
augaauuacauuugua

SEQ ID NO: 1496745 - RNA, 21 nt, Human
augaauauuuaguguucauaa

SEQ ID NO: 1496746 - RNA, 15 nt, Human
augaauuacauuugu

SEQ ID NO: 1496747 - RNA, 13 nt, Human
augaacuugagga

SEQ ID NO: 1496748 - RNA, 15 nt, Human
augaacuugaggaca

SEQ ID NO: 1496749 - RNA, 16 nt, Human
augaauauuuaguguu

SEQ ID NO: 1496750 - RNA, 18 nt, Human
augaacuuguaaaggaau

SEQ ID NO: 1496751 - RNA, 16 nt, Human
augaacuugaggacac

SEQ ID NO: 1496752 - RNA, 17 nt, Human
augaacuugaggacaca

SEQ ID NO: 1496753 - RNA, 18 nt, Human
augaacuugaggacacau

SEQ ID NO: 1496754 - RNA, 19 nt, Human
augaacuugaggacacaug

SEQ ID NO: 1496755 - RNA, 20 nt, Human
augaacuugaggacacaugu

SEQ ID NO: 1496756 - RNA, 21 nt, Human
augaacuugaggacacauguc

SEQ ID NO: 1496757 - RNA, 22 nt, Human
augaacuugaggacacaugucc

SEQ ID NO: 1496758 - RNA, 15 nt, Human
aucugcgugugugca

SEQ ID NO: 1496759 - RNA, 15 nt, Human
uugcauuuauaugua

SEQ ID NO: 1496760 - RNA, 20 nt, Human
uugcauuuauauguaccgua

SEQ ID NO: 1496761 - RNA, 14 nt, Human
aucuuauaauuuaa

SEQ ID NO: 1496762 - RNA, 21 nt, Human
auccucuccacagcugccucu

SEQ ID NO: 1496763 - RNA, 17 nt, Human
uugaagggaaauuucag

SEQ ID NO: 1496764 - RNA, 16 nt, Human
uugagauguguucaca

SEQ ID NO: 1496765 - RNA, 16 nt, Human
uugagucaaaaaaucu

SEQ ID NO: 1496766 - RNA, 18 nt, Human
uugacuuauaguacauga

SEQ ID NO: 1496767 - RNA, 14 nt, Human
aucucauuuccaag

SEQ ID NO: 1496768 - RNA, 12 nt, Human
uucucuaggaaa

SEQ ID NO: 1496769 - RNA, 20 nt, Human
aucauuuuaccuuugacaaa

SEQ ID NO: 1496770 - RNA, 15 nt, Human
uucuuuguaaugaaa

SEQ ID NO: 1496771 - RNA, 16 nt, Human
uucuuuguaaugaaaa

SEQ ID NO: 1496772 - RNA, 17 nt, Human
uugaaauuguauuacaa

SEQ ID NO: 1496773 - RNA, 17 nt, Human
uugaaauuaugugacau

SEQ ID NO: 1496774 - RNA, 20 nt, Human
uugaaauuaugugacauuuu

SEQ ID NO: 1496775 - RNA, 21 nt, Human
aucacugaacuuugcugagcc

SEQ ID NO: 1496776 - RNA, 21 nt, Human
aucaaucuguaaaacuaagaa

SEQ ID NO: 1496777 - RNA, 19 nt, Human
uuccguagguuauuuucag

SEQ ID NO: 1496778 - RNA, 15 nt, Human
uuccugaacaggaua

SEQ ID NO: 1496779 - RNA, 14 nt, Human
uuccugaacaggau

SEQ ID NO: 1496780 - RNA, 20 nt, Human
uuccuaaauauauuuuaaga

SEQ ID NO: 1496781 - RNA, 13 nt, Human
uucuaaaguaaaa

SEQ ID NO: 1496782 - RNA, 22 nt, Human
aucacuugucaauaaaauccau

SEQ ID NO: 1496783 - RNA, 23 nt, Human
uucuaggacugaauuaugaaacu

SEQ ID NO: 1496784 - RNA, 16 nt, Human
uucuaggacugaauua

SEQ ID NO: 1496785 - RNA, 14 nt, Human
uucuaggacugaau

SEQ ID NO: 1496786 - RNA, 13 nt, Human
uucuaggacugaa

SEQ ID NO: 1496787 - RNA, 17 nt, Human
aucaggguuaguauugu

SEQ ID NO: 1496788 - RNA, 16 nt, Human
auggcacuaguauuuc

SEQ ID NO: 1496789 - RNA, 14 nt, Human
auggcacuaguauu

SEQ ID NO: 1496790 - RNA, 14 nt, Human
auggagaaggaagg

SEQ ID NO: 1496791 - RNA, 15 nt, Human
auggagaaggaaggc

SEQ ID NO: 1496792 - RNA, 18 nt, Human
uuucccccuagccugccu

SEQ ID NO: 1496793 - RNA, 12 nt, Human
auggagaaggaa

SEQ ID NO: 1496794 - RNA, 13 nt, Human
auggagaaggaag

SEQ ID NO: 1496795 - RNA, 15 nt, Human
auggacacuacaccc

SEQ ID NO: 1496796 - RNA, 16 nt, Human
auggacacuacaccca

SEQ ID NO: 1496797 - RNA, 17 nt, Human
auggacacuacacccag

SEQ ID NO: 1496798 - RNA, 18 nt, Human
auggacacuacacccagc

SEQ ID NO: 1496799 - RNA, 19 nt, Human
auggacacuacacccagca

SEQ ID NO: 1496800 - RNA, 22 nt, Human
auggacacuacacccagcaaua

SEQ ID NO: 1496801 - RNA, 17 nt, Human
uuucaaacauauauaac

SEQ ID NO: 1496802 - RNA, 16 nt, Human
uuucaaacauauauaa

SEQ ID NO: 1496803 - RNA, 22 nt, Human
uuucaaaauuguuacaaauugu

SEQ ID NO: 1496804 - RNA, 20 nt, Human
uuuauuuuguguuuaggaac

SEQ ID NO: 1496805 - RNA, 16 nt, Human
uuuauuuuguguuuag

SEQ ID NO: 1496806 - RNA, 13 nt, Human
uuucaaaagaaag

SEQ ID NO: 1496807 - RNA, 19 nt, Human
augcuguucaugaaagauu

SEQ ID NO: 1496808 - RNA, 14 nt, Human
augcugugugacuc

SEQ ID NO: 1496809 - RNA, 23 nt, Human
augcuguucaugaaagauucaau

SEQ ID NO: 1496810 - RNA, 16 nt, Human
augcuucccuuuccug

SEQ ID NO: 1496811 - RNA, 17 nt, Human
augcuguucaugaaaga

SEQ ID NO: 1496812 - RNA, 17 nt, Human
uuuaucaugugaaauca

SEQ ID NO: 1496813 - RNA, 18 nt, Human
uuuaucaugugaaaucau

SEQ ID NO: 1496814 - RNA, 15 nt, Human
augauaacuggaaac

SEQ ID NO: 1496815 - RNA, 18 nt, Human
augauuaaguaaugauaa

SEQ ID NO: 1496816 - RNA, 14 nt, Human
augauuaaguaaug

SEQ ID NO: 1496817 - RNA, 17 nt, Human
augauacuugaaaauua

SEQ ID NO: 1496818 - RNA, 21 nt, Human
augauacuugaaaauuaacau

SEQ ID NO: 1496819 - RNA, 19 nt, Human
augauugaauuauauguuc

SEQ ID NO: 1496820 - RNA, 13 nt, Human
augcaguucugaa

SEQ ID NO: 1496821 - RNA, 18 nt, Human
uuuaaauauaugcuaagu

SEQ ID NO: 1496822 - RNA, 14 nt, Human
uuugcaagccagau

SEQ ID NO: 1496823 - RNA, 19 nt, Human
auguagccccucuccugga

SEQ ID NO: 1496824 - RNA, 16 nt, Human
auguacuucaugcugu

SEQ ID NO: 1496825 - RNA, 16 nt, Human
auguaccguaggcuuu

SEQ ID NO: 1496826 - RNA, 22 nt, Human
auguauuacaguggggaaugaa

SEQ ID NO: 1496827 - RNA, 13 nt, Human
uuuggcaggugca

SEQ ID NO: 1496828 - RNA, 16 nt, Human
augugacauuuuacau

SEQ ID NO: 1496829 - RNA, 18 nt, Human
augugacauuuuacauua

SEQ ID NO: 1496830 - RNA, 21 nt, Human
uuuguaguguuggagaagaac

SEQ ID NO: 1496831 - RNA, 19 nt, Human
uuuguaguguuggagaaga

SEQ ID NO: 1496832 - RNA, 12 nt, Human
uuuguauaaaag

SEQ ID NO: 1496833 - RNA, 13 nt, Human
uuuguaaugaaaa

SEQ ID NO: 1496834 - RNA, 14 nt, Human
uuuguaaugaaaac

SEQ ID NO: 1496835 - RNA, 17 nt, Human
uuugugaagcaaaauuu

SEQ ID NO: 1496836 - RNA, 20 nt, Human
uuugugaagguggaaauaaa

SEQ ID NO: 1496837 - RNA, 21 nt, Human
augguucccuugaugaagaag

SEQ ID NO: 1496838 - RNA, 13 nt, Human
augguuguacaua

SEQ ID NO: 1496839 - RNA, 14 nt, Human
auggggguuucacc

SEQ ID NO: 1496840 - RNA, 22 nt, Human
uuugaaauuaugugacauuuua

SEQ ID NO: 1496841 - RNA, 15 nt, Human
uuugaaauuauguga

SEQ ID NO: 1496842 - RNA, 17 nt, Human
uuugaaauuaugugaca

SEQ ID NO: 1496843 - RNA, 13 nt, Human
auugucuagugaa

SEQ ID NO: 1496844 - RNA, 15 nt, Human
auuguuuuacaauag

SEQ ID NO: 1496845 - RNA, 17 nt, Human
auuguuuuacaauaguu

SEQ ID NO: 1496846 - RNA, 18 nt, Human
auuguuuuacaauaguuc

SEQ ID NO: 1496847 - RNA, 13 nt, Human
auuguuuuacaau

SEQ ID NO: 1496848 - RNA, 14 nt, Human
auuguuuuacaaua

SEQ ID NO: 1496849 - RNA, 21 nt, Human
auugcuuuguauuguauauua

SEQ ID NO: 1496850 - RNA, 18 nt, Human
auugacuuuuuauggcac

SEQ ID NO: 1496851 - RNA, 13 nt, Human
auugacuuuuuau

SEQ ID NO: 1496852 - RNA, 13 nt, Human
auuggaaacaagu

SEQ ID NO: 1496853 - RNA, 19 nt, Human
auuggacaguaaaauccac

SEQ ID NO: 1496854 - RNA, 14 nt, Human
auuuauuuuaauaa

SEQ ID NO: 1496855 - RNA, 20 nt, Human
auuucuugagguaaaagcau

SEQ ID NO: 1496856 - RNA, 18 nt, Human
auuugaaacacuuugcau

SEQ ID NO: 1496857 - RNA, 23 nt, Human
auuucuaggacugaauuaugaaa

SEQ ID NO: 1496858 - RNA, 20 nt, Human
auuucuaggacugaauuaug

SEQ ID NO: 1496859 - RNA, 14 nt, Human
auuucccucucuca

SEQ ID NO: 1496860 - RNA, 18 nt, Human
auuucuaggacugaauua

SEQ ID NO: 1496861 - RNA, 17 nt, Human
auuucuaggacugaauu

SEQ ID NO: 1496862 - RNA, 23 nt, Human
auuugugaagguggaaauaaacu

SEQ ID NO: 1496863 - RNA, 16 nt, Human
auuuuaaaagaaugau

SEQ ID NO: 1496864 - RNA, 18 nt, Human
auuugugaagguggaaau

SEQ ID NO: 1496865 - RNA, 21 nt, Human
auuugugaagguggaaauaaa

SEQ ID NO: 1496866 - RNA, 23 nt, Human
auuuuaaaagaaugauuaugaau

SEQ ID NO: 1496867 - RNA, 15 nt, Human
auuuguauaaaauaa

SEQ ID NO: 1496868 - RNA, 14 nt, Human
auuuguauaaaaua

SEQ ID NO: 1496869 - RNA, 22 nt, Human
auuuguaguguuggagaagaac

SEQ ID NO: 1496870 - RNA, 16 nt, Human
auuuuguuucagugca

SEQ ID NO: 1496871 - RNA, 17 nt, Human
auuuuguguuuaggaac

SEQ ID NO: 1496872 - RNA, 14 nt, Human
auuuuccugaaaac

SEQ ID NO: 1496873 - RNA, 14 nt, Human
auuuucuauaauuu

SEQ ID NO: 1496874 - RNA, 15 nt, Human
auuuucuauaauuua

SEQ ID NO: 1496875 - RNA, 12 nt, Human
auuuuaauaaug

SEQ ID NO: 1496876 - RNA, 15 nt, Human
auuuuaauaaacacu

SEQ ID NO: 1496877 - RNA, 16 nt, Human
auuuuaauaaacacuc

SEQ ID NO: 1496878 - RNA, 17 nt, Human
auuuuaauaaacacucu

SEQ ID NO: 1496879 - RNA, 15 nt, Human
auuuuuguaguagcg

SEQ ID NO: 1496880 - RNA, 22 nt, Human
auuuuugugauuuugugauuga

SEQ ID NO: 1496881 - RNA, 22 nt, Human
auuuuuugggcagcaauuuaaa

SEQ ID NO: 1496882 - RNA, 23 nt, Human
auuuuuucucuaggaaauauuua

SEQ ID NO: 1496883 - RNA, 20 nt, Human
auuuuuucucuaggaaauau

SEQ ID NO: 1496884 - RNA, 16 nt, Human
auuuuuugaaaagcag

SEQ ID NO: 1496885 - RNA, 19 nt, Human
auuuuuugaaaagcagaca

SEQ ID NO: 1496886 - RNA, 21 nt, Human
auucuucccuaucuuugccac

SEQ ID NO: 1496887 - RNA, 20 nt, Human
auucuucccuaucuuugcca

SEQ ID NO: 1496888 - RNA, 15 nt, Human
auuauauuuacaaau

SEQ ID NO: 1496889 - RNA, 14 nt, Human
auuauauuaugaag

SEQ ID NO: 1496890 - RNA, 18 nt, Human
auuauauguucagauuau

SEQ ID NO: 1496891 - RNA, 21 nt, Human
auuauguuaaaacugggacag

SEQ ID NO: 1496892 - RNA, 18 nt, Human
auuauauuuauuacugua

SEQ ID NO: 1496893 - RNA, 15 nt, Human
auuauauuuauuacu

SEQ ID NO: 1496894 - RNA, 15 nt, Human
auuauuauuuggccc

SEQ ID NO: 1496895 - RNA, 13 nt, Human
auucacauuguau

SEQ ID NO: 1496896 - RNA, 20 nt, Human
auucacauuguauucagagu

SEQ ID NO: 1496897 - RNA, 17 nt, Human
auuccagagcacugcuc

SEQ ID NO: 1496898 - RNA, 19 nt, Human
aacuuaaauuuuaguucuu

SEQ ID NO: 1496899 - RNA, 20 nt, Human
aacugacucuuaagaagacu

SEQ ID NO: 1496900 - RNA, 19 nt, Human
aacugacucuuaagaagac

SEQ ID NO: 1496901 - RNA, 18 nt, Human
aacugacucuuaagaaga

SEQ ID NO: 1496902 - RNA, 15 nt, Human
aacugacucuuaaga

SEQ ID NO: 1496903 - RNA, 14 nt, Human
aacggaagaagaga

SEQ ID NO: 1496904 - RNA, 12 nt, Human
aacggagucaaa

SEQ ID NO: 1496905 - RNA, 16 nt, Human
aacuauugcauuuaua

SEQ ID NO: 1496906 - RNA, 15 nt, Human
aacuauugcauuuau

SEQ ID NO: 1496907 - RNA, 21 nt, Human
aacuauugcauuuauauguac

SEQ ID NO: 1496908 - RNA, 13 nt, Human
aaauucuuucauu

SEQ ID NO: 1496909 - RNA, 19 nt, Human
aaauuaaaccggaccaucu

SEQ ID NO: 1496910 - RNA, 15 nt, Human
aaauuuuuuuuacau

SEQ ID NO: 1496911 - RNA, 17 nt, Human
aaaucuuauaauuuaaa

SEQ ID NO: 1496912 - RNA, 15 nt, Human
aaaugccuuuguacu

SEQ ID NO: 1496913 - RNA, 16 nt, Human
aaauuuuuuuuacauu

SEQ ID NO: 1496914 - RNA, 17 nt, Human
aaauuuuuuuuacauuu

SEQ ID NO: 1496915 - RNA, 18 nt, Human
aaauuuuuuuuacauuuu

SEQ ID NO: 1496916 - RNA, 14 nt, Human
aaccacuuuuugca

SEQ ID NO: 1496917 - RNA, 15 nt, Human
aaccacuuuuugcag

SEQ ID NO: 1496918 - RNA, 17 nt, Human
aaccacuuuuugcagcu

SEQ ID NO: 1496919 - RNA, 15 nt, Human
aaccagagugcugaa

SEQ ID NO: 1496920 - RNA, 15 nt, Human
aacaucccuccuggg

SEQ ID NO: 1496921 - RNA, 21 nt, Human
aaccgaacugauguaaguaaa

SEQ ID NO: 1496922 - RNA, 12 nt, Human
aaccagaucauu

SEQ ID NO: 1496923 - RNA, 23 nt, Human
aacccuaaauaauaaaaauaaac

SEQ ID NO: 1496924 - RNA, 14 nt, Human
aacccuagcaaaag

SEQ ID NO: 1496925 - RNA, 17 nt, Human
aaccuagggugauauua

SEQ ID NO: 1496926 - RNA, 15 nt, Human
aaagaaauauaccua

SEQ ID NO: 1496927 - RNA, 17 nt, Human
aaagaaauauaccuaaa

SEQ ID NO: 1496928 - RNA, 17 nt, Human
aaaaucucaauauuuca

SEQ ID NO: 1496929 - RNA, 16 nt, Human
aaaaucucaauauuuc

SEQ ID NO: 1496930 - RNA, 21 nt, Human
aaaauugaugggauuugguca

SEQ ID NO: 1496931 - RNA, 22 nt, Human
aaacacugggagaaaugaaaaa

SEQ ID NO: 1496932 - RNA, 21 nt, Human
aaacacugggagaaaugaaaa

SEQ ID NO: 1496933 - RNA, 16 nt, Human
aaaaagaaacauuugg

SEQ ID NO: 1496934 - RNA, 13 nt, Human
aaaaguugaauuu

SEQ ID NO: 1496935 - RNA, 20 nt, Human
aaauagcuuuuuucucugau

SEQ ID NO: 1496936 - RNA, 17 nt, Human
aaauagcuuuuuucucu

SEQ ID NO: 1496937 - RNA, 20 nt, Human
aaauauuuauuuuaauaaug

SEQ ID NO: 1496938 - RNA, 13 nt, Human
aaauauuuauuuu

SEQ ID NO: 1496939 - RNA, 15 nt, Human
aaauauuuauuuuaa

SEQ ID NO: 1496940 - RNA, 20 nt, Human
aaaucaaucuguaaaacuaa

SEQ ID NO: 1496941 - RNA, 13 nt, Human
aagauacugaaau

SEQ ID NO: 1496942 - RNA, 14 nt, Human
aagauacugaaaua

SEQ ID NO: 1496943 - RNA, 14 nt, Human
aagcgccuccaacc

SEQ ID NO: 1496944 - RNA, 15 nt, Human
aagcgccuccaaccc

SEQ ID NO: 1496945 - RNA, 16 nt, Human
aagcgccuccaacccu

SEQ ID NO: 1496946 - RNA, 20 nt, Human
aagcgccuccaacccuagca

SEQ ID NO: 1496947 - RNA, 20 nt, Human
aagcuacagaagaaacuggg

SEQ ID NO: 1496948 - RNA, 20 nt, Human
aaggcagcucuaaaugucaa

SEQ ID NO: 1496949 - RNA, 18 nt, Human
aagcuguguggcagucug

SEQ ID NO: 1496950 - RNA, 14 nt, Human
aaggacaucagcaa

SEQ ID NO: 1496951 - RNA, 15 nt, Human
aaggacaucagcaaa

SEQ ID NO: 1496952 - RNA, 17 nt, Human
aaggacaucagcaaaca

SEQ ID NO: 1496953 - RNA, 12 nt, Human
aaguugaauuuu

SEQ ID NO: 1496954 - RNA, 16 nt, Human
aaguugacuuauagua

SEQ ID NO: 1496955 - RNA, 19 nt, Human
aaguugacuuauaguacau

SEQ ID NO: 1496956 - RNA, 20 nt, Human
aaguugacuuauaguacaug

SEQ ID NO: 1496957 - RNA, 21 nt, Human
aaguugacuuauaguacauga

SEQ ID NO: 1496958 - RNA, 23 nt, Human
aaguugacuuauaguacaugaua

SEQ ID NO: 1496959 - RNA, 15 nt, Human
aagucuccaaagucu

SEQ ID NO: 1496960 - RNA, 14 nt, Human
aagucuccaaaguc

SEQ ID NO: 1496961 - RNA, 18 nt, Human
aaguccaagcauuuagau

SEQ ID NO: 1496962 - RNA, 14 nt, Human
aaggucggaccagc

SEQ ID NO: 1496963 - RNA, 20 nt, Human
aaggugaggagcuugaaacc

SEQ ID NO: 1496964 - RNA, 15 nt, Human
aauccaaugaaauga

SEQ ID NO: 1496965 - RNA, 13 nt, Human
aauccagccugcu

SEQ ID NO: 1496966 - RNA, 15 nt, Human
aaugauuaugaauua

SEQ ID NO: 1496967 - RNA, 23 nt, Human
aaugauuaugaauuacauuugua

SEQ ID NO: 1496968 - RNA, 21 nt, Human
aaugauuaugaauuacauuug

SEQ ID NO: 1496969 - RNA, 17 nt, Human
aauccaagcaaauguga

SEQ ID NO: 1496970 - RNA, 18 nt, Human
aauccaagcaaaugugaa

SEQ ID NO: 1496971 - RNA, 13 nt, Human
aauacucuuauau

SEQ ID NO: 1496972 - RNA, 23 nt, Human
aauguuucaaacauauauaacaa

SEQ ID NO: 1496973 - RNA, 22 nt, Human
aauguuuuuuuuuaaagacuuu

SEQ ID NO: 1496974 - RNA, 15 nt, Human
aauguuuuuuuuuaa

SEQ ID NO: 1496975 - RNA, 20 nt, Human
aauguuuuuuuuuaaagacu

SEQ ID NO: 1496976 - RNA, 17 nt, Human
agaaauaaauuuauuuc

SEQ ID NO: 1496977 - RNA, 22 nt, Human
acuuuauuuucuauaauuuaaa

SEQ ID NO: 1496978 - RNA, 22 nt, Human
acuuuaucuugaauaauguaag

SEQ ID NO: 1496979 - RNA, 12 nt, Human
acuuuuaugaua

SEQ ID NO: 1496980 - RNA, 16 nt, Human
acuuuuaugauacuug

SEQ ID NO: 1496981 - RNA, 23 nt, Human
acuuuuaugauacuugaaaauua

SEQ ID NO: 1496982 - RNA, 14 nt, Human
acuuuuggaaggua

SEQ ID NO: 1496983 - RNA, 18 nt, Human
acuuguaaaggaauuuaa

SEQ ID NO: 1496984 - RNA, 18 nt, Human
acugguaggaaacuaggu

SEQ ID NO: 1496985 - RNA, 22 nt, Human
acuguaagaaaauaucacuugu

SEQ ID NO: 1496986 - RNA, 13 nt, Human
acuguaagaaaau

SEQ ID NO: 1496987 - RNA, 19 nt, Human
acuguaagaaaauaucacu

SEQ ID NO: 1496988 - RNA, 15 nt, Human
acucauauuuucaug

SEQ ID NO: 1496989 - RNA, 20 nt, Human
acuaguauuucuaugaaaua

SEQ ID NO: 1496990 - RNA, 15 nt, Human
acuaagagagaauga

SEQ ID NO: 1496991 - RNA, 13 nt, Human
acuaagagagaau

SEQ ID NO: 1496992 - RNA, 14 nt, Human
acggaacucaaaua

SEQ ID NO: 1496993 - RNA, 11 nt, Human
accugucuguc

SEQ ID NO: 1496994 - RNA, 12 nt, Human
accugucugucu

SEQ ID NO: 1496995 - RNA, 22 nt, Human
acaauugagguaaguuuuuuga

SEQ ID NO: 1496996 - RNA, 10 nt, Human
acaacuaagu

SEQ ID NO: 1496997 - RNA, 22 nt, Human
acaacuaagugauuuguauguc

SEQ ID NO: 1496998 - RNA, 14 nt, Human
acaacggagucaaa

SEQ ID NO: 1496999 - RNA, 20 nt, Human
acaacggagucaaaaauuaa

SEQ ID NO: 1497000 - RNA, 22 nt, Human
acaacggagucaaaaauuaaac

SEQ ID NO: 1497001 - RNA, 13 nt, Human
aauuuugugaagc

SEQ ID NO: 1497002 - RNA, 22 nt, Human
acaggaugguucccuugaugaa

SEQ ID NO: 1497003 - RNA, 18 nt, Human
acaggauccaggccggcu

SEQ ID NO: 1497004 - RNA, 19 nt, Human
acaggaucaguuaacuauu

SEQ ID NO: 1497005 - RNA, 12 nt, Human
acaggauccagg

SEQ ID NO: 1497006 - RNA, 13 nt, Human
acaggauccaggc

SEQ ID NO: 1497007 - RNA, 21 nt, Human
acaggaugaugacuauggaaa

SEQ ID NO: 1497008 - RNA, 14 nt, Human
acagagucuuccuc

SEQ ID NO: 1497009 - RNA, 19 nt, Human
acagagucuuccucugucu

SEQ ID NO: 1497010 - RNA, 17 nt, Human
acagccaacuauggccu

SEQ ID NO: 1497011 - RNA, 19 nt, Human
acagccaacuauggccugu

SEQ ID NO: 1497012 - RNA, 13 nt, Human
acaucagcaaaca

SEQ ID NO: 1497013 - RNA, 12 nt, Human
acaucagcaaac

SEQ ID NO: 1497014 - RNA, 23 nt, Human
acauguuucuuuguaaugaaaac

SEQ ID NO: 1497015 - RNA, 19 nt, Human
acauguuucuuuguaauga

SEQ ID NO: 1497016 - RNA, 22 nt, Human
acauguuucuuuguaaugaaaa

SEQ ID NO: 1497017 - RNA, 17 nt, Human
acaggcacacaccacca

SEQ ID NO: 1497018 - RNA, 19 nt, Human
acauuuguucuauagcuuu

SEQ ID NO: 1497019 - RNA, 20 nt, Human
acauuuuaaaaaauggucac

SEQ ID NO: 1497020 - RNA, 17 nt, Human
accaauaaaauaauuuu

SEQ ID NO: 1497021 - RNA, 11 nt, Human
accaauaaagu

SEQ ID NO: 1497022 - RNA, 12 nt, Human
accaauaaagug

SEQ ID NO: 1497023 - RNA, 17 nt, Human
accaauaaagugacccu

SEQ ID NO: 1497024 - RNA, 21 nt, Human
accaccgcgcccagccuuuuu

SEQ ID NO: 1497025 - RNA, 15 nt, Human
accaccucucaauau

SEQ ID NO: 1497026 - RNA, 23 nt, Human
accaccucucaauauucaauaaa

SEQ ID NO: 1497027 - RNA, 22 nt, Human
accagagugcugaaggaaugga

SEQ ID NO: 1497028 - RNA, 13 nt, Human
accagaucauugu

SEQ ID NO: 1497029 - RNA, 22 nt, Human
acccauuagcagucccuccaca

SEQ ID NO: 1497030 - RNA, 14 nt, Human
acccagugcugaau

SEQ ID NO: 1497031 - RNA, 17 nt, Human
accccuccacucuuucu

SEQ ID NO: 1497032 - RNA, 13 nt, Human
accccuccacucu

SEQ ID NO: 1497033 - RNA, 23 nt, Human
aggcuacuguaaggcaaucaugg

SEQ ID NO: 1497034 - RNA, 17 nt, Human
aggcuagauguauguac

SEQ ID NO: 1497035 - RNA, 16 nt, Human
aggcuagauguaugua

SEQ ID NO: 1497036 - RNA, 15 nt, Human
aggcuagauguaugu

SEQ ID NO: 1497037 - RNA, 22 nt, Human
agggaccggcggaccccagcca

SEQ ID NO: 1497038 - RNA, 13 nt, Human
aggucccuaauaa

SEQ ID NO: 1497039 - RNA, 15 nt, Human
aggucccuaauaaag

SEQ ID NO: 1497040 - RNA, 16 nt, Human
aggucccuaauaaagc

SEQ ID NO: 1497041 - RNA, 20 nt, Human
agguaaaagcaucacaugaa

SEQ ID NO: 1497042 - RNA, 18 nt, Human
agguaaaucagacuauga

SEQ ID NO: 1497043 - RNA, 23 nt, Human
agguaaaucagacuaugaaguuu

SEQ ID NO: 1497044 - RNA, 17 nt, Human
agguaauuuuuuucacc

SEQ ID NO: 1497045 - RNA, 12 nt, Human
aggucccuaaua

SEQ ID NO: 1497046 - RNA, 11 nt, Human
aggucccuaau

SEQ ID NO: 1497047 - RNA, 21 nt, Human
agcuuuucccuuuuuuuaagu

SEQ ID NO: 1497048 - RNA, 12 nt, Human
aggacccaggac

SEQ ID NO: 1497049 - RNA, 13 nt, Human
aggacccaggaca

SEQ ID NO: 1497050 - RNA, 14 nt, Human
aggacccaggacag

SEQ ID NO: 1497051 - RNA, 18 nt, Human
aggacccaggacaggauc

SEQ ID NO: 1497052 - RNA, 23 nt, Human
aggacccaggacaggauccaggc

SEQ ID NO: 1497053 - RNA, 23 nt, Human
aggaugguucccuugaugaagaa

SEQ ID NO: 1497054 - RNA, 15 nt, Human
agcaugccuucaaau

SEQ ID NO: 1497055 - RNA, 13 nt, Human
agccaagugcagg

SEQ ID NO: 1497056 - RNA, 17 nt, Human
agagaacuuccagaucc

SEQ ID NO: 1497057 - RNA, 13 nt, Human
agagaagaaagaa

SEQ ID NO: 1497058 - RNA, 17 nt, Human
agagaagaaagaacgga

SEQ ID NO: 1497059 - RNA, 20 nt, Human
agacagagucuuccucuguc

SEQ ID NO: 1497060 - RNA, 19 nt, Human
agacagagucuuacucugu

SEQ ID NO: 1497061 - RNA, 20 nt, Human
agacagagucuuacucuguu

SEQ ID NO: 1497062 - RNA, 23 nt, Human
agacagagucuuccucugucucc

SEQ ID NO: 1497063 - RNA, 16 nt, Human
augcauauuauuuuau

SEQ ID NO: 1497064 - RNA, 20 nt, Human
augcauauuauuuuauguug

SEQ ID NO: 1497065 - RNA, 20 nt, Human
auggucacguuuggugcuuc

SEQ ID NO: 1497066 - RNA, 21 nt, Human
auggucacguuuggugcuucu

SEQ ID NO: 1497067 - RNA, 24 nt, Human
auggucacguuuggugcuucucag

SEQ ID NO: 1497068 - RNA, 14 nt, Human
augugaaaucauuc

SEQ ID NO: 1497069 - RNA, 15 nt, Human
augugaaacauguuu

SEQ ID NO: 1497070 - RNA, 23 nt, Human
augugaacaguuguguuugaagc

SEQ ID NO: 1497071 - RNA, 21 nt, Human
augugaacaguuguguuugaa

SEQ ID NO: 1497072 - RNA, 11 nt, Human
augugaacagu

SEQ ID NO: 1497073 - RNA, 18 nt, Human
aucuugaauaauguaaga

SEQ ID NO: 1497074 - RNA, 18 nt, Human
aucuggaaccaucagaaa

SEQ ID NO: 1497075 - RNA, 21 nt, Human
aucuauauuuuacauaaauuu

SEQ ID NO: 1497076 - RNA, 17 nt, Human
aucuauauuuuacauaa

SEQ ID NO: 1497077 - RNA, 22 nt, Human
augaagcuuuuaugugaaacau

SEQ ID NO: 1497078 - RNA, 19 nt, Human
augaaguuuuuuuuauaca

SEQ ID NO: 1497079 - RNA, 23 nt, Human
augaaguuuuuuuuauacaggau

SEQ ID NO: 1497080 - RNA, 20 nt, Human
auccucccacuucagccucc

SEQ ID NO: 1497081 - RNA, 18 nt, Human
auccagaaagaaaacuug

SEQ ID NO: 1497082 - RNA, 16 nt, Human
auccagaaagaaaacu

SEQ ID NO: 1497083 - RNA, 15 nt, Human
aucaugugaaaucau

SEQ ID NO: 1497084 - RNA, 16 nt, Human
aucaugugaaaucauu

SEQ ID NO: 1497085 - RNA, 15 nt, Human
auauuuauuuuaaua

SEQ ID NO: 1497086 - RNA, 14 nt, Human
auauuuauuuuaau

SEQ ID NO: 1497087 - RNA, 17 nt, Human
auauuuauuuuaauaau

SEQ ID NO: 1497088 - RNA, 15 nt, Human
auaaagcaggcagaa

SEQ ID NO: 1497089 - RNA, 18 nt, Human
auaaagcuguguggcagu

SEQ ID NO: 1497090 - RNA, 14 nt, Human
auaaaggacuguaa

SEQ ID NO: 1497091 - RNA, 20 nt, Human
auaaacuuuuuucuuacugu

SEQ ID NO: 1497092 - RNA, 18 nt, Human
auaaaggauuaaugucaa

SEQ ID NO: 1497093 - RNA, 13 nt, Human
auacccacccaga

SEQ ID NO: 1497094 - RNA, 14 nt, Human
auacccacccagaa

SEQ ID NO: 1497095 - RNA, 23 nt, Human
auaauguuucaaacauauauaac

SEQ ID NO: 1497096 - RNA, 22 nt, Human
auaugcuucuguuuuauaauuu

SEQ ID NO: 1497097 - RNA, 20 nt, Human
auaugcuucuguuuuauaau

SEQ ID NO: 1497098 - RNA, 23 nt, Human
auaugcuucuguuuuauaauuuu

SEQ ID NO: 1497099 - RNA, 13 nt, Human
auauuuauuuuaa

SEQ ID NO: 1497100 - RNA, 14 nt, Human
auauuauuuuaugu

SEQ ID NO: 1497101 - RNA, 23 nt, Human
auauuaugaagcuuuuaugugaa

SEQ ID NO: 1497102 - RNA, 19 nt, Human
auauauuuuuuucugaaau

SEQ ID NO: 1497103 - RNA, 16 nt, Human
auaucaaauauauuca

SEQ ID NO: 1497104 - RNA, 18 nt, Human
auagguuuggacaaaaug

SEQ ID NO: 1497105 - RNA, 14 nt, Human
auagguuuggacaa

SEQ ID NO: 1497106 - RNA, 15 nt, Human
auagguuuaauaauu

SEQ ID NO: 1497107 - RNA, 17 nt, Human
auagucaaauuguguga

SEQ ID NO: 1497108 - RNA, 14 nt, Human
auagucaaauugug

SEQ ID NO: 1497109 - RNA, 12 nt, Human
aguccuguaaug

SEQ ID NO: 1497110 - RNA, 19 nt, Human
aguccugggauuacaggug

SEQ ID NO: 1497111 - RNA, 18 nt, Human
aguauggguuagggaaaa

SEQ ID NO: 1497112 - RNA, 19 nt, Human
agucaaauugugugaaagg

SEQ ID NO: 1497113 - RNA, 23 nt, Human
agucaaauugugugaaagguacu

SEQ ID NO: 1497114 - RNA, 16 nt, Human
aguaucuuuuuauuca

SEQ ID NO: 1497115 - RNA, 18 nt, Human
aguaucucuucagucucu

SEQ ID NO: 1497116 - RNA, 16 nt, Human
aguaucucuucagucu

SEQ ID NO: 1497117 - RNA, 16 nt, Human
aguuguguuugaagca

SEQ ID NO: 1497118 - RNA, 23 nt, Human
aguugaaaaucuuauaauuuaaa

SEQ ID NO: 1497119 - RNA, 22 nt, Human
aguugaaaaucuuauaauuuaa

SEQ ID NO: 1497120 - RNA, 19 nt, Human
aguggcgcgaucucagcuc

SEQ ID NO: 1497121 - RNA, 20 nt, Human
aguggcgcgaucucagcuca

SEQ ID NO: 1497122 - RNA, 19 nt, Human
aguggcgugaucucagcuc

SEQ ID NO: 1497123 - RNA, 20 nt, Human
aguggcgugaucucagcuca

SEQ ID NO: 1497124 - RNA, 21 nt, Human
cacaaauucugucucuggauu

SEQ ID NO: 1497125 - RNA, 18 nt, Human
caauccucccacuucagc

SEQ ID NO: 1497126 - RNA, 22 nt, Human
caauccucccacuucagccucc

SEQ ID NO: 1497127 - RNA, 20 nt, Human
caaugaucaccgacugaaaa

SEQ ID NO: 1497128 - RNA, 18 nt, Human
cacacacaugcuucccuu

SEQ ID NO: 1497129 - RNA, 13 nt, Human
cacaacuauauug

SEQ ID NO: 1497130 - RNA, 19 nt, Human
cacacugggacuugcaaaa

SEQ ID NO: 1497131 - RNA, 20 nt, Human
cacaggaaccacaagacugc

SEQ ID NO: 1497132 - RNA, 19 nt, Human
cacaggaaccacaagacug

SEQ ID NO: 1497133 - RNA, 17 nt, Human
cacauuggaaacaaguc

SEQ ID NO: 1497134 - RNA, 18 nt, Human
cacauuggagauguuuag

SEQ ID NO: 1497135 - RNA, 20 nt, Human
cacaugcuucccuuuccuga

SEQ ID NO: 1497136 - RNA, 12 nt, Human
cacauguccagu

SEQ ID NO: 1497137 - RNA, 16 nt, Human
cacauuccugaacagg

SEQ ID NO: 1497138 - RNA, 17 nt, Human
caagcacuaaacaaaga

SEQ ID NO: 1497139 - RNA, 14 nt, Human
caaggucugcuuuu

SEQ ID NO: 1497140 - RNA, 22 nt, Human
caagugcagggccuguaauccc

SEQ ID NO: 1497141 - RNA, 15 nt, Human
caaauucugucucug

SEQ ID NO: 1497142 - RNA, 18 nt, Human
caaauucugucucuggau

SEQ ID NO: 1497143 - RNA, 21 nt, Human
caacucugaaggguaauuaua

SEQ ID NO: 1497144 - RNA, 15 nt, Human
caacugcuaaucuac

SEQ ID NO: 1497145 - RNA, 14 nt, Human
caacuucaguccaa

SEQ ID NO: 1497146 - RNA, 11 nt, Human
caacuuuguau

SEQ ID NO: 1497147 - RNA, 12 nt, Human
caacuuuguaua

SEQ ID NO: 1497148 - RNA, 15 nt, Human
caaaucacugaacuu

SEQ ID NO: 1497149 - RNA, 14 nt, Human
caaaucacugaacu

SEQ ID NO: 1497150 - RNA, 12 nt, Human
caaauauauuca

SEQ ID NO: 1497151 - RNA, 11 nt, Human
caaaaaacuac

SEQ ID NO: 1497152 - RNA, 15 nt, Human
caaaaaacuacuucu

SEQ ID NO: 1497153 - RNA, 23 nt, Human
caccccuaaaagaaacccugcac

SEQ ID NO: 1497154 - RNA, 21 nt, Human
ccagccuggggcugaggcuga

SEQ ID NO: 1497155 - RNA, 20 nt, Human
ccaccucgcagguucaagca

SEQ ID NO: 1497156 - RNA, 21 nt, Human
ccaccucgcagguucaagcaa

SEQ ID NO: 1497157 - RNA, 13 nt, Human
ccaccucucaaua

SEQ ID NO: 1497158 - RNA, 14 nt, Human
ccaccucucaauau

SEQ ID NO: 1497159 - RNA, 23 nt, Human
ccaccucucaauauucaauaaag

SEQ ID NO: 1497160 - RNA, 17 nt, Human
ccacccucguggacacc

SEQ ID NO: 1497161 - RNA, 18 nt, Human
ccacccucguggacaccu

SEQ ID NO: 1497162 - RNA, 19 nt, Human
ccacccucguggacaccug

SEQ ID NO: 1497163 - RNA, 13 nt, Human
ccacuuuuugcag

SEQ ID NO: 1497164 - RNA, 14 nt, Human
ccacuuuuugcagc

SEQ ID NO: 1497165 - RNA, 15 nt, Human
ccacuuuuugcagcu

SEQ ID NO: 1497166 - RNA, 17 nt, Human
ccacuuuuugcagcuuu

SEQ ID NO: 1497167 - RNA, 16 nt, Human
ccacuuuuugcagcuu

SEQ ID NO: 1497168 - RNA, 18 nt, Human
ccagaaaccuuuguuugc

SEQ ID NO: 1497169 - RNA, 16 nt, Human
ccagaaugagacaucc

SEQ ID NO: 1497170 - RNA, 20 nt, Human
ccagguauucguuaucuaau

SEQ ID NO: 1497171 - RNA, 21 nt, Human
ccagguauucguuaucuaaua

SEQ ID NO: 1497172 - RNA, 20 nt, Human
ccaucaucuauagaaagcua

SEQ ID NO: 1497173 - RNA, 20 nt, Human
ccagguagaggguguguaag

SEQ ID NO: 1497174 - RNA, 14 nt, Human
ccaggguggcagca

SEQ ID NO: 1497175 - RNA, 16 nt, Human
ccaggguggcagcaac

SEQ ID NO: 1497176 - RNA, 17 nt, Human
ccaggguggcagcaaca

SEQ ID NO: 1497177 - RNA, 12 nt, Human
ccaggcuggguc

SEQ ID NO: 1497178 - RNA, 16 nt, Human
ccaggcugggucgccc

SEQ ID NO: 1497179 - RNA, 21 nt, Human
ccaggcugggucgcccuggac

SEQ ID NO: 1497180 - RNA, 22 nt, Human
ccaggcugggucgcccuggacu

SEQ ID NO: 1497181 - RNA, 23 nt, Human
ccaggcugggucgcccuggacug

SEQ ID NO: 1497182 - RNA, 24 nt, Human
ccaggcugggucgcccuggacugu

SEQ ID NO: 1497183 - RNA, 20 nt, Human
ccauguuaaccccuccacuc

SEQ ID NO: 1497184 - RNA, 12 nt, Human
cccagaaugaga

SEQ ID NO: 1497185 - RNA, 18 nt, Human
cccagaaugagacaucca

SEQ ID NO: 1497186 - RNA, 18 nt, Human
cccauucauuccauucug

SEQ ID NO: 1497187 - RNA, 22 nt, Human
cccauucauuccauucuggaag

SEQ ID NO: 1497188 - RNA, 21 nt, Human
cccauucauuccauucuggaa

SEQ ID NO: 1497189 - RNA, 21 nt, Human
ccccacccucguggacaccug

SEQ ID NO: 1497190 - RNA, 22 nt, Human
ccccacccucguggacaccugc

SEQ ID NO: 1497191 - RNA, 23 nt, Human
ccccacccucguggacaccugcc

SEQ ID NO: 1497192 - RNA, 20 nt, Human
cccagaaugagacauccagc

SEQ ID NO: 1497193 - RNA, 18 nt, Human
ccccaguaucucuucagu

SEQ ID NO: 1497194 - RNA, 17 nt, Human
ccccaucauugguaccc

SEQ ID NO: 1497195 - RNA, 22 nt, Human
cccccagaaaagaaagcuacag

SEQ ID NO: 1497196 - RNA, 17 nt, Human
cccccacugccuuugac

SEQ ID NO: 1497197 - RNA, 12 nt, Human
ccccuccacucu

SEQ ID NO: 1497198 - RNA, 17 nt, Human
ccccuccacucuuucuu

SEQ ID NO: 1497199 - RNA, 15 nt, Human
ccccuagccugccuc

SEQ ID NO: 1497200 - RNA, 14 nt, Human
ccccugccucucug

SEQ ID NO: 1497201 - RNA, 15 nt, Human
ccccugccucucugc

SEQ ID NO: 1497202 - RNA, 16 nt, Human
ccccugccucucugca

SEQ ID NO: 1497203 - RNA, 17 nt, Human
ccccugccucucugcag

SEQ ID NO: 1497204 - RNA, 19 nt, Human
ccccugccucucugcaggu

SEQ ID NO: 1497205 - RNA, 17 nt, Human
ccccuggucccucugca

SEQ ID NO: 1497206 - RNA, 18 nt, Human
ccccuggucccucugcag

SEQ ID NO: 1497207 - RNA, 23 nt, Human
ccccuggugcacuggccccaccc

SEQ ID NO: 1497208 - RNA, 20 nt, Human
cccucucccaaaaaacuacu

SEQ ID NO: 1497209 - RNA, 13 nt, Human
cccucuuccuucc

SEQ ID NO: 1497210 - RNA, 15 nt, Human
cccucccuacccuaa

SEQ ID NO: 1497211 - RNA, 16 nt, Human
cccucccuacccuaac

SEQ ID NO: 1497212 - RNA, 16 nt, Human
cccucguggacaccug

SEQ ID NO: 1497213 - RNA, 17 nt, Human
cccucguggacaccugc

SEQ ID NO: 1497214 - RNA, 18 nt, Human
cccucguggacaccugcc

SEQ ID NO: 1497215 - RNA, 19 nt, Human
cccucguggacaccugccc

SEQ ID NO: 1497216 - RNA, 22 nt, Human
cccucguggacaccugcccugc

SEQ ID NO: 1497217 - RNA, 23 nt, Human
cccucguggacaccugcccugcc

SEQ ID NO: 1497218 - RNA, 16 nt, Human
cccugcugcugccugc

SEQ ID NO: 1497219 - RNA, 17 nt, Human
cccugcugcugccugcc

SEQ ID NO: 1497220 - RNA, 18 nt, Human
cccugcugcugccugccu

SEQ ID NO: 1497221 - RNA, 21 nt, Human
cccuggugcacuggccccacc

SEQ ID NO: 1497222 - RNA, 15 nt, Human
cccuugaugaagaag

SEQ ID NO: 1497223 - RNA, 13 nt, Human
cccugcugcugcc

SEQ ID NO: 1497224 - RNA, 15 nt, Human
cccugccucucugca

SEQ ID NO: 1497225 - RNA, 16 nt, Human
cccugccucucugcag

SEQ ID NO: 1497226 - RNA, 13 nt, Human
cccugccucucug

SEQ ID NO: 1497227 - RNA, 14 nt, Human
cccugccucucugc

SEQ ID NO: 1497228 - RNA, 13 nt, Human
ccgcagaaggaag

SEQ ID NO: 1497229 - RNA, 15 nt, Human
ccgcagaaggaaggc

SEQ ID NO: 1497230 - RNA, 18 nt, Human
ccgcagaaggaaggcagg

SEQ ID NO: 1497231 - RNA, 18 nt, Human
ccgccucagccucccaaa

SEQ ID NO: 1497232 - RNA, 20 nt, Human
ccgacugaaaauauuguuuu

SEQ ID NO: 1497233 - RNA, 20 nt, Human
ccgccucgaccucucucaaa

SEQ ID NO: 1497234 - RNA, 16 nt, Human
ccggggggucucuucu

SEQ ID NO: 1497235 - RNA, 16 nt, Human
ccuacuagucaccaga

SEQ ID NO: 1497236 - RNA, 11 nt, Human
ccuaaccaagu

SEQ ID NO: 1497237 - RNA, 19 nt, Human
ccuggacuuggccccugcc

SEQ ID NO: 1497238 - RNA, 14 nt, Human
ccugccaccuccug

SEQ ID NO: 1497239 - RNA, 16 nt, Human
ccugccaccuccugcc

SEQ ID NO: 1497240 - RNA, 19 nt, Human
ccugccaccuccugccuca

SEQ ID NO: 1497241 - RNA, 12 nt, Human
ccuaucuuugcc

SEQ ID NO: 1497242 - RNA, 13 nt, Human
ccuaucuuugcca

SEQ ID NO: 1497243 - RNA, 15 nt, Human
ccuaucuuugccacc

SEQ ID NO: 1497244 - RNA, 19 nt, Human
ccuaucuuugccacccuca

SEQ ID NO: 1497245 - RNA, 20 nt, Human
ccuaucuuugccacccucau

SEQ ID NO: 1497246 - RNA, 23 nt, Human
ccucuuccuucccugcugugaaa

SEQ ID NO: 1497247 - RNA, 17 nt, Human
ccugccaccuccugccu

SEQ ID NO: 1497248 - RNA, 12 nt, Human
ccugccaccugu

SEQ ID NO: 1497249 - RNA, 13 nt, Human
ccugccaccuguc

SEQ ID NO: 1497250 - RNA, 14 nt, Human
ccugccaccugucu

SEQ ID NO: 1497251 - RNA, 15 nt, Human
ccugccaccugucug

SEQ ID NO: 1497252 - RNA, 16 nt, Human
ccugccaccugucugu

SEQ ID NO: 1497253 - RNA, 17 nt, Human
ccugccaccugucuguc

SEQ ID NO: 1497254 - RNA, 21 nt, Human
ccugcccugccaccugucugu

SEQ ID NO: 1497255 - RNA, 18 nt, Human
ccugcccugccaccuguc

SEQ ID NO: 1497256 - RNA, 15 nt, Human
ccugcccugcccugc

SEQ ID NO: 1497257 - RNA, 16 nt, Human
ccugcccugcccugcc

SEQ ID NO: 1497258 - RNA, 17 nt, Human
ccugcccugcccugcca

SEQ ID NO: 1497259 - RNA, 11 nt, Human
ccugcccugcc

SEQ ID NO: 1497260 - RNA, 12 nt, Human
ccugcccugcca

SEQ ID NO: 1497261 - RNA, 14 nt, Human
ccugcccugccacc

SEQ ID NO: 1497262 - RNA, 15 nt, Human
ccugcccugccaccu

SEQ ID NO: 1497263 - RNA, 17 nt, Human
ccugcccugccaccugu

SEQ ID NO: 1497264 - RNA, 22 nt, Human
ccuucuccauggcccugccaug

SEQ ID NO: 1497265 - RNA, 19 nt, Human
ccuucuccauggcccugcc

SEQ ID NO: 1497266 - RNA, 15 nt, Human
ccuucaugcauggaa

SEQ ID NO: 1497267 - RNA, 12 nt, Human
ccuucaugcaug

SEQ ID NO: 1497268 - RNA, 21 nt, Human
ccuucaugcauggaaauuccc

SEQ ID NO: 1497269 - RNA, 18 nt, Human
ccuguggaucaaauccag

SEQ ID NO: 1497270 - RNA, 16 nt, Human
cgcacggcagccacag

SEQ ID NO: 1497271 - RNA, 16 nt, Human
cggcuugccacacccc

SEQ ID NO: 1497272 - RNA, 18 nt, Human
cgggaauuuucaucuagg

SEQ ID NO: 1497273 - RNA, 20 nt, Human
cgggaauuuucaucuaggau

SEQ ID NO: 1497274 - RNA, 18 nt, Human
cguuuggugcuucucaga

SEQ ID NO: 1497275 - RNA, 17 nt, Human
cuaaauauauuuuaaga

SEQ ID NO: 1497276 - RNA, 15 nt, Human
cuaagagagaaugag

SEQ ID NO: 1497277 - RNA, 14 nt, Human
cuaagagagaauga

SEQ ID NO: 1497278 - RNA, 10 nt, Human
cuaaccaagu

SEQ ID NO: 1497279 - RNA, 12 nt, Human
cuaaccaaguuc

SEQ ID NO: 1497280 - RNA, 19 nt, Human
cuaaauucuuucauuuuag

SEQ ID NO: 1497281 - RNA, 13 nt, Human
cguuuucaaaauu

SEQ ID NO: 1497282 - RNA, 14 nt, Human
cuacacuaagagag

SEQ ID NO: 1497283 - RNA, 23 nt, Human
cuacacgagauacagaauuuuau

SEQ ID NO: 1497284 - RNA, 11 nt, Human
cuacacccagc

SEQ ID NO: 1497285 - RNA, 12 nt, Human
cuacacccagca

SEQ ID NO: 1497286 - RNA, 13 nt, Human
cuacacccagcaa

SEQ ID NO: 1497287 - RNA, 14 nt, Human
cuacacccagcaau

SEQ ID NO: 1497288 - RNA, 16 nt, Human
cuacacccagcaauag

SEQ ID NO: 1497289 - RNA, 21 nt, Human
cuaagcuucacuguaaaauaa

SEQ ID NO: 1497290 - RNA, 22 nt, Human
cuaauagggcaauuaauuccuu

SEQ ID NO: 1497291 - RNA, 16 nt, Human
cuacccuaaccaaguu

SEQ ID NO: 1497292 - RNA, 20 nt, Human
cuaccaaggucuucuuaaua

SEQ ID NO: 1497293 - RNA, 22 nt, Human
cuaggaaauauuuauuuuaaua

SEQ ID NO: 1497294 - RNA, 15 nt, Human
cucagcucacugcaa

SEQ ID NO: 1497295 - RNA, 20 nt, Human
cucagcucacuacaaccucc

SEQ ID NO: 1497296 - RNA, 14 nt, Human
cucagcucacugca

SEQ ID NO: 1497297 - RNA, 20 nt, Human
cucagcucacugcaaccucc

SEQ ID NO: 1497298 - RNA, 24 nt, Human
cucaggagcccugggaggcucugg

SEQ ID NO: 1497299 - RNA, 20 nt, Human
cucagcucucaguugcagcc

SEQ ID NO: 1497300 - RNA, 12 nt, Human
cucaggagcccu

SEQ ID NO: 1497301 - RNA, 13 nt, Human
cucaggagcccug

SEQ ID NO: 1497302 - RNA, 14 nt, Human
cucaggagcccugg

SEQ ID NO: 1497303 - RNA, 15 nt, Human
cucaggagcccuggg

SEQ ID NO: 1497304 - RNA, 16 nt, Human
cucaggagcccuggga

SEQ ID NO: 1497305 - RNA, 17 nt, Human
cucaggagcccugggag

SEQ ID NO: 1497306 - RNA, 20 nt, Human
cucaggagcccugggaggcu

SEQ ID NO: 1497307 - RNA, 21 nt, Human
cucaggagcccugggaggcuc

SEQ ID NO: 1497308 - RNA, 22 nt, Human
cucaggagcccugggaggcucu

SEQ ID NO: 1497309 - RNA, 23 nt, Human
cucaggagcccugggaggcucug

SEQ ID NO: 1497310 - RNA, 21 nt, Human
cucauuuccaagcaaguauua

SEQ ID NO: 1497311 - RNA, 17 nt, Human
cucauuuccaagcaagu

SEQ ID NO: 1497312 - RNA, 14 nt, Human
cucauuuccaagca

SEQ ID NO: 1497313 - RNA, 13 nt, Human
cucauuuccaagc

SEQ ID NO: 1497314 - RNA, 12 nt, Human
cucauuuccaag

SEQ ID NO: 1497315 - RNA, 12 nt, Human
cucauuucagga

SEQ ID NO: 1497316 - RNA, 13 nt, Human
cucauuucaggau

SEQ ID NO: 1497317 - RNA, 13 nt, Human
cuccaaaccacuu

SEQ ID NO: 1497318 - RNA, 22 nt, Human
cuccaaaccacuuuuugcagcu

SEQ ID NO: 1497319 - RNA, 13 nt, Human
cucaguugcagcc

SEQ ID NO: 1497320 - RNA, 18 nt, Human
cuccaccgcagaaggaag

SEQ ID NO: 1497321 - RNA, 16 nt, Human
cuccaccgcagaagga

SEQ ID NO: 1497322 - RNA, 17 nt, Human
cuccaccgcagaaggaa

SEQ ID NO: 1497323 - RNA, 15 nt, Human
cuccauggcccugcc

SEQ ID NO: 1497324 - RNA, 16 nt, Human
cuccauggcccugcca

SEQ ID NO: 1497325 - RNA, 13 nt, Human
cucccucaaccuc

SEQ ID NO: 1497326 - RNA, 17 nt, Human
cucccucaaccucaucc

SEQ ID NO: 1497327 - RNA, 14 nt, Human
cuauugcauuuaua

SEQ ID NO: 1497328 - RNA, 17 nt, Human
cuauugcauuuauaugu

SEQ ID NO: 1497329 - RNA, 19 nt, Human
cuauugcauuuauauguac

SEQ ID NO: 1497330 - RNA, 23 nt, Human
cucaacuccgugcuuaaccaaag

SEQ ID NO: 1497331 - RNA, 12 nt, Human
cuauaauuuaaa

SEQ ID NO: 1497332 - RNA, 13 nt, Human
cuauaauuuaaau

SEQ ID NO: 1497333 - RNA, 15 nt, Human
cuauaccaauaaagu

SEQ ID NO: 1497334 - RNA, 16 nt, Human
cuauaccaauaaagug

SEQ ID NO: 1497335 - RNA, 15 nt, Human
cuauacccacccaga

SEQ ID NO: 1497336 - RNA, 16 nt, Human
cuauacccacccagaa

SEQ ID NO: 1497337 - RNA, 19 nt, Human
cuaugaaauauuauguuaa

SEQ ID NO: 1497338 - RNA, 19 nt, Human
cuauauaagacaagaacuc

SEQ ID NO: 1497339 - RNA, 15 nt, Human
cuauagcuaaguaca

SEQ ID NO: 1497340 - RNA, 17 nt, Human
cuauagcuaaguacaca

SEQ ID NO: 1497341 - RNA, 22 nt, Human
cuaugaaguuuuuuuuauacag

SEQ ID NO: 1497342 - RNA, 20 nt, Human
cuaggaaauauuuauuuuaa

SEQ ID NO: 1497343 - RNA, 19 nt, Human
cuaggaaauauuuauuuua

SEQ ID NO: 1497344 - RNA, 15 nt, Human
cuaggaaauauuuau

SEQ ID NO: 1497345 - RNA, 14 nt, Human
cuaggaaauauuua

SEQ ID NO: 1497346 - RNA, 19 nt, Human
cuagaguuuagcuggaaaa

SEQ ID NO: 1497347 - RNA, 18 nt, Human
cuagaguuuagcuggaaa

SEQ ID NO: 1497348 - RNA, 22 nt, Human
cugccucucugcaggucccuaa

SEQ ID NO: 1497349 - RNA, 20 nt, Human
cugccucucugcaggucccu

SEQ ID NO: 1497350 - RNA, 21 nt, Human
cugccucucugcaggucccua

SEQ ID NO: 1497351 - RNA, 19 nt, Human
cucccuucaugcauggaaa

SEQ ID NO: 1497352 - RNA, 14 nt, Human
cugcugcugccugc

SEQ ID NO: 1497353 - RNA, 16 nt, Human
cugcugcuacaauguc

SEQ ID NO: 1497354 - RNA, 13 nt, Human
cuggaauuugaaa

SEQ ID NO: 1497355 - RNA, 16 nt, Human
cuggagaugaggccag

SEQ ID NO: 1497356 - RNA, 17 nt, Human
cuggagaugaggccaga

SEQ ID NO: 1497357 - RNA, 18 nt, Human
cuggagaugaggccagac

SEQ ID NO: 1497358 - RNA, 20 nt, Human
cuggagaugaggccagacca

SEQ ID NO: 1497359 - RNA, 19 nt, Human
cuggagaugaggccagacc

SEQ ID NO: 1497360 - RNA, 23 nt, Human
cuggccccacccucguggacacc

SEQ ID NO: 1497361 - RNA, 12 nt, Human
cuggccccaccc

SEQ ID NO: 1497362 - RNA, 14 nt, Human
cuggagugcagugg

SEQ ID NO: 1497363 - RNA, 20 nt, Human
cuguauuuuaaaagaaugau

SEQ ID NO: 1497364 - RNA, 22 nt, Human
cuguauuuuaaaagaaugauua

SEQ ID NO: 1497365 - RNA, 16 nt, Human
cugugcaaggccuggu

SEQ ID NO: 1497366 - RNA, 22 nt, Human
cugucuccuaagcuggagugca

SEQ ID NO: 1497367 - RNA, 23 nt, Human
cuguucaugaaagauucaaugcc

SEQ ID NO: 1497368 - RNA, 18 nt, Human
cuguucaugaaagauuca

SEQ ID NO: 1497369 - RNA, 17 nt, Human
cuguucaugaaagauuc

SEQ ID NO: 1497370 - RNA, 15 nt, Human
cuguucauuccucca

SEQ ID NO: 1497371 - RNA, 16 nt, Human
cuguucauuccuccag

SEQ ID NO: 1497372 - RNA, 17 nt, Human
cuguucauuccuccagg

SEQ ID NO: 1497373 - RNA, 22 nt, Human
cuguucauuccuccagguauuc

SEQ ID NO: 1497374 - RNA, 19 nt, Human
cugugugcucaggagcccu

SEQ ID NO: 1497375 - RNA, 16 nt, Human
cugugugcucaggagc

SEQ ID NO: 1497376 - RNA, 20 nt, Human
cugugugcucaggagcccug

SEQ ID NO: 1497377 - RNA, 21 nt, Human
cugugugcucaggagcccugg

SEQ ID NO: 1497378 - RNA, 23 nt, Human
cugugugcucaggagcccuggga

SEQ ID NO: 1497379 - RNA, 15 nt, Human
cuguguggcagucug

SEQ ID NO: 1497380 - RNA, 12 nt, Human
cuugaaaaaugc

SEQ ID NO: 1497381 - RNA, 18 nt, Human
cuugaaaaaugcauguug

SEQ ID NO: 1497382 - RNA, 12 nt, Human
cuugaaaauuaa

SEQ ID NO: 1497383 - RNA, 13 nt, Human
cuugaaaauuaac

SEQ ID NO: 1497384 - RNA, 18 nt, Human
cuugaaaauuaacaugaa

SEQ ID NO: 1497385 - RNA, 12 nt, Human
cuuccacccagu

SEQ ID NO: 1497386 - RNA, 14 nt, Human
cuuccacccagugc

SEQ ID NO: 1497387 - RNA, 20 nt, Human
cuucccuuuccugaguccca

SEQ ID NO: 1497388 - RNA, 14 nt, Human
cuucccuuuccuga

SEQ ID NO: 1497389 - RNA, 22 nt, Human
cuuagaugcaguucugaagaag

SEQ ID NO: 1497390 - RNA, 19 nt, Human
cuuauaucuauauuuuaca

SEQ ID NO: 1497391 - RNA, 13 nt, Human
cuuauauuaugga

SEQ ID NO: 1497392 - RNA, 14 nt, Human
cuuugaccugccuc

SEQ ID NO: 1497393 - RNA, 15 nt, Human
cuuugaccugccucc

SEQ ID NO: 1497394 - RNA, 18 nt, Human
cuuugaccugccucccuu

SEQ ID NO: 1497395 - RNA, 22 nt, Human
cuuugcauaacguauaaaagcc

SEQ ID NO: 1497396 - RNA, 14 nt, Human
cuuuggcugcaugc

SEQ ID NO: 1497397 - RNA, 22 nt, Human
cuuuguauuguauauuacaaug

SEQ ID NO: 1497398 - RNA, 16 nt, Human
cuuuaaaaggaaagaa

SEQ ID NO: 1497399 - RNA, 18 nt, Human
cuuuaaaaggaaagaaaa

SEQ ID NO: 1497400 - RNA, 17 nt, Human
cuuuaaaaggaaagaaa

SEQ ID NO: 1497401 - RNA, 17 nt, Human
cuuuaaaauuacaacua

SEQ ID NO: 1497402 - RNA, 19 nt, Human
cuuuaaaauuacaacuaag

SEQ ID NO: 1497403 - RNA, 20 nt, Human
cuuuaaaauuacaacuaagu

SEQ ID NO: 1497404 - RNA, 23 nt, Human
cuuuaucuugaauaauguaagac

SEQ ID NO: 1497405 - RNA, 18 nt, Human
cuuuaucuugaauaaugu

SEQ ID NO: 1497406 - RNA, 21 nt, Human
cuuuaucuugaauaauguaag

SEQ ID NO: 1497407 - RNA, 19 nt, Human
cuugaguuuaaauuguaau

SEQ ID NO: 1497408 - RNA, 23 nt, Human
cuugucaauaaaauccauacauu

SEQ ID NO: 1497409 - RNA, 17 nt, Human
cuuguacuuuauuuucu

SEQ ID NO: 1497410 - RNA, 16 nt, Human
gaaacacaacuauauu

SEQ ID NO: 1497411 - RNA, 21 nt, Human
gaaacccugcacccauuagca

SEQ ID NO: 1497412 - RNA, 23 nt, Human
gaaacucguuaauuuguaguguu

SEQ ID NO: 1497413 - RNA, 19 nt, Human
gaaacuaggugcauauuua

SEQ ID NO: 1497414 - RNA, 14 nt, Human
gaaaccuuccaccc

SEQ ID NO: 1497415 - RNA, 17 nt, Human
gaaagagaacuuccaga

SEQ ID NO: 1497416 - RNA, 13 nt, Human
gaaagaggaagca

SEQ ID NO: 1497417 - RNA, 21 nt, Human
gaaagaguacucuuguuuccu

SEQ ID NO: 1497418 - RNA, 19 nt, Human
gaaagcuauauaagacaag

SEQ ID NO: 1497419 - RNA, 17 nt, Human
gaaagcgccuccaaccc

SEQ ID NO: 1497420 - RNA, 22 nt, Human
gaaagcgccuccaacccuagca

SEQ ID NO: 1497421 - RNA, 15 nt, Human
gaaaaguugaauuuu

SEQ ID NO: 1497422 - RNA, 14 nt, Human
gaaaaguugaauuu

SEQ ID NO: 1497423 - RNA, 18 nt, Human
gaaaaucuuauaauuuaa

SEQ ID NO: 1497424 - RNA, 22 nt, Human
gaaaauauuguuuuacaauagu

SEQ ID NO: 1497425 - RNA, 15 nt, Human
gaaaauauuguuuua

SEQ ID NO: 1497426 - RNA, 17 nt, Human
cuuuuuauggccuguga

SEQ ID NO: 1497427 - RNA, 16 nt, Human
gacaugggacauuugc

SEQ ID NO: 1497428 - RNA, 17 nt, Human
gacaugggacauuugcu

SEQ ID NO: 1497429 - RNA, 16 nt, Human
gaccaccucucaauau

SEQ ID NO: 1497430 - RNA, 16 nt, Human
gacaaggaaaaaauaa

SEQ ID NO: 1497431 - RNA, 14 nt, Human
gaauuucccucucu

SEQ ID NO: 1497432 - RNA, 20 nt, Human
gaauuucuaggacugaauua

SEQ ID NO: 1497433 - RNA, 19 nt, Human
gaauuucuaggacugaauu

SEQ ID NO: 1497434 - RNA, 20 nt, Human
gaauuugauaugugaacagu

SEQ ID NO: 1497435 - RNA, 20 nt, Human
gaauuugugaagguggaaau

SEQ ID NO: 1497436 - RNA, 16 nt, Human
gaauuggagcucgugg

SEQ ID NO: 1497437 - RNA, 16 nt, Human
gacugcauuauauuua

SEQ ID NO: 1497438 - RNA, 14 nt, Human
gacugcauuauauu

SEQ ID NO: 1497439 - RNA, 24 nt, Human
gacugcauuauauuuauuacugua

SEQ ID NO: 1497440 - RNA, 15 nt, Human
gacuuggccccugcc

SEQ ID NO: 1497441 - RNA, 21 nt, Human
gagaaaugaaaaaauauauau

SEQ ID NO: 1497442 - RNA, 22 nt, Human
gagaaccuagggugauauuaac

SEQ ID NO: 1497443 - RNA, 21 nt, Human
gagaaccuagggugauauuaa

SEQ ID NO: 1497444 - RNA, 14 nt, Human
gagaaauuuauaaa

SEQ ID NO: 1497445 - RNA, 13 nt, Human
gagaagaacugaa

SEQ ID NO: 1497446 - RNA, 16 nt, Human
gagaagaaagaacgga

SEQ ID NO: 1497447 - RNA, 21 nt, Human
gagaagaaagaacggaagaag

SEQ ID NO: 1497448 - RNA, 23 nt, Human
gagaacuuccagauccuggaaau

SEQ ID NO: 1497449 - RNA, 22 nt, Human
gagaacuuccagauccuggaaa

SEQ ID NO: 1497450 - RNA, 17 nt, Human
gagaaugagagacacac

SEQ ID NO: 1497451 - RNA, 22 nt, Human
gagaagcaaguaaaaaggcuaa

SEQ ID NO: 1497452 - RNA, 15 nt, Human
gagacuggguaggaa

SEQ ID NO: 1497453 - RNA, 21 nt, Human
gagaaugagagacacacugaa

SEQ ID NO: 1497454 - RNA, 20 nt, Human
gagaaugagagacacacuga

SEQ ID NO: 1497455 - RNA, 20 nt, Human
gagcaagaccccaucucaaa

SEQ ID NO: 1497456 - RNA, 15 nt, Human
gagaugaggccagac

SEQ ID NO: 1497457 - RNA, 13 nt, Human
gagaugaggccag

SEQ ID NO: 1497458 - RNA, 14 nt, Human
gagaugaggccaga

SEQ ID NO: 1497459 - RNA, 21 nt, Human
gagcccuucuauacccaccca

SEQ ID NO: 1497460 - RNA, 22 nt, Human
gagcccuucuauacccacccag

SEQ ID NO: 1497461 - RNA, 16 nt, Human
gaggcagagaagaaag

SEQ ID NO: 1497462 - RNA, 18 nt, Human
gaggcagagaagaaagaa

SEQ ID NO: 1497463 - RNA, 21 nt, Human
gaggcgcaugaauuugugaag

SEQ ID NO: 1497464 - RNA, 22 nt, Human
gaggcugggaauggaggggcag

SEQ ID NO: 1497465 - RNA, 12 nt, Human
gagguaaguuuu

SEQ ID NO: 1497466 - RNA, 18 nt, Human
gagguugaaaaacaaaau

SEQ ID NO: 1497467 - RNA, 22 nt, Human
gaguaauccaagcaaaugugaa

SEQ ID NO: 1497468 - RNA, 21 nt, Human
gagucuauuuacggaacucaa

SEQ ID NO: 1497469 - RNA, 24 nt, Human
gauaugauucaaaugucuauaaac

SEQ ID NO: 1497470 - RNA, 22 nt, Human
gauaugauucaaaugucuauaa

SEQ ID NO: 1497471 - RNA, 14 nt, Human
gauaugauucaaau

SEQ ID NO: 1497472 - RNA, 15 nt, Human
gauauaagugugugu

SEQ ID NO: 1497473 - RNA, 17 nt, Human
gauauaaguguguguuu

SEQ ID NO: 1497474 - RNA, 22 nt, Human
gauaaauggcuuccuggcaaua

SEQ ID NO: 1497475 - RNA, 15 nt, Human
gauaaaugauagaca

SEQ ID NO: 1497476 - RNA, 23 nt, Human
gcacaaauucugucucuggauua

SEQ ID NO: 1497477 - RNA, 13 nt, Human
gcaauuuaaaugu

SEQ ID NO: 1497478 - RNA, 18 nt, Human
gcaauuuaaauguuauga

SEQ ID NO: 1497479 - RNA, 16 nt, Human
gcaauuaauuccuuca

SEQ ID NO: 1497480 - RNA, 20 nt, Human
gcaauuacaacggagucaaa

SEQ ID NO: 1497481 - RNA, 19 nt, Human
gcaauuaauuccuucagca

SEQ ID NO: 1497482 - RNA, 13 nt, Human
gcaacucugaagg

SEQ ID NO: 1497483 - RNA, 22 nt, Human
gcaccccagcuggggccaggcu

SEQ ID NO: 1497484 - RNA, 19 nt, Human
gcacuguggguagacacac

SEQ ID NO: 1497485 - RNA, 12 nt, Human
gcagaaggaagg

SEQ ID NO: 1497486 - RNA, 13 nt, Human
gcagaaggaaggc

SEQ ID NO: 1497487 - RNA, 15 nt, Human
gcagaaggaaggcag

SEQ ID NO: 1497488 - RNA, 22 nt, Human
gcagaaggaaggcagggaggag

SEQ ID NO: 1497489 - RNA, 16 nt, Human
gcagaaggaaggcagg

SEQ ID NO: 1497490 - RNA, 16 nt, Human
gcaaauugucacagga

SEQ ID NO: 1497491 - RNA, 13 nt, Human
gcaacaauaaaua

SEQ ID NO: 1497492 - RNA, 20 nt, Human
gauucaaugccccugaauuu

SEQ ID NO: 1497493 - RNA, 19 nt, Human
gauucaaugccccugaauu

SEQ ID NO: 1497494 - RNA, 21 nt, Human
gauucaaugccccugaauuua

SEQ ID NO: 1497495 - RNA, 14 nt, Human
gauuacacacguga

SEQ ID NO: 1497496 - RNA, 16 nt, Human
gauguuuaguaaucau

SEQ ID NO: 1497497 - RNA, 22 nt, Human
gaugguucccuugaugaagaag

SEQ ID NO: 1497498 - RNA, 17 nt, Human
gaugggguuucaccaug

SEQ ID NO: 1497499 - RNA, 12 nt, Human
gcccuggacugu

SEQ ID NO: 1497500 - RNA, 16 nt, Human
gcccuggacugugugc

SEQ ID NO: 1497501 - RNA, 22 nt, Human
gcccuggacugugugcucagga

SEQ ID NO: 1497502 - RNA, 13 nt, Human
gcccugggaggcu

SEQ ID NO: 1497503 - RNA, 14 nt, Human
gcccugggaggcuc

SEQ ID NO: 1497504 - RNA, 15 nt, Human
gcccugggaggcucu

SEQ ID NO: 1497505 - RNA, 16 nt, Human
gcccugggaggcucug

SEQ ID NO: 1497506 - RNA, 23 nt, Human
gcccugggaggcucuggagccca

SEQ ID NO: 1497507 - RNA, 17 nt, Human
gcccugggaggcucugg

SEQ ID NO: 1497508 - RNA, 18 nt, Human
gcccugggaggcucugga

SEQ ID NO: 1497509 - RNA, 19 nt, Human
gcccugggaggcucuggag

SEQ ID NO: 1497510 - RNA, 21 nt, Human
gcccugggaggcucuggagcc

SEQ ID NO: 1497511 - RNA, 19 nt, Human
gccucaccagcccuggcaa

SEQ ID NO: 1497512 - RNA, 19 nt, Human
gccucucugcaggucccua

SEQ ID NO: 1497513 - RNA, 22 nt, Human
gccuggggcugaggcugaggca

SEQ ID NO: 1497514 - RNA, 18 nt, Human
gccugcuuuuuauggccu

SEQ ID NO: 1497515 - RNA, 19 nt, Human
gccugcuuuuuauggccug

SEQ ID NO: 1497516 - RNA, 22 nt, Human
gccugcuuuuuauggccuguga

SEQ ID NO: 1497517 - RNA, 23 nt, Human
gccucucugcaggucccuaauaa

SEQ ID NO: 1497518 - RNA, 20 nt, Human
gccucucugcaggucccuaa

SEQ ID NO: 1497519 - RNA, 21 nt, Human
gccucucugcaggucccuaau

SEQ ID NO: 1497520 - RNA, 20 nt, Human
gccugagugacagagcaaga

SEQ ID NO: 1497521 - RNA, 17 nt, Human
gcucuccuccaccucaa

SEQ ID NO: 1497522 - RNA, 14 nt, Human
gcucuugaugccug

SEQ ID NO: 1497523 - RNA, 15 nt, Human
gcucuugaugccugg

SEQ ID NO: 1497524 - RNA, 16 nt, Human
gcucuugaugccuggc

SEQ ID NO: 1497525 - RNA, 17 nt, Human
gcucuugaugccuggcg

SEQ ID NO: 1497526 - RNA, 16 nt, Human
gcugauggagaaggaa

SEQ ID NO: 1497527 - RNA, 17 nt, Human
gcugauggagaaggaag

SEQ ID NO: 1497528 - RNA, 23 nt, Human
gccugugagcuaggaauuguguu

SEQ ID NO: 1497529 - RNA, 14 nt, Human
gcuaagcauuccaa

SEQ ID NO: 1497530 - RNA, 20 nt, Human
gcuccauuuuuagugaaaua

SEQ ID NO: 1497531 - RNA, 14 nt, Human
gcuccaagaauuuc

SEQ ID NO: 1497532 - RNA, 18 nt, Human
gcuuaugcuuaaauucaa

SEQ ID NO: 1497533 - RNA, 17 nt, Human
gcuuauaauaaaggacu

SEQ ID NO: 1497534 - RNA, 20 nt, Human
gcugucuacacuaagagaga

SEQ ID NO: 1497535 - RNA, 12 nt, Human
gcuguucaugaa

SEQ ID NO: 1497536 - RNA, 21 nt, Human
gcuguucaugaaagauucaau

SEQ ID NO: 1497537 - RNA, 13 nt, Human
ggaacauaaaaag

SEQ ID NO: 1497538 - RNA, 18 nt, Human
ggaacauaaaaaggacau

SEQ ID NO: 1497539 - RNA, 15 nt, Human
ggaaaacauuccauc

SEQ ID NO: 1497540 - RNA, 14 nt, Human
ggaauggaggggca

SEQ ID NO: 1497541 - RNA, 16 nt, Human
ggaauggaggggcaga

SEQ ID NO: 1497542 - RNA, 17 nt, Human
ggaauggaggggcagag

SEQ ID NO: 1497543 - RNA, 21 nt, Human
ggaauggaggggcagagccag

SEQ ID NO: 1497544 - RNA, 19 nt, Human
ggaauuacgugcucugugg

SEQ ID NO: 1497545 - RNA, 17 nt, Human
ggacaaaauggaauacu

SEQ ID NO: 1497546 - RNA, 16 nt, Human
ggacaaaauggaauac

SEQ ID NO: 1497547 - RNA, 19 nt, Human
ggaauuuucaucuaggauu

SEQ ID NO: 1497548 - RNA, 15 nt, Human
ggacacuacacccag

SEQ ID NO: 1497549 - RNA, 16 nt, Human
ggacacuacacccagc

SEQ ID NO: 1497550 - RNA, 17 nt, Human
ggacacuacacccagca

SEQ ID NO: 1497551 - RNA, 18 nt, Human
ggacacuacacccagcaa

SEQ ID NO: 1497552 - RNA, 19 nt, Human
ggacacuacacccagcaau

SEQ ID NO: 1497553 - RNA, 20 nt, Human
ggacacuacacccagcaaua

SEQ ID NO: 1497554 - RNA, 21 nt, Human
ggacacuacacccagcaauag

SEQ ID NO: 1497555 - RNA, 12 nt, Human
ggaauuguguuu

SEQ ID NO: 1497556 - RNA, 22 nt, Human
ggaauuggagcucgugggacag

SEQ ID NO: 1497557 - RNA, 16 nt, Human
ggaauuggagcucgug

SEQ ID NO: 1497558 - RNA, 18 nt, Human
ggaagugcuaauuuugaa

SEQ ID NO: 1497559 - RNA, 17 nt, Human
ggaaggcagggaggagg

SEQ ID NO: 1497560 - RNA, 21 nt, Human
ggaaggcagggaggaggcaga

SEQ ID NO: 1497561 - RNA, 22 nt, Human
ggacacuacacccagcaauaga

SEQ ID NO: 1497562 - RNA, 16 nt, Human
ggacauuugcucaugg

SEQ ID NO: 1497563 - RNA, 17 nt, Human
ggacugugugcucagga

SEQ ID NO: 1497564 - RNA, 14 nt, Human
ggagaugaggccag

SEQ ID NO: 1497565 - RNA, 15 nt, Human
ggagaugaggccaga

SEQ ID NO: 1497566 - RNA, 16 nt, Human
ggagaugaggccagac

SEQ ID NO: 1497567 - RNA, 19 nt, Human
ggcaaucauggugcucaga

SEQ ID NO: 1497568 - RNA, 18 nt, Human
ggagaugaggccagacca

SEQ ID NO: 1497569 - RNA, 11 nt, Human
ggccugugagc

SEQ ID NO: 1497570 - RNA, 20 nt, Human
ggccuguggaucaaauccag

SEQ ID NO: 1497571 - RNA, 23 nt, Human
guacuuuauuuucuauaauuuaa

SEQ ID NO: 1497572 - RNA, 14 nt, Human
guacuugcucuuga

SEQ ID NO: 1497573 - RNA, 22 nt, Human
guacuugcucuugaugccuggc

SEQ ID NO: 1497574 - RNA, 15 nt, Human
guacuugcucuugau

SEQ ID NO: 1497575 - RNA, 16 nt, Human
guacuugcucuugaug

SEQ ID NO: 1497576 - RNA, 18 nt, Human
guacuugcucuugaugcc

SEQ ID NO: 1497577 - RNA, 19 nt, Human
guacuugcucuugaugccu

SEQ ID NO: 1497578 - RNA, 15 nt, Human
guacagacagaaaaa

SEQ ID NO: 1497579 - RNA, 15 nt, Human
guaauuggaaaggca

SEQ ID NO: 1497580 - RNA, 23 nt, Human
guaauucuaccaaggucuucuua

SEQ ID NO: 1497581 - RNA, 11 nt, Human
guaaugaaaac

SEQ ID NO: 1497582 - RNA, 13 nt, Human
guaaugaaaacca

SEQ ID NO: 1497583 - RNA, 19 nt, Human
guaaugauaacuggaaacu

SEQ ID NO: 1497584 - RNA, 20 nt, Human
gguuuucacauuggaaacaa

SEQ ID NO: 1497585 - RNA, 17 nt, Human
guaaaaauggaaacuau

SEQ ID NO: 1497586 - RNA, 18 nt, Human
guaaaaacaaagaaauua

SEQ ID NO: 1497587 - RNA, 20 nt, Human
guaaaaacaaagaaauuaug

SEQ ID NO: 1497588 - RNA, 23 nt, Human
guaagcauaagcuuaugcuuaaa

SEQ ID NO: 1497589 - RNA, 16 nt, Human
guaaaauaaaaggucg

SEQ ID NO: 1497590 - RNA, 18 nt, Human
ggucccuaauaaagcugu

SEQ ID NO: 1497591 - RNA, 12 nt, Human
ggucccuaauaa

SEQ ID NO: 1497592 - RNA, 13 nt, Human
ggucccuaauaaa

SEQ ID NO: 1497593 - RNA, 16 nt, Human
ggucccuaauaaagcu

SEQ ID NO: 1497594 - RNA, 17 nt, Human
ggucccuaauaaagcug

SEQ ID NO: 1497595 - RNA, 22 nt, Human
gguagacacacaugaaguccaa

SEQ ID NO: 1497596 - RNA, 15 nt, Human
gguagacacacauga

SEQ ID NO: 1497597 - RNA, 20 nt, Human
ggguuucaccauguuggcca

SEQ ID NO: 1497598 - RNA, 22 nt, Human
gguacuucaaauccuugaagau

SEQ ID NO: 1497599 - RNA, 19 nt, Human
gggugcugggccccugccu

SEQ ID NO: 1497600 - RNA, 22 nt, Human
gggcuccuccaggguggcagca

SEQ ID NO: 1497601 - RNA, 23 nt, Human
gggcuccuccaggguggcagcaa

SEQ ID NO: 1497602 - RNA, 20 nt, Human
gggcuuauaauaaaggacug

SEQ ID NO: 1497603 - RNA, 16 nt, Human
gggccuuuggcaggug

SEQ ID NO: 1497604 - RNA, 20 nt, Human
ggggcuuauaauaaaggacu

SEQ ID NO: 1497605 - RNA, 13 nt, Human
ggggcagagccag

SEQ ID NO: 1497606 - RNA, 14 nt, Human
ggggcagagccagg

SEQ ID NO: 1497607 - RNA, 15 nt, Human
ggggcagagccagga

SEQ ID NO: 1497608 - RNA, 16 nt, Human
ggggcagagccaggaa

SEQ ID NO: 1497609 - RNA, 18 nt, Human
guauuuuaaaagaaugau

SEQ ID NO: 1497610 - RNA, 17 nt, Human
guauuuuaaaagaauga

SEQ ID NO: 1497611 - RNA, 16 nt, Human
guauuuuaaaagaaug

SEQ ID NO: 1497612 - RNA, 21 nt, Human
gucaauaaaauccauacauuu

SEQ ID NO: 1497613 - RNA, 15 nt, Human
gucaauaaaauccau

SEQ ID NO: 1497614 - RNA, 20 nt, Human
gucacccaggcuggacugca

SEQ ID NO: 1497615 - RNA, 20 nt, Human
gucacccagguuggagugca

SEQ ID NO: 1497616 - RNA, 14 nt, Human
gucaccucauggaa

SEQ ID NO: 1497617 - RNA, 15 nt, Human
guauuauguguguuu

SEQ ID NO: 1497618 - RNA, 19 nt, Human
guauucaaaaauuaucuau

SEQ ID NO: 1497619 - RNA, 22 nt, Human
guauuacaguggggaaugaaga

SEQ ID NO: 1497620 - RNA, 20 nt, Human
guauuacaguggggaaugaa

SEQ ID NO: 1497621 - RNA, 22 nt, Human
guauuucuaugaaauauuaugu

SEQ ID NO: 1497622 - RNA, 17 nt, Human
guauuucuaugaaauau

SEQ ID NO: 1497623 - RNA, 16 nt, Human
guauucguuaucuaau

SEQ ID NO: 1497624 - RNA, 21 nt, Human
gucucuauaccaauaaaguga

SEQ ID NO: 1497625 - RNA, 20 nt, Human
gucucuauaccaauaaagug

SEQ ID NO: 1497626 - RNA, 13 nt, Human
gucugacuguuuc

SEQ ID NO: 1497627 - RNA, 23 nt, Human
gucuacacuaagagagaaugaga

SEQ ID NO: 1497628 - RNA, 17 nt, Human
gucuacacuaagagaga

SEQ ID NO: 1497629 - RNA, 20 nt, Human
gugaaacucguuaauuugua

SEQ ID NO: 1497630 - RNA, 19 nt, Human
gugaaagaaaauaacaaua

SEQ ID NO: 1497631 - RNA, 13 nt, Human
gugaaagaaguaa

SEQ ID NO: 1497632 - RNA, 13 nt, Human
gugaaaucauuca

SEQ ID NO: 1497633 - RNA, 18 nt, Human
gugaaauuauucauaauu

SEQ ID NO: 1497634 - RNA, 20 nt, Human
gugaaauuauucauaauuau

SEQ ID NO: 1497635 - RNA, 16 nt, Human
gugagcagucaggaaa

SEQ ID NO: 1497636 - RNA, 16 nt, Human
gugacaagcucacaga

SEQ ID NO: 1497637 - RNA, 24 nt, Human
gugcaguggcaucaucucagcuca

SEQ ID NO: 1497638 - RNA, 23 nt, Human
gugcagggccuguaaucccagca

SEQ ID NO: 1497639 - RNA, 18 nt, Human
gugcaaauugucacagga

SEQ ID NO: 1497640 - RNA, 24 nt, Human
gugcaguggcgcgaucucagcuca

SEQ ID NO: 1497641 - RNA, 19 nt, Human
guggaacauaaaaaggaca

SEQ ID NO: 1497642 - RNA, 20 nt, Human
guggaacauaaaaaggacau

SEQ ID NO: 1497643 - RNA, 21 nt, Human
guggaacauaaaaaggacauc

SEQ ID NO: 1497644 - RNA, 11 nt, Human
guggcagucug

SEQ ID NO: 1497645 - RNA, 19 nt, Human
guggcaucaucucagcuca

SEQ ID NO: 1497646 - RNA, 22 nt, Human
ucaccgacugaaaauauuguuu

SEQ ID NO: 1497647 - RNA, 14 nt, Human
ucaccagagacuuu

SEQ ID NO: 1497648 - RNA, 15 nt, Human
ucaccagagacuuua

SEQ ID NO: 1497649 - RNA, 17 nt, Human
ucacauuggaaacaagu

SEQ ID NO: 1497650 - RNA, 22 nt, Human
ucacauuguauucagaguugau

SEQ ID NO: 1497651 - RNA, 12 nt, Human
ucacauuuaaau

SEQ ID NO: 1497652 - RNA, 14 nt, Human
ucacauuggaaaca

SEQ ID NO: 1497653 - RNA, 14 nt, Human
ucaauaaaauccau

SEQ ID NO: 1497654 - RNA, 23 nt, Human
ucaauuaaaauagucucuuuaaa

SEQ ID NO: 1497655 - RNA, 22 nt, Human
ucaacuccaaacugacucuuaa

SEQ ID NO: 1497656 - RNA, 16 nt, Human
ucaaauccuugaagau

SEQ ID NO: 1497657 - RNA, 17 nt, Human
ucaaacauauauaacaa

SEQ ID NO: 1497658 - RNA, 20 nt, Human
ucaaaccaaaucacugaacu

SEQ ID NO: 1497659 - RNA, 16 nt, Human
uauguucagauuauug

SEQ ID NO: 1497660 - RNA, 19 nt, Human
uauguuagugcaaauuguc

SEQ ID NO: 1497661 - RNA, 12 nt, Human
uauguuaaaacu

SEQ ID NO: 1497662 - RNA, 14 nt, Human
uauggaggcaggag

SEQ ID NO: 1497663 - RNA, 13 nt, Human
uauguguguuuua

SEQ ID NO: 1497664 - RNA, 17 nt, Human
uauuauauuuacaaaug

SEQ ID NO: 1497665 - RNA, 16 nt, Human
uauuauguuaaaacug

SEQ ID NO: 1497666 - RNA, 20 nt, Human
uauuauggaggcaggaguuu

SEQ ID NO: 1497667 - RNA, 13 nt, Human
uauugcauuuaua

SEQ ID NO: 1497668 - RNA, 17 nt, Human
uauugcauuuauaugua

SEQ ID NO: 1497669 - RNA, 14 nt, Human
uauuuauuacugua

SEQ ID NO: 1497670 - RNA, 13 nt, Human
uauuucuaugaaa

SEQ ID NO: 1497671 - RNA, 16 nt, Human
uauuugaaccaauaaa

SEQ ID NO: 1497672 - RNA, 15 nt, Human
uauuucuaugaaaua

SEQ ID NO: 1497673 - RNA, 14 nt, Human
uauuucuaugaaau

SEQ ID NO: 1497674 - RNA, 13 nt, Human
uauaugcuucugu

SEQ ID NO: 1497675 - RNA, 14 nt, Human
uauauguguaugca

SEQ ID NO: 1497676 - RNA, 13 nt, Human
uauauaacaaugc

SEQ ID NO: 1497677 - RNA, 17 nt, Human
uaguugccuuaaaauaa

SEQ ID NO: 1497678 - RNA, 14 nt, Human
uauaauaaaggacu

SEQ ID NO: 1497679 - RNA, 19 nt, Human
uauaauaaaggacuguaau

SEQ ID NO: 1497680 - RNA, 22 nt, Human
uauaauaaaggacuguaaucuu

SEQ ID NO: 1497681 - RNA, 15 nt, Human
uauaauucacauugu

SEQ ID NO: 1497682 - RNA, 20 nt, Human
uauaauucacauuguauuca

SEQ ID NO: 1497683 - RNA, 16 nt, Human
uaguauuucuaugaaa

SEQ ID NO: 1497684 - RNA, 19 nt, Human
uaguauuucuaugaaauau

SEQ ID NO: 1497685 - RNA, 18 nt, Human
uaguauuucuaugaaaua

SEQ ID NO: 1497686 - RNA, 15 nt, Human
uagugcaaauuguca

SEQ ID NO: 1497687 - RNA, 14 nt, Human
uagugcaaauuguc

SEQ ID NO: 1497688 - RNA, 14 nt, Human
uagucaaauugugu

SEQ ID NO: 1497689 - RNA, 13 nt, Human
uagucaaauugug

SEQ ID NO: 1497690 - RNA, 13 nt, Human
uaguguucauaaa

SEQ ID NO: 1497691 - RNA, 20 nt, Human
uaguugcaacuuuguauaaa

SEQ ID NO: 1497692 - RNA, 16 nt, Human
uagguaaauuacaguu

SEQ ID NO: 1497693 - RNA, 16 nt, Human
uaggucagugcaaaua

SEQ ID NO: 1497694 - RNA, 15 nt, Human
uaggucucaauaccu

SEQ ID NO: 1497695 - RNA, 15 nt, Human
uaucguaaaauuaag

SEQ ID NO: 1497696 - RNA, 18 nt, Human
uaucguaaaauuaagaaa

SEQ ID NO: 1497697 - RNA, 23 nt, Human
uaugaauuacauuuguauaaaau

SEQ ID NO: 1497698 - RNA, 17 nt, Human
uaugaauuacauuugua

SEQ ID NO: 1497699 - RNA, 20 nt, Human
uaugaaguuuuuuuuauaca

SEQ ID NO: 1497700 - RNA, 16 nt, Human
uaugcuucuguuuuau

SEQ ID NO: 1497701 - RNA, 15 nt, Human
uaugcuucuguuuua

SEQ ID NO: 1497702 - RNA, 20 nt, Human
uaugcauauuauuuuauguu

SEQ ID NO: 1497703 - RNA, 14 nt, Human
uaugcacaguaaaa

SEQ ID NO: 1497704 - RNA, 16 nt, Human
uaugacuauguaaacu

SEQ ID NO: 1497705 - RNA, 17 nt, Human
uaugacuauguaaacua

SEQ ID NO: 1497706 - RNA, 18 nt, Human
uaugacuauguaaacuac

SEQ ID NO: 1497707 - RNA, 21 nt, Human
uaugauucaaaugucuauaaa

SEQ ID NO: 1497708 - RNA, 16 nt, Human
uaugauucaaaugucu

SEQ ID NO: 1497709 - RNA, 16 nt, Human
uaugauucccagccag

SEQ ID NO: 1497710 - RNA, 11 nt, Human
ucaggagcccu

SEQ ID NO: 1497711 - RNA, 12 nt, Human
ucaggagcccug

SEQ ID NO: 1497712 - RNA, 14 nt, Human
ucaggagcccuggg

SEQ ID NO: 1497713 - RNA, 15 nt, Human
ucaggagcccuggga

SEQ ID NO: 1497714 - RNA, 15 nt, Human
ucagucucuauacca

SEQ ID NO: 1497715 - RNA, 18 nt, Human
ucagucucuauaccaaua

SEQ ID NO: 1497716 - RNA, 21 nt, Human
ucagucucuauaccaauaaag

SEQ ID NO: 1497717 - RNA, 20 nt, Human
ucagucucuauaccaauaaa

SEQ ID NO: 1497718 - RNA, 22 nt, Human
uccaaaccacuuuuugcagcuu

SEQ ID NO: 1497719 - RNA, 12 nt, Human
uccaaaccacuu

SEQ ID NO: 1497720 - RNA, 14 nt, Human
ucauggugcucaga

SEQ ID NO: 1497721 - RNA, 19 nt, Human
ucaucucagcucacugcaa

SEQ ID NO: 1497722 - RNA, 18 nt, Human
ucaucucagcucacugca

SEQ ID NO: 1497723 - RNA, 16 nt, Human
ucaucuccccaucauu

SEQ ID NO: 1497724 - RNA, 17 nt, Human
ucaugcuguucaugaaa

SEQ ID NO: 1497725 - RNA, 14 nt, Human
ucccauguucaagc

SEQ ID NO: 1497726 - RNA, 19 nt, Human
uccagguagagggugugua

SEQ ID NO: 1497727 - RNA, 21 nt, Human
uccagguauucguuaucuaau

SEQ ID NO: 1497728 - RNA, 14 nt, Human
uccaguaaaauaau

SEQ ID NO: 1497729 - RNA, 15 nt, Human
uccauacauuugugu

SEQ ID NO: 1497730 - RNA, 20 nt, Human
uccaugggccauaugaaaag

SEQ ID NO: 1497731 - RNA, 23 nt, Human
uccagaaagaaaacuuguauuau

SEQ ID NO: 1497732 - RNA, 15 nt, Human
uccgcuauccaccaa

SEQ ID NO: 1497733 - RNA, 17 nt, Human
uccuccaccucaacucc

SEQ ID NO: 1497734 - RNA, 20 nt, Human
uccuccaggguggcagcaac

SEQ ID NO: 1497735 - RNA, 21 nt, Human
uccuccaggguggcagcaaca

SEQ ID NO: 1497736 - RNA, 22 nt, Human
uccuaagcuggagugcaguggc

SEQ ID NO: 1497737 - RNA, 17 nt, Human
uccuggcaauagucaaa

SEQ ID NO: 1497738 - RNA, 19 nt, Human
uccuuagaaaaaaaauuau

SEQ ID NO: 1497739 - RNA, 12 nt, Human
ucguggacaccu

SEQ ID NO: 1497740 - RNA, 13 nt, Human
ucguggacaccug

SEQ ID NO: 1497741 - RNA, 14 nt, Human
ucguggacaccugc

SEQ ID NO: 1497742 - RNA, 15 nt, Human
ucguggacaccugcc

SEQ ID NO: 1497743 - RNA, 16 nt, Human
ucguggacaccugccc

SEQ ID NO: 1497744 - RNA, 17 nt, Human
ucguggacaccugcccu

SEQ ID NO: 1497745 - RNA, 18 nt, Human
ucguggacaccugcccug

SEQ ID NO: 1497746 - RNA, 19 nt, Human
ucguggacaccugcccugc

SEQ ID NO: 1497747 - RNA, 20 nt, Human
ucguggacaccugcccugcc

SEQ ID NO: 1497748 - RNA, 17 nt, Human
ucuacacuaagagagaa

SEQ ID NO: 1497749 - RNA, 15 nt, Human
ucucagucugucacc

SEQ ID NO: 1497750 - RNA, 16 nt, Human
ucucauacccucccuc

SEQ ID NO: 1497751 - RNA, 16 nt, Human
ucuccagccucagccu

SEQ ID NO: 1497752 - RNA, 19 nt, Human
ucuccagccucagccuccc

SEQ ID NO: 1497753 - RNA, 18 nt, Human
ucuccagccucagcucuc

SEQ ID NO: 1497754 - RNA, 24 nt, Human
ugaucagcuuauugucuagugaaa

SEQ ID NO: 1497755 - RNA, 17 nt, Human
ugaucagcuuauugucu

SEQ ID NO: 1497756 - RNA, 23 nt, Human
ugaugcuacaggauuugaaauug

SEQ ID NO: 1497757 - RNA, 20 nt, Human
ugaugcuacaggauuugaaa

SEQ ID NO: 1497758 - RNA, 11 nt, Human
ugaugccuggc

SEQ ID NO: 1497759 - RNA, 13 nt, Human
ugaugguuguaca

SEQ ID NO: 1497760 - RNA, 14 nt, Human
ugaugguuguacau

SEQ ID NO: 1497761 - RNA, 21 nt, Human
ugaugguuguacauauaagug

SEQ ID NO: 1497762 - RNA, 22 nt, Human
ugauuaugaauuacauuuguau

SEQ ID NO: 1497763 - RNA, 21 nt, Human
ugauuaugaauuacauuugua

SEQ ID NO: 1497764 - RNA, 22 nt, Human
ugauguuuagaaacacaacuau

SEQ ID NO: 1497765 - RNA, 19 nt, Human
ugauuaugaauuacauuug

SEQ ID NO: 1497766 - RNA, 17 nt, Human
ugauuaugaauuacauu

SEQ ID NO: 1497767 - RNA, 13 nt, Human
ugauuauauguca

SEQ ID NO: 1497768 - RNA, 17 nt, Human
ugagaaauuuauaaacu

SEQ ID NO: 1497769 - RNA, 12 nt, Human
ugagaccaccuc

SEQ ID NO: 1497770 - RNA, 15 nt, Human
ugagaccaccucuca

SEQ ID NO: 1497771 - RNA, 19 nt, Human
ugagaccaccucucaauau

SEQ ID NO: 1497772 - RNA, 16 nt, Human
ugauaacuggaaacuu

SEQ ID NO: 1497773 - RNA, 17 nt, Human
ugagggagaacaagacc

SEQ ID NO: 1497774 - RNA, 16 nt, Human
ugaggagcuugaaacc

SEQ ID NO: 1497775 - RNA, 16 nt, Human
ugaaagaugaucauuu

SEQ ID NO: 1497776 - RNA, 15 nt, Human
ugaaagguacuucaa

SEQ ID NO: 1497777 - RNA, 16 nt, Human
ugaaagguacuucaaa

SEQ ID NO: 1497778 - RNA, 20 nt, Human
ugaaaagcuccauuuuuagu

SEQ ID NO: 1497779 - RNA, 16 nt, Human
ugaaaagcagacauuu

SEQ ID NO: 1497780 - RNA, 19 nt, Human
ugaacaguuguguuugaag

SEQ ID NO: 1497781 - RNA, 16 nt, Human
ugaaauauugacuuuu

SEQ ID NO: 1497782 - RNA, 15 nt, Human
ugaaaucauucauuu

SEQ ID NO: 1497783 - RNA, 12 nt, Human
ugaaauuauuca

SEQ ID NO: 1497784 - RNA, 20 nt, Human
ugaaauuaugugacauuuua

SEQ ID NO: 1497785 - RNA, 22 nt, Human
ugaaauuaugugacauuuuaca

SEQ ID NO: 1497786 - RNA, 14 nt, Human
ucuuugccacccuc

SEQ ID NO: 1497787 - RNA, 16 nt, Human
ucuuugccacccucau

SEQ ID NO: 1497788 - RNA, 17 nt, Human
ucuuugccacccucaug

SEQ ID NO: 1497789 - RNA, 18 nt, Human
ucuuugccacccucaugc

SEQ ID NO: 1497790 - RNA, 20 nt, Human
ucuuugccacccucaugcug

SEQ ID NO: 1497791 - RNA, 12 nt, Human
ucuuugccaagu

SEQ ID NO: 1497792 - RNA, 19 nt, Human
ucuuuccacagaagcucca

SEQ ID NO: 1497793 - RNA, 16 nt, Human
ucuuucuuucaauaaa

SEQ ID NO: 1497794 - RNA, 22 nt, Human
ugaaucauuuuaccuuugacaa

SEQ ID NO: 1497795 - RNA, 23 nt, Human
ugaaucauuuuaccuuugacaaa

SEQ ID NO: 1497796 - RNA, 17 nt, Human
ugaauuaugaaacuuuu

SEQ ID NO: 1497797 - RNA, 15 nt, Human
ugaauuaugaaacuu

SEQ ID NO: 1497798 - RNA, 13 nt, Human
ugaauuaugaaac

SEQ ID NO: 1497799 - RNA, 16 nt, Human
ugaauuauuuucucuc

SEQ ID NO: 1497800 - RNA, 18 nt, Human
ugaauuacauuuguauaa

SEQ ID NO: 1497801 - RNA, 16 nt, Human
ugaauuacauuuguau

SEQ ID NO: 1497802 - RNA, 15 nt, Human
ugaauuacauuugua

SEQ ID NO: 1497803 - RNA, 15 nt, Human
ugaauuauauguuca

SEQ ID NO: 1497804 - RNA, 11 nt, Human
ugaaguccaag

SEQ ID NO: 1497805 - RNA, 13 nt, Human
ugaaguccaagca

SEQ ID NO: 1497806 - RNA, 14 nt, Human
ugaagauacugaaa

SEQ ID NO: 1497807 - RNA, 18 nt, Human
ugaagauacugaaauaaa

SEQ ID NO: 1497808 - RNA, 16 nt, Human
ugaagauacugaaaua

SEQ ID NO: 1497809 - RNA, 15 nt, Human
ugaagauacugaaau

SEQ ID NO: 1497810 - RNA, 18 nt, Human
ugacaugggacauuugcu

SEQ ID NO: 1497811 - RNA, 17 nt, Human
ugacaugggacauuugc

SEQ ID NO: 1497812 - RNA, 16 nt, Human
ugacaugggacauuug

SEQ ID NO: 1497813 - RNA, 20 nt, Human
ugacaagcucacagaccuuu

SEQ ID NO: 1497814 - RNA, 15 nt, Human
ugacaagcucacaga

SEQ ID NO: 1497815 - RNA, 12 nt, Human
ugacaagcucac

SEQ ID NO: 1497816 - RNA, 23 nt, Human
ugacauaaguauuuaauucaugu

SEQ ID NO: 1497817 - RNA, 14 nt, Human
ugcaguucugaaga

SEQ ID NO: 1497818 - RNA, 12 nt, Human
ugcaguucugaa

SEQ ID NO: 1497819 - RNA, 18 nt, Human
ugcauauuauuuuauguu

SEQ ID NO: 1497820 - RNA, 14 nt, Human
ugccaccugucugu

SEQ ID NO: 1497821 - RNA, 15 nt, Human
ugccaccugucuguc

SEQ ID NO: 1497822 - RNA, 16 nt, Human
ugccaccugucugucu

SEQ ID NO: 1497823 - RNA, 14 nt, Human
ugccaccuccugcc

SEQ ID NO: 1497824 - RNA, 10 nt, Human
ugccaccugu

SEQ ID NO: 1497825 - RNA, 11 nt, Human
ugccaccuguc

SEQ ID NO: 1497826 - RNA, 12 nt, Human
ugccaccugucu

SEQ ID NO: 1497827 - RNA, 13 nt, Human
ugccaccugucug

SEQ ID NO: 1497828 - RNA, 17 nt, Human
ugccaggcuggagugca

SEQ ID NO: 1497829 - RNA, 19 nt, Human
ugccaggcuggagugcagu

SEQ ID NO: 1497830 - RNA, 13 nt, Human
ugcugcugccugc

SEQ ID NO: 1497831 - RNA, 14 nt, Human
ugcugcugccugcc

SEQ ID NO: 1497832 - RNA, 14 nt, Human
ugcugggccccugc

SEQ ID NO: 1497833 - RNA, 16 nt, Human
ugcugggccccugccu

SEQ ID NO: 1497834 - RNA, 17 nt, Human
ugcugggccccugccuc

SEQ ID NO: 1497835 - RNA, 18 nt, Human
ugcugggccccugccucu

SEQ ID NO: 1497836 - RNA, 19 nt, Human
ugcugggccccugccucuc

SEQ ID NO: 1497837 - RNA, 21 nt, Human
ugcugggccccugccucucug

SEQ ID NO: 1497838 - RNA, 22 nt, Human
ugcugggccccugccucucugc

SEQ ID NO: 1497839 - RNA, 23 nt, Human
ugcugggccccugccucucugca

SEQ ID NO: 1497840 - RNA, 24 nt, Human
ugcugggccccugccucucugcag

SEQ ID NO: 1497841 - RNA, 15 nt, Human
ugcugccugcuuuuu

SEQ ID NO: 1497842 - RNA, 17 nt, Human
ugcugccugcuuuuuau

SEQ ID NO: 1497843 - RNA, 13 nt, Human
ugcugguuuuagu

SEQ ID NO: 1497844 - RNA, 17 nt, Human
ugcuguucaugaaagau

SEQ ID NO: 1497845 - RNA, 16 nt, Human
ugcuguucaugaaaga

SEQ ID NO: 1497846 - RNA, 13 nt, Human
ugcucuccuccac

SEQ ID NO: 1497847 - RNA, 18 nt, Human
ugcucaggagcccuggga

SEQ ID NO: 1497848 - RNA, 19 nt, Human
ugcucaggagcccugggag

SEQ ID NO: 1497849 - RNA, 20 nt, Human
ugcucaggagcccugggagg

SEQ ID NO: 1497850 - RNA, 20 nt, Human
ugccuugcauaauggucaga

SEQ ID NO: 1497851 - RNA, 15 nt, Human
uggcgggguggggug

SEQ ID NO: 1497852 - RNA, 15 nt, Human
uggcacuaguauuuc

SEQ ID NO: 1497853 - RNA, 20 nt, Human
uggcaauagucaaauugugu

SEQ ID NO: 1497854 - RNA, 11 nt, Human
uggagaaggaa

SEQ ID NO: 1497855 - RNA, 12 nt, Human
uggagaaggaag

SEQ ID NO: 1497856 - RNA, 13 nt, Human
uggagaaggaagg

SEQ ID NO: 1497857 - RNA, 14 nt, Human
uggagaaggaaggc

SEQ ID NO: 1497858 - RNA, 23 nt, Human
uggacaccugcccugcccugcca

SEQ ID NO: 1497859 - RNA, 16 nt, Human
uggacacuacacccag

SEQ ID NO: 1497860 - RNA, 17 nt, Human
uggacacuacacccagc

SEQ ID NO: 1497861 - RNA, 18 nt, Human
uggacacuacacccagca

SEQ ID NO: 1497862 - RNA, 19 nt, Human
uggacacuacacccagcaa

SEQ ID NO: 1497863 - RNA, 20 nt, Human
uggacacuacacccagcaau

SEQ ID NO: 1497864 - RNA, 21 nt, Human
ugguauguuuucaggcuagau

SEQ ID NO: 1497865 - RNA, 13 nt, Human
ugguauguuuuca

SEQ ID NO: 1497866 - RNA, 21 nt, Human
ugggccccugccucucugcag

SEQ ID NO: 1497867 - RNA, 23 nt, Human
ugggccccugccucucugcaggu

SEQ ID NO: 1497868 - RNA, 21 nt, Human
uggggccaggcugggucgccc

SEQ ID NO: 1497869 - RNA, 22 nt, Human
uggggccaggcugggucgcccu

SEQ ID NO: 1497870 - RNA, 18 nt, Human
uucccuugaugaagaagu

SEQ ID NO: 1497871 - RNA, 21 nt, Human
uucccucucucauacccuccc

SEQ ID NO: 1497872 - RNA, 17 nt, Human
uucccuugaugaagaag

SEQ ID NO: 1497873 - RNA, 22 nt, Human
uucccugcugugaaagaaguaa

SEQ ID NO: 1497874 - RNA, 20 nt, Human
uucccuggaaaccuuccacc

SEQ ID NO: 1497875 - RNA, 23 nt, Human
uucccuggaaaccuuccacccag

SEQ ID NO: 1497876 - RNA, 22 nt, Human
uucccuggaaaccuuccaccca

SEQ ID NO: 1497877 - RNA, 13 nt, Human
uuccauucuggaa

SEQ ID NO: 1497878 - RNA, 15 nt, Human
uuccauucuggaagu

SEQ ID NO: 1497879 - RNA, 17 nt, Human
uucaugcaaacuuuauu

SEQ ID NO: 1497880 - RNA, 13 nt, Human
uucaugcauggaa

SEQ ID NO: 1497881 - RNA, 17 nt, Human
uucaugaaagauucaau

SEQ ID NO: 1497882 - RNA, 15 nt, Human
uucaugaaagauuca

SEQ ID NO: 1497883 - RNA, 19 nt, Human
uuccacucguguguuucua

SEQ ID NO: 1497884 - RNA, 15 nt, Human
uuauugucuagugaa

SEQ ID NO: 1497885 - RNA, 16 nt, Human
uuauuuuaauaauguu

SEQ ID NO: 1497886 - RNA, 15 nt, Human
uuauuuuaauaaugu

SEQ ID NO: 1497887 - RNA, 17 nt, Human
uuauuuuaauaauguuu

SEQ ID NO: 1497888 - RNA, 20 nt, Human
uuauuuuauguugcauagaa

SEQ ID NO: 1497889 - RNA, 17 nt, Human
uucaaauccuugaagau

SEQ ID NO: 1497890 - RNA, 22 nt, Human
uucaaaucaaucuguaaaacua

SEQ ID NO: 1497891 - RNA, 23 nt, Human
uucaaaucaaucuguaaaacuaa

SEQ ID NO: 1497892 - RNA, 20 nt, Human
uucagauaaucacaauacau

SEQ ID NO: 1497893 - RNA, 21 nt, Human
uucagaguugaugguuguaca

SEQ ID NO: 1497894 - RNA, 22 nt, Human
uucagaguugaugguuguacau

SEQ ID NO: 1497895 - RNA, 18 nt, Human
uuauuacuguaagaaaau

SEQ ID NO: 1497896 - RNA, 17 nt, Human
uuauuacuguaagaaaa

SEQ ID NO: 1497897 - RNA, 16 nt, Human
uuauuacuguaagaaa

SEQ ID NO: 1497898 - RNA, 16 nt, Human
uuauuaaacaaauaau

SEQ ID NO: 1497899 - RNA, 20 nt, Human
uuaucuugaauaauguaaga

SEQ ID NO: 1497900 - RNA, 13 nt, Human
uuaguugcaacuu

SEQ ID NO: 1497901 - RNA, 20 nt, Human
uuaguugcaacuuuguauaa

SEQ ID NO: 1497902 - RNA, 21 nt, Human
uuauggcacuaguauuucuau

SEQ ID NO: 1497903 - RNA, 16 nt, Human
uuaugcuuaaauucaa

SEQ ID NO: 1497904 - RNA, 21 nt, Human
uuagaugcaguucugaagaag

SEQ ID NO: 1497905 - RNA, 20 nt, Human
uuagaugcaguucugaagaa

SEQ ID NO: 1497906 - RNA, 13 nt, Human
uuagcuggaaaag

SEQ ID NO: 1497907 - RNA, 12 nt, Human
uuagcuggaaaa

SEQ ID NO: 1497908 - RNA, 14 nt, Human
uuaguguucauaaa

SEQ ID NO: 1497909 - RNA, 22 nt, Human
uuaggaaguugacuuauaguac

SEQ ID NO: 1497910 - RNA, 23 nt, Human
uuaggaaguugacuuauaguaca

SEQ ID NO: 1497911 - RNA, 14 nt, Human
uuagggaaaacauu

SEQ ID NO: 1497912 - RNA, 19 nt, Human
uuagaaacacaacuauauu

SEQ ID NO: 1497913 - RNA, 19 nt, Human
uuacugucuuuuuucuaaa

SEQ ID NO: 1497914 - RNA, 17 nt, Human
uuacugucuuuuuucua

SEQ ID NO: 1497915 - RNA, 22 nt, Human
uuaaugucaauucuugccaaau

SEQ ID NO: 1497916 - RNA, 14 nt, Human
uuaaagacuuuuau

SEQ ID NO: 1497917 - RNA, 21 nt, Human
uuaaauguuuuuuuuuaaaga

SEQ ID NO: 1497918 - RNA, 23 nt, Human
uuaaauguuuuuuuuuaaagacu

SEQ ID NO: 1497919 - RNA, 14 nt, Human
uuaacuauugcauu

SEQ ID NO: 1497920 - RNA, 21 nt, Human
uuaacuauugcauuuauaugu

SEQ ID NO: 1497921 - RNA, 22 nt, Human
uuaacuauugcauuuauaugua

SEQ ID NO: 1497922 - RNA, 16 nt, Human
uguuuuuuuguuauua

SEQ ID NO: 1497923 - RNA, 18 nt, Human
uguuuuuuuguuauuaaa

SEQ ID NO: 1497924 - RNA, 18 nt, Human
uguuuuuuuuuaaagacu

SEQ ID NO: 1497925 - RNA, 13 nt, Human
uuaaaagaaugau

SEQ ID NO: 1497926 - RNA, 22 nt, Human
uguuucaaacauauauaacaau

SEQ ID NO: 1497927 - RNA, 21 nt, Human
uguuucaaacauauauaacaa

SEQ ID NO: 1497928 - RNA, 18 nt, Human
uuucuuaaccagaucauu

SEQ ID NO: 1497929 - RNA, 21 nt, Human
uuugaaauuguauuacaaauc

SEQ ID NO: 1497930 - RNA, 13 nt, Human
uuugaaccaauaa

SEQ ID NO: 1497931 - RNA, 18 nt, Human
uuugaagcacagugauca

SEQ ID NO: 1497932 - RNA, 13 nt, Human
uuuguauucaaaa

SEQ ID NO: 1497933 - RNA, 18 nt, Human
uuugguaaggggaauuga

SEQ ID NO: 1497934 - RNA, 17 nt, Human
uuugauaugugaacagu

SEQ ID NO: 1497935 - RNA, 15 nt, Human
uuugauaugugaaca

SEQ ID NO: 1497936 - RNA, 14 nt, Human
uuugauaugugaac

SEQ ID NO: 1497937 - RNA, 19 nt, Human
uuugccacccucaugcugu

SEQ ID NO: 1497938 - RNA, 18 nt, Human
uuugccacccucaugcug

SEQ ID NO: 1497939 - RNA, 22 nt, Human
uuucuaaaguaaaaacaaagaa

SEQ ID NO: 1497940 - RNA, 17 nt, Human
uuucuaaaguaaaaaca

SEQ ID NO: 1497941 - RNA, 12 nt, Human
uuucucuaggaa

SEQ ID NO: 1497942 - RNA, 19 nt, Human
uuucugaaauuuccuggga

SEQ ID NO: 1497943 - RNA, 12 nt, Human
uuucugaaauuu

SEQ ID NO: 1497944 - RNA, 22 nt, Human
uuuaugauacuugaaaauuaac

SEQ ID NO: 1497945 - RNA, 17 nt, Human
uuuauggcacuaguauu

SEQ ID NO: 1497946 - RNA, 17 nt, Human
uuuaguugcaacuuugu

SEQ ID NO: 1497947 - RNA, 18 nt, Human
uuuaguugcaacuuugua

SEQ ID NO: 1497948 - RNA, 14 nt, Human
uuuaaccucuaaau

SEQ ID NO: 1497949 - RNA, 14 nt, Human
uuuaauaaacacuc

SEQ ID NO: 1497950 - RNA, 15 nt, Human
uuuaauaaacacucu

SEQ ID NO: 1497951 - RNA, 19 nt, Human
uuuaauaauguuucaaaca

SEQ ID NO: 1497952 - RNA, 15 nt, Human
uuuaauaauguuuca

SEQ ID NO: 1497953 - RNA, 22 nt, Human
uuuaauaaacacucuugaaaaa

SEQ ID NO: 1497954 - RNA, 16 nt, Human
uuuacauggcuggagc

SEQ ID NO: 1497955 - RNA, 17 nt, Human
uuuaaaagaaugauuau

SEQ ID NO: 1497956 - RNA, 14 nt, Human
uuuaaaagaaugau

SEQ ID NO: 1497957 - RNA, 17 nt, Human
uuuaaaaggaaagaaaa

SEQ ID NO: 1497958 - RNA, 16 nt, Human
uuuaaaauuacaacua

SEQ ID NO: 1497959 - RNA, 12 nt, Human
uuuaaaaugucu

SEQ ID NO: 1497960 - RNA, 16 nt, Human
uuuaaaaugagaaauc

SEQ ID NO: 1497961 - RNA, 12 nt, Human
uuguuuuacaau

SEQ ID NO: 1497962 - RNA, 13 nt, Human
uuguuuuacaaua

SEQ ID NO: 1497963 - RNA, 15 nt, Human
uuguuauuaaacaaa

SEQ ID NO: 1497964 - RNA, 22 nt, Human
uugcagcccugcugcugccugc

SEQ ID NO: 1497965 - RNA, 19 nt, Human
uugccaggcuggagugcag

SEQ ID NO: 1497966 - RNA, 23 nt, Human
uugccaggcuggagugcaguggc

SEQ ID NO: 1497967 - RNA, 16 nt, Human
uugcauaacguauaaa

SEQ ID NO: 1497968 - RNA, 17 nt, Human
uugauccagaaagaaaa

SEQ ID NO: 1497969 - RNA, 16 nt, Human
uugauaugugaacagu

SEQ ID NO: 1497970 - RNA, 20 nt, Human
uugauaugccuuuucccaac

SEQ ID NO: 1497971 - RNA, 18 nt, Human
uucuuaugccauauaauu

SEQ ID NO: 1497972 - RNA, 19 nt, Human
uucuuaggguuaugauuaa

SEQ ID NO: 1497973 - RNA, 21 nt, Human
uugaaaaucuuauaauuuaaa

SEQ ID NO: 1497974 - RNA, 18 nt, Human
uugaaaauuaacaugaau

SEQ ID NO: 1497975 - RNA, 16 nt, Human
uugaagagguuuuaaa

SEQ ID NO: 1497976 - RNA, 20 nt, Human
uugaagcacagugaucaagu

SEQ ID NO: 1497977 - RNA, 21 nt, Human
uugaagagguuuuaaagcuuc

SEQ ID NO: 1497978 - RNA, 20 nt, Human
uugguaaggggaauugagga

SEQ ID NO: 1497979 - RNA, 15 nt, Human
uuguagcauccugga

SEQ ID NO: 1497980 - RNA, 22 nt, Human
uuguagaagucacauuccugaa

SEQ ID NO: 1497981 - RNA, 17 nt, Human
uuguagaagucacauuc

SEQ ID NO: 1497982 - RNA, 18 nt, Human
uuguacuuuagggaagua

SEQ ID NO: 1497983 - RNA, 13 nt, Human
uugccuuaaaaua

SEQ ID NO: 1497984 - RNA, 18 nt, Human
uugcuaagcauuccaacu

SEQ ID NO: 1497985 - RNA, 16 nt, Human
uugcuaagcauuccaa

SEQ ID NO: 1497986 - RNA, 18 nt, Human
uuggacaaaauggaauac

SEQ ID NO: 1497987 - RNA, 15 nt, Human
cugacagccgcugcu

SEQ ID NO: 1497988 - RNA, 21 nt, Human
cccaguaucucuucagucucu

SEQ ID NO: 1497989 - RNA, 22 nt, Human
cccuggucccucugcagucucu

SEQ ID NO: 1497990 - RNA, 17 nt, Human
cagugggccccgcugca

SEQ ID NO: 1497991 - RNA, 18 nt, Human
gaggccagagagggcgug

SEQ ID NO: 1497992 - RNA, 17 nt, Human
agagacuuuagggggug

SEQ ID NO: 1497993 - RNA, 17 nt, Human
aaaagaaagaaaaucag

SEQ ID NO: 1497994 - RNA, 12 nt, Human
aaaagaauauuu

SEQ ID NO: 1497995 - RNA, 20 nt, Human
aaaagacaaggaaaaaauaa

SEQ ID NO: 1497996 - RNA, 13 nt, Human
aaaagaauauuuu

SEQ ID NO: 1497997 - RNA, 11 nt, Human
aaaagaaugau

SEQ ID NO: 1497998 - RNA, 13 nt, Human
aaaagacuccaaa

SEQ ID NO: 1497999 - RNA, 11 nt, Human
aaaagaaaaag

SEQ ID NO: 1498000 - RNA, 19 nt, Human
aaaacacuguucucugccc

SEQ ID NO: 1498001 - RNA, 17 nt, Human
aaaacacauuuuucuua

SEQ ID NO: 1498002 - RNA, 17 nt, Human
aaaagaugaaaauauuu

SEQ ID NO: 1498003 - RNA, 18 nt, Human
aaaaguugaauuuuacau

SEQ ID NO: 1498004 - RNA, 14 nt, Human
aaaauaaaacuuuu

SEQ ID NO: 1498005 - RNA, 16 nt, Human
aaaauaaaacuuuuua

SEQ ID NO: 1498006 - RNA, 13 nt, Human
aaaaucagccugc

SEQ ID NO: 1498007 - RNA, 17 nt, Human
aaaaucagccugcucca

SEQ ID NO: 1498008 - RNA, 21 nt, Human
aaaaucagccugcuccagcug

SEQ ID NO: 1498009 - RNA, 10 nt, Human
aaaaucauuu

SEQ ID NO: 1498010 - RNA, 11 nt, Human
aaaaucauuuc

SEQ ID NO: 1498011 - RNA, 12 nt, Human
aaaaucauuucu

SEQ ID NO: 1498012 - RNA, 22 nt, Human
aaaccgaacugauguaaguaaa

SEQ ID NO: 1498013 - RNA, 18 nt, Human
aaacccagcucuggucca

SEQ ID NO: 1498014 - RNA, 12 nt, Human
aaacccagcucu

SEQ ID NO: 1498015 - RNA, 16 nt, Human
aaacccagcucugguc

SEQ ID NO: 1498016 - RNA, 15 nt, Human
aaaccgccaaggcug

SEQ ID NO: 1498017 - RNA, 16 nt, Human
aaaccgccaaggcugg

SEQ ID NO: 1498018 - RNA, 15 nt, Human
aaacugcacugucaa

SEQ ID NO: 1498019 - RNA, 12 nt, Human
aaacucuuaaaa

SEQ ID NO: 1498020 - RNA, 23 nt, Human
aaacucuuaaaacccaagugccu

SEQ ID NO: 1498021 - RNA, 23 nt, Human
aaacugauuuuuuuuuccuucag

SEQ ID NO: 1498022 - RNA, 21 nt, Human
aaaaucauuucugcaucagcu

SEQ ID NO: 1498023 - RNA, 16 nt, Human
aaaaucucaaauuucu

SEQ ID NO: 1498024 - RNA, 15 nt, Human
aaaaucucaaauuuc

SEQ ID NO: 1498025 - RNA, 18 nt, Human
aaaaucucaaauuucuaa

SEQ ID NO: 1498026 - RNA, 19 nt, Human
aaagcauuguaaaugugcu

SEQ ID NO: 1498027 - RNA, 13 nt, Human
aaagccugcaauu

SEQ ID NO: 1498028 - RNA, 18 nt, Human
aaagccugcaauuucaua

SEQ ID NO: 1498029 - RNA, 15 nt, Human
aaagcauuguaaaug

SEQ ID NO: 1498030 - RNA, 17 nt, Human
aaagcauuguaaaugug

SEQ ID NO: 1498031 - RNA, 11 nt, Human
aacaucuuuuc

SEQ ID NO: 1498032 - RNA, 15 nt, Human
aacaucuuuucuugc

SEQ ID NO: 1498033 - RNA, 22 nt, Human
aacauggccuuugcuugaaaga

SEQ ID NO: 1498034 - RNA, 11 nt, Human
aacaggcagau

SEQ ID NO: 1498035 - RNA, 18 nt, Human
aacagccacuacauuacu

SEQ ID NO: 1498036 - RNA, 18 nt, Human
aaauucuugcaaaguauc

SEQ ID NO: 1498037 - RNA, 15 nt, Human
aaauucuugcaaagu

SEQ ID NO: 1498038 - RNA, 23 nt, Human
aaauucuucuccacuuucuagcc

SEQ ID NO: 1498039 - RNA, 16 nt, Human
aaccuuuugagugccu

SEQ ID NO: 1498040 - RNA, 23 nt, Human
aaccuuuugagugccuuacacaa

SEQ ID NO: 1498041 - RNA, 23 nt, Human
aacauggccuuugcuugaaagaa

SEQ ID NO: 1498042 - RNA, 22 nt, Human
aaauguugacaugggacauuug

SEQ ID NO: 1498043 - RNA, 17 nt, Human
aaauguucaucaaugaa

SEQ ID NO: 1498044 - RNA, 13 nt, Human
aaauguucaucaa

SEQ ID NO: 1498045 - RNA, 23 nt, Human
aaauguugacaugggacauuugc

SEQ ID NO: 1498046 - RNA, 21 nt, Human
aaauauuuauuuuaauaaugu

SEQ ID NO: 1498047 - RNA, 19 nt, Human
aaaugcuguaacuuucuga

SEQ ID NO: 1498048 - RNA, 18 nt, Human
aaaucucaauauuucaga

SEQ ID NO: 1498049 - RNA, 23 nt, Human
aaaucucaaauuuggauugcuaa

SEQ ID NO: 1498050 - RNA, 19 nt, Human
aaaucuccaaaauaaaacu

SEQ ID NO: 1498051 - RNA, 13 nt, Human
aaaucuuuuugcu

SEQ ID NO: 1498052 - RNA, 14 nt, Human
aaaucuuuuugcuu

SEQ ID NO: 1498053 - RNA, 20 nt, Human
aaaggaugcccaaagaugca

SEQ ID NO: 1498054 - RNA, 13 nt, Human
aagcuacuuauug

SEQ ID NO: 1498055 - RNA, 16 nt, Human
aagcgugagccacugc

SEQ ID NO: 1498056 - RNA, 15 nt, Human
aagcgugagccacug

SEQ ID NO: 1498057 - RNA, 14 nt, Human
aagcggcuggcagc

SEQ ID NO: 1498058 - RNA, 18 nt, Human
aagccauaauuguucuua

SEQ ID NO: 1498059 - RNA, 19 nt, Human
aagauaauauuaaggaaga

SEQ ID NO: 1498060 - RNA, 21 nt, Human
aagauaauauuaaggaagaca

SEQ ID NO: 1498061 - RNA, 23 nt, Human
aagauacaguuacucagaauucu

SEQ ID NO: 1498062 - RNA, 17 nt, Human
aagauacaguuacucag

SEQ ID NO: 1498063 - RNA, 16 nt, Human
aaggcaaggcugucaa

SEQ ID NO: 1498064 - RNA, 15 nt, Human
aaggcaaggcuguca

SEQ ID NO: 1498065 - RNA, 13 nt, Human
aaggcaaggcugu

SEQ ID NO: 1498066 - RNA, 22 nt, Human
aagcuagacgagcaggcuucuu

SEQ ID NO: 1498067 - RNA, 13 nt, Human
aagcugcacccuc

SEQ ID NO: 1498068 - RNA, 19 nt, Human
aagcugcacccucaggcag

SEQ ID NO: 1498069 - RNA, 14 nt, Human
aagagagaaaauaa

SEQ ID NO: 1498070 - RNA, 23 nt, Human
aagacagauacuccuccaagguu

SEQ ID NO: 1498071 - RNA, 15 nt, Human
aagacagagcuggga

SEQ ID NO: 1498072 - RNA, 16 nt, Human
aagacagagcugggau

SEQ ID NO: 1498073 - RNA, 17 nt, Human
aagaccacguuucuaaa

SEQ ID NO: 1498074 - RNA, 15 nt, Human
aagaccacguuucua

SEQ ID NO: 1498075 - RNA, 21 nt, Human
aagacuuuuccaacccucauc

SEQ ID NO: 1498076 - RNA, 12 nt, Human
aagacuuuucuu

SEQ ID NO: 1498077 - RNA, 19 nt, Human
aagacuuuucuuucagcca

SEQ ID NO: 1498078 - RNA, 13 nt, Human
aagagaaaaaaua

SEQ ID NO: 1498079 - RNA, 17 nt, Human
aagaacggggcucuucu

SEQ ID NO: 1498080 - RNA, 20 nt, Human
aagaacuacaaacaaaauuu

SEQ ID NO: 1498081 - RNA, 21 nt, Human
aagaacuacaaacaaaauuuc

SEQ ID NO: 1498082 - RNA, 18 nt, Human
aagaacggggcucuucuc

SEQ ID NO: 1498083 - RNA, 21 nt, Human
aagaacggggcucuucucauu

SEQ ID NO: 1498084 - RNA, 22 nt, Human
aagaacggggcucuucucauuu

SEQ ID NO: 1498085 - RNA, 23 nt, Human
aagaacggggcucuucucauuuc

SEQ ID NO: 1498086 - RNA, 20 nt, Human
aacgcaggcccccaggugcc

SEQ ID NO: 1498087 - RNA, 11 nt, Human
aagaacugaaa

SEQ ID NO: 1498088 - RNA, 12 nt, Human
aagaacugaaau

SEQ ID NO: 1498089 - RNA, 13 nt, Human
aagaacugaaauc

SEQ ID NO: 1498090 - RNA, 15 nt, Human
aagaacugaaaucau

SEQ ID NO: 1498091 - RNA, 21 nt, Human
aagacaaggaaaaaauaacaa

SEQ ID NO: 1498092 - RNA, 20 nt, Human
aagaagacugcauuauauuu

SEQ ID NO: 1498093 - RNA, 15 nt, Human
aagaagacugcauua

SEQ ID NO: 1498094 - RNA, 22 nt, Human
aagacaaugacuuacuguacau

SEQ ID NO: 1498095 - RNA, 19 nt, Human
aagacaaugugaaaagaaa

SEQ ID NO: 1498096 - RNA, 20 nt, Human
aagacaaugugaaaagaaaa

SEQ ID NO: 1498097 - RNA, 23 nt, Human
aagacaauggcuuacuccaggag

SEQ ID NO: 1498098 - RNA, 15 nt, Human
aagagucgcugugcc

SEQ ID NO: 1498099 - RNA, 22 nt, Human
aagagucgcugugccacaggcu

SEQ ID NO: 1498100 - RNA, 19 nt, Human
aagaguauuuuugacagaa

SEQ ID NO: 1498101 - RNA, 16 nt, Human
aagaguaguaauagag

SEQ ID NO: 1498102 - RNA, 22 nt, Human
aaguuguaggcauaaagucagg

SEQ ID NO: 1498103 - RNA, 22 nt, Human
aagugcugcauuuaaaagauac

SEQ ID NO: 1498104 - RNA, 22 nt, Human
aagugcugggauuacaggugug

SEQ ID NO: 1498105 - RNA, 12 nt, Human
aagugcugggau

SEQ ID NO: 1498106 - RNA, 22 nt, Human
aauaaugugaaacuggauuaaa

SEQ ID NO: 1498107 - RNA, 17 nt, Human
aauaaugugaaacugga

SEQ ID NO: 1498108 - RNA, 14 nt, Human
aauaaagcagcguu

SEQ ID NO: 1498109 - RNA, 19 nt, Human
aauaauguuaacauggaca

SEQ ID NO: 1498110 - RNA, 16 nt, Human
aaucucaauauuucag

SEQ ID NO: 1498111 - RNA, 16 nt, Human
aaucucauaauuuaua

SEQ ID NO: 1498112 - RNA, 20 nt, Human
aaugaagauacugaaauaaa

SEQ ID NO: 1498113 - RNA, 21 nt, Human
aaugaaagacuguacaaagua

SEQ ID NO: 1498114 - RNA, 20 nt, Human
aaugaaagacuguacaaagu

SEQ ID NO: 1498115 - RNA, 20 nt, Human
aaugaauacuuuauaaagga

SEQ ID NO: 1498116 - RNA, 20 nt, Human
aaugaugccaugaggaacaa

SEQ ID NO: 1498117 - RNA, 23 nt, Human
aauauguggaguucaucuugaau

SEQ ID NO: 1498118 - RNA, 13 nt, Human
aauauuaagaaag

SEQ ID NO: 1498119 - RNA, 23 nt, Human
aaucaccgaaaacguggcugcuu

SEQ ID NO: 1498120 - RNA, 21 nt, Human
aaucaccgaaaacguggcugc

SEQ ID NO: 1498121 - RNA, 23 nt, Human
acccucaucaccaacgucugugc

SEQ ID NO: 1498122 - RNA, 23 nt, Human
acccuggcacuauaauguaagcu

SEQ ID NO: 1498123 - RNA, 13 nt, Human
acccucaggcagg

SEQ ID NO: 1498124 - RNA, 14 nt, Human
acccucaggcaggu

SEQ ID NO: 1498125 - RNA, 13 nt, Human
acccucaucacca

SEQ ID NO: 1498126 - RNA, 15 nt, Human
acccucaggcaggug

SEQ ID NO: 1498127 - RNA, 16 nt, Human
acccucaggcaggugg

SEQ ID NO: 1498128 - RNA, 16 nt, Human
acccuggggagaaagu

SEQ ID NO: 1498129 - RNA, 16 nt, Human
acccugugauggggcc

SEQ ID NO: 1498130 - RNA, 21 nt, Human
acccugucucuacuaaaaaua

SEQ ID NO: 1498131 - RNA, 14 nt, Human
acccuauugcugcu

SEQ ID NO: 1498132 - RNA, 19 nt, Human
acccuauugcugcuugagg

SEQ ID NO: 1498133 - RNA, 13 nt, Human
acccuauugcugc

SEQ ID NO: 1498134 - RNA, 18 nt, Human
accgugaggccagagaca

SEQ ID NO: 1498135 - RNA, 12 nt, Human
accucagccucc

SEQ ID NO: 1498136 - RNA, 23 nt, Human
accgugaggccagagacacaagc

SEQ ID NO: 1498137 - RNA, 17 nt, Human
acccugugauggggccc

SEQ ID NO: 1498138 - RNA, 19 nt, Human
acccugugauggggcccug

SEQ ID NO: 1498139 - RNA, 20 nt, Human
acccugugauggggcccugc

SEQ ID NO: 1498140 - RNA, 21 nt, Human
acccugugauggggcccugcc

SEQ ID NO: 1498141 - RNA, 12 nt, Human
accgggcacuca

SEQ ID NO: 1498142 - RNA, 14 nt, Human
accgggcacucaga

SEQ ID NO: 1498143 - RNA, 16 nt, Human
accgggcacucagaag

SEQ ID NO: 1498144 - RNA, 20 nt, Human
accgggcacucagaagacac

SEQ ID NO: 1498145 - RNA, 11 nt, Human
accucaggccu

SEQ ID NO: 1498146 - RNA, 20 nt, Human
accucaggugauccacccac

SEQ ID NO: 1498147 - RNA, 21 nt, Human
accucaggugauccacccacc

SEQ ID NO: 1498148 - RNA, 13 nt, Human
acgucuuaaauau

SEQ ID NO: 1498149 - RNA, 14 nt, Human
acgucuuaaauauu

SEQ ID NO: 1498150 - RNA, 13 nt, Human
acgucugugccau

SEQ ID NO: 1498151 - RNA, 19 nt, Human
acggaauaguuggcuagga

SEQ ID NO: 1498152 - RNA, 17 nt, Human
acggacacucaaaagcu

SEQ ID NO: 1498153 - RNA, 19 nt, Human
acggacacucaaaagcugg

SEQ ID NO: 1498154 - RNA, 19 nt, Human
acgcaggcccccaggugcc

SEQ ID NO: 1498155 - RNA, 22 nt, Human
acgcugugcugcccugcccacc

SEQ ID NO: 1498156 - RNA, 19 nt, Human
acgcugugcugcccugccc

SEQ ID NO: 1498157 - RNA, 23 nt, Human
acgauuucuguuuagauaauaca

SEQ ID NO: 1498158 - RNA, 20 nt, Human
acgauuucuguuuagauaau

SEQ ID NO: 1498159 - RNA, 20 nt, Human
acuaauguguaagacaaaaa

SEQ ID NO: 1498160 - RNA, 18 nt, Human
acuaauggggcggugaga

SEQ ID NO: 1498161 - RNA, 21 nt, Human
accugccaggaagccagcagg

SEQ ID NO: 1498162 - RNA, 22 nt, Human
accugccaggaagccagcaggc

SEQ ID NO: 1498163 - RNA, 23 nt, Human
accugccaggaagccagcaggcu

SEQ ID NO: 1498164 - RNA, 12 nt, Human
accugccccuca

SEQ ID NO: 1498165 - RNA, 15 nt, Human
accugccccucaacu

SEQ ID NO: 1498166 - RNA, 20 nt, Human
accugccccucaacucuccu

SEQ ID NO: 1498167 - RNA, 12 nt, Human
accucugccuga

SEQ ID NO: 1498168 - RNA, 20 nt, Human
accucugccugaagucacac

SEQ ID NO: 1498169 - RNA, 23 nt, Human
accucugccugaagucacacagu

SEQ ID NO: 1498170 - RNA, 12 nt, Human
accuuggcucaa

SEQ ID NO: 1498171 - RNA, 13 nt, Human
acugaauuaugaa

SEQ ID NO: 1498172 - RNA, 14 nt, Human
acugaauuaugaaa

SEQ ID NO: 1498173 - RNA, 15 nt, Human
acugaauuaugaaac

SEQ ID NO: 1498174 - RNA, 20 nt, Human
acugaauuaugaaacuuuug

SEQ ID NO: 1498175 - RNA, 12 nt, Human
acugaauuucuu

SEQ ID NO: 1498176 - RNA, 13 nt, Human
acucuacccucuu

SEQ ID NO: 1498177 - RNA, 23 nt, Human
acugaauuucuuuugccguuauu

SEQ ID NO: 1498178 - RNA, 16 nt, Human
acugacagauuuccau

SEQ ID NO: 1498179 - RNA, 17 nt, Human
acugacauuguuggcca

SEQ ID NO: 1498180 - RNA, 18 nt, Human
acugacauuguuggccaa

SEQ ID NO: 1498181 - RNA, 19 nt, Human
acugauaugggucuugaua

SEQ ID NO: 1498182 - RNA, 22 nt, Human
acugacauuguuggccaaagcc

SEQ ID NO: 1498183 - RNA, 16 nt, Human
acugauuuuuuuuucc

SEQ ID NO: 1498184 - RNA, 17 nt, Human
acugauuuuuuuuuccu

SEQ ID NO: 1498185 - RNA, 18 nt, Human
acugauuuuuuuuuccuu

SEQ ID NO: 1498186 - RNA, 19 nt, Human
acugauuuuuuuuuccuuc

SEQ ID NO: 1498187 - RNA, 20 nt, Human
acugauuuuuuuuuccuuca

SEQ ID NO: 1498188 - RNA, 14 nt, Human
acucguuaauuugu

SEQ ID NO: 1498189 - RNA, 19 nt, Human
acucguuaauuuguagugu

SEQ ID NO: 1498190 - RNA, 15 nt, Human
acucuacagaggcca

SEQ ID NO: 1498191 - RNA, 22 nt, Human
acucccaucugugaaaggaaag

SEQ ID NO: 1498192 - RNA, 14 nt, Human
acucccuuucaaca

SEQ ID NO: 1498193 - RNA, 17 nt, Human
acuucagcgguuuauau

SEQ ID NO: 1498194 - RNA, 16 nt, Human
acuucaaacugagauc

SEQ ID NO: 1498195 - RNA, 21 nt, Human
acuucagacauagaauuaaca

SEQ ID NO: 1498196 - RNA, 13 nt, Human
acuuggucuguga

SEQ ID NO: 1498197 - RNA, 23 nt, Human
acuuggggggcugaggugggagg

SEQ ID NO: 1498198 - RNA, 17 nt, Human
acuucaaauccuugaag

SEQ ID NO: 1498199 - RNA, 18 nt, Human
acuucaaauccuugaaga

SEQ ID NO: 1498200 - RNA, 19 nt, Human
acuucaaauccuugaagau

SEQ ID NO: 1498201 - RNA, 22 nt, Human
acuuaaaaaugguuuaaauggu

SEQ ID NO: 1498202 - RNA, 19 nt, Human
acuguuucaaacuuuacua

SEQ ID NO: 1498203 - RNA, 18 nt, Human
acuguuucaaacuuuacu

SEQ ID NO: 1498204 - RNA, 15 nt, Human
acuguuucaaacuuu

SEQ ID NO: 1498205 - RNA, 17 nt, Human
acuguaaaauaauaacu

SEQ ID NO: 1498206 - RNA, 12 nt, Human
acuggaacucuc

SEQ ID NO: 1498207 - RNA, 16 nt, Human
acugugaagagaacca

SEQ ID NO: 1498208 - RNA, 17 nt, Human
acugugccaugugccag

SEQ ID NO: 1498209 - RNA, 18 nt, Human
acugugccaugugccagg

SEQ ID NO: 1498210 - RNA, 23 nt, Human
acagugaucaaguuauuuuuaau

SEQ ID NO: 1498211 - RNA, 18 nt, Human
acaggcaaugcuggcugu

SEQ ID NO: 1498212 - RNA, 23 nt, Human
acaggcacccaccaucaugucug

SEQ ID NO: 1498213 - RNA, 19 nt, Human
acagugauuaccagggacu

SEQ ID NO: 1498214 - RNA, 20 nt, Human
acagugauuaccagggacug

SEQ ID NO: 1498215 - RNA, 24 nt, Human
acaggaugguucccuugaugaaga

SEQ ID NO: 1498216 - RNA, 22 nt, Human
acaggaugguucccuugaugaa

SEQ ID NO: 1498217 - RNA, 14 nt, Human
acaggauuauugga

SEQ ID NO: 1498218 - RNA, 15 nt, Human
acaggcaaugcuggc

SEQ ID NO: 1498219 - RNA, 16 nt, Human
acaggcaaugcuggcu

SEQ ID NO: 1498220 - RNA, 17 nt, Human
acaggcaaugcuggcug

SEQ ID NO: 1498221 - RNA, 19 nt, Human
acagcucuucuccaggcug

SEQ ID NO: 1498222 - RNA, 20 nt, Human
acagcucuucuccaggcugu

SEQ ID NO: 1498223 - RNA, 15 nt, Human
acauuugcucaugga

SEQ ID NO: 1498224 - RNA, 16 nt, Human
acauuugcucauggaa

SEQ ID NO: 1498225 - RNA, 16 nt, Human
acauuuguauaaaaua

SEQ ID NO: 1498226 - RNA, 19 nt, Human
acauuuguauaaaauaauu

SEQ ID NO: 1498227 - RNA, 21 nt, Human
acauuuguauaaaauaauuuu

SEQ ID NO: 1498228 - RNA, 14 nt, Human
accaacgucugugc

SEQ ID NO: 1498229 - RNA, 17 nt, Human
accaacgucugugccau

SEQ ID NO: 1498230 - RNA, 21 nt, Human
accaacgucugugccauuuug

SEQ ID NO: 1498231 - RNA, 14 nt, Human
accacguuucuaaa

SEQ ID NO: 1498232 - RNA, 13 nt, Human
accacguuucuaa

SEQ ID NO: 1498233 - RNA, 19 nt, Human
accacgggcccggguuggg

SEQ ID NO: 1498234 - RNA, 18 nt, Human
accacgcuggaccuugaa

SEQ ID NO: 1498235 - RNA, 16 nt, Human
accacgcuggaccuug

SEQ ID NO: 1498236 - RNA, 19 nt, Human
accagagcugccaccugcc

SEQ ID NO: 1498237 - RNA, 13 nt, Human
accagagcugcca

SEQ ID NO: 1498238 - RNA, 14 nt, Human
accagagcugccac

SEQ ID NO: 1498239 - RNA, 16 nt, Human
accagagcugccaccu

SEQ ID NO: 1498240 - RNA, 20 nt, Human
acaucccuuaccugggaaag

SEQ ID NO: 1498241 - RNA, 13 nt, Human
acaugcacgugug

SEQ ID NO: 1498242 - RNA, 21 nt, Human
acauaaguaauucaagaaaac

SEQ ID NO: 1498243 - RNA, 15 nt, Human
acauaagauaaaugu

SEQ ID NO: 1498244 - RNA, 16 nt, Human
acauacaauuccaaac

SEQ ID NO: 1498245 - RNA, 21 nt, Human
acauaaugcgugcauaccacu

SEQ ID NO: 1498246 - RNA, 20 nt, Human
acauacaggaagguagaaau

SEQ ID NO: 1498247 - RNA, 19 nt, Human
acauguuuuucuucucccu

SEQ ID NO: 1498248 - RNA, 12 nt, Human
aauuaugaaacu

SEQ ID NO: 1498249 - RNA, 13 nt, Human
aauuaugaaacuu

SEQ ID NO: 1498250 - RNA, 15 nt, Human
aauuaugaaacuuuu

SEQ ID NO: 1498251 - RNA, 18 nt, Human
aauuaugaaacuuuugga

SEQ ID NO: 1498252 - RNA, 19 nt, Human
aauuaugaguuauuuuuau

SEQ ID NO: 1498253 - RNA, 15 nt, Human
aauuauauaaguauu

SEQ ID NO: 1498254 - RNA, 16 nt, Human
aauuauauaaguauuc

SEQ ID NO: 1498255 - RNA, 17 nt, Human
aauuauauaaguauucu

SEQ ID NO: 1498256 - RNA, 14 nt, Human
aauucuacuuugag

SEQ ID NO: 1498257 - RNA, 14 nt, Human
aauucuaacuuuuu

SEQ ID NO: 1498258 - RNA, 19 nt, Human
aauucucagaaucucaaau

SEQ ID NO: 1498259 - RNA, 17 nt, Human
aauucucuaguuugauu

SEQ ID NO: 1498260 - RNA, 15 nt, Human
aauucucuaguuuga

SEQ ID NO: 1498261 - RNA, 15 nt, Human
aauucucuuauccaa

SEQ ID NO: 1498262 - RNA, 21 nt, Human
aauucucauuugucacacacu

SEQ ID NO: 1498263 - RNA, 22 nt, Human
aauuguaaggaaugauuaauua

SEQ ID NO: 1498264 - RNA, 14 nt, Human
aauucuguuuuucu

SEQ ID NO: 1498265 - RNA, 18 nt, Human
aauucuguuuuucuaggc

SEQ ID NO: 1498266 - RNA, 13 nt, Human
aauucuuaaauau

SEQ ID NO: 1498267 - RNA, 17 nt, Human
aauuuccugggagcuuu

SEQ ID NO: 1498268 - RNA, 12 nt, Human
aauuuccuggga

SEQ ID NO: 1498269 - RNA, 15 nt, Human
aauuuccugggagcu

SEQ ID NO: 1498270 - RNA, 11 nt, Human
aauuguaauag

SEQ ID NO: 1498271 - RNA, 15 nt, Human
aauuucccaaagcag

SEQ ID NO: 1498272 - RNA, 17 nt, Human
aauuucccaaagcagug

SEQ ID NO: 1498273 - RNA, 16 nt, Human
aauuucauaugcugua

SEQ ID NO: 1498274 - RNA, 18 nt, Human
aauuucauaugcuguaua

SEQ ID NO: 1498275 - RNA, 19 nt, Human
acacagcucuucuccaggc

SEQ ID NO: 1498276 - RNA, 18 nt, Human
acacagcucuucuccagg

SEQ ID NO: 1498277 - RNA, 15 nt, Human
acaccaauauucaua

SEQ ID NO: 1498278 - RNA, 18 nt, Human
acaccagagcccaccuug

SEQ ID NO: 1498279 - RNA, 23 nt, Human
acaccagagcccaccuuggcuca

SEQ ID NO: 1498280 - RNA, 14 nt, Human
acacagcucuucuc

SEQ ID NO: 1498281 - RNA, 16 nt, Human
acacagcucuucucca

SEQ ID NO: 1498282 - RNA, 19 nt, Human
acaaacaugugguuaaugc

SEQ ID NO: 1498283 - RNA, 22 nt, Human
acaacauguauaauauuuuuaa

SEQ ID NO: 1498284 - RNA, 16 nt, Human
acaaggcaaggcuguc

SEQ ID NO: 1498285 - RNA, 17 nt, Human
acaaggcaaggcuguca

SEQ ID NO: 1498286 - RNA, 19 nt, Human
acaaggcaaggcugucaau

SEQ ID NO: 1498287 - RNA, 20 nt, Human
acaaggcaaggcugucaauu

SEQ ID NO: 1498288 - RNA, 15 nt, Human
acaaguuaaauaaau

SEQ ID NO: 1498289 - RNA, 14 nt, Human
aggagugagcacua

SEQ ID NO: 1498290 - RNA, 15 nt, Human
aggaggucucuaaga

SEQ ID NO: 1498291 - RNA, 12 nt, Human
aggagugagcac

SEQ ID NO: 1498292 - RNA, 14 nt, Human
aggagggcagcaga

SEQ ID NO: 1498293 - RNA, 14 nt, Human
aggaggucucuaag

SEQ ID NO: 1498294 - RNA, 14 nt, Human
aggagacccacagg

SEQ ID NO: 1498295 - RNA, 13 nt, Human
aggaaguagagga

SEQ ID NO: 1498296 - RNA, 19 nt, Human
aggaaguacuggagaaaau

SEQ ID NO: 1498297 - RNA, 22 nt, Human
aggauguucuagcauggcugcc

SEQ ID NO: 1498298 - RNA, 12 nt, Human
aggcauguucuc

SEQ ID NO: 1498299 - RNA, 23 nt, Human
aggcaugugaugagaggaaauca

SEQ ID NO: 1498300 - RNA, 24 nt, Human
aggcaugugaugagaggaaaucac

SEQ ID NO: 1498301 - RNA, 18 nt, Human
aggcagccaggccacaag

SEQ ID NO: 1498302 - RNA, 21 nt, Human
aggcauuccccaggaggccag

SEQ ID NO: 1498303 - RNA, 20 nt, Human
aggcauguucucugaggaca

SEQ ID NO: 1498304 - RNA, 22 nt, Human
aggcauguucucugaggacacu

SEQ ID NO: 1498305 - RNA, 17 nt, Human
aggcauuccccaggagg

SEQ ID NO: 1498306 - RNA, 22 nt, Human
aggcauuccccaggaggccagc

SEQ ID NO: 1498307 - RNA, 23 nt, Human
aggcauuccccaggaggccagcc

SEQ ID NO: 1498308 - RNA, 23 nt, Human
aggccagcugcuugggcuucauc

SEQ ID NO: 1498309 - RNA, 14 nt, Human
aggccaugggccuc

SEQ ID NO: 1498310 - RNA, 16 nt, Human
aggccaugggccuccu

SEQ ID NO: 1498311 - RNA, 17 nt, Human
aggccaugggccuccug

SEQ ID NO: 1498312 - RNA, 17 nt, Human
aggcccucugcccacuc

SEQ ID NO: 1498313 - RNA, 13 nt, Human
aggccagcugcuu

SEQ ID NO: 1498314 - RNA, 14 nt, Human
aggccagcugcuug

SEQ ID NO: 1498315 - RNA, 16 nt, Human
aggccagcugcuuggg

SEQ ID NO: 1498316 - RNA, 17 nt, Human
aggccaggcccucugcc

SEQ ID NO: 1498317 - RNA, 18 nt, Human
aggccaggcccucugccc

SEQ ID NO: 1498318 - RNA, 19 nt, Human
aggccaggcccucugccca

SEQ ID NO: 1498319 - RNA, 23 nt, Human
aggccaggcccucugcccacucc

SEQ ID NO: 1498320 - RNA, 20 nt, Human
aggcagagguugcagugagc

SEQ ID NO: 1498321 - RNA, 13 nt, Human
aggcagauacagg

SEQ ID NO: 1498322 - RNA, 14 nt, Human
aggcagccaggcca

SEQ ID NO: 1498323 - RNA, 15 nt, Human
aggcagccaggccac

SEQ ID NO: 1498324 - RNA, 16 nt, Human
aggcagccaggccaca

SEQ ID NO: 1498325 - RNA, 19 nt, Human
agggcguggaaaggggcag

SEQ ID NO: 1498326 - RNA, 18 nt, Human
agggccuggcucaggugg

SEQ ID NO: 1498327 - RNA, 13 nt, Human
agggccuggcuca

SEQ ID NO: 1498328 - RNA, 14 nt, Human
agggccuggcucag

SEQ ID NO: 1498329 - RNA, 21 nt, Human
agggacaggaccccagcucug

SEQ ID NO: 1498330 - RNA, 17 nt, Human
agggacaggauaagagg

SEQ ID NO: 1498331 - RNA, 24 nt, Human
aggcuguaucccaugagccucagc

SEQ ID NO: 1498332 - RNA, 19 nt, Human
aggcugucaauuacaggaa

SEQ ID NO: 1498333 - RNA, 12 nt, Human
aggcugucaauu

SEQ ID NO: 1498334 - RNA, 17 nt, Human
aggcugcagugagccga

SEQ ID NO: 1498335 - RNA, 19 nt, Human
aggcugcagugagccgaga

SEQ ID NO: 1498336 - RNA, 21 nt, Human
aggcccucugcccacucccug

SEQ ID NO: 1498337 - RNA, 19 nt, Human
aggcccucugcccacuccc

SEQ ID NO: 1498338 - RNA, 20 nt, Human
aggcccucugcccacucccu

SEQ ID NO: 1498339 - RNA, 17 nt, Human
agcuguaugauucccag

SEQ ID NO: 1498340 - RNA, 18 nt, Human
agcuguaugauucccagc

SEQ ID NO: 1498341 - RNA, 18 nt, Human
aggaaaaaauaacaauga

SEQ ID NO: 1498342 - RNA, 19 nt, Human
agcuuuuuucucugauaca

SEQ ID NO: 1498343 - RNA, 20 nt, Human
agcuuuuuucucugauacag

SEQ ID NO: 1498344 - RNA, 22 nt, Human
agcuuuuuucucugauacagaa

SEQ ID NO: 1498345 - RNA, 23 nt, Human
agcuuuuuucucugauacagaaa

SEQ ID NO: 1498346 - RNA, 21 nt, Human
agcuuuguuuguugucagcug

SEQ ID NO: 1498347 - RNA, 22 nt, Human
agcuuuguuuguugucagcuga

SEQ ID NO: 1498348 - RNA, 15 nt, Human
aggaacacuccuuca

SEQ ID NO: 1498349 - RNA, 12 nt, Human
aggaacacuccu

SEQ ID NO: 1498350 - RNA, 12 nt, Human
aggaagaacggg

SEQ ID NO: 1498351 - RNA, 18 nt, Human
aggaagaacggggcucuu

SEQ ID NO: 1498352 - RNA, 22 nt, Human
aggaagaacggggcucuucuca

SEQ ID NO: 1498353 - RNA, 14 nt, Human
aggaagguagaaau

SEQ ID NO: 1498354 - RNA, 11 nt, Human
aggaaguacug

SEQ ID NO: 1498355 - RNA, 15 nt, Human
aggaaguacuggaga

SEQ ID NO: 1498356 - RNA, 16 nt, Human
agcugguugagguuuc

SEQ ID NO: 1498357 - RNA, 21 nt, Human
agcuggugguaucugaguuga

SEQ ID NO: 1498358 - RNA, 16 nt, Human
agcuggucccacucag

SEQ ID NO: 1498359 - RNA, 15 nt, Human
agcuggucccacuca

SEQ ID NO: 1498360 - RNA, 14 nt, Human
agcugcugaaacaa

SEQ ID NO: 1498361 - RNA, 15 nt, Human
agcugcugaaacaac

SEQ ID NO: 1498362 - RNA, 16 nt, Human
agcugcugaaacaaca

SEQ ID NO: 1498363 - RNA, 20 nt, Human
agcugcugaaacaacaaaua

SEQ ID NO: 1498364 - RNA, 15 nt, Human
agcugacuuuucugu

SEQ ID NO: 1498365 - RNA, 21 nt, Human
agcugacuuuucuguccgagc

SEQ ID NO: 1498366 - RNA, 22 nt, Human
agcucaccagccccagugccca

SEQ ID NO: 1498367 - RNA, 23 nt, Human
agcucaccagccccagugcccac

SEQ ID NO: 1498368 - RNA, 19 nt, Human
agcuaacauggaaguacua

SEQ ID NO: 1498369 - RNA, 20 nt, Human
agcuaacauggaaguacuau

SEQ ID NO: 1498370 - RNA, 13 nt, Human
agcgacagugaga

SEQ ID NO: 1498371 - RNA, 15 nt, Human
agcgacagugagacu

SEQ ID NO: 1498372 - RNA, 17 nt, Human
agcgacagugagacucu

SEQ ID NO: 1498373 - RNA, 15 nt, Human
agcgauucuucugcu

SEQ ID NO: 1498374 - RNA, 17 nt, Human
agcgauucuucugcuuc

SEQ ID NO: 1498375 - RNA, 19 nt, Human
agcgauucuucugcuucag

SEQ ID NO: 1498376 - RNA, 13 nt, Human
agcuacaaaugca

SEQ ID NO: 1498377 - RNA, 13 nt, Human
agcucaccagccc

SEQ ID NO: 1498378 - RNA, 14 nt, Human
agcucaccagcccc

SEQ ID NO: 1498379 - RNA, 15 nt, Human
agcucaccagcccca

SEQ ID NO: 1498380 - RNA, 21 nt, Human
agcucaccagccccagugccc

SEQ ID NO: 1498381 - RNA, 13 nt, Human
agcuaaugggaca

SEQ ID NO: 1498382 - RNA, 14 nt, Human
agcuaaugggacac

SEQ ID NO: 1498383 - RNA, 15 nt, Human
agcuaaugggacacu

SEQ ID NO: 1498384 - RNA, 14 nt, Human
agccuggacccugu

SEQ ID NO: 1498385 - RNA, 18 nt, Human
agccugggcaaugugaua

SEQ ID NO: 1498386 - RNA, 14 nt, Human
agauaugauucaaa

SEQ ID NO: 1498387 - RNA, 15 nt, Human
agauaugauucaaau

SEQ ID NO: 1498388 - RNA, 16 nt, Human
agauaugauucaaaug

SEQ ID NO: 1498389 - RNA, 20 nt, Human
agauagauaggucagugcaa

SEQ ID NO: 1498390 - RNA, 20 nt, Human
agauagccaaggccaaagga

SEQ ID NO: 1498391 - RNA, 14 nt, Human
agaguugaagacag

SEQ ID NO: 1498392 - RNA, 15 nt, Human
agaguugaagacaga

SEQ ID NO: 1498393 - RNA, 13 nt, Human
agaguugaagaca

SEQ ID NO: 1498394 - RNA, 20 nt, Human
agagggucugaggaauccag

SEQ ID NO: 1498395 - RNA, 19 nt, Human
agaggguggugaccucugc

SEQ ID NO: 1498396 - RNA, 16 nt, Human
agauugcaacaggcug

SEQ ID NO: 1498397 - RNA, 18 nt, Human
agauucuuuccugaggcu

SEQ ID NO: 1498398 - RNA, 15 nt, Human
agauucuuuccugag

SEQ ID NO: 1498399 - RNA, 16 nt, Human
agauucuuuccugagg

SEQ ID NO: 1498400 - RNA, 13 nt, Human
agcaaaauugaug

SEQ ID NO: 1498401 - RNA, 19 nt, Human
agcaaaauugauguguuua

SEQ ID NO: 1498402 - RNA, 16 nt, Human
agauugcaccacugca

SEQ ID NO: 1498403 - RNA, 17 nt, Human
agauugcaacaggcugg

SEQ ID NO: 1498404 - RNA, 19 nt, Human
agauugcaacaggcugggc

SEQ ID NO: 1498405 - RNA, 23 nt, Human
agcaaaauuuuuucucuaggaaa

SEQ ID NO: 1498406 - RNA, 23 nt, Human
agcaaaauugauguguuuauuua

SEQ ID NO: 1498407 - RNA, 19 nt, Human
agcaaauucuguuuuucua

SEQ ID NO: 1498408 - RNA, 18 nt, Human
agaugacaucugucuagg

SEQ ID NO: 1498409 - RNA, 22 nt, Human
agaugggugcuuggaggaagga

SEQ ID NO: 1498410 - RNA, 20 nt, Human
agaugggugcuuggaggaag

SEQ ID NO: 1498411 - RNA, 14 nt, Human
agauucuuuccuga

SEQ ID NO: 1498412 - RNA, 14 nt, Human
agccagauuucacu

SEQ ID NO: 1498413 - RNA, 17 nt, Human
agccagauuucacucuc

SEQ ID NO: 1498414 - RNA, 20 nt, Human
agccagauuucacucuccuu

SEQ ID NO: 1498415 - RNA, 22 nt, Human
agccagauuucacucuccuugg

SEQ ID NO: 1498416 - RNA, 22 nt, Human
agccagcaggcucucaggccag

SEQ ID NO: 1498417 - RNA, 21 nt, Human
agccagcaggcucucaggcca

SEQ ID NO: 1498418 - RNA, 23 nt, Human
agccagcaggcucucaggccagc

SEQ ID NO: 1498419 - RNA, 23 nt, Human
agcccaccccucaacaccucugc

SEQ ID NO: 1498420 - RNA, 13 nt, Human
agcccaaagaagg

SEQ ID NO: 1498421 - RNA, 14 nt, Human
agcccaaagaagga

SEQ ID NO: 1498422 - RNA, 13 nt, Human
agcccaccuuggc

SEQ ID NO: 1498423 - RNA, 17 nt, Human
agcccacgcccccacug

SEQ ID NO: 1498424 - RNA, 18 nt, Human
agcccacgcccccacugg

SEQ ID NO: 1498425 - RNA, 19 nt, Human
agcccacgcccccacuggu

SEQ ID NO: 1498426 - RNA, 14 nt, Human
agcccaccuuggcu

SEQ ID NO: 1498427 - RNA, 20 nt, Human
agcccacgcccccacuggug

SEQ ID NO: 1498428 - RNA, 13 nt, Human
agcaucuaucaga

SEQ ID NO: 1498429 - RNA, 16 nt, Human
agcaucuaugugagac

SEQ ID NO: 1498430 - RNA, 21 nt, Human
agcacagacccugcccugugg

SEQ ID NO: 1498431 - RNA, 17 nt, Human
agcagugcaugcugucc

SEQ ID NO: 1498432 - RNA, 18 nt, Human
agcagugcaugcuguccc

SEQ ID NO: 1498433 - RNA, 21 nt, Human
agcacugaggaagaacggggc

SEQ ID NO: 1498434 - RNA, 16 nt, Human
agcagccuggacccug

SEQ ID NO: 1498435 - RNA, 19 nt, Human
agcacugacuucuaaguaa

SEQ ID NO: 1498436 - RNA, 10 nt, Human
agcacugagg

SEQ ID NO: 1498437 - RNA, 11 nt, Human
agcacugagga

SEQ ID NO: 1498438 - RNA, 14 nt, Human
agcacugaggaaga

SEQ ID NO: 1498439 - RNA, 17 nt, Human
agcacugacuucuaagu

SEQ ID NO: 1498440 - RNA, 20 nt, Human
agcagccuggacccugugga

SEQ ID NO: 1498441 - RNA, 19 nt, Human
agcagcguuucuaugacac

SEQ ID NO: 1498442 - RNA, 13 nt, Human
agcagugcaugcu

SEQ ID NO: 1498443 - RNA, 16 nt, Human
agcagugcaugcuguc

SEQ ID NO: 1498444 - RNA, 17 nt, Human
agacccaaaaggcagaa

SEQ ID NO: 1498445 - RNA, 15 nt, Human
agaccacguuucuaa

SEQ ID NO: 1498446 - RNA, 14 nt, Human
agaccacguuucua

SEQ ID NO: 1498447 - RNA, 23 nt, Human
agaccaucccugaaggccccgcc

SEQ ID NO: 1498448 - RNA, 14 nt, Human
agacaauuuauuau

SEQ ID NO: 1498449 - RNA, 22 nt, Human
agacagcccgggcucugccucc

SEQ ID NO: 1498450 - RNA, 23 nt, Human
agacagcccgggcucugccuccc

SEQ ID NO: 1498451 - RNA, 20 nt, Human
agacgcugugcugcccugcc

SEQ ID NO: 1498452 - RNA, 17 nt, Human
agacgcugugcugcccu

SEQ ID NO: 1498453 - RNA, 18 nt, Human
agacgcugugcugcccug

SEQ ID NO: 1498454 - RNA, 19 nt, Human
agacgcugugcugcccugc

SEQ ID NO: 1498455 - RNA, 15 nt, Human
agacuaucuaaaugu

SEQ ID NO: 1498456 - RNA, 17 nt, Human
agacuauauuguacaca

SEQ ID NO: 1498457 - RNA, 19 nt, Human
agacaaggaaaaaauaaca

SEQ ID NO: 1498458 - RNA, 20 nt, Human
agacaaugugaaaagaaaaa

SEQ ID NO: 1498459 - RNA, 18 nt, Human
agagcccacgcccccacu

SEQ ID NO: 1498460 - RNA, 11 nt, Human
agagagcaaga

SEQ ID NO: 1498461 - RNA, 19 nt, Human
agagagcaagacgcugugc

SEQ ID NO: 1498462 - RNA, 23 nt, Human
agagagcaagacgcugugcugcc

SEQ ID NO: 1498463 - RNA, 16 nt, Human
agacucuuuggacacu

SEQ ID NO: 1498464 - RNA, 21 nt, Human
agaagacugcauuauauuuau

SEQ ID NO: 1498465 - RNA, 21 nt, Human
agaaccaaaaagaggcuaugu

SEQ ID NO: 1498466 - RNA, 20 nt, Human
agaagagcuguucacagcca

SEQ ID NO: 1498467 - RNA, 21 nt, Human
agaagagcuguucacagccag

SEQ ID NO: 1498468 - RNA, 15 nt, Human
agaagagaaugcaca

SEQ ID NO: 1498469 - RNA, 23 nt, Human
agaagagaaugcacaaacagagg

SEQ ID NO: 1498470 - RNA, 13 nt, Human
agaagagcuguuc

SEQ ID NO: 1498471 - RNA, 17 nt, Human
agaagucuuagauguau

SEQ ID NO: 1498472 - RNA, 19 nt, Human
agaagucuuagauguauau

SEQ ID NO: 1498473 - RNA, 14 nt, Human
agaagucacacagu

SEQ ID NO: 1498474 - RNA, 16 nt, Human
agaaugaaagggccca

SEQ ID NO: 1498475 - RNA, 17 nt, Human
agaaucucaaauaacua

SEQ ID NO: 1498476 - RNA, 18 nt, Human
agaaugcucuuuacuuca

SEQ ID NO: 1498477 - RNA, 23 nt, Human
agaaugcacaaacagaggccgcc

SEQ ID NO: 1498478 - RNA, 17 nt, Human
agaaccaaaaagaggcu

SEQ ID NO: 1498479 - RNA, 18 nt, Human
agaaccaaaaagaggcua

SEQ ID NO: 1498480 - RNA, 22 nt, Human
agaacagugauuaccagggacu

SEQ ID NO: 1498481 - RNA, 19 nt, Human
agaacagauaaucagugug

SEQ ID NO: 1498482 - RNA, 16 nt, Human
agaacacaaggucauu

SEQ ID NO: 1498483 - RNA, 12 nt, Human
auccuugaagau

SEQ ID NO: 1498484 - RNA, 21 nt, Human
auccacugugccaugugccag

SEQ ID NO: 1498485 - RNA, 19 nt, Human
aucauggagguuugaagau

SEQ ID NO: 1498486 - RNA, 15 nt, Human
aucauccuaagcuau

SEQ ID NO: 1498487 - RNA, 20 nt, Human
aucaugacaaagacugagua

SEQ ID NO: 1498488 - RNA, 21 nt, Human
aucaugaauuaguuuuauaug

SEQ ID NO: 1498489 - RNA, 19 nt, Human
auauuuuuuucugaaauuu

SEQ ID NO: 1498490 - RNA, 14 nt, Human
aucaaaagaaagaa

SEQ ID NO: 1498491 - RNA, 14 nt, Human
auauuuuuuucuga

SEQ ID NO: 1498492 - RNA, 16 nt, Human
auauuuuuuucugaaa

SEQ ID NO: 1498493 - RNA, 18 nt, Human
auauuuuuuucugaaauu

SEQ ID NO: 1498494 - RNA, 18 nt, Human
auauuuuuuucuuuucuu

SEQ ID NO: 1498495 - RNA, 24 nt, Human
aucaaaagguuaauaaaguaauua

SEQ ID NO: 1498496 - RNA, 20 nt, Human
aucaaaagguuaauaaagua

SEQ ID NO: 1498497 - RNA, 19 nt, Human
aucaaagagguuuuaaaaa

SEQ ID NO: 1498498 - RNA, 18 nt, Human
aucaaagagagaaaauaa

SEQ ID NO: 1498499 - RNA, 20 nt, Human
aucaaagggugaaaauuauu

SEQ ID NO: 1498500 - RNA, 15 nt, Human
auagcacagacccug

SEQ ID NO: 1498501 - RNA, 14 nt, Human
auagcacagacccu

SEQ ID NO: 1498502 - RNA, 16 nt, Human
augaaacuuuuggaag

SEQ ID NO: 1498503 - RNA, 12 nt, Human
augaaagacugu

SEQ ID NO: 1498504 - RNA, 23 nt, Human
augaagcauuuacuuuguguuca

SEQ ID NO: 1498505 - RNA, 13 nt, Human
augaaguacucau

SEQ ID NO: 1498506 - RNA, 23 nt, Human
augaaguaauaugcacacauuuu

SEQ ID NO: 1498507 - RNA, 21 nt, Human
augaaguaauaugcacacauu

SEQ ID NO: 1498508 - RNA, 14 nt, Human
augaaguaauaugc

SEQ ID NO: 1498509 - RNA, 17 nt, Human
augaccuucuaggaagc

SEQ ID NO: 1498510 - RNA, 18 nt, Human
augaccuucuaggaagcu

SEQ ID NO: 1498511 - RNA, 13 nt, Human
augaccuuucaau

SEQ ID NO: 1498512 - RNA, 15 nt, Human
augaccuuucaauag

SEQ ID NO: 1498513 - RNA, 18 nt, Human
augaccuuucaauaggaa

SEQ ID NO: 1498514 - RNA, 21 nt, Human
augagccucagcauccuggca

SEQ ID NO: 1498515 - RNA, 11 nt, Human
augagccuggc

SEQ ID NO: 1498516 - RNA, 12 nt, Human
augagccuggca

SEQ ID NO: 1498517 - RNA, 23 nt, Human
aucuaggaagacuuuggaaagag

SEQ ID NO: 1498518 - RNA, 20 nt, Human
augggacauuugcucaugga

SEQ ID NO: 1498519 - RNA, 15 nt, Human
augggacagggagga

SEQ ID NO: 1498520 - RNA, 14 nt, Human
augggaaagcauug

SEQ ID NO: 1498521 - RNA, 20 nt, Human
augggaaagcauuguaaaug

SEQ ID NO: 1498522 - RNA, 23 nt, Human
auggcuuccuggcaauagucaaa

SEQ ID NO: 1498523 - RNA, 16 nt, Human
augcuuugaucccuuc

SEQ ID NO: 1498524 - RNA, 18 nt, Human
augcucugcauguuacau

SEQ ID NO: 1498525 - RNA, 19 nt, Human
augcucugcauguuacaua

SEQ ID NO: 1498526 - RNA, 14 nt, Human
augcuucuucagag

SEQ ID NO: 1498527 - RNA, 17 nt, Human
augcuucuucagagacu

SEQ ID NO: 1498528 - RNA, 20 nt, Human
augcuucuucagagacuccu

SEQ ID NO: 1498529 - RNA, 22 nt, Human
augcuucuucagagacuccugc

SEQ ID NO: 1498530 - RNA, 17 nt, Human
augcauagguuuagcag

SEQ ID NO: 1498531 - RNA, 12 nt, Human
augccugguggc

SEQ ID NO: 1498532 - RNA, 13 nt, Human
augccugguggca

SEQ ID NO: 1498533 - RNA, 14 nt, Human
augccugguggcag

SEQ ID NO: 1498534 - RNA, 19 nt, Human
augccugguggcagcugcg

SEQ ID NO: 1498535 - RNA, 21 nt, Human
augccugguggcagcugcggu

SEQ ID NO: 1498536 - RNA, 20 nt, Human
aguacuucuccacccugcuc

SEQ ID NO: 1498537 - RNA, 21 nt, Human
aguacuucuccacccugcucu

SEQ ID NO: 1498538 - RNA, 22 nt, Human
aguacuucuccacccugcucuc

SEQ ID NO: 1498539 - RNA, 14 nt, Human
aguacguugugcau

SEQ ID NO: 1498540 - RNA, 15 nt, Human
aguacuggagaaaau

SEQ ID NO: 1498541 - RNA, 17 nt, Human
aguaacuuacuuaggug

SEQ ID NO: 1498542 - RNA, 20 nt, Human
aguaaaugggggugcauuug

SEQ ID NO: 1498543 - RNA, 19 nt, Human
aguaaaugggggugcauuu

SEQ ID NO: 1498544 - RNA, 21 nt, Human
aguaaaugggggugcauuuga

SEQ ID NO: 1498545 - RNA, 16 nt, Human
agugacagaggcagcc

SEQ ID NO: 1498546 - RNA, 19 nt, Human
agugacagaggcagcccca

SEQ ID NO: 1498547 - RNA, 14 nt, Human
agugacagaggcag

SEQ ID NO: 1498548 - RNA, 13 nt, Human
agugaaugaaaca

SEQ ID NO: 1498549 - RNA, 15 nt, Human
agugauuaccaggga

SEQ ID NO: 1498550 - RNA, 20 nt, Human
agugauucuccugccucagc

SEQ ID NO: 1498551 - RNA, 18 nt, Human
agugauucuccugccuca

SEQ ID NO: 1498552 - RNA, 19 nt, Human
agugauucuccugccucag

SEQ ID NO: 1498553 - RNA, 19 nt, Human
agugccuuauggaacacuc

SEQ ID NO: 1498554 - RNA, 20 nt, Human
agugccuuauggaacacucu

SEQ ID NO: 1498555 - RNA, 21 nt, Human
agugccuuauggaacacucug

SEQ ID NO: 1498556 - RNA, 22 nt, Human
agugccuuauggaacacucuga

SEQ ID NO: 1498557 - RNA, 13 nt, Human
agugauuaccagg

SEQ ID NO: 1498558 - RNA, 23 nt, Human
agugauccucccaccucagccuc

SEQ ID NO: 1498559 - RNA, 19 nt, Human
agugaugucacuagggcag

SEQ ID NO: 1498560 - RNA, 20 nt, Human
agugauccucccaccucagc

SEQ ID NO: 1498561 - RNA, 22 nt, Human
agugauccucccaccucagccu

SEQ ID NO: 1498562 - RNA, 18 nt, Human
agucuggcccuuccuuuu

SEQ ID NO: 1498563 - RNA, 21 nt, Human
agucugauucccaagcucugc

SEQ ID NO: 1498564 - RNA, 22 nt, Human
agucugauucccaagcucugcu

SEQ ID NO: 1498565 - RNA, 19 nt, Human
aguccuuaccagcagagca

SEQ ID NO: 1498566 - RNA, 16 nt, Human
agucgaggacagggag

SEQ ID NO: 1498567 - RNA, 14 nt, Human
aguccucuuuucug

SEQ ID NO: 1498568 - RNA, 16 nt, Human
aguccuuaccagcaga

SEQ ID NO: 1498569 - RNA, 18 nt, Human
aguccuuaccagcagagc

SEQ ID NO: 1498570 - RNA, 13 nt, Human
agucauuuaauaa

SEQ ID NO: 1498571 - RNA, 20 nt, Human
auaaaaagacauucuuccaa

SEQ ID NO: 1498572 - RNA, 14 nt, Human
auaaaaacaacuuu

SEQ ID NO: 1498573 - RNA, 15 nt, Human
auaaaagacagugaa

SEQ ID NO: 1498574 - RNA, 16 nt, Human
auaaaagacagugaaa

SEQ ID NO: 1498575 - RNA, 23 nt, Human
auaaaaauauuguguugugaaug

SEQ ID NO: 1498576 - RNA, 14 nt, Human
aguuugauuaaauu

SEQ ID NO: 1498577 - RNA, 16 nt, Human
aguuugauuaaauucu

SEQ ID NO: 1498578 - RNA, 11 nt, Human
aguuugcaguu

SEQ ID NO: 1498579 - RNA, 18 nt, Human
aguuccaccaucaagcca

SEQ ID NO: 1498580 - RNA, 21 nt, Human
aguuccaccaucaagccacca

SEQ ID NO: 1498581 - RNA, 14 nt, Human
aguucauacccugu

SEQ ID NO: 1498582 - RNA, 18 nt, Human
aguuacacuaaaagguga

SEQ ID NO: 1498583 - RNA, 17 nt, Human
aguugaaaaacagcuga

SEQ ID NO: 1498584 - RNA, 14 nt, Human
aguugaaaagacuc

SEQ ID NO: 1498585 - RNA, 18 nt, Human
aguugaaaaacagcugag

SEQ ID NO: 1498586 - RNA, 16 nt, Human
aguugaagacagagcu

SEQ ID NO: 1498587 - RNA, 17 nt, Human
aguugaagacagagcua

SEQ ID NO: 1498588 - RNA, 20 nt, Human
aguuguucaauaauaaauau

SEQ ID NO: 1498589 - RNA, 17 nt, Human
aguuguuagugugucuu

SEQ ID NO: 1498590 - RNA, 22 nt, Human
aguuguuagugugucuuagugu

SEQ ID NO: 1498591 - RNA, 15 nt, Human
auaaguaaaugcuag

SEQ ID NO: 1498592 - RNA, 23 nt, Human
auacaaugcugugcccuaaagug

SEQ ID NO: 1498593 - RNA, 12 nt, Human
auaauguuaaca

SEQ ID NO: 1498594 - RNA, 15 nt, Human
auacaccacuacauu

SEQ ID NO: 1498595 - RNA, 17 nt, Human
auaaguaauucaagaaa

SEQ ID NO: 1498596 - RNA, 21 nt, Human
auaaagaugagugagcaugcc

SEQ ID NO: 1498597 - RNA, 15 nt, Human
auacuguugugcgca

SEQ ID NO: 1498598 - RNA, 18 nt, Human
auacaccacuacauucug

SEQ ID NO: 1498599 - RNA, 17 nt, Human
auacaccacuacauucu

SEQ ID NO: 1498600 - RNA, 15 nt, Human
auuuaccacuugugu

SEQ ID NO: 1498601 - RNA, 22 nt, Human
auuuaccacuuguguuuugcaa

SEQ ID NO: 1498602 - RNA, 16 nt, Human
auuuaaauagcuuuuu

SEQ ID NO: 1498603 - RNA, 16 nt, Human
auuguaguccuguaau

SEQ ID NO: 1498604 - RNA, 17 nt, Human
auuguagcauccuggaa

SEQ ID NO: 1498605 - RNA, 20 nt, Human
auuguagcauccuggaauau

SEQ ID NO: 1498606 - RNA, 17 nt, Human
auuguuuucaguguaca

SEQ ID NO: 1498607 - RNA, 14 nt, Human
auuuaaaaaaaauc

SEQ ID NO: 1498608 - RNA, 17 nt, Human
auuuaaaaaaaaaccug

SEQ ID NO: 1498609 - RNA, 18 nt, Human
auuguuuucaguguacau

SEQ ID NO: 1498610 - RNA, 19 nt, Human
auuguuuucaguguacaug

SEQ ID NO: 1498611 - RNA, 19 nt, Human
auuuacuucuuauacauuu

SEQ ID NO: 1498612 - RNA, 20 nt, Human
auuuacuucuuauacauuug

SEQ ID NO: 1498613 - RNA, 19 nt, Human
auuuauuacuguaagaaaa

SEQ ID NO: 1498614 - RNA, 20 nt, Human
auuuauuacuguaagaaaau

SEQ ID NO: 1498615 - RNA, 21 nt, Human
auuuauuuuaauaauguuuca

SEQ ID NO: 1498616 - RNA, 20 nt, Human
auuucaucugcucuccuucc

SEQ ID NO: 1498617 - RNA, 21 nt, Human
auuucaucugcucuccuuccu

SEQ ID NO: 1498618 - RNA, 18 nt, Human
auuucaucugcucuccuu

SEQ ID NO: 1498619 - RNA, 19 nt, Human
auuucaucugcucuccuuc

SEQ ID NO: 1498620 - RNA, 14 nt, Human
auuucccaaagcag

SEQ ID NO: 1498621 - RNA, 16 nt, Human
auuucccaaagcagug

SEQ ID NO: 1498622 - RNA, 12 nt, Human
auuugguuuuca

SEQ ID NO: 1498623 - RNA, 14 nt, Human
auuugguuuucaca

SEQ ID NO: 1498624 - RNA, 21 nt, Human
auuuggugguuucagaaaugu

SEQ ID NO: 1498625 - RNA, 18 nt, Human
auuugauaugugaacagu

SEQ ID NO: 1498626 - RNA, 20 nt, Human
auuugauaguauugugcaua

SEQ ID NO: 1498627 - RNA, 19 nt, Human
auuugauaugugaacaguu

SEQ ID NO: 1498628 - RNA, 22 nt, Human
auuugaggucuguucuuuccaa

SEQ ID NO: 1498629 - RNA, 21 nt, Human
auuugaggucuguucuuucca

SEQ ID NO: 1498630 - RNA, 19 nt, Human
auuugaauguuaagcagau

SEQ ID NO: 1498631 - RNA, 18 nt, Human
auuugaggucuguucuuu

SEQ ID NO: 1498632 - RNA, 17 nt, Human
auuugaggucuguucuu

SEQ ID NO: 1498633 - RNA, 15 nt, Human
auuugagcagggcuc

SEQ ID NO: 1498634 - RNA, 16 nt, Human
auuugagcagggcuca

SEQ ID NO: 1498635 - RNA, 13 nt, Human
auuugaauguuaa

SEQ ID NO: 1498636 - RNA, 18 nt, Human
auuugaauguuaagcaga

SEQ ID NO: 1498637 - RNA, 16 nt, Human
auuucuuccacaagag

SEQ ID NO: 1498638 - RNA, 14 nt, Human
auuggaaacaaguc

SEQ ID NO: 1498639 - RNA, 13 nt, Human
auuggaaacaagu

SEQ ID NO: 1498640 - RNA, 16 nt, Human
auugcauauauacaua

SEQ ID NO: 1498641 - RNA, 16 nt, Human
auuggagcucguggaa

SEQ ID NO: 1498642 - RNA, 17 nt, Human
auuggagcucgugggac

SEQ ID NO: 1498643 - RNA, 22 nt, Human
auuggcuagagguucaaagaua

SEQ ID NO: 1498644 - RNA, 20 nt, Human
auuggcuagagguucaaaga

SEQ ID NO: 1498645 - RNA, 19 nt, Human
auuggcuagagguucaaag

SEQ ID NO: 1498646 - RNA, 13 nt, Human
auuggcucacacu

SEQ ID NO: 1498647 - RNA, 15 nt, Human
auuggcucacacuga

SEQ ID NO: 1498648 - RNA, 16 nt, Human
auuggcucacacugag

SEQ ID NO: 1498649 - RNA, 23 nt, Human
auuggcuagagguucaaagauau

SEQ ID NO: 1498650 - RNA, 12 nt, Human
auugauguguuu

SEQ ID NO: 1498651 - RNA, 19 nt, Human
auugauguguuuauuuaua

SEQ ID NO: 1498652 - RNA, 17 nt, Human
auugcaacaggcugggc

SEQ ID NO: 1498653 - RNA, 18 nt, Human
auugcaacaggcugggcu

SEQ ID NO: 1498654 - RNA, 19 nt, Human
auugcaacaggcugggcuu

SEQ ID NO: 1498655 - RNA, 12 nt, Human
auugcaccacug

SEQ ID NO: 1498656 - RNA, 17 nt, Human
auuggcucacacugaga

SEQ ID NO: 1498657 - RNA, 12 nt, Human
auguguuuccau

SEQ ID NO: 1498658 - RNA, 21 nt, Human
augugcuaguaauuggaaagg

SEQ ID NO: 1498659 - RNA, 21 nt, Human
augugccagguuuuuggucug

SEQ ID NO: 1498660 - RNA, 21 nt, Human
uuuuaaaaaacugcugacugu

SEQ ID NO: 1498661 - RNA, 18 nt, Human
uuuuaaaaaacugcugac

SEQ ID NO: 1498662 - RNA, 20 nt, Human
auguuacauaagauaaaugu

SEQ ID NO: 1498663 - RNA, 12 nt, Human
auguuaagcaga

SEQ ID NO: 1498664 - RNA, 13 nt, Human
auguuaagcagau

SEQ ID NO: 1498665 - RNA, 19 nt, Human
auguuacauaagauaaaug

SEQ ID NO: 1498666 - RNA, 12 nt, Human
auguugaaagau

SEQ ID NO: 1498667 - RNA, 18 nt, Human
auguugaaagaucaaaag

SEQ ID NO: 1498668 - RNA, 13 nt, Human
auguugcccaggc

SEQ ID NO: 1498669 - RNA, 14 nt, Human
auguugcccaggca

SEQ ID NO: 1498670 - RNA, 15 nt, Human
auguugcccaggcag

SEQ ID NO: 1498671 - RNA, 16 nt, Human
auguugcccaggcagg

SEQ ID NO: 1498672 - RNA, 17 nt, Human
uuuuagaguugauacua

SEQ ID NO: 1498673 - RNA, 21 nt, Human
uuuuagacccuauugcugcuu

SEQ ID NO: 1498674 - RNA, 13 nt, Human
auguuggccaggc

SEQ ID NO: 1498675 - RNA, 16 nt, Human
uuuucuauaauuuaaa

SEQ ID NO: 1498676 - RNA, 12 nt, Human
uuuuccaggcug

SEQ ID NO: 1498677 - RNA, 13 nt, Human
uuuuccaggcugg

SEQ ID NO: 1498678 - RNA, 17 nt, Human
uuuucucugauacagaa

SEQ ID NO: 1498679 - RNA, 20 nt, Human
uuuucaggcuagauguaugu

SEQ ID NO: 1498680 - RNA, 14 nt, Human
uuuucaguguacau

SEQ ID NO: 1498681 - RNA, 18 nt, Human
uuuuccaaucauuugacu

SEQ ID NO: 1498682 - RNA, 19 nt, Human
uuuuauggcuuuugugcau

SEQ ID NO: 1498683 - RNA, 18 nt, Human
uuuuauggcuuuugugca

SEQ ID NO: 1498684 - RNA, 23 nt, Human
uuuuagaguugauacuacaguuu

SEQ ID NO: 1498685 - RNA, 15 nt, Human
uuuuaguagagacag

SEQ ID NO: 1498686 - RNA, 21 nt, Human
uuuuauggcuuuugugcauua

SEQ ID NO: 1498687 - RNA, 12 nt, Human
uuuuauuaaauu

SEQ ID NO: 1498688 - RNA, 23 nt, Human
auuaaaaaucucaaauuucuaaa

SEQ ID NO: 1498689 - RNA, 19 nt, Human
auuaaaacacaacaucuuu

SEQ ID NO: 1498690 - RNA, 13 nt, Human
uuuucuguucuuu

SEQ ID NO: 1498691 - RNA, 17 nt, Human
auguuggccaggcuggu

SEQ ID NO: 1498692 - RNA, 17 nt, Human
uuuguaguguuggagaa

SEQ ID NO: 1498693 - RNA, 16 nt, Human
uuuguaauuuuuuuau

SEQ ID NO: 1498694 - RNA, 14 nt, Human
uuuguacagacaac

SEQ ID NO: 1498695 - RNA, 15 nt, Human
augugaugagaggaa

SEQ ID NO: 1498696 - RNA, 14 nt, Human
uuuguuucugaaag

SEQ ID NO: 1498697 - RNA, 16 nt, Human
uuuguuucugaaaggg

SEQ ID NO: 1498698 - RNA, 22 nt, Human
uuugugcauuaucuagauacug

SEQ ID NO: 1498699 - RNA, 19 nt, Human
uuugugcauuaucuagaua

SEQ ID NO: 1498700 - RNA, 22 nt, Human
uuugugauacaaugcugugccc

SEQ ID NO: 1498701 - RNA, 16 nt, Human
uuugugauacaaugcu

SEQ ID NO: 1498702 - RNA, 23 nt, Human
uuugucuuaaaaaguggaaaaau

SEQ ID NO: 1498703 - RNA, 13 nt, Human
uuugucuuaaaaa

SEQ ID NO: 1498704 - RNA, 14 nt, Human
uuugucuuaaaaag

SEQ ID NO: 1498705 - RNA, 23 nt, Human
augucgucaaagcugaaauggac

SEQ ID NO: 1498706 - RNA, 14 nt, Human
augugagacugguu

SEQ ID NO: 1498707 - RNA, 13 nt, Human
augugagaccauu

SEQ ID NO: 1498708 - RNA, 12 nt, Human
auguaucaauga

SEQ ID NO: 1498709 - RNA, 19 nt, Human
auguauauuuuauaucaau

SEQ ID NO: 1498710 - RNA, 16 nt, Human
auguccaagaagccca

SEQ ID NO: 1498711 - RNA, 17 nt, Human
auguccaagaagcccag

SEQ ID NO: 1498712 - RNA, 18 nt, Human
auguccaagaagcccagg

SEQ ID NO: 1498713 - RNA, 23 nt, Human
auguauaauauuuuuaauuaaau

SEQ ID NO: 1498714 - RNA, 13 nt, Human
uuuggggaagaac

SEQ ID NO: 1498715 - RNA, 21 nt, Human
uuugggguacccacugcucug

SEQ ID NO: 1498716 - RNA, 22 nt, Human
uuugggguacccacugcucugg

SEQ ID NO: 1498717 - RNA, 12 nt, Human
uuuggcugcuga

SEQ ID NO: 1498718 - RNA, 13 nt, Human
uuuggcugcugaa

SEQ ID NO: 1498719 - RNA, 19 nt, Human
uuugcuaagcauuccaacu

SEQ ID NO: 1498720 - RNA, 20 nt, Human
uuugcuggagcucugcccau

SEQ ID NO: 1498721 - RNA, 22 nt, Human
uuugcuggggccgaaagaacag

SEQ ID NO: 1498722 - RNA, 19 nt, Human
uuugcuggggccgaaagaa

SEQ ID NO: 1498723 - RNA, 22 nt, Human
uuugcuaacuagcuuggaaacu

SEQ ID NO: 1498724 - RNA, 22 nt, Human
uuuggauuggaugaauuccaaa

SEQ ID NO: 1498725 - RNA, 18 nt, Human
uuugauucagacagcugc

SEQ ID NO: 1498726 - RNA, 13 nt, Human
uuugagacagagu

SEQ ID NO: 1498727 - RNA, 21 nt, Human
uuugacacuuauagauugaaa

SEQ ID NO: 1498728 - RNA, 14 nt, Human
uuugagaguucuaa

SEQ ID NO: 1498729 - RNA, 15 nt, Human
uuugauccaagcugg

SEQ ID NO: 1498730 - RNA, 13 nt, Human
uuugagaguucua

SEQ ID NO: 1498731 - RNA, 15 nt, Human
uuugauucagacagc

SEQ ID NO: 1498732 - RNA, 14 nt, Human
uuugacaaggggca

SEQ ID NO: 1498733 - RNA, 21 nt, Human
uuugaccucugcagcaauaaa

SEQ ID NO: 1498734 - RNA, 19 nt, Human
uuugaccucugcagcaaua

SEQ ID NO: 1498735 - RNA, 18 nt, Human
uuugacagaauauguuuc

SEQ ID NO: 1498736 - RNA, 19 nt, Human
uuugacagaauauguuuca

SEQ ID NO: 1498737 - RNA, 20 nt, Human
uuugacagaauauguuucaa

SEQ ID NO: 1498738 - RNA, 21 nt, Human
uuugacagaauauguuucaaa

SEQ ID NO: 1498739 - RNA, 23 nt, Human
uuucccucccuuccucuuuccau

SEQ ID NO: 1498740 - RNA, 22 nt, Human
auucaaacagucucaggaaauc

SEQ ID NO: 1498741 - RNA, 20 nt, Human
auuauauggcuugaguuuaa

SEQ ID NO: 1498742 - RNA, 16 nt, Human
auuauaacucauuugu

SEQ ID NO: 1498743 - RNA, 13 nt, Human
auuauaaaguuuu

SEQ ID NO: 1498744 - RNA, 16 nt, Human
auuauaaaguuuucua

SEQ ID NO: 1498745 - RNA, 16 nt, Human
auucaguuguuagugu

SEQ ID NO: 1498746 - RNA, 21 nt, Human
auucaggagaguagaacagau

SEQ ID NO: 1498747 - RNA, 22 nt, Human
auucaggagaguagaacagaua

SEQ ID NO: 1498748 - RNA, 17 nt, Human
auuccaagugauugaaa

SEQ ID NO: 1498749 - RNA, 22 nt, Human
auuccccaggaggccagccuug

SEQ ID NO: 1498750 - RNA, 20 nt, Human
auuccccaggaggccagccu

SEQ ID NO: 1498751 - RNA, 18 nt, Human
auucccaagcucugcucc

SEQ ID NO: 1498752 - RNA, 19 nt, Human
auucccaagcucugcuccu

SEQ ID NO: 1498753 - RNA, 15 nt, Human
auuacuguaagaaaa

SEQ ID NO: 1498754 - RNA, 16 nt, Human
auuacuguaagaaaau

SEQ ID NO: 1498755 - RNA, 13 nt, Human
auuagagaagaga

SEQ ID NO: 1498756 - RNA, 14 nt, Human
auuacuucugcuac

SEQ ID NO: 1498757 - RNA, 13 nt, Human
auuacuucugcua

SEQ ID NO: 1498758 - RNA, 15 nt, Human
uuuuguuuucauuau

SEQ ID NO: 1498759 - RNA, 16 nt, Human
uuuuguuuuugucuua

SEQ ID NO: 1498760 - RNA, 14 nt, Human
uuuuguuccccucc

SEQ ID NO: 1498761 - RNA, 15 nt, Human
uuuuguuccccuccu

SEQ ID NO: 1498762 - RNA, 19 nt, Human
uuuuguuccccuccuccac

SEQ ID NO: 1498763 - RNA, 14 nt, Human
uuuugugaagcaaa

SEQ ID NO: 1498764 - RNA, 23 nt, Human
auuaaaacacaacaucuuuuucu

SEQ ID NO: 1498765 - RNA, 12 nt, Human
uuuuugacagaa

SEQ ID NO: 1498766 - RNA, 13 nt, Human
uuuuugacagaau

SEQ ID NO: 1498767 - RNA, 12 nt, Human
uuuuugauauau

SEQ ID NO: 1498768 - RNA, 19 nt, Human
uuuuuauuuguuugugcau

SEQ ID NO: 1498769 - RNA, 17 nt, Human
uuuuuauauuugaaaua

SEQ ID NO: 1498770 - RNA, 20 nt, Human
uuuuuguagcacugacagau

SEQ ID NO: 1498771 - RNA, 21 nt, Human
uuuuuguagcacugacagauu

SEQ ID NO: 1498772 - RNA, 19 nt, Human
uuuuuguagcacugacaga

SEQ ID NO: 1498773 - RNA, 13 nt, Human
auuaaggaagaca

SEQ ID NO: 1498774 - RNA, 18 nt, Human
auuaaguacuauguauca

SEQ ID NO: 1498775 - RNA, 19 nt, Human
auuaaguacuauguaucaa

SEQ ID NO: 1498776 - RNA, 20 nt, Human
uugucaauaaaauccauaca

SEQ ID NO: 1498777 - RNA, 13 nt, Human
augaguccccugu

SEQ ID NO: 1498778 - RNA, 23 nt, Human
augaguccccuguuuguuucuga

SEQ ID NO: 1498779 - RNA, 17 nt, Human
uugucacacacuuuggc

SEQ ID NO: 1498780 - RNA, 18 nt, Human
uugucacacacuuuggcu

SEQ ID NO: 1498781 - RNA, 21 nt, Human
uugucauauaagauucauauu

SEQ ID NO: 1498782 - RNA, 16 nt, Human
uuguagcauccuggaa

SEQ ID NO: 1498783 - RNA, 18 nt, Human
uuguagcauccuggaaua

SEQ ID NO: 1498784 - RNA, 15 nt, Human
augagguacugagag

SEQ ID NO: 1498785 - RNA, 16 nt, Human
uuguagcuuuaucaaa

SEQ ID NO: 1498786 - RNA, 17 nt, Human
uuguagcuuuaucaaag

SEQ ID NO: 1498787 - RNA, 17 nt, Human
augagguacugagagug

SEQ ID NO: 1498788 - RNA, 18 nt, Human
augagguacugagaguga

SEQ ID NO: 1498789 - RNA, 22 nt, Human
augaggucagagccugcaguua

SEQ ID NO: 1498790 - RNA, 19 nt, Human
augaggucagagccugcag

SEQ ID NO: 1498791 - RNA, 20 nt, Human
augaggucagagccugcagu

SEQ ID NO: 1498792 - RNA, 15 nt, Human
augaggucagagccu

SEQ ID NO: 1498793 - RNA, 16 nt, Human
augaggucagagccug

SEQ ID NO: 1498794 - RNA, 18 nt, Human
augaggucagagccugca

SEQ ID NO: 1498795 - RNA, 20 nt, Human
uuguucaauaauaaauauuu

SEQ ID NO: 1498796 - RNA, 13 nt, Human
uuguucauacaua

SEQ ID NO: 1498797 - RNA, 22 nt, Human
uuguucaauaauaaauauuuuu

SEQ ID NO: 1498798 - RNA, 13 nt, Human
uugugaggaagcc

SEQ ID NO: 1498799 - RNA, 21 nt, Human
uugugaggaagccgcuggggc

SEQ ID NO: 1498800 - RNA, 20 nt, Human
uugugauacaaugcugugcc

SEQ ID NO: 1498801 - RNA, 17 nt, Human
uugugaggaagccgcug

SEQ ID NO: 1498802 - RNA, 18 nt, Human
uugugaggaagccgcugg

SEQ ID NO: 1498803 - RNA, 15 nt, Human
uuguccccgacccuu

SEQ ID NO: 1498804 - RNA, 16 nt, Human
uuguccccgacccuug

SEQ ID NO: 1498805 - RNA, 18 nt, Human
uuguccccaccgcagaca

SEQ ID NO: 1498806 - RNA, 20 nt, Human
uuguccccaccgcagacagg

SEQ ID NO: 1498807 - RNA, 20 nt, Human
uuuaaaaaagaaacauuugg

SEQ ID NO: 1498808 - RNA, 23 nt, Human
uuuaaaaauacagauagauauau

SEQ ID NO: 1498809 - RNA, 21 nt, Human
uuuaaauauaugcuaagucuu

SEQ ID NO: 1498810 - RNA, 11 nt, Human
uuuaaaugcac

SEQ ID NO: 1498811 - RNA, 14 nt, Human
uuuaagaggcaggg

SEQ ID NO: 1498812 - RNA, 12 nt, Human
uuuaagagaaau

SEQ ID NO: 1498813 - RNA, 19 nt, Human
uuuaaggaugcuuguacau

SEQ ID NO: 1498814 - RNA, 21 nt, Human
uuuaagcuguuacugucuuca

SEQ ID NO: 1498815 - RNA, 22 nt, Human
uuuaaggaugcuuguacauaau

SEQ ID NO: 1498816 - RNA, 21 nt, Human
uuuaaggaugcuuguacauaa

SEQ ID NO: 1498817 - RNA, 20 nt, Human
uuuaaggaugcuuguacaua

SEQ ID NO: 1498818 - RNA, 16 nt, Human
uuuaaugaaagacugu

SEQ ID NO: 1498819 - RNA, 18 nt, Human
uuuaaaaaaauuccaagu

SEQ ID NO: 1498820 - RNA, 23 nt, Human
augcacuuuguucuggcucuucc

SEQ ID NO: 1498821 - RNA, 12 nt, Human
augcaaagcacu

SEQ ID NO: 1498822 - RNA, 13 nt, Human
augcaaagcacug

SEQ ID NO: 1498823 - RNA, 14 nt, Human
augcaaagcacuga

SEQ ID NO: 1498824 - RNA, 15 nt, Human
augcaaagcacugac

SEQ ID NO: 1498825 - RNA, 13 nt, Human
augauuucauuca

SEQ ID NO: 1498826 - RNA, 20 nt, Human
uuguucuugguuuguaaauu

SEQ ID NO: 1498827 - RNA, 19 nt, Human
uuguucuugguuuguaaau

SEQ ID NO: 1498828 - RNA, 17 nt, Human
uuguucuugguuuguaa

SEQ ID NO: 1498829 - RNA, 16 nt, Human
uuguucauacauauuu

SEQ ID NO: 1498830 - RNA, 18 nt, Human
uuguucauacauauuuuu

SEQ ID NO: 1498831 - RNA, 15 nt, Human
augccccugaauuua

SEQ ID NO: 1498832 - RNA, 20 nt, Human
augccccugaauuuaaauag

SEQ ID NO: 1498833 - RNA, 17 nt, Human
augcccagccccuucug

SEQ ID NO: 1498834 - RNA, 21 nt, Human
augccaugaggaacaaggcaa

SEQ ID NO: 1498835 - RNA, 16 nt, Human
augcccagccccuucu

SEQ ID NO: 1498836 - RNA, 21 nt, Human
uuuaaugaaagacuguacaaa

SEQ ID NO: 1498837 - RNA, 23 nt, Human
uuuaaugaaagacuguacaaagu

SEQ ID NO: 1498838 - RNA, 20 nt, Human
augccuuuucccaacuccag

SEQ ID NO: 1498839 - RNA, 22 nt, Human
augccuuuucccaacuccagaa

SEQ ID NO: 1498840 - RNA, 15 nt, Human
augccucucucaggc

SEQ ID NO: 1498841 - RNA, 13 nt, Human
augccucucucag

SEQ ID NO: 1498842 - RNA, 14 nt, Human
augccucucucagg

SEQ ID NO: 1498843 - RNA, 18 nt, Human
augcuacaggauuugaaa

SEQ ID NO: 1498844 - RNA, 22 nt, Human
augcgugcauaccacuuuuguu

SEQ ID NO: 1498845 - RNA, 17 nt, Human
augccucucucaggcca

SEQ ID NO: 1498846 - RNA, 21 nt, Human
uuuauaugcuucuguuuuaua

SEQ ID NO: 1498847 - RNA, 17 nt, Human
uuuagggguagcauuug

SEQ ID NO: 1498848 - RNA, 23 nt, Human
uuuaggauguguauuucauuuau

SEQ ID NO: 1498849 - RNA, 20 nt, Human
uuuacuucuaagucauucau

SEQ ID NO: 1498850 - RNA, 15 nt, Human
uuuacuucuuauaca

SEQ ID NO: 1498851 - RNA, 14 nt, Human
uuuacuucuuauac

SEQ ID NO: 1498852 - RNA, 13 nt, Human
uuuacuucuuaua

SEQ ID NO: 1498853 - RNA, 22 nt, Human
uuuaccugaagucuuuguacag

SEQ ID NO: 1498854 - RNA, 18 nt, Human
uuuaccugaagucuuugu

SEQ ID NO: 1498855 - RNA, 16 nt, Human
uuuacugcagcuuugu

SEQ ID NO: 1498856 - RNA, 11 nt, Human
uuuacuuaaac

SEQ ID NO: 1498857 - RNA, 13 nt, Human
uuucacauuggaa

SEQ ID NO: 1498858 - RNA, 14 nt, Human
uuucacauuggaaa

SEQ ID NO: 1498859 - RNA, 19 nt, Human
uuucacauuggaaacaagu

SEQ ID NO: 1498860 - RNA, 19 nt, Human
uuucaaacauauauaacaa

SEQ ID NO: 1498861 - RNA, 12 nt, Human
uuucaaacuuua

SEQ ID NO: 1498862 - RNA, 15 nt, Human
uuucaaacuuuacua

SEQ ID NO: 1498863 - RNA, 22 nt, Human
uuucacauaucuaguaugaaau

SEQ ID NO: 1498864 - RNA, 21 nt, Human
auggaaugcuguguuaaauaa

SEQ ID NO: 1498865 - RNA, 21 nt, Human
uuucaugcuguucaugaaaga

SEQ ID NO: 1498866 - RNA, 20 nt, Human
uuucaucugcucuccuuccu

SEQ ID NO: 1498867 - RNA, 19 nt, Human
uuucaugcuguucaugaaa

SEQ ID NO: 1498868 - RNA, 18 nt, Human
uuucaucugcucuccuuc

SEQ ID NO: 1498869 - RNA, 19 nt, Human
uuucaucugcucuccuucc

SEQ ID NO: 1498870 - RNA, 11 nt, Human
uuucaucugcu

SEQ ID NO: 1498871 - RNA, 15 nt, Human
uuucaucugcucucc

SEQ ID NO: 1498872 - RNA, 16 nt, Human
uuucaucugcucuccu

SEQ ID NO: 1498873 - RNA, 17 nt, Human
uuucaucugcucuccuu

SEQ ID NO: 1498874 - RNA, 13 nt, Human
uuucagaaaugug

SEQ ID NO: 1498875 - RNA, 12 nt, Human
uuucagaaaugu

SEQ ID NO: 1498876 - RNA, 11 nt, Human
uuucagaaaug

SEQ ID NO: 1498877 - RNA, 16 nt, Human
uuucccuauuagagaa

SEQ ID NO: 1498878 - RNA, 23 nt, Human
augcuguauuuuaaaagaaugau

SEQ ID NO: 1498879 - RNA, 22 nt, Human
augcuguauuuuaaaagaauga

SEQ ID NO: 1498880 - RNA, 22 nt, Human
augcuggcuguuggcugggggc

SEQ ID NO: 1498881 - RNA, 19 nt, Human
augcuggcuguuggcuggg

SEQ ID NO: 1498882 - RNA, 20 nt, Human
augcuggcuguuggcugggg

SEQ ID NO: 1498883 - RNA, 21 nt, Human
augcuucuguuuuauaauuuu

SEQ ID NO: 1498884 - RNA, 16 nt, Human
augcuucucacugcca

SEQ ID NO: 1498885 - RNA, 20 nt, Human
augcuucucacugccaugcc

SEQ ID NO: 1498886 - RNA, 17 nt, Human
auggaagacagcucuua

SEQ ID NO: 1498887 - RNA, 18 nt, Human
auggaagacagcucuuau

SEQ ID NO: 1498888 - RNA, 14 nt, Human
uuuaucagaauucu

SEQ ID NO: 1498889 - RNA, 14 nt, Human
augcuccuggccca

SEQ ID NO: 1498890 - RNA, 19 nt, Human
augcuccuggcccacugca

SEQ ID NO: 1498891 - RNA, 18 nt, Human
augcuggcuguuggcugg

SEQ ID NO: 1498892 - RNA, 20 nt, Human
uugguuuucacauuggaaac

SEQ ID NO: 1498893 - RNA, 14 nt, Human
uugguuuguaaauu

SEQ ID NO: 1498894 - RNA, 13 nt, Human
uugguguugacau

SEQ ID NO: 1498895 - RNA, 17 nt, Human
uuggugucgggcaugac

SEQ ID NO: 1498896 - RNA, 18 nt, Human
uuggugucgggcaugaca

SEQ ID NO: 1498897 - RNA, 19 nt, Human
uuggugucgggcaugacac

SEQ ID NO: 1498898 - RNA, 19 nt, Human
uuggugguuucagaaaugu

SEQ ID NO: 1498899 - RNA, 18 nt, Human
uuggugguuucagaaaug

SEQ ID NO: 1498900 - RNA, 20 nt, Human
augaaugucagugugacuga

SEQ ID NO: 1498901 - RNA, 16 nt, Human
augaaugucaguguga

SEQ ID NO: 1498902 - RNA, 18 nt, Human
augaaugucagugugacu

SEQ ID NO: 1498903 - RNA, 13 nt, Human
augaaauauuaug

SEQ ID NO: 1498904 - RNA, 23 nt, Human
augaaccacaucuugcucugcug

SEQ ID NO: 1498905 - RNA, 17 nt, Human
augaaugaaacauuuug

SEQ ID NO: 1498906 - RNA, 15 nt, Human
aucuuauaauuuaaa

SEQ ID NO: 1498907 - RNA, 16 nt, Human
aucuuauaauuuaaaa

SEQ ID NO: 1498908 - RNA, 14 nt, Human
aucuugcucugcug

SEQ ID NO: 1498909 - RNA, 17 nt, Human
aucuugcucugcugaca

SEQ ID NO: 1498910 - RNA, 15 nt, Human
aucuugcucugcuga

SEQ ID NO: 1498911 - RNA, 16 nt, Human
aucuugcucugcugac

SEQ ID NO: 1498912 - RNA, 12 nt, Human
aucugucauuug

SEQ ID NO: 1498913 - RNA, 17 nt, Human
aucugucauuugagcag

SEQ ID NO: 1498914 - RNA, 22 nt, Human
aucugucauuugagcagggcuc

SEQ ID NO: 1498915 - RNA, 17 nt, Human
uuggagaagaacugaaa

SEQ ID NO: 1498916 - RNA, 22 nt, Human
uuggagaagaacugaaaucaua

SEQ ID NO: 1498917 - RNA, 15 nt, Human
uuggagaagaacuga

SEQ ID NO: 1498918 - RNA, 18 nt, Human
uuggagacacaacuauuu

SEQ ID NO: 1498919 - RNA, 20 nt, Human
uugcuuugugauuuuuguaa

SEQ ID NO: 1498920 - RNA, 17 nt, Human
uuggaaaauaaauuauu

SEQ ID NO: 1498921 - RNA, 12 nt, Human
aucuuuaaaaua

SEQ ID NO: 1498922 - RNA, 15 nt, Human
aucuuuaaaauacac

SEQ ID NO: 1498923 - RNA, 15 nt, Human
uugcuuugugauuuu

SEQ ID NO: 1498924 - RNA, 22 nt, Human
uugcaagccagauuuuccugaa

SEQ ID NO: 1498925 - RNA, 21 nt, Human
uugauuaaauucuugcaaagu

SEQ ID NO: 1498926 - RNA, 20 nt, Human
uugauuaaauucuugcaaag

SEQ ID NO: 1498927 - RNA, 16 nt, Human
uugauuaaauucuugc

SEQ ID NO: 1498928 - RNA, 15 nt, Human
uugauuaaauucuug

SEQ ID NO: 1498929 - RNA, 17 nt, Human
aucugacuaugacauaa

SEQ ID NO: 1498930 - RNA, 14 nt, Human
aucugacuaugaca

SEQ ID NO: 1498931 - RNA, 23 nt, Human
uugauguucuuucacccuuuucu

SEQ ID NO: 1498932 - RNA, 12 nt, Human
aucugaaaaugu

SEQ ID NO: 1498933 - RNA, 17 nt, Human
aucucaaauuucuaaau

SEQ ID NO: 1498934 - RNA, 16 nt, Human
aucucaaauuucuaaa

SEQ ID NO: 1498935 - RNA, 23 nt, Human
aucucacacaugagcaucaggcc

SEQ ID NO: 1498936 - RNA, 14 nt, Human
uugcaugaggcuag

SEQ ID NO: 1498937 - RNA, 21 nt, Human
uugcaccacugcacuccagcc

SEQ ID NO: 1498938 - RNA, 14 nt, Human
uugcaauggcagcc

SEQ ID NO: 1498939 - RNA, 13 nt, Human
uugcccaggcagg

SEQ ID NO: 1498940 - RNA, 14 nt, Human
uugcccaggcaggu

SEQ ID NO: 1498941 - RNA, 16 nt, Human
uugcccaggcaggucu

SEQ ID NO: 1498942 - RNA, 18 nt, Human
uugcccaggcaggucuug

SEQ ID NO: 1498943 - RNA, 11 nt, Human
uugcccaggcu

SEQ ID NO: 1498944 - RNA, 12 nt, Human
uugcccaggcug

SEQ ID NO: 1498945 - RNA, 14 nt, Human
uugcccaggcuggc

SEQ ID NO: 1498946 - RNA, 23 nt, Human
uugcccaggcuggcgugcagugg

SEQ ID NO: 1498947 - RNA, 13 nt, Human
uugacaugggaca

SEQ ID NO: 1498948 - RNA, 19 nt, Human
uugacagggcacaccgggc

SEQ ID NO: 1498949 - RNA, 16 nt, Human
uugacaucaacugcau

SEQ ID NO: 1498950 - RNA, 19 nt, Human
uugacaggauuauuggaaa

SEQ ID NO: 1498951 - RNA, 10 nt, Human
uugacagggc

SEQ ID NO: 1498952 - RNA, 12 nt, Human
uugacagggcac

SEQ ID NO: 1498953 - RNA, 12 nt, Human
uugacuuuuuau

SEQ ID NO: 1498954 - RNA, 17 nt, Human
uugaccauucuccaccu

SEQ ID NO: 1498955 - RNA, 16 nt, Human
uugagcagggcucagc

SEQ ID NO: 1498956 - RNA, 12 nt, Human
uugagacagagu

SEQ ID NO: 1498957 - RNA, 12 nt, Human
uugagcagggcu

SEQ ID NO: 1498958 - RNA, 11 nt, Human
uugagacagag

SEQ ID NO: 1498959 - RNA, 15 nt, Human
aucucaaaacugcac

SEQ ID NO: 1498960 - RNA, 19 nt, Human
aucucaaaacugcacuguc

SEQ ID NO: 1498961 - RNA, 20 nt, Human
aucucaaaacugcacuguca

SEQ ID NO: 1498962 - RNA, 14 nt, Human
aucucaaauuucua

SEQ ID NO: 1498963 - RNA, 23 nt, Human
aucucaaauaacuaaaagguaug

SEQ ID NO: 1498964 - RNA, 14 nt, Human
aucucaaauaacua

SEQ ID NO: 1498965 - RNA, 21 nt, Human
aucucaaauaacuaaaaggua

SEQ ID NO: 1498966 - RNA, 19 nt, Human
aucuagauacuguaucaug

SEQ ID NO: 1498967 - RNA, 17 nt, Human
aucuaggaagacuuugg

SEQ ID NO: 1498968 - RNA, 18 nt, Human
aucuaggaagacuuugga

SEQ ID NO: 1498969 - RNA, 19 nt, Human
aucuaggaagacuuuggaa

SEQ ID NO: 1498970 - RNA, 22 nt, Human
aucuaggaagacuuuggaaaga

SEQ ID NO: 1498971 - RNA, 23 nt, Human
aucuaauauguaacaagccaccc

SEQ ID NO: 1498972 - RNA, 18 nt, Human
aucuagauacuguaucau

SEQ ID NO: 1498973 - RNA, 18 nt, Human
uugauagcacagacccug

SEQ ID NO: 1498974 - RNA, 17 nt, Human
uugauacuacaguuugu

SEQ ID NO: 1498975 - RNA, 21 nt, Human
uugagugcugucuccauguuu

SEQ ID NO: 1498976 - RNA, 14 nt, Human
auauuugaaauauu

SEQ ID NO: 1498977 - RNA, 19 nt, Human
auauuugaaauauugacuu

SEQ ID NO: 1498978 - RNA, 23 nt, Human
auauuugaaauauugacuuuuua

SEQ ID NO: 1498979 - RNA, 12 nt, Human
auauuuuaacuu

SEQ ID NO: 1498980 - RNA, 22 nt, Human
auauuuguaucacaaaucuuaa

SEQ ID NO: 1498981 - RNA, 13 nt, Human
auauuugaaauau

SEQ ID NO: 1498982 - RNA, 20 nt, Human
auauuguuuucaguguacau

SEQ ID NO: 1498983 - RNA, 17 nt, Human
auauuguguugugaaug

SEQ ID NO: 1498984 - RNA, 18 nt, Human
auauuguguugugaaugu

SEQ ID NO: 1498985 - RNA, 17 nt, Human
auauugcugauggugca

SEQ ID NO: 1498986 - RNA, 21 nt, Human
auauugcugauggugcaauga

SEQ ID NO: 1498987 - RNA, 22 nt, Human
auauucucacagcuccaagaau

SEQ ID NO: 1498988 - RNA, 23 nt, Human
auauucucacagcuccaagaauu

SEQ ID NO: 1498989 - RNA, 16 nt, Human
auauucuguuggccag

SEQ ID NO: 1498990 - RNA, 22 nt, Human
auauugauuuccguuaaaauac

SEQ ID NO: 1498991 - RNA, 21 nt, Human
auauugauuuccguuaaaaua

SEQ ID NO: 1498992 - RNA, 19 nt, Human
auauugauuuccguuaaaa

SEQ ID NO: 1498993 - RNA, 18 nt, Human
auauguuuuaagaggcag

SEQ ID NO: 1498994 - RNA, 20 nt, Human
auauguuuuaagaggcaggg

SEQ ID NO: 1498995 - RNA, 24 nt, Human
auauuaagaaagacuaucuaaaug

SEQ ID NO: 1498996 - RNA, 22 nt, Human
auauuaaggaagacaaugugaa

SEQ ID NO: 1498997 - RNA, 18 nt, Human
auauuuucaugcuguuca

SEQ ID NO: 1498998 - RNA, 21 nt, Human
auauuuucaugcuguucauga

SEQ ID NO: 1498999 - RNA, 15 nt, Human
uuccuucagugccuu

SEQ ID NO: 1499000 - RNA, 11 nt, Human
uuccuucagug

SEQ ID NO: 1499001 - RNA, 14 nt, Human
uuccuucagugccu

SEQ ID NO: 1499002 - RNA, 16 nt, Human
uuccugggagcuuuug

SEQ ID NO: 1499003 - RNA, 15 nt, Human
uuccugggagcuuuu

SEQ ID NO: 1499004 - RNA, 11 nt, Human
uuccucuuucc

SEQ ID NO: 1499005 - RNA, 17 nt, Human
uuccuguucccaugaga

SEQ ID NO: 1499006 - RNA, 17 nt, Human
uuccuaauccucuagga

SEQ ID NO: 1499007 - RNA, 13 nt, Human
uuccuaauccucu

SEQ ID NO: 1499008 - RNA, 15 nt, Human
uuccuaauccucuag

SEQ ID NO: 1499009 - RNA, 22 nt, Human
aucacggcucacugcagccuca

SEQ ID NO: 1499010 - RNA, 18 nt, Human
aucaaguauuauaccuuu

SEQ ID NO: 1499011 - RNA, 14 nt, Human
aucaaguauuauac

SEQ ID NO: 1499012 - RNA, 13 nt, Human
aucaaguauuaua

SEQ ID NO: 1499013 - RNA, 21 nt, Human
aucaagaugugacauguuuua

SEQ ID NO: 1499014 - RNA, 22 nt, Human
aucauuaaagccugaguuugcu

SEQ ID NO: 1499015 - RNA, 14 nt, Human
aucauugaaaucuu

SEQ ID NO: 1499016 - RNA, 15 nt, Human
aucauugaaaucuuu

SEQ ID NO: 1499017 - RNA, 23 nt, Human
aucauaguggcuuaaaacaacac

SEQ ID NO: 1499018 - RNA, 20 nt, Human
aucagugugucuaaauuuga

SEQ ID NO: 1499019 - RNA, 19 nt, Human
aucagugugucuaaauuug

SEQ ID NO: 1499020 - RNA, 16 nt, Human
aucagcacgauuucug

SEQ ID NO: 1499021 - RNA, 15 nt, Human
aucagcacgauuucu

SEQ ID NO: 1499022 - RNA, 18 nt, Human
aucagcacgauuucuguu

SEQ ID NO: 1499023 - RNA, 17 nt, Human
aucagcacgauuucugu

SEQ ID NO: 1499024 - RNA, 14 nt, Human
uucucaacuccaaa

SEQ ID NO: 1499025 - RNA, 18 nt, Human
uucucaacuccaaacuga

SEQ ID NO: 1499026 - RNA, 14 nt, Human
uuccuuuuuuugau

SEQ ID NO: 1499027 - RNA, 13 nt, Human
uucuaggccuggg

SEQ ID NO: 1499028 - RNA, 20 nt, Human
uucucacagcuccaagaauu

SEQ ID NO: 1499029 - RNA, 19 nt, Human
uucucagaaucucaaauaa

SEQ ID NO: 1499030 - RNA, 22 nt, Human
uucucagaaucucaaauaacua

SEQ ID NO: 1499031 - RNA, 23 nt, Human
uucucagaaucucaaauaacuaa

SEQ ID NO: 1499032 - RNA, 19 nt, Human
uucuggguggggcaguggg

SEQ ID NO: 1499033 - RNA, 23 nt, Human
uucugccgcagcccugcagaggg

SEQ ID NO: 1499034 - RNA, 10 nt, Human
uucugggaca

SEQ ID NO: 1499035 - RNA, 11 nt, Human
uucugggacac

SEQ ID NO: 1499036 - RNA, 22 nt, Human
uucugggacacaguucaauucu

SEQ ID NO: 1499037 - RNA, 14 nt, Human
uucugaagaagaug

SEQ ID NO: 1499038 - RNA, 23 nt, Human
uucugcaucagcugcugaaacaa

SEQ ID NO: 1499039 - RNA, 12 nt, Human
uucugaagaaga

SEQ ID NO: 1499040 - RNA, 13 nt, Human
uucugaagaagau

SEQ ID NO: 1499041 - RNA, 21 nt, Human
uucugaaauuuccugggagcu

SEQ ID NO: 1499042 - RNA, 20 nt, Human
aucauugaaaucuuuuugcu

SEQ ID NO: 1499043 - RNA, 19 nt, Human
aucauugaaaucuuuuugc

SEQ ID NO: 1499044 - RNA, 15 nt, Human
uucugaaagggacgc

SEQ ID NO: 1499045 - RNA, 19 nt, Human
uucugaaaauuaacacugc

SEQ ID NO: 1499046 - RNA, 17 nt, Human
aucccauaugccugggc

SEQ ID NO: 1499047 - RNA, 16 nt, Human
aucccauaugccuggg

SEQ ID NO: 1499048 - RNA, 15 nt, Human
auccagguucagcuu

SEQ ID NO: 1499049 - RNA, 16 nt, Human
auccagguucagcuug

SEQ ID NO: 1499050 - RNA, 15 nt, Human
uucaaacauauauaa

SEQ ID NO: 1499051 - RNA, 16 nt, Human
uucaaacuuuggaaca

SEQ ID NO: 1499052 - RNA, 17 nt, Human
uucaaguuaaauuuuau

SEQ ID NO: 1499053 - RNA, 22 nt, Human
uucaagaaaacaacuucaauau

SEQ ID NO: 1499054 - RNA, 15 nt, Human
uucaaggauccugag

SEQ ID NO: 1499055 - RNA, 16 nt, Human
uucaaggauccugagc

SEQ ID NO: 1499056 - RNA, 18 nt, Human
uucaaggauccugagcca

SEQ ID NO: 1499057 - RNA, 19 nt, Human
uucaaggauccugagccag

SEQ ID NO: 1499058 - RNA, 21 nt, Human
uucaaggauccugagccagau

SEQ ID NO: 1499059 - RNA, 22 nt, Human
auaggaauugacccacaagaaa

SEQ ID NO: 1499060 - RNA, 19 nt, Human
auaggaacuuaaauaaugu

SEQ ID NO: 1499061 - RNA, 21 nt, Human
auaggaauugacccacaagaa

SEQ ID NO: 1499062 - RNA, 14 nt, Human
uucacauuggaaac

SEQ ID NO: 1499063 - RNA, 22 nt, Human
uucaccacaugugcacaugcac

SEQ ID NO: 1499064 - RNA, 13 nt, Human
uucacauuggaaa

SEQ ID NO: 1499065 - RNA, 17 nt, Human
uucacauauugauuucc

SEQ ID NO: 1499066 - RNA, 20 nt, Human
uucacauaucuaguaugaaa

SEQ ID NO: 1499067 - RNA, 21 nt, Human
uucacauaucuaguaugaaau

SEQ ID NO: 1499068 - RNA, 13 nt, Human
uucacaguucucu

SEQ ID NO: 1499069 - RNA, 17 nt, Human
auagcuacuaauuuuaa

SEQ ID NO: 1499070 - RNA, 14 nt, Human
auagcuacuaauuu

SEQ ID NO: 1499071 - RNA, 18 nt, Human
auagccugccucuucucu

SEQ ID NO: 1499072 - RNA, 13 nt, Human
auaagauaaaugu

SEQ ID NO: 1499073 - RNA, 17 nt, Human
auaagauaaaugugcug

SEQ ID NO: 1499074 - RNA, 18 nt, Human
auagcuacuaauuuuaaa

SEQ ID NO: 1499075 - RNA, 19 nt, Human
auagcucaggugucccugc

SEQ ID NO: 1499076 - RNA, 12 nt, Human
auagcugggacu

SEQ ID NO: 1499077 - RNA, 22 nt, Human
auagcucaggugucccugcacu

SEQ ID NO: 1499078 - RNA, 20 nt, Human
auagcucaggugucccugca

SEQ ID NO: 1499079 - RNA, 21 nt, Human
auagcucaggugucccugcac

SEQ ID NO: 1499080 - RNA, 16 nt, Human
uuauuuaguuccuuga

SEQ ID NO: 1499081 - RNA, 18 nt, Human
uuauuuaaugaaagacug

SEQ ID NO: 1499082 - RNA, 22 nt, Human
uuauuuaaugaaagacuguaca

SEQ ID NO: 1499083 - RNA, 14 nt, Human
uuauuuaaauuuua

SEQ ID NO: 1499084 - RNA, 23 nt, Human
auagcuggucuuauuuguaaagc

SEQ ID NO: 1499085 - RNA, 22 nt, Human
auagcuggucuuauuuguaaag

SEQ ID NO: 1499086 - RNA, 17 nt, Human
auagcugggacuacagg

SEQ ID NO: 1499087 - RNA, 17 nt, Human
uuauuguuuaaaaucau

SEQ ID NO: 1499088 - RNA, 17 nt, Human
auaucuauauuuuacau

SEQ ID NO: 1499089 - RNA, 16 nt, Human
auaucuauauuuuaca

SEQ ID NO: 1499090 - RNA, 20 nt, Human
auaucuauauuuuacauaaa

SEQ ID NO: 1499091 - RNA, 22 nt, Human
auaucuauauuuuacauaaauu

SEQ ID NO: 1499092 - RNA, 21 nt, Human
uucaucauccuaagcuauuca

SEQ ID NO: 1499093 - RNA, 18 nt, Human
uucaucauccuaagcuau

SEQ ID NO: 1499094 - RNA, 16 nt, Human
uucauauuuacuucuu

SEQ ID NO: 1499095 - RNA, 21 nt, Human
uucauauuuacuucuuauaca

SEQ ID NO: 1499096 - RNA, 14 nt, Human
uucaguaauaacuc

SEQ ID NO: 1499097 - RNA, 13 nt, Human
auaugauucaaau

SEQ ID NO: 1499098 - RNA, 22 nt, Human
auaugauucaaaugucuauaaa

SEQ ID NO: 1499099 - RNA, 20 nt, Human
auaugauuuaaaucagccgu

SEQ ID NO: 1499100 - RNA, 12 nt, Human
auaugauucaaa

SEQ ID NO: 1499101 - RNA, 22 nt, Human
auaucugaaaauguauguguaa

SEQ ID NO: 1499102 - RNA, 13 nt, Human
auaugugaacagu

SEQ ID NO: 1499103 - RNA, 14 nt, Human
auaugucaagccau

SEQ ID NO: 1499104 - RNA, 13 nt, Human
auaugcacacauu

SEQ ID NO: 1499105 - RNA, 23 nt, Human
auaugcaaagcacugacuucuaa

SEQ ID NO: 1499106 - RNA, 16 nt, Human
auaugcaaagcacuga

SEQ ID NO: 1499107 - RNA, 17 nt, Human
auauaacaaugcuguau

SEQ ID NO: 1499108 - RNA, 19 nt, Human
auauaagcuuguauuccuu

SEQ ID NO: 1499109 - RNA, 17 nt, Human
auauaaguauucuaaau

SEQ ID NO: 1499110 - RNA, 12 nt, Human
auauaacaaugc

SEQ ID NO: 1499111 - RNA, 15 nt, Human
auauaacaaugcugu

SEQ ID NO: 1499112 - RNA, 17 nt, Human
auauauaacaaugcugu

SEQ ID NO: 1499113 - RNA, 18 nt, Human
auauauaacaaugcugua

SEQ ID NO: 1499114 - RNA, 19 nt, Human
auauauaacaaugcuguau

SEQ ID NO: 1499115 - RNA, 19 nt, Human
auauaaguauucuaaauuu

SEQ ID NO: 1499116 - RNA, 18 nt, Human
auagucaaauugugugaa

SEQ ID NO: 1499117 - RNA, 13 nt, Human
auauaaacacuau

SEQ ID NO: 1499118 - RNA, 15 nt, Human
auauaaacacuauau

SEQ ID NO: 1499119 - RNA, 14 nt, Human
uucagaaaauauua

SEQ ID NO: 1499120 - RNA, 20 nt, Human
uucagaaaauauuauguguu

SEQ ID NO: 1499121 - RNA, 21 nt, Human
uucagaaaauauuauguguuu

SEQ ID NO: 1499122 - RNA, 14 nt, Human
auauauacauauau

SEQ ID NO: 1499123 - RNA, 19 nt, Human
uucagccaagaauucuuaa

SEQ ID NO: 1499124 - RNA, 12 nt, Human
uucagcccucac

SEQ ID NO: 1499125 - RNA, 16 nt, Human
uucagcccucaccccu

SEQ ID NO: 1499126 - RNA, 17 nt, Human
uucagaucucuaacuuc

SEQ ID NO: 1499127 - RNA, 14 nt, Human
uucagacagcugcc

SEQ ID NO: 1499128 - RNA, 15 nt, Human
uuacuguaagaaaau

SEQ ID NO: 1499129 - RNA, 11 nt, Human
uuagaaauaua

SEQ ID NO: 1499130 - RNA, 12 nt, Human
uuagaaauauaa

SEQ ID NO: 1499131 - RNA, 14 nt, Human
uuagaaauauaauu

SEQ ID NO: 1499132 - RNA, 13 nt, Human
uuagacagagucu

SEQ ID NO: 1499133 - RNA, 11 nt, Human
uuagacagagu

SEQ ID NO: 1499134 - RNA, 18 nt, Human
uuacaucaaggcuucaaa

SEQ ID NO: 1499135 - RNA, 14 nt, Human
uuaccuuacagaag

SEQ ID NO: 1499136 - RNA, 23 nt, Human
uuacucagaauucucuaguuuga

SEQ ID NO: 1499137 - RNA, 18 nt, Human
uuacucagaauucucuag

SEQ ID NO: 1499138 - RNA, 15 nt, Human
uuacaggaaguacug

SEQ ID NO: 1499139 - RNA, 14 nt, Human
uuacaggaaguacu

SEQ ID NO: 1499140 - RNA, 16 nt, Human
auaaaauaauuuuuau

SEQ ID NO: 1499141 - RNA, 21 nt, Human
auaaaauaauuuuuauauuug

SEQ ID NO: 1499142 - RNA, 22 nt, Human
auaaaauaauuuuuauauuuga

SEQ ID NO: 1499143 - RNA, 18 nt, Human
auaaaauccauacauuug

SEQ ID NO: 1499144 - RNA, 19 nt, Human
auaaaauccauacauuugu

SEQ ID NO: 1499145 - RNA, 18 nt, Human
uuaaguaaugauaacugg

SEQ ID NO: 1499146 - RNA, 17 nt, Human
uuaaguacuauguauca

SEQ ID NO: 1499147 - RNA, 14 nt, Human
uuaagugcugcauu

SEQ ID NO: 1499148 - RNA, 18 nt, Human
uuaaguuagggaauggca

SEQ ID NO: 1499149 - RNA, 21 nt, Human
uuaagagguugauuauaaagu

SEQ ID NO: 1499150 - RNA, 15 nt, Human
uuaagaggcaggguc

SEQ ID NO: 1499151 - RNA, 16 nt, Human
uuaagaggcagggucu

SEQ ID NO: 1499152 - RNA, 22 nt, Human
uuaagaagacugcauuauauuu

SEQ ID NO: 1499153 - RNA, 13 nt, Human
uuaagaggcaggg

SEQ ID NO: 1499154 - RNA, 17 nt, Human
uuaauuccaauuauaug

SEQ ID NO: 1499155 - RNA, 15 nt, Human
uuaauucuuagcuca

SEQ ID NO: 1499156 - RNA, 23 nt, Human
uuaaugaaagacuguacaaagua

SEQ ID NO: 1499157 - RNA, 20 nt, Human
uuaaugaaagacuguacaaa

SEQ ID NO: 1499158 - RNA, 22 nt, Human
auaaacaagaccacguuucuaa

SEQ ID NO: 1499159 - RNA, 15 nt, Human
auaaacaagaccacg

SEQ ID NO: 1499160 - RNA, 23 nt, Human
auaaacaagaccacguuucuaaa

SEQ ID NO: 1499161 - RNA, 19 nt, Human
uuaauuuuuuugagacaga

SEQ ID NO: 1499162 - RNA, 13 nt, Human
uuaaauaauguga

SEQ ID NO: 1499163 - RNA, 22 nt, Human
aguugcauagguuuaauaauuu

SEQ ID NO: 1499164 - RNA, 16 nt, Human
aguuggcuaggacccc

SEQ ID NO: 1499165 - RNA, 21 nt, Human
aguuggguggaugccuggugg

SEQ ID NO: 1499166 - RNA, 13 nt, Human
aguugggcuuccu

SEQ ID NO: 1499167 - RNA, 18 nt, Human
aguuggucccccuuccau

SEQ ID NO: 1499168 - RNA, 18 nt, Human
aguuguaccgcaauguga

SEQ ID NO: 1499169 - RNA, 21 nt, Human
aguuguuugauucagacagcu

SEQ ID NO: 1499170 - RNA, 23 nt, Human
aguuguuugauucagacagcugc

SEQ ID NO: 1499171 - RNA, 19 nt, Human
uguugcccaggcaggucuu

SEQ ID NO: 1499172 - RNA, 19 nt, Human
uguuuauugucaaaguggu

SEQ ID NO: 1499173 - RNA, 14 nt, Human
uguuuauuuauaga

SEQ ID NO: 1499174 - RNA, 24 nt, Human
uguuuauuuauagaguguacuuaa

SEQ ID NO: 1499175 - RNA, 17 nt, Human
uguuugauucagacagc

SEQ ID NO: 1499176 - RNA, 22 nt, Human
uguuugauucagacagcugccu

SEQ ID NO: 1499177 - RNA, 21 nt, Human
uguuugacgggaaacaaaacu

SEQ ID NO: 1499178 - RNA, 14 nt, Human
uguuuugcaagcca

SEQ ID NO: 1499179 - RNA, 21 nt, Human
aguucugcagauaaacaguag

SEQ ID NO: 1499180 - RNA, 16 nt, Human
aguucugcagauaaac

SEQ ID NO: 1499181 - RNA, 14 nt, Human
aguucugguuccua

SEQ ID NO: 1499182 - RNA, 21 nt, Human
uguuuuauuuaaccucuaaau

SEQ ID NO: 1499183 - RNA, 21 nt, Human
uguuuuauuuuaauucaguug

SEQ ID NO: 1499184 - RNA, 19 nt, Human
uguuuugaaucucauaauu

SEQ ID NO: 1499185 - RNA, 19 nt, Human
uguuuucauuaucucaaaa

SEQ ID NO: 1499186 - RNA, 20 nt, Human
uguuuuccaugaguccccug

SEQ ID NO: 1499187 - RNA, 13 nt, Human
uguguugaagagg

SEQ ID NO: 1499188 - RNA, 22 nt, Human
uguguuaaguauguguaaaaug

SEQ ID NO: 1499189 - RNA, 19 nt, Human
uguguuaaguauguguaaa

SEQ ID NO: 1499190 - RNA, 15 nt, Human
uguuaaguaugugua

SEQ ID NO: 1499191 - RNA, 16 nt, Human
uguuaaguauguguaa

SEQ ID NO: 1499192 - RNA, 20 nt, Human
ugugugaaagguacuucaaa

SEQ ID NO: 1499193 - RNA, 19 nt, Human
uguguguuuauugucaaag

SEQ ID NO: 1499194 - RNA, 23 nt, Human
uguguguuuauugucaaaguggu

SEQ ID NO: 1499195 - RNA, 13 nt, Human
uguguaaguagau

SEQ ID NO: 1499196 - RNA, 17 nt, Human
ugugucucuugguccug

SEQ ID NO: 1499197 - RNA, 20 nt, Human
ugugucucuugguccugcug

SEQ ID NO: 1499198 - RNA, 21 nt, Human
ugugucuugcaauggcagccu

SEQ ID NO: 1499199 - RNA, 21 nt, Human
ugugucucuugguccugcugc

SEQ ID NO: 1499200 - RNA, 22 nt, Human
ugugucucuugguccugcugca

SEQ ID NO: 1499201 - RNA, 18 nt, Human
uguguaagacaaaaagcu

SEQ ID NO: 1499202 - RNA, 20 nt, Human
ugugguguuuccuggcacug

SEQ ID NO: 1499203 - RNA, 14 nt, Human
ugugguguuuccug

SEQ ID NO: 1499204 - RNA, 16 nt, Human
ugugguguuuccuggc

SEQ ID NO: 1499205 - RNA, 16 nt, Human
uguggucccaccccac

SEQ ID NO: 1499206 - RNA, 13 nt, Human
uguggucccaccc

SEQ ID NO: 1499207 - RNA, 15 nt, Human
uguggucccacccca

SEQ ID NO: 1499208 - RNA, 21 nt, Human
uguggguuucuaaagcugcca

SEQ ID NO: 1499209 - RNA, 23 nt, Human
uguggguuucuaaagcugccagc

SEQ ID NO: 1499210 - RNA, 13 nt, Human
agugcugcauuua

SEQ ID NO: 1499211 - RNA, 12 nt, Human
agugcugcauuu

SEQ ID NO: 1499212 - RNA, 22 nt, Human
agugaguugauagcacagaccc

SEQ ID NO: 1499213 - RNA, 23 nt, Human
agugaguugauagcacagacccu

SEQ ID NO: 1499214 - RNA, 19 nt, Human
agugcugcauuuaaaagau

SEQ ID NO: 1499215 - RNA, 20 nt, Human
agugcugggauuacaggugu

SEQ ID NO: 1499216 - RNA, 17 nt, Human
agugcugcauuuaaaag

SEQ ID NO: 1499217 - RNA, 16 nt, Human
agugcugcauuuaaaa

SEQ ID NO: 1499218 - RNA, 21 nt, Human
agugcugggauuacaggugug

SEQ ID NO: 1499219 - RNA, 15 nt, Human
uguuauaaucuuuca

SEQ ID NO: 1499220 - RNA, 20 nt, Human
agugugucuuagugugugca

SEQ ID NO: 1499221 - RNA, 14 nt, Human
agugugucuaaauu

SEQ ID NO: 1499222 - RNA, 20 nt, Human
uguuccacaaguuaaauaaa

SEQ ID NO: 1499223 - RNA, 16 nt, Human
uguucugggacacagu

SEQ ID NO: 1499224 - RNA, 14 nt, Human
uguuccuagugaaa

SEQ ID NO: 1499225 - RNA, 18 nt, Human
uguuccuagugaaagagg

SEQ ID NO: 1499226 - RNA, 13 nt, Human
uguugcccaggca

SEQ ID NO: 1499227 - RNA, 15 nt, Human
uguugcccaggcagg

SEQ ID NO: 1499228 - RNA, 16 nt, Human
uguugcccaggcaggu

SEQ ID NO: 1499229 - RNA, 17 nt, Human
uguugcccaggcagguc

SEQ ID NO: 1499230 - RNA, 18 nt, Human
uguugcccaggcaggucu

SEQ ID NO: 1499231 - RNA, 17 nt, Human
aguggugcgaucugggu

SEQ ID NO: 1499232 - RNA, 23 nt, Human
aguggugguuuucuguucuuucu

SEQ ID NO: 1499233 - RNA, 21 nt, Human
aguggugguuuucuguucuuu

SEQ ID NO: 1499234 - RNA, 20 nt, Human
aguggugguuuucuguucuu

SEQ ID NO: 1499235 - RNA, 19 nt, Human
aguggugguuuucuguucu

SEQ ID NO: 1499236 - RNA, 18 nt, Human
aguggugguuuucuguuc

SEQ ID NO: 1499237 - RNA, 17 nt, Human
aguggugguuuucuguu

SEQ ID NO: 1499238 - RNA, 21 nt, Human
agugguggugaacagaacaaa

SEQ ID NO: 1499239 - RNA, 17 nt, Human
aguguacuuaacuauuc

SEQ ID NO: 1499240 - RNA, 16 nt, Human
agugugguguuuccug

SEQ ID NO: 1499241 - RNA, 20 nt, Human
agugugccugaagucccaga

SEQ ID NO: 1499242 - RNA, 17 nt, Human
agugugguguuuccugg

SEQ ID NO: 1499243 - RNA, 19 nt, Human
agugugguguuuccuggca

SEQ ID NO: 1499244 - RNA, 20 nt, Human
agugugguguuuccuggcac

SEQ ID NO: 1499245 - RNA, 12 nt, Human
ugugccacaggc

SEQ ID NO: 1499246 - RNA, 16 nt, Human
ugugccacaggcuuag

SEQ ID NO: 1499247 - RNA, 20 nt, Human
ugugccagguuuuuggucug

SEQ ID NO: 1499248 - RNA, 12 nt, Human
ugugccaugugc

SEQ ID NO: 1499249 - RNA, 16 nt, Human
ugugccaugugccagg

SEQ ID NO: 1499250 - RNA, 17 nt, Human
agugaaagaaaauaaca

SEQ ID NO: 1499251 - RNA, 15 nt, Human
agugaaagaaaauaa

SEQ ID NO: 1499252 - RNA, 16 nt, Human
agugaacaaauuuaca

SEQ ID NO: 1499253 - RNA, 20 nt, Human
agugaacaaauuuacagaga

SEQ ID NO: 1499254 - RNA, 18 nt, Human
ugugaugagaggaaauca

SEQ ID NO: 1499255 - RNA, 19 nt, Human
ugugauggggcccugccuc

SEQ ID NO: 1499256 - RNA, 20 nt, Human
ugugauggggcccugccucc

SEQ ID NO: 1499257 - RNA, 16 nt, Human
ugugauguauucuagc

SEQ ID NO: 1499258 - RNA, 14 nt, Human
ugugauguauucua

SEQ ID NO: 1499259 - RNA, 15 nt, Human
agugaggcucugccc

SEQ ID NO: 1499260 - RNA, 16 nt, Human
agugaggcucugcccu

SEQ ID NO: 1499261 - RNA, 17 nt, Human
agugaggcucugcccuu

SEQ ID NO: 1499262 - RNA, 21 nt, Human
agugaggcucugcccuugguu

SEQ ID NO: 1499263 - RNA, 19 nt, Human
agugaggcucugcccuugg

SEQ ID NO: 1499264 - RNA, 20 nt, Human
agugaggcucugcccuuggu

SEQ ID NO: 1499265 - RNA, 15 nt, Human
agugagucgaggaca

SEQ ID NO: 1499266 - RNA, 21 nt, Human
ugugcccccauguaagcaccc

SEQ ID NO: 1499267 - RNA, 21 nt, Human
uguggaguucaucuugaauug

SEQ ID NO: 1499268 - RNA, 17 nt, Human
uguggaguucaucuuga

SEQ ID NO: 1499269 - RNA, 20 nt, Human
ugugaacaguuguguuugaa

SEQ ID NO: 1499270 - RNA, 19 nt, Human
ugugaaccaccacacccag

SEQ ID NO: 1499271 - RNA, 20 nt, Human
ugugaaccaccacacccagc

SEQ ID NO: 1499272 - RNA, 21 nt, Human
ugugaaccaccacacccagcc

SEQ ID NO: 1499273 - RNA, 14 nt, Human
ugugaagagaacca

SEQ ID NO: 1499274 - RNA, 15 nt, Human
ugugaaaggaaagag

SEQ ID NO: 1499275 - RNA, 18 nt, Human
ugugaaaggaaagaggcu

SEQ ID NO: 1499276 - RNA, 21 nt, Human
ugugaaaggaaagagggaggu

SEQ ID NO: 1499277 - RNA, 18 nt, Human
agucacuaccuucaugca

SEQ ID NO: 1499278 - RNA, 19 nt, Human
agucucaugccuugagauc

SEQ ID NO: 1499279 - RNA, 21 nt, Human
agucucaugccuugagaucug

SEQ ID NO: 1499280 - RNA, 15 nt, Human
ugugacugaauuucu

SEQ ID NO: 1499281 - RNA, 16 nt, Human
ugugacugaauuucuu

SEQ ID NO: 1499282 - RNA, 16 nt, Human
ugugacugaucucucg

SEQ ID NO: 1499283 - RNA, 15 nt, Human
ugugagaugcuagaa

SEQ ID NO: 1499284 - RNA, 19 nt, Human
ugugagaugcuagaacucc

SEQ ID NO: 1499285 - RNA, 22 nt, Human
ugugagaugcuagaacucccuu

SEQ ID NO: 1499286 - RNA, 22 nt, Human
agucucaggaaaucaaauaugc

SEQ ID NO: 1499287 - RNA, 14 nt, Human
agucuuuguacaga

SEQ ID NO: 1499288 - RNA, 14 nt, Human
uguaguguuggaga

SEQ ID NO: 1499289 - RNA, 15 nt, Human
uguaguguuggagaa

SEQ ID NO: 1499290 - RNA, 16 nt, Human
uguaguguuggagaag

SEQ ID NO: 1499291 - RNA, 17 nt, Human
uguaucaaugaguaaca

SEQ ID NO: 1499292 - RNA, 15 nt, Human
uguaucacaaaucuu

SEQ ID NO: 1499293 - RNA, 18 nt, Human
uguaucacaaaucuuaac

SEQ ID NO: 1499294 - RNA, 22 nt, Human
uguauuacaaauccaaugaaau

SEQ ID NO: 1499295 - RNA, 20 nt, Human
uguauucuagcuaauguaau

SEQ ID NO: 1499296 - RNA, 13 nt, Human
uguauuacaaauc

SEQ ID NO: 1499297 - RNA, 20 nt, Human
uguauucucuccuguaccuc

SEQ ID NO: 1499298 - RNA, 19 nt, Human
uguauucucuccuguaccu

SEQ ID NO: 1499299 - RNA, 22 nt, Human
uguauucuagcuaauguaauaa

SEQ ID NO: 1499300 - RNA, 18 nt, Human
aguauuagaauaccacag

SEQ ID NO: 1499301 - RNA, 18 nt, Human
aguauuacuucugcuaca

SEQ ID NO: 1499302 - RNA, 17 nt, Human
aguaugguggcuggguu

SEQ ID NO: 1499303 - RNA, 15 nt, Human
aguaugguggcuggg

SEQ ID NO: 1499304 - RNA, 16 nt, Human
aguaugguggcugggu

SEQ ID NO: 1499305 - RNA, 19 nt, Human
ugucaauuacaggaaguac

SEQ ID NO: 1499306 - RNA, 17 nt, Human
ugucaauuacaggaagu

SEQ ID NO: 1499307 - RNA, 16 nt, Human
aguaguaauagagcaa

SEQ ID NO: 1499308 - RNA, 14 nt, Human
ugucaauuacagga

SEQ ID NO: 1499309 - RNA, 15 nt, Human
ugucaauuacaggaa

SEQ ID NO: 1499310 - RNA, 17 nt, Human
aguauuucuaugaaaua

SEQ ID NO: 1499311 - RNA, 16 nt, Human
aguauuucuaugaaau

SEQ ID NO: 1499312 - RNA, 18 nt, Human
aguauuucuaugaaauau

SEQ ID NO: 1499313 - RNA, 21 nt, Human
aguauuagaauaccacaggaa

SEQ ID NO: 1499314 - RNA, 14 nt, Human
agucaccucaugga

SEQ ID NO: 1499315 - RNA, 15 nt, Human
agucaccucauggaa

SEQ ID NO: 1499316 - RNA, 17 nt, Human
agucaccucauggaauu

SEQ ID NO: 1499317 - RNA, 19 nt, Human
agucaccccggccaccugc

SEQ ID NO: 1499318 - RNA, 15 nt, Human
agucacacagugagu

SEQ ID NO: 1499319 - RNA, 23 nt, Human
agucacacagugagucgaggaca

SEQ ID NO: 1499320 - RNA, 16 nt, Human
uguagagccagggucu

SEQ ID NO: 1499321 - RNA, 18 nt, Human
uguagagccagggucuca

SEQ ID NO: 1499322 - RNA, 16 nt, Human
uguagaggagaaacug

SEQ ID NO: 1499323 - RNA, 13 nt, Human
aguaaaauccaca

SEQ ID NO: 1499324 - RNA, 18 nt, Human
aguaaugauaacuggaaa

SEQ ID NO: 1499325 - RNA, 20 nt, Human
aguaaugauaacuggaaacu

SEQ ID NO: 1499326 - RNA, 17 nt, Human
aguaaugauaacuggaa

SEQ ID NO: 1499327 - RNA, 17 nt, Human
aguaauaugcacacauu

SEQ ID NO: 1499328 - RNA, 14 nt, Human
aguaauagagcaaa

SEQ ID NO: 1499329 - RNA, 15 nt, Human
aguaauaugcacaca

SEQ ID NO: 1499330 - RNA, 14 nt, Human
aguaauaugcacac

SEQ ID NO: 1499331 - RNA, 15 nt, Human
aguaauucaagaaaa

SEQ ID NO: 1499332 - RNA, 16 nt, Human
aguacauuuggagaca

SEQ ID NO: 1499333 - RNA, 21 nt, Human
aguagaagucuuagauguaua

SEQ ID NO: 1499334 - RNA, 19 nt, Human
aguagaagucuuagaugua

SEQ ID NO: 1499335 - RNA, 20 nt, Human
aguagaagucuuagauguau

SEQ ID NO: 1499336 - RNA, 14 nt, Human
uguaguaucucaua

SEQ ID NO: 1499337 - RNA, 17 nt, Human
uguaggcauaaagucag

SEQ ID NO: 1499338 - RNA, 20 nt, Human
uguaggcauaaagucagggg

SEQ ID NO: 1499339 - RNA, 11 nt, Human
aguagagacag

SEQ ID NO: 1499340 - RNA, 21 nt, Human
aggugagaagcagaggaagga

SEQ ID NO: 1499341 - RNA, 23 nt, Human
aggugagaagcagaggaaggaga

SEQ ID NO: 1499342 - RNA, 16 nt, Human
aggugagaagcagagg

SEQ ID NO: 1499343 - RNA, 22 nt, Human
aggugacagagugagacucugu

SEQ ID NO: 1499344 - RNA, 13 nt, Human
aggugaccccagg

SEQ ID NO: 1499345 - RNA, 18 nt, Human
aggucuugaacuccuggc

SEQ ID NO: 1499346 - RNA, 17 nt, Human
aggucuugaacuccugg

SEQ ID NO: 1499347 - RNA, 13 nt, Human
aggugacagagug

SEQ ID NO: 1499348 - RNA, 15 nt, Human
aggugacagagugag

SEQ ID NO: 1499349 - RNA, 16 nt, Human
aggucuugaacuccug

SEQ ID NO: 1499350 - RNA, 15 nt, Human
uggucagauuugaac

SEQ ID NO: 1499351 - RNA, 16 nt, Human
uggucagauuugaacu

SEQ ID NO: 1499352 - RNA, 13 nt, Human
aggucagagccug

SEQ ID NO: 1499353 - RNA, 14 nt, Human
aggucagagccugc

SEQ ID NO: 1499354 - RNA, 15 nt, Human
aggucagagccugca

SEQ ID NO: 1499355 - RNA, 17 nt, Human
aggucagagccugcagu

SEQ ID NO: 1499356 - RNA, 18 nt, Human
aggucagagccugcaguu

SEQ ID NO: 1499357 - RNA, 14 nt, Human
ugguggcagcugcg

SEQ ID NO: 1499358 - RNA, 15 nt, Human
ugguggcagcugcgg

SEQ ID NO: 1499359 - RNA, 12 nt, Human
ugguggcagugg

SEQ ID NO: 1499360 - RNA, 18 nt, Human
ugguuaggcauuguggga

SEQ ID NO: 1499361 - RNA, 20 nt, Human
ugguuaggcauugugggaag

SEQ ID NO: 1499362 - RNA, 11 nt, Human
uggugucucca

SEQ ID NO: 1499363 - RNA, 19 nt, Human
uggugucuccaacccccca

SEQ ID NO: 1499364 - RNA, 20 nt, Human
uggugucuccaaccccccag

SEQ ID NO: 1499365 - RNA, 23 nt, Human
uggugugaccacugcagaagaca

SEQ ID NO: 1499366 - RNA, 16 nt, Human
uggugcgaucuggguu

SEQ ID NO: 1499367 - RNA, 17 nt, Human
uggugcgaucuggguuc

SEQ ID NO: 1499368 - RNA, 19 nt, Human
uggugcccuggaugcccag

SEQ ID NO: 1499369 - RNA, 21 nt, Human
aggugauccacccaccucagc

SEQ ID NO: 1499370 - RNA, 18 nt, Human
aggugauauuuuucuuau

SEQ ID NO: 1499371 - RNA, 14 nt, Human
aggugauccaccca

SEQ ID NO: 1499372 - RNA, 20 nt, Human
aggugauccacccaccucag

SEQ ID NO: 1499373 - RNA, 15 nt, Human
aggugggauccucca

SEQ ID NO: 1499374 - RNA, 18 nt, Human
aggugccucaagagaagg

SEQ ID NO: 1499375 - RNA, 16 nt, Human
aggugggauccuccag

SEQ ID NO: 1499376 - RNA, 17 nt, Human
aggugggauccuccagg

SEQ ID NO: 1499377 - RNA, 18 nt, Human
aggugggauccuccaggu

SEQ ID NO: 1499378 - RNA, 23 nt, Human
agguggggcagcuugaggguugg

SEQ ID NO: 1499379 - RNA, 14 nt, Human
agguuuaagcuguu

SEQ ID NO: 1499380 - RNA, 19 nt, Human
agguggggucacucuggca

SEQ ID NO: 1499381 - RNA, 23 nt, Human
agguggggucacucuggcagcuc

SEQ ID NO: 1499382 - RNA, 17 nt, Human
aggugugaaccaccaca

SEQ ID NO: 1499383 - RNA, 15 nt, Human
aggugugcucugauc

SEQ ID NO: 1499384 - RNA, 20 nt, Human
aggugugcucugaucaucca

SEQ ID NO: 1499385 - RNA, 15 nt, Human
ugguuuguaaauuaa

SEQ ID NO: 1499386 - RNA, 14 nt, Human
ugguuuucaaaaua

SEQ ID NO: 1499387 - RNA, 21 nt, Human
ugguuuguaaauuaacuuuua

SEQ ID NO: 1499388 - RNA, 15 nt, Human
ugguuuucaaaauaa

SEQ ID NO: 1499389 - RNA, 17 nt, Human
ugguuuucaaaauaaaa

SEQ ID NO: 1499390 - RNA, 14 nt, Human
ugguuauggagagg

SEQ ID NO: 1499391 - RNA, 16 nt, Human
uguaaauaguauuuga

SEQ ID NO: 1499392 - RNA, 15 nt, Human
uguaaauagcucagg

SEQ ID NO: 1499393 - RNA, 16 nt, Human
uguaaauagcucaggu

SEQ ID NO: 1499394 - RNA, 17 nt, Human
aggguggugaccucugc

SEQ ID NO: 1499395 - RNA, 16 nt, Human
aggguggugaccucug

SEQ ID NO: 1499396 - RNA, 20 nt, Human
ugguagagugugccugaagu

SEQ ID NO: 1499397 - RNA, 17 nt, Human
uggguggcaccagcagc

SEQ ID NO: 1499398 - RNA, 20 nt, Human
uggguggcaccagcagccug

SEQ ID NO: 1499399 - RNA, 21 nt, Human
uggguggcaccagcagccugg

SEQ ID NO: 1499400 - RNA, 22 nt, Human
uggguggcaccagcagccugga

SEQ ID NO: 1499401 - RNA, 16 nt, Human
aggggaauugaggaca

SEQ ID NO: 1499402 - RNA, 21 nt, Human
aggggaauguuugccucugcc

SEQ ID NO: 1499403 - RNA, 19 nt, Human
aggggaauguuugccucug

SEQ ID NO: 1499404 - RNA, 20 nt, Human
aggggaauguuugccucugc

SEQ ID NO: 1499405 - RNA, 18 nt, Human
aggggagcaugggaagug

SEQ ID NO: 1499406 - RNA, 21 nt, Human
agggucucacucugucgccca

SEQ ID NO: 1499407 - RNA, 16 nt, Human
agggucucacucuguc

SEQ ID NO: 1499408 - RNA, 14 nt, Human
agggucucacucug

SEQ ID NO: 1499409 - RNA, 15 nt, Human
agggucucacucugu

SEQ ID NO: 1499410 - RNA, 15 nt, Human
aggguaaggcugugg

SEQ ID NO: 1499411 - RNA, 13 nt, Human
agggggcugggac

SEQ ID NO: 1499412 - RNA, 20 nt, Human
aggggguggccucccaacuc

SEQ ID NO: 1499413 - RNA, 18 nt, Human
aggggugggacacccugu

SEQ ID NO: 1499414 - RNA, 22 nt, Human
aggggugcggcggucccagcuc

SEQ ID NO: 1499415 - RNA, 20 nt, Human
aggggugcggcggucccagc

SEQ ID NO: 1499416 - RNA, 21 nt, Human
aggggugcggcggucccagcu

SEQ ID NO: 1499417 - RNA, 23 nt, Human
aggggugcggcggucccagcucc

SEQ ID NO: 1499418 - RNA, 23 nt, Human
uggggcugcaccggcuggccugg

SEQ ID NO: 1499419 - RNA, 14 nt, Human
uggggccaugccuc

SEQ ID NO: 1499420 - RNA, 19 nt, Human
uggggccaugccuccucag

SEQ ID NO: 1499421 - RNA, 21 nt, Human
uggggccaugccuccucagga

SEQ ID NO: 1499422 - RNA, 12 nt, Human
uggggcccugcc

SEQ ID NO: 1499423 - RNA, 20 nt, Human
uggggccaugccuccucagg

SEQ ID NO: 1499424 - RNA, 16 nt, Human
uggggaccucaggccu

SEQ ID NO: 1499425 - RNA, 17 nt, Human
uggggaccucaggccug

SEQ ID NO: 1499426 - RNA, 12 nt, Human
agggcuccagac

SEQ ID NO: 1499427 - RNA, 15 nt, Human
agggcuccagacaca

SEQ ID NO: 1499428 - RNA, 14 nt, Human
uggggaccucaggc

SEQ ID NO: 1499429 - RNA, 15 nt, Human
uggggaccucaggcc

SEQ ID NO: 1499430 - RNA, 13 nt, Human
aggggaauguuug

SEQ ID NO: 1499431 - RNA, 18 nt, Human
aggggaaaaucagccugc

SEQ ID NO: 1499432 - RNA, 22 nt, Human
aggggaaaaucagccugcucca

SEQ ID NO: 1499433 - RNA, 14 nt, Human
aggggaacagacug

SEQ ID NO: 1499434 - RNA, 13 nt, Human
aggggaaaagagg

SEQ ID NO: 1499435 - RNA, 17 nt, Human
ugggguacccacugcuc

SEQ ID NO: 1499436 - RNA, 18 nt, Human
ugggguacccacugcucu

SEQ ID NO: 1499437 - RNA, 19 nt, Human
ugggguacccacugcucug

SEQ ID NO: 1499438 - RNA, 20 nt, Human
ugggguacccacugcucugg

SEQ ID NO: 1499439 - RNA, 13 nt, Human
uggggucacucug

SEQ ID NO: 1499440 - RNA, 14 nt, Human
uggggucacucugg

SEQ ID NO: 1499441 - RNA, 16 nt, Human
uggggucacucuggca

SEQ ID NO: 1499442 - RNA, 22 nt, Human
uggggucacucuggcagcucag

SEQ ID NO: 1499443 - RNA, 23 nt, Human
agggaggacgcucucuggccuuc

SEQ ID NO: 1499444 - RNA, 21 nt, Human
agggaggacgcucucuggccu

SEQ ID NO: 1499445 - RNA, 22 nt, Human
agggaggacgcucucuggccuu

SEQ ID NO: 1499446 - RNA, 14 nt, Human
ugggacuacaggca

SEQ ID NO: 1499447 - RNA, 15 nt, Human
ugggacuacaggcac

SEQ ID NO: 1499448 - RNA, 16 nt, Human
ugggacuacaggcacc

SEQ ID NO: 1499449 - RNA, 21 nt, Human
agggagcaaguccuucccuuu

SEQ ID NO: 1499450 - RNA, 19 nt, Human
agggagcaaguccuucccu

SEQ ID NO: 1499451 - RNA, 19 nt, Human
ugggagagaagagaaugca

SEQ ID NO: 1499452 - RNA, 21 nt, Human
ugggagagaagagaaugcaca

SEQ ID NO: 1499453 - RNA, 16 nt, Human
ugggagagccuuccag

SEQ ID NO: 1499454 - RNA, 20 nt, Human
ugggacucaaugcacugaca

SEQ ID NO: 1499455 - RNA, 13 nt, Human
agggaaguuuugu

SEQ ID NO: 1499456 - RNA, 15 nt, Human
agggaauggcacagc

SEQ ID NO: 1499457 - RNA, 22 nt, Human
agggaaggauacaaaagcaugu

SEQ ID NO: 1499458 - RNA, 21 nt, Human
aggcccggcuccaggcuccuu

SEQ ID NO: 1499459 - RNA, 18 nt, Human
aggcccggcuccaggcuc

SEQ ID NO: 1499460 - RNA, 20 nt, Human
aggcccggcuccaggcuccu

SEQ ID NO: 1499461 - RNA, 13 nt, Human
agggaggcagggg

SEQ ID NO: 1499462 - RNA, 15 nt, Human
agggagggagggcuc

SEQ ID NO: 1499463 - RNA, 17 nt, Human
agggagggagggcucca

SEQ ID NO: 1499464 - RNA, 16 nt, Human
ugggcccccaaaugga

SEQ ID NO: 1499465 - RNA, 21 nt, Human
ugggcccccaaauggaaaugg

SEQ ID NO: 1499466 - RNA, 12 nt, Human
ugggcagaagga

SEQ ID NO: 1499467 - RNA, 11 nt, Human
ugggcagagca

SEQ ID NO: 1499468 - RNA, 12 nt, Human
ugggcagagcag

SEQ ID NO: 1499469 - RNA, 18 nt, Human
ugggccaggagccuccug

SEQ ID NO: 1499470 - RNA, 13 nt, Human
ugggcagagcaga

SEQ ID NO: 1499471 - RNA, 20 nt, Human
ugggaggaucucuugagccu

SEQ ID NO: 1499472 - RNA, 21 nt, Human
ugggaggaucucuugagccug

SEQ ID NO: 1499473 - RNA, 22 nt, Human
ugggaggaucucuugagccugg

SEQ ID NO: 1499474 - RNA, 19 nt, Human
ugggaggccaaggugggag

SEQ ID NO: 1499475 - RNA, 20 nt, Human
ugggaggccaaggugggagg

SEQ ID NO: 1499476 - RNA, 17 nt, Human
agggagggcuccagaca

SEQ ID NO: 1499477 - RNA, 16 nt, Human
agggagggcuccagac

SEQ ID NO: 1499478 - RNA, 14 nt, Human
agggagggcuccag

SEQ ID NO: 1499479 - RNA, 15 nt, Human
agggagggcuccaga

SEQ ID NO: 1499480 - RNA, 19 nt, Human
agggcucagcggggacagc

SEQ ID NO: 1499481 - RNA, 20 nt, Human
agggcucagcggggacagcu

SEQ ID NO: 1499482 - RNA, 22 nt, Human
agggcucagcggggacagcucc

SEQ ID NO: 1499483 - RNA, 23 nt, Human
agggcucagcggggacagcuccu

SEQ ID NO: 1499484 - RNA, 13 nt, Human
ugcuaucuccccc

SEQ ID NO: 1499485 - RNA, 14 nt, Human
ugcuaucuccccca

SEQ ID NO: 1499486 - RNA, 17 nt, Human
ugcuaucucccccagcc

SEQ ID NO: 1499487 - RNA, 16 nt, Human
aggaaaagcugcugac

SEQ ID NO: 1499488 - RNA, 18 nt, Human
ugcuaucucccccagccc

SEQ ID NO: 1499489 - RNA, 16 nt, Human
ugcucugcugacagac

SEQ ID NO: 1499490 - RNA, 14 nt, Human
ugcucugcugacag

SEQ ID NO: 1499491 - RNA, 15 nt, Human
ugcucugcugacaga

SEQ ID NO: 1499492 - RNA, 21 nt, Human
ugcuccagcuguucagcuggu

SEQ ID NO: 1499493 - RNA, 19 nt, Human
ugcucugaucauccacugu

SEQ ID NO: 1499494 - RNA, 23 nt, Human
aggaaaucaaauaugcaaagcac

SEQ ID NO: 1499495 - RNA, 21 nt, Human
aggaaaucaaauaugcaaagc

SEQ ID NO: 1499496 - RNA, 22 nt, Human
aggaaaucaaauaugcaaagca

SEQ ID NO: 1499497 - RNA, 20 nt, Human
aggaaaucaaauaugcaaag

SEQ ID NO: 1499498 - RNA, 23 nt, Human
aggaauuaaguuagggaauggca

SEQ ID NO: 1499499 - RNA, 18 nt, Human
aggaagccacagcuggug

SEQ ID NO: 1499500 - RNA, 15 nt, Human
aggaagcucagggcc

SEQ ID NO: 1499501 - RNA, 16 nt, Human
aggaagcucagggccu

SEQ ID NO: 1499502 - RNA, 15 nt, Human
aggaagccacagcug

SEQ ID NO: 1499503 - RNA, 16 nt, Human
aggaagccacagcugg

SEQ ID NO: 1499504 - RNA, 13 nt, Human
aggaagccagcag

SEQ ID NO: 1499505 - RNA, 13 nt, Human
aggaagcucaggg

SEQ ID NO: 1499506 - RNA, 14 nt, Human
aggaagcucagggc

SEQ ID NO: 1499507 - RNA, 14 nt, Human
ugcuacaaaaacac

SEQ ID NO: 1499508 - RNA, 15 nt, Human
ugcuacaaaaacaca

SEQ ID NO: 1499509 - RNA, 17 nt, Human
ugccuuuucccaacucc

SEQ ID NO: 1499510 - RNA, 19 nt, Human
ugccuuuucccaacuccag

SEQ ID NO: 1499511 - RNA, 14 nt, Human
ugcgguccacccag

SEQ ID NO: 1499512 - RNA, 15 nt, Human
ugcgguccacccagg

SEQ ID NO: 1499513 - RNA, 17 nt, Human
ugcgguccacccaggag

SEQ ID NO: 1499514 - RNA, 14 nt, Human
aggaaaagcugcug

SEQ ID NO: 1499515 - RNA, 16 nt, Human
agcuugcccuguuaaa

SEQ ID NO: 1499516 - RNA, 18 nt, Human
agcuugcccuguuaaaag

SEQ ID NO: 1499517 - RNA, 19 nt, Human
agcuugcccuguuaaaaga

SEQ ID NO: 1499518 - RNA, 20 nt, Human
agcuugaccgugaggccaga

SEQ ID NO: 1499519 - RNA, 22 nt, Human
agcuugaccgugaggccagaga

SEQ ID NO: 1499520 - RNA, 23 nt, Human
agcuugaccgugaggccagagac

SEQ ID NO: 1499521 - RNA, 20 nt, Human
agcuugcccuggugccucac

SEQ ID NO: 1499522 - RNA, 24 nt, Human
ugccugcccaggccccugccaccc

SEQ ID NO: 1499523 - RNA, 23 nt, Human
ugccuccagggcuggacugaggc

SEQ ID NO: 1499524 - RNA, 22 nt, Human
ugccugcccaggccccugccac

SEQ ID NO: 1499525 - RNA, 23 nt, Human
ugccugcccaggccccugccacc

SEQ ID NO: 1499526 - RNA, 14 nt, Human
ugccucagccuccc

SEQ ID NO: 1499527 - RNA, 12 nt, Human
ugccuccagggc

SEQ ID NO: 1499528 - RNA, 14 nt, Human
ugccuccagggcug

SEQ ID NO: 1499529 - RNA, 15 nt, Human
ugccuccagggcugg

SEQ ID NO: 1499530 - RNA, 16 nt, Human
ugccuccagggcugga

SEQ ID NO: 1499531 - RNA, 17 nt, Human
ugccuccagggcuggac

SEQ ID NO: 1499532 - RNA, 18 nt, Human
ugccucugccucugacac

SEQ ID NO: 1499533 - RNA, 20 nt, Human
ugccucugccucugacacac

SEQ ID NO: 1499534 - RNA, 18 nt, Human
ugccuccagggcuggacu

SEQ ID NO: 1499535 - RNA, 19 nt, Human
ugccuccagggcuggacug

SEQ ID NO: 1499536 - RNA, 20 nt, Human
ugccuccagggcuggacuga

SEQ ID NO: 1499537 - RNA, 21 nt, Human
ugccuccagggcuggacugag

SEQ ID NO: 1499538 - RNA, 19 nt, Human
agcugccuguucagcucca

SEQ ID NO: 1499539 - RNA, 18 nt, Human
agcugccuguucagcucc

SEQ ID NO: 1499540 - RNA, 14 nt, Human
agcugccuguucag

SEQ ID NO: 1499541 - RNA, 16 nt, Human
agcugccuguucagcu

SEQ ID NO: 1499542 - RNA, 16 nt, Human
ugccuggauggggcug

SEQ ID NO: 1499543 - RNA, 17 nt, Human
ugccuggauggggcugc

SEQ ID NO: 1499544 - RNA, 20 nt, Human
ugccuggauggggcugcacc

SEQ ID NO: 1499545 - RNA, 21 nt, Human
ugccuggauggggcugcaccg

SEQ ID NO: 1499546 - RNA, 20 nt, Human
agcugcuugggcuucauccu

SEQ ID NO: 1499547 - RNA, 16 nt, Human
agcugcuugggcuuca

SEQ ID NO: 1499548 - RNA, 22 nt, Human
agcuggccgcgccaaauaaugu

SEQ ID NO: 1499549 - RNA, 18 nt, Human
agcuguuacugucuucag

SEQ ID NO: 1499550 - RNA, 19 nt, Human
agcugugcucuggacaggc

SEQ ID NO: 1499551 - RNA, 17 nt, Human
agcugugcucuggacag

SEQ ID NO: 1499552 - RNA, 18 nt, Human
agcugugcucuggacagg

SEQ ID NO: 1499553 - RNA, 17 nt, Human
agcugggacuacaggug

SEQ ID NO: 1499554 - RNA, 22 nt, Human
agcugggguggggaccucaggc

SEQ ID NO: 1499555 - RNA, 23 nt, Human
agcugggguggggaccucaggcc

SEQ ID NO: 1499556 - RNA, 20 nt, Human
agcugggacuacaggcaccc

SEQ ID NO: 1499557 - RNA, 23 nt, Human
agcugggacuacaggcacccacc

SEQ ID NO: 1499558 - RNA, 16 nt, Human
agcugggacuacaggu

SEQ ID NO: 1499559 - RNA, 20 nt, Human
agcugggguggggaccucag

SEQ ID NO: 1499560 - RNA, 21 nt, Human
ugccuuacccucauguucuua

SEQ ID NO: 1499561 - RNA, 16 nt, Human
ugccuuggggacaaga

SEQ ID NO: 1499562 - RNA, 20 nt, Human
ugccuuacccucauguucuu

SEQ ID NO: 1499563 - RNA, 19 nt, Human
ugccuguugggccaggagc

SEQ ID NO: 1499564 - RNA, 16 nt, Human
ugccuguugggccagg

SEQ ID NO: 1499565 - RNA, 17 nt, Human
ugccuguugggccagga

SEQ ID NO: 1499566 - RNA, 19 nt, Human
agcuguuacugucuucagu

SEQ ID NO: 1499567 - RNA, 14 nt, Human
agcuguucacagcc

SEQ ID NO: 1499568 - RNA, 13 nt, Human
ugccgcagagcug

SEQ ID NO: 1499569 - RNA, 14 nt, Human
ugccgcagagcugg

SEQ ID NO: 1499570 - RNA, 15 nt, Human
ugccgcagagcuggc

SEQ ID NO: 1499571 - RNA, 17 nt, Human
ugccgcagagcuggccg

SEQ ID NO: 1499572 - RNA, 12 nt, Human
ugccgcagcccu

SEQ ID NO: 1499573 - RNA, 14 nt, Human
ugccgcagcccugc

SEQ ID NO: 1499574 - RNA, 12 nt, Human
ugccucagccuc

SEQ ID NO: 1499575 - RNA, 13 nt, Human
ugccucagccucc

SEQ ID NO: 1499576 - RNA, 18 nt, Human
ugcccuuaccugccagga

SEQ ID NO: 1499577 - RNA, 19 nt, Human
ugcccuuaccugccaggaa

SEQ ID NO: 1499578 - RNA, 20 nt, Human
ugcccuguuaaaagaugaaa

SEQ ID NO: 1499579 - RNA, 18 nt, Human
agcugcauacaguuugca

SEQ ID NO: 1499580 - RNA, 20 nt, Human
agcugccagccgagauagcc

SEQ ID NO: 1499581 - RNA, 16 nt, Human
agcucuguccugggag

SEQ ID NO: 1499582 - RNA, 21 nt, Human
agcucuguccugggagugagc

SEQ ID NO: 1499583 - RNA, 23 nt, Human
agcucuguccugggagugagcug

SEQ ID NO: 1499584 - RNA, 12 nt, Human
agcucuggucca

SEQ ID NO: 1499585 - RNA, 17 nt, Human
agcucugguccauagag

SEQ ID NO: 1499586 - RNA, 20 nt, Human
agcucugguccauagagagc

SEQ ID NO: 1499587 - RNA, 22 nt, Human
agcuccuucuguccuacucugu

SEQ ID NO: 1499588 - RNA, 16 nt, Human
agcuccuucuguccua

SEQ ID NO: 1499589 - RNA, 21 nt, Human
agcuccuucuguccuacucug

SEQ ID NO: 1499590 - RNA, 13 nt, Human
agcuccaguucga

SEQ ID NO: 1499591 - RNA, 13 nt, Human
agcucccaggcau

SEQ ID NO: 1499592 - RNA, 23 nt, Human
agcucccaggcauuccccaggag

SEQ ID NO: 1499593 - RNA, 15 nt, Human
agcuccuucuguccu

SEQ ID NO: 1499594 - RNA, 17 nt, Human
uggagcucguggaacag

SEQ ID NO: 1499595 - RNA, 21 nt, Human
uggagcucguggaacaguuac

SEQ ID NO: 1499596 - RNA, 21 nt, Human
uggagcucgugggacagucac

SEQ ID NO: 1499597 - RNA, 17 nt, Human
aggcaaggcugucaauu

SEQ ID NO: 1499598 - RNA, 16 nt, Human
aggcaaggcugucaau

SEQ ID NO: 1499599 - RNA, 20 nt, Human
aggcaagcaccuccugccuc

SEQ ID NO: 1499600 - RNA, 18 nt, Human
aggcaagcaccuccugcc

SEQ ID NO: 1499601 - RNA, 19 nt, Human
aggcaagcaccuccugccu

SEQ ID NO: 1499602 - RNA, 22 nt, Human
aggauugcuacuguccuaccca

SEQ ID NO: 1499603 - RNA, 18 nt, Human
aggauugcuacuguccua

SEQ ID NO: 1499604 - RNA, 15 nt, Human
aggauugcuacuguc

SEQ ID NO: 1499605 - RNA, 17 nt, Human
aggauugcuacuguccu

SEQ ID NO: 1499606 - RNA, 15 nt, Human
aggcagcuugaaacu

SEQ ID NO: 1499607 - RNA, 15 nt, Human
aggcauaaagucagg

SEQ ID NO: 1499608 - RNA, 17 nt, Human
aggcaggugggauggau

SEQ ID NO: 1499609 - RNA, 12 nt, Human
aggcagggucuc

SEQ ID NO: 1499610 - RNA, 18 nt, Human
aggcagggucucacucug

SEQ ID NO: 1499611 - RNA, 22 nt, Human
aggcaggucuugaacuccuggc

SEQ ID NO: 1499612 - RNA, 22 nt, Human
aggcauaaagucagggguuccc

SEQ ID NO: 1499613 - RNA, 20 nt, Human
aggcauuuaggccaugggac

SEQ ID NO: 1499614 - RNA, 18 nt, Human
aggcauugugggaagggg

SEQ ID NO: 1499615 - RNA, 23 nt, Human
uggcacaucagcacgauuucugu

SEQ ID NO: 1499616 - RNA, 21 nt, Human
uggaugccugguggcagcugc

SEQ ID NO: 1499617 - RNA, 23 nt, Human
uggaugccugguggcagcugcgg

SEQ ID NO: 1499618 - RNA, 23 nt, Human
uggaugcggaacccaaauuacgu

SEQ ID NO: 1499619 - RNA, 21 nt, Human
uggagugugaggguccugcag

SEQ ID NO: 1499620 - RNA, 14 nt, Human
uggaguugaaaauc

SEQ ID NO: 1499621 - RNA, 16 nt, Human
aggcauuugcugaaua

SEQ ID NO: 1499622 - RNA, 20 nt, Human
aggcauuugcugaauacaga

SEQ ID NO: 1499623 - RNA, 14 nt, Human
uggagugcagugag

SEQ ID NO: 1499624 - RNA, 15 nt, Human
aggcccagagggccu

SEQ ID NO: 1499625 - RNA, 13 nt, Human
aggcccagagggc

SEQ ID NO: 1499626 - RNA, 15 nt, Human
aggcccccaggugcc

SEQ ID NO: 1499627 - RNA, 14 nt, Human
aggccccgcccagg

SEQ ID NO: 1499628 - RNA, 13 nt, Human
aggcccggcucca

SEQ ID NO: 1499629 - RNA, 18 nt, Human
uggcacccggccccugcu

SEQ ID NO: 1499630 - RNA, 19 nt, Human
uggcacccggccccugcug

SEQ ID NO: 1499631 - RNA, 20 nt, Human
uggcacccggccccugcugg

SEQ ID NO: 1499632 - RNA, 13 nt, Human
uggcagcucagag

SEQ ID NO: 1499633 - RNA, 23 nt, Human
uggcagcucaccucucccuugga

SEQ ID NO: 1499634 - RNA, 21 nt, Human
uggcagcucaccucucccuug

SEQ ID NO: 1499635 - RNA, 22 nt, Human
uggcagcucaccucucccuugg

SEQ ID NO: 1499636 - RNA, 13 nt, Human
aggccagccuuga

SEQ ID NO: 1499637 - RNA, 12 nt, Human
aggccagcugcu

SEQ ID NO: 1499638 - RNA, 15 nt, Human
aggccagccuugacc

SEQ ID NO: 1499639 - RNA, 16 nt, Human
uggaagacagcucuua

SEQ ID NO: 1499640 - RNA, 21 nt, Human
uggaacaagaugguucuagca

SEQ ID NO: 1499641 - RNA, 21 nt, Human
uggaaauuuguuauaaugaau

SEQ ID NO: 1499642 - RNA, 23 nt, Human
uggaaauuuguuauaaugaauga

SEQ ID NO: 1499643 - RNA, 17 nt, Human
aggagccuccugcccuu

SEQ ID NO: 1499644 - RNA, 15 nt, Human
ugcuugagcucagga

SEQ ID NO: 1499645 - RNA, 22 nt, Human
ugcuuugugauuuuuguaauuu

SEQ ID NO: 1499646 - RNA, 18 nt, Human
ugcuuuuggucuguguga

SEQ ID NO: 1499647 - RNA, 17 nt, Human
ugcuuuuaaaaaaaaau

SEQ ID NO: 1499648 - RNA, 20 nt, Human
ugcuuuugucuaugggacuc

SEQ ID NO: 1499649 - RNA, 23 nt, Human
ugcuuuuuaauauugauaugcuu

SEQ ID NO: 1499650 - RNA, 13 nt, Human
aggaucagucuga

SEQ ID NO: 1499651 - RNA, 22 nt, Human
aggaugcacagaguuguuacau

SEQ ID NO: 1499652 - RNA, 22 nt, Human
aggaugaucuaggaagacuuug

SEQ ID NO: 1499653 - RNA, 23 nt, Human
aggaugaucuaggaagacuuugg

SEQ ID NO: 1499654 - RNA, 17 nt, Human
aggauucuuccucccuc

SEQ ID NO: 1499655 - RNA, 19 nt, Human
aggauucuuccucccuccc

SEQ ID NO: 1499656 - RNA, 16 nt, Human
aggagccgaagcccag

SEQ ID NO: 1499657 - RNA, 18 nt, Human
aggagccgaagcccaggg

SEQ ID NO: 1499658 - RNA, 16 nt, Human
aggagccuccugcccu

SEQ ID NO: 1499659 - RNA, 17 nt, Human
aggagccccgaggccuu

SEQ ID NO: 1499660 - RNA, 14 nt, Human
aggagcagccacau

SEQ ID NO: 1499661 - RNA, 12 nt, Human
aggagcagccac

SEQ ID NO: 1499662 - RNA, 13 nt, Human
aggagcagccaca

SEQ ID NO: 1499663 - RNA, 11 nt, Human
aggacugggcc

SEQ ID NO: 1499664 - RNA, 12 nt, Human
aggacugggcca

SEQ ID NO: 1499665 - RNA, 15 nt, Human
aggacugggccacuu

SEQ ID NO: 1499666 - RNA, 18 nt, Human
aggagaaacuggaacucu

SEQ ID NO: 1499667 - RNA, 19 nt, Human
aggagaaacuggaacucuc

SEQ ID NO: 1499668 - RNA, 22 nt, Human
aggacuuuucuuuguggcuucc

SEQ ID NO: 1499669 - RNA, 23 nt, Human
aggacuuuucuuuguggcuuccu

SEQ ID NO: 1499670 - RNA, 17 nt, Human
aggacuuuucuuugugg

SEQ ID NO: 1499671 - RNA, 19 nt, Human
aggacuuuucuuuguggcu

SEQ ID NO: 1499672 - RNA, 13 nt, Human
aggacgcucucug

SEQ ID NO: 1499673 - RNA, 14 nt, Human
aggacgcucucugg

SEQ ID NO: 1499674 - RNA, 16 nt, Human
aggacgcucucuggcc

SEQ ID NO: 1499675 - RNA, 17 nt, Human
aggacgcucucuggccu

SEQ ID NO: 1499676 - RNA, 19 nt, Human
aggacgcucucuggccuuc

SEQ ID NO: 1499677 - RNA, 20 nt, Human
aggacgcucucuggccuucg

SEQ ID NO: 1499678 - RNA, 15 nt, Human
ugauuaaguaaugau

SEQ ID NO: 1499679 - RNA, 16 nt, Human
ugauuaaguaaugaua

SEQ ID NO: 1499680 - RNA, 16 nt, Human
agccacggccaggcca

SEQ ID NO: 1499681 - RNA, 16 nt, Human
ugauuaaauucuugca

SEQ ID NO: 1499682 - RNA, 13 nt, Human
ugauuaaauucuu

SEQ ID NO: 1499683 - RNA, 17 nt, Human
ugauuaaauucuugcaa

SEQ ID NO: 1499684 - RNA, 21 nt, Human
ugauguuuuaaggaugcuugu

SEQ ID NO: 1499685 - RNA, 17 nt, Human
ugauguuuuccaugagu

SEQ ID NO: 1499686 - RNA, 23 nt, Human
ugauguuuuccaugaguccccug

SEQ ID NO: 1499687 - RNA, 19 nt, Human
ugauguuuuccaugagucc

SEQ ID NO: 1499688 - RNA, 14 nt, Human
ugauggggcccugc

SEQ ID NO: 1499689 - RNA, 22 nt, Human
ugauggggcccugccuccuuug

SEQ ID NO: 1499690 - RNA, 22 nt, Human
ugaugaaaugaggucagagccu

SEQ ID NO: 1499691 - RNA, 14 nt, Human
ugaucuaggaagac

SEQ ID NO: 1499692 - RNA, 15 nt, Human
ugaucuaggaagacu

SEQ ID NO: 1499693 - RNA, 23 nt, Human
ugaugaaaugaggucagagccug

SEQ ID NO: 1499694 - RNA, 19 nt, Human
ugaugaucuuugcagacag

SEQ ID NO: 1499695 - RNA, 20 nt, Human
ugaugaucuuugcagacagg

SEQ ID NO: 1499696 - RNA, 22 nt, Human
ugaugaucuuugcagacaggca

SEQ ID NO: 1499697 - RNA, 21 nt, Human
ugaugaucuuugcagacaggc

SEQ ID NO: 1499698 - RNA, 14 nt, Human
ugaugggaaagcau

SEQ ID NO: 1499699 - RNA, 22 nt, Human
ugaugggcaacccccagccugc

SEQ ID NO: 1499700 - RNA, 13 nt, Human
ugauggggcccug

SEQ ID NO: 1499701 - RNA, 18 nt, Human
ugauccucccaccucagc

SEQ ID NO: 1499702 - RNA, 13 nt, Human
ugaucuaggaaga

SEQ ID NO: 1499703 - RNA, 19 nt, Human
ugauccucccaccucagcc

SEQ ID NO: 1499704 - RNA, 20 nt, Human
ugauccucccaccucagccu

SEQ ID NO: 1499705 - RNA, 22 nt, Human
agccacaggccugagauuucau

SEQ ID NO: 1499706 - RNA, 23 nt, Human
agccacaggccugagauuucauc

SEQ ID NO: 1499707 - RNA, 14 nt, Human
agccacaggccuga

SEQ ID NO: 1499708 - RNA, 16 nt, Human
agccacaggccugaga

SEQ ID NO: 1499709 - RNA, 17 nt, Human
agccacaggccugagau

SEQ ID NO: 1499710 - RNA, 21 nt, Human
agccacaggccugagauuuca

SEQ ID NO: 1499711 - RNA, 13 nt, Human
agccacagcuggu

SEQ ID NO: 1499712 - RNA, 13 nt, Human
agccacaggccug

SEQ ID NO: 1499713 - RNA, 14 nt, Human
agcauccuggaaua

SEQ ID NO: 1499714 - RNA, 15 nt, Human
agcauccuggaauau

SEQ ID NO: 1499715 - RNA, 13 nt, Human
agcauccuggaau

SEQ ID NO: 1499716 - RNA, 23 nt, Human
agcaucaggccaggcccucugcc

SEQ ID NO: 1499717 - RNA, 22 nt, Human
agcaucaggccaggcccucugc

SEQ ID NO: 1499718 - RNA, 21 nt, Human
agcaucaggccaggcccucug

SEQ ID NO: 1499719 - RNA, 12 nt, Human
agcaucaggcca

SEQ ID NO: 1499720 - RNA, 17 nt, Human
agcaucacuugggauua

SEQ ID NO: 1499721 - RNA, 18 nt, Human
ugauacaaugcugugccc

SEQ ID NO: 1499722 - RNA, 18 nt, Human
ugaucacggcucacugca

SEQ ID NO: 1499723 - RNA, 15 nt, Human
ugaucacggcucacu

SEQ ID NO: 1499724 - RNA, 13 nt, Human
ugaucacggcuca

SEQ ID NO: 1499725 - RNA, 14 nt, Human
ugaucacggcucac

SEQ ID NO: 1499726 - RNA, 17 nt, Human
agcauauucaggaagcu

SEQ ID NO: 1499727 - RNA, 19 nt, Human
agcauauucaggaagcuca

SEQ ID NO: 1499728 - RNA, 21 nt, Human
agcauauucaggaagcucagg

SEQ ID NO: 1499729 - RNA, 17 nt, Human
agcauuuguguugaaga

SEQ ID NO: 1499730 - RNA, 18 nt, Human
agcauuuguguugaagag

SEQ ID NO: 1499731 - RNA, 22 nt, Human
agcauuuugcuaaaugugaaug

SEQ ID NO: 1499732 - RNA, 15 nt, Human
agcauuuugcuaaau

SEQ ID NO: 1499733 - RNA, 22 nt, Human
agcauuuagauguauagguuga

SEQ ID NO: 1499734 - RNA, 19 nt, Human
agcauuaugauguggguca

SEQ ID NO: 1499735 - RNA, 19 nt, Human
agcauggcugccaauggga

SEQ ID NO: 1499736 - RNA, 17 nt, Human
agcagucaggaaagaga

SEQ ID NO: 1499737 - RNA, 18 nt, Human
agcagucaggaaagagaa

SEQ ID NO: 1499738 - RNA, 19 nt, Human
agcagucaggaaagagaac

SEQ ID NO: 1499739 - RNA, 19 nt, Human
agcauaaaaauuagccaag

SEQ ID NO: 1499740 - RNA, 19 nt, Human
ugaguacguugugcauuug

SEQ ID NO: 1499741 - RNA, 18 nt, Human
ugaguacguugugcauuu

SEQ ID NO: 1499742 - RNA, 17 nt, Human
ugaguacguugugcauu

SEQ ID NO: 1499743 - RNA, 16 nt, Human
ugaguacguugugcau

SEQ ID NO: 1499744 - RNA, 19 nt, Human
agcauaccaacacgagcag

SEQ ID NO: 1499745 - RNA, 22 nt, Human
agcauaccaacacgagcaggcu

SEQ ID NO: 1499746 - RNA, 23 nt, Human
agcauaaaaauuagccaagugug

SEQ ID NO: 1499747 - RNA, 13 nt, Human
agcauaccaacac

SEQ ID NO: 1499748 - RNA, 21 nt, Human
ugagugggggaucacagccuc

SEQ ID NO: 1499749 - RNA, 23 nt, Human
ugagugggggaucacagccucug

SEQ ID NO: 1499750 - RNA, 15 nt, Human
ugauacaaugcugug

SEQ ID NO: 1499751 - RNA, 14 nt, Human
ugauacaaugcugu

SEQ ID NO: 1499752 - RNA, 15 nt, Human
ugaguucuacauaag

SEQ ID NO: 1499753 - RNA, 20 nt, Human
ugaguucuacauaaguaauu

SEQ ID NO: 1499754 - RNA, 22 nt, Human
ugaguucuacauaaguaauuca

SEQ ID NO: 1499755 - RNA, 16 nt, Human
ugauaaguaaaugcua

SEQ ID NO: 1499756 - RNA, 13 nt, Human
ugauaaguucaua

SEQ ID NO: 1499757 - RNA, 15 nt, Human
ugauaaguucauaca

SEQ ID NO: 1499758 - RNA, 17 nt, Human
ugauaaguucauacauu

SEQ ID NO: 1499759 - RNA, 19 nt, Human
ugauaaguucauacauugu

SEQ ID NO: 1499760 - RNA, 18 nt, Human
ugagucaccaagcccagu

SEQ ID NO: 1499761 - RNA, 20 nt, Human
ugaguacguugugcauuugg

SEQ ID NO: 1499762 - RNA, 14 nt, Human
ugaguacuacaguc

SEQ ID NO: 1499763 - RNA, 13 nt, Human
ugaguccagaagu

SEQ ID NO: 1499764 - RNA, 16 nt, Human
ugagugccuuacacaa

SEQ ID NO: 1499765 - RNA, 17 nt, Human
ugagugcagcucuggag

SEQ ID NO: 1499766 - RNA, 13 nt, Human
ugagugccuuaca

SEQ ID NO: 1499767 - RNA, 14 nt, Human
ugagugccuuacac

SEQ ID NO: 1499768 - RNA, 19 nt, Human
agcagggcauggcugggaa

SEQ ID NO: 1499769 - RNA, 20 nt, Human
agcagggagggcuucugcca

SEQ ID NO: 1499770 - RNA, 13 nt, Human
agcagggcucagc

SEQ ID NO: 1499771 - RNA, 14 nt, Human
agcagggcucagcg

SEQ ID NO: 1499772 - RNA, 15 nt, Human
agcagggcucagcgg

SEQ ID NO: 1499773 - RNA, 22 nt, Human
agcagggcucagcggggacagc

SEQ ID NO: 1499774 - RNA, 13 nt, Human
agcagggaaacag

SEQ ID NO: 1499775 - RNA, 14 nt, Human
agcagggaaacagc

SEQ ID NO: 1499776 - RNA, 15 nt, Human
agcagggaaacagcu

SEQ ID NO: 1499777 - RNA, 21 nt, Human
agcaggcucucaggccagcug

SEQ ID NO: 1499778 - RNA, 22 nt, Human
agcaggcucucaggccagcugc

SEQ ID NO: 1499779 - RNA, 23 nt, Human
agcaggcucucaggccagcugcu

SEQ ID NO: 1499780 - RNA, 17 nt, Human
agcaggcucgggcuccc

SEQ ID NO: 1499781 - RNA, 13 nt, Human
agcaggcucucag

SEQ ID NO: 1499782 - RNA, 14 nt, Human
agcaggcucucagg

SEQ ID NO: 1499783 - RNA, 15 nt, Human
agcaggcucucaggc

SEQ ID NO: 1499784 - RNA, 16 nt, Human
agcaggcucucaggcc

SEQ ID NO: 1499785 - RNA, 17 nt, Human
agcaggcucucaggcca

SEQ ID NO: 1499786 - RNA, 18 nt, Human
agcaggcucucaggccag

SEQ ID NO: 1499787 - RNA, 19 nt, Human
agcaggcucucaggccagc

SEQ ID NO: 1499788 - RNA, 20 nt, Human
ugacccaugcugcccuguga

SEQ ID NO: 1499789 - RNA, 18 nt, Human
ugacccaugcugcccugu

SEQ ID NO: 1499790 - RNA, 19 nt, Human
ugacccaugcugcccugug

SEQ ID NO: 1499791 - RNA, 16 nt, Human
agcagcagggagggcu

SEQ ID NO: 1499792 - RNA, 13 nt, Human
agcaggacaugga

SEQ ID NO: 1499793 - RNA, 15 nt, Human
agcagccacauuccu

SEQ ID NO: 1499794 - RNA, 11 nt, Human
agcagccacau

SEQ ID NO: 1499795 - RNA, 14 nt, Human
agcaggcuacuguc

SEQ ID NO: 1499796 - RNA, 16 nt, Human
agcaggcuacugucag

SEQ ID NO: 1499797 - RNA, 17 nt, Human
agcaggcuacugucagc

SEQ ID NO: 1499798 - RNA, 19 nt, Human
agcaggcuacugucagcuc

SEQ ID NO: 1499799 - RNA, 20 nt, Human
agcaggcuacugucagcucc

SEQ ID NO: 1499800 - RNA, 12 nt, Human
ugcagacaggca

SEQ ID NO: 1499801 - RNA, 13 nt, Human
ugcagacaggcaa

SEQ ID NO: 1499802 - RNA, 21 nt, Human
ugcagacaggcaagcaccucc

SEQ ID NO: 1499803 - RNA, 13 nt, Human
agccuccugcccu

SEQ ID NO: 1499804 - RNA, 14 nt, Human
agccuccugcccuu

SEQ ID NO: 1499805 - RNA, 18 nt, Human
agccuccugcccuuaccu

SEQ ID NO: 1499806 - RNA, 21 nt, Human
ugcagccucacaguccuuacc

SEQ ID NO: 1499807 - RNA, 18 nt, Human
ugcagccucacaguccuu

SEQ ID NO: 1499808 - RNA, 17 nt, Human
ugcauagagccacguau

SEQ ID NO: 1499809 - RNA, 20 nt, Human
ugcauagauucccugagcag

SEQ ID NO: 1499810 - RNA, 21 nt, Human
ugcauaccacuuuuguucuug

SEQ ID NO: 1499811 - RNA, 19 nt, Human
ugcauacucauuaggaugg

SEQ ID NO: 1499812 - RNA, 20 nt, Human
ugcauaccacuuuuguucuu

SEQ ID NO: 1499813 - RNA, 18 nt, Human
ugcauaccacuuuuguuc

SEQ ID NO: 1499814 - RNA, 16 nt, Human
ugcauaccacuuuugu

SEQ ID NO: 1499815 - RNA, 19 nt, Human
ugcaugcugucccuuacgu

SEQ ID NO: 1499816 - RNA, 21 nt, Human
ugcaugcugucccuuacguga

SEQ ID NO: 1499817 - RNA, 18 nt, Human
ugcaugcugucccuuacg

SEQ ID NO: 1499818 - RNA, 19 nt, Human
ugcauagagccacguaugu

SEQ ID NO: 1499819 - RNA, 20 nt, Human
ugcaugaaguaauaugcaca

SEQ ID NO: 1499820 - RNA, 19 nt, Human
ugcaugaagguuucugaaa

SEQ ID NO: 1499821 - RNA, 21 nt, Human
ugcaugaagguuucugaaaau

SEQ ID NO: 1499822 - RNA, 13 nt, Human
ugcaugaagguuu

SEQ ID NO: 1499823 - RNA, 18 nt, Human
ugcaugaagguuucugaa

SEQ ID NO: 1499824 - RNA, 17 nt, Human
agccugugccucuggga

SEQ ID NO: 1499825 - RNA, 18 nt, Human
agccugugccucugggac

SEQ ID NO: 1499826 - RNA, 19 nt, Human
agccugugccucugggacu

SEQ ID NO: 1499827 - RNA, 13 nt, Human
agccuugaacuuu

SEQ ID NO: 1499828 - RNA, 22 nt, Human
agccuuagaagucacacaguau

SEQ ID NO: 1499829 - RNA, 20 nt, Human
agccuuagaagucacacagu

SEQ ID NO: 1499830 - RNA, 22 nt, Human
agccuugaccauucuccaccug

SEQ ID NO: 1499831 - RNA, 18 nt, Human
agccuugaccauucucca

SEQ ID NO: 1499832 - RNA, 19 nt, Human
agccuugaccauucuccac

SEQ ID NO: 1499833 - RNA, 21 nt, Human
agccuugaccauucuccaccu

SEQ ID NO: 1499834 - RNA, 19 nt, Human
agccuugcggaagguucua

SEQ ID NO: 1499835 - RNA, 13 nt, Human
ugccauaauuacu

SEQ ID NO: 1499836 - RNA, 17 nt, Human
ugccaguuauggcuaua

SEQ ID NO: 1499837 - RNA, 17 nt, Human
ugccagccgagauagcc

SEQ ID NO: 1499838 - RNA, 22 nt, Human
ugccagccgagauagccaaggc

SEQ ID NO: 1499839 - RNA, 18 nt, Human
ugccaaugggagcucaug

SEQ ID NO: 1499840 - RNA, 13 nt, Human
ugccaauggacua

SEQ ID NO: 1499841 - RNA, 14 nt, Human
ugccaaugggagcu

SEQ ID NO: 1499842 - RNA, 16 nt, Human
ugcauuuaaaagauac

SEQ ID NO: 1499843 - RNA, 21 nt, Human
ugcaccacugcacuccagccu

SEQ ID NO: 1499844 - RNA, 13 nt, Human
ugcaccagcccuu

SEQ ID NO: 1499845 - RNA, 17 nt, Human
ugcacuccagccugagc

SEQ ID NO: 1499846 - RNA, 15 nt, Human
ugcacuccagccugg

SEQ ID NO: 1499847 - RNA, 16 nt, Human
ugcacuccagccuggg

SEQ ID NO: 1499848 - RNA, 15 nt, Human
ugcacuccagccuga

SEQ ID NO: 1499849 - RNA, 14 nt, Human
ugcacuccagccug

SEQ ID NO: 1499850 - RNA, 16 nt, Human
ugcaccggcuggccug

SEQ ID NO: 1499851 - RNA, 18 nt, Human
ugcaccggcuggccuggc

SEQ ID NO: 1499852 - RNA, 14 nt, Human
ugcaccggcuggcc

SEQ ID NO: 1499853 - RNA, 15 nt, Human
ugcaccggcuggccu

SEQ ID NO: 1499854 - RNA, 18 nt, Human
agccccgugggguuccuc

SEQ ID NO: 1499855 - RNA, 16 nt, Human
agccccgaggccuucu

SEQ ID NO: 1499856 - RNA, 14 nt, Human
agccccgaggccuu

SEQ ID NO: 1499857 - RNA, 14 nt, Human
agcccaggccuccu

SEQ ID NO: 1499858 - RNA, 19 nt, Human
agcccaggccuccuacagc

SEQ ID NO: 1499859 - RNA, 21 nt, Human
agcccaggccuccuacagcuu

SEQ ID NO: 1499860 - RNA, 16 nt, Human
agcccgggcucugccu

SEQ ID NO: 1499861 - RNA, 14 nt, Human
agcccugcagaggg

SEQ ID NO: 1499862 - RNA, 15 nt, Human
agcccugcagagggc

SEQ ID NO: 1499863 - RNA, 16 nt, Human
agcccugcagagggca

SEQ ID NO: 1499864 - RNA, 19 nt, Human
agcccugcagagggcacag

SEQ ID NO: 1499865 - RNA, 14 nt, Human
agccccuucugacc

SEQ ID NO: 1499866 - RNA, 15 nt, Human
agccccuucugaccc

SEQ ID NO: 1499867 - RNA, 16 nt, Human
agccccuucugaccca

SEQ ID NO: 1499868 - RNA, 19 nt, Human
agccccuucugacccaugc

SEQ ID NO: 1499869 - RNA, 13 nt, Human
agcccgggcucug

SEQ ID NO: 1499870 - RNA, 14 nt, Human
agcccgggcucugc

SEQ ID NO: 1499871 - RNA, 15 nt, Human
agcccgggcucugcc

SEQ ID NO: 1499872 - RNA, 15 nt, Human
ugcaaggucauuuuu

SEQ ID NO: 1499873 - RNA, 12 nt, Human
agcccaggccuc

SEQ ID NO: 1499874 - RNA, 15 nt, Human
ugcaagccagauuuu

SEQ ID NO: 1499875 - RNA, 21 nt, Human
ugcaagccagauuuuccugaa

SEQ ID NO: 1499876 - RNA, 19 nt, Human
ugcaaggaagccacagcug

SEQ ID NO: 1499877 - RNA, 20 nt, Human
ugcaaggaagccacagcugg

SEQ ID NO: 1499878 - RNA, 13 nt, Human
ugcaacaacaugu

SEQ ID NO: 1499879 - RNA, 15 nt, Human
ugcaacaacauguau

SEQ ID NO: 1499880 - RNA, 13 nt, Human
ugcaacaggcugg

SEQ ID NO: 1499881 - RNA, 17 nt, Human
agccacggccaggccag

SEQ ID NO: 1499882 - RNA, 18 nt, Human
agccacggccaggccaga

SEQ ID NO: 1499883 - RNA, 18 nt, Human
ugauuuccguuaaaauac

SEQ ID NO: 1499884 - RNA, 12 nt, Human
ugcaaaccauca

SEQ ID NO: 1499885 - RNA, 13 nt, Human
ugcaaaccaucau

SEQ ID NO: 1499886 - RNA, 20 nt, Human
ugcaaaguaucccuacugua

SEQ ID NO: 1499887 - RNA, 21 nt, Human
ugcaaaggguaucaggugcug

SEQ ID NO: 1499888 - RNA, 18 nt, Human
ugcaaaccaucauugaaa

SEQ ID NO: 1499889 - RNA, 20 nt, Human
ugcaaaccaucauugaaauc

SEQ ID NO: 1499890 - RNA, 18 nt, Human
ugcaaagcacugacuucu

SEQ ID NO: 1499891 - RNA, 20 nt, Human
ugcaaagcacugacuucuaa

SEQ ID NO: 1499892 - RNA, 22 nt, Human
ugcaaagcacugacuucuaagu

SEQ ID NO: 1499893 - RNA, 18 nt, Human
agaugcaguucugaagaa

SEQ ID NO: 1499894 - RNA, 19 nt, Human
agaugcaguucugaagaag

SEQ ID NO: 1499895 - RNA, 20 nt, Human
agaugcaguucugaagaaga

SEQ ID NO: 1499896 - RNA, 14 nt, Human
agaugcuagaacuc

SEQ ID NO: 1499897 - RNA, 15 nt, Human
agaugcuagaacucc

SEQ ID NO: 1499898 - RNA, 14 nt, Human
agaugcaccagccc

SEQ ID NO: 1499899 - RNA, 15 nt, Human
agaugcaccagcccu

SEQ ID NO: 1499900 - RNA, 16 nt, Human
agaugcuucucacugc

SEQ ID NO: 1499901 - RNA, 15 nt, Human
agaugcuucucacug

SEQ ID NO: 1499902 - RNA, 12 nt, Human
ugacccacugcu

SEQ ID NO: 1499903 - RNA, 13 nt, Human
ugacccacugcuu

SEQ ID NO: 1499904 - RNA, 17 nt, Human
ugacccacaagaaauga

SEQ ID NO: 1499905 - RNA, 13 nt, Human
agaucagccuggg

SEQ ID NO: 1499906 - RNA, 15 nt, Human
agaucagccugggca

SEQ ID NO: 1499907 - RNA, 18 nt, Human
ugacauaaaaacaacuuu

SEQ ID NO: 1499908 - RNA, 20 nt, Human
ugacauaaaaacaacuuuau

SEQ ID NO: 1499909 - RNA, 20 nt, Human
ugacauuguuggccaaagcc

SEQ ID NO: 1499910 - RNA, 21 nt, Human
ugacauuguuggccaaagcca

SEQ ID NO: 1499911 - RNA, 18 nt, Human
ugaccaaugauggucacc

SEQ ID NO: 1499912 - RNA, 17 nt, Human
ugacauaaaaacaacuu

SEQ ID NO: 1499913 - RNA, 21 nt, Human
ugacagggcacaccgggcacu

SEQ ID NO: 1499914 - RNA, 20 nt, Human
ugacagggcacaccgggcac

SEQ ID NO: 1499915 - RNA, 11 nt, Human
ugacagggcac

SEQ ID NO: 1499916 - RNA, 16 nt, Human
ugacagggcacaccgg

SEQ ID NO: 1499917 - RNA, 20 nt, Human
ugacaggcaaugcuggcugu

SEQ ID NO: 1499918 - RNA, 21 nt, Human
ugacacacagcucuguccugg

SEQ ID NO: 1499919 - RNA, 16 nt, Human
agaguuuagcuggaaa

SEQ ID NO: 1499920 - RNA, 17 nt, Human
agaguuuagcuggaaaa

SEQ ID NO: 1499921 - RNA, 16 nt, Human
agaguuguuacauuuu

SEQ ID NO: 1499922 - RNA, 12 nt, Human
agaguuguuaca

SEQ ID NO: 1499923 - RNA, 15 nt, Human
agagucuccauuuaa

SEQ ID NO: 1499924 - RNA, 14 nt, Human
agagugaacaaauu

SEQ ID NO: 1499925 - RNA, 17 nt, Human
agaguugauacuacagu

SEQ ID NO: 1499926 - RNA, 22 nt, Human
agaguugauacuacaguuuguu

SEQ ID NO: 1499927 - RNA, 20 nt, Human
agaguugauacuacaguuug

SEQ ID NO: 1499928 - RNA, 19 nt, Human
ugaaugucagugugacuga

SEQ ID NO: 1499929 - RNA, 20 nt, Human
ugaaugguuuucaaaauaaa

SEQ ID NO: 1499930 - RNA, 12 nt, Human
agauacugaaau

SEQ ID NO: 1499931 - RNA, 13 nt, Human
agauacugaaaua

SEQ ID NO: 1499932 - RNA, 15 nt, Human
agauacugaaauaaa

SEQ ID NO: 1499933 - RNA, 12 nt, Human
agauaaaugugc

SEQ ID NO: 1499934 - RNA, 14 nt, Human
agaucacgccacug

SEQ ID NO: 1499935 - RNA, 15 nt, Human
agaucacgccacugc

SEQ ID NO: 1499936 - RNA, 16 nt, Human
agaucacgccacugca

SEQ ID NO: 1499937 - RNA, 16 nt, Human
ugaauuuuacauggcu

SEQ ID NO: 1499938 - RNA, 15 nt, Human
ugaauuucuuuugcc

SEQ ID NO: 1499939 - RNA, 17 nt, Human
agaucacgccacugcac

SEQ ID NO: 1499940 - RNA, 18 nt, Human
agaucacgccacugcacu

SEQ ID NO: 1499941 - RNA, 12 nt, Human
agagguuuuaaa

SEQ ID NO: 1499942 - RNA, 22 nt, Human
ugaagcacagugaucaaguuau

SEQ ID NO: 1499943 - RNA, 15 nt, Human
agagguugcagugag

SEQ ID NO: 1499944 - RNA, 19 nt, Human
agaggccaugggccuccug

SEQ ID NO: 1499945 - RNA, 21 nt, Human
agaggcagggucucacucugu

SEQ ID NO: 1499946 - RNA, 10 nt, Human
agaggcaggg

SEQ ID NO: 1499947 - RNA, 13 nt, Human
agaggcagggucu

SEQ ID NO: 1499948 - RNA, 21 nt, Human
agaggcagccccauucugccu

SEQ ID NO: 1499949 - RNA, 13 nt, Human
agaggcagcccca

SEQ ID NO: 1499950 - RNA, 19 nt, Human
agaggcagccccauucugc

SEQ ID NO: 1499951 - RNA, 21 nt, Human
agagcuguucacagccagacu

SEQ ID NO: 1499952 - RNA, 16 nt, Human
ugaacuccuggccuca

SEQ ID NO: 1499953 - RNA, 22 nt, Human
ugaacuuugaccucugcagcaa

SEQ ID NO: 1499954 - RNA, 20 nt, Human
ugaacuuugaccucugcagc

SEQ ID NO: 1499955 - RNA, 19 nt, Human
ugaacuuugaccucugcag

SEQ ID NO: 1499956 - RNA, 12 nt, Human
ugaacuccuggc

SEQ ID NO: 1499957 - RNA, 14 nt, Human
ugaacuccuggccu

SEQ ID NO: 1499958 - RNA, 15 nt, Human
ugaacuccuggccuc

SEQ ID NO: 1499959 - RNA, 19 nt, Human
ugaacaaauuuacagagac

SEQ ID NO: 1499960 - RNA, 20 nt, Human
ugaacaaauuuacagagaca

SEQ ID NO: 1499961 - RNA, 15 nt, Human
ugaaauuuuuauuaa

SEQ ID NO: 1499962 - RNA, 21 nt, Human
agagcaccuuagacagucccu

SEQ ID NO: 1499963 - RNA, 12 nt, Human
agagcagagacc

SEQ ID NO: 1499964 - RNA, 14 nt, Human
agagcaaaauugau

SEQ ID NO: 1499965 - RNA, 20 nt, Human
agagcaaaauugauguguuu

SEQ ID NO: 1499966 - RNA, 17 nt, Human
ucuuuggacccugaggc

SEQ ID NO: 1499967 - RNA, 21 nt, Human
ucuuuggacccugaggcccag

SEQ ID NO: 1499968 - RNA, 11 nt, Human
agagccuugcg

SEQ ID NO: 1499969 - RNA, 21 nt, Human
agagccuugcggaagguucua

SEQ ID NO: 1499970 - RNA, 20 nt, Human
agagcagagaccaucccuga

SEQ ID NO: 1499971 - RNA, 17 nt, Human
agagcagagaccauccc

SEQ ID NO: 1499972 - RNA, 18 nt, Human
agagcagagaccaucccu

SEQ ID NO: 1499973 - RNA, 23 nt, Human
ugaaauuuccugggagcuuuugu

SEQ ID NO: 1499974 - RNA, 15 nt, Human
ugaaauuguauuaca

SEQ ID NO: 1499975 - RNA, 18 nt, Human
ugaaauauuauguuaaaa

SEQ ID NO: 1499976 - RNA, 18 nt, Human
agagcugccaccugccug

SEQ ID NO: 1499977 - RNA, 17 nt, Human
ugaaauaagccagacau

SEQ ID NO: 1499978 - RNA, 18 nt, Human
ugaaauaagccagacauc

SEQ ID NO: 1499979 - RNA, 20 nt, Human
ugaaauaagccagacaucaa

SEQ ID NO: 1499980 - RNA, 23 nt, Human
ugaaauaagccagacaucaacag

SEQ ID NO: 1499981 - RNA, 15 nt, Human
ucuguccccuucucu

SEQ ID NO: 1499982 - RNA, 19 nt, Human
ucuguccccuucucucauc

SEQ ID NO: 1499983 - RNA, 20 nt, Human
ucuguccccuucucucaucu

SEQ ID NO: 1499984 - RNA, 21 nt, Human
ucuguccccuucucucaucuc

SEQ ID NO: 1499985 - RNA, 22 nt, Human
ucuguccccuucucucaucucu

SEQ ID NO: 1499986 - RNA, 19 nt, Human
ucuguuuagauaauacacc

SEQ ID NO: 1499987 - RNA, 16 nt, Human
ucuguuuagauaauac

SEQ ID NO: 1499988 - RNA, 23 nt, Human
ucuguuuagauaauacaccacua

SEQ ID NO: 1499989 - RNA, 23 nt, Human
agaaccccaggguccuguagccc

SEQ ID NO: 1499990 - RNA, 21 nt, Human
agaauguguuuaaacuugguu

SEQ ID NO: 1499991 - RNA, 19 nt, Human
agaauuaguggcacuugcu

SEQ ID NO: 1499992 - RNA, 14 nt, Human
agaauucucuaguu

SEQ ID NO: 1499993 - RNA, 18 nt, Human
agaauucucuaguuugau

SEQ ID NO: 1499994 - RNA, 20 nt, Human
agaauuauaauuaguuccuc

SEQ ID NO: 1499995 - RNA, 20 nt, Human
agaauucucagaaucucaaa

SEQ ID NO: 1499996 - RNA, 13 nt, Human
agacagcugccug

SEQ ID NO: 1499997 - RNA, 14 nt, Human
agacagcugccugg

SEQ ID NO: 1499998 - RNA, 23 nt, Human
agacacaggcccggcuccaggcu

SEQ ID NO: 1499999 - RNA, 21 nt, Human
agacacauguccaagaagccc

SEQ ID NO: 1500000 - RNA, 22 nt, Human
agacacauguccaagaagccca

SEQ ID NO: 1500001 - RNA, 22 nt, Human
agacaccuugacagggcacacc

SEQ ID NO: 1500002 - RNA, 24 nt, Human
agacacauguccaagaagcccagg

SEQ ID NO: 1500003 - RNA, 16 nt, Human
agacacacugaagaag

SEQ ID NO: 1500004 - RNA, 17 nt, Human
agacacacugaagaagc

SEQ ID NO: 1500005 - RNA, 17 nt, Human
agacacaggcccggcuc

SEQ ID NO: 1500006 - RNA, 19 nt, Human
agacacaggcccggcucca

SEQ ID NO: 1500007 - RNA, 20 nt, Human
agacacaggcccggcuccag

SEQ ID NO: 1500008 - RNA, 21 nt, Human
agacacaggcccggcuccagg

SEQ ID NO: 1500009 - RNA, 22 nt, Human
agacacaggcccggcuccaggc

SEQ ID NO: 1500010 - RNA, 19 nt, Human
agaauucucuaguuugauu

SEQ ID NO: 1500011 - RNA, 17 nt, Human
agaauucucuuauccaa

SEQ ID NO: 1500012 - RNA, 14 nt, Human
agacacaagccuuc

SEQ ID NO: 1500013 - RNA, 13 nt, Human
agacacaagccuu

SEQ ID NO: 1500014 - RNA, 20 nt, Human
agacacaacuauuuuuccaa

SEQ ID NO: 1500015 - RNA, 23 nt, Human
ucuuagaugcaguucugaagaag

SEQ ID NO: 1500016 - RNA, 12 nt, Human
ucuuagauguau

SEQ ID NO: 1500017 - RNA, 14 nt, Human
ucuuagauguauau

SEQ ID NO: 1500018 - RNA, 14 nt, Human
ucuuacaaacaugu

SEQ ID NO: 1500019 - RNA, 14 nt, Human
ucuuaauuaaaaga

SEQ ID NO: 1500020 - RNA, 13 nt, Human
agacagucccugc

SEQ ID NO: 1500021 - RNA, 14 nt, Human
agacagucccugcc

SEQ ID NO: 1500022 - RNA, 15 nt, Human
agacagcugccuggg

SEQ ID NO: 1500023 - RNA, 16 nt, Human
agacagcugccuggga

SEQ ID NO: 1500024 - RNA, 12 nt, Human
agacagucccug

SEQ ID NO: 1500025 - RNA, 14 nt, Human
agacauagaauuaa

SEQ ID NO: 1500026 - RNA, 23 nt, Human
ucuucuguacgucugacaggcaa

SEQ ID NO: 1500027 - RNA, 23 nt, Human
agacauacuaaccagcagaaaug

SEQ ID NO: 1500028 - RNA, 16 nt, Human
ucuuauuucauuucuu

SEQ ID NO: 1500029 - RNA, 15 nt, Human
ucuuauuucauuucu

SEQ ID NO: 1500030 - RNA, 21 nt, Human
ucuucuguacgucugacaggc

SEQ ID NO: 1500031 - RNA, 22 nt, Human
ucuucuguacgucugacaggca

SEQ ID NO: 1500032 - RNA, 22 nt, Human
ucuucugcuucagccucccgag

SEQ ID NO: 1500033 - RNA, 14 nt, Human
agacccggcugcgu

SEQ ID NO: 1500034 - RNA, 17 nt, Human
ucuugagccuugaacuu

SEQ ID NO: 1500035 - RNA, 15 nt, Human
agacucauucuucug

SEQ ID NO: 1500036 - RNA, 19 nt, Human
ucuugagccuugaacuuug

SEQ ID NO: 1500037 - RNA, 18 nt, Human
ucuugagccuugaacuuu

SEQ ID NO: 1500038 - RNA, 20 nt, Human
ucuugagccuugaacuuuga

SEQ ID NO: 1500039 - RNA, 21 nt, Human
agacucgcgacaaugcaaacc

SEQ ID NO: 1500040 - RNA, 20 nt, Human
agacucgcgacaaugcaaac

SEQ ID NO: 1500041 - RNA, 15 nt, Human
agacuguacaaagua

SEQ ID NO: 1500042 - RNA, 16 nt, Human
agacuguacaaaguag

SEQ ID NO: 1500043 - RNA, 24 nt, Human
agagacagaaagcagaacagugau

SEQ ID NO: 1500044 - RNA, 15 nt, Human
agagacacaagccuu

SEQ ID NO: 1500045 - RNA, 22 nt, Human
agagaaaaaauauuuuccugcc

SEQ ID NO: 1500046 - RNA, 22 nt, Human
ucuuuaaugucacaggcagguc

SEQ ID NO: 1500047 - RNA, 16 nt, Human
ucuugguuuguaaauu

SEQ ID NO: 1500048 - RNA, 20 nt, Human
ucuuuaaugucacaggcagg

SEQ ID NO: 1500049 - RNA, 14 nt, Human
ucuugguuuguaaa

SEQ ID NO: 1500050 - RNA, 20 nt, Human
ucuugaucaacaucuuuucu

SEQ ID NO: 1500051 - RNA, 23 nt, Human
ucuugaucaacaucuuuucuugc

SEQ ID NO: 1500052 - RNA, 17 nt, Human
ucuugaucaacaucuuu

SEQ ID NO: 1500053 - RNA, 18 nt, Human
ucuugaucaacaucuuuu

SEQ ID NO: 1500054 - RNA, 19 nt, Human
ucuugaucaacaucuuuuc

SEQ ID NO: 1500055 - RNA, 19 nt, Human
ucuuucuggcuaugcauuu

SEQ ID NO: 1500056 - RNA, 18 nt, Human
ucuuucuggcuaugcauu

SEQ ID NO: 1500057 - RNA, 20 nt, Human
ucuuuauaauucuacuuuga

SEQ ID NO: 1500058 - RNA, 13 nt, Human
ucuuucugcuuug

SEQ ID NO: 1500059 - RNA, 14 nt, Human
agacucgagaacuu

SEQ ID NO: 1500060 - RNA, 15 nt, Human
agacucgagaacuuu

SEQ ID NO: 1500061 - RNA, 18 nt, Human
agacucgagaacuuucau

SEQ ID NO: 1500062 - RNA, 19 nt, Human
agacucgagaacuuucauu

SEQ ID NO: 1500063 - RNA, 15 nt, Human
agacucgcgacaaug

SEQ ID NO: 1500064 - RNA, 17 nt, Human
agacucgcgacaaugca

SEQ ID NO: 1500065 - RNA, 18 nt, Human
agacucgcgacaaugcaa

SEQ ID NO: 1500066 - RNA, 19 nt, Human
agacucgcgacaaugcaaa

SEQ ID NO: 1500067 - RNA, 13 nt, Human
ucugauacagaaa

SEQ ID NO: 1500068 - RNA, 18 nt, Human
ucugauucccaagcucug

SEQ ID NO: 1500069 - RNA, 18 nt, Human
ucugcacuccccugcugg

SEQ ID NO: 1500070 - RNA, 19 nt, Human
ucugcacuccccugcuggg

SEQ ID NO: 1500071 - RNA, 14 nt, Human
ucugacuaugacau

SEQ ID NO: 1500072 - RNA, 23 nt, Human
ucugagacucgcgacaaugcaaa

SEQ ID NO: 1500073 - RNA, 16 nt, Human
ucugacuaugacauaa

SEQ ID NO: 1500074 - RNA, 20 nt, Human
ucugcacuccccugcugggu

SEQ ID NO: 1500075 - RNA, 22 nt, Human
ucugcacuccccugcugggugu

SEQ ID NO: 1500076 - RNA, 14 nt, Human
agaaauauaauuga

SEQ ID NO: 1500077 - RNA, 19 nt, Human
agaaauaucugaaaaugua

SEQ ID NO: 1500078 - RNA, 20 nt, Human
agaaauaucugaaaauguau

SEQ ID NO: 1500079 - RNA, 17 nt, Human
agaaaucaaagagagaa

SEQ ID NO: 1500080 - RNA, 14 nt, Human
agaaagaaaaucag

SEQ ID NO: 1500081 - RNA, 14 nt, Human
agaaaugaaagcag

SEQ ID NO: 1500082 - RNA, 12 nt, Human
ucugaagaagau

SEQ ID NO: 1500083 - RNA, 12 nt, Human
ucugacacacag

SEQ ID NO: 1500084 - RNA, 17 nt, Human
ucucucacuuguuuuau

SEQ ID NO: 1500085 - RNA, 21 nt, Human
ucucucacuuguuuuauuuaa

SEQ ID NO: 1500086 - RNA, 13 nt, Human
ucucucacuccuu

SEQ ID NO: 1500087 - RNA, 15 nt, Human
ucucucacuccuuga

SEQ ID NO: 1500088 - RNA, 14 nt, Human
acuuucugaaauaa

SEQ ID NO: 1500089 - RNA, 18 nt, Human
acuuugaccucugcagca

SEQ ID NO: 1500090 - RNA, 16 nt, Human
acuuugaccucugcag

SEQ ID NO: 1500091 - RNA, 15 nt, Human
acuuugaccucugca

SEQ ID NO: 1500092 - RNA, 14 nt, Human
ucucucaucucuua

SEQ ID NO: 1500093 - RNA, 19 nt, Human
ucucucaucucuuagcucc

SEQ ID NO: 1500094 - RNA, 23 nt, Human
ucucucaucucuuagcuccccuc

SEQ ID NO: 1500095 - RNA, 22 nt, Human
ucucucaucucuuagcuccccu

SEQ ID NO: 1500096 - RNA, 17 nt, Human
ucucuccagccccugga

SEQ ID NO: 1500097 - RNA, 18 nt, Human
ucucuccagccccuggau

SEQ ID NO: 1500098 - RNA, 19 nt, Human
ucucuccagccccuggaug

SEQ ID NO: 1500099 - RNA, 12 nt, Human
ucucuggccuuc

SEQ ID NO: 1500100 - RNA, 17 nt, Human
ucucuccuguaccucuu

SEQ ID NO: 1500101 - RNA, 16 nt, Human
ucucuccuguaccucu

SEQ ID NO: 1500102 - RNA, 14 nt, Human
ucucuccuguaccu

SEQ ID NO: 1500103 - RNA, 15 nt, Human
ucucugcccuccaag

SEQ ID NO: 1500104 - RNA, 16 nt, Human
ucucugcccuccaaga

SEQ ID NO: 1500105 - RNA, 17 nt, Human
ucucugcccuccaagac

SEQ ID NO: 1500106 - RNA, 18 nt, Human
agaaaaaggaugcacaga

SEQ ID NO: 1500107 - RNA, 17 nt, Human
agaaaaaggaugcacag

SEQ ID NO: 1500108 - RNA, 16 nt, Human
ucucuugguccugcug

SEQ ID NO: 1500109 - RNA, 13 nt, Human
agaaaaagaaaaa

SEQ ID NO: 1500110 - RNA, 20 nt, Human
ucucuuuaaugucacaggca

SEQ ID NO: 1500111 - RNA, 21 nt, Human
ucucuuuaaugucacaggcag

SEQ ID NO: 1500112 - RNA, 21 nt, Human
ucucuggccuucggccuccau

SEQ ID NO: 1500113 - RNA, 22 nt, Human
ucucuggccuucggccuccauc

SEQ ID NO: 1500114 - RNA, 23 nt, Human
ucucuggccuucggccuccaucc

SEQ ID NO: 1500115 - RNA, 13 nt, Human
ucucuggccuucg

SEQ ID NO: 1500116 - RNA, 18 nt, Human
ucucuugagccugggagg

SEQ ID NO: 1500117 - RNA, 14 nt, Human
ucucuugauucaua

SEQ ID NO: 1500118 - RNA, 16 nt, Human
ucucuugauucauaau

SEQ ID NO: 1500119 - RNA, 12 nt, Human
ucucaggaaauc

SEQ ID NO: 1500120 - RNA, 12 nt, Human
ucucagggccug

SEQ ID NO: 1500121 - RNA, 13 nt, Human
ucucagggccugg

SEQ ID NO: 1500122 - RNA, 19 nt, Human
ucucagggccuggucguuu

SEQ ID NO: 1500123 - RNA, 14 nt, Human
ucucagggccuggu

SEQ ID NO: 1500124 - RNA, 15 nt, Human
ucucagggccugguc

SEQ ID NO: 1500125 - RNA, 22 nt, Human
ucuccaaaauaaaacuuuuuaa

SEQ ID NO: 1500126 - RNA, 19 nt, Human
ucuccaaaauaaaacuuuu

SEQ ID NO: 1500127 - RNA, 17 nt, Human
ucuccaaaauaaaacuu

SEQ ID NO: 1500128 - RNA, 23 nt, Human
ucuccaaccccccagcacugagg

SEQ ID NO: 1500129 - RNA, 21 nt, Human
ucuccaaccccccagcacuga

SEQ ID NO: 1500130 - RNA, 22 nt, Human
ucuccaaccccccagcacugag

SEQ ID NO: 1500131 - RNA, 15 nt, Human
ucuccaagcaggaca

SEQ ID NO: 1500132 - RNA, 17 nt, Human
ucuccaaccccccagca

SEQ ID NO: 1500133 - RNA, 18 nt, Human
ucuccaaccccccagcac

SEQ ID NO: 1500134 - RNA, 19 nt, Human
ucuccaaccccccagcacu

SEQ ID NO: 1500135 - RNA, 20 nt, Human
ucuccaaccccccagcacug

SEQ ID NO: 1500136 - RNA, 16 nt, Human
ucuccaggcuguaucc

SEQ ID NO: 1500137 - RNA, 16 nt, Human
acuuguguuuugcaag

SEQ ID NO: 1500138 - RNA, 21 nt, Human
ucuccuccuuuucacaguucu

SEQ ID NO: 1500139 - RNA, 14 nt, Human
acuuugaccucugc

SEQ ID NO: 1500140 - RNA, 17 nt, Human
acuuucuagccagagga

SEQ ID NO: 1500141 - RNA, 16 nt, Human
ucuccauguuugaugu

SEQ ID NO: 1500142 - RNA, 16 nt, Human
acuugucaauaaaauc

SEQ ID NO: 1500143 - RNA, 16 nt, Human
acuuguggacacagcu

SEQ ID NO: 1500144 - RNA, 17 nt, Human
acuuguggacacagcuc

SEQ ID NO: 1500145 - RNA, 18 nt, Human
acuuguggacacagcucu

SEQ ID NO: 1500146 - RNA, 19 nt, Human
acuugagcccagagugaac

SEQ ID NO: 1500147 - RNA, 21 nt, Human
acuugaacccgggaggcagag

SEQ ID NO: 1500148 - RNA, 20 nt, Human
acuugaauaaccaucugaaa

SEQ ID NO: 1500149 - RNA, 19 nt, Human
acuugaauaaccaucugaa

SEQ ID NO: 1500150 - RNA, 21 nt, Human
acuugaacccauauuuguaca

SEQ ID NO: 1500151 - RNA, 19 nt, Human
acuugaacccgggaggcag

SEQ ID NO: 1500152 - RNA, 20 nt, Human
acuugaacccgggaggcaga

SEQ ID NO: 1500153 - RNA, 18 nt, Human
acuucuccacccugcucu

SEQ ID NO: 1500154 - RNA, 15 nt, Human
acuucuccacccugc

SEQ ID NO: 1500155 - RNA, 16 nt, Human
acuucuccacccugcu

SEQ ID NO: 1500156 - RNA, 21 nt, Human
ucucacagcuccaagaauuuc

SEQ ID NO: 1500157 - RNA, 11 nt, Human
ucucacuccuu

SEQ ID NO: 1500158 - RNA, 11 nt, Human
acuucagcuga

SEQ ID NO: 1500159 - RNA, 16 nt, Human
acuucagcugacuuuu

SEQ ID NO: 1500160 - RNA, 14 nt, Human
acuucuccacccug

SEQ ID NO: 1500161 - RNA, 23 nt, Human
acuucuaaguaaaaccacagcag

SEQ ID NO: 1500162 - RNA, 16 nt, Human
ucucacuauguugccc

SEQ ID NO: 1500163 - RNA, 13 nt, Human
ucucacuccuuga

SEQ ID NO: 1500164 - RNA, 16 nt, Human
ucucacucugucgccc

SEQ ID NO: 1500165 - RNA, 12 nt, Human
ucucacucuguc

SEQ ID NO: 1500166 - RNA, 15 nt, Human
uccuucagugccuua

SEQ ID NO: 1500167 - RNA, 20 nt, Human
uccuucagugccuuauggaa

SEQ ID NO: 1500168 - RNA, 16 nt, Human
uccuucagugccuuau

SEQ ID NO: 1500169 - RNA, 17 nt, Human
uccuucagugccuuaug

SEQ ID NO: 1500170 - RNA, 23 nt, Human
uccuuguguuacuaaguuuuuau

SEQ ID NO: 1500171 - RNA, 14 nt, Human
uccuuguguuacua

SEQ ID NO: 1500172 - RNA, 15 nt, Human
uccuuuagcgcccag

SEQ ID NO: 1500173 - RNA, 19 nt, Human
uccuuuagcgcccaguugg

SEQ ID NO: 1500174 - RNA, 22 nt, Human
uccuuuagcgcccaguugggug

SEQ ID NO: 1500175 - RNA, 23 nt, Human
uccuuuagcgcccaguugggugg

SEQ ID NO: 1500176 - RNA, 14 nt, Human
ucgagaacuuucau

SEQ ID NO: 1500177 - RNA, 22 nt, Human
ucgagaacuuucauuuuuuucc

SEQ ID NO: 1500178 - RNA, 15 nt, Human
ucgagaacuuucauu

SEQ ID NO: 1500179 - RNA, 16 nt, Human
ucgagaacuuucauuu

SEQ ID NO: 1500180 - RNA, 16 nt, Human
ucgagcaugccuggau

SEQ ID NO: 1500181 - RNA, 18 nt, Human
ucgagcaugccuggaugg

SEQ ID NO: 1500182 - RNA, 19 nt, Human
ucgcgacaaugcaaaccau

SEQ ID NO: 1500183 - RNA, 13 nt, Human
ucgaggacaggga

SEQ ID NO: 1500184 - RNA, 16 nt, Human
ucgcgacaaugcaaac

SEQ ID NO: 1500185 - RNA, 13 nt, Human
acugccuucucaa

SEQ ID NO: 1500186 - RNA, 19 nt, Human
acugccuucucaacuccaa

SEQ ID NO: 1500187 - RNA, 20 nt, Human
acugccuucucaacuccaaa

SEQ ID NO: 1500188 - RNA, 18 nt, Human
acugcuuaacuucacaua

SEQ ID NO: 1500189 - RNA, 16 nt, Human
acugcuuguguuuuua

SEQ ID NO: 1500190 - RNA, 17 nt, Human
acugcuuccagugaggc

SEQ ID NO: 1500191 - RNA, 20 nt, Human
acugcuuaacuucacauauu

SEQ ID NO: 1500192 - RNA, 14 nt, Human
acugcuuuuggucu

SEQ ID NO: 1500193 - RNA, 18 nt, Human
acugcuuguguuuuuaac

SEQ ID NO: 1500194 - RNA, 21 nt, Human
acuggcacaguuuucugagaa

SEQ ID NO: 1500195 - RNA, 19 nt, Human
acuggcacaguuuucugag

SEQ ID NO: 1500196 - RNA, 20 nt, Human
acuggcacaguuuucugaga

SEQ ID NO: 1500197 - RNA, 13 nt, Human
acuggcacaguuu

SEQ ID NO: 1500198 - RNA, 22 nt, Human
acuggauuaaacuuaaucuaaa

SEQ ID NO: 1500199 - RNA, 15 nt, Human
acuggauuaaacuua

SEQ ID NO: 1500200 - RNA, 15 nt, Human
acugcauuauauuua

SEQ ID NO: 1500201 - RNA, 14 nt, Human
acugcauuauauuu

SEQ ID NO: 1500202 - RNA, 20 nt, Human
acugcaucaagaugugacau

SEQ ID NO: 1500203 - RNA, 22 nt, Human
acugcaucaagaugugacaugu

SEQ ID NO: 1500204 - RNA, 16 nt, Human
acugcauguuugugau

SEQ ID NO: 1500205 - RNA, 15 nt, Human
acugcauguuuguga

SEQ ID NO: 1500206 - RNA, 16 nt, Human
acugcauaugaaagga

SEQ ID NO: 1500207 - RNA, 21 nt, Human
uccuagaaauuccccacccug

SEQ ID NO: 1500208 - RNA, 22 nt, Human
uccuagaaauuccccacccuga

SEQ ID NO: 1500209 - RNA, 20 nt, Human
ucuaaagccauuguaguccu

SEQ ID NO: 1500210 - RNA, 13 nt, Human
ucuaaagcugcca

SEQ ID NO: 1500211 - RNA, 14 nt, Human
ucuaaagcugccag

SEQ ID NO: 1500212 - RNA, 16 nt, Human
ucuaaagcugccagcc

SEQ ID NO: 1500213 - RNA, 15 nt, Human
ucuaaagcugccagc

SEQ ID NO: 1500214 - RNA, 21 nt, Human
ucuaaguaaaaccacagcagu

SEQ ID NO: 1500215 - RNA, 22 nt, Human
ucuaaguaaaaccacagcaguu

SEQ ID NO: 1500216 - RNA, 23 nt, Human
ucuaaguaaaaccacagcaguug

SEQ ID NO: 1500217 - RNA, 17 nt, Human
ucuacauaaguaauuca

SEQ ID NO: 1500218 - RNA, 20 nt, Human
ucuacauaaguaauucaaga

SEQ ID NO: 1500219 - RNA, 16 nt, Human
ucuacauacuauggaa

SEQ ID NO: 1500220 - RNA, 22 nt, Human
ucuacauaaguaauucaagaaa

SEQ ID NO: 1500221 - RNA, 21 nt, Human
acuguucucugcccuccaaga

SEQ ID NO: 1500222 - RNA, 15 nt, Human
acuguucucugcccu

SEQ ID NO: 1500223 - RNA, 20 nt, Human
acuguucucugcccuccaag

SEQ ID NO: 1500224 - RNA, 14 nt, Human
acuguucucugccc

SEQ ID NO: 1500225 - RNA, 16 nt, Human
acuuaaauaaugugaa

SEQ ID NO: 1500226 - RNA, 18 nt, Human
acuuaaauaaugugaaac

SEQ ID NO: 1500227 - RNA, 17 nt, Human
acuuaaauaaugugaaa

SEQ ID NO: 1500228 - RNA, 13 nt, Human
acuguugcccagg

SEQ ID NO: 1500229 - RNA, 14 nt, Human
acuguugcccaggc

SEQ ID NO: 1500230 - RNA, 17 nt, Human
acuguugcccaggcugg

SEQ ID NO: 1500231 - RNA, 18 nt, Human
acuguugcccaggcuggc

SEQ ID NO: 1500232 - RNA, 15 nt, Human
acuuauagauugaaa

SEQ ID NO: 1500233 - RNA, 16 nt, Human
acuuaaucuaaaugga

SEQ ID NO: 1500234 - RNA, 15 nt, Human
acuuaaucuaaaugg

SEQ ID NO: 1500235 - RNA, 13 nt, Human
acuuaaucuaaau

SEQ ID NO: 1500236 - RNA, 18 nt, Human
acuguggguagacacaca

SEQ ID NO: 1500237 - RNA, 21 nt, Human
acugucagcuccccucggaga

SEQ ID NO: 1500238 - RNA, 18 nt, Human
acugggacaggggagaac

SEQ ID NO: 1500239 - RNA, 22 nt, Human
acugucagcuccccucggagaa

SEQ ID NO: 1500240 - RNA, 17 nt, Human
acuguccuacccacccu

SEQ ID NO: 1500241 - RNA, 18 nt, Human
acuguccuacccacccuc

SEQ ID NO: 1500242 - RNA, 23 nt, Human
acuguccuacccacccuccuuuc

SEQ ID NO: 1500243 - RNA, 13 nt, Human
ucgguccuggugc

SEQ ID NO: 1500244 - RNA, 16 nt, Human
ucgguccuggugcccu

SEQ ID NO: 1500245 - RNA, 17 nt, Human
ucgggaggucgaggcag

SEQ ID NO: 1500246 - RNA, 19 nt, Human
ucgggaggucgaggcagga

SEQ ID NO: 1500247 - RNA, 21 nt, Human
ucgggaggucgaggcaggagg

SEQ ID NO: 1500248 - RNA, 22 nt, Human
ucggguuuuauuguuuaaaauc

SEQ ID NO: 1500249 - RNA, 11 nt, Human
ucgggcaugac

SEQ ID NO: 1500250 - RNA, 12 nt, Human
ucgggcaugaca

SEQ ID NO: 1500251 - RNA, 17 nt, Human
uccggucccugucccag

SEQ ID NO: 1500252 - RNA, 16 nt, Human
uccuagaaauucccca

SEQ ID NO: 1500253 - RNA, 12 nt, Human
ucccuuuuccuu

SEQ ID NO: 1500254 - RNA, 19 nt, Human
ucccuuucugcuuguguua

SEQ ID NO: 1500255 - RNA, 23 nt, Human
ucccuuucuccccugcccccagg

SEQ ID NO: 1500256 - RNA, 17 nt, Human
ucccuuacgugaguccu

SEQ ID NO: 1500257 - RNA, 14 nt, Human
ucccuuucuccccu

SEQ ID NO: 1500258 - RNA, 15 nt, Human
ucccuuucuccccug

SEQ ID NO: 1500259 - RNA, 16 nt, Human
ucccuuucuccccugc

SEQ ID NO: 1500260 - RNA, 17 nt, Human
ucccuuucuccccugcc

SEQ ID NO: 1500261 - RNA, 18 nt, Human
ucccuuucuccccugccc

SEQ ID NO: 1500262 - RNA, 21 nt, Human
acuccugcaggcagccaggcc

SEQ ID NO: 1500263 - RNA, 15 nt, Human
ucccugguggcagcu

SEQ ID NO: 1500264 - RNA, 12 nt, Human
ucccugucccag

SEQ ID NO: 1500265 - RNA, 15 nt, Human
acucauucuucugua

SEQ ID NO: 1500266 - RNA, 14 nt, Human
acucauugaccuga

SEQ ID NO: 1500267 - RNA, 15 nt, Human
acucauugaccugag

SEQ ID NO: 1500268 - RNA, 14 nt, Human
acuccaaagaaaug

SEQ ID NO: 1500269 - RNA, 15 nt, Human
acuccaaagaaaugu

SEQ ID NO: 1500270 - RNA, 18 nt, Human
acuccaaagaaauguaag

SEQ ID NO: 1500271 - RNA, 15 nt, Human
acuccagaauuuccc

SEQ ID NO: 1500272 - RNA, 17 nt, Human
acuccagaauuucccaa

SEQ ID NO: 1500273 - RNA, 21 nt, Human
acuccaaagaaauguaaggga

SEQ ID NO: 1500274 - RNA, 18 nt, Human
acuccugcaggcagccag

SEQ ID NO: 1500275 - RNA, 19 nt, Human
acuccugcaggcagccagg

SEQ ID NO: 1500276 - RNA, 23 nt, Human
acuccagaauuucccaaagcagu

SEQ ID NO: 1500277 - RNA, 12 nt, Human
acuccagccugg

SEQ ID NO: 1500278 - RNA, 13 nt, Human
acuccagccuggg

SEQ ID NO: 1500279 - RNA, 17 nt, Human
acuacucccccaggugg

SEQ ID NO: 1500280 - RNA, 12 nt, Human
acucaccccagc

SEQ ID NO: 1500281 - RNA, 20 nt, Human
ucccgaauagcugggacuac

SEQ ID NO: 1500282 - RNA, 15 nt, Human
ucccgaguagcuggg

SEQ ID NO: 1500283 - RNA, 20 nt, Human
ucccgaguagcugggacuac

SEQ ID NO: 1500284 - RNA, 18 nt, Human
ucccgaguagcugggacu

SEQ ID NO: 1500285 - RNA, 16 nt, Human
ucccgaguagcuggga

SEQ ID NO: 1500286 - RNA, 17 nt, Human
ucccgaguagcugggac

SEQ ID NO: 1500287 - RNA, 16 nt, Human
uccccucggagaagag

SEQ ID NO: 1500288 - RNA, 17 nt, Human
uccccucggagaagagc

SEQ ID NO: 1500289 - RNA, 21 nt, Human
ucccucuuucccucccuuccu

SEQ ID NO: 1500290 - RNA, 11 nt, Human
ucccugaaggc

SEQ ID NO: 1500291 - RNA, 15 nt, Human
ucccugaaggccccg

SEQ ID NO: 1500292 - RNA, 18 nt, Human
ucccucuuucccucccuu

SEQ ID NO: 1500293 - RNA, 20 nt, Human
ucccucuuucccucccuucc

SEQ ID NO: 1500294 - RNA, 11 nt, Human
ucccugagcag

SEQ ID NO: 1500295 - RNA, 16 nt, Human
ucccugaaggccccgc

SEQ ID NO: 1500296 - RNA, 17 nt, Human
ucccugaaggccccgcc

SEQ ID NO: 1500297 - RNA, 17 nt, Human
acgugggcauucaaaug

SEQ ID NO: 1500298 - RNA, 20 nt, Human
acgugggcauucaaauguau

SEQ ID NO: 1500299 - RNA, 18 nt, Human
acguguacuacaauuuaa

SEQ ID NO: 1500300 - RNA, 15 nt, Human
acgguuuuacugcag

SEQ ID NO: 1500301 - RNA, 17 nt, Human
acgguuuuacugcagcu

SEQ ID NO: 1500302 - RNA, 20 nt, Human
acguauguuuuuguguauuu

SEQ ID NO: 1500303 - RNA, 20 nt, Human
acgggaggguaaggcugugg

SEQ ID NO: 1500304 - RNA, 20 nt, Human
acgggcccggguugggucac

SEQ ID NO: 1500305 - RNA, 21 nt, Human
acgggcccggguugggucacc

SEQ ID NO: 1500306 - RNA, 16 nt, Human
acgggcccggguuggg

SEQ ID NO: 1500307 - RNA, 17 nt, Human
acgggcccggguugggu

SEQ ID NO: 1500308 - RNA, 16 nt, Human
ucccacaaaggagagc

SEQ ID NO: 1500309 - RNA, 15 nt, Human
ucccaccccacacac

SEQ ID NO: 1500310 - RNA, 20 nt, Human
ucccaccccacacacgccag

SEQ ID NO: 1500311 - RNA, 13 nt, Human
ucccaaagugcug

SEQ ID NO: 1500312 - RNA, 14 nt, Human
ucccaaagugcugg

SEQ ID NO: 1500313 - RNA, 21 nt, Human
ucccaaagcagugcaugcugu

SEQ ID NO: 1500314 - RNA, 17 nt, Human
ucccaaagcagugcaug

SEQ ID NO: 1500315 - RNA, 18 nt, Human
ucccaaagcagugcaugc

SEQ ID NO: 1500316 - RNA, 16 nt, Human
ucccaaagcagugcau

SEQ ID NO: 1500317 - RNA, 18 nt, Human
ucccaaacccuucagugc

SEQ ID NO: 1500318 - RNA, 15 nt, Human
uccaugaaaaugcaa

SEQ ID NO: 1500319 - RNA, 16 nt, Human
uccaugaaaaugcaac

SEQ ID NO: 1500320 - RNA, 13 nt, Human
uccaugaagaugu

SEQ ID NO: 1500321 - RNA, 21 nt, Human
uccaugaagauguagaggaga

SEQ ID NO: 1500322 - RNA, 22 nt, Human
uccaugaagauguagaggagaa

SEQ ID NO: 1500323 - RNA, 20 nt, Human
uccauccugaggcuccacuu

SEQ ID NO: 1500324 - RNA, 21 nt, Human
uccauccugaggcuccacuug

SEQ ID NO: 1500325 - RNA, 22 nt, Human
acgccagauucuuuccugaggc

SEQ ID NO: 1500326 - RNA, 23 nt, Human
acgccagauucuuuccugaggcu

SEQ ID NO: 1500327 - RNA, 15 nt, Human
acuacauucuguuaa

SEQ ID NO: 1500328 - RNA, 23 nt, Human
ucccagauuggcucacacugaga

SEQ ID NO: 1500329 - RNA, 14 nt, Human
acuacauucuguua

SEQ ID NO: 1500330 - RNA, 13 nt, Human
acuacauucuguu

SEQ ID NO: 1500331 - RNA, 12 nt, Human
acuacauucugu

SEQ ID NO: 1500332 - RNA, 15 nt, Human
acuacaguuuguuag

SEQ ID NO: 1500333 - RNA, 12 nt, Human
ucccagccccaa

SEQ ID NO: 1500334 - RNA, 17 nt, Human
ucccagcugugcucugg

SEQ ID NO: 1500335 - RNA, 23 nt, Human
acuacaggugugagucaccaagc

SEQ ID NO: 1500336 - RNA, 15 nt, Human
acuacaggcacccac

SEQ ID NO: 1500337 - RNA, 14 nt, Human
acuacaguuuguua

SEQ ID NO: 1500338 - RNA, 13 nt, Human
acuacaguuuguu

SEQ ID NO: 1500339 - RNA, 17 nt, Human
acuacaauuuaaagcaa

SEQ ID NO: 1500340 - RNA, 22 nt, Human
acuacaauuuaaagcaaaggag

SEQ ID NO: 1500341 - RNA, 11 nt, Human
acuacaggcac

SEQ ID NO: 1500342 - RNA, 21 nt, Human
acuacaaacaaaauuucuauu

SEQ ID NO: 1500343 - RNA, 12 nt, Human
acuaaccacgcu

SEQ ID NO: 1500344 - RNA, 22 nt, Human
acuacaaacaaaauuucuauua

SEQ ID NO: 1500345 - RNA, 20 nt, Human
ucccagcugugcucuggaca

SEQ ID NO: 1500346 - RNA, 14 nt, Human
ucccagucauuuaa

SEQ ID NO: 1500347 - RNA, 22 nt, Human
ucccagucauuuaauaaaugug

SEQ ID NO: 1500348 - RNA, 15 nt, Human
ucccaucacccgcua

SEQ ID NO: 1500349 - RNA, 22 nt, Human
ucccauaugccugggcagaagg

SEQ ID NO: 1500350 - RNA, 12 nt, Human
uccccacccuga

SEQ ID NO: 1500351 - RNA, 22 nt, Human
uccccaccgcagacaggaccag

SEQ ID NO: 1500352 - RNA, 17 nt, Human
uccccaccgcagacagg

SEQ ID NO: 1500353 - RNA, 18 nt, Human
uccccaccgcagacagga

SEQ ID NO: 1500354 - RNA, 21 nt, Human
uccccaccgcagacaggacca

SEQ ID NO: 1500355 - RNA, 14 nt, Human
acgagaaaacaaua

SEQ ID NO: 1500356 - RNA, 22 nt, Human
accuuuuuuauacauaaacaag

SEQ ID NO: 1500357 - RNA, 21 nt, Human
accuuuuuuauacauaaacaa

SEQ ID NO: 1500358 - RNA, 21 nt, Human
uccaggcuguaucccaugagc

SEQ ID NO: 1500359 - RNA, 20 nt, Human
accuuuuuuauacauaaaca

SEQ ID NO: 1500360 - RNA, 19 nt, Human
accuuuuuuauacauaaac

SEQ ID NO: 1500361 - RNA, 16 nt, Human
acgagcaggcuucuuc

SEQ ID NO: 1500362 - RNA, 19 nt, Human
acgccagauucuuuccuga

SEQ ID NO: 1500363 - RNA, 19 nt, Human
acgagcaggcuacugucag

SEQ ID NO: 1500364 - RNA, 20 nt, Human
acgagcaggcuacugucagc

SEQ ID NO: 1500365 - RNA, 14 nt, Human
uccagccccuggau

SEQ ID NO: 1500366 - RNA, 13 nt, Human
uccagccccugga

SEQ ID NO: 1500367 - RNA, 12 nt, Human
uccagccccugg

SEQ ID NO: 1500368 - RNA, 19 nt, Human
uccagacccggcugcgugg

SEQ ID NO: 1500369 - RNA, 15 nt, Human
uccagacccggcugc

SEQ ID NO: 1500370 - RNA, 18 nt, Human
uccagacccggcugcgug

SEQ ID NO: 1500371 - RNA, 20 nt, Human
uccagaauuucccaaagcag

SEQ ID NO: 1500372 - RNA, 22 nt, Human
uccagaauuucccaaagcagug

SEQ ID NO: 1500373 - RNA, 13 nt, Human
uccagacacaugu

SEQ ID NO: 1500374 - RNA, 14 nt, Human
accuuuugagugcc

SEQ ID NO: 1500375 - RNA, 17 nt, Human
accuuuugagugccuua

SEQ ID NO: 1500376 - RNA, 20 nt, Human
accuuuugagugccuuacac

SEQ ID NO: 1500377 - RNA, 23 nt, Human
uccaacccucaucaccaacgucu

SEQ ID NO: 1500378 - RNA, 16 nt, Human
uccaacccucaucacc

SEQ ID NO: 1500379 - RNA, 17 nt, Human
uccaacccucaucacca

SEQ ID NO: 1500380 - RNA, 14 nt, Human
uccaacccucauca

SEQ ID NO: 1500381 - RNA, 23 nt, Human
uccaaccccccagcacugaggaa

SEQ ID NO: 1500382 - RNA, 19 nt, Human
uccaaccccccagcacuga

SEQ ID NO: 1500383 - RNA, 20 nt, Human
uccaaccccccagcacugag

SEQ ID NO: 1500384 - RNA, 21 nt, Human
uccaaccccccagcacugagg

SEQ ID NO: 1500385 - RNA, 22 nt, Human
uccaaccccccagcacugagga

SEQ ID NO: 1500386 - RNA, 12 nt, Human
accugccaggaa

SEQ ID NO: 1500387 - RNA, 14 nt, Human
accugccaggaagc

SEQ ID NO: 1500388 - RNA, 15 nt, Human
accugccaggaagcc

SEQ ID NO: 1500389 - RNA, 14 nt, Human
uccaaccccccagc

SEQ ID NO: 1500390 - RNA, 17 nt, Human
uccaaccccccagcacu

SEQ ID NO: 1500391 - RNA, 18 nt, Human
uccaaccccccagcacug

SEQ ID NO: 1500392 - RNA, 12 nt, Human
uccaagaagccc

SEQ ID NO: 1500393 - RNA, 20 nt, Human
uccaagcuggucccacucag

SEQ ID NO: 1500394 - RNA, 21 nt, Human
uccaaccuggggggcaguggu

SEQ ID NO: 1500395 - RNA, 21 nt, Human
uccaagcuggucccacucagu

SEQ ID NO: 1500396 - RNA, 23 nt, Human
accuggccucugcacuccccugc

SEQ ID NO: 1500397 - RNA, 18 nt, Human
accuggccucugcacucc

SEQ ID NO: 1500398 - RNA, 20 nt, Human
accuggccucugcacucccc

SEQ ID NO: 1500399 - RNA, 19 nt, Human
accuguuucugcagccacu

SEQ ID NO: 1500400 - RNA, 18 nt, Human
accuuagacagucccugc

SEQ ID NO: 1500401 - RNA, 19 nt, Human
accuuagacagucccugcc

SEQ ID NO: 1500402 - RNA, 20 nt, Human
accuuagacagucccugcca

SEQ ID NO: 1500403 - RNA, 18 nt, Human
uccacccaccucagccuc

SEQ ID NO: 1500404 - RNA, 19 nt, Human
uccacccaccucagccucc

SEQ ID NO: 1500405 - RNA, 12 nt, Human
uccacccaggag

SEQ ID NO: 1500406 - RNA, 14 nt, Human
uccacccaggagcc

SEQ ID NO: 1500407 - RNA, 15 nt, Human
uccacccaggagccc

SEQ ID NO: 1500408 - RNA, 17 nt, Human
uccacccaggagccccg

SEQ ID NO: 1500409 - RNA, 14 nt, Human
accuggccucugca

SEQ ID NO: 1500410 - RNA, 16 nt, Human
accuggccucugcacu

SEQ ID NO: 1500411 - RNA, 17 nt, Human
accuggccucugcacuc

SEQ ID NO: 1500412 - RNA, 21 nt, Human
accuagggugauauuaaccag

SEQ ID NO: 1500413 - RNA, 19 nt, Human
accucaaaaugucuaagau

SEQ ID NO: 1500414 - RNA, 22 nt, Human
ucaggaaaucaaauaugcaaag

SEQ ID NO: 1500415 - RNA, 23 nt, Human
ucaggaaaucaaauaugcaaagc

SEQ ID NO: 1500416 - RNA, 13 nt, Human
ucaggaagcucag

SEQ ID NO: 1500417 - RNA, 14 nt, Human
ucaggaagcucagg

SEQ ID NO: 1500418 - RNA, 15 nt, Human
ucaggaagcucaggg

SEQ ID NO: 1500419 - RNA, 16 nt, Human
ucaggaagcucagggc

SEQ ID NO: 1500420 - RNA, 16 nt, Human
ucaugaauuaguuuua

SEQ ID NO: 1500421 - RNA, 22 nt, Human
ucauccuucuggaauaaggaga

SEQ ID NO: 1500422 - RNA, 14 nt, Human
ucauccuucuggaa

SEQ ID NO: 1500423 - RNA, 18 nt, Human
ucauccucauacccaccc

SEQ ID NO: 1500424 - RNA, 13 nt, Human
ucauccuccucag

SEQ ID NO: 1500425 - RNA, 19 nt, Human
ucauccuccucagaucuuc

SEQ ID NO: 1500426 - RNA, 13 nt, Human
accuccugccucg

SEQ ID NO: 1500427 - RNA, 12 nt, Human
accuccugccuc

SEQ ID NO: 1500428 - RNA, 15 nt, Human
ucauccuaagcuauu

SEQ ID NO: 1500429 - RNA, 23 nt, Human
accuccugccucgaacuggcugc

SEQ ID NO: 1500430 - RNA, 14 nt, Human
accucuaaauucuu

SEQ ID NO: 1500431 - RNA, 14 nt, Human
accugaggcccuuc

SEQ ID NO: 1500432 - RNA, 22 nt, Human
accugaggcccuucucuccagc

SEQ ID NO: 1500433 - RNA, 15 nt, Human
accugaggcccuucu

SEQ ID NO: 1500434 - RNA, 16 nt, Human
accugaggcccuucuc

SEQ ID NO: 1500435 - RNA, 20 nt, Human
accugaggcccuucucucca

SEQ ID NO: 1500436 - RNA, 21 nt, Human
accugaggcccuucucuccag

SEQ ID NO: 1500437 - RNA, 15 nt, Human
accugauugugucuc

SEQ ID NO: 1500438 - RNA, 17 nt, Human
accugauugugucucuu

SEQ ID NO: 1500439 - RNA, 18 nt, Human
accugauugugucucuug

SEQ ID NO: 1500440 - RNA, 19 nt, Human
accucgugccaccccgagg

SEQ ID NO: 1500441 - RNA, 23 nt, Human
accucgugccaccccgagggcug

SEQ ID NO: 1500442 - RNA, 19 nt, Human
accucggugccuuccucuu

SEQ ID NO: 1500443 - RNA, 13 nt, Human
accuccugggcua

SEQ ID NO: 1500444 - RNA, 19 nt, Human
ucauugaccugaggcccuu

SEQ ID NO: 1500445 - RNA, 22 nt, Human
ucauugaaaucuuuuugcuuug

SEQ ID NO: 1500446 - RNA, 12 nt, Human
ucauugaccuga

SEQ ID NO: 1500447 - RNA, 14 nt, Human
ucauugaccugagg

SEQ ID NO: 1500448 - RNA, 15 nt, Human
ucauugaccugaggc

SEQ ID NO: 1500449 - RNA, 21 nt, Human
ucaugaauuaguuuuauaugc

SEQ ID NO: 1500450 - RNA, 12 nt, Human
ucauucuucugu

SEQ ID NO: 1500451 - RNA, 12 nt, Human
ucauugaaaucu

SEQ ID NO: 1500452 - RNA, 13 nt, Human
ucauugaaaucuu

SEQ ID NO: 1500453 - RNA, 14 nt, Human
ucaaaaugucuaag

SEQ ID NO: 1500454 - RNA, 21 nt, Human
ucaaaauaugccccauucaac

SEQ ID NO: 1500455 - RNA, 23 nt, Human
ucaaaauaccaugccauuuaaag

SEQ ID NO: 1500456 - RNA, 21 nt, Human
ucaaaauaccaugccauuuaa

SEQ ID NO: 1500457 - RNA, 17 nt, Human
uauuuuuaauuaaauaa

SEQ ID NO: 1500458 - RNA, 13 nt, Human
uauuuuuauuugu

SEQ ID NO: 1500459 - RNA, 13 nt, Human
uauuuuugacaga

SEQ ID NO: 1500460 - RNA, 14 nt, Human
uauuuuugacagaa

SEQ ID NO: 1500461 - RNA, 15 nt, Human
uauuuuugacagaau

SEQ ID NO: 1500462 - RNA, 19 nt, Human
uauuuuugacagaauaugu

SEQ ID NO: 1500463 - RNA, 23 nt, Human
uauuuuugacagaauauguuuca

SEQ ID NO: 1500464 - RNA, 18 nt, Human
ucaaaagaaagaaaauca

SEQ ID NO: 1500465 - RNA, 14 nt, Human
ucaaagcugaaaug

SEQ ID NO: 1500466 - RNA, 17 nt, Human
ucaaagggugaaaauua

SEQ ID NO: 1500467 - RNA, 16 nt, Human
acaugaaguccaagca

SEQ ID NO: 1500468 - RNA, 20 nt, Human
ucaaauacgugggcauucaa

SEQ ID NO: 1500469 - RNA, 18 nt, Human
ucaaauaacuaaaaggua

SEQ ID NO: 1500470 - RNA, 20 nt, Human
acaugagcaucaggccaggc

SEQ ID NO: 1500471 - RNA, 19 nt, Human
acaugaucuucuuuauaau

SEQ ID NO: 1500472 - RNA, 15 nt, Human
acaugaucuucuuua

SEQ ID NO: 1500473 - RNA, 17 nt, Human
acaugaucuucuuuaua

SEQ ID NO: 1500474 - RNA, 19 nt, Human
acaugauccugcaauucca

SEQ ID NO: 1500475 - RNA, 19 nt, Human
acaugagcaucaggccagg

SEQ ID NO: 1500476 - RNA, 17 nt, Human
acaugagcaucaggcca

SEQ ID NO: 1500477 - RNA, 18 nt, Human
acaugagcaucaggccag

SEQ ID NO: 1500478 - RNA, 12 nt, Human
ucaacaucuuuu

SEQ ID NO: 1500479 - RNA, 22 nt, Human
ucaagaugaugaugaucuuuaa

SEQ ID NO: 1500480 - RNA, 11 nt, Human
ucaaguauuau

SEQ ID NO: 1500481 - RNA, 15 nt, Human
ucaaguauuauaccu

SEQ ID NO: 1500482 - RNA, 21 nt, Human
ucaaguauuauaccuuuuuua

SEQ ID NO: 1500483 - RNA, 16 nt, Human
ucaaguauuauaccuu

SEQ ID NO: 1500484 - RNA, 23 nt, Human
ucaaguauuauaccuuuuuuaga

SEQ ID NO: 1500485 - RNA, 21 nt, Human
acauguccaagaagcccagga

SEQ ID NO: 1500486 - RNA, 17 nt, Human
ucaaauuucuaaaucuc

SEQ ID NO: 1500487 - RNA, 16 nt, Human
ucaacagguuuuccug

SEQ ID NO: 1500488 - RNA, 12 nt, Human
acauucuguuaa

SEQ ID NO: 1500489 - RNA, 16 nt, Human
ucaaauuucuaaaucu

SEQ ID NO: 1500490 - RNA, 15 nt, Human
ucaaauuucuaaauc

SEQ ID NO: 1500491 - RNA, 15 nt, Human
acauucuguuaauca

SEQ ID NO: 1500492 - RNA, 21 nt, Human
uaugaaauauuauguuaaaac

SEQ ID NO: 1500493 - RNA, 15 nt, Human
uaugaagaagagagu

SEQ ID NO: 1500494 - RNA, 21 nt, Human
uauuuccauuaaaaaaucagu

SEQ ID NO: 1500495 - RNA, 22 nt, Human
uauuucccucaccuuucccauc

SEQ ID NO: 1500496 - RNA, 23 nt, Human
uauuuccuauauuguuuucagug

SEQ ID NO: 1500497 - RNA, 15 nt, Human
acaguugaaaaacag

SEQ ID NO: 1500498 - RNA, 16 nt, Human
acaguugaaaaacagc

SEQ ID NO: 1500499 - RNA, 20 nt, Human
acaguugaaaaacagcugag

SEQ ID NO: 1500500 - RNA, 18 nt, Human
acaguugcuguuguguga

SEQ ID NO: 1500501 - RNA, 16 nt, Human
acauaaaaacaacuuu

SEQ ID NO: 1500502 - RNA, 19 nt, Human
acauaaaaacaacuuuaua

SEQ ID NO: 1500503 - RNA, 21 nt, Human
acauaaaaacaacuuuauacc

SEQ ID NO: 1500504 - RNA, 18 nt, Human
acaguuuucugagaaaga

SEQ ID NO: 1500505 - RNA, 19 nt, Human
acaguuuucugagaaagac

SEQ ID NO: 1500506 - RNA, 20 nt, Human
acaguuuucugagaaagacu

SEQ ID NO: 1500507 - RNA, 21 nt, Human
acaguuuucugagaaagacua

SEQ ID NO: 1500508 - RNA, 20 nt, Human
acaguuuguuaguaugaggc

SEQ ID NO: 1500509 - RNA, 16 nt, Human
acaguuuguuaguaug

SEQ ID NO: 1500510 - RNA, 15 nt, Human
acaguuuucugagaa

SEQ ID NO: 1500511 - RNA, 16 nt, Human
acaguuuucugagaaa

SEQ ID NO: 1500512 - RNA, 17 nt, Human
acaguuuucugagaaag

SEQ ID NO: 1500513 - RNA, 17 nt, Human
acauacucccaucugug

SEQ ID NO: 1500514 - RNA, 14 nt, Human
acauacucugcuua

SEQ ID NO: 1500515 - RNA, 13 nt, Human
acauacucccauc

SEQ ID NO: 1500516 - RNA, 22 nt, Human
acauacuaaccagcagaaaugc

SEQ ID NO: 1500517 - RNA, 21 nt, Human
acauacuaaccagcagaaaug

SEQ ID NO: 1500518 - RNA, 13 nt, Human
acauacuaaccag

SEQ ID NO: 1500519 - RNA, 19 nt, Human
acauauauaacaaugcugu

SEQ ID NO: 1500520 - RNA, 14 nt, Human
acauagaauuaaca

SEQ ID NO: 1500521 - RNA, 18 nt, Human
acauagaauuaacacaug

SEQ ID NO: 1500522 - RNA, 23 nt, Human
acauauugauuuccguuaaaaua

SEQ ID NO: 1500523 - RNA, 22 nt, Human
acauauugauuuccguuaaaau

SEQ ID NO: 1500524 - RNA, 18 nt, Human
acauauugauuuccguua

SEQ ID NO: 1500525 - RNA, 16 nt, Human
acauauugauuuccgu

SEQ ID NO: 1500526 - RNA, 14 nt, Human
acauauugauuucc

SEQ ID NO: 1500527 - RNA, 23 nt, Human
acauaucuaguaugaaauuauau

SEQ ID NO: 1500528 - RNA, 20 nt, Human
acauaucuaguaugaaauua

SEQ ID NO: 1500529 - RNA, 22 nt, Human
acauaucuaguaugaaauuaua

SEQ ID NO: 1500530 - RNA, 17 nt, Human
acauaucuaguaugaaa

SEQ ID NO: 1500531 - RNA, 22 nt, Human
acaugaaaacacauuuuucuua

SEQ ID NO: 1500532 - RNA, 22 nt, Human
acaucuugcucugcugacagac

SEQ ID NO: 1500533 - RNA, 19 nt, Human
acaugaaaacacauuuuuc

SEQ ID NO: 1500534 - RNA, 18 nt, Human
acaugaaaacacauuuuu

SEQ ID NO: 1500535 - RNA, 17 nt, Human
acaugaaaacacauuuu

SEQ ID NO: 1500536 - RNA, 21 nt, Human
acaucuugcucugcugacaga

SEQ ID NO: 1500537 - RNA, 18 nt, Human
acaucuugcucugcugac

SEQ ID NO: 1500538 - RNA, 19 nt, Human
acaucuugcucugcugaca

SEQ ID NO: 1500539 - RNA, 13 nt, Human
acaucuugcucug

SEQ ID NO: 1500540 - RNA, 14 nt, Human
acaucuugcucugc

SEQ ID NO: 1500541 - RNA, 16 nt, Human
acaucaacaucuuggu

SEQ ID NO: 1500542 - RNA, 18 nt, Human
acaucaacaucuugguca

SEQ ID NO: 1500543 - RNA, 13 nt, Human
acaucaacagaua

SEQ ID NO: 1500544 - RNA, 22 nt, Human
accacuuuuguucuugguuugu

SEQ ID NO: 1500545 - RNA, 12 nt, Human
accagagcccac

SEQ ID NO: 1500546 - RNA, 14 nt, Human
accagagcccaccu

SEQ ID NO: 1500547 - RNA, 16 nt, Human
accagagcccaccuug

SEQ ID NO: 1500548 - RNA, 14 nt, Human
accagacggggcug

SEQ ID NO: 1500549 - RNA, 15 nt, Human
accagacggggcugg

SEQ ID NO: 1500550 - RNA, 21 nt, Human
accagacggggcuggagugug

SEQ ID NO: 1500551 - RNA, 16 nt, Human
accagacggggcugga

SEQ ID NO: 1500552 - RNA, 14 nt, Human
accagacaccuuga

SEQ ID NO: 1500553 - RNA, 17 nt, Human
accagacaccuugacag

SEQ ID NO: 1500554 - RNA, 18 nt, Human
accacuuguguuuugcaa

SEQ ID NO: 1500555 - RNA, 15 nt, Human
accacuuuuguucuu

SEQ ID NO: 1500556 - RNA, 21 nt, Human
accacuuuuguucuugguuug

SEQ ID NO: 1500557 - RNA, 16 nt, Human
accacuuuuguucuug

SEQ ID NO: 1500558 - RNA, 13 nt, Human
accacugcagaag

SEQ ID NO: 1500559 - RNA, 22 nt, Human
ucaccccggccaccugcggugc

SEQ ID NO: 1500560 - RNA, 21 nt, Human
accacugcacuccagccuggg

SEQ ID NO: 1500561 - RNA, 17 nt, Human
ucaccccggccaccugc

SEQ ID NO: 1500562 - RNA, 18 nt, Human
ucaccccggccaccugcg

SEQ ID NO: 1500563 - RNA, 20 nt, Human
accacugcacuccagccugg

SEQ ID NO: 1500564 - RNA, 17 nt, Human
ucacuaccuucaugcau

SEQ ID NO: 1500565 - RNA, 18 nt, Human
ucacuauguugcccaggc

SEQ ID NO: 1500566 - RNA, 19 nt, Human
ucacuauguugcccaggca

SEQ ID NO: 1500567 - RNA, 20 nt, Human
ucacuauguugcccaggcag

SEQ ID NO: 1500568 - RNA, 13 nt, Human
ucaccugccccuc

SEQ ID NO: 1500569 - RNA, 16 nt, Human
ucaccugccccucaac

SEQ ID NO: 1500570 - RNA, 15 nt, Human
ucaccugccccucaa

SEQ ID NO: 1500571 - RNA, 15 nt, Human
ucaccucucccuugg

SEQ ID NO: 1500572 - RNA, 16 nt, Human
ucaccugaagacucau

SEQ ID NO: 1500573 - RNA, 14 nt, Human
accagggacugagg

SEQ ID NO: 1500574 - RNA, 17 nt, Human
accagagcccaccuugg

SEQ ID NO: 1500575 - RNA, 15 nt, Human
ucaauucuugccaaa

SEQ ID NO: 1500576 - RNA, 20 nt, Human
ucaauuuuucuuauuucauu

SEQ ID NO: 1500577 - RNA, 23 nt, Human
ucaauuuuucuuauuucauuucu

SEQ ID NO: 1500578 - RNA, 13 nt, Human
accaaucaugaau

SEQ ID NO: 1500579 - RNA, 15 nt, Human
accaaucaugaauua

SEQ ID NO: 1500580 - RNA, 15 nt, Human
accaauguucucucu

SEQ ID NO: 1500581 - RNA, 22 nt, Human
ucaaguccucuuuucugagagg

SEQ ID NO: 1500582 - RNA, 15 nt, Human
ucaagugaaaaagga

SEQ ID NO: 1500583 - RNA, 23 nt, Human
ucaagugaaaaaggaggaagaga

SEQ ID NO: 1500584 - RNA, 19 nt, Human
accaacauacucccaucug

SEQ ID NO: 1500585 - RNA, 21 nt, Human
accaacauacucccaucugug

SEQ ID NO: 1500586 - RNA, 22 nt, Human
accaacauacucccaucuguga

SEQ ID NO: 1500587 - RNA, 13 nt, Human
ucaccccagcccc

SEQ ID NO: 1500588 - RNA, 14 nt, Human
ucaccccagcccca

SEQ ID NO: 1500589 - RNA, 20 nt, Human
ucaccccagccccaaaacuc

SEQ ID NO: 1500590 - RNA, 15 nt, Human
ucaccccggccaccu

SEQ ID NO: 1500591 - RNA, 11 nt, Human
ucacacugaga

SEQ ID NO: 1500592 - RNA, 12 nt, Human
ucacacugagaa

SEQ ID NO: 1500593 - RNA, 19 nt, Human
ucacacugagaauguaaga

SEQ ID NO: 1500594 - RNA, 20 nt, Human
ucacacugagaauguaagaa

SEQ ID NO: 1500595 - RNA, 21 nt, Human
ucacacugagaauguaagaac

SEQ ID NO: 1500596 - RNA, 23 nt, Human
ucacacugagaauguaagaacua

SEQ ID NO: 1500597 - RNA, 21 nt, Human
ucacaacagauuauuaccuua

SEQ ID NO: 1500598 - RNA, 15 nt, Human
ucacaguucucuccu

SEQ ID NO: 1500599 - RNA, 17 nt, Human
ucacauaucuaguauga

SEQ ID NO: 1500600 - RNA, 21 nt, Human
ucacauaucuaguaugaaauu

SEQ ID NO: 1500601 - RNA, 22 nt, Human
ucacauaucuaguaugaaauua

SEQ ID NO: 1500602 - RNA, 12 nt, Human
ucacauaucugu

SEQ ID NO: 1500603 - RNA, 15 nt, Human
ucacauaucugucau

SEQ ID NO: 1500604 - RNA, 13 nt, Human
acccacugcucug

SEQ ID NO: 1500605 - RNA, 14 nt, Human
acccacugcucugg

SEQ ID NO: 1500606 - RNA, 15 nt, Human
acccacugcucuggu

SEQ ID NO: 1500607 - RNA, 11 nt, Human
acccacugcuu

SEQ ID NO: 1500608 - RNA, 23 nt, Human
accauuucuugagguaaaagcau

SEQ ID NO: 1500609 - RNA, 10 nt, Human
acccacugcu

SEQ ID NO: 1500610 - RNA, 11 nt, Human
acccacugcuc

SEQ ID NO: 1500611 - RNA, 12 nt, Human
accauuauuuuu

SEQ ID NO: 1500612 - RNA, 18 nt, Human
accauuaugaagaagaga

SEQ ID NO: 1500613 - RNA, 22 nt, Human
accauggucggaaaacaugcua

SEQ ID NO: 1500614 - RNA, 21 nt, Human
ucacucuuauugcccacgcug

SEQ ID NO: 1500615 - RNA, 23 nt, Human
ucacucuuauugcccacgcugga

SEQ ID NO: 1500616 - RNA, 23 nt, Human
ucagaaguuucugccgcagcccu

SEQ ID NO: 1500617 - RNA, 18 nt, Human
ucagaaucucaaauaacu

SEQ ID NO: 1500618 - RNA, 19 nt, Human
ucagaaucucaaauaacua

SEQ ID NO: 1500619 - RNA, 22 nt, Human
ucagagacuccugcaggcagcc

SEQ ID NO: 1500620 - RNA, 21 nt, Human
ucagagacuccugcaggcagc

SEQ ID NO: 1500621 - RNA, 17 nt, Human
ucagagacuccugcagg

SEQ ID NO: 1500622 - RNA, 20 nt, Human
ucagagacuccugcaggcag

SEQ ID NO: 1500623 - RNA, 16 nt, Human
ucagagagggugggag

SEQ ID NO: 1500624 - RNA, 21 nt, Human
ucagagagggugggagugggc

SEQ ID NO: 1500625 - RNA, 23 nt, Human
ucagagagggugggagugggccc

SEQ ID NO: 1500626 - RNA, 12 nt, Human
ucagagccugca

SEQ ID NO: 1500627 - RNA, 13 nt, Human
ucagagccugcag

SEQ ID NO: 1500628 - RNA, 14 nt, Human
ucagagccugcagu

SEQ ID NO: 1500629 - RNA, 15 nt, Human
ucagagccugcaguu

SEQ ID NO: 1500630 - RNA, 18 nt, Human
ucagagccugcaguuauu

SEQ ID NO: 1500631 - RNA, 19 nt, Human
ucagaaguuucugccgcag

SEQ ID NO: 1500632 - RNA, 22 nt, Human
ucagaaguuucugccgcagccc

SEQ ID NO: 1500633 - RNA, 24 nt, Human
acccagcgagcccugguggcagug

SEQ ID NO: 1500634 - RNA, 19 nt, Human
acccagcgagcccuggugg

SEQ ID NO: 1500635 - RNA, 23 nt, Human
acccagcgagcccugguggcagu

SEQ ID NO: 1500636 - RNA, 23 nt, Human
ucagccguguaaccauggaccca

SEQ ID NO: 1500637 - RNA, 22 nt, Human
ucagccaagaauucuuaaauau

SEQ ID NO: 1500638 - RNA, 13 nt, Human
ucaggaaagagaa

SEQ ID NO: 1500639 - RNA, 19 nt, Human
ucaggaaagagaacuucca

SEQ ID NO: 1500640 - RNA, 20 nt, Human
ucaggaaaucaaauaugcaa

SEQ ID NO: 1500641 - RNA, 21 nt, Human
ucaggaaaucaaauaugcaaa

SEQ ID NO: 1500642 - RNA, 20 nt, Human
ucagcuuguaaauagcucag

SEQ ID NO: 1500643 - RNA, 14 nt, Human
ucagcggggacagc

SEQ ID NO: 1500644 - RNA, 15 nt, Human
ucagcggggacagcu

SEQ ID NO: 1500645 - RNA, 15 nt, Human
accccccagcacuga

SEQ ID NO: 1500646 - RNA, 17 nt, Human
accccccagcacugagg

SEQ ID NO: 1500647 - RNA, 19 nt, Human
accccccagcacugaggaa

SEQ ID NO: 1500648 - RNA, 12 nt, Human
acccccacccaa

SEQ ID NO: 1500649 - RNA, 13 nt, Human
accccccagcacu

SEQ ID NO: 1500650 - RNA, 14 nt, Human
accccccagcacug

SEQ ID NO: 1500651 - RNA, 14 nt, Human
accccugguucuca

SEQ ID NO: 1500652 - RNA, 15 nt, Human
accccugguucucau

SEQ ID NO: 1500653 - RNA, 16 nt, Human
accccugguucucauc

SEQ ID NO: 1500654 - RNA, 20 nt, Human
accccugguucucaucuuuc

SEQ ID NO: 1500655 - RNA, 22 nt, Human
accccugguucucaucuuucuu

SEQ ID NO: 1500656 - RNA, 16 nt, Human
accccuucgcuccugu

SEQ ID NO: 1500657 - RNA, 14 nt, Human
accccuucgcuccu

SEQ ID NO: 1500658 - RNA, 15 nt, Human
accccuucgcuccug

SEQ ID NO: 1500659 - RNA, 21 nt, Human
aaugccccugaauuuaaauag

SEQ ID NO: 1500660 - RNA, 13 nt, Human
aaugcugugcccu

SEQ ID NO: 1500661 - RNA, 21 nt, Human
aaugcugugcccuaaagugua

SEQ ID NO: 1500662 - RNA, 20 nt, Human
aaugcugugcccuaaagugu

SEQ ID NO: 1500663 - RNA, 20 nt, Human
aaugcccagccccuucugac

SEQ ID NO: 1500664 - RNA, 22 nt, Human
aaugcccagccccuucugaccc

SEQ ID NO: 1500665 - RNA, 23 nt, Human
aaugcccagccccuucugaccca

SEQ ID NO: 1500666 - RNA, 24 nt, Human
aaugcccagccccuucugacccau

SEQ ID NO: 1500667 - RNA, 12 nt, Human
aaugcuguguua

SEQ ID NO: 1500668 - RNA, 16 nt, Human
aauggacguguuauga

SEQ ID NO: 1500669 - RNA, 16 nt, Human
uacaaacaaaauuucu

SEQ ID NO: 1500670 - RNA, 14 nt, Human
aaugcccagccccu

SEQ ID NO: 1500671 - RNA, 15 nt, Human
aaugcccagccccuu

SEQ ID NO: 1500672 - RNA, 13 nt, Human
uaauucaagaaaa

SEQ ID NO: 1500673 - RNA, 17 nt, Human
uaauuuauacaggucau

SEQ ID NO: 1500674 - RNA, 13 nt, Human
uacaaaaacacag

SEQ ID NO: 1500675 - RNA, 14 nt, Human
uacaaaaacacagc

SEQ ID NO: 1500676 - RNA, 15 nt, Human
uacaaaagcauguga

SEQ ID NO: 1500677 - RNA, 20 nt, Human
uacaaaaagcauaaaaauua

SEQ ID NO: 1500678 - RNA, 15 nt, Human
uacaaaaacacagca

SEQ ID NO: 1500679 - RNA, 16 nt, Human
uacaaaaacacagcaa

SEQ ID NO: 1500680 - RNA, 19 nt, Human
uacacuaagagagaaugag

SEQ ID NO: 1500681 - RNA, 14 nt, Human
uacacuccagugag

SEQ ID NO: 1500682 - RNA, 18 nt, Human
uacagaggccaugggccu

SEQ ID NO: 1500683 - RNA, 19 nt, Human
aauggacuuuuguacauag

SEQ ID NO: 1500684 - RNA, 21 nt, Human
aauggacguguuaugacucca

SEQ ID NO: 1500685 - RNA, 18 nt, Human
uacaccacuacauucugu

SEQ ID NO: 1500686 - RNA, 17 nt, Human
uacaccacuacauucug

SEQ ID NO: 1500687 - RNA, 16 nt, Human
uacaccacuacauucu

SEQ ID NO: 1500688 - RNA, 15 nt, Human
uacaccacuacauuc

SEQ ID NO: 1500689 - RNA, 20 nt, Human
uacaccacuacauucuguua

SEQ ID NO: 1500690 - RNA, 19 nt, Human
uacaccacuacauucuguu

SEQ ID NO: 1500691 - RNA, 12 nt, Human
aauguacugcau

SEQ ID NO: 1500692 - RNA, 17 nt, Human
uacauauuuuuguagca

SEQ ID NO: 1500693 - RNA, 18 nt, Human
uacauauuuuuguagcac

SEQ ID NO: 1500694 - RNA, 21 nt, Human
uacauaaugcgugcauaccac

SEQ ID NO: 1500695 - RNA, 20 nt, Human
uacauaaugcgugcauacca

SEQ ID NO: 1500696 - RNA, 19 nt, Human
uacauaaugcgugcauacc

SEQ ID NO: 1500697 - RNA, 17 nt, Human
uacauaaugcgugcaua

SEQ ID NO: 1500698 - RNA, 15 nt, Human
uacaguaucucaggg

SEQ ID NO: 1500699 - RNA, 11 nt, Human
aaugugauaug

SEQ ID NO: 1500700 - RNA, 14 nt, Human
aauguacugcauau

SEQ ID NO: 1500701 - RNA, 18 nt, Human
aauguacugcauaugaaa

SEQ ID NO: 1500702 - RNA, 12 nt, Human
aauguaugugua

SEQ ID NO: 1500703 - RNA, 14 nt, Human
aauguauguguaag

SEQ ID NO: 1500704 - RNA, 19 nt, Human
uaauagguuuggacaaaau

SEQ ID NO: 1500705 - RNA, 14 nt, Human
uaauagguuuggac

SEQ ID NO: 1500706 - RNA, 13 nt, Human
aaucuucugaacu

SEQ ID NO: 1500707 - RNA, 20 nt, Human
aaucuucugaacuuggcgcu

SEQ ID NO: 1500708 - RNA, 14 nt, Human
uaaugaaagacugu

SEQ ID NO: 1500709 - RNA, 17 nt, Human
uaaugaaagacuguaca

SEQ ID NO: 1500710 - RNA, 18 nt, Human
uaaugaaagacuguacaa

SEQ ID NO: 1500711 - RNA, 19 nt, Human
uaaugaaagacuguacaaa

SEQ ID NO: 1500712 - RNA, 15 nt, Human
uaaugacuuaagcac

SEQ ID NO: 1500713 - RNA, 21 nt, Human
uaaugacuuaagcacacuuga

SEQ ID NO: 1500714 - RNA, 22 nt, Human
uaaugaaagacuguacaaagua

SEQ ID NO: 1500715 - RNA, 23 nt, Human
uaaugaaagacuguacaaaguag

SEQ ID NO: 1500716 - RNA, 21 nt, Human
aaugagagacacacugaagaa

SEQ ID NO: 1500717 - RNA, 15 nt, Human
aaugagccuggcaag

SEQ ID NO: 1500718 - RNA, 17 nt, Human
aaugacuuacuguacau

SEQ ID NO: 1500719 - RNA, 14 nt, Human
aaugacuuacugua

SEQ ID NO: 1500720 - RNA, 18 nt, Human
aaugacuuacuguacaug

SEQ ID NO: 1500721 - RNA, 16 nt, Human
uaaugauaacuggaaa

SEQ ID NO: 1500722 - RNA, 13 nt, Human
uaaugaggaaacu

SEQ ID NO: 1500723 - RNA, 15 nt, Human
uaaugguuugaauau

SEQ ID NO: 1500724 - RNA, 14 nt, Human
uaaugguguuuuaa

SEQ ID NO: 1500725 - RNA, 20 nt, Human
aauccucaguuuuugugaaa

SEQ ID NO: 1500726 - RNA, 22 nt, Human
aaucauuucugcaucagcugcu

SEQ ID NO: 1500727 - RNA, 13 nt, Human
aauccuugaagau

SEQ ID NO: 1500728 - RNA, 15 nt, Human
aaucuaaauggaacc

SEQ ID NO: 1500729 - RNA, 13 nt, Human
aaucuaaauggaa

SEQ ID NO: 1500730 - RNA, 18 nt, Human
aaucuaaauggaaccacu

SEQ ID NO: 1500731 - RNA, 16 nt, Human
aaucuuauaauuuaaa

SEQ ID NO: 1500732 - RNA, 14 nt, Human
aaucuuauaauuua

SEQ ID NO: 1500733 - RNA, 12 nt, Human
aaucucaaauuu

SEQ ID NO: 1500734 - RNA, 15 nt, Human
aaucucaaauaacua

SEQ ID NO: 1500735 - RNA, 14 nt, Human
aaucucaaauuucu

SEQ ID NO: 1500736 - RNA, 15 nt, Human
aaucucaaauuucua

SEQ ID NO: 1500737 - RNA, 15 nt, Human
aaucaucaagucuuu

SEQ ID NO: 1500738 - RNA, 19 nt, Human
aaucaugaauuaguuuuau

SEQ ID NO: 1500739 - RNA, 17 nt, Human
aaucaugaauuaguuuu

SEQ ID NO: 1500740 - RNA, 23 nt, Human
aaucaugaauuaguuuuauaugc

SEQ ID NO: 1500741 - RNA, 20 nt, Human
uaaguauguguaaaauguga

SEQ ID NO: 1500742 - RNA, 18 nt, Human
uaaguuuuuuuuuaaaaa

SEQ ID NO: 1500743 - RNA, 20 nt, Human
uaaguuuuuauggcuuuugu

SEQ ID NO: 1500744 - RNA, 13 nt, Human
uaaguucauacau

SEQ ID NO: 1500745 - RNA, 14 nt, Human
uaaguucauacauu

SEQ ID NO: 1500746 - RNA, 12 nt, Human
uaaguucauaca

SEQ ID NO: 1500747 - RNA, 18 nt, Human
aauaggcguaacuaauuu

SEQ ID NO: 1500748 - RNA, 24 nt, Human
aauagcuuuuuucucugauacaga

SEQ ID NO: 1500749 - RNA, 19 nt, Human
aauaggaaaaacugauuuu

SEQ ID NO: 1500750 - RNA, 17 nt, Human
aauaggaaaaacugauu

SEQ ID NO: 1500751 - RNA, 18 nt, Human
aauaggaaaaacugauuu

SEQ ID NO: 1500752 - RNA, 15 nt, Human
aauaggaaaaacuga

SEQ ID NO: 1500753 - RNA, 16 nt, Human
aauaggaaaaacugau

SEQ ID NO: 1500754 - RNA, 20 nt, Human
aauagccugccucuucucua

SEQ ID NO: 1500755 - RNA, 13 nt, Human
aauagcugggacu

SEQ ID NO: 1500756 - RNA, 14 nt, Human
aauagcugggacua

SEQ ID NO: 1500757 - RNA, 23 nt, Human
aauagacaauuuauuauggcaca

SEQ ID NO: 1500758 - RNA, 18 nt, Human
aauagacaauuuauuaug

SEQ ID NO: 1500759 - RNA, 15 nt, Human
uaaauuuugugucuc

SEQ ID NO: 1500760 - RNA, 18 nt, Human
uaaauuuugaguucuaca

SEQ ID NO: 1500761 - RNA, 19 nt, Human
uaaauuuugaguucuacau

SEQ ID NO: 1500762 - RNA, 20 nt, Human
uaaauuuugucuuuaacuca

SEQ ID NO: 1500763 - RNA, 12 nt, Human
aauaucacuugu

SEQ ID NO: 1500764 - RNA, 15 nt, Human
aauaguauuugagag

SEQ ID NO: 1500765 - RNA, 15 nt, Human
aauaucacuugucaa

SEQ ID NO: 1500766 - RNA, 20 nt, Human
aauaucacuugucaauaaaa

SEQ ID NO: 1500767 - RNA, 16 nt, Human
uaaccucuaaauucuu

SEQ ID NO: 1500768 - RNA, 15 nt, Human
uaacauggaaguacu

SEQ ID NO: 1500769 - RNA, 16 nt, Human
uaacauggaaguacua

SEQ ID NO: 1500770 - RNA, 15 nt, Human
uaacuaaaagguaug

SEQ ID NO: 1500771 - RNA, 14 nt, Human
uaacauggaaguac

SEQ ID NO: 1500772 - RNA, 16 nt, Human
aauaucuccgucaacu

SEQ ID NO: 1500773 - RNA, 21 nt, Human
aauaucuccgucaacucauau

SEQ ID NO: 1500774 - RNA, 16 nt, Human
aauaucugaaaaugua

SEQ ID NO: 1500775 - RNA, 17 nt, Human
aauaucugaaaauguau

SEQ ID NO: 1500776 - RNA, 18 nt, Human
aauaucugaaaauguaug

SEQ ID NO: 1500777 - RNA, 19 nt, Human
aauaucugaaaauguaugu

SEQ ID NO: 1500778 - RNA, 20 nt, Human
aauaucugaaaauguaugug

SEQ ID NO: 1500779 - RNA, 19 nt, Human
aauaucuuuuuuuuaauaa

SEQ ID NO: 1500780 - RNA, 19 nt, Human
uaacuuuuauaaacuuuac

SEQ ID NO: 1500781 - RNA, 18 nt, Human
uaacuuuuauaaacuuua

SEQ ID NO: 1500782 - RNA, 17 nt, Human
uaacuuuuauaaacuuu

SEQ ID NO: 1500783 - RNA, 15 nt, Human
uaacuuuuauaaacu

SEQ ID NO: 1500784 - RNA, 20 nt, Human
aauauugcuuuggucauaug

SEQ ID NO: 1500785 - RNA, 15 nt, Human
aauauuucagauaau

SEQ ID NO: 1500786 - RNA, 21 nt, Human
aauauuuuccaugaaaaugca

SEQ ID NO: 1500787 - RNA, 15 nt, Human
aauaugcaaagcacu

SEQ ID NO: 1500788 - RNA, 17 nt, Human
aauaugcaaagcacuga

SEQ ID NO: 1500789 - RNA, 15 nt, Human
aauaugcacacauuu

SEQ ID NO: 1500790 - RNA, 24 nt, Human
aauaugcaaagcacugacuucuaa

SEQ ID NO: 1500791 - RNA, 18 nt, Human
aauauugauaugcuuaua

SEQ ID NO: 1500792 - RNA, 11 nt, Human
aauauugcuga

SEQ ID NO: 1500793 - RNA, 12 nt, Human
aauauugcugau

SEQ ID NO: 1500794 - RNA, 13 nt, Human
aauauugcugaug

SEQ ID NO: 1500795 - RNA, 15 nt, Human
aauauugcugauggu

SEQ ID NO: 1500796 - RNA, 18 nt, Human
aauauugcugauggugca

SEQ ID NO: 1500797 - RNA, 21 nt, Human
aauauugcugauggugcaaug

SEQ ID NO: 1500798 - RNA, 22 nt, Human
aauauugcugauggugcaauga

SEQ ID NO: 1500799 - RNA, 21 nt, Human
aauaauuuuaagaaaucaaag

SEQ ID NO: 1500800 - RNA, 16 nt, Human
aauaauuuuuauauuu

SEQ ID NO: 1500801 - RNA, 17 nt, Human
aauaauuuuuauauuug

SEQ ID NO: 1500802 - RNA, 19 nt, Human
aauaauuuuuauauuugaa

SEQ ID NO: 1500803 - RNA, 20 nt, Human
aauaacugugaaguuuacau

SEQ ID NO: 1500804 - RNA, 14 nt, Human
aauaacugugaagu

SEQ ID NO: 1500805 - RNA, 16 nt, Human
aauaacugugaaguuu

SEQ ID NO: 1500806 - RNA, 20 nt, Human
aauaauuuuuauauuugaaa

SEQ ID NO: 1500807 - RNA, 19 nt, Human
uaaauaaugugaaacugga

SEQ ID NO: 1500808 - RNA, 14 nt, Human
uaaauuaacuuuua

SEQ ID NO: 1500809 - RNA, 12 nt, Human
uaaauuaacuuu

SEQ ID NO: 1500810 - RNA, 18 nt, Human
uaaauuaacuuuuauaaa

SEQ ID NO: 1500811 - RNA, 17 nt, Human
uaaauuaacuuuuauaa

SEQ ID NO: 1500812 - RNA, 16 nt, Human
uaaauuaacuuuuaua

SEQ ID NO: 1500813 - RNA, 15 nt, Human
uaaauuaacuuuuau

SEQ ID NO: 1500814 - RNA, 15 nt, Human
uaaauguugacaugg

SEQ ID NO: 1500815 - RNA, 20 nt, Human
uaaauguugaaagaucaaaa

SEQ ID NO: 1500816 - RNA, 15 nt, Human
uaaauguugaaagau

SEQ ID NO: 1500817 - RNA, 23 nt, Human
uaaaugcaccuggaauauauaac

SEQ ID NO: 1500818 - RNA, 18 nt, Human
uaaaucuccaaaauaaaa

SEQ ID NO: 1500819 - RNA, 15 nt, Human
uaaaucuccaaaaua

SEQ ID NO: 1500820 - RNA, 14 nt, Human
uaaaucuccaaaau

SEQ ID NO: 1500821 - RNA, 20 nt, Human
aaguuuuuauggcuuuugug

SEQ ID NO: 1500822 - RNA, 21 nt, Human
aauaacaaugaaaguugauaa

SEQ ID NO: 1500823 - RNA, 15 nt, Human
aauaacgauaaaaga

SEQ ID NO: 1500824 - RNA, 13 nt, Human
aauaacugugaag

SEQ ID NO: 1500825 - RNA, 16 nt, Human
aauaaaucauaaaacu

SEQ ID NO: 1500826 - RNA, 15 nt, Human
aauaaaacuuuuuaa

SEQ ID NO: 1500827 - RNA, 14 nt, Human
aauaaaacuuuuua

SEQ ID NO: 1500828 - RNA, 12 nt, Human
aauaaaacuuuu

SEQ ID NO: 1500829 - RNA, 18 nt, Human
aauaaaacuuuuuaaaau

SEQ ID NO: 1500830 - RNA, 19 nt, Human
acacccagcccacuucugc

SEQ ID NO: 1500831 - RNA, 18 nt, Human
acaccucugcacaagcug

SEQ ID NO: 1500832 - RNA, 14 nt, Human
acaccuugacaggg

SEQ ID NO: 1500833 - RNA, 15 nt, Human
acaccuugacagggc

SEQ ID NO: 1500834 - RNA, 16 nt, Human
acaccuugacagggca

SEQ ID NO: 1500835 - RNA, 19 nt, Human
acaccucugcacaagcugc

SEQ ID NO: 1500836 - RNA, 18 nt, Human
acacuaagagagaaugag

SEQ ID NO: 1500837 - RNA, 19 nt, Human
acacuaagagagaaugaga

SEQ ID NO: 1500838 - RNA, 20 nt, Human
acacuaaccacgcuggaccu

SEQ ID NO: 1500839 - RNA, 17 nt, Human
acacuaagagagaauga

SEQ ID NO: 1500840 - RNA, 19 nt, Human
acacuaaccacgcuggacc

SEQ ID NO: 1500841 - RNA, 16 nt, Human
acacuaaccacgcugg

SEQ ID NO: 1500842 - RNA, 17 nt, Human
acacuaaccacgcugga

SEQ ID NO: 1500843 - RNA, 22 nt, Human
uauaaccaguguuguggauuua

SEQ ID NO: 1500844 - RNA, 13 nt, Human
acacauguccaag

SEQ ID NO: 1500845 - RNA, 18 nt, Human
acacauguccaagaagcc

SEQ ID NO: 1500846 - RNA, 19 nt, Human
acacauguccaagaagccc

SEQ ID NO: 1500847 - RNA, 13 nt, Human
acacauuuuauuu

SEQ ID NO: 1500848 - RNA, 12 nt, Human
acacccagccca

SEQ ID NO: 1500849 - RNA, 13 nt, Human
acacccagcccac

SEQ ID NO: 1500850 - RNA, 21 nt, Human
acacauguccaagaagcccag

SEQ ID NO: 1500851 - RNA, 22 nt, Human
acacauguccaagaagcccagg

SEQ ID NO: 1500852 - RNA, 18 nt, Human
uaguuuugugaaggugau

SEQ ID NO: 1500853 - RNA, 18 nt, Human
uaguucagguaacaggca

SEQ ID NO: 1500854 - RNA, 22 nt, Human
uagguuuggacaaaauggaaua

SEQ ID NO: 1500855 - RNA, 14 nt, Human
uaguaauagagcaa

SEQ ID NO: 1500856 - RNA, 13 nt, Human
acacagugagucg

SEQ ID NO: 1500857 - RNA, 21 nt, Human
uagguuggcaaaaaggcagga

SEQ ID NO: 1500858 - RNA, 14 nt, Human
acacacugaagaag

SEQ ID NO: 1500859 - RNA, 11 nt, Human
acacagugagu

SEQ ID NO: 1500860 - RNA, 12 nt, Human
uaguguuggaga

SEQ ID NO: 1500861 - RNA, 16 nt, Human
uaguguuggagaagaa

SEQ ID NO: 1500862 - RNA, 17 nt, Human
uaguguuggagaagaac

SEQ ID NO: 1500863 - RNA, 14 nt, Human
uaguagagacaggg

SEQ ID NO: 1500864 - RNA, 20 nt, Human
uaguaauagagcaaaauuga

SEQ ID NO: 1500865 - RNA, 13 nt, Human
uaguagagacagg

SEQ ID NO: 1500866 - RNA, 13 nt, Human
acacacugaagaa

SEQ ID NO: 1500867 - RNA, 11 nt, Human
acacacagcuc

SEQ ID NO: 1500868 - RNA, 12 nt, Human
acacacagcucu

SEQ ID NO: 1500869 - RNA, 14 nt, Human
acacacacauacac

SEQ ID NO: 1500870 - RNA, 14 nt, Human
acacaacuauauug

SEQ ID NO: 1500871 - RNA, 17 nt, Human
acacaacuauauuguuu

SEQ ID NO: 1500872 - RNA, 21 nt, Human
acaaugguuuucuuguguguu

SEQ ID NO: 1500873 - RNA, 18 nt, Human
acacaacuauuuuuccaa

SEQ ID NO: 1500874 - RNA, 14 nt, Human
acaaugcuguauuu

SEQ ID NO: 1500875 - RNA, 17 nt, Human
acaaugcuguauuuuaa

SEQ ID NO: 1500876 - RNA, 18 nt, Human
acaaugcuguauuuuaaa

SEQ ID NO: 1500877 - RNA, 15 nt, Human
acaaugguuuucuug

SEQ ID NO: 1500878 - RNA, 12 nt, Human
acacugaagaag

SEQ ID NO: 1500879 - RNA, 14 nt, Human
acacugaagaagca

SEQ ID NO: 1500880 - RNA, 14 nt, Human
acacuguucucugc

SEQ ID NO: 1500881 - RNA, 15 nt, Human
acacuguucucugcc

SEQ ID NO: 1500882 - RNA, 22 nt, Human
acacuguucucugcccuccaag

SEQ ID NO: 1500883 - RNA, 23 nt, Human
acacuguucucugcccuccaaga

SEQ ID NO: 1500884 - RNA, 16 nt, Human
acacuguucucugccc

SEQ ID NO: 1500885 - RNA, 17 nt, Human
acacuguucucugcccu

SEQ ID NO: 1500886 - RNA, 18 nt, Human
acacuguucucugcccuc

SEQ ID NO: 1500887 - RNA, 20 nt, Human
acacuguucucugcccucca

SEQ ID NO: 1500888 - RNA, 16 nt, Human
uauaaguauucuaaau

SEQ ID NO: 1500889 - RNA, 11 nt, Human
acacucugaga

SEQ ID NO: 1500890 - RNA, 13 nt, Human
acacucugagacu

SEQ ID NO: 1500891 - RNA, 14 nt, Human
acacuccagugaga

SEQ ID NO: 1500892 - RNA, 12 nt, Human
uauauuuacaaa

SEQ ID NO: 1500893 - RNA, 15 nt, Human
uauauuuaaugauaa

SEQ ID NO: 1500894 - RNA, 19 nt, Human
acagaaagcagaacaguga

SEQ ID NO: 1500895 - RNA, 17 nt, Human
acagacacaggcccggc

SEQ ID NO: 1500896 - RNA, 18 nt, Human
acagacacaggcccggcu

SEQ ID NO: 1500897 - RNA, 22 nt, Human
acagacacaggcccggcuccag

SEQ ID NO: 1500898 - RNA, 19 nt, Human
acagacuggaagcacagcu

SEQ ID NO: 1500899 - RNA, 21 nt, Human
acagacuggaagcacagcuuc

SEQ ID NO: 1500900 - RNA, 22 nt, Human
acagacuggaagcacagcuuca

SEQ ID NO: 1500901 - RNA, 15 nt, Human
acacuguuucaaacu

SEQ ID NO: 1500902 - RNA, 16 nt, Human
acacuguuucaaacuu

SEQ ID NO: 1500903 - RNA, 13 nt, Human
acacuuaaaaaug

SEQ ID NO: 1500904 - RNA, 15 nt, Human
acacuuaaaaauggu

SEQ ID NO: 1500905 - RNA, 20 nt, Human
acagcccuucuuuccacaga

SEQ ID NO: 1500906 - RNA, 21 nt, Human
acagcccuucuuuccacagaa

SEQ ID NO: 1500907 - RNA, 23 nt, Human
acagcccgggcucugccucccau

SEQ ID NO: 1500908 - RNA, 16 nt, Human
acagcaaggagauuua

SEQ ID NO: 1500909 - RNA, 21 nt, Human
acagcccgggcucugccuccc

SEQ ID NO: 1500910 - RNA, 22 nt, Human
acagcccgggcucugccuccca

SEQ ID NO: 1500911 - RNA, 16 nt, Human
uaucuuguagcuuuau

SEQ ID NO: 1500912 - RNA, 16 nt, Human
uaucuuugauucuccu

SEQ ID NO: 1500913 - RNA, 17 nt, Human
uaucuuugauucuccuu

SEQ ID NO: 1500914 - RNA, 18 nt, Human
uaucuuugauucuccuuc

SEQ ID NO: 1500915 - RNA, 22 nt, Human
acagaguuguuacauuuuuaag

SEQ ID NO: 1500916 - RNA, 21 nt, Human
acagaguuguuacauuuuuaa

SEQ ID NO: 1500917 - RNA, 14 nt, Human
acagauaaucagug

SEQ ID NO: 1500918 - RNA, 20 nt, Human
acagauacuccuccaagguu

SEQ ID NO: 1500919 - RNA, 20 nt, Human
acagauagauauaugcucug

SEQ ID NO: 1500920 - RNA, 23 nt, Human
acagaugggugcuuggaggaagg

SEQ ID NO: 1500921 - RNA, 14 nt, Human
acagagcugggaug

SEQ ID NO: 1500922 - RNA, 10 nt, Human
acagagcugg

SEQ ID NO: 1500923 - RNA, 18 nt, Human
acagagcugggauguuuc

SEQ ID NO: 1500924 - RNA, 21 nt, Human
acagagcugggauguuucugu

SEQ ID NO: 1500925 - RNA, 16 nt, Human
acagaguuguuacauu

SEQ ID NO: 1500926 - RNA, 20 nt, Human
acagaguuguuacauuuuua

SEQ ID NO: 1500927 - RNA, 19 nt, Human
acagaguuguuacauuuuu

SEQ ID NO: 1500928 - RNA, 18 nt, Human
acagaguuguuacauuuu

SEQ ID NO: 1500929 - RNA, 17 nt, Human
acagaguuguuacauuu

SEQ ID NO: 1500930 - RNA, 21 nt, Human
acagagcaagugagacccugu

SEQ ID NO: 1500931 - RNA, 14 nt, Human
acagagcccacgcc

SEQ ID NO: 1500932 - RNA, 15 nt, Human
uauauuuauuacugu

SEQ ID NO: 1500933 - RNA, 19 nt, Human
uauauuuauuacuguaaga

SEQ ID NO: 1500934 - RNA, 20 nt, Human
uauauuuauuacuguaagaa

SEQ ID NO: 1500935 - RNA, 20 nt, Human
uaucccuacuguaauuugug

SEQ ID NO: 1500936 - RNA, 19 nt, Human
uaucccuacuguaauuugu

SEQ ID NO: 1500937 - RNA, 13 nt, Human
uaucucagggccu

SEQ ID NO: 1500938 - RNA, 15 nt, Human
uaucucagggccugg

SEQ ID NO: 1500939 - RNA, 19 nt, Human
uacugaaauaaacgucuua

SEQ ID NO: 1500940 - RNA, 22 nt, Human
uacugaaauaaacgucuuaaau

SEQ ID NO: 1500941 - RNA, 17 nt, Human
uacugagagugaacaaa

SEQ ID NO: 1500942 - RNA, 19 nt, Human
uacugagagugaacaaauu

SEQ ID NO: 1500943 - RNA, 15 nt, Human
uacuguaauuuguga

SEQ ID NO: 1500944 - RNA, 17 nt, Human
uacuguaauuugugaua

SEQ ID NO: 1500945 - RNA, 16 nt, Human
uacuguaauuugugau

SEQ ID NO: 1500946 - RNA, 18 nt, Human
aauugaggacacugauau

SEQ ID NO: 1500947 - RNA, 18 nt, Human
uacuguacaugaaaacac

SEQ ID NO: 1500948 - RNA, 22 nt, Human
uacucuacccucuuagaaaaac

SEQ ID NO: 1500949 - RNA, 18 nt, Human
uacuaaaaauacaaaaaa

SEQ ID NO: 1500950 - RNA, 18 nt, Human
uacgggaggguaaggcug

SEQ ID NO: 1500951 - RNA, 16 nt, Human
uacgucugacaggcaa

SEQ ID NO: 1500952 - RNA, 14 nt, Human
uacuaaaaauacaa

SEQ ID NO: 1500953 - RNA, 13 nt, Human
uacgugaguccug

SEQ ID NO: 1500954 - RNA, 13 nt, Human
aauugacccacaa

SEQ ID NO: 1500955 - RNA, 15 nt, Human
uacgucugacaggca

SEQ ID NO: 1500956 - RNA, 16 nt, Human
aauuuauacaggucau

SEQ ID NO: 1500957 - RNA, 17 nt, Human
aauuuauacaggucaua

SEQ ID NO: 1500958 - RNA, 23 nt, Human
aauuucuaggacugaauuaugaa

SEQ ID NO: 1500959 - RNA, 19 nt, Human
aauuucucccagucauuua

SEQ ID NO: 1500960 - RNA, 13 nt, Human
aauuucuauuaaa

SEQ ID NO: 1500961 - RNA, 18 nt, Human
aauuucuaggacugaauu

SEQ ID NO: 1500962 - RNA, 22 nt, Human
aauuucuaggacugaauuauga

SEQ ID NO: 1500963 - RNA, 17 nt, Human
aauuucuaggacugaau

SEQ ID NO: 1500964 - RNA, 17 nt, Human
aauuuauuauggcacau

SEQ ID NO: 1500965 - RNA, 14 nt, Human
aauuuauuauggca

SEQ ID NO: 1500966 - RNA, 13 nt, Human
aauuuauuauggc

SEQ ID NO: 1500967 - RNA, 15 nt, Human
aauuggagcucgugg

SEQ ID NO: 1500968 - RNA, 13 nt, Human
aauuuaguauuuu

SEQ ID NO: 1500969 - RNA, 17 nt, Human
aauuuacagagacagaa

SEQ ID NO: 1500970 - RNA, 18 nt, Human
aauuuacagagacagaaa

SEQ ID NO: 1500971 - RNA, 15 nt, Human
aauuuacauacucug

SEQ ID NO: 1500972 - RNA, 17 nt, Human
aauuuaccugaagucuu

SEQ ID NO: 1500973 - RNA, 19 nt, Human
uacuucuuaggguuaugau

SEQ ID NO: 1500974 - RNA, 15 nt, Human
uacuucugcuacaua

SEQ ID NO: 1500975 - RNA, 20 nt, Human
uacuucuccacccugcucuc

SEQ ID NO: 1500976 - RNA, 16 nt, Human
uacuucuuauacauuu

SEQ ID NO: 1500977 - RNA, 14 nt, Human
uacuucuuauacau

SEQ ID NO: 1500978 - RNA, 15 nt, Human
uacuucuuauacauu

SEQ ID NO: 1500979 - RNA, 13 nt, Human
uacuucuccaccc

SEQ ID NO: 1500980 - RNA, 18 nt, Human
uacuucuccacccugcuc

SEQ ID NO: 1500981 - RNA, 13 nt, Human
aauuugguuuuca

SEQ ID NO: 1500982 - RNA, 15 nt, Human
aauuugguuuucaca

SEQ ID NO: 1500983 - RNA, 21 nt, Human
aauuugguuuucacauuggaa

SEQ ID NO: 1500984 - RNA, 16 nt, Human
aauuuguuauaaugaa

SEQ ID NO: 1500985 - RNA, 21 nt, Human
aauuuuucuuauuucauuucu

SEQ ID NO: 1500986 - RNA, 22 nt, Human
aauuuuuuuaucgucacugcuu

SEQ ID NO: 1500987 - RNA, 22 nt, Human
aauuuuuucucuaggaaauauu

SEQ ID NO: 1500988 - RNA, 22 nt, Human
uagauaggucagugcaaauacu

SEQ ID NO: 1500989 - RNA, 17 nt, Human
uagauaggccaugggca

SEQ ID NO: 1500990 - RNA, 21 nt, Human
uagaugcaguucugaagaaga

SEQ ID NO: 1500991 - RNA, 20 nt, Human
uagaugcaguucugaagaag

SEQ ID NO: 1500992 - RNA, 14 nt, Human
acaaaacuuuucua

SEQ ID NO: 1500993 - RNA, 21 nt, Human
acaaagcgugguggacaugca

SEQ ID NO: 1500994 - RNA, 16 nt, Human
uagcuacuaauuuuaa

SEQ ID NO: 1500995 - RNA, 18 nt, Human
acaaugaagauaaaaaga

SEQ ID NO: 1500996 - RNA, 16 nt, Human
uagcucaggugucccu

SEQ ID NO: 1500997 - RNA, 18 nt, Human
acaagcgugagccacugc

SEQ ID NO: 1500998 - RNA, 22 nt, Human
acaagcuccaagcucccaggca

SEQ ID NO: 1500999 - RNA, 15 nt, Human
acaagcuccaagcuc

SEQ ID NO: 1501000 - RNA, 16 nt, Human
acaagcuccaagcucc

SEQ ID NO: 1501001 - RNA, 17 nt, Human
acaagcuccaagcuccc

SEQ ID NO: 1501002 - RNA, 19 nt, Human
acaagcuccaagcucccag

SEQ ID NO: 1501003 - RNA, 13 nt, Human
acaaauguaugau

SEQ ID NO: 1501004 - RNA, 17 nt, Human
acaaauuuacagagaca

SEQ ID NO: 1501005 - RNA, 14 nt, Human
acaacauguauaau

SEQ ID NO: 1501006 - RNA, 17 nt, Human
acaacaucuuuuucuac

SEQ ID NO: 1501007 - RNA, 18 nt, Human
acaagaccacguuucuaa

SEQ ID NO: 1501008 - RNA, 17 nt, Human
acaagaccacguuucua

SEQ ID NO: 1501009 - RNA, 16 nt, Human
acaagaccacguuucu

SEQ ID NO: 1501010 - RNA, 17 nt, Human
acaagaugguucuagca

SEQ ID NO: 1501011 - RNA, 22 nt, Human
acaagagcccaggccuccuaca

SEQ ID NO: 1501012 - RNA, 17 nt, Human
acaagcgugagccacug

SEQ ID NO: 1501013 - RNA, 13 nt, Human
acaagcuccaagc

SEQ ID NO: 1501014 - RNA, 12 nt, Human
guuuucuguucu

SEQ ID NO: 1501015 - RNA, 11 nt, Human
guuuucuguuc

SEQ ID NO: 1501016 - RNA, 23 nt, Human
guuuucugagaaagacuauucaa

SEQ ID NO: 1501017 - RNA, 18 nt, Human
guuuggggaugagaaagg

SEQ ID NO: 1501018 - RNA, 15 nt, Human
guuuuacugcagcuu

SEQ ID NO: 1501019 - RNA, 17 nt, Human
guuugcaaggaagccac

SEQ ID NO: 1501020 - RNA, 22 nt, Human
guuugcaaggaagccacagcug

SEQ ID NO: 1501021 - RNA, 13 nt, Human
guuugcaaggaag

SEQ ID NO: 1501022 - RNA, 14 nt, Human
guuugcaaggaagc

SEQ ID NO: 1501023 - RNA, 15 nt, Human
guuugcaaggaagcc

SEQ ID NO: 1501024 - RNA, 13 nt, Human
guuugccucugcc

SEQ ID NO: 1501025 - RNA, 16 nt, Human
guuugccucugccucu

SEQ ID NO: 1501026 - RNA, 23 nt, Human
guuucuaaaggcuaccuuuguau

SEQ ID NO: 1501027 - RNA, 22 nt, Human
guuucuaaaggcuaccuuugua

SEQ ID NO: 1501028 - RNA, 22 nt, Human
guuugauucagacagcugccug

SEQ ID NO: 1501029 - RNA, 21 nt, Human
guuucaaacauauauaacaau

SEQ ID NO: 1501030 - RNA, 17 nt, Human
aaggggaauugaggaca

SEQ ID NO: 1501031 - RNA, 22 nt, Human
aaggggaauguuugccucugcc

SEQ ID NO: 1501032 - RNA, 23 nt, Human
aaggggaauguuugccucugccu

SEQ ID NO: 1501033 - RNA, 19 nt, Human
aagggccuggccugagcug

SEQ ID NO: 1501034 - RNA, 14 nt, Human
aagggccuggccug

SEQ ID NO: 1501035 - RNA, 17 nt, Human
aagggccuggccugagc

SEQ ID NO: 1501036 - RNA, 12 nt, Human
aaguaauaugca

SEQ ID NO: 1501037 - RNA, 19 nt, Human
guuucuaaaggcuaccuuu

SEQ ID NO: 1501038 - RNA, 16 nt, Human
aaguaauaugcacaca

SEQ ID NO: 1501039 - RNA, 15 nt, Human
aaguaauaugcacac

SEQ ID NO: 1501040 - RNA, 13 nt, Human
aagguacuucaaa

SEQ ID NO: 1501041 - RNA, 17 nt, Human
aaggguaucaggugcug

SEQ ID NO: 1501042 - RNA, 16 nt, Human
aaggguaucaggugcu

SEQ ID NO: 1501043 - RNA, 10 nt, Human
guuuaaaauc

SEQ ID NO: 1501044 - RNA, 16 nt, Human
guuuaaaaucauuucu

SEQ ID NO: 1501045 - RNA, 18 nt, Human
guuguaccgcaaugugac

SEQ ID NO: 1501046 - RNA, 18 nt, Human
guuggucccccuuccaug

SEQ ID NO: 1501047 - RNA, 21 nt, Human
guugcccaggcuggcgugcag

SEQ ID NO: 1501048 - RNA, 14 nt, Human
aaggcuccaggagc

SEQ ID NO: 1501049 - RNA, 17 nt, Human
guugcccaggcaggucu

SEQ ID NO: 1501050 - RNA, 18 nt, Human
guugcccaggcaggucuu

SEQ ID NO: 1501051 - RNA, 19 nt, Human
guugcccaggcaggucuug

SEQ ID NO: 1501052 - RNA, 18 nt, Human
aaggccaaaggaagcaca

SEQ ID NO: 1501053 - RNA, 19 nt, Human
aaggcuaccuuuguauucu

SEQ ID NO: 1501054 - RNA, 19 nt, Human
aaggaugcuuguacauaau

SEQ ID NO: 1501055 - RNA, 17 nt, Human
aaggaugcuuguacaua

SEQ ID NO: 1501056 - RNA, 16 nt, Human
aaggaugcuuguacau

SEQ ID NO: 1501057 - RNA, 15 nt, Human
aaggaugcuuguaca

SEQ ID NO: 1501058 - RNA, 18 nt, Human
aaggaugcacagaguugu

SEQ ID NO: 1501059 - RNA, 22 nt, Human
aaggaugcacagaguuguuaca

SEQ ID NO: 1501060 - RNA, 20 nt, Human
aaggauccugagccagauuu

SEQ ID NO: 1501061 - RNA, 23 nt, Human
guugaugaucuuugcagacaggc

SEQ ID NO: 1501062 - RNA, 14 nt, Human
aaggauccugagcc

SEQ ID NO: 1501063 - RNA, 15 nt, Human
aaggauccugagcca

SEQ ID NO: 1501064 - RNA, 17 nt, Human
aaggauccugagccaga

SEQ ID NO: 1501065 - RNA, 18 nt, Human
aaggaugaucuaggaaga

SEQ ID NO: 1501066 - RNA, 23 nt, Human
aaggaugaucuaggaagacuuug

SEQ ID NO: 1501067 - RNA, 11 nt, Human
guucauacauu

SEQ ID NO: 1501068 - RNA, 14 nt, Human
guucauacauugua

SEQ ID NO: 1501069 - RNA, 17 nt, Human
aagcuaggccuggccag

SEQ ID NO: 1501070 - RNA, 18 nt, Human
aagcuaggccuggccaga

SEQ ID NO: 1501071 - RNA, 22 nt, Human
aagcuaggccuggccagaugca

SEQ ID NO: 1501072 - RNA, 18 nt, Human
guucagcuccagcucacc

SEQ ID NO: 1501073 - RNA, 16 nt, Human
guucagcuccagcuca

SEQ ID NO: 1501074 - RNA, 17 nt, Human
guucagcuccagcucac

SEQ ID NO: 1501075 - RNA, 17 nt, Human
guucaggguuggccccu

SEQ ID NO: 1501076 - RNA, 18 nt, Human
guucaggguuggccccug

SEQ ID NO: 1501077 - RNA, 19 nt, Human
guucaggguuggccccugc

SEQ ID NO: 1501078 - RNA, 20 nt, Human
guucaggguuggccccugcc

SEQ ID NO: 1501079 - RNA, 9 nt, Human
guucauaca

SEQ ID NO: 1501080 - RNA, 10 nt, Human
guucauacau

SEQ ID NO: 1501081 - RNA, 13 nt, Human
guucauacauauu

SEQ ID NO: 1501082 - RNA, 14 nt, Human
guucauacauauuu

SEQ ID NO: 1501083 - RNA, 23 nt, Human
guucauacauauuuuuguagcac

SEQ ID NO: 1501084 - RNA, 18 nt, Human
guuaaugauagcuacugu

SEQ ID NO: 1501085 - RNA, 14 nt, Human
guuaaguaugugua

SEQ ID NO: 1501086 - RNA, 17 nt, Human
guuaguaugaggcauuu

SEQ ID NO: 1501087 - RNA, 20 nt, Human
guuaguaugaggcauuuguu

SEQ ID NO: 1501088 - RNA, 14 nt, Human
guugacaugggaca

SEQ ID NO: 1501089 - RNA, 18 nt, Human
guugacaugggacauuug

SEQ ID NO: 1501090 - RNA, 22 nt, Human
guugaugaucuuugcagacagg

SEQ ID NO: 1501091 - RNA, 17 nt, Human
guucuuaguuugcaguu

SEQ ID NO: 1501092 - RNA, 21 nt, Human
guucuugguuuguaaauuaac

SEQ ID NO: 1501093 - RNA, 13 nt, Human
guucucuccuucu

SEQ ID NO: 1501094 - RNA, 18 nt, Human
guucuagcauggcauauu

SEQ ID NO: 1501095 - RNA, 19 nt, Human
guucuagcauggcauauuu

SEQ ID NO: 1501096 - RNA, 20 nt, Human
guucccuuugacgccauccc

SEQ ID NO: 1501097 - RNA, 21 nt, Human
guucccuuugacgccauccca

SEQ ID NO: 1501098 - RNA, 22 nt, Human
guucccuuugacgccaucccag

SEQ ID NO: 1501099 - RNA, 16 nt, Human
guucuacccaggugcu

SEQ ID NO: 1501100 - RNA, 22 nt, Human
aagcuauucaguaauaacucua

SEQ ID NO: 1501101 - RNA, 21 nt, Human
aagcucuacugaggugcuaug

SEQ ID NO: 1501102 - RNA, 16 nt, Human
guucccauuugcuccu

SEQ ID NO: 1501103 - RNA, 20 nt, Human
guucccauuugcuccuuucu

SEQ ID NO: 1501104 - RNA, 20 nt, Human
guuccauggccucuucagau

SEQ ID NO: 1501105 - RNA, 14 nt, Human
aagagguuuuaaag

SEQ ID NO: 1501106 - RNA, 18 nt, Human
aagagguuuuaaagcuuc

SEQ ID NO: 1501107 - RNA, 18 nt, Human
aagagguuuuaaaaaaau

SEQ ID NO: 1501108 - RNA, 17 nt, Human
gugguuuucuguucuuu

SEQ ID NO: 1501109 - RNA, 20 nt, Human
guggugguuuucuguucuuu

SEQ ID NO: 1501110 - RNA, 12 nt, Human
aagaugcagccg

SEQ ID NO: 1501111 - RNA, 12 nt, Human
aagcaaaggaga

SEQ ID NO: 1501112 - RNA, 13 nt, Human
aagcaaaggagau

SEQ ID NO: 1501113 - RNA, 14 nt, Human
aagaugugacaugu

SEQ ID NO: 1501114 - RNA, 18 nt, Human
aagaugugacauguuuua

SEQ ID NO: 1501115 - RNA, 18 nt, Human
guguuuccauauuuuaua

SEQ ID NO: 1501116 - RNA, 23 nt, Human
guguuuccuggcacugcuuccag

SEQ ID NO: 1501117 - RNA, 19 nt, Human
gugucuugcaauggcagcc

SEQ ID NO: 1501118 - RNA, 17 nt, Human
gugucuugcaauggcag

SEQ ID NO: 1501119 - RNA, 18 nt, Human
gugucuugcaauggcagc

SEQ ID NO: 1501120 - RNA, 18 nt, Human
gugucuuuuuucacuaca

SEQ ID NO: 1501121 - RNA, 17 nt, Human
gugugacuacuccccca

SEQ ID NO: 1501122 - RNA, 13 nt, Human
gugggagugggcc

SEQ ID NO: 1501123 - RNA, 14 nt, Human
gugggagugggccc

SEQ ID NO: 1501124 - RNA, 13 nt, Human
gugggauccucca

SEQ ID NO: 1501125 - RNA, 21 nt, Human
gugggacagucaccucaugga

SEQ ID NO: 1501126 - RNA, 23 nt, Human
guggcgcagcauauucaggaagc

SEQ ID NO: 1501127 - RNA, 14 nt, Human
guggguagacacac

SEQ ID NO: 1501128 - RNA, 14 nt, Human
guggugguuuucug

SEQ ID NO: 1501129 - RNA, 16 nt, Human
gugguuucagaaaugu

SEQ ID NO: 1501130 - RNA, 20 nt, Human
gugggggaucacagccucug

SEQ ID NO: 1501131 - RNA, 14 nt, Human
guggguacgggagg

SEQ ID NO: 1501132 - RNA, 13 nt, Human
aagacuauucaaa

SEQ ID NO: 1501133 - RNA, 18 nt, Human
aagacuaucuaaauguug

SEQ ID NO: 1501134 - RNA, 17 nt, Human
aagacugaguacguugu

SEQ ID NO: 1501135 - RNA, 22 nt, Human
aagacugaguacguugugcauu

SEQ ID NO: 1501136 - RNA, 21 nt, Human
aagacugaguacguugugcau

SEQ ID NO: 1501137 - RNA, 17 nt, Human
aagacuguacaaaguag

SEQ ID NO: 1501138 - RNA, 22 nt, Human
aagacccuuguggucccacccc

SEQ ID NO: 1501139 - RNA, 18 nt, Human
aagacccuugugguccca

SEQ ID NO: 1501140 - RNA, 21 nt, Human
aagacccuuguggucccaccc

SEQ ID NO: 1501141 - RNA, 16 nt, Human
aagacuaucuaaaugu

SEQ ID NO: 1501142 - RNA, 17 nt, Human
aagacuaucuaaauguu

SEQ ID NO: 1501143 - RNA, 18 nt, Human
gugcuaguaauuggaaag

SEQ ID NO: 1501144 - RNA, 21 nt, Human
gugcuaucucccccagcccca

SEQ ID NO: 1501145 - RNA, 22 nt, Human
gugcuaggaacacuccuucaca

SEQ ID NO: 1501146 - RNA, 18 nt, Human
gugcuaggaacacuccuu

SEQ ID NO: 1501147 - RNA, 17 nt, Human
aagaaggaaaaggcagg

SEQ ID NO: 1501148 - RNA, 19 nt, Human
aagaaggcagcagguggca

SEQ ID NO: 1501149 - RNA, 16 nt, Human
aagaagugaaaaucua

SEQ ID NO: 1501150 - RNA, 22 nt, Human
aagaagugaaaaucuacacucc

SEQ ID NO: 1501151 - RNA, 13 nt, Human
aagaaagaaaauc

SEQ ID NO: 1501152 - RNA, 20 nt, Human
aagaaagacuaucuaaaugu

SEQ ID NO: 1501153 - RNA, 22 nt, Human
aagaaagacuaucuaaauguug

SEQ ID NO: 1501154 - RNA, 18 nt, Human
aagaaaaaggaugcacag

SEQ ID NO: 1501155 - RNA, 17 nt, Human
aagaaaaaggaugcaca

SEQ ID NO: 1501156 - RNA, 15 nt, Human
aagaaaaaggaugca

SEQ ID NO: 1501157 - RNA, 22 nt, Human
aacuugucuuuggacccugagg

SEQ ID NO: 1501158 - RNA, 18 nt, Human
aacuugucuuuggacccu

SEQ ID NO: 1501159 - RNA, 13 nt, Human
aacuuuaccuuuu

SEQ ID NO: 1501160 - RNA, 12 nt, Human
gugccucuggga

SEQ ID NO: 1501161 - RNA, 13 nt, Human
gugccucugggac

SEQ ID NO: 1501162 - RNA, 14 nt, Human
gugccucugggacu

SEQ ID NO: 1501163 - RNA, 14 nt, Human
gugccuuauggaac

SEQ ID NO: 1501164 - RNA, 21 nt, Human
gugccuuauggaacacucuga

SEQ ID NO: 1501165 - RNA, 23 nt, Human
gugccuuauggaacacucugaga

SEQ ID NO: 1501166 - RNA, 15 nt, Human
gugccucaagagaag

SEQ ID NO: 1501167 - RNA, 21 nt, Human
gugaaccaccacacccagccc

SEQ ID NO: 1501168 - RNA, 22 nt, Human
gugccguguccccugacagggc

SEQ ID NO: 1501169 - RNA, 23 nt, Human
gugccguguccccugacagggcc

SEQ ID NO: 1501170 - RNA, 12 nt, Human
gugcuauguucu

SEQ ID NO: 1501171 - RNA, 22 nt, Human
gugcuaucucccccagccccau

SEQ ID NO: 1501172 - RNA, 21 nt, Human
gugcugggauuacaagcguga

SEQ ID NO: 1501173 - RNA, 22 nt, Human
gugcugggauuacaagcgugag

SEQ ID NO: 1501174 - RNA, 20 nt, Human
gugcugggauuacaggugug

SEQ ID NO: 1501175 - RNA, 23 nt, Human
guggacacagcucuucuccaggc

SEQ ID NO: 1501176 - RNA, 18 nt, Human
guggacacagcucuucuc

SEQ ID NO: 1501177 - RNA, 22 nt, Human
guggacacagcucuucuccagg

SEQ ID NO: 1501178 - RNA, 21 nt, Human
guggaugccugguggcagcug

SEQ ID NO: 1501179 - RNA, 16 nt, Human
aagaaugauuaugaau

SEQ ID NO: 1501180 - RNA, 20 nt, Human
guggcagcucaccucucccu

SEQ ID NO: 1501181 - RNA, 14 nt, Human
guggcagcucaccu

SEQ ID NO: 1501182 - RNA, 16 nt, Human
guggcagcucaccucu

SEQ ID NO: 1501183 - RNA, 19 nt, Human
guggauuuaacagaaaugu

SEQ ID NO: 1501184 - RNA, 18 nt, Human
guggauuuaacagaaaug

SEQ ID NO: 1501185 - RNA, 20 nt, Human
guggauuuaacagaaaugua

SEQ ID NO: 1501186 - RNA, 19 nt, Human
guggcaccagcagccugga

SEQ ID NO: 1501187 - RNA, 20 nt, Human
aagacaaaaagcuacuuauu

SEQ ID NO: 1501188 - RNA, 23 nt, Human
aagacaaaaagcuacuuauugua

SEQ ID NO: 1501189 - RNA, 18 nt, Human
aagaaugauuaugaauua

SEQ ID NO: 1501190 - RNA, 16 nt, Human
aagaauugaagcagga

SEQ ID NO: 1501191 - RNA, 15 nt, Human
guaggaagacuuugg

SEQ ID NO: 1501192 - RNA, 18 nt, Human
guaggaagguuaauguuc

SEQ ID NO: 1501193 - RNA, 17 nt, Human
aaaggagagcuagcagc

SEQ ID NO: 1501194 - RNA, 14 nt, Human
aaaggaugcacaga

SEQ ID NO: 1501195 - RNA, 12 nt, Human
guagcugggacu

SEQ ID NO: 1501196 - RNA, 18 nt, Human
guagcugggacuacaggc

SEQ ID NO: 1501197 - RNA, 19 nt, Human
guagcugggacuacaggca

SEQ ID NO: 1501198 - RNA, 21 nt, Human
guagcugggacuacaggcacc

SEQ ID NO: 1501199 - RNA, 14 nt, Human
aaauccuugaagau

SEQ ID NO: 1501200 - RNA, 13 nt, Human
aaaucgaugcagu

SEQ ID NO: 1501201 - RNA, 15 nt, Human
aaaucccauuuaaaa

SEQ ID NO: 1501202 - RNA, 18 nt, Human
aaaucccuuaccucggug

SEQ ID NO: 1501203 - RNA, 14 nt, Human
aaaucuacaguaca

SEQ ID NO: 1501204 - RNA, 19 nt, Human
aaaucuacacuccagugag

SEQ ID NO: 1501205 - RNA, 19 nt, Human
aaaucucaaauuucuaaau

SEQ ID NO: 1501206 - RNA, 17 nt, Human
aaaucucaaauuucuaa

SEQ ID NO: 1501207 - RNA, 16 nt, Human
aaaucucaaauuucua

SEQ ID NO: 1501208 - RNA, 15 nt, Human
aaaucucaaauuucu

SEQ ID NO: 1501209 - RNA, 17 nt, Human
aaaugaaaaucgugaca

SEQ ID NO: 1501210 - RNA, 21 nt, Human
aaaugaaagcagggacuugaa

SEQ ID NO: 1501211 - RNA, 22 nt, Human
aaaugaaagcagggacuugaac

SEQ ID NO: 1501212 - RNA, 13 nt, Human
aaaugagccuggc

SEQ ID NO: 1501213 - RNA, 19 nt, Human
aaaugagccuggcaagaau

SEQ ID NO: 1501214 - RNA, 16 nt, Human
aaaugagguacucucc

SEQ ID NO: 1501215 - RNA, 23 nt, Human
aaaugagguacucuccuggaaau

SEQ ID NO: 1501216 - RNA, 17 nt, Human
aaaugaggucagagccu

SEQ ID NO: 1501217 - RNA, 19 nt, Human
aaaugaggucagagccugc

SEQ ID NO: 1501218 - RNA, 22 nt, Human
aaaugcaccuggaauauauaac

SEQ ID NO: 1501219 - RNA, 18 nt, Human
aaaugcaccuggaauaua

SEQ ID NO: 1501220 - RNA, 16 nt, Human
aaaugaucuuuucaag

SEQ ID NO: 1501221 - RNA, 14 nt, Human
aaaugcaccuggaa

SEQ ID NO: 1501222 - RNA, 16 nt, Human
aaaugcaacaacaugu

SEQ ID NO: 1501223 - RNA, 19 nt, Human
aaauggcuuccuggcaaua

SEQ ID NO: 1501224 - RNA, 23 nt, Human
aaaugccuuacccucauguucuu

SEQ ID NO: 1501225 - RNA, 15 nt, Human
aaaugggcagagcag

SEQ ID NO: 1501226 - RNA, 18 nt, Human
aaaugggcagagcagaga

SEQ ID NO: 1501227 - RNA, 20 nt, Human
aaaugggcagagcagagacc

SEQ ID NO: 1501228 - RNA, 14 nt, Human
aaaugcauuucuaa

SEQ ID NO: 1501229 - RNA, 13 nt, Human
aaaugcccagccc

SEQ ID NO: 1501230 - RNA, 14 nt, Human
aaaugcccagcccc

SEQ ID NO: 1501231 - RNA, 15 nt, Human
aaaugcccagccccu

SEQ ID NO: 1501232 - RNA, 18 nt, Human
aaaugcccagccccuucu

SEQ ID NO: 1501233 - RNA, 13 nt, Human
aaaugcccagcuu

SEQ ID NO: 1501234 - RNA, 15 nt, Human
guaugggagagaaga

SEQ ID NO: 1501235 - RNA, 13 nt, Human
guaugguggcugg

SEQ ID NO: 1501236 - RNA, 15 nt, Human
guauucuuauuuaau

SEQ ID NO: 1501237 - RNA, 14 nt, Human
guaugauucccagc

SEQ ID NO: 1501238 - RNA, 14 nt, Human
guaugggagagaag

SEQ ID NO: 1501239 - RNA, 15 nt, Human
guaucccuacuguaa

SEQ ID NO: 1501240 - RNA, 19 nt, Human
aaaugggggugcauuugag

SEQ ID NO: 1501241 - RNA, 22 nt, Human
aaauguaagggaaacugccagc

SEQ ID NO: 1501242 - RNA, 18 nt, Human
aaaugggggugcauuuga

SEQ ID NO: 1501243 - RNA, 17 nt, Human
aaaugggggugcauuug

SEQ ID NO: 1501244 - RNA, 16 nt, Human
aaaugggggugcauuu

SEQ ID NO: 1501245 - RNA, 15 nt, Human
aaaugggggugcauu

SEQ ID NO: 1501246 - RNA, 20 nt, Human
guauuuaauagguuuggaca

SEQ ID NO: 1501247 - RNA, 22 nt, Human
guauuggcuagagguucaaaga

SEQ ID NO: 1501248 - RNA, 21 nt, Human
aaauuaacuuuuauaaacuuu

SEQ ID NO: 1501249 - RNA, 23 nt, Human
aaauuaacuuuuauaaacuuuac

SEQ ID NO: 1501250 - RNA, 22 nt, Human
aaauuaacuuuuauaaacuuua

SEQ ID NO: 1501251 - RNA, 14 nt, Human
aaauucaugcugcu

SEQ ID NO: 1501252 - RNA, 22 nt, Human
aaauuauuuuguucauacauau

SEQ ID NO: 1501253 - RNA, 20 nt, Human
aaauuauuuuguucauacau

SEQ ID NO: 1501254 - RNA, 21 nt, Human
aaauuauuuuguucauacaua

SEQ ID NO: 1501255 - RNA, 22 nt, Human
aaauuauauaaguauucuaaau

SEQ ID NO: 1501256 - RNA, 17 nt, Human
aaauuauuuuguucaua

SEQ ID NO: 1501257 - RNA, 19 nt, Human
aaauuauuuuguucauaca

SEQ ID NO: 1501258 - RNA, 16 nt, Human
aaauuauauaaguauu

SEQ ID NO: 1501259 - RNA, 18 nt, Human
aaauuauauaaguauucu

SEQ ID NO: 1501260 - RNA, 18 nt, Human
aaauuucagcagcugcag

SEQ ID NO: 1501261 - RNA, 17 nt, Human
aaauuucagcagcugca

SEQ ID NO: 1501262 - RNA, 20 nt, Human
aaauuuaguauuuuguuuca

SEQ ID NO: 1501263 - RNA, 22 nt, Human
aaauuuccugggagcuuuugua

SEQ ID NO: 1501264 - RNA, 12 nt, Human
aaauuucuaaau

SEQ ID NO: 1501265 - RNA, 20 nt, Human
guauuuuugacagaauaugu

SEQ ID NO: 1501266 - RNA, 15 nt, Human
guauuuuuuuacuaa

SEQ ID NO: 1501267 - RNA, 14 nt, Human
guauuuuuuuacua

SEQ ID NO: 1501268 - RNA, 16 nt, Human
gucaaauugugugaaa

SEQ ID NO: 1501269 - RNA, 19 nt, Human
gucaacucauauuuucaug

SEQ ID NO: 1501270 - RNA, 16 nt, Human
gucacacacuuuggcu

SEQ ID NO: 1501271 - RNA, 20 nt, Human
gucacacaguauuacuucug

SEQ ID NO: 1501272 - RNA, 19 nt, Human
gucaaaguggugagaggca

SEQ ID NO: 1501273 - RNA, 21 nt, Human
guauuuuuuuacuaauagaca

SEQ ID NO: 1501274 - RNA, 17 nt, Human
guauuuuuuuacuaaua

SEQ ID NO: 1501275 - RNA, 12 nt, Human
aaccacagcagu

SEQ ID NO: 1501276 - RNA, 23 nt, Human
aaccaucauugaaaucuuuuugc

SEQ ID NO: 1501277 - RNA, 21 nt, Human
aaccaucauugaaaucuuuuu

SEQ ID NO: 1501278 - RNA, 20 nt, Human
aaccacaucuugcucugcug

SEQ ID NO: 1501279 - RNA, 22 nt, Human
aaccacaucuugcucugcugac

SEQ ID NO: 1501280 - RNA, 19 nt, Human
aaccaucauugaaaucuuu

SEQ ID NO: 1501281 - RNA, 20 nt, Human
aaccaucauugaaaucuuuu

SEQ ID NO: 1501282 - RNA, 20 nt, Human
aaccuagggugauauuaacc

SEQ ID NO: 1501283 - RNA, 17 nt, Human
aaccucaaaaugucuaa

SEQ ID NO: 1501284 - RNA, 13 nt, Human
aacccccagccug

SEQ ID NO: 1501285 - RNA, 14 nt, Human
aacccccagccugc

SEQ ID NO: 1501286 - RNA, 15 nt, Human
aacccccagccugcu

SEQ ID NO: 1501287 - RNA, 17 nt, Human
aaccuccgccucuuggg

SEQ ID NO: 1501288 - RNA, 14 nt, Human
aaccuccugggcua

SEQ ID NO: 1501289 - RNA, 20 nt, Human
aacccauauuuguacaccaa

SEQ ID NO: 1501290 - RNA, 17 nt, Human
aacccagcucuggucca

SEQ ID NO: 1501291 - RNA, 13 nt, Human
aacccaaauguuc

SEQ ID NO: 1501292 - RNA, 18 nt, Human
aacccaaauguucaucaa

SEQ ID NO: 1501293 - RNA, 11 nt, Human
aacccagcucu

SEQ ID NO: 1501294 - RNA, 13 nt, Human
aacccagcucugg

SEQ ID NO: 1501295 - RNA, 14 nt, Human
aacccagcucuggu

SEQ ID NO: 1501296 - RNA, 14 nt, Human
aacuccagaaagug

SEQ ID NO: 1501297 - RNA, 18 nt, Human
aacuagcuuggaaacugg

SEQ ID NO: 1501298 - RNA, 21 nt, Human
aacuccagaaagugacaagcu

SEQ ID NO: 1501299 - RNA, 18 nt, Human
aacucguuaauuuguagu

SEQ ID NO: 1501300 - RNA, 13 nt, Human
aacucccuuucaa

SEQ ID NO: 1501301 - RNA, 14 nt, Human
aacucccuuucaac

SEQ ID NO: 1501302 - RNA, 19 nt, Human
gugaaccaccacacccagc

SEQ ID NO: 1501303 - RNA, 15 nt, Human
aacuacaaacaaaau

SEQ ID NO: 1501304 - RNA, 19 nt, Human
aacuacaaacaaaauuucu

SEQ ID NO: 1501305 - RNA, 22 nt, Human
aacguggcugcuucaaggaucc

SEQ ID NO: 1501306 - RNA, 16 nt, Human
aacguggcugcuucaa

SEQ ID NO: 1501307 - RNA, 19 nt, Human
aacguggcugcuucaagga

SEQ ID NO: 1501308 - RNA, 15 nt, Human
aacguggcugcuuca

SEQ ID NO: 1501309 - RNA, 19 nt, Human
gucuuauauauuguagaua

SEQ ID NO: 1501310 - RNA, 15 nt, Human
gucuuagauguauau

SEQ ID NO: 1501311 - RNA, 24 nt, Human
gucuuuucuugcaugaggcuagug

SEQ ID NO: 1501312 - RNA, 14 nt, Human
gucuuuucuugcau

SEQ ID NO: 1501313 - RNA, 19 nt, Human
gucuuuucuugcaugaggc

SEQ ID NO: 1501314 - RNA, 18 nt, Human
gucuuuggacccugaggc

SEQ ID NO: 1501315 - RNA, 17 nt, Human
gucuuuggacccugagg

SEQ ID NO: 1501316 - RNA, 14 nt, Human
gucuuuggacccug

SEQ ID NO: 1501317 - RNA, 15 nt, Human
gucuuuggacccuga

SEQ ID NO: 1501318 - RNA, 22 nt, Human
gucuuaauuaaaagaauauuuu

SEQ ID NO: 1501319 - RNA, 21 nt, Human
gucuuaauuaaaagaauauuu

SEQ ID NO: 1501320 - RNA, 21 nt, Human
guccaagcauuuagauguaua

SEQ ID NO: 1501321 - RNA, 22 nt, Human
gucauuugagcagggcucagcg

SEQ ID NO: 1501322 - RNA, 24 nt, Human
guccaagcauaccaacacgagcag

SEQ ID NO: 1501323 - RNA, 21 nt, Human
gucauuugagcagggcucagc

SEQ ID NO: 1501324 - RNA, 21 nt, Human
aacacuguucucugcccucca

SEQ ID NO: 1501325 - RNA, 16 nt, Human
aacacuguucucugcc

SEQ ID NO: 1501326 - RNA, 17 nt, Human
aacacugcuuguguuuu

SEQ ID NO: 1501327 - RNA, 14 nt, Human
aacacugcuugugu

SEQ ID NO: 1501328 - RNA, 16 nt, Human
aacacugucuugaaga

SEQ ID NO: 1501329 - RNA, 15 nt, Human
aacacuguucucugc

SEQ ID NO: 1501330 - RNA, 20 nt, Human
aacacuguucucugcccucc

SEQ ID NO: 1501331 - RNA, 14 nt, Human
aacacucugagacu

SEQ ID NO: 1501332 - RNA, 12 nt, Human
aacacucugaga

SEQ ID NO: 1501333 - RNA, 13 nt, Human
aacacucugagac

SEQ ID NO: 1501334 - RNA, 21 nt, Human
aacacucauugaccugaggcc

SEQ ID NO: 1501335 - RNA, 12 nt, Human
aacacuccuuca

SEQ ID NO: 1501336 - RNA, 11 nt, Human
aacacucugag

SEQ ID NO: 1501337 - RNA, 14 nt, Human
aacaaugcuguauu

SEQ ID NO: 1501338 - RNA, 14 nt, Human
aacaaugaagauaa

SEQ ID NO: 1501339 - RNA, 18 nt, Human
aacaaugaagauaaaaag

SEQ ID NO: 1501340 - RNA, 15 nt, Human
aacaagucagucauu

SEQ ID NO: 1501341 - RNA, 18 nt, Human
aacaagucagucauucag

SEQ ID NO: 1501342 - RNA, 15 nt, Human
aacaaggaugaauua

SEQ ID NO: 1501343 - RNA, 15 nt, Human
aacaaggcaaggcug

SEQ ID NO: 1501344 - RNA, 21 nt, Human
aacaagccuccuuuuaaagua

SEQ ID NO: 1501345 - RNA, 20 nt, Human
aacaagaccacguuucuaaa

SEQ ID NO: 1501346 - RNA, 19 nt, Human
aacaagaccacguuucuaa

SEQ ID NO: 1501347 - RNA, 17 nt, Human
aacaagaccacguuucu

SEQ ID NO: 1501348 - RNA, 16 nt, Human
aacaagaccacguuuc

SEQ ID NO: 1501349 - RNA, 21 nt, Human
gucacacaguauuacuucugc

SEQ ID NO: 1501350 - RNA, 16 nt, Human
gucacaggcaggucca

SEQ ID NO: 1501351 - RNA, 13 nt, Human
gucacaggcaggu

SEQ ID NO: 1501352 - RNA, 15 nt, Human
gucacaggcaggucc

SEQ ID NO: 1501353 - RNA, 19 nt, Human
aacaguuguguuugaagca

SEQ ID NO: 1501354 - RNA, 22 nt, Human
aacaguagugauaguuguaccg

SEQ ID NO: 1501355 - RNA, 23 nt, Human
aacaggcugggcuucaguggcag

SEQ ID NO: 1501356 - RNA, 19 nt, Human
aacagacuggaagcacagc

SEQ ID NO: 1501357 - RNA, 20 nt, Human
aacagacuggaagcacagcu

SEQ ID NO: 1501358 - RNA, 22 nt, Human
aacaggcugggcuucaguggca

SEQ ID NO: 1501359 - RNA, 13 nt, Human
aacaggcugggcu

SEQ ID NO: 1501360 - RNA, 21 nt, Human
aacagaaauguacagcaagga

SEQ ID NO: 1501361 - RNA, 11 nt, Human
aacagaaaugu

SEQ ID NO: 1501362 - RNA, 10 nt, Human
aacagaaaug

SEQ ID NO: 1501363 - RNA, 21 nt, Human
guccggucccugucccagugc

SEQ ID NO: 1501364 - RNA, 18 nt, Human
aacauuugguaaggggaa

SEQ ID NO: 1501365 - RNA, 16 nt, Human
aacauuugcugucagc

SEQ ID NO: 1501366 - RNA, 16 nt, Human
aacauacucccaucug

SEQ ID NO: 1501367 - RNA, 14 nt, Human
aacauacucccauc

SEQ ID NO: 1501368 - RNA, 15 nt, Human
aacauacucccaucu

SEQ ID NO: 1501369 - RNA, 22 nt, Human
cugcaaccugauugugucucuu

SEQ ID NO: 1501370 - RNA, 18 nt, Human
cugcaagaauugaagcag

SEQ ID NO: 1501371 - RNA, 20 nt, Human
cugcaaccuccgccucuugg

SEQ ID NO: 1501372 - RNA, 22 nt, Human
cugcaaccuccgccucuugggu

SEQ ID NO: 1501373 - RNA, 14 nt, Human
cugcaaccugauug

SEQ ID NO: 1501374 - RNA, 19 nt, Human
cugcaaccugauugugucu

SEQ ID NO: 1501375 - RNA, 21 nt, Human
cugcaaccugauugugucucu

SEQ ID NO: 1501376 - RNA, 23 nt, Human
cugcaccgggccacagagaaagu

SEQ ID NO: 1501377 - RNA, 12 nt, Human
cugcaagggagu

SEQ ID NO: 1501378 - RNA, 20 nt, Human
cugcaagaauugaagcagga

SEQ ID NO: 1501379 - RNA, 15 nt, Human
cucuuauaucuauau

SEQ ID NO: 1501380 - RNA, 18 nt, Human
cucuuauaucuauauuuu

SEQ ID NO: 1501381 - RNA, 14 nt, Human
cucuuaugggcugg

SEQ ID NO: 1501382 - RNA, 15 nt, Human
cucuuaugggcuggg

SEQ ID NO: 1501383 - RNA, 16 nt, Human
cugaugcuucuucaga

SEQ ID NO: 1501384 - RNA, 17 nt, Human
cugaugcuucuucagag

SEQ ID NO: 1501385 - RNA, 18 nt, Human
cugaugggcaacccccag

SEQ ID NO: 1501386 - RNA, 21 nt, Human
cugaugggcaacccccagccu

SEQ ID NO: 1501387 - RNA, 18 nt, Human
cugaugcuucuucagaga

SEQ ID NO: 1501388 - RNA, 19 nt, Human
cugaugcuucuucagagac

SEQ ID NO: 1501389 - RNA, 20 nt, Human
cugaugcuucuucagagacu

SEQ ID NO: 1501390 - RNA, 24 nt, Human
cugaugggcaacccccagccugcu

SEQ ID NO: 1501391 - RNA, 22 nt, Human
cugaugggcaacccccagccug

SEQ ID NO: 1501392 - RNA, 23 nt, Human
cugaugggcaacccccagccugc

SEQ ID NO: 1501393 - RNA, 21 nt, Human
cugcaaaggguaucaggugcu

SEQ ID NO: 1501394 - RNA, 22 nt, Human
cugcaaaggguaucaggugcug

SEQ ID NO: 1501395 - RNA, 12 nt, Human
cugcagcuuugu

SEQ ID NO: 1501396 - RNA, 13 nt, Human
cugcaggcagcca

SEQ ID NO: 1501397 - RNA, 14 nt, Human
cugcaggcagccag

SEQ ID NO: 1501398 - RNA, 15 nt, Human
cugcaggcagccagg

SEQ ID NO: 1501399 - RNA, 16 nt, Human
cugcaggcagccaggc

SEQ ID NO: 1501400 - RNA, 17 nt, Human
cugcaggcagccaggcc

SEQ ID NO: 1501401 - RNA, 18 nt, Human
cugcaggcagccaggcca

SEQ ID NO: 1501402 - RNA, 19 nt, Human
cugcaggcagccaggccac

SEQ ID NO: 1501403 - RNA, 20 nt, Human
cugcaggcagccaggccaca

SEQ ID NO: 1501404 - RNA, 12 nt, Human
cugcagccugca

SEQ ID NO: 1501405 - RNA, 14 nt, Human
cugcagccugcagg

SEQ ID NO: 1501406 - RNA, 19 nt, Human
cugcagccugcaggaccuc

SEQ ID NO: 1501407 - RNA, 15 nt, Human
cugcagccugcagga

SEQ ID NO: 1501408 - RNA, 18 nt, Human
cugcacuccagccugggu

SEQ ID NO: 1501409 - RNA, 16 nt, Human
cugcacuccagccugg

SEQ ID NO: 1501410 - RNA, 17 nt, Human
cugcacuccagccuggg

SEQ ID NO: 1501411 - RNA, 24 nt, Human
cugcagccucaaccuccugggcua

SEQ ID NO: 1501412 - RNA, 19 nt, Human
cugcacuccagccugggug

SEQ ID NO: 1501413 - RNA, 23 nt, Human
cugcagccucaaccuccugggcu

SEQ ID NO: 1501414 - RNA, 16 nt, Human
cugcacuauagccuag

SEQ ID NO: 1501415 - RNA, 17 nt, Human
cugcacuauagccuagg

SEQ ID NO: 1501416 - RNA, 18 nt, Human
cugcacuauagccuaggu

SEQ ID NO: 1501417 - RNA, 20 nt, Human
cugcacuauagccuagguga

SEQ ID NO: 1501418 - RNA, 13 nt, Human
cugcacuccagcc

SEQ ID NO: 1501419 - RNA, 22 nt, Human
cugcacuauagccuaggugaca

SEQ ID NO: 1501420 - RNA, 23 nt, Human
cugcacuauagccuaggugacag

SEQ ID NO: 1501421 - RNA, 17 nt, Human
cugcacuccagccugag

SEQ ID NO: 1501422 - RNA, 20 nt, Human
cugcacuccagccugagcga

SEQ ID NO: 1501423 - RNA, 16 nt, Human
cugcacuccagccuga

SEQ ID NO: 1501424 - RNA, 15 nt, Human
cugcacuccagccug

SEQ ID NO: 1501425 - RNA, 12 nt, Human
cugcccuuaccu

SEQ ID NO: 1501426 - RNA, 16 nt, Human
cugcccuuaccugcca

SEQ ID NO: 1501427 - RNA, 17 nt, Human
cugcccuuaccugccag

SEQ ID NO: 1501428 - RNA, 16 nt, Human
cugccauauucuguug

SEQ ID NO: 1501429 - RNA, 16 nt, Human
cugccauccagguuca

SEQ ID NO: 1501430 - RNA, 18 nt, Human
cugccauccagguucagc

SEQ ID NO: 1501431 - RNA, 19 nt, Human
cugccauccagguucagcu

SEQ ID NO: 1501432 - RNA, 19 nt, Human
cugcccccaggacugggcc

SEQ ID NO: 1501433 - RNA, 17 nt, Human
cugcccccaggacuggg

SEQ ID NO: 1501434 - RNA, 18 nt, Human
cugcccccaggacugggc

SEQ ID NO: 1501435 - RNA, 13 nt, Human
cugcccccaggac

SEQ ID NO: 1501436 - RNA, 14 nt, Human
cugcccccaggacu

SEQ ID NO: 1501437 - RNA, 15 nt, Human
cugcccccaggacug

SEQ ID NO: 1501438 - RNA, 16 nt, Human
cugcccccaggacugg

SEQ ID NO: 1501439 - RNA, 18 nt, Human
cugcauuuaaaagauaca

SEQ ID NO: 1501440 - RNA, 17 nt, Human
cugcauuuaaaagauac

SEQ ID NO: 1501441 - RNA, 20 nt, Human
cugccagggacagagggggu

SEQ ID NO: 1501442 - RNA, 22 nt, Human
cugccagggacagagggggugg

SEQ ID NO: 1501443 - RNA, 23 nt, Human
cugccagggacagaggggguggc

SEQ ID NO: 1501444 - RNA, 14 nt, Human
cugcauuuaaaaga

SEQ ID NO: 1501445 - RNA, 22 nt, Human
cugggagaaccaaaaagaggcu

SEQ ID NO: 1501446 - RNA, 13 nt, Human
cugggacuacagg

SEQ ID NO: 1501447 - RNA, 15 nt, Human
cugggacuacaggca

SEQ ID NO: 1501448 - RNA, 16 nt, Human
cugggacuacaggcac

SEQ ID NO: 1501449 - RNA, 14 nt, Human
cugggacaugggaa

SEQ ID NO: 1501450 - RNA, 18 nt, Human
cugggacaugggaaaggg

SEQ ID NO: 1501451 - RNA, 22 nt, Human
cugggacaugggaaaggggaag

SEQ ID NO: 1501452 - RNA, 14 nt, Human
cuggcuaugcauuu

SEQ ID NO: 1501453 - RNA, 13 nt, Human
cuggcuaugcauu

SEQ ID NO: 1501454 - RNA, 16 nt, Human
cuggcuaugcauuuga

SEQ ID NO: 1501455 - RNA, 15 nt, Human
cuggcuaugcauuug

SEQ ID NO: 1501456 - RNA, 22 nt, Human
cuggcuaugcauuugaaaauuu

SEQ ID NO: 1501457 - RNA, 12 nt, Human
cuggcccuuccu

SEQ ID NO: 1501458 - RNA, 15 nt, Human
cuggguguggcgcag

SEQ ID NO: 1501459 - RNA, 14 nt, Human
cuggguguggcgca

SEQ ID NO: 1501460 - RNA, 22 nt, Human
cuggguggcaccagcagccugg

SEQ ID NO: 1501461 - RNA, 21 nt, Human
cuggguggcaccagcagccug

SEQ ID NO: 1501462 - RNA, 21 nt, Human
cuggugccucaccccuugcca

SEQ ID NO: 1501463 - RNA, 11 nt, Human
cuggugcccug

SEQ ID NO: 1501464 - RNA, 20 nt, Human
cugggcagguuggugggggc

SEQ ID NO: 1501465 - RNA, 13 nt, Human
cugggcagaggaa

SEQ ID NO: 1501466 - RNA, 16 nt, Human
cugggcagaggaaagc

SEQ ID NO: 1501467 - RNA, 12 nt, Human
cugggcagagga

SEQ ID NO: 1501468 - RNA, 20 nt, Human
cugggcagaggaaagcaaag

SEQ ID NO: 1501469 - RNA, 13 nt, Human
cuggggagaaagu

SEQ ID NO: 1501470 - RNA, 14 nt, Human
cuggggagaaagua

SEQ ID NO: 1501471 - RNA, 18 nt, Human
cuggguggcaccagcagc

SEQ ID NO: 1501472 - RNA, 20 nt, Human
cuggguggcaccagcagccu

SEQ ID NO: 1501473 - RNA, 16 nt, Human
cuggaguucugguucc

SEQ ID NO: 1501474 - RNA, 17 nt, Human
cuggaguucugguuccu

SEQ ID NO: 1501475 - RNA, 15 nt, Human
cuggaguucugguuc

SEQ ID NO: 1501476 - RNA, 14 nt, Human
cuggaugauauuuu

SEQ ID NO: 1501477 - RNA, 15 nt, Human
cuggaugcagccuca

SEQ ID NO: 1501478 - RNA, 16 nt, Human
cuggaugcccaggaau

SEQ ID NO: 1501479 - RNA, 13 nt, Human
cuggaugcccagg

SEQ ID NO: 1501480 - RNA, 14 nt, Human
cuggaugcccagga

SEQ ID NO: 1501481 - RNA, 15 nt, Human
cuggaugcccaggaa

SEQ ID NO: 1501482 - RNA, 16 nt, Human
cugcucacauaucugu

SEQ ID NO: 1501483 - RNA, 19 nt, Human
cugcucacauaucugucau

SEQ ID NO: 1501484 - RNA, 13 nt, Human
cugcugacagugu

SEQ ID NO: 1501485 - RNA, 15 nt, Human
cugcugacaguguug

SEQ ID NO: 1501486 - RNA, 13 nt, Human
cugcugaaggcuc

SEQ ID NO: 1501487 - RNA, 14 nt, Human
cugcugaaggcucg

SEQ ID NO: 1501488 - RNA, 15 nt, Human
cugcugaaggcucga

SEQ ID NO: 1501489 - RNA, 12 nt, Human
cugcugacagug

SEQ ID NO: 1501490 - RNA, 18 nt, Human
cuucaucugacuaugaca

SEQ ID NO: 1501491 - RNA, 23 nt, Human
cuucaugcugucuacacuaagag

SEQ ID NO: 1501492 - RNA, 19 nt, Human
cuucaucugacuaugacau

SEQ ID NO: 1501493 - RNA, 16 nt, Human
cuucauccuccucaga

SEQ ID NO: 1501494 - RNA, 12 nt, Human
cuucaucugacu

SEQ ID NO: 1501495 - RNA, 13 nt, Human
cuucaucccucug

SEQ ID NO: 1501496 - RNA, 15 nt, Human
cuucauccuccucag

SEQ ID NO: 1501497 - RNA, 18 nt, Human
cuucaguggcagcugcuu

SEQ ID NO: 1501498 - RNA, 23 nt, Human
cuucagagacuccugcaggcagc

SEQ ID NO: 1501499 - RNA, 24 nt, Human
cuucagagacuccugcaggcagcc

SEQ ID NO: 1501500 - RNA, 14 nt, Human
cuucaccuuugucc

SEQ ID NO: 1501501 - RNA, 20 nt, Human
cuuauuagaaaaauauuaua

SEQ ID NO: 1501502 - RNA, 18 nt, Human
cuuauugcccacgcugga

SEQ ID NO: 1501503 - RNA, 17 nt, Human
cuucaccuuugucccca

SEQ ID NO: 1501504 - RNA, 20 nt, Human
cuucaccuuuguccccaccg

SEQ ID NO: 1501505 - RNA, 17 nt, Human
cuucagagacuccugca

SEQ ID NO: 1501506 - RNA, 16 nt, Human
cuucagagacuccugc

SEQ ID NO: 1501507 - RNA, 21 nt, Human
cuucagagacuccugcaggca

SEQ ID NO: 1501508 - RNA, 22 nt, Human
cuucagagacuccugcaggcag

SEQ ID NO: 1501509 - RNA, 11 nt, Human
cuucagacaua

SEQ ID NO: 1501510 - RNA, 16 nt, Human
cuuccauggacuuugu

SEQ ID NO: 1501511 - RNA, 17 nt, Human
cuuccauggacuuuguu

SEQ ID NO: 1501512 - RNA, 18 nt, Human
cuuccagugaggcucugc

SEQ ID NO: 1501513 - RNA, 19 nt, Human
cuuccagugaggcucugcc

SEQ ID NO: 1501514 - RNA, 20 nt, Human
cuuccagugaggcucugccc

SEQ ID NO: 1501515 - RNA, 18 nt, Human
cuuagcagggaaacagcu

SEQ ID NO: 1501516 - RNA, 21 nt, Human
cuuagcagggaaacagcuaau

SEQ ID NO: 1501517 - RNA, 12 nt, Human
cuuauugcccac

SEQ ID NO: 1501518 - RNA, 13 nt, Human
cuuauugcccacg

SEQ ID NO: 1501519 - RNA, 22 nt, Human
cuuaugggcuggguucuaccca

SEQ ID NO: 1501520 - RNA, 23 nt, Human
cuuaugggcuggguucuacccag

SEQ ID NO: 1501521 - RNA, 14 nt, Human
cuuaugggcugggu

SEQ ID NO: 1501522 - RNA, 21 nt, Human
cuuaugggcuggguucuaccc

SEQ ID NO: 1501523 - RNA, 13 nt, Human
cuguucagcucca

SEQ ID NO: 1501524 - RNA, 14 nt, Human
cuguucagcuccag

SEQ ID NO: 1501525 - RNA, 20 nt, Human
cugugucuugcaauggcagc

SEQ ID NO: 1501526 - RNA, 16 nt, Human
cugugucuugcaaugg

SEQ ID NO: 1501527 - RNA, 19 nt, Human
cugugucuugcaauggcag

SEQ ID NO: 1501528 - RNA, 20 nt, Human
cugugcugagucugaaggcu

SEQ ID NO: 1501529 - RNA, 22 nt, Human
cugugcugagucugaaggcugg

SEQ ID NO: 1501530 - RNA, 11 nt, Human
cugugcugccc

SEQ ID NO: 1501531 - RNA, 22 nt, Human
cugugucagguggggcagcuug

SEQ ID NO: 1501532 - RNA, 21 nt, Human
cugugucagguggggcagcuu

SEQ ID NO: 1501533 - RNA, 20 nt, Human
cugugucagcauagaaguaa

SEQ ID NO: 1501534 - RNA, 19 nt, Human
cugugucagguggggcagc

SEQ ID NO: 1501535 - RNA, 14 nt, Human
cugugucuugcaau

SEQ ID NO: 1501536 - RNA, 14 nt, Human
cugugucucccuuc

SEQ ID NO: 1501537 - RNA, 19 nt, Human
cugugucucccuucauccu

SEQ ID NO: 1501538 - RNA, 16 nt, Human
cuguugggccaggagc

SEQ ID NO: 1501539 - RNA, 17 nt, Human
cuguugggccaggagcc

SEQ ID NO: 1501540 - RNA, 20 nt, Human
cuguugggccaggagccucc

SEQ ID NO: 1501541 - RNA, 13 nt, Human
cuuacacaauggu

SEQ ID NO: 1501542 - RNA, 14 nt, Human
cuuaaacaaaugua

SEQ ID NO: 1501543 - RNA, 19 nt, Human
cuuacccucauguucuuaa

SEQ ID NO: 1501544 - RNA, 18 nt, Human
cuuacccucauguucuua

SEQ ID NO: 1501545 - RNA, 17 nt, Human
cuuacccucauguucuu

SEQ ID NO: 1501546 - RNA, 13 nt, Human
cuuaccucggugc

SEQ ID NO: 1501547 - RNA, 19 nt, Human
cuuaccucggugccuuccu

SEQ ID NO: 1501548 - RNA, 21 nt, Human
cuuaccucggugccuuccucu

SEQ ID NO: 1501549 - RNA, 13 nt, Human
cuuaccugccagg

SEQ ID NO: 1501550 - RNA, 16 nt, Human
cuuguggacacagcuc

SEQ ID NO: 1501551 - RNA, 14 nt, Human
cuuguggacacagc

SEQ ID NO: 1501552 - RNA, 15 nt, Human
cuuguggacacagcu

SEQ ID NO: 1501553 - RNA, 13 nt, Human
cuuguggacacag

SEQ ID NO: 1501554 - RNA, 12 nt, Human
cuuuaauauaaa

SEQ ID NO: 1501555 - RNA, 23 nt, Human
cuuucaauaggaaaaacugauuu

SEQ ID NO: 1501556 - RNA, 20 nt, Human
cuuucaauaggaaaaacuga

SEQ ID NO: 1501557 - RNA, 21 nt, Human
cuuucaauaggaaaaacugau

SEQ ID NO: 1501558 - RNA, 22 nt, Human
cuuucaauaggaaaaacugauu

SEQ ID NO: 1501559 - RNA, 15 nt, Human
cuuuucaaaacauuu

SEQ ID NO: 1501560 - RNA, 20 nt, Human
cuuuggucuacacugugcug

SEQ ID NO: 1501561 - RNA, 16 nt, Human
cuuuggucuacacugu

SEQ ID NO: 1501562 - RNA, 20 nt, Human
cuuuggggcuuuuacaccag

SEQ ID NO: 1501563 - RNA, 21 nt, Human
cuuuggggcuuuuacaccagu

SEQ ID NO: 1501564 - RNA, 15 nt, Human
cuuuuauaaacuuua

SEQ ID NO: 1501565 - RNA, 18 nt, Human
cuuuuauaaacuuuaccu

SEQ ID NO: 1501566 - RNA, 16 nt, Human
cuuuuauaaacuuuac

SEQ ID NO: 1501567 - RNA, 19 nt, Human
cuuuuauaaacuuuaccuu

SEQ ID NO: 1501568 - RNA, 17 nt, Human
cuuuuauuucuuaaaca

SEQ ID NO: 1501569 - RNA, 19 nt, Human
cuuugacgccaucccagcc

SEQ ID NO: 1501570 - RNA, 21 nt, Human
cuuugacgccaucccagcccc

SEQ ID NO: 1501571 - RNA, 22 nt, Human
cuuugacgccaucccagcccca

SEQ ID NO: 1501572 - RNA, 21 nt, Human
cuuugagugucuuaauuaaaa

SEQ ID NO: 1501573 - RNA, 13 nt, Human
cuuugauucuccu

SEQ ID NO: 1501574 - RNA, 14 nt, Human
cuuugauucuccuu

SEQ ID NO: 1501575 - RNA, 15 nt, Human
cuuugauucuccuuc

SEQ ID NO: 1501576 - RNA, 14 nt, Human
cuuucuccccugcc

SEQ ID NO: 1501577 - RNA, 18 nt, Human
cuuucuccccugccccca

SEQ ID NO: 1501578 - RNA, 19 nt, Human
cuuucuccccugcccccag

SEQ ID NO: 1501579 - RNA, 22 nt, Human
cuuucuccccugcccccaggac

SEQ ID NO: 1501580 - RNA, 23 nt, Human
cuuucuccccugcccccaggacu

SEQ ID NO: 1501581 - RNA, 24 nt, Human
cuuucuccccugcccccaggacug

SEQ ID NO: 1501582 - RNA, 13 nt, Human
cuugcucugcuga

SEQ ID NO: 1501583 - RNA, 19 nt, Human
cuugccucuguccccuucu

SEQ ID NO: 1501584 - RNA, 23 nt, Human
cuugccucuguccccuucucuca

SEQ ID NO: 1501585 - RNA, 12 nt, Human
cuugcucugcug

SEQ ID NO: 1501586 - RNA, 14 nt, Human
cuugacagaacacu

SEQ ID NO: 1501587 - RNA, 16 nt, Human
cuugacagaacacugu

SEQ ID NO: 1501588 - RNA, 17 nt, Human
cuugacagaacacuguc

SEQ ID NO: 1501589 - RNA, 23 nt, Human
cuugaaugaugccaugaggaaca

SEQ ID NO: 1501590 - RNA, 12 nt, Human
cuugacagggca

SEQ ID NO: 1501591 - RNA, 20 nt, Human
cuugccgucuaccugagggg

SEQ ID NO: 1501592 - RNA, 23 nt, Human
cuugccgucuaccugaggggccu

SEQ ID NO: 1501593 - RNA, 15 nt, Human
cuucuguuuuauaau

SEQ ID NO: 1501594 - RNA, 20 nt, Human
cuucuguuuuauaauuuugu

SEQ ID NO: 1501595 - RNA, 20 nt, Human
cuucuucagagacuccugca

SEQ ID NO: 1501596 - RNA, 21 nt, Human
cuucuucagagacuccugcag

SEQ ID NO: 1501597 - RNA, 22 nt, Human
cuucuucagagacuccugcagg

SEQ ID NO: 1501598 - RNA, 23 nt, Human
cuucuucagagacuccugcaggc

SEQ ID NO: 1501599 - RNA, 20 nt, Human
cuugaaugaugccaugagga

SEQ ID NO: 1501600 - RNA, 12 nt, Human
gauuauuggaaa

SEQ ID NO: 1501601 - RNA, 16 nt, Human
gauuuaccacuugugu

SEQ ID NO: 1501602 - RNA, 15 nt, Human
gauuuaccacuugug

SEQ ID NO: 1501603 - RNA, 12 nt, Human
gauucuucugcu

SEQ ID NO: 1501604 - RNA, 17 nt, Human
gauucuuccucccuccc

SEQ ID NO: 1501605 - RNA, 18 nt, Human
gauucuuccucccucccu

SEQ ID NO: 1501606 - RNA, 18 nt, Human
gauucuccugccucagcc

SEQ ID NO: 1501607 - RNA, 15 nt, Human
gauucuccugccuca

SEQ ID NO: 1501608 - RNA, 17 nt, Human
gauucuccugccucagc

SEQ ID NO: 1501609 - RNA, 14 nt, Human
gaugaucuuugcag

SEQ ID NO: 1501610 - RNA, 14 nt, Human
gaugguucuagcau

SEQ ID NO: 1501611 - RNA, 18 nt, Human
gauguagaggagaaacug

SEQ ID NO: 1501612 - RNA, 16 nt, Human
gaugagugagcaugcc

SEQ ID NO: 1501613 - RNA, 15 nt, Human
gaugaucuaggaaga

SEQ ID NO: 1501614 - RNA, 21 nt, Human
gaugaucuaggaagacuuugg

SEQ ID NO: 1501615 - RNA, 16 nt, Human
gaugaucuuuaaaaua

SEQ ID NO: 1501616 - RNA, 20 nt, Human
gcaaguauuagaauaccaca

SEQ ID NO: 1501617 - RNA, 22 nt, Human
gcaauagucaaauugugugaaa

SEQ ID NO: 1501618 - RNA, 13 nt, Human
gcaagucaggguu

SEQ ID NO: 1501619 - RNA, 14 nt, Human
gcacaccgggcacu

SEQ ID NO: 1501620 - RNA, 23 nt, Human
gcacaguuuucugagaaagacua

SEQ ID NO: 1501621 - RNA, 22 nt, Human
gcacaguuuucugagaaagacu

SEQ ID NO: 1501622 - RNA, 20 nt, Human
gcacaccgggcacucagaag

SEQ ID NO: 1501623 - RNA, 16 nt, Human
gauuuuuuuuuccuuc

SEQ ID NO: 1501624 - RNA, 22 nt, Human
gcacuccccugcuggguguggc

SEQ ID NO: 1501625 - RNA, 13 nt, Human
gcacucagaagac

SEQ ID NO: 1501626 - RNA, 16 nt, Human
gcacucagaagacacu

SEQ ID NO: 1501627 - RNA, 17 nt, Human
gcacucagaagacacug

SEQ ID NO: 1501628 - RNA, 17 nt, Human
gcacuccccugcugggu

SEQ ID NO: 1501629 - RNA, 23 nt, Human
gcaccgggccacagagaaaguac

SEQ ID NO: 1501630 - RNA, 14 nt, Human
gcaccgggccacag

SEQ ID NO: 1501631 - RNA, 23 nt, Human
gcacaucagcacgauuucuguuu

SEQ ID NO: 1501632 - RNA, 22 nt, Human
gcacaucagcacgauuucuguu

SEQ ID NO: 1501633 - RNA, 17 nt, Human
gagucaccaagcccagu

SEQ ID NO: 1501634 - RNA, 16 nt, Human
gagucaccaagcccag

SEQ ID NO: 1501635 - RNA, 22 nt, Human
gagucagaaguuucugccgcag

SEQ ID NO: 1501636 - RNA, 12 nt, Human
gagucccaccuu

SEQ ID NO: 1501637 - RNA, 13 nt, Human
gagucccaccuug

SEQ ID NO: 1501638 - RNA, 18 nt, Human
gagugacagaggcagccc

SEQ ID NO: 1501639 - RNA, 20 nt, Human
gagugacagaggcagcccca

SEQ ID NO: 1501640 - RNA, 15 nt, Human
gaguugauucagcuc

SEQ ID NO: 1501641 - RNA, 16 nt, Human
gaguugauucagcucu

SEQ ID NO: 1501642 - RNA, 17 nt, Human
gaguugauucagcucug

SEQ ID NO: 1501643 - RNA, 15 nt, Human
gaggucgaggcagga

SEQ ID NO: 1501644 - RNA, 23 nt, Human
gaggugaccccagguuucuaugu

SEQ ID NO: 1501645 - RNA, 16 nt, Human
gaguuuaaauuguaau

SEQ ID NO: 1501646 - RNA, 18 nt, Human
gaguugauucagcucugc

SEQ ID NO: 1501647 - RNA, 22 nt, Human
gaguuguuacauuuuuaagugc

SEQ ID NO: 1501648 - RNA, 13 nt, Human
gaggccagagaca

SEQ ID NO: 1501649 - RNA, 14 nt, Human
gaggccagagacac

SEQ ID NO: 1501650 - RNA, 19 nt, Human
gaggccagagacacaagcc

SEQ ID NO: 1501651 - RNA, 22 nt, Human
gaggcuagugugguguuuccug

SEQ ID NO: 1501652 - RNA, 19 nt, Human
gaggcuccacuuggucugu

SEQ ID NO: 1501653 - RNA, 12 nt, Human
gaggcuccacuu

SEQ ID NO: 1501654 - RNA, 23 nt, Human
gaggcuccacuuggucugugaga

SEQ ID NO: 1501655 - RNA, 22 nt, Human
gaggccaaggugggaggauugc

SEQ ID NO: 1501656 - RNA, 15 nt, Human
gaggcagggucucac

SEQ ID NO: 1501657 - RNA, 18 nt, Human
gaggcagggucucacucu

SEQ ID NO: 1501658 - RNA, 20 nt, Human
gaggacgcucucuggccuuc

SEQ ID NO: 1501659 - RNA, 14 nt, Human
gaggcagggucuca

SEQ ID NO: 1501660 - RNA, 15 nt, Human
gaggacgcucucugg

SEQ ID NO: 1501661 - RNA, 20 nt, Human
gagggcugagccugguccca

SEQ ID NO: 1501662 - RNA, 12 nt, Human
gaggggccucuu

SEQ ID NO: 1501663 - RNA, 19 nt, Human
gagccuugaacuuugaccu

SEQ ID NO: 1501664 - RNA, 13 nt, Human
gagccuugaacuu

SEQ ID NO: 1501665 - RNA, 23 nt, Human
gagccuuccaggggugggacacc

SEQ ID NO: 1501666 - RNA, 20 nt, Human
gagccuuccaggggugggac

SEQ ID NO: 1501667 - RNA, 14 nt, Human
gacauugcggacag

SEQ ID NO: 1501668 - RNA, 15 nt, Human
gacauugcggacagc

SEQ ID NO: 1501669 - RNA, 17 nt, Human
gacauugcggacagcca

SEQ ID NO: 1501670 - RNA, 21 nt, Human
gacagugagacucugucucag

SEQ ID NO: 1501671 - RNA, 20 nt, Human
gacagcccgggcucugccuc

SEQ ID NO: 1501672 - RNA, 13 nt, Human
gacagaagaaggc

SEQ ID NO: 1501673 - RNA, 18 nt, Human
gacagcccgggcucugcc

SEQ ID NO: 1501674 - RNA, 19 nt, Human
gacagcccgggcucugccu

SEQ ID NO: 1501675 - RNA, 16 nt, Human
gacauuugcucaugga

SEQ ID NO: 1501676 - RNA, 17 nt, Human
gacauuugcucauggaa

SEQ ID NO: 1501677 - RNA, 19 nt, Human
gacauuguuggccaaagcc

SEQ ID NO: 1501678 - RNA, 18 nt, Human
gaccagggauuuccauga

SEQ ID NO: 1501679 - RNA, 20 nt, Human
gaccagggauuuccaugaug

SEQ ID NO: 1501680 - RNA, 12 nt, Human
gaccaucccuga

SEQ ID NO: 1501681 - RNA, 13 nt, Human
gaccaucccugaa

SEQ ID NO: 1501682 - RNA, 19 nt, Human
gaccaucccugaaggcccc

SEQ ID NO: 1501683 - RNA, 15 nt, Human
gacacacugaagaag

SEQ ID NO: 1501684 - RNA, 16 nt, Human
gacacacugaagaagc

SEQ ID NO: 1501685 - RNA, 14 nt, Human
gacacagcucuucu

SEQ ID NO: 1501686 - RNA, 16 nt, Human
gacacagcucuucucc

SEQ ID NO: 1501687 - RNA, 17 nt, Human
gacacagcucuucucca

SEQ ID NO: 1501688 - RNA, 22 nt, Human
gacacagcucuucuccaggcug

SEQ ID NO: 1501689 - RNA, 23 nt, Human
gacacagcucuucuccaggcugu

SEQ ID NO: 1501690 - RNA, 12 nt, Human
gacacaggcccg

SEQ ID NO: 1501691 - RNA, 17 nt, Human
gacagcccgggcucugc

SEQ ID NO: 1501692 - RNA, 21 nt, Human
gacagaaagcagaacagugau

SEQ ID NO: 1501693 - RNA, 13 nt, Human
gacagaacacugu

SEQ ID NO: 1501694 - RNA, 14 nt, Human
gacagaacacuguc

SEQ ID NO: 1501695 - RNA, 15 nt, Human
gacagaacacugucu

SEQ ID NO: 1501696 - RNA, 14 nt, Human
gacucuuaagaaga

SEQ ID NO: 1501697 - RNA, 15 nt, Human
gacucuuaagaagac

SEQ ID NO: 1501698 - RNA, 21 nt, Human
gacucuuaagaagacugcauu

SEQ ID NO: 1501699 - RNA, 20 nt, Human
gacugaauuaugaaacuuuu

SEQ ID NO: 1501700 - RNA, 16 nt, Human
gacugaauuucuuuug

SEQ ID NO: 1501701 - RNA, 14 nt, Human
gacugaauuaugaa

SEQ ID NO: 1501702 - RNA, 14 nt, Human
gacugaauuucuuu

SEQ ID NO: 1501703 - RNA, 11 nt, Human
gaccugaggcc

SEQ ID NO: 1501704 - RNA, 13 nt, Human
gaccugaggcccu

SEQ ID NO: 1501705 - RNA, 14 nt, Human
gaccugaggcccuu

SEQ ID NO: 1501706 - RNA, 16 nt, Human
gacgccaucccagccc

SEQ ID NO: 1501707 - RNA, 14 nt, Human
gaccucugcagcaa

SEQ ID NO: 1501708 - RNA, 18 nt, Human
gaccucgugccaccccga

SEQ ID NO: 1501709 - RNA, 20 nt, Human
gaccaucccugaaggccccg

SEQ ID NO: 1501710 - RNA, 14 nt, Human
gaccaucccugaag

SEQ ID NO: 1501711 - RNA, 16 nt, Human
gacgcucucuggccuu

SEQ ID NO: 1501712 - RNA, 17 nt, Human
gacgcucucuggccuuc

SEQ ID NO: 1501713 - RNA, 19 nt, Human
gacgccaucccagccccaa

SEQ ID NO: 1501714 - RNA, 17 nt, Human
gacgccaucccagcccc

SEQ ID NO: 1501715 - RNA, 18 nt, Human
gacgccaucccagcccca

SEQ ID NO: 1501716 - RNA, 16 nt, Human
gacgcuacccgggaag

SEQ ID NO: 1501717 - RNA, 18 nt, Human
gacgcuacccgggaaggg

SEQ ID NO: 1501718 - RNA, 19 nt, Human
gacgcuacccgggaagggg

SEQ ID NO: 1501719 - RNA, 22 nt, Human
gaagcuccgcuuucuacccagc

SEQ ID NO: 1501720 - RNA, 20 nt, Human
gaaggcuggguucugauccu

SEQ ID NO: 1501721 - RNA, 22 nt, Human
gaaggcuggguucugauccuag

SEQ ID NO: 1501722 - RNA, 18 nt, Human
gaaggccccgcccaggcu

SEQ ID NO: 1501723 - RNA, 19 nt, Human
gaaggccccgcccaggcuu

SEQ ID NO: 1501724 - RNA, 21 nt, Human
gaaggcucgagcaugccugga

SEQ ID NO: 1501725 - RNA, 15 nt, Human
gaaggcuggguucug

SEQ ID NO: 1501726 - RNA, 19 nt, Human
gaaggcuggguucugaucc

SEQ ID NO: 1501727 - RNA, 13 nt, Human
gaauauaaacacu

SEQ ID NO: 1501728 - RNA, 22 nt, Human
gaaggggagauaaggguaucug

SEQ ID NO: 1501729 - RNA, 14 nt, Human
gaauauguuucaaa

SEQ ID NO: 1501730 - RNA, 15 nt, Human
gaauauguuucaaac

SEQ ID NO: 1501731 - RNA, 21 nt, Human
gaauauaaacacuauauggca

SEQ ID NO: 1501732 - RNA, 14 nt, Human
gaauauaaacacua

SEQ ID NO: 1501733 - RNA, 20 nt, Human
gaauauguuucaaacuuugg

SEQ ID NO: 1501734 - RNA, 14 nt, Human
gaauauugcugaug

SEQ ID NO: 1501735 - RNA, 15 nt, Human
gaauauugcugaugg

SEQ ID NO: 1501736 - RNA, 19 nt, Human
gaauauugcugauggugca

SEQ ID NO: 1501737 - RNA, 20 nt, Human
gaauauugcugauggugcaa

SEQ ID NO: 1501738 - RNA, 14 nt, Human
gaacugaaaucaua

SEQ ID NO: 1501739 - RNA, 21 nt, Human
gaacugccuuuggcagaguuc

SEQ ID NO: 1501740 - RNA, 11 nt, Human
gaacuggcugc

SEQ ID NO: 1501741 - RNA, 12 nt, Human
gaacuggcugca

SEQ ID NO: 1501742 - RNA, 23 nt, Human
gaagcaacccaaauguucaucaa

SEQ ID NO: 1501743 - RNA, 15 nt, Human
gaagcacaugccucu

SEQ ID NO: 1501744 - RNA, 17 nt, Human
gaagcacaugccucucu

SEQ ID NO: 1501745 - RNA, 20 nt, Human
gaagcacaugccucucucag

SEQ ID NO: 1501746 - RNA, 14 nt, Human
gaagcaaaauuuuu

SEQ ID NO: 1501747 - RNA, 22 nt, Human
gaagacaaugacuuacuguaca

SEQ ID NO: 1501748 - RNA, 23 nt, Human
gaagacaaugugaaaagaaaaau

SEQ ID NO: 1501749 - RNA, 16 nt, Human
gaagacaaugacuuac

SEQ ID NO: 1501750 - RNA, 21 nt, Human
gaagcacaugccucucucagg

SEQ ID NO: 1501751 - RNA, 15 nt, Human
gaagcagaggaagga

SEQ ID NO: 1501752 - RNA, 19 nt, Human
aaaauuuuuucucuaggaa

SEQ ID NO: 1501753 - RNA, 22 nt, Human
aaaauuuuuucucuaggaaaua

SEQ ID NO: 1501754 - RNA, 14 nt, Human
aaacaaaauuucua

SEQ ID NO: 1501755 - RNA, 15 nt, Human
aaacaaaauuucuau

SEQ ID NO: 1501756 - RNA, 17 nt, Human
aaacaaggaugaauuaa

SEQ ID NO: 1501757 - RNA, 18 nt, Human
aaacaagaccacguuucu

SEQ ID NO: 1501758 - RNA, 19 nt, Human
aaacaacuucaauauccaa

SEQ ID NO: 1501759 - RNA, 12 nt, Human
aaaauggaauac

SEQ ID NO: 1501760 - RNA, 21 nt, Human
aaaauggacguguuaugacuc

SEQ ID NO: 1501761 - RNA, 21 nt, Human
aaaauguaggguuauaauaau

SEQ ID NO: 1501762 - RNA, 21 nt, Human
aaaauauuauguguuuccaua

SEQ ID NO: 1501763 - RNA, 14 nt, Human
aaaauauuaugugu

SEQ ID NO: 1501764 - RNA, 15 nt, Human
aaaauauuauguguu

SEQ ID NO: 1501765 - RNA, 14 nt, Human
gggcuggacugagg

SEQ ID NO: 1501766 - RNA, 15 nt, Human
gggcuggacugaggc

SEQ ID NO: 1501767 - RNA, 19 nt, Human
gggcuggacugaggccuga

SEQ ID NO: 1501768 - RNA, 14 nt, Human
aaacacaacuauau

SEQ ID NO: 1501769 - RNA, 19 nt, Human
aaacaagucagucauucag

SEQ ID NO: 1501770 - RNA, 13 nt, Human
aaacauauauaac

SEQ ID NO: 1501771 - RNA, 16 nt, Human
aaacauauauaacaau

SEQ ID NO: 1501772 - RNA, 19 nt, Human
aaacauauauaacaaugcu

SEQ ID NO: 1501773 - RNA, 21 nt, Human
aaacauauauaacaaugcugu

SEQ ID NO: 1501774 - RNA, 22 nt, Human
aaacaugcuacacacugcaugu

SEQ ID NO: 1501775 - RNA, 17 nt, Human
ggggccaguuggucccc

SEQ ID NO: 1501776 - RNA, 19 nt, Human
ggggccaguuggucccccu

SEQ ID NO: 1501777 - RNA, 16 nt, Human
ggggcccugccuccuu

SEQ ID NO: 1501778 - RNA, 19 nt, Human
ggggcccugccuccuuugu

SEQ ID NO: 1501779 - RNA, 23 nt, Human
ggggcccugccuccuuugugagg

SEQ ID NO: 1501780 - RNA, 15 nt, Human
ggggaccucaggccu

SEQ ID NO: 1501781 - RNA, 16 nt, Human
ggggaccucaggccug

SEQ ID NO: 1501782 - RNA, 17 nt, Human
ggggaccucaggccugg

SEQ ID NO: 1501783 - RNA, 20 nt, Human
ggguaucaggugcugccauc

SEQ ID NO: 1501784 - RNA, 22 nt, Human
gggucucacuauguugcccagg

SEQ ID NO: 1501785 - RNA, 12 nt, Human
gggucucacucu

SEQ ID NO: 1501786 - RNA, 23 nt, Human
gggucucacuauguugcccaggc

SEQ ID NO: 1501787 - RNA, 16 nt, Human
aaaccacagcaguuga

SEQ ID NO: 1501788 - RNA, 18 nt, Human
aaacuaaggcccucuuga

SEQ ID NO: 1501789 - RNA, 15 nt, Human
aaacgucuuaaauau

SEQ ID NO: 1501790 - RNA, 16 nt, Human
aaacguggcugcuuca

SEQ ID NO: 1501791 - RNA, 17 nt, Human
aaacguggcugcuucaa

SEQ ID NO: 1501792 - RNA, 20 nt, Human
aaacguggcugcuucaagga

SEQ ID NO: 1501793 - RNA, 22 nt, Human
aaacugguauuuuaucuuugau

SEQ ID NO: 1501794 - RNA, 16 nt, Human
aaacugguauuuuauc

SEQ ID NO: 1501795 - RNA, 16 nt, Human
aaacuggauuaaacuu

SEQ ID NO: 1501796 - RNA, 18 nt, Human
aaagagaacuuccagauc

SEQ ID NO: 1501797 - RNA, 19 nt, Human
aaagacuuuuccaacccuc

SEQ ID NO: 1501798 - RNA, 22 nt, Human
aaagacuauucaaacagucuca

SEQ ID NO: 1501799 - RNA, 14 nt, Human
aaagacuccaaaga

SEQ ID NO: 1501800 - RNA, 15 nt, Human
aaagacuguacaaag

SEQ ID NO: 1501801 - RNA, 13 nt, Human
aaagacuccaaag

SEQ ID NO: 1501802 - RNA, 23 nt, Human
aaagacuauucaaacagucucag

SEQ ID NO: 1501803 - RNA, 15 nt, Human
aaagaugagugagca

SEQ ID NO: 1501804 - RNA, 13 nt, Human
aaagaggcuaugu

SEQ ID NO: 1501805 - RNA, 18 nt, Human
aaagaggcuaugugagca

SEQ ID NO: 1501806 - RNA, 20 nt, Human
aaagaggcagcuugaaacug

SEQ ID NO: 1501807 - RNA, 22 nt, Human
aaagauuacuuuuucuuuaugu

SEQ ID NO: 1501808 - RNA, 15 nt, Human
aaagauuuucagaaa

SEQ ID NO: 1501809 - RNA, 16 nt, Human
aaagaaugauuaugaa

SEQ ID NO: 1501810 - RNA, 14 nt, Human
aaacuuuaccuuuu

SEQ ID NO: 1501811 - RNA, 14 nt, Human
ggucccaccccaca

SEQ ID NO: 1501812 - RNA, 12 nt, Human
ggucccacccca

SEQ ID NO: 1501813 - RNA, 20 nt, Human
gguccacccaggagccccga

SEQ ID NO: 1501814 - RNA, 22 nt, Human
gguccacccaggagccccgagg

SEQ ID NO: 1501815 - RNA, 21 nt, Human
ggucauauuaauauauuucca

SEQ ID NO: 1501816 - RNA, 23 nt, Human
gguauuggcuagagguucaaaga

SEQ ID NO: 1501817 - RNA, 22 nt, Human
ggugcacaagcuccaagcuccc

SEQ ID NO: 1501818 - RNA, 13 nt, Human
ggugaaaauuauu

SEQ ID NO: 1501819 - RNA, 21 nt, Human
aaagauuuucagaaaauauua

SEQ ID NO: 1501820 - RNA, 19 nt, Human
ggucuguucuuuccaaagu

SEQ ID NO: 1501821 - RNA, 17 nt, Human
ggucuguucuuuccaaa

SEQ ID NO: 1501822 - RNA, 22 nt, Human
ggucuugaacuccuggccucaa

SEQ ID NO: 1501823 - RNA, 12 nt, Human
ggucuguucuuu

SEQ ID NO: 1501824 - RNA, 14 nt, Human
ggucugugagaugc

SEQ ID NO: 1501825 - RNA, 24 nt, Human
ggucugugagaugcuagaacuccc

SEQ ID NO: 1501826 - RNA, 16 nt, Human
aaagcuacuuauugua

SEQ ID NO: 1501827 - RNA, 17 nt, Human
aaagcuacuuauuguag

SEQ ID NO: 1501828 - RNA, 18 nt, Human
aaagcuaggccuggccag

SEQ ID NO: 1501829 - RNA, 21 nt, Human
aaagcagugcaugcugucccu

SEQ ID NO: 1501830 - RNA, 22 nt, Human
aaagcagugcaugcugucccuu

SEQ ID NO: 1501831 - RNA, 17 nt, Human
aaagcagugcaugcugu

SEQ ID NO: 1501832 - RNA, 13 nt, Human
aaaggaauuuaaa

SEQ ID NO: 1501833 - RNA, 11 nt, Human
aaaggaaagag

SEQ ID NO: 1501834 - RNA, 20 nt, Human
gggcagcagaaggggguggu

SEQ ID NO: 1501835 - RNA, 14 nt, Human
gggcagaggaaagc

SEQ ID NO: 1501836 - RNA, 15 nt, Human
gggauuuccaugaug

SEQ ID NO: 1501837 - RNA, 14 nt, Human
aaaauauauuuaau

SEQ ID NO: 1501838 - RNA, 15 nt, Human
aaaauauauuuaaug

SEQ ID NO: 1501839 - RNA, 18 nt, Human
aaaauaguggugugauuu

SEQ ID NO: 1501840 - RNA, 12 nt, Human
aaaauagccugc

SEQ ID NO: 1501841 - RNA, 21 nt, Human
aaaauaauuuuuauauuugaa

SEQ ID NO: 1501842 - RNA, 23 nt, Human
aaaauaauuuuuauauuugaaau

SEQ ID NO: 1501843 - RNA, 14 nt, Human
aaaauaccagccag

SEQ ID NO: 1501844 - RNA, 15 nt, Human
aaaauaccagccagu

SEQ ID NO: 1501845 - RNA, 12 nt, Human
aaaauaaauuau

SEQ ID NO: 1501846 - RNA, 19 nt, Human
aaaagccugcaauuucaua

SEQ ID NO: 1501847 - RNA, 21 nt, Human
aaaacuuuaugcuaagugaaa

SEQ ID NO: 1501848 - RNA, 22 nt, Human
aaaagcuccauuuuuagugaaa

SEQ ID NO: 1501849 - RNA, 14 nt, Human
aaaagcugggcagg

SEQ ID NO: 1501850 - RNA, 17 nt, Human
aaaagcuggauuuucuu

SEQ ID NO: 1501851 - RNA, 11 nt, Human
gggagggcucc

SEQ ID NO: 1501852 - RNA, 13 nt, Human
gggagggcuccag

SEQ ID NO: 1501853 - RNA, 20 nt, Human
gggaggcagagguugcagug

SEQ ID NO: 1501854 - RNA, 19 nt, Human
gggaggccaaggugggagg

SEQ ID NO: 1501855 - RNA, 14 nt, Human
gggaacagacugga

SEQ ID NO: 1501856 - RNA, 20 nt, Human
aaaaaucucaaauuucuaaa

SEQ ID NO: 1501857 - RNA, 19 nt, Human
aaaaaucucaaauuucuaa

SEQ ID NO: 1501858 - RNA, 22 nt, Human
gggaacagacuggaagcacagc

SEQ ID NO: 1501859 - RNA, 15 nt, Human
aaaaccaauguucuc

SEQ ID NO: 1501860 - RNA, 21 nt, Human
aaaaccaauguucucucuucu

SEQ ID NO: 1501861 - RNA, 16 nt, Human
aaaacguggcugcuuc

SEQ ID NO: 1501862 - RNA, 17 nt, Human
aaaacguggcugcuuca

SEQ ID NO: 1501863 - RNA, 18 nt, Human
aaaacguggcugcuucaa

SEQ ID NO: 1501864 - RNA, 20 nt, Human
aaaacugcugacuguuuucu

SEQ ID NO: 1501865 - RNA, 18 nt, Human
aaaacugauuuuuuuuuc

SEQ ID NO: 1501866 - RNA, 22 nt, Human
aaaacugauuuuuuuuuccuuc

SEQ ID NO: 1501867 - RNA, 21 nt, Human
aaaacguggcugcuucaagga

SEQ ID NO: 1501868 - RNA, 13 nt, Human
ggcugggagagcc

SEQ ID NO: 1501869 - RNA, 14 nt, Human
ggcuggcgugcagu

SEQ ID NO: 1501870 - RNA, 16 nt, Human
ggcuggcgugcagugg

SEQ ID NO: 1501871 - RNA, 20 nt, Human
ggcuggcgugcaguggugcg

SEQ ID NO: 1501872 - RNA, 17 nt, Human
ggcuggccuggccccuc

SEQ ID NO: 1501873 - RNA, 22 nt, Human
ggcuggccuggccccucagggu

SEQ ID NO: 1501874 - RNA, 20 nt, Human
ggcucccuucccaccucucu

SEQ ID NO: 1501875 - RNA, 22 nt, Human
ggcucccuucccaccucucuca

SEQ ID NO: 1501876 - RNA, 16 nt, Human
ggcucccuucccaccu

SEQ ID NO: 1501877 - RNA, 17 nt, Human
ggcucccuucccaccuc

SEQ ID NO: 1501878 - RNA, 18 nt, Human
ggcucccuucccaccucu

SEQ ID NO: 1501879 - RNA, 22 nt, Human
ggcugcaugcgggcuuccuccu

SEQ ID NO: 1501880 - RNA, 20 nt, Human
ggcugcaugcgggcuuccuc

SEQ ID NO: 1501881 - RNA, 18 nt, Human
ggcucgagcaugccugga

SEQ ID NO: 1501882 - RNA, 23 nt, Human
ggcucuuccaggcugggagagcc

SEQ ID NO: 1501883 - RNA, 24 nt, Human
ggcucuuccaggcugggagagccu

SEQ ID NO: 1501884 - RNA, 12 nt, Human
ggcucuucucau

SEQ ID NO: 1501885 - RNA, 13 nt, Human
ggcucuucucauu

SEQ ID NO: 1501886 - RNA, 20 nt, Human
ggcucuucucauuucacccc

SEQ ID NO: 1501887 - RNA, 22 nt, Human
ggcucuucucauuucaccccuc

SEQ ID NO: 1501888 - RNA, 13 nt, Human
aaaaaaacacaaa

SEQ ID NO: 1501889 - RNA, 19 nt, Human
ggcuguaucccaugagccu

SEQ ID NO: 1501890 - RNA, 16 nt, Human
ggcuggugucaccuga

SEQ ID NO: 1501891 - RNA, 15 nt, Human
ggcuucaguggcagc

SEQ ID NO: 1501892 - RNA, 20 nt, Human
ggcuguaucccaugagccuc

SEQ ID NO: 1501893 - RNA, 22 nt, Human
ggcuguaucccaugagccucag

SEQ ID NO: 1501894 - RNA, 23 nt, Human
ggcuguaucccaugagccucagc

SEQ ID NO: 1501895 - RNA, 15 nt, Human
ggcugucaauuacag

SEQ ID NO: 1501896 - RNA, 17 nt, Human
ggcuucaguggcagcug

SEQ ID NO: 1501897 - RNA, 16 nt, Human
ggcuucaguggcagcu

SEQ ID NO: 1501898 - RNA, 13 nt, Human
gggaaaaucagcc

SEQ ID NO: 1501899 - RNA, 23 nt, Human
gggaaaaucagccugcuccagcu

SEQ ID NO: 1501900 - RNA, 12 nt, Human
ggaccccagcuc

SEQ ID NO: 1501901 - RNA, 15 nt, Human
ggaccccagcucugc

SEQ ID NO: 1501902 - RNA, 13 nt, Human
ggaccccagcucu

SEQ ID NO: 1501903 - RNA, 19 nt, Human
ggacccugaggcccagagg

SEQ ID NO: 1501904 - RNA, 14 nt, Human
ggacccugaggccc

SEQ ID NO: 1501905 - RNA, 15 nt, Human
ggacccugaggccca

SEQ ID NO: 1501906 - RNA, 18 nt, Human
ggacccugaggcccagag

SEQ ID NO: 1501907 - RNA, 19 nt, Human
gcuuguacauaaugcgugc

SEQ ID NO: 1501908 - RNA, 20 nt, Human
ggacuacaggugugagucac

SEQ ID NO: 1501909 - RNA, 12 nt, Human
ggaccucaggcc

SEQ ID NO: 1501910 - RNA, 22 nt, Human
ggacucaaugcacugacauugu

SEQ ID NO: 1501911 - RNA, 19 nt, Human
ggagaaaauggacguguua

SEQ ID NO: 1501912 - RNA, 17 nt, Human
ggacuuggaagcuccgc

SEQ ID NO: 1501913 - RNA, 22 nt, Human
ggagaaccaaaaagaggcuaug

SEQ ID NO: 1501914 - RNA, 15 nt, Human
ggagagcuagcagca

SEQ ID NO: 1501915 - RNA, 17 nt, Human
ggagagcuagcagcagg

SEQ ID NO: 1501916 - RNA, 13 nt, Human
ggagagccuucca

SEQ ID NO: 1501917 - RNA, 16 nt, Human
ggagagccuuccaggg

SEQ ID NO: 1501918 - RNA, 22 nt, Human
ggagagccuuccagggguggga

SEQ ID NO: 1501919 - RNA, 17 nt, Human
ggagagccuuccagggg

SEQ ID NO: 1501920 - RNA, 18 nt, Human
ggagagccuuccaggggu

SEQ ID NO: 1501921 - RNA, 16 nt, Human
ggagcugaguggggga

SEQ ID NO: 1501922 - RNA, 18 nt, Human
ggaggccaaggugggagg

SEQ ID NO: 1501923 - RNA, 20 nt, Human
ggaggccaaggugggaggau

SEQ ID NO: 1501924 - RNA, 13 nt, Human
ggaggccagccuu

SEQ ID NO: 1501925 - RNA, 12 nt, Human
ggaggaagagaa

SEQ ID NO: 1501926 - RNA, 21 nt, Human
ggaggcaugugaugagaggaa

SEQ ID NO: 1501927 - RNA, 15 nt, Human
ggaggcugagauggg

SEQ ID NO: 1501928 - RNA, 19 nt, Human
ggaggcugagaugggagaa

SEQ ID NO: 1501929 - RNA, 15 nt, Human
ggaggucgaggcagg

SEQ ID NO: 1501930 - RNA, 16 nt, Human
ggaggucgaggcagga

SEQ ID NO: 1501931 - RNA, 18 nt, Human
ggaggucgaggcaggagg

SEQ ID NO: 1501932 - RNA, 13 nt, Human
ggagcagccacau

SEQ ID NO: 1501933 - RNA, 21 nt, Human
ggagcagccacauuccugaug

SEQ ID NO: 1501934 - RNA, 12 nt, Human
ggcagaaggaag

SEQ ID NO: 1501935 - RNA, 10 nt, Human
ggcagagcag

SEQ ID NO: 1501936 - RNA, 12 nt, Human
ggcagagcagag

SEQ ID NO: 1501937 - RNA, 15 nt, Human
ggcagccaggccaca

SEQ ID NO: 1501938 - RNA, 17 nt, Human
ggcagccaggccacaag

SEQ ID NO: 1501939 - RNA, 22 nt, Human
ggaugguucccuugaugaagaa

SEQ ID NO: 1501940 - RNA, 23 nt, Human
ggaugguucccuugaugaagaag

SEQ ID NO: 1501941 - RNA, 13 nt, Human
ggauguucuggga

SEQ ID NO: 1501942 - RNA, 12 nt, Human
ggaugagaaagg

SEQ ID NO: 1501943 - RNA, 22 nt, Human
ggaugagaaagguugaagcacc

SEQ ID NO: 1501944 - RNA, 21 nt, Human
ggaugaauuccaaauucugcu

SEQ ID NO: 1501945 - RNA, 21 nt, Human
ggauuuugauccaagcugguc

SEQ ID NO: 1501946 - RNA, 23 nt, Human
ggauuaaacuuaaucuaaaugga

SEQ ID NO: 1501947 - RNA, 23 nt, Human
ggauguuucugucacaucagcuc

SEQ ID NO: 1501948 - RNA, 14 nt, Human
ggcccuuccuuuuc

SEQ ID NO: 1501949 - RNA, 13 nt, Human
ggccucccaacuc

SEQ ID NO: 1501950 - RNA, 14 nt, Human
ggccucccaacuca

SEQ ID NO: 1501951 - RNA, 12 nt, Human
ggcauuguggga

SEQ ID NO: 1501952 - RNA, 13 nt, Human
ggccaaaggaagc

SEQ ID NO: 1501953 - RNA, 15 nt, Human
ggccaaagccaaagc

SEQ ID NO: 1501954 - RNA, 12 nt, Human
ggccaaaggaag

SEQ ID NO: 1501955 - RNA, 13 nt, Human
ggccaagguggga

SEQ ID NO: 1501956 - RNA, 23 nt, Human
ggccagagggagugacagaggca

SEQ ID NO: 1501957 - RNA, 19 nt, Human
ggccagaugcaccagcccu

SEQ ID NO: 1501958 - RNA, 20 nt, Human
ggccagaugcaccagcccuu

SEQ ID NO: 1501959 - RNA, 22 nt, Human
gcuuccuucugugaaaguacau

SEQ ID NO: 1501960 - RNA, 19 nt, Human
gcuugggcuucauccuccu

SEQ ID NO: 1501961 - RNA, 16 nt, Human
gcuuguacauaaugcg

SEQ ID NO: 1501962 - RNA, 14 nt, Human
gcuuguacauaaug

SEQ ID NO: 1501963 - RNA, 20 nt, Human
gcuguaucccaugagccuca

SEQ ID NO: 1501964 - RNA, 23 nt, Human
gcuguaucccaugagccucagca

SEQ ID NO: 1501965 - RNA, 15 nt, Human
gcuggguucuaccca

SEQ ID NO: 1501966 - RNA, 15 nt, Human
gcuggguucugaucc

SEQ ID NO: 1501967 - RNA, 14 nt, Human
gcuggguuggaggg

SEQ ID NO: 1501968 - RNA, 21 nt, Human
gcuggguuggaggguguccca

SEQ ID NO: 1501969 - RNA, 17 nt, Human
gcuggguucuacccagg

SEQ ID NO: 1501970 - RNA, 22 nt, Human
gcuucaaggauccugagccaga

SEQ ID NO: 1501971 - RNA, 14 nt, Human
gcuuaacuucacau

SEQ ID NO: 1501972 - RNA, 15 nt, Human
gcuucacggaagagc

SEQ ID NO: 1501973 - RNA, 20 nt, Human
gcuucacggaagagccuugc

SEQ ID NO: 1501974 - RNA, 21 nt, Human
gcuguuggcugggggccucag

SEQ ID NO: 1501975 - RNA, 22 nt, Human
gcuguuggcugggggccucagu

SEQ ID NO: 1501976 - RNA, 19 nt, Human
gcugugcugcccugcccac

SEQ ID NO: 1501977 - RNA, 22 nt, Human
gcugugcugcccugcccaccug

SEQ ID NO: 1501978 - RNA, 21 nt, Human
gcugugcucuggacaggcaug

SEQ ID NO: 1501979 - RNA, 12 nt, Human
gcugugcugccc

SEQ ID NO: 1501980 - RNA, 13 nt, Human
gcugugcugcccu

SEQ ID NO: 1501981 - RNA, 14 nt, Human
gcugugcugcccug

SEQ ID NO: 1501982 - RNA, 15 nt, Human
gcuggguguggcgca

SEQ ID NO: 1501983 - RNA, 14 nt, Human
gcugggcagguugg

SEQ ID NO: 1501984 - RNA, 16 nt, Human
gcugggcagaggaaag

SEQ ID NO: 1501985 - RNA, 17 nt, Human
gcugggcagaggaaagc

SEQ ID NO: 1501986 - RNA, 19 nt, Human
gcugggcagaggaaagcaa

SEQ ID NO: 1501987 - RNA, 16 nt, Human
gcugggcucccuuccc

SEQ ID NO: 1501988 - RNA, 17 nt, Human
gcugggcucccuuccca

SEQ ID NO: 1501989 - RNA, 20 nt, Human
gcugggcucccuucccaccu

SEQ ID NO: 1501990 - RNA, 14 nt, Human
gcuggagugcagug

SEQ ID NO: 1501991 - RNA, 15 nt, Human
gcuggagugcaguga

SEQ ID NO: 1501992 - RNA, 17 nt, Human
gcuggccuggccccuca

SEQ ID NO: 1501993 - RNA, 16 nt, Human
gcugggauuacaggug

SEQ ID NO: 1501994 - RNA, 18 nt, Human
gcuggccuggccccucag

SEQ ID NO: 1501995 - RNA, 19 nt, Human
gcuggccuggccccucagg

SEQ ID NO: 1501996 - RNA, 13 nt, Human
gcugggcagagga

SEQ ID NO: 1501997 - RNA, 14 nt, Human
gcugggcagaggaa

SEQ ID NO: 1501998 - RNA, 15 nt, Human
gcugggcagaggaaa

SEQ ID NO: 1501999 - RNA, 18 nt, Human
gcugggauuacaggugug

SEQ ID NO: 1502000 - RNA, 19 nt, Human
gcugggauuacagguguga

SEQ ID NO: 1502001 - RNA, 12 nt, Human
gcuggagugcag

SEQ ID NO: 1502002 - RNA, 17 nt, Human
gcuggagcucugcccau

SEQ ID NO: 1502003 - RNA, 13 nt, Human
gcuggacugaggc

SEQ ID NO: 1502004 - RNA, 14 nt, Human
gcuggacugaggcc

SEQ ID NO: 1502005 - RNA, 16 nt, Human
gcuggacugaggccug

SEQ ID NO: 1502006 - RNA, 17 nt, Human
gcuggacugaggccuga

SEQ ID NO: 1502007 - RNA, 18 nt, Human
gcuggacugaggccugag

SEQ ID NO: 1502008 - RNA, 19 nt, Human
gcuggacugaggccugagc

SEQ ID NO: 1502009 - RNA, 19 nt, Human
gcugccugggaucccucau

SEQ ID NO: 1502010 - RNA, 16 nt, Human
gcugccugggaucccu

SEQ ID NO: 1502011 - RNA, 18 nt, Human
gcugccugggaucccuca

SEQ ID NO: 1502012 - RNA, 13 nt, Human
gcugccugggauc

SEQ ID NO: 1502013 - RNA, 18 nt, Human
gcugagggugagugggug

SEQ ID NO: 1502014 - RNA, 19 nt, Human
gcugccagccgagauagcc

SEQ ID NO: 1502015 - RNA, 21 nt, Human
gcugccagccgagauagccaa

SEQ ID NO: 1502016 - RNA, 21 nt, Human
gcugccauccagguucagcuu

SEQ ID NO: 1502017 - RNA, 23 nt, Human
gcugccauccagguucagcuugu

SEQ ID NO: 1502018 - RNA, 16 nt, Human
gcugcaccggcuggcc

SEQ ID NO: 1502019 - RNA, 17 nt, Human
gcugcaccggcuggccu

SEQ ID NO: 1502020 - RNA, 18 nt, Human
gcugcaccggcuggccug

SEQ ID NO: 1502021 - RNA, 19 nt, Human
gcugcaccggcuggccugg

SEQ ID NO: 1502022 - RNA, 22 nt, Human
gcugcaccggcuggccuggccc

SEQ ID NO: 1502023 - RNA, 17 nt, Human
gcugacagacacaggcc

SEQ ID NO: 1502024 - RNA, 16 nt, Human
gcugacagacacaggc

SEQ ID NO: 1502025 - RNA, 14 nt, Human
gcugacagacacag

SEQ ID NO: 1502026 - RNA, 15 nt, Human
gcugacagacacagg

SEQ ID NO: 1502027 - RNA, 12 nt, Human
gcugaaggcucg

SEQ ID NO: 1502028 - RNA, 20 nt, Human
gcugaaggcucgagcaugcc

SEQ ID NO: 1502029 - RNA, 23 nt, Human
gcugaaggcucgagcaugccugg

SEQ ID NO: 1502030 - RNA, 17 nt, Human
gcugaaugguuuucaaa

SEQ ID NO: 1502031 - RNA, 15 nt, Human
gcucuuccaggcugg

SEQ ID NO: 1502032 - RNA, 16 nt, Human
gcucuuccaggcuggg

SEQ ID NO: 1502033 - RNA, 12 nt, Human
gcucuuccaggc

SEQ ID NO: 1502034 - RNA, 16 nt, Human
gcucuguccugggagu

SEQ ID NO: 1502035 - RNA, 15 nt, Human
gcucuguccugggag

SEQ ID NO: 1502036 - RNA, 18 nt, Human
gcuccugccgcagagcug

SEQ ID NO: 1502037 - RNA, 19 nt, Human
gcuccugccgcagagcugg

SEQ ID NO: 1502038 - RNA, 22 nt, Human
gcuccugccgcagagcuggccg

SEQ ID NO: 1502039 - RNA, 15 nt, Human
gcuccugccgcagag

SEQ ID NO: 1502040 - RNA, 17 nt, Human
gcuccugccgcagagcu

SEQ ID NO: 1502041 - RNA, 18 nt, Human
gcuccccucggagaagag

SEQ ID NO: 1502042 - RNA, 15 nt, Human
gcuccccucggagaa

SEQ ID NO: 1502043 - RNA, 22 nt, Human
gcucccaggcauuccccaggag

SEQ ID NO: 1502044 - RNA, 23 nt, Human
gcucccaggcauuccccaggagg

SEQ ID NO: 1502045 - RNA, 12 nt, Human
gcuccccuccaa

SEQ ID NO: 1502046 - RNA, 14 nt, Human
gcuccccagcccca

SEQ ID NO: 1502047 - RNA, 20 nt, Human
gcucccaggcauuccccagg

SEQ ID NO: 1502048 - RNA, 21 nt, Human
gcucccaggcauuccccagga

SEQ ID NO: 1502049 - RNA, 13 nt, Human
gcucucaggccag

SEQ ID NO: 1502050 - RNA, 14 nt, Human
gcucucaggccagc

SEQ ID NO: 1502051 - RNA, 15 nt, Human
gcucucaggccagcu

SEQ ID NO: 1502052 - RNA, 16 nt, Human
gcucucaggccagcug

SEQ ID NO: 1502053 - RNA, 12 nt, Human
gcucagggccug

SEQ ID NO: 1502054 - RNA, 17 nt, Human
gcucagggccuggcuca

SEQ ID NO: 1502055 - RNA, 13 nt, Human
gcucagggccugg

SEQ ID NO: 1502056 - RNA, 16 nt, Human
gcucagggccuggcuc

SEQ ID NO: 1502057 - RNA, 22 nt, Human
gcucagagagggugggaguggg

SEQ ID NO: 1502058 - RNA, 18 nt, Human
gcucagagagggugggag

SEQ ID NO: 1502059 - RNA, 20 nt, Human
gcucagagagggugggagug

SEQ ID NO: 1502060 - RNA, 15 nt, Human
gcucagagagggugg

SEQ ID NO: 1502061 - RNA, 23 nt, Human
gcucagguggggucacucuggca

SEQ ID NO: 1502062 - RNA, 21 nt, Human
gcucagguggggucacucugg

SEQ ID NO: 1502063 - RNA, 22 nt, Human
gcucagguggggucacucuggc

SEQ ID NO: 1502064 - RNA, 21 nt, Human
gcuaguaauuggaaaggcagc

SEQ ID NO: 1502065 - RNA, 16 nt, Human
gcuaguaucaaaagaa

SEQ ID NO: 1502066 - RNA, 14 nt, Human
gcuaggccuggcca

SEQ ID NO: 1502067 - RNA, 15 nt, Human
gcuaggccuggccag

SEQ ID NO: 1502068 - RNA, 18 nt, Human
gcuaggaacacuccuuca

SEQ ID NO: 1502069 - RNA, 19 nt, Human
gcuaggaacacuccuucac

SEQ ID NO: 1502070 - RNA, 21 nt, Human
gcuaggaacacuccuucacag

SEQ ID NO: 1502071 - RNA, 14 nt, Human
gccuguucagcucc

SEQ ID NO: 1502072 - RNA, 20 nt, Human
gccuguucagcuccagcuca

SEQ ID NO: 1502073 - RNA, 19 nt, Human
gccuguucagcuccagcuc

SEQ ID NO: 1502074 - RNA, 16 nt, Human
gccaccccgagggcug

SEQ ID NO: 1502075 - RNA, 23 nt, Human
gccaccccgagggcugagccugg

SEQ ID NO: 1502076 - RNA, 17 nt, Human
gccaccccgagggcuga

SEQ ID NO: 1502077 - RNA, 21 nt, Human
gccacugcacuauagccuagg

SEQ ID NO: 1502078 - RNA, 13 nt, Human
gccacccugggga

SEQ ID NO: 1502079 - RNA, 19 nt, Human
gccacccuggggagaaagu

SEQ ID NO: 1502080 - RNA, 23 nt, Human
gccacugcaccgggccacagaga

SEQ ID NO: 1502081 - RNA, 18 nt, Human
gccacugugaagagaacc

SEQ ID NO: 1502082 - RNA, 21 nt, Human
gccacuguuuugaaucucaua

SEQ ID NO: 1502083 - RNA, 19 nt, Human
gccacugugaagagaacca

SEQ ID NO: 1502084 - RNA, 23 nt, Human
gccacuucuggguggggcagugg

SEQ ID NO: 1502085 - RNA, 14 nt, Human
gccacuucugggug

SEQ ID NO: 1502086 - RNA, 20 nt, Human
gccacuucuggguggggcag

SEQ ID NO: 1502087 - RNA, 22 nt, Human
gccaccaacauacucccaucug

SEQ ID NO: 1502088 - RNA, 19 nt, Human
gccaccaacauacucccau

SEQ ID NO: 1502089 - RNA, 20 nt, Human
gccaccaacauacucccauc

SEQ ID NO: 1502090 - RNA, 21 nt, Human
gccaccaacauacucccaucu

SEQ ID NO: 1502091 - RNA, 16 nt, Human
gccacauuccugaugc

SEQ ID NO: 1502092 - RNA, 20 nt, Human
gccacauuccugaugcuucu

SEQ ID NO: 1502093 - RNA, 22 nt, Human
gccagacaucaacagauaaaua

SEQ ID NO: 1502094 - RNA, 13 nt, Human
gccagcaggcucu

SEQ ID NO: 1502095 - RNA, 16 nt, Human
gccagcaggcucucag

SEQ ID NO: 1502096 - RNA, 21 nt, Human
gccagcaggcucucaggccag

SEQ ID NO: 1502097 - RNA, 23 nt, Human
gccagcaggcucucaggccagcu

SEQ ID NO: 1502098 - RNA, 17 nt, Human
gccagcaggcucucagg

SEQ ID NO: 1502099 - RNA, 18 nt, Human
gccagcaggcucucaggc

SEQ ID NO: 1502100 - RNA, 19 nt, Human
gccagcaggcucucaggcc

SEQ ID NO: 1502101 - RNA, 20 nt, Human
gccagcaggcucucaggcca

SEQ ID NO: 1502102 - RNA, 12 nt, Human
gccaggccagag

SEQ ID NO: 1502103 - RNA, 19 nt, Human
gccaggcccucugcccacu

SEQ ID NO: 1502104 - RNA, 20 nt, Human
gccaggcccucugcccacuc

SEQ ID NO: 1502105 - RNA, 21 nt, Human
gccaggcccucugcccacucc

SEQ ID NO: 1502106 - RNA, 16 nt, Human
gccaggcccucugccc

SEQ ID NO: 1502107 - RNA, 17 nt, Human
gccaggcccucugccca

SEQ ID NO: 1502108 - RNA, 13 nt, Human
gccaggccagagg

SEQ ID NO: 1502109 - RNA, 18 nt, Human
gcccaccuuggcucaagu

SEQ ID NO: 1502110 - RNA, 13 nt, Human
gcccacgccccca

SEQ ID NO: 1502111 - RNA, 14 nt, Human
gcccacgcccccac

SEQ ID NO: 1502112 - RNA, 15 nt, Human
gcccacgcccccacu

SEQ ID NO: 1502113 - RNA, 15 nt, Human
gcccacgcuggagug

SEQ ID NO: 1502114 - RNA, 16 nt, Human
gcccacgcuggagugc

SEQ ID NO: 1502115 - RNA, 17 nt, Human
gcccacgcuggagugca

SEQ ID NO: 1502116 - RNA, 19 nt, Human
gccauguuggccaggcugg

SEQ ID NO: 1502117 - RNA, 20 nt, Human
gccauguuggccaggcuggu

SEQ ID NO: 1502118 - RNA, 22 nt, Human
gccauguuggccaggcuggucu

SEQ ID NO: 1502119 - RNA, 24 nt, Human
gccauguuggccaggcuggucuca

SEQ ID NO: 1502120 - RNA, 14 nt, Human
gccauguuggccag

SEQ ID NO: 1502121 - RNA, 15 nt, Human
gccauguuggccagg

SEQ ID NO: 1502122 - RNA, 16 nt, Human
gccauguuggccaggc

SEQ ID NO: 1502123 - RNA, 17 nt, Human
gccauguuggccaggcu

SEQ ID NO: 1502124 - RNA, 18 nt, Human
gccauguuggccaggcug

SEQ ID NO: 1502125 - RNA, 19 nt, Human
gccauauucuguuggccag

SEQ ID NO: 1502126 - RNA, 20 nt, Human
gccauauucuguuggccagu

SEQ ID NO: 1502127 - RNA, 16 nt, Human
gcccccaggugccagu

SEQ ID NO: 1502128 - RNA, 19 nt, Human
gccccaaaacucuccucug

SEQ ID NO: 1502129 - RNA, 18 nt, Human
gcccccaggacugggcca

SEQ ID NO: 1502130 - RNA, 18 nt, Human
gccccaaaacucuccucu

SEQ ID NO: 1502131 - RNA, 13 nt, Human
gccccugcccggc

SEQ ID NO: 1502132 - RNA, 14 nt, Human
gccccugcccggcu

SEQ ID NO: 1502133 - RNA, 22 nt, Human
gcccuaaaguguauuuuuuuac

SEQ ID NO: 1502134 - RNA, 15 nt, Human
gccccugcccggcug

SEQ ID NO: 1502135 - RNA, 16 nt, Human
gccccuggaugcagcc

SEQ ID NO: 1502136 - RNA, 18 nt, Human
gccccuggaugcagccuc

SEQ ID NO: 1502137 - RNA, 22 nt, Human
gccccuggaugcagccucacag

SEQ ID NO: 1502138 - RNA, 13 nt, Human
gcccacucccugc

SEQ ID NO: 1502139 - RNA, 19 nt, Human
gcccacucccugcaaccug

SEQ ID NO: 1502140 - RNA, 14 nt, Human
gcccacucccugca

SEQ ID NO: 1502141 - RNA, 15 nt, Human
gcccacucccugcaa

SEQ ID NO: 1502142 - RNA, 16 nt, Human
gcccugccuccuuugu

SEQ ID NO: 1502143 - RNA, 22 nt, Human
gcccugccuccuuugugaggaa

SEQ ID NO: 1502144 - RNA, 13 nt, Human
gcccuguuaaaag

SEQ ID NO: 1502145 - RNA, 14 nt, Human
gcccuguuaaaaga

SEQ ID NO: 1502146 - RNA, 17 nt, Human
gcccuguuaaaagauga

SEQ ID NO: 1502147 - RNA, 16 nt, Human
gcccuuaccugccagg

SEQ ID NO: 1502148 - RNA, 20 nt, Human
gcccuuaccugccaggaagc

SEQ ID NO: 1502149 - RNA, 21 nt, Human
gcccuuaccugccaggaagcc

SEQ ID NO: 1502150 - RNA, 15 nt, Human
gccgccaugcuccug

SEQ ID NO: 1502151 - RNA, 16 nt, Human
gccgccaugcuccugg

SEQ ID NO: 1502152 - RNA, 22 nt, Human
gccugccuccagggcuggacug

SEQ ID NO: 1502153 - RNA, 17 nt, Human
gccugccuccagggcug

SEQ ID NO: 1502154 - RNA, 18 nt, Human
gccugccuccagggcugg

SEQ ID NO: 1502155 - RNA, 16 nt, Human
gccugccucuucucua

SEQ ID NO: 1502156 - RNA, 15 nt, Human
gccuggccccucagg

SEQ ID NO: 1502157 - RNA, 16 nt, Human
gccuggccccucaggg

SEQ ID NO: 1502158 - RNA, 17 nt, Human
gccuggccccucagggu

SEQ ID NO: 1502159 - RNA, 10 nt, Human
gccuggccug

SEQ ID NO: 1502160 - RNA, 20 nt, Human
gccuggccccucaggguccc

SEQ ID NO: 1502161 - RNA, 22 nt, Human
gccuggccccucagggucccug

SEQ ID NO: 1502162 - RNA, 21 nt, Human
gccugggaggucaaggcugca

SEQ ID NO: 1502163 - RNA, 22 nt, Human
gccugggaggucaaggcugcag

SEQ ID NO: 1502164 - RNA, 14 nt, Human
gccugggaucccuc

SEQ ID NO: 1502165 - RNA, 21 nt, Human
gccugggaucccucauccuca

SEQ ID NO: 1502166 - RNA, 18 nt, Human
gccugggaucccucaucc

SEQ ID NO: 1502167 - RNA, 17 nt, Human
gccggccaguggccuuc

SEQ ID NO: 1502168 - RNA, 13 nt, Human
gccuccuccagcc

SEQ ID NO: 1502169 - RNA, 14 nt, Human
gccucugggacugg

SEQ ID NO: 1502170 - RNA, 12 nt, Human
gccucugggacu

SEQ ID NO: 1502171 - RNA, 13 nt, Human
gccuccugugugu

SEQ ID NO: 1502172 - RNA, 12 nt, Human
gccucuucucua

SEQ ID NO: 1502173 - RNA, 23 nt, Human
gccucuucucuacucuagggaaa

SEQ ID NO: 1502174 - RNA, 18 nt, Human
gccugcccaggccccugc

SEQ ID NO: 1502175 - RNA, 11 nt, Human
gccugccucca

SEQ ID NO: 1502176 - RNA, 16 nt, Human
gccugccuccagggcu

SEQ ID NO: 1502177 - RNA, 19 nt, Human
gccugcccaggccccugcc

SEQ ID NO: 1502178 - RNA, 20 nt, Human
gccugcccaggccccugcca

SEQ ID NO: 1502179 - RNA, 18 nt, Human
cauccugaggcuccacuu

SEQ ID NO: 1502180 - RNA, 19 nt, Human
cauccugaggcuccacuug

SEQ ID NO: 1502181 - RNA, 19 nt, Human
caucccaaacccuucagug

SEQ ID NO: 1502182 - RNA, 13 nt, Human
caucagcugcuga

SEQ ID NO: 1502183 - RNA, 21 nt, Human
caucagcacgauuucuguuua

SEQ ID NO: 1502184 - RNA, 20 nt, Human
caucccaaacccuucagugc

SEQ ID NO: 1502185 - RNA, 11 nt, Human
caucccagccc

SEQ ID NO: 1502186 - RNA, 12 nt, Human
caucccagcccc

SEQ ID NO: 1502187 - RNA, 22 nt, Human
cauccucuguacagagcccacg

SEQ ID NO: 1502188 - RNA, 16 nt, Human
cauagguuuaauaauu

SEQ ID NO: 1502189 - RNA, 20 nt, Human
cauagcagcuuauucacaag

SEQ ID NO: 1502190 - RNA, 19 nt, Human
cauagcagcuuauucacaa

SEQ ID NO: 1502191 - RNA, 11 nt, Human
cauacauauuu

SEQ ID NO: 1502192 - RNA, 23 nt, Human
cauacaggaagguagaaauaucu

SEQ ID NO: 1502193 - RNA, 16 nt, Human
cauacaguuugcacuu

SEQ ID NO: 1502194 - RNA, 23 nt, Human
cauaaugcgugcauaccacuuuu

SEQ ID NO: 1502195 - RNA, 23 nt, Human
caguuguucaauaauaaauauuu

SEQ ID NO: 1502196 - RNA, 22 nt, Human
caguuguuagugugucuuagug

SEQ ID NO: 1502197 - RNA, 23 nt, Human
caguuuguuaguaugaggcauuu

SEQ ID NO: 1502198 - RNA, 22 nt, Human
caguuauuauauuuacaaaugg

SEQ ID NO: 1502199 - RNA, 21 nt, Human
cagucugauucccaagcucug

SEQ ID NO: 1502200 - RNA, 22 nt, Human
cagucugauucccaagcucugc

SEQ ID NO: 1502201 - RNA, 21 nt, Human
caguuauuauauuuacaaaug

SEQ ID NO: 1502202 - RNA, 17 nt, Human
caguuauuauauuuaca

SEQ ID NO: 1502203 - RNA, 13 nt, Human
caguuauggcuau

SEQ ID NO: 1502204 - RNA, 19 nt, Human
caguuauggcuauaggugc

SEQ ID NO: 1502205 - RNA, 20 nt, Human
caguuauggcuauaggugcu

SEQ ID NO: 1502206 - RNA, 20 nt, Human
caguuacucagaauucucua

SEQ ID NO: 1502207 - RNA, 21 nt, Human
cagugguaugaucacggcuca

SEQ ID NO: 1502208 - RNA, 19 nt, Human
caguggugcgaucuggguu

SEQ ID NO: 1502209 - RNA, 20 nt, Human
caguggugcgaucuggguuc

SEQ ID NO: 1502210 - RNA, 20 nt, Human
cagugguaugaucacggcuc

SEQ ID NO: 1502211 - RNA, 16 nt, Human
cagugggagcugccug

SEQ ID NO: 1502212 - RNA, 17 nt, Human
cagugggagcugccugu

SEQ ID NO: 1502213 - RNA, 18 nt, Human
cagugggagcugccuguu

SEQ ID NO: 1502214 - RNA, 23 nt, Human
cagucugauucccaagcucugcu

SEQ ID NO: 1502215 - RNA, 21 nt, Human
cagugcccacaggaucagucu

SEQ ID NO: 1502216 - RNA, 22 nt, Human
cagugcccacaggaucagucug

SEQ ID NO: 1502217 - RNA, 21 nt, Human
ccaacuccagaaagugacaag

SEQ ID NO: 1502218 - RNA, 14 nt, Human
ccaacucaccccag

SEQ ID NO: 1502219 - RNA, 21 nt, Human
ccaacucaccccagccccaaa

SEQ ID NO: 1502220 - RNA, 17 nt, Human
ccaagcucugcuccucu

SEQ ID NO: 1502221 - RNA, 16 nt, Human
ccaagcucugcuccuc

SEQ ID NO: 1502222 - RNA, 14 nt, Human
ccaagcucugcucc

SEQ ID NO: 1502223 - RNA, 15 nt, Human
ccaagcucugcuccu

SEQ ID NO: 1502224 - RNA, 13 nt, Human
ccaacucacccca

SEQ ID NO: 1502225 - RNA, 15 nt, Human
ccaaaucagcugcua

SEQ ID NO: 1502226 - RNA, 23 nt, Human
ccaaaucagcugcuacuacuccu

SEQ ID NO: 1502227 - RNA, 16 nt, Human
ccaaaucauaguggcu

SEQ ID NO: 1502228 - RNA, 23 nt, Human
ccaauggacuaacuugucuuugg

SEQ ID NO: 1502229 - RNA, 14 nt, Human
ccaaugggagcuca

SEQ ID NO: 1502230 - RNA, 19 nt, Human
ccaauucgaacuuuuucca

SEQ ID NO: 1502231 - RNA, 11 nt, Human
ccaauucuuac

SEQ ID NO: 1502232 - RNA, 14 nt, Human
ccaaagugcuggga

SEQ ID NO: 1502233 - RNA, 22 nt, Human
ccaaaguacacuguuucaaacu

SEQ ID NO: 1502234 - RNA, 18 nt, Human
cauuuaggugaggaagca

SEQ ID NO: 1502235 - RNA, 16 nt, Human
cauuuaggugaggaag

SEQ ID NO: 1502236 - RNA, 14 nt, Human
ccaaaaggcagaag

SEQ ID NO: 1502237 - RNA, 17 nt, Human
ccaaaaaaugcuugcuu

SEQ ID NO: 1502238 - RNA, 17 nt, Human
cauuuguauaaaauaau

SEQ ID NO: 1502239 - RNA, 14 nt, Human
cauuuguauaaaau

SEQ ID NO: 1502240 - RNA, 16 nt, Human
cauuuguauaaaauaa

SEQ ID NO: 1502241 - RNA, 14 nt, Human
cauuuguuguuuga

SEQ ID NO: 1502242 - RNA, 23 nt, Human
cauuuuuuuuaagaaaaaggaug

SEQ ID NO: 1502243 - RNA, 21 nt, Human
cauuuggugguuucagaaaug

SEQ ID NO: 1502244 - RNA, 13 nt, Human
caugacaaagacu

SEQ ID NO: 1502245 - RNA, 15 nt, Human
caugcaaggucauuu

SEQ ID NO: 1502246 - RNA, 12 nt, Human
caugcaagguca

SEQ ID NO: 1502247 - RNA, 20 nt, Human
caugcuccuggcccacugca

SEQ ID NO: 1502248 - RNA, 17 nt, Human
caugcuccuggcccacu

SEQ ID NO: 1502249 - RNA, 14 nt, Human
caugcuccuggccc

SEQ ID NO: 1502250 - RNA, 16 nt, Human
caugcuccuggcccac

SEQ ID NO: 1502251 - RNA, 22 nt, Human
cauggccucuucagaucucuaa

SEQ ID NO: 1502252 - RNA, 21 nt, Human
cauggccucuucagaucucua

SEQ ID NO: 1502253 - RNA, 18 nt, Human
caugggaaaggggaaguu

SEQ ID NO: 1502254 - RNA, 21 nt, Human
cauguuacauaagauaaaugu

SEQ ID NO: 1502255 - RNA, 16 nt, Human
cauguucuuaauucuu

SEQ ID NO: 1502256 - RNA, 13 nt, Human
cauguucuuaauu

SEQ ID NO: 1502257 - RNA, 15 nt, Human
cauguccaagaagcc

SEQ ID NO: 1502258 - RNA, 16 nt, Human
cauguccaagaagccc

SEQ ID NO: 1502259 - RNA, 16 nt, Human
cauguuacauaagaua

SEQ ID NO: 1502260 - RNA, 17 nt, Human
cauguuacauaagauaa

SEQ ID NO: 1502261 - RNA, 18 nt, Human
cauguucuuaauucuuag

SEQ ID NO: 1502262 - RNA, 18 nt, Human
cauguuggccaggcuggu

SEQ ID NO: 1502263 - RNA, 17 nt, Human
cauguuggccaggcugg

SEQ ID NO: 1502264 - RNA, 19 nt, Human
cauguuggccaggcugguc

SEQ ID NO: 1502265 - RNA, 17 nt, Human
cauucuccaccugccag

SEQ ID NO: 1502266 - RNA, 18 nt, Human
cauucuccaccugccagg

SEQ ID NO: 1502267 - RNA, 19 nt, Human
cauucuccaccugccaggg

SEQ ID NO: 1502268 - RNA, 21 nt, Human
cauucuccaccugccagggac

SEQ ID NO: 1502269 - RNA, 19 nt, Human
cagauuugaacucuucaau

SEQ ID NO: 1502270 - RNA, 17 nt, Human
cagcaccaucucuccuc

SEQ ID NO: 1502271 - RNA, 19 nt, Human
cagcaccaucucuccuccu

SEQ ID NO: 1502272 - RNA, 13 nt, Human
cagauuucacucu

SEQ ID NO: 1502273 - RNA, 20 nt, Human
cagauuucacucuccuuggu

SEQ ID NO: 1502274 - RNA, 21 nt, Human
cagauugcaacaggcugggcu

SEQ ID NO: 1502275 - RNA, 21 nt, Human
cagauuggcucacacugagaa

SEQ ID NO: 1502276 - RNA, 22 nt, Human
cagauuggcucacacugagaau

SEQ ID NO: 1502277 - RNA, 19 nt, Human
cagauugcaacaggcuggg

SEQ ID NO: 1502278 - RNA, 20 nt, Human
cagauugcaacaggcugggc

SEQ ID NO: 1502279 - RNA, 18 nt, Human
cagauugcaacaggcugg

SEQ ID NO: 1502280 - RNA, 14 nt, Human
cagccagacuggca

SEQ ID NO: 1502281 - RNA, 15 nt, Human
cagcacgauuucugu

SEQ ID NO: 1502282 - RNA, 14 nt, Human
cagcacgauuucug

SEQ ID NO: 1502283 - RNA, 20 nt, Human
cagccagacuggcacaguuu

SEQ ID NO: 1502284 - RNA, 15 nt, Human
cagccagacuggcac

SEQ ID NO: 1502285 - RNA, 18 nt, Human
cagccagacuggcacagu

SEQ ID NO: 1502286 - RNA, 14 nt, Human
cagauaugauucaa

SEQ ID NO: 1502287 - RNA, 19 nt, Human
cagauagauauaugcucug

SEQ ID NO: 1502288 - RNA, 17 nt, Human
cagaggggguggccucc

SEQ ID NO: 1502289 - RNA, 19 nt, Human
cagauacuuggggggcuga

SEQ ID NO: 1502290 - RNA, 14 nt, Human
cagaggggguggcc

SEQ ID NO: 1502291 - RNA, 16 nt, Human
cagaggggguggccuc

SEQ ID NO: 1502292 - RNA, 20 nt, Human
cagaggaaagcaaaggagau

SEQ ID NO: 1502293 - RNA, 13 nt, Human
cagaggggguggc

SEQ ID NO: 1502294 - RNA, 17 nt, Human
cagaggaaagcaaagga

SEQ ID NO: 1502295 - RNA, 19 nt, Human
cagaggaaagcaaaggaga

SEQ ID NO: 1502296 - RNA, 16 nt, Human
cagagcugccaccugc

SEQ ID NO: 1502297 - RNA, 13 nt, Human
cagagcugccacc

SEQ ID NO: 1502298 - RNA, 20 nt, Human
cagagagguuaaggugggua

SEQ ID NO: 1502299 - RNA, 23 nt, Human
cagagaggguggugaccucugcc

SEQ ID NO: 1502300 - RNA, 12 nt, Human
cagagagggugg

SEQ ID NO: 1502301 - RNA, 13 nt, Human
cagagaggguggg

SEQ ID NO: 1502302 - RNA, 17 nt, Human
cagagaggguggugacc

SEQ ID NO: 1502303 - RNA, 20 nt, Human
cagagaggguggugaccucu

SEQ ID NO: 1502304 - RNA, 22 nt, Human
cagagaggguggugaccucugc

SEQ ID NO: 1502305 - RNA, 13 nt, Human
cagacuggaagca

SEQ ID NO: 1502306 - RNA, 14 nt, Human
cagacuggaagcac

SEQ ID NO: 1502307 - RNA, 16 nt, Human
cagacuggaagcacag

SEQ ID NO: 1502308 - RNA, 17 nt, Human
cagacuggaagcacagc

SEQ ID NO: 1502309 - RNA, 18 nt, Human
cagacuggaagcacagcu

SEQ ID NO: 1502310 - RNA, 22 nt, Human
cagacuggcacaguuuucugag

SEQ ID NO: 1502311 - RNA, 23 nt, Human
cagacuggcacaguuuucugaga

SEQ ID NO: 1502312 - RNA, 20 nt, Human
cagacuggaagcacagcuuc

SEQ ID NO: 1502313 - RNA, 21 nt, Human
cagacuggaagcacagcuuca

SEQ ID NO: 1502314 - RNA, 17 nt, Human
cagacuggcacaguuuu

SEQ ID NO: 1502315 - RNA, 18 nt, Human
cagacuggcacaguuuuc

SEQ ID NO: 1502316 - RNA, 23 nt, Human
cagacucuacagaggccaugggc

SEQ ID NO: 1502317 - RNA, 18 nt, Human
cagacucuacagaggcca

SEQ ID NO: 1502318 - RNA, 19 nt, Human
cagacucuacagaggccau

SEQ ID NO: 1502319 - RNA, 20 nt, Human
cagacucuacagaggccaug

SEQ ID NO: 1502320 - RNA, 21 nt, Human
cagacucuacagaggccaugg

SEQ ID NO: 1502321 - RNA, 17 nt, Human
cagacucuacagaggcc

SEQ ID NO: 1502322 - RNA, 22 nt, Human
cagacaggcaagcaccuccugc

SEQ ID NO: 1502323 - RNA, 23 nt, Human
cagacaggcaagcaccuccugcc

SEQ ID NO: 1502324 - RNA, 13 nt, Human
cagacagcugccu

SEQ ID NO: 1502325 - RNA, 14 nt, Human
cagacagcugccug

SEQ ID NO: 1502326 - RNA, 13 nt, Human
cagacaggaccag

SEQ ID NO: 1502327 - RNA, 15 nt, Human
cagacaggaccaggg

SEQ ID NO: 1502328 - RNA, 16 nt, Human
cagacaggaccaggga

SEQ ID NO: 1502329 - RNA, 15 nt, Human
cagacagcugccugg

SEQ ID NO: 1502330 - RNA, 16 nt, Human
cagacagcugccuggg

SEQ ID NO: 1502331 - RNA, 17 nt, Human
cagacagcugccuggga

SEQ ID NO: 1502332 - RNA, 18 nt, Human
cagacagcugccugggau

SEQ ID NO: 1502333 - RNA, 17 nt, Human
cagacaggaccagggau

SEQ ID NO: 1502334 - RNA, 24 nt, Human
cagacaggaccagggauuuccaug

SEQ ID NO: 1502335 - RNA, 11 nt, Human
cagacaggcaa

SEQ ID NO: 1502336 - RNA, 13 nt, Human
cagacaggcaagc

SEQ ID NO: 1502337 - RNA, 18 nt, Human
cagacaggcaagcaccuc

SEQ ID NO: 1502338 - RNA, 20 nt, Human
cagacaggcaagcaccuccu

SEQ ID NO: 1502339 - RNA, 21 nt, Human
cagacaggcaagcaccuccug

SEQ ID NO: 1502340 - RNA, 22 nt, Human
caggcugggagagccuuccagg

SEQ ID NO: 1502341 - RNA, 23 nt, Human
caggcugggagagccuuccaggg

SEQ ID NO: 1502342 - RNA, 17 nt, Human
caggggaaaaucagccu

SEQ ID NO: 1502343 - RNA, 14 nt, Human
caggggaaaagagg

SEQ ID NO: 1502344 - RNA, 16 nt, Human
caggggaaaagaggag

SEQ ID NO: 1502345 - RNA, 14 nt, Human
caggccuccuacag

SEQ ID NO: 1502346 - RNA, 11 nt, Human
caggcuacugu

SEQ ID NO: 1502347 - RNA, 21 nt, Human
caggcugggagagccuuccag

SEQ ID NO: 1502348 - RNA, 17 nt, Human
caggaccucgugccacc

SEQ ID NO: 1502349 - RNA, 18 nt, Human
caggaccucgugccaccc

SEQ ID NO: 1502350 - RNA, 19 nt, Human
caggaggaucacuugaguc

SEQ ID NO: 1502351 - RNA, 22 nt, Human
caggaggccagccuugaccauu

SEQ ID NO: 1502352 - RNA, 19 nt, Human
caggaggccagccuugacc

SEQ ID NO: 1502353 - RNA, 15 nt, Human
caggcaaugcuggcu

SEQ ID NO: 1502354 - RNA, 16 nt, Human
caggcaaugcuggcug

SEQ ID NO: 1502355 - RNA, 17 nt, Human
caggcaaugcuggcugu

SEQ ID NO: 1502356 - RNA, 12 nt, Human
caggaccccagc

SEQ ID NO: 1502357 - RNA, 16 nt, Human
caggaccucaggugag

SEQ ID NO: 1502358 - RNA, 23 nt, Human
caggaccucaggugagaagcaga

SEQ ID NO: 1502359 - RNA, 13 nt, Human
caggaccccagcu

SEQ ID NO: 1502360 - RNA, 14 nt, Human
caggaccccagcuc

SEQ ID NO: 1502361 - RNA, 15 nt, Human
caggaccccagcucu

SEQ ID NO: 1502362 - RNA, 11 nt, Human
caggccaggcc

SEQ ID NO: 1502363 - RNA, 12 nt, Human
caggccaggccc

SEQ ID NO: 1502364 - RNA, 20 nt, Human
cagcuguaugauucccagcc

SEQ ID NO: 1502365 - RNA, 14 nt, Human
cagcuuauugucua

SEQ ID NO: 1502366 - RNA, 20 nt, Human
cagcuuauugucuagugaaa

SEQ ID NO: 1502367 - RNA, 16 nt, Human
caggaaagagaacuuc

SEQ ID NO: 1502368 - RNA, 20 nt, Human
caggaaagagaacuuccaga

SEQ ID NO: 1502369 - RNA, 16 nt, Human
caggaaaggcuccagg

SEQ ID NO: 1502370 - RNA, 17 nt, Human
caggaaaggcuccagga

SEQ ID NO: 1502371 - RNA, 19 nt, Human
caggaaaggcuccaggagc

SEQ ID NO: 1502372 - RNA, 20 nt, Human
caggaaaggcuccaggagca

SEQ ID NO: 1502373 - RNA, 21 nt, Human
cagcugacuuuucuguccgag

SEQ ID NO: 1502374 - RNA, 19 nt, Human
cagcugagggugagugggu

SEQ ID NO: 1502375 - RNA, 15 nt, Human
cagcuaacauggaag

SEQ ID NO: 1502376 - RNA, 17 nt, Human
cagccugcuccagcugu

SEQ ID NO: 1502377 - RNA, 19 nt, Human
cagccugcuccagcuguuc

SEQ ID NO: 1502378 - RNA, 16 nt, Human
cagccugcuccagcug

SEQ ID NO: 1502379 - RNA, 13 nt, Human
caccugccaggga

SEQ ID NO: 1502380 - RNA, 18 nt, Human
caccugccccucaacucu

SEQ ID NO: 1502381 - RNA, 21 nt, Human
caccugccccucaacucuccu

SEQ ID NO: 1502382 - RNA, 11 nt, Human
caccugccagg

SEQ ID NO: 1502383 - RNA, 12 nt, Human
caccugccaggg

SEQ ID NO: 1502384 - RNA, 12 nt, Human
cacccugcucuc

SEQ ID NO: 1502385 - RNA, 12 nt, Human
cacccuccuuuc

SEQ ID NO: 1502386 - RNA, 16 nt, Human
caccugcggugcuauc

SEQ ID NO: 1502387 - RNA, 17 nt, Human
caccugcggugcuaucu

SEQ ID NO: 1502388 - RNA, 19 nt, Human
caccugcggugcuaucucc

SEQ ID NO: 1502389 - RNA, 20 nt, Human
caccugcggugcuaucuccc

SEQ ID NO: 1502390 - RNA, 23 nt, Human
cacugaagaagcaccaaucauga

SEQ ID NO: 1502391 - RNA, 21 nt, Human
cacuccagugagacagcucug

SEQ ID NO: 1502392 - RNA, 21 nt, Human
cacgcuggagugcagugagcc

SEQ ID NO: 1502393 - RNA, 16 nt, Human
cacgcuggagugcagu

SEQ ID NO: 1502394 - RNA, 17 nt, Human
cacgcuggagugcagug

SEQ ID NO: 1502395 - RNA, 18 nt, Human
cacgcuggagugcaguga

SEQ ID NO: 1502396 - RNA, 20 nt, Human
cacgcuggagugcagugagc

SEQ ID NO: 1502397 - RNA, 15 nt, Human
cacgcuggagugcag

SEQ ID NO: 1502398 - RNA, 15 nt, Human
cacuacauucuguua

SEQ ID NO: 1502399 - RNA, 16 nt, Human
cacggaagagccuugc

SEQ ID NO: 1502400 - RNA, 22 nt, Human
cacggaagagccuugcggaagg

SEQ ID NO: 1502401 - RNA, 14 nt, Human
cacuacauucuguu

SEQ ID NO: 1502402 - RNA, 13 nt, Human
cacuacauucugu

SEQ ID NO: 1502403 - RNA, 16 nt, Human
cacaugaaguccaagc

SEQ ID NO: 1502404 - RNA, 23 nt, Human
cacaucuugcucugcugacagac

SEQ ID NO: 1502405 - RNA, 16 nt, Human
cacaucuugcucugcu

SEQ ID NO: 1502406 - RNA, 17 nt, Human
cacauuuauucugcuca

SEQ ID NO: 1502407 - RNA, 18 nt, Human
cacauuuauucugcucac

SEQ ID NO: 1502408 - RNA, 17 nt, Human
caccagccccagugccc

SEQ ID NO: 1502409 - RNA, 21 nt, Human
caccagcccuuagcagggaaa

SEQ ID NO: 1502410 - RNA, 19 nt, Human
caccagcccuuagcaggga

SEQ ID NO: 1502411 - RNA, 18 nt, Human
caccagccccagugccca

SEQ ID NO: 1502412 - RNA, 21 nt, Human
caccagccccagugcccacag

SEQ ID NO: 1502413 - RNA, 22 nt, Human
caccagccccagugcccacagg

SEQ ID NO: 1502414 - RNA, 16 nt, Human
cacccagcccacuucu

SEQ ID NO: 1502415 - RNA, 12 nt, Human
cacccagcccac

SEQ ID NO: 1502416 - RNA, 13 nt, Human
cacaucuugcucu

SEQ ID NO: 1502417 - RNA, 14 nt, Human
cacaucuugcucug

SEQ ID NO: 1502418 - RNA, 15 nt, Human
cacaucuugcucugc

SEQ ID NO: 1502419 - RNA, 20 nt, Human
cacaucuugcucugcugaca

SEQ ID NO: 1502420 - RNA, 21 nt, Human
cacaucuugcucugcugacag

SEQ ID NO: 1502421 - RNA, 22 nt, Human
cacaucuugcucugcugacaga

SEQ ID NO: 1502422 - RNA, 23 nt, Human
cacaucagcuugcccuguuaaaa

SEQ ID NO: 1502423 - RNA, 20 nt, Human
caaguuauuuuuaauuuggu

SEQ ID NO: 1502424 - RNA, 22 nt, Human
caaguauuauaccuuuuuuaga

SEQ ID NO: 1502425 - RNA, 17 nt, Human
caaguauuauaccuuuu

SEQ ID NO: 1502426 - RNA, 13 nt, Human
caagcugcacccu

SEQ ID NO: 1502427 - RNA, 20 nt, Human
caaggauugcuacuguccua

SEQ ID NO: 1502428 - RNA, 14 nt, Human
caaggcaaggcugu

SEQ ID NO: 1502429 - RNA, 16 nt, Human
caaggcaaggcuguca

SEQ ID NO: 1502430 - RNA, 16 nt, Human
caagcucugcuccucu

SEQ ID NO: 1502431 - RNA, 12 nt, Human
caagcucccagg

SEQ ID NO: 1502432 - RNA, 14 nt, Human
caagcucccaggca

SEQ ID NO: 1502433 - RNA, 15 nt, Human
caagcucccaggcau

SEQ ID NO: 1502434 - RNA, 17 nt, Human
caagcucccaggcauuc

SEQ ID NO: 1502435 - RNA, 19 nt, Human
caagcuccaagcucccagg

SEQ ID NO: 1502436 - RNA, 21 nt, Human
caagcuccaagcucccaggca

SEQ ID NO: 1502437 - RNA, 18 nt, Human
caagcuccaagcucccag

SEQ ID NO: 1502438 - RNA, 17 nt, Human
caaucagccuaguugau

SEQ ID NO: 1502439 - RNA, 14 nt, Human
caaucaaaucugcu

SEQ ID NO: 1502440 - RNA, 12 nt, Human
caaugcuggcug

SEQ ID NO: 1502441 - RNA, 16 nt, Human
caauggcagccuuggc

SEQ ID NO: 1502442 - RNA, 13 nt, Human
caauggcagccuu

SEQ ID NO: 1502443 - RNA, 14 nt, Human
caauggcagccuug

SEQ ID NO: 1502444 - RNA, 15 nt, Human
caauggcagccuugg

SEQ ID NO: 1502445 - RNA, 16 nt, Human
caauauuuuccaugaa

SEQ ID NO: 1502446 - RNA, 19 nt, Human
caauauuuuccaugaaaau

SEQ ID NO: 1502447 - RNA, 20 nt, Human
caauauuuuccaugaaaaug

SEQ ID NO: 1502448 - RNA, 22 nt, Human
caauauuuuccaugaaaaugca

SEQ ID NO: 1502449 - RNA, 11 nt, Human
caauauuuucc

SEQ ID NO: 1502450 - RNA, 13 nt, Human
caauauuuuccau

SEQ ID NO: 1502451 - RNA, 15 nt, Human
caauauuuuccauga

SEQ ID NO: 1502452 - RNA, 17 nt, Human
caauuuccaagagcuga

SEQ ID NO: 1502453 - RNA, 20 nt, Human
caauuuauuauggcacauca

SEQ ID NO: 1502454 - RNA, 19 nt, Human
caacuauauuguuugcuaa

SEQ ID NO: 1502455 - RNA, 19 nt, Human
caacuaucucauuuccaag

SEQ ID NO: 1502456 - RNA, 17 nt, Human
caaccccuucgcuccug

SEQ ID NO: 1502457 - RNA, 14 nt, Human
caaccccuucgcuc

SEQ ID NO: 1502458 - RNA, 16 nt, Human
caaccccuucgcuccu

SEQ ID NO: 1502459 - RNA, 14 nt, Human
caacccccagccug

SEQ ID NO: 1502460 - RNA, 12 nt, Human
caacuccagaaa

SEQ ID NO: 1502461 - RNA, 15 nt, Human
caacuauuuuuccaa

SEQ ID NO: 1502462 - RNA, 20 nt, Human
caacuauuuuuccaaaauaa

SEQ ID NO: 1502463 - RNA, 15 nt, Human
caagaagcccaggaa

SEQ ID NO: 1502464 - RNA, 18 nt, Human
caagaagcccaggaaagg

SEQ ID NO: 1502465 - RNA, 17 nt, Human
caagaaggaugauucaa

SEQ ID NO: 1502466 - RNA, 14 nt, Human
caagcaaguauuag

SEQ ID NO: 1502467 - RNA, 16 nt, Human
caagaccacguuucua

SEQ ID NO: 1502468 - RNA, 14 nt, Human
caagaccacguuuc

SEQ ID NO: 1502469 - RNA, 14 nt, Human
caagcaccuccugc

SEQ ID NO: 1502470 - RNA, 13 nt, Human
caagcaccuccug

SEQ ID NO: 1502471 - RNA, 19 nt, Human
auuuuuauauuugaaauau

SEQ ID NO: 1502472 - RNA, 22 nt, Human
auuuuguuuuugucuuaaaaag

SEQ ID NO: 1502473 - RNA, 16 nt, Human
auuuuuuucugaaauu

SEQ ID NO: 1502474 - RNA, 17 nt, Human
auuuuuuucugaaauuu

SEQ ID NO: 1502475 - RNA, 16 nt, Human
auuuuuauuaaauuau

SEQ ID NO: 1502476 - RNA, 12 nt, Human
auuuuuuuuucc

SEQ ID NO: 1502477 - RNA, 21 nt, Human
caaaagguauuuuaaucacca

SEQ ID NO: 1502478 - RNA, 13 nt, Human
caaaagcauguga

SEQ ID NO: 1502479 - RNA, 19 nt, Human
caaaagcaucuaugugaga

SEQ ID NO: 1502480 - RNA, 20 nt, Human
caaaagguuaauaaaguaau

SEQ ID NO: 1502481 - RNA, 20 nt, Human
caaacaugugguuaaugcca

SEQ ID NO: 1502482 - RNA, 18 nt, Human
caaacaugugguuaaugc

SEQ ID NO: 1502483 - RNA, 14 nt, Human
caaaccaucauuga

SEQ ID NO: 1502484 - RNA, 16 nt, Human
caaaccaucauugaaa

SEQ ID NO: 1502485 - RNA, 17 nt, Human
caaaccaucauugaaau

SEQ ID NO: 1502486 - RNA, 19 nt, Human
auuuucuauaauuuaaaua

SEQ ID NO: 1502487 - RNA, 18 nt, Human
auuuucuauaauuuaaau

SEQ ID NO: 1502488 - RNA, 17 nt, Human
auuuucuauaauuuaaa

SEQ ID NO: 1502489 - RNA, 12 nt, Human
auuuguuaaugg

SEQ ID NO: 1502490 - RNA, 14 nt, Human
auuuguguugaaga

SEQ ID NO: 1502491 - RNA, 15 nt, Human
auuuguguugaagag

SEQ ID NO: 1502492 - RNA, 18 nt, Human
auuuguguugaagagguu

SEQ ID NO: 1502493 - RNA, 22 nt, Human
auuuguguugaagagguuuuaa

SEQ ID NO: 1502494 - RNA, 14 nt, Human
auuuguuauaauga

SEQ ID NO: 1502495 - RNA, 12 nt, Human
auugauaaguuc

SEQ ID NO: 1502496 - RNA, 15 nt, Human
auugauaaguucaua

SEQ ID NO: 1502497 - RNA, 16 nt, Human
auugauaaguucauac

SEQ ID NO: 1502498 - RNA, 17 nt, Human
auugauaaguucauaca

SEQ ID NO: 1502499 - RNA, 18 nt, Human
auugauaaguucauacau

SEQ ID NO: 1502500 - RNA, 19 nt, Human
auugauaaguucauacauu

SEQ ID NO: 1502501 - RNA, 21 nt, Human
auugauaaguucauacauugu

SEQ ID NO: 1502502 - RNA, 22 nt, Human
auuuaauagguuuggacaaaau

SEQ ID NO: 1502503 - RNA, 21 nt, Human
auuucaauuuccaagagcuga

SEQ ID NO: 1502504 - RNA, 21 nt, Human
auuucaccccucccuuucucc

SEQ ID NO: 1502505 - RNA, 15 nt, Human
auuucaccccucccu

SEQ ID NO: 1502506 - RNA, 20 nt, Human
auuucaccccucccuuucuc

SEQ ID NO: 1502507 - RNA, 12 nt, Human
auuucacucucc

SEQ ID NO: 1502508 - RNA, 14 nt, Human
auuucacucuccuu

SEQ ID NO: 1502509 - RNA, 21 nt, Human
auuucuguuuagauaauacac

SEQ ID NO: 1502510 - RNA, 13 nt, Human
auuucuuaaacaa

SEQ ID NO: 1502511 - RNA, 21 nt, Human
auuucuuaaacaaauguauga

SEQ ID NO: 1502512 - RNA, 20 nt, Human
auuucuguuuagauaauaca

SEQ ID NO: 1502513 - RNA, 11 nt, Human
auuaacacugc

SEQ ID NO: 1502514 - RNA, 22 nt, Human
auugaggacacugauauggguc

SEQ ID NO: 1502515 - RNA, 23 nt, Human
auucucuaguuugauuaaauucu

SEQ ID NO: 1502516 - RNA, 12 nt, Human
auucucuuaucc

SEQ ID NO: 1502517 - RNA, 14 nt, Human
auucucuuauccaa

SEQ ID NO: 1502518 - RNA, 20 nt, Human
auucucuaguuugauuaaau

SEQ ID NO: 1502519 - RNA, 16 nt, Human
auucucuccuguaccu

SEQ ID NO: 1502520 - RNA, 15 nt, Human
auucucuuauccaac

SEQ ID NO: 1502521 - RNA, 14 nt, Human
auucauauuuacuu

SEQ ID NO: 1502522 - RNA, 16 nt, Human
auuacaggugugaacc

SEQ ID NO: 1502523 - RNA, 16 nt, Human
ccagagacacaagccu

SEQ ID NO: 1502524 - RNA, 18 nt, Human
ccagagacacaagccuuc

SEQ ID NO: 1502525 - RNA, 18 nt, Human
ccagacuugggaggaugu

SEQ ID NO: 1502526 - RNA, 13 nt, Human
ccagaugcaccag

SEQ ID NO: 1502527 - RNA, 14 nt, Human
ccagaugcaccagc

SEQ ID NO: 1502528 - RNA, 15 nt, Human
ccagaucaaggaugu

SEQ ID NO: 1502529 - RNA, 13 nt, Human
ccagagagggugg

SEQ ID NO: 1502530 - RNA, 12 nt, Human
ccacuuggucug

SEQ ID NO: 1502531 - RNA, 15 nt, Human
ccacuucuggguggg

SEQ ID NO: 1502532 - RNA, 18 nt, Human
ccacugcacuccagccug

SEQ ID NO: 1502533 - RNA, 19 nt, Human
ccacugcacuauagccuag

SEQ ID NO: 1502534 - RNA, 20 nt, Human
ccacugcacuauagccuagg

SEQ ID NO: 1502535 - RNA, 13 nt, Human
ccacugcaccggg

SEQ ID NO: 1502536 - RNA, 14 nt, Human
ccacugcaccgggc

SEQ ID NO: 1502537 - RNA, 17 nt, Human
ccacugcaccgggccac

SEQ ID NO: 1502538 - RNA, 19 nt, Human
ccacugcaccgggccacag

SEQ ID NO: 1502539 - RNA, 15 nt, Human
ccagacggggcugga

SEQ ID NO: 1502540 - RNA, 22 nt, Human
ccacuuuuguucuugguuugua

SEQ ID NO: 1502541 - RNA, 21 nt, Human
ccacuuuuguucuugguuugu

SEQ ID NO: 1502542 - RNA, 15 nt, Human
ccacuuuuguucuug

SEQ ID NO: 1502543 - RNA, 14 nt, Human
ccacuuuuguucuu

SEQ ID NO: 1502544 - RNA, 17 nt, Human
ccagacccggcugcgug

SEQ ID NO: 1502545 - RNA, 20 nt, Human
ccacuuucuagccagaggag

SEQ ID NO: 1502546 - RNA, 13 nt, Human
ccacuuucuagcc

SEQ ID NO: 1502547 - RNA, 18 nt, Human
ccacuuucuagccagagg

SEQ ID NO: 1502548 - RNA, 19 nt, Human
ccacuuucuagccagagga

SEQ ID NO: 1502549 - RNA, 20 nt, Human
ccacuuggucugugagaugc

SEQ ID NO: 1502550 - RNA, 22 nt, Human
ccacuuggucugugagaugcua

SEQ ID NO: 1502551 - RNA, 15 nt, Human
ccacuuggucuguga

SEQ ID NO: 1502552 - RNA, 16 nt, Human
ccacuuggucugugag

SEQ ID NO: 1502553 - RNA, 17 nt, Human
ccacuuggucugugaga

SEQ ID NO: 1502554 - RNA, 19 nt, Human
ccacuuggucugugagaug

SEQ ID NO: 1502555 - RNA, 15 nt, Human
ccaggggccaugaau

SEQ ID NO: 1502556 - RNA, 16 nt, Human
ccagucaccccggcca

SEQ ID NO: 1502557 - RNA, 19 nt, Human
ccaguaucuugaagacuuu

SEQ ID NO: 1502558 - RNA, 22 nt, Human
ccaguaucuugaagacuuuucu

SEQ ID NO: 1502559 - RNA, 20 nt, Human
ccaggggugggacacccugu

SEQ ID NO: 1502560 - RNA, 21 nt, Human
ccaggggugggacacccugug

SEQ ID NO: 1502561 - RNA, 22 nt, Human
ccaggggugggacacccuguga

SEQ ID NO: 1502562 - RNA, 23 nt, Human
ccaggggugggacacccugugau

SEQ ID NO: 1502563 - RNA, 19 nt, Human
ccagucaccccggccaccu

SEQ ID NO: 1502564 - RNA, 17 nt, Human
ccagucaccccggccac

SEQ ID NO: 1502565 - RNA, 18 nt, Human
ccagucaccccggccacc

SEQ ID NO: 1502566 - RNA, 22 nt, Human
ccagcagaaaugccuuacccuc

SEQ ID NO: 1502567 - RNA, 17 nt, Human
ccagcagaaaugccuua

SEQ ID NO: 1502568 - RNA, 16 nt, Human
ccagcagaaaugccuu

SEQ ID NO: 1502569 - RNA, 11 nt, Human
ccagcagccug

SEQ ID NO: 1502570 - RNA, 12 nt, Human
ccagcagccugg

SEQ ID NO: 1502571 - RNA, 14 nt, Human
ccagcagccuggac

SEQ ID NO: 1502572 - RNA, 13 nt, Human
ccagcagccugga

SEQ ID NO: 1502573 - RNA, 23 nt, Human
ccagccccauccucuguacagag

SEQ ID NO: 1502574 - RNA, 13 nt, Human
ccagccccuggau

SEQ ID NO: 1502575 - RNA, 14 nt, Human
ccagccccuggaug

SEQ ID NO: 1502576 - RNA, 15 nt, Human
ccagccccuggaugc

SEQ ID NO: 1502577 - RNA, 18 nt, Human
ccagccccuucugaccca

SEQ ID NO: 1502578 - RNA, 18 nt, Human
ccagccccuggaugcagc

SEQ ID NO: 1502579 - RNA, 15 nt, Human
ccagccccuucugac

SEQ ID NO: 1502580 - RNA, 16 nt, Human
ccagccccuucugacc

SEQ ID NO: 1502581 - RNA, 17 nt, Human
ccagccccuucugaccc

SEQ ID NO: 1502582 - RNA, 20 nt, Human
ccaggaaaggcuccaggagc

SEQ ID NO: 1502583 - RNA, 17 nt, Human
ccaggaaaggcuccagg

SEQ ID NO: 1502584 - RNA, 18 nt, Human
ccaggaaaggcuccagga

SEQ ID NO: 1502585 - RNA, 19 nt, Human
ccaggaaaggcuccaggag

SEQ ID NO: 1502586 - RNA, 12 nt, Human
ccccagccccaa

SEQ ID NO: 1502587 - RNA, 16 nt, Human
ccccagccccauccca

SEQ ID NO: 1502588 - RNA, 21 nt, Human
ccccauucugccugcccaggc

SEQ ID NO: 1502589 - RNA, 14 nt, Human
ccccagccccaucc

SEQ ID NO: 1502590 - RNA, 14 nt, Human
ccccagccccaaaa

SEQ ID NO: 1502591 - RNA, 18 nt, Human
ccccaaaacucuccucug

SEQ ID NO: 1502592 - RNA, 20 nt, Human
ccccaaaacucuccucugcu

SEQ ID NO: 1502593 - RNA, 21 nt, Human
ccccaaaacucuccucugcug

SEQ ID NO: 1502594 - RNA, 14 nt, Human
ccccggccaccugc

SEQ ID NO: 1502595 - RNA, 18 nt, Human
ccccggccaccugcggug

SEQ ID NO: 1502596 - RNA, 14 nt, Human
ccccgcccaggcuu

SEQ ID NO: 1502597 - RNA, 15 nt, Human
ccccauuguggucac

SEQ ID NO: 1502598 - RNA, 14 nt, Human
cccccuuccaugga

SEQ ID NO: 1502599 - RNA, 12 nt, Human
ccccgcccaggc

SEQ ID NO: 1502600 - RNA, 18 nt, Human
cccaggcuggcgugcagu

SEQ ID NO: 1502601 - RNA, 21 nt, Human
cccaggcuggcgugcaguggu

SEQ ID NO: 1502602 - RNA, 19 nt, Human
cccaggcuggcgugcagug

SEQ ID NO: 1502603 - RNA, 20 nt, Human
cccaggcuggcgugcagugg

SEQ ID NO: 1502604 - RNA, 14 nt, Human
cccauccucuguac

SEQ ID NO: 1502605 - RNA, 20 nt, Human
cccauccucuguacagagcc

SEQ ID NO: 1502606 - RNA, 15 nt, Human
cccauccucuguaca

SEQ ID NO: 1502607 - RNA, 19 nt, Human
cccauccucuguacagagc

SEQ ID NO: 1502608 - RNA, 19 nt, Human
cccagcccacuucugccau

SEQ ID NO: 1502609 - RNA, 21 nt, Human
cccagccccaaaacucuccuc

SEQ ID NO: 1502610 - RNA, 23 nt, Human
cccagccccaaaacucuccucug

SEQ ID NO: 1502611 - RNA, 23 nt, Human
cccagcaugcaccacgggcccgg

SEQ ID NO: 1502612 - RNA, 19 nt, Human
cccagcaugcaccacgggc

SEQ ID NO: 1502613 - RNA, 22 nt, Human
ccauuguggucacaggaaguag

SEQ ID NO: 1502614 - RNA, 13 nt, Human
ccauuuaaagcuu

SEQ ID NO: 1502615 - RNA, 12 nt, Human
cccaagcucugc

SEQ ID NO: 1502616 - RNA, 17 nt, Human
cccaagcucugcuccuc

SEQ ID NO: 1502617 - RNA, 18 nt, Human
cccacccaagggccuggc

SEQ ID NO: 1502618 - RNA, 15 nt, Human
cccacccaagggccu

SEQ ID NO: 1502619 - RNA, 15 nt, Human
cccaccgcagacagg

SEQ ID NO: 1502620 - RNA, 18 nt, Human
cccaccgcagacaggacc

SEQ ID NO: 1502621 - RNA, 18 nt, Human
ccaugggcacugugggua

SEQ ID NO: 1502622 - RNA, 13 nt, Human
ccaugagccucag

SEQ ID NO: 1502623 - RNA, 16 nt, Human
ccaugaggaacaaggc

SEQ ID NO: 1502624 - RNA, 17 nt, Human
ccaugaggaacaaggca

SEQ ID NO: 1502625 - RNA, 18 nt, Human
ccaugaggaacaaggcaa

SEQ ID NO: 1502626 - RNA, 15 nt, Human
ccugccucuucucua

SEQ ID NO: 1502627 - RNA, 22 nt, Human
ccugcugcaguugccagucacc

SEQ ID NO: 1502628 - RNA, 11 nt, Human
ccugcugcagu

SEQ ID NO: 1502629 - RNA, 12 nt, Human
ccugcugcaguu

SEQ ID NO: 1502630 - RNA, 16 nt, Human
ccugcugcaguugcca

SEQ ID NO: 1502631 - RNA, 23 nt, Human
ccugccuccuuugugaggaagcc

SEQ ID NO: 1502632 - RNA, 21 nt, Human
ccugccuccuuugugaggaag

SEQ ID NO: 1502633 - RNA, 22 nt, Human
ccugccuccuuugugaggaagc

SEQ ID NO: 1502634 - RNA, 13 nt, Human
ccugccuccuuug

SEQ ID NO: 1502635 - RNA, 15 nt, Human
ccugccuccuuugug

SEQ ID NO: 1502636 - RNA, 19 nt, Human
ccugccuccuuugugagga

SEQ ID NO: 1502637 - RNA, 20 nt, Human
ccugccuccuuugugaggaa

SEQ ID NO: 1502638 - RNA, 19 nt, Human
ccucuuuggucuacacugu

SEQ ID NO: 1502639 - RNA, 21 nt, Human
ccucugccugaagucacacag

SEQ ID NO: 1502640 - RNA, 12 nt, Human
ccugcagagggc

SEQ ID NO: 1502641 - RNA, 16 nt, Human
ccugcaggcagccagg

SEQ ID NO: 1502642 - RNA, 17 nt, Human
ccugcaggcagccaggc

SEQ ID NO: 1502643 - RNA, 14 nt, Human
ccugcagagggcac

SEQ ID NO: 1502644 - RNA, 23 nt, Human
ccugcaggcagccaggccacaag

SEQ ID NO: 1502645 - RNA, 18 nt, Human
ccugcaggcagccaggcc

SEQ ID NO: 1502646 - RNA, 19 nt, Human
ccugcaggcagccaggcca

SEQ ID NO: 1502647 - RNA, 20 nt, Human
ccugcaggcagccaggccac

SEQ ID NO: 1502648 - RNA, 21 nt, Human
ccugcaggcagccaggccaca

SEQ ID NO: 1502649 - RNA, 17 nt, Human
ccugaggcugggcuccc

SEQ ID NO: 1502650 - RNA, 19 nt, Human
ccugaggcugggcucccuu

SEQ ID NO: 1502651 - RNA, 21 nt, Human
ccugaggcugggcucccuucc

SEQ ID NO: 1502652 - RNA, 12 nt, Human
ccugaggggccu

SEQ ID NO: 1502653 - RNA, 16 nt, Human
ccugaggggccucuua

SEQ ID NO: 1502654 - RNA, 12 nt, Human
ccucucucacuc

SEQ ID NO: 1502655 - RNA, 20 nt, Human
ccucugccucugacacacag

SEQ ID NO: 1502656 - RNA, 21 nt, Human
ccucugccucugacacacagc

SEQ ID NO: 1502657 - RNA, 23 nt, Human
ccucugccucugacacacagcuc

SEQ ID NO: 1502658 - RNA, 11 nt, Human
ccucugccuga

SEQ ID NO: 1502659 - RNA, 20 nt, Human
ccucugccugaagucacaca

SEQ ID NO: 1502660 - RNA, 18 nt, Human
ccuccuuugugaggaagc

SEQ ID NO: 1502661 - RNA, 19 nt, Human
ccuccuuugugaggaagcc

SEQ ID NO: 1502662 - RNA, 20 nt, Human
ccuccuuugugaggaagccg

SEQ ID NO: 1502663 - RNA, 16 nt, Human
ccucgaacuggcugca

SEQ ID NO: 1502664 - RNA, 15 nt, Human
ccucgaacuggcugc

SEQ ID NO: 1502665 - RNA, 13 nt, Human
ccuccgccucuug

SEQ ID NO: 1502666 - RNA, 11 nt, Human
ccucaggcagg

SEQ ID NO: 1502667 - RNA, 17 nt, Human
ccucccaacucacccca

SEQ ID NO: 1502668 - RNA, 20 nt, Human
ccucccaacucaccccagcc

SEQ ID NO: 1502669 - RNA, 21 nt, Human
ccucccaacucaccccagccc

SEQ ID NO: 1502670 - RNA, 23 nt, Human
ccucccaacucaccccagcccca

SEQ ID NO: 1502671 - RNA, 11 nt, Human
cccugcccugu

SEQ ID NO: 1502672 - RNA, 15 nt, Human
cccuggaugcccagg

SEQ ID NO: 1502673 - RNA, 16 nt, Human
cccuggaugcccagga

SEQ ID NO: 1502674 - RNA, 13 nt, Human
cccuggaugcagc

SEQ ID NO: 1502675 - RNA, 17 nt, Human
cccuggaugcagccuca

SEQ ID NO: 1502676 - RNA, 21 nt, Human
cccuggaugcagccucacagu

SEQ ID NO: 1502677 - RNA, 16 nt, Human
cccugagcuuucugcu

SEQ ID NO: 1502678 - RNA, 14 nt, Human
cccugagcaggauu

SEQ ID NO: 1502679 - RNA, 22 nt, Human
cccugcccaccuggccucugca

SEQ ID NO: 1502680 - RNA, 23 nt, Human
cccugcccccaggacugggccac

SEQ ID NO: 1502681 - RNA, 13 nt, Human
cccugcccccagg

SEQ ID NO: 1502682 - RNA, 14 nt, Human
cccugcccccagga

SEQ ID NO: 1502683 - RNA, 16 nt, Human
cccugcccccaggacu

SEQ ID NO: 1502684 - RNA, 17 nt, Human
cccugcccccaggacug

SEQ ID NO: 1502685 - RNA, 18 nt, Human
cccugcccccaggacugg

SEQ ID NO: 1502686 - RNA, 20 nt, Human
cccugcccccaggacugggc

SEQ ID NO: 1502687 - RNA, 22 nt, Human
cccugcccccaggacugggcca

SEQ ID NO: 1502688 - RNA, 14 nt, Human
cccugcccggcugc

SEQ ID NO: 1502689 - RNA, 17 nt, Human
cccugcccggcugcgga

SEQ ID NO: 1502690 - RNA, 20 nt, Human
cccugaauuuaaauagcuuu

SEQ ID NO: 1502691 - RNA, 13 nt, Human
cccugacagggcc

SEQ ID NO: 1502692 - RNA, 16 nt, Human
cccugacagggccagu

SEQ ID NO: 1502693 - RNA, 16 nt, Human
cccugacaacacucau

SEQ ID NO: 1502694 - RNA, 22 nt, Human
cccugacaacacucauugaccu

SEQ ID NO: 1502695 - RNA, 14 nt, Human
cccugacaacacuc

SEQ ID NO: 1502696 - RNA, 20 nt, Human
cccugaaggccccgcccagg

SEQ ID NO: 1502697 - RNA, 22 nt, Human
cccugaaggccccgcccaggcu

SEQ ID NO: 1502698 - RNA, 12 nt, Human
cccugaaggccc

SEQ ID NO: 1502699 - RNA, 13 nt, Human
cccugaaggcccc

SEQ ID NO: 1502700 - RNA, 14 nt, Human
cccugaaggccccg

SEQ ID NO: 1502701 - RNA, 16 nt, Human
cccugaaggccccgcc

SEQ ID NO: 1502702 - RNA, 19 nt, Human
cccugaaggccccgcccag

SEQ ID NO: 1502703 - RNA, 18 nt, Human
cccugaaagcccugagcu

SEQ ID NO: 1502704 - RNA, 13 nt, Human
cccucggagaaga

SEQ ID NO: 1502705 - RNA, 16 nt, Human
ccgaauagcugggacu

SEQ ID NO: 1502706 - RNA, 17 nt, Human
ccgaauagcugggacua

SEQ ID NO: 1502707 - RNA, 18 nt, Human
ccgaccagacaccuugac

SEQ ID NO: 1502708 - RNA, 13 nt, Human
ccgaccagacacc

SEQ ID NO: 1502709 - RNA, 17 nt, Human
ccgaccagacaccuuga

SEQ ID NO: 1502710 - RNA, 19 nt, Human
ccgaaagggacuuggaagc

SEQ ID NO: 1502711 - RNA, 16 nt, Human
ccgaaaacguggcugc

SEQ ID NO: 1502712 - RNA, 17 nt, Human
ccgaaaacguggcugcu

SEQ ID NO: 1502713 - RNA, 15 nt, Human
cccuuccucuuucca

SEQ ID NO: 1502714 - RNA, 12 nt, Human
ccgcccaggcuu

SEQ ID NO: 1502715 - RNA, 16 nt, Human
ccgcagacaggaccag

SEQ ID NO: 1502716 - RNA, 17 nt, Human
ccgcagacaggaccagg

SEQ ID NO: 1502717 - RNA, 13 nt, Human
cccugucuaauga

SEQ ID NO: 1502718 - RNA, 23 nt, Human
cccugugauggggcccugccucc

SEQ ID NO: 1502719 - RNA, 21 nt, Human
cccugugauggggcccugccu

SEQ ID NO: 1502720 - RNA, 22 nt, Human
cccugugauggggcccugccuc

SEQ ID NO: 1502721 - RNA, 21 nt, Human
ccuagcauacguacacauuuu

SEQ ID NO: 1502722 - RNA, 20 nt, Human
ccuagccugugccucuggga

SEQ ID NO: 1502723 - RNA, 19 nt, Human
ccuagcauacguacacauu

SEQ ID NO: 1502724 - RNA, 14 nt, Human
ccuaaucuucugaa

SEQ ID NO: 1502725 - RNA, 15 nt, Human
ccggcuccaggcucc

SEQ ID NO: 1502726 - RNA, 14 nt, Human
ccgucuaccugagg

SEQ ID NO: 1502727 - RNA, 15 nt, Human
ccgucuaccugaggg

SEQ ID NO: 1502728 - RNA, 13 nt, Human
ccggcuccaggcu

SEQ ID NO: 1502729 - RNA, 14 nt, Human
ccggcuccaggcuc

SEQ ID NO: 1502730 - RNA, 20 nt, Human
ccuaacgaaguauccuucag

SEQ ID NO: 1502731 - RNA, 16 nt, Human
ccgugaggccagagac

SEQ ID NO: 1502732 - RNA, 17 nt, Human
ccgucuaccugaggggc

SEQ ID NO: 1502733 - RNA, 12 nt, Human
ccgugaggccag

SEQ ID NO: 1502734 - RNA, 13 nt, Human
ccgugaggccaga

SEQ ID NO: 1502735 - RNA, 14 nt, Human
ccgugaggccagag

SEQ ID NO: 1502736 - RNA, 16 nt, Human
ccggccaccugcggug

SEQ ID NO: 1502737 - RNA, 11 nt, Human
cuaaagcugcc

SEQ ID NO: 1502738 - RNA, 16 nt, Human
cgugaggccagagaca

SEQ ID NO: 1502739 - RNA, 19 nt, Human
cgugaguccuggcauggga

SEQ ID NO: 1502740 - RNA, 15 nt, Human
cguguuaugacucca

SEQ ID NO: 1502741 - RNA, 19 nt, Human
cguguuaugacuccagaau

SEQ ID NO: 1502742 - RNA, 19 nt, Human
cuaaaguguauuuuuuuac

SEQ ID NO: 1502743 - RNA, 14 nt, Human
cuaacuugucuuug

SEQ ID NO: 1502744 - RNA, 22 nt, Human
cuaacuugucuuuggacccuga

SEQ ID NO: 1502745 - RNA, 16 nt, Human
cuaacuuuccuucauu

SEQ ID NO: 1502746 - RNA, 22 nt, Human
cgugagccacugcaccgggcca

SEQ ID NO: 1502747 - RNA, 14 nt, Human
cgugaggccagaga

SEQ ID NO: 1502748 - RNA, 14 nt, Human
cgugagccacugca

SEQ ID NO: 1502749 - RNA, 15 nt, Human
cgugagccacugcac

SEQ ID NO: 1502750 - RNA, 20 nt, Human
cgugagccacugcaccgggc

SEQ ID NO: 1502751 - RNA, 14 nt, Human
cgugacaacacuug

SEQ ID NO: 1502752 - RNA, 15 nt, Human
cgugacaacacuugu

SEQ ID NO: 1502753 - RNA, 14 nt, Human
cuaagucauucaua

SEQ ID NO: 1502754 - RNA, 14 nt, Human
cuaaguuuuuaugg

SEQ ID NO: 1502755 - RNA, 20 nt, Human
cuaauaaaauuuaaaagucu

SEQ ID NO: 1502756 - RNA, 19 nt, Human
cuacaaaaagcauaaaaau

SEQ ID NO: 1502757 - RNA, 12 nt, Human
ccuuuucccaac

SEQ ID NO: 1502758 - RNA, 20 nt, Human
ccuuuucgcaggauucuucc

SEQ ID NO: 1502759 - RNA, 19 nt, Human
cgcugccccuggcagcccc

SEQ ID NO: 1502760 - RNA, 20 nt, Human
cgcugccccuggcagccccu

SEQ ID NO: 1502761 - RNA, 17 nt, Human
cgcuggagugcagugag

SEQ ID NO: 1502762 - RNA, 18 nt, Human
cgcuggagugcagugagc

SEQ ID NO: 1502763 - RNA, 20 nt, Human
cgguggcucacgccuguaau

SEQ ID NO: 1502764 - RNA, 22 nt, Human
cguacacauuuuauuuuauuau

SEQ ID NO: 1502765 - RNA, 19 nt, Human
cgggcucagcaaaagaugc

SEQ ID NO: 1502766 - RNA, 12 nt, Human
cgggcucugccu

SEQ ID NO: 1502767 - RNA, 13 nt, Human
cgggcucugccuc

SEQ ID NO: 1502768 - RNA, 14 nt, Human
cggcucacugcagc

SEQ ID NO: 1502769 - RNA, 23 nt, Human
cggagucccaccuuggcugcagg

SEQ ID NO: 1502770 - RNA, 21 nt, Human
cggagucccaccuuggcugca

SEQ ID NO: 1502771 - RNA, 22 nt, Human
cggagucccaccuuggcugcag

SEQ ID NO: 1502772 - RNA, 20 nt, Human
cggagacggagucccaccuu

SEQ ID NO: 1502773 - RNA, 17 nt, Human
cggagacggagucccac

SEQ ID NO: 1502774 - RNA, 18 nt, Human
ccuuucaauaggaaaaac

SEQ ID NO: 1502775 - RNA, 17 nt, Human
ccuuucaauaggaaaaa

SEQ ID NO: 1502776 - RNA, 15 nt, Human
ccuuucaauaggaaa

SEQ ID NO: 1502777 - RNA, 12 nt, Human
ccuuccccagca

SEQ ID NO: 1502778 - RNA, 13 nt, Human
ccuuccccagcau

SEQ ID NO: 1502779 - RNA, 20 nt, Human
ccuucucuccagccccugga

SEQ ID NO: 1502780 - RNA, 21 nt, Human
ccuucucuccagccccuggau

SEQ ID NO: 1502781 - RNA, 23 nt, Human
ccuucucuccagccccuggaugc

SEQ ID NO: 1502782 - RNA, 14 nt, Human
ccuucucugaagga

SEQ ID NO: 1502783 - RNA, 16 nt, Human
ccuucucugaaggaca

SEQ ID NO: 1502784 - RNA, 17 nt, Human
ccuucucuucacaguca

SEQ ID NO: 1502785 - RNA, 20 nt, Human
ccuucuguccuacucugugu

SEQ ID NO: 1502786 - RNA, 21 nt, Human
ccuucuguccuacucuguguc

SEQ ID NO: 1502787 - RNA, 22 nt, Human
ccuucuguccuacucuguguca

SEQ ID NO: 1502788 - RNA, 13 nt, Human
ccuguucagcucc

SEQ ID NO: 1502789 - RNA, 12 nt, Human
ccuucccaccuc

SEQ ID NO: 1502790 - RNA, 14 nt, Human
ccuucccaccucuc

SEQ ID NO: 1502791 - RNA, 19 nt, Human
ccuucccaccucucucacu

SEQ ID NO: 1502792 - RNA, 22 nt, Human
ccuuauggaacacucugagacu

SEQ ID NO: 1502793 - RNA, 19 nt, Human
ccuuauggaacacucugag

SEQ ID NO: 1502794 - RNA, 20 nt, Human
ccuuauggaacacucugaga

SEQ ID NO: 1502795 - RNA, 14 nt, Human
ccuuauggaacacu

SEQ ID NO: 1502796 - RNA, 16 nt, Human
ccuuauggaacacucu

SEQ ID NO: 1502797 - RNA, 17 nt, Human
ccuuauggaacacucug

SEQ ID NO: 1502798 - RNA, 18 nt, Human
ccuuauggaacacucuga

SEQ ID NO: 1502799 - RNA, 12 nt, Human
ccuuauggaaca

SEQ ID NO: 1502800 - RNA, 23 nt, Human
ccuguugggccaggagccuccug

SEQ ID NO: 1502801 - RNA, 16 nt, Human
ccuuagcaaauucugu

SEQ ID NO: 1502802 - RNA, 19 nt, Human
ccuuagcagggaaacagcu

SEQ ID NO: 1502803 - RNA, 20 nt, Human
ccuuagcagggaaacagcua

SEQ ID NO: 1502804 - RNA, 16 nt, Human
ccuguugggccaggag

SEQ ID NO: 1502805 - RNA, 17 nt, Human
ccuguugggccaggagc

SEQ ID NO: 1502806 - RNA, 18 nt, Human
ccuguugggccaggagcc

SEQ ID NO: 1502807 - RNA, 19 nt, Human
ccuguugggccaggagccu

SEQ ID NO: 1502808 - RNA, 20 nt, Human
ccuguugggccaggagccuc

SEQ ID NO: 1502809 - RNA, 18 nt, Human
ccuguucccaugagauga

SEQ ID NO: 1502810 - RNA, 12 nt, Human
ccuguucuggca

SEQ ID NO: 1502811 - RNA, 17 nt, Human
ccuguucuggcagaguu

SEQ ID NO: 1502812 - RNA, 23 nt, Human
ccuguucagcuccagcucaccag

SEQ ID NO: 1502813 - RNA, 20 nt, Human
ccuguucagcuccagcucac

SEQ ID NO: 1502814 - RNA, 21 nt, Human
ccuguucagcuccagcucacc

SEQ ID NO: 1502815 - RNA, 14 nt, Human
ccuguucagcucca

SEQ ID NO: 1502816 - RNA, 15 nt, Human
ccuguucagcuccag

SEQ ID NO: 1502817 - RNA, 16 nt, Human
ccuguucagcuccagc

SEQ ID NO: 1502818 - RNA, 19 nt, Human
ccuguucagcuccagcuca

SEQ ID NO: 1502819 - RNA, 21 nt, Human
cucaggccaaacucaccugcc

SEQ ID NO: 1502820 - RNA, 19 nt, Human
cucaggccaaacucaccug

SEQ ID NO: 1502821 - RNA, 20 nt, Human
cucaggccaaacucaccugc

SEQ ID NO: 1502822 - RNA, 11 nt, Human
cucaggccugg

SEQ ID NO: 1502823 - RNA, 16 nt, Human
cucaggccagcugcuu

SEQ ID NO: 1502824 - RNA, 17 nt, Human
cucaggccagcugcuug

SEQ ID NO: 1502825 - RNA, 18 nt, Human
cucaggccagcugcuugg

SEQ ID NO: 1502826 - RNA, 20 nt, Human
cucaggccagcugcuugggc

SEQ ID NO: 1502827 - RNA, 13 nt, Human
cucaggccugggg

SEQ ID NO: 1502828 - RNA, 19 nt, Human
cucagccucccgaauagcu

SEQ ID NO: 1502829 - RNA, 21 nt, Human
cucagccucccgaauagcugg

SEQ ID NO: 1502830 - RNA, 22 nt, Human
cucagccucccgaauagcuggg

SEQ ID NO: 1502831 - RNA, 23 nt, Human
cucagccucccgaauagcuggga

SEQ ID NO: 1502832 - RNA, 23 nt, Human
cucagaagacacugaugggcaac

SEQ ID NO: 1502833 - RNA, 17 nt, Human
cucaccuuucccaucuu

SEQ ID NO: 1502834 - RNA, 13 nt, Human
cucagaagacacu

SEQ ID NO: 1502835 - RNA, 15 nt, Human
cucagaagacacuga

SEQ ID NO: 1502836 - RNA, 17 nt, Human
cucagaagacacugaug

SEQ ID NO: 1502837 - RNA, 20 nt, Human
cucagaagacacugaugggc

SEQ ID NO: 1502838 - RNA, 22 nt, Human
cucagaagacacugaugggcaa

SEQ ID NO: 1502839 - RNA, 22 nt, Human
cucagucuggcccuuccuuuuc

SEQ ID NO: 1502840 - RNA, 15 nt, Human
cucaguccauagcag

SEQ ID NO: 1502841 - RNA, 17 nt, Human
cucaguccauagcagag

SEQ ID NO: 1502842 - RNA, 16 nt, Human
cucaguccaugaagau

SEQ ID NO: 1502843 - RNA, 23 nt, Human
cucaggugucccugcacuugcag

SEQ ID NO: 1502844 - RNA, 18 nt, Human
cuaucucauuuccaagca

SEQ ID NO: 1502845 - RNA, 13 nt, Human
cuaucucccccag

SEQ ID NO: 1502846 - RNA, 14 nt, Human
cuaucucccccagc

SEQ ID NO: 1502847 - RNA, 14 nt, Human
cuaugugagaccau

SEQ ID NO: 1502848 - RNA, 18 nt, Human
cuauguucuaagaaguga

SEQ ID NO: 1502849 - RNA, 14 nt, Human
cuauguugcccagg

SEQ ID NO: 1502850 - RNA, 17 nt, Human
cuaugugagcacaaagg

SEQ ID NO: 1502851 - RNA, 18 nt, Human
cuauguugcccaggcagg

SEQ ID NO: 1502852 - RNA, 19 nt, Human
cuauguugcccaggcaggu

SEQ ID NO: 1502853 - RNA, 21 nt, Human
cuauguugcccaggcaggucu

SEQ ID NO: 1502854 - RNA, 22 nt, Human
cuauguugcccaggcaggucuu

SEQ ID NO: 1502855 - RNA, 13 nt, Human
cuacaaacaaaau

SEQ ID NO: 1502856 - RNA, 15 nt, Human
cuacaaacaaaauuu

SEQ ID NO: 1502857 - RNA, 17 nt, Human
cuacaaacaaaauuucu

SEQ ID NO: 1502858 - RNA, 20 nt, Human
cuacaaacaaaauuucuauu

SEQ ID NO: 1502859 - RNA, 21 nt, Human
cuacaaacaaaauuucuauua

SEQ ID NO: 1502860 - RNA, 18 nt, Human
cucaauauuuuccaugaa

SEQ ID NO: 1502861 - RNA, 19 nt, Human
cucaauauuuuccaugaaa

SEQ ID NO: 1502862 - RNA, 22 nt, Human
cucaauauuuuccaugaaaaug

SEQ ID NO: 1502863 - RNA, 23 nt, Human
cucaauuauuuugcauuuuuucu

SEQ ID NO: 1502864 - RNA, 21 nt, Human
cucugcuccucuccccagcaa

SEQ ID NO: 1502865 - RNA, 17 nt, Human
cucugcacuccccugcu

SEQ ID NO: 1502866 - RNA, 18 nt, Human
cucugcacuccccugcug

SEQ ID NO: 1502867 - RNA, 21 nt, Human
cucugcugacagacacaggcc

SEQ ID NO: 1502868 - RNA, 22 nt, Human
cucugcugacagacacaggccc

SEQ ID NO: 1502869 - RNA, 23 nt, Human
cucugcugacagacacaggcccg

SEQ ID NO: 1502870 - RNA, 13 nt, Human
cucugcugcuggc

SEQ ID NO: 1502871 - RNA, 13 nt, Human
cucuguccuggga

SEQ ID NO: 1502872 - RNA, 23 nt, Human
cucuguccccuucucucaucucu

SEQ ID NO: 1502873 - RNA, 14 nt, Human
cucuguccccuucu

SEQ ID NO: 1502874 - RNA, 15 nt, Human
cucuguccccuucuc

SEQ ID NO: 1502875 - RNA, 17 nt, Human
cucuguccccuucucuc

SEQ ID NO: 1502876 - RNA, 18 nt, Human
cucuguccccuucucuca

SEQ ID NO: 1502877 - RNA, 21 nt, Human
cucuguccccuucucucaucu

SEQ ID NO: 1502878 - RNA, 16 nt, Human
cucuguacagagccca

SEQ ID NO: 1502879 - RNA, 16 nt, Human
cucugcugcuggcugg

SEQ ID NO: 1502880 - RNA, 14 nt, Human
cucugcugcuggcu

SEQ ID NO: 1502881 - RNA, 15 nt, Human
cucugcugcuggcug

SEQ ID NO: 1502882 - RNA, 14 nt, Human
cucuguacagagcc

SEQ ID NO: 1502883 - RNA, 15 nt, Human
cucuguacagagccc

SEQ ID NO: 1502884 - RNA, 13 nt, Human
cucuguacagagc

SEQ ID NO: 1502885 - RNA, 15 nt, Human
cucugcacuccccug

SEQ ID NO: 1502886 - RNA, 16 nt, Human
cucugcacuccccugc

SEQ ID NO: 1502887 - RNA, 20 nt, Human
cucugcacaagcugcacccu

SEQ ID NO: 1502888 - RNA, 21 nt, Human
cucugcacaagcugcacccuc

SEQ ID NO: 1502889 - RNA, 21 nt, Human
cucgugccaccccgagggcug

SEQ ID NO: 1502890 - RNA, 17 nt, Human
cucgguguggagaagcg

SEQ ID NO: 1502891 - RNA, 23 nt, Human
cucgguguggagaagcggcuggc

SEQ ID NO: 1502892 - RNA, 16 nt, Human
cucgguguggagaagc

SEQ ID NO: 1502893 - RNA, 17 nt, Human
cuccuuugugaggaagc

SEQ ID NO: 1502894 - RNA, 18 nt, Human
cuccuuugugaggaagcc

SEQ ID NO: 1502895 - RNA, 23 nt, Human
cuccuuugugaggaagccgcugg

SEQ ID NO: 1502896 - RNA, 16 nt, Human
cucuccccaugauguu

SEQ ID NO: 1502897 - RNA, 19 nt, Human
cucuauguucuaagaagug

SEQ ID NO: 1502898 - RNA, 13 nt, Human
cucucccccaccc

SEQ ID NO: 1502899 - RNA, 16 nt, Human
cucucccccacccccu

SEQ ID NO: 1502900 - RNA, 13 nt, Human
cucuccuccagag

SEQ ID NO: 1502901 - RNA, 15 nt, Human
cucuccuccagaguc

SEQ ID NO: 1502902 - RNA, 14 nt, Human
cucucuggccuucg

SEQ ID NO: 1502903 - RNA, 16 nt, Human
cucucuggccuucggc

SEQ ID NO: 1502904 - RNA, 16 nt, Human
cucuccuccagaguca

SEQ ID NO: 1502905 - RNA, 14 nt, Human
cuccuuguguuacu

SEQ ID NO: 1502906 - RNA, 15 nt, Human
cuccuuucaccacau

SEQ ID NO: 1502907 - RNA, 16 nt, Human
cuccuguaccucuuga

SEQ ID NO: 1502908 - RNA, 15 nt, Human
cuccucugcugcugg

SEQ ID NO: 1502909 - RNA, 13 nt, Human
cuccucugcugcu

SEQ ID NO: 1502910 - RNA, 14 nt, Human
cuccucugcugcug

SEQ ID NO: 1502911 - RNA, 19 nt, Human
cuccuggcccacugcaucg

SEQ ID NO: 1502912 - RNA, 19 nt, Human
cuccuggccucaagugauu

SEQ ID NO: 1502913 - RNA, 18 nt, Human
cuccugggcuaagugauc

SEQ ID NO: 1502914 - RNA, 23 nt, Human
cuccaggugcacaagcuccaagc

SEQ ID NO: 1502915 - RNA, 23 nt, Human
cuccaggcuccuuuagcgcccag

SEQ ID NO: 1502916 - RNA, 20 nt, Human
cuccaggcuguaucccauga

SEQ ID NO: 1502917 - RNA, 22 nt, Human
cuccaggcuguaucccaugagc

SEQ ID NO: 1502918 - RNA, 15 nt, Human
cucccaggcauuccc

SEQ ID NO: 1502919 - RNA, 20 nt, Human
cucccucuuucccucccuuc

SEQ ID NO: 1502920 - RNA, 15 nt, Human
caagaaaugaaagca

SEQ ID NO: 1502921 - RNA, 13 nt, Human
caagaaaugaaag

SEQ ID NO: 1502922 - RNA, 23 nt, Human
caagacgcugugcugcccugccc

SEQ ID NO: 1502923 - RNA, 21 nt, Human
caagacgcugugcugcccugc

SEQ ID NO: 1502924 - RNA, 22 nt, Human
caagacgcugugcugcccugcc

SEQ ID NO: 1502925 - RNA, 14 nt, Human
caagaccuucuccu

SEQ ID NO: 1502926 - RNA, 20 nt, Human
caagacgcugugcugcccug

SEQ ID NO: 1502927 - RNA, 13 nt, Human
caagaccuucucc

SEQ ID NO: 1502928 - RNA, 12 nt, Human
caagagggucug

SEQ ID NO: 1502929 - RNA, 16 nt, Human
caagagggucugagga

SEQ ID NO: 1502930 - RNA, 17 nt, Human
caagagggucugaggaa

SEQ ID NO: 1502931 - RNA, 16 nt, Human
caagcauuuagaugua

SEQ ID NO: 1502932 - RNA, 19 nt, Human
caagcauuuagauguauag

SEQ ID NO: 1502933 - RNA, 21 nt, Human
caagcauaccaacacgagcag

SEQ ID NO: 1502934 - RNA, 16 nt, Human
caagcauaccaacacg

SEQ ID NO: 1502935 - RNA, 14 nt, Human
caaggauccugagc

SEQ ID NO: 1502936 - RNA, 15 nt, Human
caaggauccugagcc

SEQ ID NO: 1502937 - RNA, 16 nt, Human
caaggauccugagcca

SEQ ID NO: 1502938 - RNA, 17 nt, Human
caaggauccugagccag

SEQ ID NO: 1502939 - RNA, 21 nt, Human
caaggcugggggaagaagcuc

SEQ ID NO: 1502940 - RNA, 13 nt, Human
caaggcugucaau

SEQ ID NO: 1502941 - RNA, 14 nt, Human
caaggcugucaauu

SEQ ID NO: 1502942 - RNA, 21 nt, Human
caaggcugucaauuacaggaa

SEQ ID NO: 1502943 - RNA, 22 nt, Human
caagugaaaaaggaggaagaga

SEQ ID NO: 1502944 - RNA, 23 nt, Human
caagugaaaaaggaggaagagaa

SEQ ID NO: 1502945 - RNA, 14 nt, Human
caagugagacccug

SEQ ID NO: 1502946 - RNA, 21 nt, Human
caagugauucuccugccucag

SEQ ID NO: 1502947 - RNA, 20 nt, Human
caagugauucuccugccuca

SEQ ID NO: 1502948 - RNA, 15 nt, Human
caagugagacccugu

SEQ ID NO: 1502949 - RNA, 19 nt, Human
caagugagacccugucuca

SEQ ID NO: 1502950 - RNA, 19 nt, Human
caagugauucuccugccuc

SEQ ID NO: 1502951 - RNA, 23 nt, Human
caaggggaauguuugccucugcc

SEQ ID NO: 1502952 - RNA, 17 nt, Human
caaggggcccaaauucu

SEQ ID NO: 1502953 - RNA, 13 nt, Human
caaggucauuuuu

SEQ ID NO: 1502954 - RNA, 13 nt, Human
caagggccuggcc

SEQ ID NO: 1502955 - RNA, 14 nt, Human
caagggccuggccu

SEQ ID NO: 1502956 - RNA, 15 nt, Human
caagggccuggccug

SEQ ID NO: 1502957 - RNA, 21 nt, Human
caaggggaauguuugccucug

SEQ ID NO: 1502958 - RNA, 16 nt, Human
caagggccuggccuga

SEQ ID NO: 1502959 - RNA, 17 nt, Human
caaccugauugugucuc

SEQ ID NO: 1502960 - RNA, 19 nt, Human
caaccugauugugucucuu

SEQ ID NO: 1502961 - RNA, 21 nt, Human
caaccugauugugucucuugg

SEQ ID NO: 1502962 - RNA, 16 nt, Human
caacugcauuggcuuu

SEQ ID NO: 1502963 - RNA, 17 nt, Human
caacugcaucaagaugu

SEQ ID NO: 1502964 - RNA, 20 nt, Human
caacugcaucaagaugugac

SEQ ID NO: 1502965 - RNA, 23 nt, Human
caacugcaucaagaugugacaug

SEQ ID NO: 1502966 - RNA, 16 nt, Human
caacauacucccaucu

SEQ ID NO: 1502967 - RNA, 14 nt, Human
caacauacucccau

SEQ ID NO: 1502968 - RNA, 15 nt, Human
caacauacucccauc

SEQ ID NO: 1502969 - RNA, 17 nt, Human
caaauuuacagagacag

SEQ ID NO: 1502970 - RNA, 23 nt, Human
caaauuuacagagacagaaagca

SEQ ID NO: 1502971 - RNA, 14 nt, Human
caacaggcugggcu

SEQ ID NO: 1502972 - RNA, 17 nt, Human
caacaggcugggcuuca

SEQ ID NO: 1502973 - RNA, 19 nt, Human
caaaguggugagaggcauc

SEQ ID NO: 1502974 - RNA, 20 nt, Human
caaaggguaucaggugcugc

SEQ ID NO: 1502975 - RNA, 21 nt, Human
caaaggguaucaggugcugcc

SEQ ID NO: 1502976 - RNA, 23 nt, Human
caaaggguaucaggugcugccau

SEQ ID NO: 1502977 - RNA, 16 nt, Human
caaaguggugagaggc

SEQ ID NO: 1502978 - RNA, 17 nt, Human
caaaguggugagaggca

SEQ ID NO: 1502979 - RNA, 20 nt, Human
caaaggagauuggaaggaac

SEQ ID NO: 1502980 - RNA, 14 nt, Human
caaaggagauugga

SEQ ID NO: 1502981 - RNA, 18 nt, Human
auuuuaauaauguuucaa

SEQ ID NO: 1502982 - RNA, 19 nt, Human
auuuuaauaauguuucaaa

SEQ ID NO: 1502983 - RNA, 14 nt, Human
caaagaaauguaag

SEQ ID NO: 1502984 - RNA, 14 nt, Human
caaagagguuuuaa

SEQ ID NO: 1502985 - RNA, 21 nt, Human
caaagagguuuuaaaaaaauc

SEQ ID NO: 1502986 - RNA, 20 nt, Human
caacaggcugggcuucagug

SEQ ID NO: 1502987 - RNA, 14 nt, Human
cacacccagcccac

SEQ ID NO: 1502988 - RNA, 20 nt, Human
cacacccagcccacuucugc

SEQ ID NO: 1502989 - RNA, 16 nt, Human
cacacagcucuguccu

SEQ ID NO: 1502990 - RNA, 21 nt, Human
cacaccagagcccaccuuggc

SEQ ID NO: 1502991 - RNA, 22 nt, Human
cacaccagagcccaccuuggcu

SEQ ID NO: 1502992 - RNA, 19 nt, Human
cacacagcaagucaggguu

SEQ ID NO: 1502993 - RNA, 13 nt, Human
cacacagcucugu

SEQ ID NO: 1502994 - RNA, 14 nt, Human
cacacagcucuguc

SEQ ID NO: 1502995 - RNA, 15 nt, Human
cacacagcucugucc

SEQ ID NO: 1502996 - RNA, 15 nt, Human
cacacaccagagccc

SEQ ID NO: 1502997 - RNA, 16 nt, Human
cacacaccagagccca

SEQ ID NO: 1502998 - RNA, 20 nt, Human
cacacaccagagcccaccuu

SEQ ID NO: 1502999 - RNA, 14 nt, Human
cacacacuuuggcu

SEQ ID NO: 1503000 - RNA, 13 nt, Human
cacaagaaaugaa

SEQ ID NO: 1503001 - RNA, 18 nt, Human
cacaagaaaugaaagcag

SEQ ID NO: 1503002 - RNA, 15 nt, Human
cacaagaaaugaaag

SEQ ID NO: 1503003 - RNA, 23 nt, Human
cacaagaaaugaaagcagggacu

SEQ ID NO: 1503004 - RNA, 23 nt, Human
cacaagacccaaaaggcagaagc

SEQ ID NO: 1503005 - RNA, 19 nt, Human
caaugguuugcaaggaagc

SEQ ID NO: 1503006 - RNA, 20 nt, Human
caaugguuugcaaggaagcc

SEQ ID NO: 1503007 - RNA, 14 nt, Human
caaugcacuuuguu

SEQ ID NO: 1503008 - RNA, 18 nt, Human
caaugguuuucuugugug

SEQ ID NO: 1503009 - RNA, 13 nt, Human
caaugguuugcaa

SEQ ID NO: 1503010 - RNA, 16 nt, Human
caaugguuugcaagga

SEQ ID NO: 1503011 - RNA, 17 nt, Human
caaugguuugcaaggaa

SEQ ID NO: 1503012 - RNA, 18 nt, Human
caaugguuugcaaggaag

SEQ ID NO: 1503013 - RNA, 17 nt, Human
cacaaacgggcucagca

SEQ ID NO: 1503014 - RNA, 14 nt, Human
caauaucagacuuu

SEQ ID NO: 1503015 - RNA, 21 nt, Human
caaugaccuuucaauaggaaa

SEQ ID NO: 1503016 - RNA, 13 nt, Human
caaugauggucac

SEQ ID NO: 1503017 - RNA, 15 nt, Human
caaugaccuuucaau

SEQ ID NO: 1503018 - RNA, 16 nt, Human
caaugaccuuucaaua

SEQ ID NO: 1503019 - RNA, 14 nt, Human
caaugaccuuucaa

SEQ ID NO: 1503020 - RNA, 14 nt, Human
caaugauggucacc

SEQ ID NO: 1503021 - RNA, 14 nt, Human
caaugcaaaccauc

SEQ ID NO: 1503022 - RNA, 21 nt, Human
caaugcaaaccaucauugaaa

SEQ ID NO: 1503023 - RNA, 22 nt, Human
caaugcaaaccaucauugaaau

SEQ ID NO: 1503024 - RNA, 23 nt, Human
caaugcaaaccaucauugaaauc

SEQ ID NO: 1503025 - RNA, 14 nt, Human
caaugcacugacau

SEQ ID NO: 1503026 - RNA, 13 nt, Human
caaugcacuuugu

SEQ ID NO: 1503027 - RNA, 17 nt, Human
cacaugaaguccaagca

SEQ ID NO: 1503028 - RNA, 20 nt, Human
cacaugaaguccaagcauuu

SEQ ID NO: 1503029 - RNA, 21 nt, Human
cacaguuuucugagaaagacu

SEQ ID NO: 1503030 - RNA, 22 nt, Human
cacaguuuucugagaaagacua

SEQ ID NO: 1503031 - RNA, 13 nt, Human
cacaugagcauca

SEQ ID NO: 1503032 - RNA, 17 nt, Human
cacaugagcaucaggcc

SEQ ID NO: 1503033 - RNA, 18 nt, Human
cacaugagcaucaggcca

SEQ ID NO: 1503034 - RNA, 19 nt, Human
cacaugagcaucaggccag

SEQ ID NO: 1503035 - RNA, 20 nt, Human
cacaugagcaucaggccagg

SEQ ID NO: 1503036 - RNA, 21 nt, Human
cacaugagcaucaggccaggc

SEQ ID NO: 1503037 - RNA, 19 nt, Human
cacaugcaaggucauuuuu

SEQ ID NO: 1503038 - RNA, 17 nt, Human
cacaugcaaggucauuu

SEQ ID NO: 1503039 - RNA, 20 nt, Human
cacaugcaaggucauuuuuu

SEQ ID NO: 1503040 - RNA, 18 nt, Human
cacaugcacgugugugca

SEQ ID NO: 1503041 - RNA, 16 nt, Human
cacauguccaagaagc

SEQ ID NO: 1503042 - RNA, 17 nt, Human
cacauguccaagaagcc

SEQ ID NO: 1503043 - RNA, 20 nt, Human
cacaugccucucucaggcca

SEQ ID NO: 1503044 - RNA, 21 nt, Human
cacaugccucucucaggccaa

SEQ ID NO: 1503045 - RNA, 19 nt, Human
cacagcccaaagaaggaaa

SEQ ID NO: 1503046 - RNA, 22 nt, Human
cacacggacacucaaaagcugg

SEQ ID NO: 1503047 - RNA, 14 nt, Human
cacaggcccggcuc

SEQ ID NO: 1503048 - RNA, 23 nt, Human
cacaguccuuaccagcagagcac

SEQ ID NO: 1503049 - RNA, 21 nt, Human
cacagcucuucuccaggcugu

SEQ ID NO: 1503050 - RNA, 19 nt, Human
cacagcucuucuccaggcu

SEQ ID NO: 1503051 - RNA, 20 nt, Human
cacagcucuucuccaggcug

SEQ ID NO: 1503052 - RNA, 13 nt, Human
caccaucaagcca

SEQ ID NO: 1503053 - RNA, 14 nt, Human
caccaucaagccac

SEQ ID NO: 1503054 - RNA, 15 nt, Human
caccaucaagccacc

SEQ ID NO: 1503055 - RNA, 18 nt, Human
caccaguuccuuucaaug

SEQ ID NO: 1503056 - RNA, 21 nt, Human
caccauauuaccacagacaua

SEQ ID NO: 1503057 - RNA, 12 nt, Human
caccagcagccu

SEQ ID NO: 1503058 - RNA, 16 nt, Human
caccagguagaacaca

SEQ ID NO: 1503059 - RNA, 16 nt, Human
caccaucaagccacca

SEQ ID NO: 1503060 - RNA, 17 nt, Human
caccaucaagccaccaa

SEQ ID NO: 1503061 - RNA, 19 nt, Human
caccaucaagccaccaaca

SEQ ID NO: 1503062 - RNA, 24 nt, Human
caccaucaagccaccaacauacuc

SEQ ID NO: 1503063 - RNA, 15 nt, Human
caccaucaugucugg

SEQ ID NO: 1503064 - RNA, 17 nt, Human
caccaucaugucuggcu

SEQ ID NO: 1503065 - RNA, 18 nt, Human
caccaucaugucuggcua

SEQ ID NO: 1503066 - RNA, 15 nt, Human
caccaagcccaguua

SEQ ID NO: 1503067 - RNA, 13 nt, Human
caccaagcccagu

SEQ ID NO: 1503068 - RNA, 12 nt, Human
caccaagcccag

SEQ ID NO: 1503069 - RNA, 23 nt, Human
cacauguccaagaagcccaggaa

SEQ ID NO: 1503070 - RNA, 17 nt, Human
caccaacgucugugcca

SEQ ID NO: 1503071 - RNA, 18 nt, Human
cacauguccaagaagccc

SEQ ID NO: 1503072 - RNA, 19 nt, Human
cacauguccaagaagccca

SEQ ID NO: 1503073 - RNA, 21 nt, Human
cacauguccaagaagcccagg

SEQ ID NO: 1503074 - RNA, 22 nt, Human
cacauguccaagaagcccagga

SEQ ID NO: 1503075 - RNA, 17 nt, Human
caccagacggggcugga

SEQ ID NO: 1503076 - RNA, 16 nt, Human
caccagacggggcugg

SEQ ID NO: 1503077 - RNA, 15 nt, Human
caccagagcccaccu

SEQ ID NO: 1503078 - RNA, 17 nt, Human
caccagagcccaccuug

SEQ ID NO: 1503079 - RNA, 18 nt, Human
caccagagcccaccuugg

SEQ ID NO: 1503080 - RNA, 20 nt, Human
caccagagcccaccuuggcu

SEQ ID NO: 1503081 - RNA, 22 nt, Human
caccagagcccaccuuggcuca

SEQ ID NO: 1503082 - RNA, 19 nt, Human
caccacacccagcccacuu

SEQ ID NO: 1503083 - RNA, 13 nt, Human
caccauucagguc

SEQ ID NO: 1503084 - RNA, 13 nt, Human
cacccaagggccu

SEQ ID NO: 1503085 - RNA, 18 nt, Human
uuuucuugccucuguccc

SEQ ID NO: 1503086 - RNA, 19 nt, Human
uuuucuugccucugucccc

SEQ ID NO: 1503087 - RNA, 21 nt, Human
uuuucuugccucuguccccuu

SEQ ID NO: 1503088 - RNA, 12 nt, Human
uuuuuucugaaa

SEQ ID NO: 1503089 - RNA, 20 nt, Human
uuuagaaacacaacuauauu

SEQ ID NO: 1503090 - RNA, 12 nt, Human
uuuagaaacaca

SEQ ID NO: 1503091 - RNA, 22 nt, Human
uuuacauggcuggagcuagaau

SEQ ID NO: 1503092 - RNA, 13 nt, Human
uuuacauuguaaa

SEQ ID NO: 1503093 - RNA, 20 nt, Human
uuuacauuguaaauaguauu

SEQ ID NO: 1503094 - RNA, 15 nt, Human
uuuacauuguaaaua

SEQ ID NO: 1503095 - RNA, 15 nt, Human
uuuacuuuguguuca

SEQ ID NO: 1503096 - RNA, 17 nt, Human
uuuacauggcuggagcu

SEQ ID NO: 1503097 - RNA, 20 nt, Human
uuguauuuuacuaauaaaau

SEQ ID NO: 1503098 - RNA, 14 nt, Human
uuuauugucaaagu

SEQ ID NO: 1503099 - RNA, 16 nt, Human
uuuauugucaaagugg

SEQ ID NO: 1503100 - RNA, 22 nt, Human
uuuauuguuuaaaaucauuucu

SEQ ID NO: 1503101 - RNA, 18 nt, Human
uuuaucuuugauucuccu

SEQ ID NO: 1503102 - RNA, 19 nt, Human
uuuaucuuugauucuccuu

SEQ ID NO: 1503103 - RNA, 18 nt, Human
uuuauaaacuuuaccuuu

SEQ ID NO: 1503104 - RNA, 21 nt, Human
uuuaucgucacugcuuaacuu

SEQ ID NO: 1503105 - RNA, 16 nt, Human
uuuauaaacuuuaccu

SEQ ID NO: 1503106 - RNA, 16 nt, Human
uuuaucgucacugcuu

SEQ ID NO: 1503107 - RNA, 14 nt, Human
uuuauaaacuuuac

SEQ ID NO: 1503108 - RNA, 16 nt, Human
uuucuaggacugaauu

SEQ ID NO: 1503109 - RNA, 22 nt, Human
uuucuccccugcccccaggacu

SEQ ID NO: 1503110 - RNA, 23 nt, Human
uuucuccccugcccccaggacug

SEQ ID NO: 1503111 - RNA, 24 nt, Human
uuucuccccugcccccaggacugg

SEQ ID NO: 1503112 - RNA, 15 nt, Human
uuucuagccagagga

SEQ ID NO: 1503113 - RNA, 22 nt, Human
uuucugagaaagacuauucaaa

SEQ ID NO: 1503114 - RNA, 18 nt, Human
uuucuaaaggcuaccuuu

SEQ ID NO: 1503115 - RNA, 14 nt, Human
uuucuaaaggcuac

SEQ ID NO: 1503116 - RNA, 17 nt, Human
uuucuaaagcugccagc

SEQ ID NO: 1503117 - RNA, 22 nt, Human
uuuccaggcugguucggauuug

SEQ ID NO: 1503118 - RNA, 15 nt, Human
uuuccaggcugguuc

SEQ ID NO: 1503119 - RNA, 22 nt, Human
uuuccucaaaacuucagacaua

SEQ ID NO: 1503120 - RNA, 21 nt, Human
uuuccucuuuggucuacacug

SEQ ID NO: 1503121 - RNA, 15 nt, Human
uuucagauaaucaca

SEQ ID NO: 1503122 - RNA, 21 nt, Human
uuucaaugguuugcaaggaag

SEQ ID NO: 1503123 - RNA, 15 nt, Human
uuucagcagcugcag

SEQ ID NO: 1503124 - RNA, 21 nt, Human
uuucagauaaucacaauacau

SEQ ID NO: 1503125 - RNA, 20 nt, Human
uuuauuuguuugugcauuug

SEQ ID NO: 1503126 - RNA, 13 nt, Human
uuuauuucuuaaa

SEQ ID NO: 1503127 - RNA, 20 nt, Human
uuucaauaggaaaaacugau

SEQ ID NO: 1503128 - RNA, 22 nt, Human
uuucaauaggaaaaacugauuu

SEQ ID NO: 1503129 - RNA, 13 nt, Human
uuuccaggaaggc

SEQ ID NO: 1503130 - RNA, 15 nt, Human
uuuccaaaguacacu

SEQ ID NO: 1503131 - RNA, 12 nt, Human
uuuccaaaguac

SEQ ID NO: 1503132 - RNA, 14 nt, Human
uuuccaaaauaauu

SEQ ID NO: 1503133 - RNA, 15 nt, Human
uuucagccaagaauu

SEQ ID NO: 1503134 - RNA, 16 nt, Human
uuucagccaagaauuc

SEQ ID NO: 1503135 - RNA, 22 nt, Human
uuucauugcugggcuugucugu

SEQ ID NO: 1503136 - RNA, 15 nt, Human
uuugagcagggcuca

SEQ ID NO: 1503137 - RNA, 13 nt, Human
uuugagugccuua

SEQ ID NO: 1503138 - RNA, 22 nt, Human
uuugaggucuguucuuuccaaa

SEQ ID NO: 1503139 - RNA, 17 nt, Human
uuugaggucuguucuuu

SEQ ID NO: 1503140 - RNA, 14 nt, Human
uuugauauaugaaa

SEQ ID NO: 1503141 - RNA, 18 nt, Human
uuugauaguauugugcau

SEQ ID NO: 1503142 - RNA, 14 nt, Human
uuugcagacaggca

SEQ ID NO: 1503143 - RNA, 23 nt, Human
uuuggaacaagaugguucuagca

SEQ ID NO: 1503144 - RNA, 22 nt, Human
uuugccauguuggccaggcugg

SEQ ID NO: 1503145 - RNA, 18 nt, Human
uuugccauguuggccagg

SEQ ID NO: 1503146 - RNA, 21 nt, Human
uuugcauagauucccugagca

SEQ ID NO: 1503147 - RNA, 21 nt, Human
uuuguauaaaauaauuuuuau

SEQ ID NO: 1503148 - RNA, 22 nt, Human
uuuguaaauuaacuuuuauaaa

SEQ ID NO: 1503149 - RNA, 17 nt, Human
uuuguaaauuaacuuuu

SEQ ID NO: 1503150 - RNA, 16 nt, Human
uuuguaaauuaacuuu

SEQ ID NO: 1503151 - RNA, 15 nt, Human
uuuguaaauuaacuu

SEQ ID NO: 1503152 - RNA, 13 nt, Human
uuuguccccaccg

SEQ ID NO: 1503153 - RNA, 21 nt, Human
uuuguccccaccgcagacagg

SEQ ID NO: 1503154 - RNA, 16 nt, Human
uuuguucauacauauu

SEQ ID NO: 1503155 - RNA, 13 nt, Human
uuuguucauacau

SEQ ID NO: 1503156 - RNA, 16 nt, Human
uuuguuccccuccucc

SEQ ID NO: 1503157 - RNA, 18 nt, Human
uuuguuccccuccuccac

SEQ ID NO: 1503158 - RNA, 12 nt, Human
uuuguuccccuc

SEQ ID NO: 1503159 - RNA, 13 nt, Human
uuuguuccccucc

SEQ ID NO: 1503160 - RNA, 15 nt, Human
uuuguuccccuccuc

SEQ ID NO: 1503161 - RNA, 22 nt, Human
uuuuacauaaauuuaguauuuu

SEQ ID NO: 1503162 - RNA, 17 nt, Human
uuuuaauuugguuuuca

SEQ ID NO: 1503163 - RNA, 13 nt, Human
uuuuaauuugaua

SEQ ID NO: 1503164 - RNA, 21 nt, Human
uuuuaauuugguuuucacauu

SEQ ID NO: 1503165 - RNA, 15 nt, Human
uuuuauaugcuucug

SEQ ID NO: 1503166 - RNA, 20 nt, Human
uuuuauaugcuucuguuuua

SEQ ID NO: 1503167 - RNA, 20 nt, Human
uuuuauaucaauuuaaaaaa

SEQ ID NO: 1503168 - RNA, 10 nt, Human
uuuuauauuu

SEQ ID NO: 1503169 - RNA, 18 nt, Human
uuuuaucgucacugcuua

SEQ ID NO: 1503170 - RNA, 19 nt, Human
uuuuaucgucacugcuuaa

SEQ ID NO: 1503171 - RNA, 13 nt, Human
uuuuccugaaaac

SEQ ID NO: 1503172 - RNA, 22 nt, Human
uuuucagaaaauauuauguguu

SEQ ID NO: 1503173 - RNA, 16 nt, Human
uuuucagaaaauauua

SEQ ID NO: 1503174 - RNA, 18 nt, Human
uuuuccaugaguccccug

SEQ ID NO: 1503175 - RNA, 19 nt, Human
uuuuccaugaguccccugu

SEQ ID NO: 1503176 - RNA, 15 nt, Human
uuuuccuucagugcc

SEQ ID NO: 1503177 - RNA, 17 nt, Human
uuuucuugcaugaggcu

SEQ ID NO: 1503178 - RNA, 15 nt, Human
uuuucagaaaauauu

SEQ ID NO: 1503179 - RNA, 16 nt, Human
uuuucacauaucuagu

SEQ ID NO: 1503180 - RNA, 13 nt, Human
uuuucacauaucu

SEQ ID NO: 1503181 - RNA, 15 nt, Human
uuuucacaguucucu

SEQ ID NO: 1503182 - RNA, 19 nt, Human
uucaaugccccugaauuua

SEQ ID NO: 1503183 - RNA, 20 nt, Human
uucaaugguuugcaaggaag

SEQ ID NO: 1503184 - RNA, 22 nt, Human
uucaaugguuugcaaggaagcc

SEQ ID NO: 1503185 - RNA, 23 nt, Human
uucaaugguuugcaaggaagcca

SEQ ID NO: 1503186 - RNA, 18 nt, Human
uucaauucucauuuguca

SEQ ID NO: 1503187 - RNA, 21 nt, Human
uucaacagguuuuccugaaga

SEQ ID NO: 1503188 - RNA, 13 nt, Human
uuacgugaguccu

SEQ ID NO: 1503189 - RNA, 14 nt, Human
uuacgugaguccug

SEQ ID NO: 1503190 - RNA, 13 nt, Human
uucaaagauauuu

SEQ ID NO: 1503191 - RNA, 23 nt, Human
uucagcuccagcucaccagcccc

SEQ ID NO: 1503192 - RNA, 17 nt, Human
uucagcucugcaagaau

SEQ ID NO: 1503193 - RNA, 24 nt, Human
uucagcucugcaagaauugaagca

SEQ ID NO: 1503194 - RNA, 21 nt, Human
uucagcugguugagguuucaa

SEQ ID NO: 1503195 - RNA, 16 nt, Human
uucaggaagcucaggg

SEQ ID NO: 1503196 - RNA, 18 nt, Human
uucagcugcauacaguuu

SEQ ID NO: 1503197 - RNA, 17 nt, Human
uucagcugacuuuucug

SEQ ID NO: 1503198 - RNA, 20 nt, Human
uucaggaagcucagggccug

SEQ ID NO: 1503199 - RNA, 17 nt, Human
uucaggaagcucagggc

SEQ ID NO: 1503200 - RNA, 19 nt, Human
uucaggaagcucagggccu

SEQ ID NO: 1503201 - RNA, 12 nt, Human
uucaccccuccc

SEQ ID NO: 1503202 - RNA, 15 nt, Human
uucaccccucccuuu

SEQ ID NO: 1503203 - RNA, 14 nt, Human
uucacucuccuugg

SEQ ID NO: 1503204 - RNA, 15 nt, Human
uucagagacuccugc

SEQ ID NO: 1503205 - RNA, 19 nt, Human
uucagagacuccugcaggc

SEQ ID NO: 1503206 - RNA, 15 nt, Human
uuccaugaaaaugca

SEQ ID NO: 1503207 - RNA, 24 nt, Human
uuccaugaaaaugcaacaacaugu

SEQ ID NO: 1503208 - RNA, 17 nt, Human
uuccaugaguccccugu

SEQ ID NO: 1503209 - RNA, 19 nt, Human
uuccacuuauaggaauuga

SEQ ID NO: 1503210 - RNA, 21 nt, Human
uuccauccuagucacuaccuu

SEQ ID NO: 1503211 - RNA, 19 nt, Human
uucauuuaggugaggaagc

SEQ ID NO: 1503212 - RNA, 18 nt, Human
uucaugaaagauucaaug

SEQ ID NO: 1503213 - RNA, 12 nt, Human
uucaucuugaau

SEQ ID NO: 1503214 - RNA, 17 nt, Human
uucaucuugaauuguaa

SEQ ID NO: 1503215 - RNA, 20 nt, Human
uucaucugacuaugacauaa

SEQ ID NO: 1503216 - RNA, 17 nt, Human
uucaucugacuaugaca

SEQ ID NO: 1503217 - RNA, 20 nt, Human
uucaucuuccaacucaaacu

SEQ ID NO: 1503218 - RNA, 11 nt, Human
uucaucuugaa

SEQ ID NO: 1503219 - RNA, 13 nt, Human
uucauaaugacuu

SEQ ID NO: 1503220 - RNA, 23 nt, Human
uucauaaugacuuaagcacacuu

SEQ ID NO: 1503221 - RNA, 19 nt, Human
uucagugccuuauggaaca

SEQ ID NO: 1503222 - RNA, 21 nt, Human
uucagugccuuauggaacacu

SEQ ID NO: 1503223 - RNA, 13 nt, Human
uucaguggcagcu

SEQ ID NO: 1503224 - RNA, 19 nt, Human
uucccuuugacgccauccc

SEQ ID NO: 1503225 - RNA, 22 nt, Human
uuccccacuugagaauuacccu

SEQ ID NO: 1503226 - RNA, 22 nt, Human
uuccccagcaugcaccacgggc

SEQ ID NO: 1503227 - RNA, 12 nt, Human
uuccuagugaaa

SEQ ID NO: 1503228 - RNA, 23 nt, Human
uuccucauaguaugguggcuggg

SEQ ID NO: 1503229 - RNA, 22 nt, Human
uuccucccucccucuuucccuc

SEQ ID NO: 1503230 - RNA, 12 nt, Human
uuccucccuccc

SEQ ID NO: 1503231 - RNA, 19 nt, Human
uuccucccucccucuuucc

SEQ ID NO: 1503232 - RNA, 21 nt, Human
uuccucccucccucuuucccu

SEQ ID NO: 1503233 - RNA, 17 nt, Human
uuccuucugugaaagua

SEQ ID NO: 1503234 - RNA, 20 nt, Human
uuccuucugugaaaguacau

SEQ ID NO: 1503235 - RNA, 16 nt, Human
uuccuucagugccuua

SEQ ID NO: 1503236 - RNA, 19 nt, Human
uuccuucagugccuuaugg

SEQ ID NO: 1503237 - RNA, 23 nt, Human
uuccuucagugccuuauggaaca

SEQ ID NO: 1503238 - RNA, 19 nt, Human
uuccuucauucaacccacc

SEQ ID NO: 1503239 - RNA, 22 nt, Human
uucggccuccauccugaggcuc

SEQ ID NO: 1503240 - RNA, 18 nt, Human
uucggccuccauccugag

SEQ ID NO: 1503241 - RNA, 19 nt, Human
uucggccuccauccugagg

SEQ ID NO: 1503242 - RNA, 16 nt, Human
uucuaaaggcuaccuu

SEQ ID NO: 1503243 - RNA, 18 nt, Human
uucuaaaggcuaccuuug

SEQ ID NO: 1503244 - RNA, 17 nt, Human
uucuaaaggcuaccuuu

SEQ ID NO: 1503245 - RNA, 19 nt, Human
uucuaaaggcuaccuuugu

SEQ ID NO: 1503246 - RNA, 14 nt, Human
uucucugauacaga

SEQ ID NO: 1503247 - RNA, 15 nt, Human
uucucugauacagaa

SEQ ID NO: 1503248 - RNA, 16 nt, Human
uucucugauacagaaa

SEQ ID NO: 1503249 - RNA, 17 nt, Human
uucucugauacagaaaa

SEQ ID NO: 1503250 - RNA, 21 nt, Human
uucugacccaugcugcccugu

SEQ ID NO: 1503251 - RNA, 18 nt, Human
uucugacccaugcugccc

SEQ ID NO: 1503252 - RNA, 20 nt, Human
uucugacccaugcugcccug

SEQ ID NO: 1503253 - RNA, 23 nt, Human
uucucuccucuccccaugauguu

SEQ ID NO: 1503254 - RNA, 18 nt, Human
uucucuccagccccugga

SEQ ID NO: 1503255 - RNA, 16 nt, Human
uucuccacccugcucu

SEQ ID NO: 1503256 - RNA, 11 nt, Human
uucuccaggcu

SEQ ID NO: 1503257 - RNA, 16 nt, Human
uucuccaagcaggaca

SEQ ID NO: 1503258 - RNA, 13 nt, Human
uucuccacccugc

SEQ ID NO: 1503259 - RNA, 18 nt, Human
uucucaucuuucuugauc

SEQ ID NO: 1503260 - RNA, 15 nt, Human
uucucaucuuucuug

SEQ ID NO: 1503261 - RNA, 14 nt, Human
uucuauuguuucuu

SEQ ID NO: 1503262 - RNA, 17 nt, Human
uucuaugacacaugcaa

SEQ ID NO: 1503263 - RNA, 16 nt, Human
uucuaugacacaugca

SEQ ID NO: 1503264 - RNA, 14 nt, Human
uucugagcauuuaa

SEQ ID NO: 1503265 - RNA, 15 nt, Human
uucugagaaagacua

SEQ ID NO: 1503266 - RNA, 17 nt, Human
uucuguccgagcuuuga

SEQ ID NO: 1503267 - RNA, 21 nt, Human
uucuguccgagcuuugaaaau

SEQ ID NO: 1503268 - RNA, 19 nt, Human
uucuguccuacucuguguc

SEQ ID NO: 1503269 - RNA, 17 nt, Human
uucuguccuacucugug

SEQ ID NO: 1503270 - RNA, 23 nt, Human
uucuguggguuucuaaagcugcc

SEQ ID NO: 1503271 - RNA, 16 nt, Human
uucuugguuuguaaau

SEQ ID NO: 1503272 - RNA, 13 nt, Human
uucuugguuugua

SEQ ID NO: 1503273 - RNA, 18 nt, Human
uucuugguuuguaaauua

SEQ ID NO: 1503274 - RNA, 17 nt, Human
uucuugguuuguaaauu

SEQ ID NO: 1503275 - RNA, 23 nt, Human
uucuugguuuguaaauuaacuuu

SEQ ID NO: 1503276 - RNA, 15 nt, Human
uucuuauuucauuuc

SEQ ID NO: 1503277 - RNA, 11 nt, Human
uucuguucuuu

SEQ ID NO: 1503278 - RNA, 19 nt, Human
uucuuauuuaaugaaagac

SEQ ID NO: 1503279 - RNA, 23 nt, Human
uucuuauuuaaugaaagacugua

SEQ ID NO: 1503280 - RNA, 19 nt, Human
uugaacucuucaaucucuu

SEQ ID NO: 1503281 - RNA, 16 nt, Human
uugaacugauaaagau

SEQ ID NO: 1503282 - RNA, 22 nt, Human
uugaacuuugaccucugcagca

SEQ ID NO: 1503283 - RNA, 19 nt, Human
uugaagacuuuucuuucag

SEQ ID NO: 1503284 - RNA, 17 nt, Human
uugaagacagagcuaca

SEQ ID NO: 1503285 - RNA, 21 nt, Human
uugaaucucauaauuuauaca

SEQ ID NO: 1503286 - RNA, 15 nt, Human
uugaaucucauaauu

SEQ ID NO: 1503287 - RNA, 18 nt, Human
uucuuuauaauucuacuu

SEQ ID NO: 1503288 - RNA, 19 nt, Human
uugaaaacacuguucucug

SEQ ID NO: 1503289 - RNA, 21 nt, Human
uugaaaacacuguucucugcc

SEQ ID NO: 1503290 - RNA, 22 nt, Human
uugaaaacacuguucucugccc

SEQ ID NO: 1503291 - RNA, 23 nt, Human
uugaaacugagaugugaacacau

SEQ ID NO: 1503292 - RNA, 18 nt, Human
uugaaaagacuccaaaga

SEQ ID NO: 1503293 - RNA, 22 nt, Human
uugaaaagacuccaaagaaaug

SEQ ID NO: 1503294 - RNA, 23 nt, Human
uugaaaagacuccaaagaaaugu

SEQ ID NO: 1503295 - RNA, 14 nt, Human
uugacgccauccca

SEQ ID NO: 1503296 - RNA, 15 nt, Human
uugacgccaucccag

SEQ ID NO: 1503297 - RNA, 22 nt, Human
uugacgccaucccagccccaau

SEQ ID NO: 1503298 - RNA, 22 nt, Human
uugaccugaggcccuucucucc

SEQ ID NO: 1503299 - RNA, 12 nt, Human
uugaccugaggc

SEQ ID NO: 1503300 - RNA, 19 nt, Human
uugaccugaggcccuucuc

SEQ ID NO: 1503301 - RNA, 20 nt, Human
uugaccgugaggccagagac

SEQ ID NO: 1503302 - RNA, 21 nt, Human
uugaccgugaggccagagaca

SEQ ID NO: 1503303 - RNA, 15 nt, Human
uugaccucaggugau

SEQ ID NO: 1503304 - RNA, 21 nt, Human
uugaccucaggugauccaccc

SEQ ID NO: 1503305 - RNA, 14 nt, Human
uugaggacacugau

SEQ ID NO: 1503306 - RNA, 15 nt, Human
uugaggacacugaua

SEQ ID NO: 1503307 - RNA, 19 nt, Human
uugauagcacagacccugc

SEQ ID NO: 1503308 - RNA, 20 nt, Human
uugauagcacagacccugcc

SEQ ID NO: 1503309 - RNA, 12 nt, Human
uugaugaagaag

SEQ ID NO: 1503310 - RNA, 13 nt, Human
uugaugaagaagu

SEQ ID NO: 1503311 - RNA, 21 nt, Human
uugauagcacagacccugccc

SEQ ID NO: 1503312 - RNA, 23 nt, Human
uugauagcacagacccugcccug

SEQ ID NO: 1503313 - RNA, 18 nt, Human
uugauuuccguuaaaaua

SEQ ID NO: 1503314 - RNA, 14 nt, Human
uugcaacaggcugg

SEQ ID NO: 1503315 - RNA, 17 nt, Human
uugcaacaggcugggcu

SEQ ID NO: 1503316 - RNA, 18 nt, Human
uugcauagauucccugag

SEQ ID NO: 1503317 - RNA, 16 nt, Human
uugcagacaggcaagc

SEQ ID NO: 1503318 - RNA, 22 nt, Human
uugcagacaggcaagcaccucc

SEQ ID NO: 1503319 - RNA, 16 nt, Human
uuggguggaugccugg

SEQ ID NO: 1503320 - RNA, 22 nt, Human
uuggcuuuggguugcaggaccu

SEQ ID NO: 1503321 - RNA, 16 nt, Human
uugggaggccauuugu

SEQ ID NO: 1503322 - RNA, 12 nt, Human
uugggaggcuga

SEQ ID NO: 1503323 - RNA, 13 nt, Human
uuggcauucccca

SEQ ID NO: 1503324 - RNA, 14 nt, Human
uuggccaggcuggu

SEQ ID NO: 1503325 - RNA, 24 nt, Human
uuggccaaagccaaagcuaggccu

SEQ ID NO: 1503326 - RNA, 18 nt, Human
uuggcugggggccucagu

SEQ ID NO: 1503327 - RNA, 21 nt, Human
uuggcugggggccucagugcc

SEQ ID NO: 1503328 - RNA, 22 nt, Human
uuggcugggggccucagugcca

SEQ ID NO: 1503329 - RNA, 16 nt, Human
uuguaaaggaauuuaa

SEQ ID NO: 1503330 - RNA, 22 nt, Human
uuggucccccuuccauggacuu

SEQ ID NO: 1503331 - RNA, 12 nt, Human
uugguccugcug

SEQ ID NO: 1503332 - RNA, 13 nt, Human
uugguccugcugc

SEQ ID NO: 1503333 - RNA, 11 nt, Human
uuguaaaugug

SEQ ID NO: 1503334 - RNA, 14 nt, Human
uuguaaaugugcuu

SEQ ID NO: 1503335 - RNA, 18 nt, Human
uuguaaaugugcuuuuaa

SEQ ID NO: 1503336 - RNA, 12 nt, Human
uuguacagacaa

SEQ ID NO: 1503337 - RNA, 13 nt, Human
uuguacagacaac

SEQ ID NO: 1503338 - RNA, 19 nt, Human
uuguacacaccuuauauuu

SEQ ID NO: 1503339 - RNA, 21 nt, Human
uuguauucucuccuguaccuc

SEQ ID NO: 1503340 - RNA, 14 nt, Human
uuguacauaaugcg

SEQ ID NO: 1503341 - RNA, 14 nt, Human
uuguagagccaggg

SEQ ID NO: 1503342 - RNA, 15 nt, Human
uuguagagccagggu

SEQ ID NO: 1503343 - RNA, 21 nt, Human
uugcguggaauugugcugagu

SEQ ID NO: 1503344 - RNA, 20 nt, Human
uugcugauggugcaaugacc

SEQ ID NO: 1503345 - RNA, 22 nt, Human
uugcugauggugcaaugaccuu

SEQ ID NO: 1503346 - RNA, 17 nt, Human
uugccucuguccccuuc

SEQ ID NO: 1503347 - RNA, 18 nt, Human
uugccucuguccccuucu

SEQ ID NO: 1503348 - RNA, 19 nt, Human
uugccucuguccccuucuc

SEQ ID NO: 1503349 - RNA, 20 nt, Human
uugccucuguccccuucucu

SEQ ID NO: 1503350 - RNA, 16 nt, Human
uugccucugccucuga

SEQ ID NO: 1503351 - RNA, 18 nt, Human
uugccucugccucugaca

SEQ ID NO: 1503352 - RNA, 11 nt, Human
uugccucugcc

SEQ ID NO: 1503353 - RNA, 14 nt, Human
uugccucugccucu

SEQ ID NO: 1503354 - RNA, 18 nt, Human
uugccagucaccccggcc

SEQ ID NO: 1503355 - RNA, 23 nt, Human
uugcccacgcuggagugcaguga

SEQ ID NO: 1503356 - RNA, 11 nt, Human
uugcccaggca

SEQ ID NO: 1503357 - RNA, 20 nt, Human
uugcuggggccgaaagaaca

SEQ ID NO: 1503358 - RNA, 11 nt, Human
uuggaaggaac

SEQ ID NO: 1503359 - RNA, 19 nt, Human
uuggaaggaacguccccug

SEQ ID NO: 1503360 - RNA, 14 nt, Human
uuggauuguccccg

SEQ ID NO: 1503361 - RNA, 17 nt, Human
uuggcaaaaaggcagga

SEQ ID NO: 1503362 - RNA, 15 nt, Human
uuggacccugaggcc

SEQ ID NO: 1503363 - RNA, 17 nt, Human
uguagauaauacaguuc

SEQ ID NO: 1503364 - RNA, 19 nt, Human
uguacugcauaugaaagga

SEQ ID NO: 1503365 - RNA, 17 nt, Human
uguacgucugacaggca

SEQ ID NO: 1503366 - RNA, 12 nt, Human
uguacuacaauu

SEQ ID NO: 1503367 - RNA, 14 nt, Human
uguaccucuugagc

SEQ ID NO: 1503368 - RNA, 22 nt, Human
uguaccucuugagccuugaacu

SEQ ID NO: 1503369 - RNA, 23 nt, Human
uguaccucuugagccuugaacuu

SEQ ID NO: 1503370 - RNA, 15 nt, Human
uguaccgcaauguga

SEQ ID NO: 1503371 - RNA, 15 nt, Human
uguaaucacagcuac

SEQ ID NO: 1503372 - RNA, 17 nt, Human
uguaaauuaacuuuuau

SEQ ID NO: 1503373 - RNA, 16 nt, Human
uguaaauuaacuuuua

SEQ ID NO: 1503374 - RNA, 15 nt, Human
uguaaauuaacuuuu

SEQ ID NO: 1503375 - RNA, 14 nt, Human
uguaaauuaacuuu

SEQ ID NO: 1503376 - RNA, 13 nt, Human
uguaaauuaacuu

SEQ ID NO: 1503377 - RNA, 19 nt, Human
uguauugcauauauacaua

SEQ ID NO: 1503378 - RNA, 19 nt, Human
uguaucccaugagccucag

SEQ ID NO: 1503379 - RNA, 23 nt, Human
uguaucccaugagccucagcauc

SEQ ID NO: 1503380 - RNA, 17 nt, Human
uguagcacugacagauu

SEQ ID NO: 1503381 - RNA, 22 nt, Human
uguagcacugacagauuuccau

SEQ ID NO: 1503382 - RNA, 16 nt, Human
uguagcacugacagau

SEQ ID NO: 1503383 - RNA, 15 nt, Human
uguauaauauuuuua

SEQ ID NO: 1503384 - RNA, 23 nt, Human
ugucccaaaaagaaaggagggga

SEQ ID NO: 1503385 - RNA, 18 nt, Human
uguauuuguuaaugguuu

SEQ ID NO: 1503386 - RNA, 20 nt, Human
uguauuuguuaaugguuuga

SEQ ID NO: 1503387 - RNA, 12 nt, Human
ugucagugugac

SEQ ID NO: 1503388 - RNA, 20 nt, Human
ugucagugugacugaucucu

SEQ ID NO: 1503389 - RNA, 21 nt, Human
ugugauacaaugcugugcccu

SEQ ID NO: 1503390 - RNA, 15 nt, Human
ugugagucaccaagc

SEQ ID NO: 1503391 - RNA, 18 nt, Human
ugugaguacuacaguccu

SEQ ID NO: 1503392 - RNA, 19 nt, Human
ugugaguacuacaguccuc

SEQ ID NO: 1503393 - RNA, 20 nt, Human
ugugaguacuacaguccucc

SEQ ID NO: 1503394 - RNA, 23 nt, Human
ugugaguacuacaguccucccau

SEQ ID NO: 1503395 - RNA, 17 nt, Human
ugugaggguccugcagc

SEQ ID NO: 1503396 - RNA, 21 nt, Human
ugugacaaggauugcuacugu

SEQ ID NO: 1503397 - RNA, 15 nt, Human
ugugacauguuuuau

SEQ ID NO: 1503398 - RNA, 22 nt, Human
ugugaccacugcagaagacagu

SEQ ID NO: 1503399 - RNA, 13 nt, Human
ugugaaaggaaag

SEQ ID NO: 1503400 - RNA, 14 nt, Human
ugugaaaggaaaga

SEQ ID NO: 1503401 - RNA, 20 nt, Human
ugugaaguuuacauuguaaa

SEQ ID NO: 1503402 - RNA, 19 nt, Human
ugucuuuggacccugaggc

SEQ ID NO: 1503403 - RNA, 22 nt, Human
ugucuuuggacccugaggccca

SEQ ID NO: 1503404 - RNA, 18 nt, Human
ugucuuuggacccugagg

SEQ ID NO: 1503405 - RNA, 13 nt, Human
uguccccaccgca

SEQ ID NO: 1503406 - RNA, 21 nt, Human
ugucucaguccaugaagaugu

SEQ ID NO: 1503407 - RNA, 22 nt, Human
ugucucaguccaugaagaugua

SEQ ID NO: 1503408 - RNA, 15 nt, Human
ugugggucaaggaau

SEQ ID NO: 1503409 - RNA, 23 nt, Human
uguggggccaugccuccucagga

SEQ ID NO: 1503410 - RNA, 12 nt, Human
ugugggaagggg

SEQ ID NO: 1503411 - RNA, 15 nt, Human
uguggacacagcucu

SEQ ID NO: 1503412 - RNA, 16 nt, Human
uguggacacagcucuu

SEQ ID NO: 1503413 - RNA, 19 nt, Human
uguggagaagccacaggcc

SEQ ID NO: 1503414 - RNA, 12 nt, Human
uguggagaagcg

SEQ ID NO: 1503415 - RNA, 21 nt, Human
uguggagaagcggcuggcagc

SEQ ID NO: 1503416 - RNA, 14 nt, Human
uguggacacagcuc

SEQ ID NO: 1503417 - RNA, 14 nt, Human
ugugcacguacaca

SEQ ID NO: 1503418 - RNA, 22 nt, Human
ugugcacaugcacgugugugca

SEQ ID NO: 1503419 - RNA, 19 nt, Human
ugugcauagagccacguau

SEQ ID NO: 1503420 - RNA, 13 nt, Human
ugugccucuggga

SEQ ID NO: 1503421 - RNA, 15 nt, Human
ugugccucugggacu

SEQ ID NO: 1503422 - RNA, 16 nt, Human
ugugccucugggacug

SEQ ID NO: 1503423 - RNA, 17 nt, Human
ugugccucugggacugg

SEQ ID NO: 1503424 - RNA, 20 nt, Human
ugugcgugcauguguguuca

SEQ ID NO: 1503425 - RNA, 19 nt, Human
uguugaagagguuuuaaag

SEQ ID NO: 1503426 - RNA, 21 nt, Human
uguuggagaagaacugaaauc

SEQ ID NO: 1503427 - RNA, 11 nt, Human
uguuggccagg

SEQ ID NO: 1503428 - RNA, 14 nt, Human
uguuggccaggcug

SEQ ID NO: 1503429 - RNA, 15 nt, Human
uguuguuuuuggaug

SEQ ID NO: 1503430 - RNA, 14 nt, Human
uguuuaaaaucauu

SEQ ID NO: 1503431 - RNA, 13 nt, Human
uguuuaaaaucau

SEQ ID NO: 1503432 - RNA, 20 nt, Human
uguucaugaaagauucaaug

SEQ ID NO: 1503433 - RNA, 16 nt, Human
uguucucugaggacac

SEQ ID NO: 1503434 - RNA, 18 nt, Human
uguucucugaggacacua

SEQ ID NO: 1503435 - RNA, 12 nt, Human
uguucucugccc

SEQ ID NO: 1503436 - RNA, 18 nt, Human
uguucugacccugcuuca

SEQ ID NO: 1503437 - RNA, 14 nt, Human
uguucuuucuggcu

SEQ ID NO: 1503438 - RNA, 19 nt, Human
uguucucugcccuccaaga

SEQ ID NO: 1503439 - RNA, 15 nt, Human
uguucugacccugcu

SEQ ID NO: 1503440 - RNA, 22 nt, Human
uguucuuucuggcuaugcauuu

SEQ ID NO: 1503441 - RNA, 20 nt, Human
uguucuuucuggcuaugcau

SEQ ID NO: 1503442 - RNA, 11 nt, Human
uguugaaagau

SEQ ID NO: 1503443 - RNA, 13 nt, Human
uguguuuauuguc

SEQ ID NO: 1503444 - RNA, 14 nt, Human
uguguaguuccagc

SEQ ID NO: 1503445 - RNA, 19 nt, Human
ugugucagcauagaaguaa

SEQ ID NO: 1503446 - RNA, 12 nt, Human
uguuauaaucuu

SEQ ID NO: 1503447 - RNA, 16 nt, Human
uguucacagccagacu

SEQ ID NO: 1503448 - RNA, 15 nt, Human
uguucagcuccagcu

SEQ ID NO: 1503449 - RNA, 16 nt, Human
uguucagcuccagcuc

SEQ ID NO: 1503450 - RNA, 18 nt, Human
uguucagcuccagcucac

SEQ ID NO: 1503451 - RNA, 11 nt, Human
uguucagcugg

SEQ ID NO: 1503452 - RNA, 13 nt, Human
uguuacauuuuua

SEQ ID NO: 1503453 - RNA, 22 nt, Human
uguuacauuuuuaagugcugca

SEQ ID NO: 1503454 - RNA, 15 nt, Human
uguuacugucuucag

SEQ ID NO: 1503455 - RNA, 16 nt, Human
uguuacugucuucagu

SEQ ID NO: 1503456 - RNA, 14 nt, Human
uuacauuuguauaa

SEQ ID NO: 1503457 - RNA, 15 nt, Human
uuacauuuguauaaa

SEQ ID NO: 1503458 - RNA, 22 nt, Human
uuacauggcuggagcuagaauu

SEQ ID NO: 1503459 - RNA, 23 nt, Human
uuacauggcuggagcuagaauuu

SEQ ID NO: 1503460 - RNA, 16 nt, Human
uuacggaacucaaaua

SEQ ID NO: 1503461 - RNA, 20 nt, Human
uuacgguuuuccagguuuaa

SEQ ID NO: 1503462 - RNA, 22 nt, Human
uuaccuuuuuuauacauaaaca

SEQ ID NO: 1503463 - RNA, 20 nt, Human
uuaccuuuuuuauacauaaa

SEQ ID NO: 1503464 - RNA, 19 nt, Human
uuaccuuuuuuauacauaa

SEQ ID NO: 1503465 - RNA, 21 nt, Human
uuaccacuuguguuuugcaag

SEQ ID NO: 1503466 - RNA, 14 nt, Human
uuaccagcagagca

SEQ ID NO: 1503467 - RNA, 23 nt, Human
uuacauuuuuaagugcugcauuu

SEQ ID NO: 1503468 - RNA, 22 nt, Human
uuacauuuuuaagugcugcauu

SEQ ID NO: 1503469 - RNA, 21 nt, Human
uuacauuuuuaagugcugcau

SEQ ID NO: 1503470 - RNA, 20 nt, Human
uuacauuuuuaagugcugca

SEQ ID NO: 1503471 - RNA, 21 nt, Human
uuaauagguuuggacaaaaug

SEQ ID NO: 1503472 - RNA, 16 nt, Human
uuaauauggggaugca

SEQ ID NO: 1503473 - RNA, 22 nt, Human
uuaauauggggaugcagcauua

SEQ ID NO: 1503474 - RNA, 18 nt, Human
uuaaugucacaggcaggu

SEQ ID NO: 1503475 - RNA, 17 nt, Human
uuaaugucacaggcagg

SEQ ID NO: 1503476 - RNA, 18 nt, Human
uuaauaauguuucaaaca

SEQ ID NO: 1503477 - RNA, 16 nt, Human
uuaauagguuuggaca

SEQ ID NO: 1503478 - RNA, 22 nt, Human
uuaaggaugcuuguacauaaug

SEQ ID NO: 1503479 - RNA, 21 nt, Human
uuaaggaagacaaugugaaaa

SEQ ID NO: 1503480 - RNA, 20 nt, Human
uuaaggaugcuuguacauaa

SEQ ID NO: 1503481 - RNA, 19 nt, Human
uuaaggaugcuuguacaua

SEQ ID NO: 1503482 - RNA, 18 nt, Human
uuaaggaugcuuguacau

SEQ ID NO: 1503483 - RNA, 17 nt, Human
uuaaggaugcuuguaca

SEQ ID NO: 1503484 - RNA, 15 nt, Human
uuaaagcuuccauug

SEQ ID NO: 1503485 - RNA, 20 nt, Human
uuaaagcuuccauuguuguc

SEQ ID NO: 1503486 - RNA, 19 nt, Human
uuaaauagcuuuuuucucu

SEQ ID NO: 1503487 - RNA, 18 nt, Human
uuaaaugcaccuggaaua

SEQ ID NO: 1503488 - RNA, 17 nt, Human
uuaaaugcaccuggaau

SEQ ID NO: 1503489 - RNA, 16 nt, Human
uuaaaugcaccuggaa

SEQ ID NO: 1503490 - RNA, 13 nt, Human
uuaaaugcccagc

SEQ ID NO: 1503491 - RNA, 18 nt, Human
uuaaaugcccagccccuu

SEQ ID NO: 1503492 - RNA, 19 nt, Human
uuaaaagaaugauuaugaa

SEQ ID NO: 1503493 - RNA, 14 nt, Human
uuaaaacccaagug

SEQ ID NO: 1503494 - RNA, 18 nt, Human
uuaaacuuaaucuaaaug

SEQ ID NO: 1503495 - RNA, 16 nt, Human
uuaaacuuaaucuaaa

SEQ ID NO: 1503496 - RNA, 22 nt, Human
uuaaacuuaaucuaaauggaac

SEQ ID NO: 1503497 - RNA, 20 nt, Human
uuaaacuuaaucuaaaugga

SEQ ID NO: 1503498 - RNA, 14 nt, Human
uuaaagcaaaggag

SEQ ID NO: 1503499 - RNA, 20 nt, Human
uuaaagcuuauuaaaacuca

SEQ ID NO: 1503500 - RNA, 13 nt, Human
uguuuuugucuua

SEQ ID NO: 1503501 - RNA, 23 nt, Human
uguuuccuggcacugcuuccagu

SEQ ID NO: 1503502 - RNA, 20 nt, Human
uguuuccuggcacugcuucc

SEQ ID NO: 1503503 - RNA, 21 nt, Human
uguuuccuggcacugcuucca

SEQ ID NO: 1503504 - RNA, 22 nt, Human
uguuuccuggcacugcuuccag

SEQ ID NO: 1503505 - RNA, 12 nt, Human
uguuuuaaaaaa

SEQ ID NO: 1503506 - RNA, 17 nt, Human
uguuuguugucagcuga

SEQ ID NO: 1503507 - RNA, 17 nt, Human
uggguagacacacauga

SEQ ID NO: 1503508 - RNA, 16 nt, Human
uggguagacacacaug

SEQ ID NO: 1503509 - RNA, 17 nt, Human
ugggguggggaccucag

SEQ ID NO: 1503510 - RNA, 21 nt, Human
ugggugucaagagggucugag

SEQ ID NO: 1503511 - RNA, 23 nt, Human
ugggugucaagagggucugagga

SEQ ID NO: 1503512 - RNA, 14 nt, Human
uggguguggcgcag

SEQ ID NO: 1503513 - RNA, 23 nt, Human
uggguucaagcgauucuucugcu

SEQ ID NO: 1503514 - RNA, 16 nt, Human
uggguucacugcaacc

SEQ ID NO: 1503515 - RNA, 15 nt, Human
uggguucuacccagg

SEQ ID NO: 1503516 - RNA, 14 nt, Human
ugggccuccugugu

SEQ ID NO: 1503517 - RNA, 16 nt, Human
ugggccuccugugugu

SEQ ID NO: 1503518 - RNA, 22 nt, Human
ugggccuccugugugugcgccu

SEQ ID NO: 1503519 - RNA, 16 nt, Human
ugggagcuuuuguaga

SEQ ID NO: 1503520 - RNA, 24 nt, Human
ugggagcugccuguucagcuccag

SEQ ID NO: 1503521 - RNA, 18 nt, Human
ugggcuucaguggcagcu

SEQ ID NO: 1503522 - RNA, 19 nt, Human
ugggcuucaguggcagcug

SEQ ID NO: 1503523 - RNA, 19 nt, Human
ugggcuuggggaccagagc

SEQ ID NO: 1503524 - RNA, 21 nt, Human
ugggcuucaguggcagcugcu

SEQ ID NO: 1503525 - RNA, 20 nt, Human
ugggcuucaguggcagcugc

SEQ ID NO: 1503526 - RNA, 16 nt, Human
uggggcagcuugaggg

SEQ ID NO: 1503527 - RNA, 21 nt, Human
ugggcuuggggaccagagcug

SEQ ID NO: 1503528 - RNA, 22 nt, Human
ugggcuuggggaccagagcugc

SEQ ID NO: 1503529 - RNA, 19 nt, Human
ugggacauuugcucaugga

SEQ ID NO: 1503530 - RNA, 20 nt, Human
ugggacauuugcucauggaa

SEQ ID NO: 1503531 - RNA, 16 nt, Human
ugggacaugggaaagg

SEQ ID NO: 1503532 - RNA, 18 nt, Human
ugggacagucaccucaug

SEQ ID NO: 1503533 - RNA, 20 nt, Human
ugggacagucaccucaugga

SEQ ID NO: 1503534 - RNA, 21 nt, Human
ugggacagucaccucauggaa

SEQ ID NO: 1503535 - RNA, 22 nt, Human
ugggaaugaaugucagugugac

SEQ ID NO: 1503536 - RNA, 15 nt, Human
uggcugggggccuca

SEQ ID NO: 1503537 - RNA, 14 nt, Human
uggcugggggccuc

SEQ ID NO: 1503538 - RNA, 22 nt, Human
uggcugguuagagguucccuuu

SEQ ID NO: 1503539 - RNA, 15 nt, Human
uggcgcugccccugg

SEQ ID NO: 1503540 - RNA, 14 nt, Human
uggcgcugccccug

SEQ ID NO: 1503541 - RNA, 22 nt, Human
uggcgugcaguggugcgaucug

SEQ ID NO: 1503542 - RNA, 20 nt, Human
uggccuucggccuccauccu

SEQ ID NO: 1503543 - RNA, 17 nt, Human
uggccuucggccuccau

SEQ ID NO: 1503544 - RNA, 18 nt, Human
uggccuucggccuccauc

SEQ ID NO: 1503545 - RNA, 15 nt, Human
uggccagaugcacca

SEQ ID NO: 1503546 - RNA, 19 nt, Human
uggcucuuccaggcuggga

SEQ ID NO: 1503547 - RNA, 16 nt, Human
uggcucuuccaggcug

SEQ ID NO: 1503548 - RNA, 12 nt, Human
uggcugggggcc

SEQ ID NO: 1503549 - RNA, 13 nt, Human
uggcucuuccagg

SEQ ID NO: 1503550 - RNA, 15 nt, Human
uggcucuuccaggcu

SEQ ID NO: 1503551 - RNA, 14 nt, Human
uggcuaaauucaug

SEQ ID NO: 1503552 - RNA, 22 nt, Human
uggcucagguggggucacucug

SEQ ID NO: 1503553 - RNA, 20 nt, Human
uggcucagguggggucacuc

SEQ ID NO: 1503554 - RNA, 16 nt, Human
uggaauacucuuauau

SEQ ID NO: 1503555 - RNA, 14 nt, Human
uggaagacagcucu

SEQ ID NO: 1503556 - RNA, 15 nt, Human
uggaagacagcucuu

SEQ ID NO: 1503557 - RNA, 15 nt, Human
uggaaaauaaauuau

SEQ ID NO: 1503558 - RNA, 16 nt, Human
uggaaaauaaauuauu

SEQ ID NO: 1503559 - RNA, 17 nt, Human
uggaaaaauagccugcc

SEQ ID NO: 1503560 - RNA, 14 nt, Human
uggaacucucgagc

SEQ ID NO: 1503561 - RNA, 11 nt, Human
uggaagacagc

SEQ ID NO: 1503562 - RNA, 12 nt, Human
uggaagacagcu

SEQ ID NO: 1503563 - RNA, 14 nt, Human
ugcuucuguuuuau

SEQ ID NO: 1503564 - RNA, 16 nt, Human
ugcuucuucagagacu

SEQ ID NO: 1503565 - RNA, 12 nt, Human
ugcuucucacug

SEQ ID NO: 1503566 - RNA, 21 nt, Human
ugcuuccagugaggcucugcc

SEQ ID NO: 1503567 - RNA, 19 nt, Human
ugcuuccagugaggcucug

SEQ ID NO: 1503568 - RNA, 20 nt, Human
ugcuuccagugaggcucugc

SEQ ID NO: 1503569 - RNA, 18 nt, Human
ugcuuccagugaggcucu

SEQ ID NO: 1503570 - RNA, 12 nt, Human
uggacaggcaug

SEQ ID NO: 1503571 - RNA, 16 nt, Human
uggacaggcauguucu

SEQ ID NO: 1503572 - RNA, 17 nt, Human
uggacaggcauguucuc

SEQ ID NO: 1503573 - RNA, 19 nt, Human
uggaugauauuuuuuauca

SEQ ID NO: 1503574 - RNA, 22 nt, Human
uggaggcaugugaugagaggaa

SEQ ID NO: 1503575 - RNA, 15 nt, Human
uggagcaaagcugau

SEQ ID NO: 1503576 - RNA, 23 nt, Human
uggcagcugcgguccacccagga

SEQ ID NO: 1503577 - RNA, 21 nt, Human
uggcagcugcgguccacccag

SEQ ID NO: 1503578 - RNA, 22 nt, Human
uggcagcugcgguccacccagg

SEQ ID NO: 1503579 - RNA, 14 nt, Human
uggaugcccaggaa

SEQ ID NO: 1503580 - RNA, 14 nt, Human
uggaugccuggugg

SEQ ID NO: 1503581 - RNA, 15 nt, Human
uggaugccugguggc

SEQ ID NO: 1503582 - RNA, 13 nt, Human
uggaugcccagga

SEQ ID NO: 1503583 - RNA, 14 nt, Human
uggcacugcuucca

SEQ ID NO: 1503584 - RNA, 16 nt, Human
uggcacugcuuccagu

SEQ ID NO: 1503585 - RNA, 18 nt, Human
uggcacugcuuccaguga

SEQ ID NO: 1503586 - RNA, 14 nt, Human
uggcagugggagcu

SEQ ID NO: 1503587 - RNA, 15 nt, Human
uggcagugggagcug

SEQ ID NO: 1503588 - RNA, 16 nt, Human
uggcagugggagcugc

SEQ ID NO: 1503589 - RNA, 19 nt, Human
uggcagugggagcugccug

SEQ ID NO: 1503590 - RNA, 20 nt, Human
uggcagugggagcugccugu

SEQ ID NO: 1503591 - RNA, 15 nt, Human
ugcacaucaaaauau

SEQ ID NO: 1503592 - RNA, 23 nt, Human
ugcacagcuaacauggaaguacu

SEQ ID NO: 1503593 - RNA, 18 nt, Human
ugcacagcuaacauggaa

SEQ ID NO: 1503594 - RNA, 20 nt, Human
ugcacagcuaacauggaagu

SEQ ID NO: 1503595 - RNA, 17 nt, Human
ugcacagcuaacaugga

SEQ ID NO: 1503596 - RNA, 23 nt, Human
ugcacagaguuguuacauuuuua

SEQ ID NO: 1503597 - RNA, 22 nt, Human
ugcacagaguuguuacauuuuu

SEQ ID NO: 1503598 - RNA, 21 nt, Human
ugcacagaguuguuacauuuu

SEQ ID NO: 1503599 - RNA, 22 nt, Human
ugaagucuuuguacagacaaca

SEQ ID NO: 1503600 - RNA, 16 nt, Human
ugaaggcuggguucug

SEQ ID NO: 1503601 - RNA, 17 nt, Human
ugaagucuuuguacaga

SEQ ID NO: 1503602 - RNA, 20 nt, Human
ugaagucuuuguacagacaa

SEQ ID NO: 1503603 - RNA, 21 nt, Human
ugcacuugcagacucuacaga

SEQ ID NO: 1503604 - RNA, 19 nt, Human
ugcacguacacacacauac

SEQ ID NO: 1503605 - RNA, 16 nt, Human
ugcacguacacacaca

SEQ ID NO: 1503606 - RNA, 16 nt, Human
ugcagauaaacaguag

SEQ ID NO: 1503607 - RNA, 17 nt, Human
ugcagauaaacaguagu

SEQ ID NO: 1503608 - RNA, 15 nt, Human
ugcacuuuguucugg

SEQ ID NO: 1503609 - RNA, 18 nt, Human
ugcacuuuguucuggcuc

SEQ ID NO: 1503610 - RNA, 19 nt, Human
ugcacuuuguucuggcucu

SEQ ID NO: 1503611 - RNA, 20 nt, Human
ugcacuuuguucuggcucuu

SEQ ID NO: 1503612 - RNA, 20 nt, Human
ugcagcaauaaagcagcguu

SEQ ID NO: 1503613 - RNA, 16 nt, Human
ugcagcaauaaagcag

SEQ ID NO: 1503614 - RNA, 15 nt, Human
ugcagcaauaaagca

SEQ ID NO: 1503615 - RNA, 14 nt, Human
ugcagcaauaaagc

SEQ ID NO: 1503616 - RNA, 18 nt, Human
ugcaggaccucaggugag

SEQ ID NO: 1503617 - RNA, 15 nt, Human
ugcaggaccucaggu

SEQ ID NO: 1503618 - RNA, 16 nt, Human
ugcaggaccucaggug

SEQ ID NO: 1503619 - RNA, 14 nt, Human
ugcaggaccucagg

SEQ ID NO: 1503620 - RNA, 11 nt, Human
ugccagggaca

SEQ ID NO: 1503621 - RNA, 22 nt, Human
ugccagggacagaggggguggc

SEQ ID NO: 1503622 - RNA, 17 nt, Human
ugccaccccgagggcug

SEQ ID NO: 1503623 - RNA, 18 nt, Human
ugccaccccgagggcuga

SEQ ID NO: 1503624 - RNA, 14 nt, Human
ugccagucaccccg

SEQ ID NO: 1503625 - RNA, 23 nt, Human
ugccauggacagaagaaggcagc

SEQ ID NO: 1503626 - RNA, 18 nt, Human
ugccauggacagaagaag

SEQ ID NO: 1503627 - RNA, 20 nt, Human
ugccauggacagaagaaggc

SEQ ID NO: 1503628 - RNA, 15 nt, Human
ugcccaccuggccuc

SEQ ID NO: 1503629 - RNA, 17 nt, Human
ugcccaccuggccucug

SEQ ID NO: 1503630 - RNA, 18 nt, Human
ugcccaccuggccucugc

SEQ ID NO: 1503631 - RNA, 19 nt, Human
ugcccaccuggccucugca

SEQ ID NO: 1503632 - RNA, 10 nt, Human
ugcccagccc

SEQ ID NO: 1503633 - RNA, 15 nt, Human
ugcauuauauuuauu

SEQ ID NO: 1503634 - RNA, 20 nt, Human
ugcauuauauuuauuacugu

SEQ ID NO: 1503635 - RNA, 21 nt, Human
ugcauuauauuuauuacugua

SEQ ID NO: 1503636 - RNA, 19 nt, Human
ugcauguuacauaagauaa

SEQ ID NO: 1503637 - RNA, 17 nt, Human
ugcaucguuucaucuuc

SEQ ID NO: 1503638 - RNA, 15 nt, Human
ugcaucguuucaucu

SEQ ID NO: 1503639 - RNA, 16 nt, Human
ugcaggcagccaggcc

SEQ ID NO: 1503640 - RNA, 17 nt, Human
ugcaggcagccaggcca

SEQ ID NO: 1503641 - RNA, 18 nt, Human
ugcaggcagccaggccac

SEQ ID NO: 1503642 - RNA, 19 nt, Human
ugcaggcagccaggccaca

SEQ ID NO: 1503643 - RNA, 22 nt, Human
ugcaucagcugcugaaacaaca

SEQ ID NO: 1503644 - RNA, 11 nt, Human
ugcucauggaa

SEQ ID NO: 1503645 - RNA, 19 nt, Human
ugcuccucuccccagcaag

SEQ ID NO: 1503646 - RNA, 20 nt, Human
ugcuaggaacacuccuucac

SEQ ID NO: 1503647 - RNA, 23 nt, Human
ugcuagguuaauuccaauuauau

SEQ ID NO: 1503648 - RNA, 16 nt, Human
ugcuagguuaauucca

SEQ ID NO: 1503649 - RNA, 15 nt, Human
ugcgugcauaccacu

SEQ ID NO: 1503650 - RNA, 19 nt, Human
ugcuagaacucccuuucaa

SEQ ID NO: 1503651 - RNA, 20 nt, Human
ugcuagaacucccuuucaac

SEQ ID NO: 1503652 - RNA, 21 nt, Human
ugcuagaacucccuuucaaca

SEQ ID NO: 1503653 - RNA, 16 nt, Human
ugcuaggaacacuccu

SEQ ID NO: 1503654 - RNA, 17 nt, Human
ugcuaggaacacuccuu

SEQ ID NO: 1503655 - RNA, 19 nt, Human
ugcuaggaacacuccuuca

SEQ ID NO: 1503656 - RNA, 20 nt, Human
ugcugauggugcaaugaccu

SEQ ID NO: 1503657 - RNA, 23 nt, Human
ugcugauggugcaaugaccuuuc

SEQ ID NO: 1503658 - RNA, 15 nt, Human
ugcugcaguugccag

SEQ ID NO: 1503659 - RNA, 16 nt, Human
ugcugcaguugccagu

SEQ ID NO: 1503660 - RNA, 15 nt, Human
ugcugaguugguguu

SEQ ID NO: 1503661 - RNA, 15 nt, Human
ugcugacagacacag

SEQ ID NO: 1503662 - RNA, 16 nt, Human
ugcugacagacacagg

SEQ ID NO: 1503663 - RNA, 19 nt, Human
ugcugacagacacaggccc

SEQ ID NO: 1503664 - RNA, 19 nt, Human
ugcuccuggcccacugcau

SEQ ID NO: 1503665 - RNA, 17 nt, Human
ugcugaaugguuuucaa

SEQ ID NO: 1503666 - RNA, 18 nt, Human
ugcugaaugguuuucaaa

SEQ ID NO: 1503667 - RNA, 22 nt, Human
ugcugaaugguuuucaaaauaa

SEQ ID NO: 1503668 - RNA, 17 nt, Human
ugcugaaacaacaaaua

SEQ ID NO: 1503669 - RNA, 18 nt, Human
ugcugaauacagaggcaa

SEQ ID NO: 1503670 - RNA, 23 nt, Human
ugcugaauacagaggcaacugca

SEQ ID NO: 1503671 - RNA, 22 nt, Human
ugccuucucaacuccaaacuga

SEQ ID NO: 1503672 - RNA, 13 nt, Human
ugcgccuacagga

SEQ ID NO: 1503673 - RNA, 23 nt, Human
ugcggugcuaucucccccagccc

SEQ ID NO: 1503674 - RNA, 18 nt, Human
ugccuuauggaacacucu

SEQ ID NO: 1503675 - RNA, 20 nt, Human
ugccuuauggaacacucuga

SEQ ID NO: 1503676 - RNA, 21 nt, Human
ugccuuauggaacacucugag

SEQ ID NO: 1503677 - RNA, 22 nt, Human
ugccuuauggaacacucugaga

SEQ ID NO: 1503678 - RNA, 11 nt, Human
ugcccagcccc

SEQ ID NO: 1503679 - RNA, 12 nt, Human
ugcccagccccu

SEQ ID NO: 1503680 - RNA, 23 nt, Human
ugcccaggcuggcgugcaguggu

SEQ ID NO: 1503681 - RNA, 22 nt, Human
ugccugaagucacacagugagu

SEQ ID NO: 1503682 - RNA, 18 nt, Human
ugccugaagucacacagu

SEQ ID NO: 1503683 - RNA, 16 nt, Human
ugccucuguccccuuc

SEQ ID NO: 1503684 - RNA, 17 nt, Human
ugccucuguccccuucu

SEQ ID NO: 1503685 - RNA, 20 nt, Human
ugccucuguccccuucucuc

SEQ ID NO: 1503686 - RNA, 21 nt, Human
ugccucuguccccuucucuca

SEQ ID NO: 1503687 - RNA, 13 nt, Human
ugccucugucccc

SEQ ID NO: 1503688 - RNA, 14 nt, Human
ugccucuguccccu

SEQ ID NO: 1503689 - RNA, 15 nt, Human
ugccucuguccccuu

SEQ ID NO: 1503690 - RNA, 20 nt, Human
ugccuccuuugugaggaagc

SEQ ID NO: 1503691 - RNA, 16 nt, Human
ugccuccuuugugagg

SEQ ID NO: 1503692 - RNA, 17 nt, Human
ugccuccuuugugagga

SEQ ID NO: 1503693 - RNA, 18 nt, Human
ugccuccuuugugaggaa

SEQ ID NO: 1503694 - RNA, 22 nt, Human
ucuguuuuauaauuuugugaag

SEQ ID NO: 1503695 - RNA, 18 nt, Human
ucuuaaaaaguggaaaaa

SEQ ID NO: 1503696 - RNA, 14 nt, Human
ucuguccuacucug

SEQ ID NO: 1503697 - RNA, 22 nt, Human
ucuguggguuucuaaagcugcc

SEQ ID NO: 1503698 - RNA, 19 nt, Human
ucuguccgagcuuugaaaa

SEQ ID NO: 1503699 - RNA, 17 nt, Human
ucuguacgucugacagg

SEQ ID NO: 1503700 - RNA, 18 nt, Human
ucuguacgucugacaggc

SEQ ID NO: 1503701 - RNA, 23 nt, Human
ucuguggguuucuaaagcugcca

SEQ ID NO: 1503702 - RNA, 18 nt, Human
ucuggcucuuccaggcug

SEQ ID NO: 1503703 - RNA, 17 nt, Human
ucuggcucuuccaggcu

SEQ ID NO: 1503704 - RNA, 15 nt, Human
ucuggcucuuccagg

SEQ ID NO: 1503705 - RNA, 16 nt, Human
ucuggcucuuccaggc

SEQ ID NO: 1503706 - RNA, 13 nt, Human
ucugggacacagu

SEQ ID NO: 1503707 - RNA, 12 nt, Human
ucugggacacag

SEQ ID NO: 1503708 - RNA, 17 nt, Human
ucuggcuaugcauuuga

SEQ ID NO: 1503709 - RNA, 14 nt, Human
ucuggcuaugcauu

SEQ ID NO: 1503710 - RNA, 18 nt, Human
ucuggagguacgaaaaga

SEQ ID NO: 1503711 - RNA, 11 nt, Human
ucuugcucugc

SEQ ID NO: 1503712 - RNA, 12 nt, Human
ucuugcucugcu

SEQ ID NO: 1503713 - RNA, 13 nt, Human
ucuugcucugcug

SEQ ID NO: 1503714 - RNA, 22 nt, Human
ucuugccucuguccccuucucu

SEQ ID NO: 1503715 - RNA, 16 nt, Human
ucuugccucugucccc

SEQ ID NO: 1503716 - RNA, 21 nt, Human
ucuugccucuguccccuucuc

SEQ ID NO: 1503717 - RNA, 21 nt, Human
ucuugaauuguaaggaaugau

SEQ ID NO: 1503718 - RNA, 12 nt, Human
ucuucuccaggc

SEQ ID NO: 1503719 - RNA, 13 nt, Human
ucuucuccaggcu

SEQ ID NO: 1503720 - RNA, 14 nt, Human
ucuucuccaggcug

SEQ ID NO: 1503721 - RNA, 15 nt, Human
ucuucuccaggcugu

SEQ ID NO: 1503722 - RNA, 16 nt, Human
ucuugaacuccuggcc

SEQ ID NO: 1503723 - RNA, 17 nt, Human
ucuugaacuccuggccu

SEQ ID NO: 1503724 - RNA, 18 nt, Human
ucuugaacuccuggccuc

SEQ ID NO: 1503725 - RNA, 14 nt, Human
ucuuagugugugca

SEQ ID NO: 1503726 - RNA, 16 nt, Human
ucuuaguggauguucu

SEQ ID NO: 1503727 - RNA, 15 nt, Human
ucuuauacauuugau

SEQ ID NO: 1503728 - RNA, 13 nt, Human
ucuuaugggcugg

SEQ ID NO: 1503729 - RNA, 15 nt, Human
ucuucaguaagccgu

SEQ ID NO: 1503730 - RNA, 14 nt, Human
ucuuccaggcuggg

SEQ ID NO: 1503731 - RNA, 21 nt, Human
ucuuccacaagagcccaggcc

SEQ ID NO: 1503732 - RNA, 16 nt, Human
ucuucaguaagccgug

SEQ ID NO: 1503733 - RNA, 19 nt, Human
ucuucuccacuuucuagcc

SEQ ID NO: 1503734 - RNA, 21 nt, Human
ucuucuccacuuucuagccag

SEQ ID NO: 1503735 - RNA, 17 nt, Human
ucuuucacauuuaaaua

SEQ ID NO: 1503736 - RNA, 16 nt, Human
ucuuuucuugccucug

SEQ ID NO: 1503737 - RNA, 20 nt, Human
ucuuuucuugccucuguccc

SEQ ID NO: 1503738 - RNA, 19 nt, Human
ucuuuugccguuauuaaaa

SEQ ID NO: 1503739 - RNA, 17 nt, Human
ucuuuugccguuauuaa

SEQ ID NO: 1503740 - RNA, 16 nt, Human
ucuuuuugcuuugcuu

SEQ ID NO: 1503741 - RNA, 19 nt, Human
ugaaaacuuuaugcuaagu

SEQ ID NO: 1503742 - RNA, 15 nt, Human
ugaaaagaaaaauga

SEQ ID NO: 1503743 - RNA, 15 nt, Human
ugaaaagacuccaaa

SEQ ID NO: 1503744 - RNA, 16 nt, Human
ugaaaagacuccaaag

SEQ ID NO: 1503745 - RNA, 17 nt, Human
ugaaaagacuccaaaga

SEQ ID NO: 1503746 - RNA, 19 nt, Human
ugaaaagacuccaaagaaa

SEQ ID NO: 1503747 - RNA, 13 nt, Human
ugaaagauucaau

SEQ ID NO: 1503748 - RNA, 12 nt, Human
ugaaaggaaaga

SEQ ID NO: 1503749 - RNA, 17 nt, Human
ugaaaggaaagaggcuc

SEQ ID NO: 1503750 - RNA, 18 nt, Human
ugaaagcagggacuugaa

SEQ ID NO: 1503751 - RNA, 19 nt, Human
ugaaagcagggacuugaac

SEQ ID NO: 1503752 - RNA, 23 nt, Human
ugaaagcagggacuugaacccau

SEQ ID NO: 1503753 - RNA, 22 nt, Human
ugaaaagacuccaaagaaaugu

SEQ ID NO: 1503754 - RNA, 16 nt, Human
ugaaacgcaaccacca

SEQ ID NO: 1503755 - RNA, 23 nt, Human
ugaaaugaggucagagccugcag

SEQ ID NO: 1503756 - RNA, 21 nt, Human
ugaaaugaggucagagccugc

SEQ ID NO: 1503757 - RNA, 22 nt, Human
ugaaaugaggucagagccugca

SEQ ID NO: 1503758 - RNA, 19 nt, Human
ugaaaugaggucagagccu

SEQ ID NO: 1503759 - RNA, 20 nt, Human
ugaaaugaggucagagccug

SEQ ID NO: 1503760 - RNA, 17 nt, Human
ugaaaucuuuuugcuuu

SEQ ID NO: 1503761 - RNA, 16 nt, Human
ugaaagggcccagaga

SEQ ID NO: 1503762 - RNA, 17 nt, Human
ugaaagggcccagagag

SEQ ID NO: 1503763 - RNA, 18 nt, Human
ugaaagggcccagagagg

SEQ ID NO: 1503764 - RNA, 19 nt, Human
ugaaauggacuuuuguaca

SEQ ID NO: 1503765 - RNA, 14 nt, Human
ugaacacaucagcu

SEQ ID NO: 1503766 - RNA, 13 nt, Human
ugaacugauaaag

SEQ ID NO: 1503767 - RNA, 15 nt, Human
ugaacugauaaagau

SEQ ID NO: 1503768 - RNA, 18 nt, Human
ugaacucuucaaucucuu

SEQ ID NO: 1503769 - RNA, 20 nt, Human
ugaaccacaucuugcucugc

SEQ ID NO: 1503770 - RNA, 21 nt, Human
ugaaccacaucuugcucugcu

SEQ ID NO: 1503771 - RNA, 22 nt, Human
ugaaccacaucuugcucugcug

SEQ ID NO: 1503772 - RNA, 15 nt, Human
ugaacucuucaaucu

SEQ ID NO: 1503773 - RNA, 17 nt, Human
ugaagauguagaggaga

SEQ ID NO: 1503774 - RNA, 21 nt, Human
ugaaguccaagcauuuagaug

SEQ ID NO: 1503775 - RNA, 22 nt, Human
ugaaguccaagcauuuagaugu

SEQ ID NO: 1503776 - RNA, 21 nt, Human
ugaaggcucgagcaugccugg

SEQ ID NO: 1503777 - RNA, 20 nt, Human
ugaaggcucgagcaugccug

SEQ ID NO: 1503778 - RNA, 22 nt, Human
ugaacuuguaaaggaauuuaaa

SEQ ID NO: 1503779 - RNA, 14 nt, Human
ugaagacagagcua

SEQ ID NO: 1503780 - RNA, 16 nt, Human
ugaagacagagcuaca

SEQ ID NO: 1503781 - RNA, 19 nt, Human
ugaacuggguacuugugga

SEQ ID NO: 1503782 - RNA, 14 nt, Human
ugaacuuggcgcug

SEQ ID NO: 1503783 - RNA, 12 nt, Human
ugaacuugguuc

SEQ ID NO: 1503784 - RNA, 17 nt, Human
ugaagacuuuucuuuca

SEQ ID NO: 1503785 - RNA, 22 nt, Human
ugaagacuuuucuuucagccaa

SEQ ID NO: 1503786 - RNA, 14 nt, Human
ugaagacuuuucuu

SEQ ID NO: 1503787 - RNA, 23 nt, Human
ugaacuggguacuuguggacaca

SEQ ID NO: 1503788 - RNA, 15 nt, Human
ucgaguuacagacaa

SEQ ID NO: 1503789 - RNA, 17 nt, Human
ucgaguuacagacaaag

SEQ ID NO: 1503790 - RNA, 14 nt, Human
uccuuaccagcaga

SEQ ID NO: 1503791 - RNA, 15 nt, Human
uccuugcaucaauuu

SEQ ID NO: 1503792 - RNA, 12 nt, Human
uccuucuguccu

SEQ ID NO: 1503793 - RNA, 19 nt, Human
uccuucuguccuacucugu

SEQ ID NO: 1503794 - RNA, 20 nt, Human
uccuucugugaaaguacauu

SEQ ID NO: 1503795 - RNA, 12 nt, Human
uccuggugcccu

SEQ ID NO: 1503796 - RNA, 13 nt, Human
uccuggugcccug

SEQ ID NO: 1503797 - RNA, 22 nt, Human
uccuggugcccuggaugcccag

SEQ ID NO: 1503798 - RNA, 10 nt, Human
ucccucccuu

SEQ ID NO: 1503799 - RNA, 22 nt, Human
uccuggcaugggaaugaauguc

SEQ ID NO: 1503800 - RNA, 17 nt, Human
uccuggcccacugcauc

SEQ ID NO: 1503801 - RNA, 15 nt, Human
uccugguguggaaga

SEQ ID NO: 1503802 - RNA, 16 nt, Human
ucuaaauucuuucauu

SEQ ID NO: 1503803 - RNA, 13 nt, Human
ucuaaauuugaau

SEQ ID NO: 1503804 - RNA, 17 nt, Human
ucuaaauuugaauguua

SEQ ID NO: 1503805 - RNA, 19 nt, Human
ucuaacaaaaaaauauauu

SEQ ID NO: 1503806 - RNA, 22 nt, Human
ucuaaauuugaauguuaagcag

SEQ ID NO: 1503807 - RNA, 23 nt, Human
ucuaaauuugaauguuaagcaga

SEQ ID NO: 1503808 - RNA, 18 nt, Human
ucuaaauuuuauaucuug

SEQ ID NO: 1503809 - RNA, 23 nt, Human
ucuaaauuuuauaucuuguagcu

SEQ ID NO: 1503810 - RNA, 21 nt, Human
ucuacacuaagagagaaugag

SEQ ID NO: 1503811 - RNA, 22 nt, Human
ucuaacuucaccauauuaccac

SEQ ID NO: 1503812 - RNA, 16 nt, Human
ucuaacuucaccauau

SEQ ID NO: 1503813 - RNA, 15 nt, Human
ucuaacuucaccaua

SEQ ID NO: 1503814 - RNA, 21 nt, Human
ucuacacugugcugagucuga

SEQ ID NO: 1503815 - RNA, 15 nt, Human
ucuacacugugcuga

SEQ ID NO: 1503816 - RNA, 18 nt, Human
ucuacugaggugcuaugu

SEQ ID NO: 1503817 - RNA, 19 nt, Human
ucuacugaggugcuauguu

SEQ ID NO: 1503818 - RNA, 17 nt, Human
ucuacacuccagugaga

SEQ ID NO: 1503819 - RNA, 12 nt, Human
ucuacacugugc

SEQ ID NO: 1503820 - RNA, 14 nt, Human
ucuacacugugcug

SEQ ID NO: 1503821 - RNA, 22 nt, Human
ucuacugaggugcuauguucuu

SEQ ID NO: 1503822 - RNA, 22 nt, Human
ucuagggaaaaaccagcgugug

SEQ ID NO: 1503823 - RNA, 15 nt, Human
ucucaacuccaaacu

SEQ ID NO: 1503824 - RNA, 17 nt, Human
ucucacucugucgccca

SEQ ID NO: 1503825 - RNA, 18 nt, Human
ucucacucugucgcccag

SEQ ID NO: 1503826 - RNA, 22 nt, Human
ucucacucugucgcccagucug

SEQ ID NO: 1503827 - RNA, 18 nt, Human
ucucacuguugcccaggc

SEQ ID NO: 1503828 - RNA, 19 nt, Human
ucucacuguugcccaggcu

SEQ ID NO: 1503829 - RNA, 20 nt, Human
ucucacuguugcccaggcug

SEQ ID NO: 1503830 - RNA, 21 nt, Human
ucucacuguugcccaggcugg

SEQ ID NO: 1503831 - RNA, 17 nt, Human
ucucagaaucucaaaua

SEQ ID NO: 1503832 - RNA, 21 nt, Human
ucucagaaucucaaauaacua

SEQ ID NO: 1503833 - RNA, 22 nt, Human
ucucaaacucuugaccucaggu

SEQ ID NO: 1503834 - RNA, 13 nt, Human
ucucaaacucuug

SEQ ID NO: 1503835 - RNA, 21 nt, Human
ucucaaacucuugaccucagg

SEQ ID NO: 1503836 - RNA, 21 nt, Human
ucucaaauuuggauugcuaau

SEQ ID NO: 1503837 - RNA, 15 nt, Human
ucuaguaugaaauua

SEQ ID NO: 1503838 - RNA, 17 nt, Human
ucuaguaugaaauuaua

SEQ ID NO: 1503839 - RNA, 22 nt, Human
ucucccccagccccauccucug

SEQ ID NO: 1503840 - RNA, 18 nt, Human
ucucccccagccccaucc

SEQ ID NO: 1503841 - RNA, 20 nt, Human
ucucccccagccccauccuc

SEQ ID NO: 1503842 - RNA, 20 nt, Human
ucuccccugcccccaggacu

SEQ ID NO: 1503843 - RNA, 21 nt, Human
ucuccccugcccccaggacug

SEQ ID NO: 1503844 - RNA, 22 nt, Human
ucuccccugcccccaggacugg

SEQ ID NO: 1503845 - RNA, 23 nt, Human
ucuccccugcccccaggacuggg

SEQ ID NO: 1503846 - RNA, 14 nt, Human
ucucccccagcccc

SEQ ID NO: 1503847 - RNA, 15 nt, Human
ucucccccagcccca

SEQ ID NO: 1503848 - RNA, 17 nt, Human
ucucccccagccccauc

SEQ ID NO: 1503849 - RNA, 21 nt, Human
ucucagugucaaugcagcccc

SEQ ID NO: 1503850 - RNA, 22 nt, Human
ucuccugccucagccucccaaa

SEQ ID NO: 1503851 - RNA, 14 nt, Human
ucucugaggacacu

SEQ ID NO: 1503852 - RNA, 13 nt, Human
ucucugaggacac

SEQ ID NO: 1503853 - RNA, 13 nt, Human
ucucuaggaaaua

SEQ ID NO: 1503854 - RNA, 19 nt, Human
ucucuaggaaauauuuauu

SEQ ID NO: 1503855 - RNA, 19 nt, Human
ucucuaguuugauuaaauu

SEQ ID NO: 1503856 - RNA, 18 nt, Human
ucucuaguuugauuaaau

SEQ ID NO: 1503857 - RNA, 13 nt, Human
ucuccuguaccuc

SEQ ID NO: 1503858 - RNA, 15 nt, Human
ucucuacaaaaagca

SEQ ID NO: 1503859 - RNA, 18 nt, Human
ucucuucacagucacauu

SEQ ID NO: 1503860 - RNA, 14 nt, Human
ucugaaauuuccug

SEQ ID NO: 1503861 - RNA, 23 nt, Human
ucugaaaauguauguguaaguau

SEQ ID NO: 1503862 - RNA, 17 nt, Human
ucugaaaauuaacacug

SEQ ID NO: 1503863 - RNA, 13 nt, Human
ucugaaagggacg

SEQ ID NO: 1503864 - RNA, 18 nt, Human
ucugaaaauuaacacugc

SEQ ID NO: 1503865 - RNA, 19 nt, Human
ucugaaaauuaacacugcu

SEQ ID NO: 1503866 - RNA, 15 nt, Human
ucucuuuucaaaaca

SEQ ID NO: 1503867 - RNA, 16 nt, Human
ucucuuuucaaaacau

SEQ ID NO: 1503868 - RNA, 16 nt, Human
ucugaaaauguaugug

SEQ ID NO: 1503869 - RNA, 14 nt, Human
ucugacccaugcug

SEQ ID NO: 1503870 - RNA, 21 nt, Human
ucugaacuuggcgcugccccu

SEQ ID NO: 1503871 - RNA, 20 nt, Human
ucugaacuuggcgcugcccc

SEQ ID NO: 1503872 - RNA, 19 nt, Human
ucugacccaugcugcccug

SEQ ID NO: 1503873 - RNA, 15 nt, Human
ucugacccaugcugc

SEQ ID NO: 1503874 - RNA, 16 nt, Human
ucugacccaugcugcc

SEQ ID NO: 1503875 - RNA, 17 nt, Human
ucugacccaugcugccc

SEQ ID NO: 1503876 - RNA, 18 nt, Human
ucugacccaugcugcccu

SEQ ID NO: 1503877 - RNA, 23 nt, Human
ucugauucccaagcucugcuccu

SEQ ID NO: 1503878 - RNA, 19 nt, Human
ucugcacaagcugcacccu

SEQ ID NO: 1503879 - RNA, 14 nt, Human
ucugcacaagcugc

SEQ ID NO: 1503880 - RNA, 20 nt, Human
ucugaggacacuaaccacgc

SEQ ID NO: 1503881 - RNA, 23 nt, Human
ucugaggacacuaaccacgcugg

SEQ ID NO: 1503882 - RNA, 16 nt, Human
ucugaggaauccagac

SEQ ID NO: 1503883 - RNA, 17 nt, Human
ucugaggaauccagacc

SEQ ID NO: 1503884 - RNA, 24 nt, Human
ucagucugauucccaagcucugcu

SEQ ID NO: 1503885 - RNA, 15 nt, Human
ucagucuggcccuuc

SEQ ID NO: 1503886 - RNA, 23 nt, Human
ucagugguuggcaauuguuucaa

SEQ ID NO: 1503887 - RNA, 11 nt, Human
ucaguguacau

SEQ ID NO: 1503888 - RNA, 13 nt, Human
ucagugugacuga

SEQ ID NO: 1503889 - RNA, 17 nt, Human
ucagugugacugaucuc

SEQ ID NO: 1503890 - RNA, 13 nt, Human
ucaguuguacagu

SEQ ID NO: 1503891 - RNA, 17 nt, Human
ucaguuguuaguguguc

SEQ ID NO: 1503892 - RNA, 15 nt, Human
ucauaauuuauacag

SEQ ID NO: 1503893 - RNA, 13 nt, Human
ucauacauuguac

SEQ ID NO: 1503894 - RNA, 15 nt, Human
ucauacauuguacga

SEQ ID NO: 1503895 - RNA, 16 nt, Human
ucauacauuguacgaa

SEQ ID NO: 1503896 - RNA, 13 nt, Human
ucauacccacccc

SEQ ID NO: 1503897 - RNA, 14 nt, Human
ucaucucuuagcuc

SEQ ID NO: 1503898 - RNA, 19 nt, Human
ucaucucuuagcuccccuc

SEQ ID NO: 1503899 - RNA, 20 nt, Human
ucaucucuuagcuccccucc

SEQ ID NO: 1503900 - RNA, 21 nt, Human
ucaucucuuagcuccccucca

SEQ ID NO: 1503901 - RNA, 16 nt, Human
ucaucucucuuuaaua

SEQ ID NO: 1503902 - RNA, 13 nt, Human
ucaucucuuagcu

SEQ ID NO: 1503903 - RNA, 21 nt, Human
ucauacccacccccacccaag

SEQ ID NO: 1503904 - RNA, 20 nt, Human
ucauacccacccccacccaa

SEQ ID NO: 1503905 - RNA, 14 nt, Human
ucauacccaccccc

SEQ ID NO: 1503906 - RNA, 15 nt, Human
ucauacccaccccca

SEQ ID NO: 1503907 - RNA, 16 nt, Human
ucauuaggugugacug

SEQ ID NO: 1503908 - RNA, 22 nt, Human
ucauuaggugugacugaauuuc

SEQ ID NO: 1503909 - RNA, 21 nt, Human
ucauuaggugugacugaauuu

SEQ ID NO: 1503910 - RNA, 18 nt, Human
ucauuaggugugacugaa

SEQ ID NO: 1503911 - RNA, 22 nt, Human
ucauucagauaugauucaaaug

SEQ ID NO: 1503912 - RNA, 14 nt, Human
ucauuucuuugagu

SEQ ID NO: 1503913 - RNA, 16 nt, Human
ucauuucugcaucagc

SEQ ID NO: 1503914 - RNA, 22 nt, Human
ucauuucugcaucagcugcuga

SEQ ID NO: 1503915 - RNA, 23 nt, Human
uccaaacugacucuuaagaagac

SEQ ID NO: 1503916 - RNA, 12 nt, Human
uccaaagaaaug

SEQ ID NO: 1503917 - RNA, 17 nt, Human
uccaaaauaaaacuuuu

SEQ ID NO: 1503918 - RNA, 16 nt, Human
uccaaaauaaaacuuu

SEQ ID NO: 1503919 - RNA, 14 nt, Human
uccaagaauuucua

SEQ ID NO: 1503920 - RNA, 22 nt, Human
uccaagaagcccaggaaaggcu

SEQ ID NO: 1503921 - RNA, 20 nt, Human
uccaagaagcccaggaaagg

SEQ ID NO: 1503922 - RNA, 17 nt, Human
uccaagcauuuagaugu

SEQ ID NO: 1503923 - RNA, 23 nt, Human
uccaagcauaccaacacgagcag

SEQ ID NO: 1503924 - RNA, 19 nt, Human
uccaagaccuucuccuuca

SEQ ID NO: 1503925 - RNA, 16 nt, Human
uccagauccuggaaau

SEQ ID NO: 1503926 - RNA, 17 nt, Human
uccagauccuggaaauc

SEQ ID NO: 1503927 - RNA, 14 nt, Human
uccagauccuggaa

SEQ ID NO: 1503928 - RNA, 23 nt, Human
uccagccaaagccuccuccagcc

SEQ ID NO: 1503929 - RNA, 14 nt, Human
uccacuuggucugu

SEQ ID NO: 1503930 - RNA, 13 nt, Human
uccaccugccagg

SEQ ID NO: 1503931 - RNA, 12 nt, Human
uccacuuggucu

SEQ ID NO: 1503932 - RNA, 13 nt, Human
uccacuuggucug

SEQ ID NO: 1503933 - RNA, 14 nt, Human
uccaccuacaugag

SEQ ID NO: 1503934 - RNA, 12 nt, Human
uccaccugccag

SEQ ID NO: 1503935 - RNA, 20 nt, Human
uccaagcauuuagauguaua

SEQ ID NO: 1503936 - RNA, 15 nt, Human
uccacaagagcccag

SEQ ID NO: 1503937 - RNA, 14 nt, Human
uccacaagagccca

SEQ ID NO: 1503938 - RNA, 13 nt, Human
ucccaccucagcc

SEQ ID NO: 1503939 - RNA, 16 nt, Human
ucccaccucagccucc

SEQ ID NO: 1503940 - RNA, 14 nt, Human
ucccaccucagccu

SEQ ID NO: 1503941 - RNA, 15 nt, Human
ucccaccucagccuc

SEQ ID NO: 1503942 - RNA, 20 nt, Human
ucccaggcauuccccaggag

SEQ ID NO: 1503943 - RNA, 21 nt, Human
ucccaggcauuccccaggagg

SEQ ID NO: 1503944 - RNA, 23 nt, Human
ucccaggcauuccccaggaggcc

SEQ ID NO: 1503945 - RNA, 22 nt, Human
ucccaggcauuccccaggaggc

SEQ ID NO: 1503946 - RNA, 21 nt, Human
ucccaucugugaaaggaaaga

SEQ ID NO: 1503947 - RNA, 20 nt, Human
ucccaucucacacaugagca

SEQ ID NO: 1503948 - RNA, 23 nt, Human
ucccaucucacacaugagcauca

SEQ ID NO: 1503949 - RNA, 14 nt, Human
uccauggacuuugu

SEQ ID NO: 1503950 - RNA, 15 nt, Human
uccauggacuuuguu

SEQ ID NO: 1503951 - RNA, 23 nt, Human
uccagcucaccagccccagugcc

SEQ ID NO: 1503952 - RNA, 16 nt, Human
ucccaacucaccccag

SEQ ID NO: 1503953 - RNA, 14 nt, Human
ucccaacucacccc

SEQ ID NO: 1503954 - RNA, 15 nt, Human
ucccaacucacccca

SEQ ID NO: 1503955 - RNA, 16 nt, Human
ucccaaauuucauacc

SEQ ID NO: 1503956 - RNA, 17 nt, Human
ucccaagcucugcuccu

SEQ ID NO: 1503957 - RNA, 12 nt, Human
ucccaagcucug

SEQ ID NO: 1503958 - RNA, 13 nt, Human
ucccaagcucugc

SEQ ID NO: 1503959 - RNA, 14 nt, Human
ucccaagcucugcu

SEQ ID NO: 1503960 - RNA, 15 nt, Human
ucccaagcucugcuc

SEQ ID NO: 1503961 - RNA, 15 nt, Human
ucccuacuguaauuu

SEQ ID NO: 1503962 - RNA, 17 nt, Human
ucccucccucuuucccu

SEQ ID NO: 1503963 - RNA, 15 nt, Human
ucccucccucuuucc

SEQ ID NO: 1503964 - RNA, 18 nt, Human
uccccuguuuguuucuga

SEQ ID NO: 1503965 - RNA, 24 nt, Human
uccccugcuggguguggcgcagca

SEQ ID NO: 1503966 - RNA, 19 nt, Human
uccccuguagagugggagc

SEQ ID NO: 1503967 - RNA, 22 nt, Human
uccccuguagagugggagcuga

SEQ ID NO: 1503968 - RNA, 23 nt, Human
uccccuguccccgcacugggcuu

SEQ ID NO: 1503969 - RNA, 14 nt, Human
uccccugcugggug

SEQ ID NO: 1503970 - RNA, 15 nt, Human
uccccugcugggugu

SEQ ID NO: 1503971 - RNA, 20 nt, Human
uccccugcuggguguggcgc

SEQ ID NO: 1503972 - RNA, 21 nt, Human
uccccugcuggguguggcgca

SEQ ID NO: 1503973 - RNA, 13 nt, Human
uccccaggaggcc

SEQ ID NO: 1503974 - RNA, 13 nt, Human
uccccugccccca

SEQ ID NO: 1503975 - RNA, 14 nt, Human
uccccugcccccag

SEQ ID NO: 1503976 - RNA, 15 nt, Human
uccccugcccccagg

SEQ ID NO: 1503977 - RNA, 20 nt, Human
uccccugcccccaggacugg

SEQ ID NO: 1503978 - RNA, 22 nt, Human
uccccugcccccaggacugggc

SEQ ID NO: 1503979 - RNA, 16 nt, Human
uccccugcccccagga

SEQ ID NO: 1503980 - RNA, 17 nt, Human
uccccugcccccaggac

SEQ ID NO: 1503981 - RNA, 18 nt, Human
uccccugcccccaggacu

SEQ ID NO: 1503982 - RNA, 19 nt, Human
uccccugcccccaggacug

SEQ ID NO: 1503983 - RNA, 13 nt, Human
uccccgcccuuuu

SEQ ID NO: 1503984 - RNA, 15 nt, Human
uccccgcccuuuuuu

SEQ ID NO: 1503985 - RNA, 20 nt, Human
uccccgcacugggcuugggg

SEQ ID NO: 1503986 - RNA, 21 nt, Human
ucccccuuccauggacuuugu

SEQ ID NO: 1503987 - RNA, 19 nt, Human
ucagcacgauuucuguuua

SEQ ID NO: 1503988 - RNA, 22 nt, Human
ucagacauagaauuaacacaug

SEQ ID NO: 1503989 - RNA, 19 nt, Human
ucagacauagaauuaacac

SEQ ID NO: 1503990 - RNA, 19 nt, Human
ucagacagcugccugggau

SEQ ID NO: 1503991 - RNA, 20 nt, Human
ucagacagcugccugggauc

SEQ ID NO: 1503992 - RNA, 15 nt, Human
ucagacagcugccug

SEQ ID NO: 1503993 - RNA, 16 nt, Human
ucagacagcugccugg

SEQ ID NO: 1503994 - RNA, 17 nt, Human
ucagacagcugccuggg

SEQ ID NO: 1503995 - RNA, 18 nt, Human
ucagacagcugccuggga

SEQ ID NO: 1503996 - RNA, 17 nt, Human
ucacuugucaauaaaau

SEQ ID NO: 1503997 - RNA, 22 nt, Human
ucacucugucgcccagucugga

SEQ ID NO: 1503998 - RNA, 19 nt, Human
ucacucugucgcccagucu

SEQ ID NO: 1503999 - RNA, 12 nt, Human
ucacucugucgc

SEQ ID NO: 1504000 - RNA, 16 nt, Human
ucacucugucgcccag

SEQ ID NO: 1504001 - RNA, 20 nt, Human
ucacugcuuaacuucacaua

SEQ ID NO: 1504002 - RNA, 18 nt, Human
ucacugcuuaacuucaca

SEQ ID NO: 1504003 - RNA, 17 nt, Human
ucacugcuuaacuucac

SEQ ID NO: 1504004 - RNA, 15 nt, Human
ucacugcuuaacuuc

SEQ ID NO: 1504005 - RNA, 17 nt, Human
ucagaaaauauuaugug

SEQ ID NO: 1504006 - RNA, 19 nt, Human
ucagaaaauauuauguguu

SEQ ID NO: 1504007 - RNA, 20 nt, Human
ucagaaaauauuauguguuu

SEQ ID NO: 1504008 - RNA, 16 nt, Human
ucacgccacugcacua

SEQ ID NO: 1504009 - RNA, 13 nt, Human
ucacgccacugca

SEQ ID NO: 1504010 - RNA, 14 nt, Human
ucacgccacugcac

SEQ ID NO: 1504011 - RNA, 19 nt, Human
ucacgccuguaauccuagc

SEQ ID NO: 1504012 - RNA, 20 nt, Human
ucacgccuguaauccuagca

SEQ ID NO: 1504013 - RNA, 14 nt, Human
ucaccuuugucccc

SEQ ID NO: 1504014 - RNA, 15 nt, Human
ucaccuuugucccca

SEQ ID NO: 1504015 - RNA, 17 nt, Human
ucaccuuuguccccacc

SEQ ID NO: 1504016 - RNA, 18 nt, Human
ucaccuuuguccccaccg

SEQ ID NO: 1504017 - RNA, 22 nt, Human
ucaccuuuguccccaccgcaga

SEQ ID NO: 1504018 - RNA, 16 nt, Human
ucacaggcagguccag

SEQ ID NO: 1504019 - RNA, 12 nt, Human
ucacaggcaggu

SEQ ID NO: 1504020 - RNA, 15 nt, Human
ucacaggcaggucca

SEQ ID NO: 1504021 - RNA, 14 nt, Human
ucaccuuucccauc

SEQ ID NO: 1504022 - RNA, 12 nt, Human
ucaccuuugucc

SEQ ID NO: 1504023 - RNA, 13 nt, Human
ucacggcucacug

SEQ ID NO: 1504024 - RNA, 15 nt, Human
ucacggcucacugca

SEQ ID NO: 1504025 - RNA, 20 nt, Human
ucacggcucacugcagccuc

SEQ ID NO: 1504026 - RNA, 14 nt, Human
ucacggaagagccu

SEQ ID NO: 1504027 - RNA, 16 nt, Human
ucacggaagagccuug

SEQ ID NO: 1504028 - RNA, 17 nt, Human
ucacggaagagccuugc

SEQ ID NO: 1504029 - RNA, 13 nt, Human
ucacuccuugaaa

SEQ ID NO: 1504030 - RNA, 23 nt, Human
ucacucuccuuggugucgggcau

SEQ ID NO: 1504031 - RNA, 12 nt, Human
ucacucuggcag

SEQ ID NO: 1504032 - RNA, 13 nt, Human
ucacucuggcagc

SEQ ID NO: 1504033 - RNA, 12 nt, Human
ucacucuccuug

SEQ ID NO: 1504034 - RNA, 14 nt, Human
ucacucuccuuggu

SEQ ID NO: 1504035 - RNA, 14 nt, Human
ucacucuggcagcu

SEQ ID NO: 1504036 - RNA, 15 nt, Human
ucacucuggcagcuc

SEQ ID NO: 1504037 - RNA, 16 nt, Human
ucacucuggcagcuca

SEQ ID NO: 1504038 - RNA, 17 nt, Human
ucacucuggcagcucag

SEQ ID NO: 1504039 - RNA, 18 nt, Human
ucacucuggcagcucaga

SEQ ID NO: 1504040 - RNA, 19 nt, Human
ucacucuggcagcucagag

SEQ ID NO: 1504041 - RNA, 20 nt, Human
ucacucuggcagcucagaga

SEQ ID NO: 1504042 - RNA, 22 nt, Human
ucacucuggcagcucagagagg

SEQ ID NO: 1504043 - RNA, 23 nt, Human
uauuuuaucuuugauucuccuuc

SEQ ID NO: 1504044 - RNA, 16 nt, Human
uauuuuuuucugaaau

SEQ ID NO: 1504045 - RNA, 17 nt, Human
uauuuuuuucugaaauu

SEQ ID NO: 1504046 - RNA, 15 nt, Human
uauuuuuuuacuaau

SEQ ID NO: 1504047 - RNA, 14 nt, Human
ucaaacucuuaaaa

SEQ ID NO: 1504048 - RNA, 22 nt, Human
ucaaaacgguuuuacugcagcu

SEQ ID NO: 1504049 - RNA, 13 nt, Human
ucaaaacugcacu

SEQ ID NO: 1504050 - RNA, 13 nt, Human
uauuuauuacugu

SEQ ID NO: 1504051 - RNA, 22 nt, Human
uauuucuaugaaauauuauguu

SEQ ID NO: 1504052 - RNA, 21 nt, Human
uauuucuaugaaauauuaugu

SEQ ID NO: 1504053 - RNA, 23 nt, Human
uauuuauuaaaugcccagccccu

SEQ ID NO: 1504054 - RNA, 14 nt, Human
uaucugaaaaugua

SEQ ID NO: 1504055 - RNA, 15 nt, Human
uaucugaaaauguau

SEQ ID NO: 1504056 - RNA, 20 nt, Human
uaucugaaaauguaugugua

SEQ ID NO: 1504057 - RNA, 15 nt, Human
uauuugagaguucua

SEQ ID NO: 1504058 - RNA, 16 nt, Human
uauuugagaguucuaa

SEQ ID NO: 1504059 - RNA, 18 nt, Human
uauuugagaguucuaaau

SEQ ID NO: 1504060 - RNA, 19 nt, Human
uauuugagaguucuaaauu

SEQ ID NO: 1504061 - RNA, 20 nt, Human
uauuucuuaaacaaauguau

SEQ ID NO: 1504062 - RNA, 19 nt, Human
ucaacuccaaacugacucu

SEQ ID NO: 1504063 - RNA, 13 nt, Human
ucaaccuccuggg

SEQ ID NO: 1504064 - RNA, 14 nt, Human
ucaaccuccugggc

SEQ ID NO: 1504065 - RNA, 16 nt, Human
ucaaacuuuacuaugg

SEQ ID NO: 1504066 - RNA, 22 nt, Human
ucaaacucuugaccucagguga

SEQ ID NO: 1504067 - RNA, 13 nt, Human
ucaaacuuuacua

SEQ ID NO: 1504068 - RNA, 15 nt, Human
ucaaacuuuacuaug

SEQ ID NO: 1504069 - RNA, 16 nt, Human
ucaagcgauucuucug

SEQ ID NO: 1504070 - RNA, 17 nt, Human
ucaagcgauucuucugc

SEQ ID NO: 1504071 - RNA, 18 nt, Human
ucaaggauccugagccag

SEQ ID NO: 1504072 - RNA, 19 nt, Human
ucaaggauccugagccaga

SEQ ID NO: 1504073 - RNA, 23 nt, Human
ucaaggauccugagccagauuuc

SEQ ID NO: 1504074 - RNA, 20 nt, Human
ucaaggauccugagccagau

SEQ ID NO: 1504075 - RNA, 22 nt, Human
ucaagugauucuccugccucag

SEQ ID NO: 1504076 - RNA, 23 nt, Human
ucacaggacagcccuucuuucca

SEQ ID NO: 1504077 - RNA, 11 nt, Human
ucacaggcagg

SEQ ID NO: 1504078 - RNA, 19 nt, Human
ucacaggaaguagaggagg

SEQ ID NO: 1504079 - RNA, 22 nt, Human
ucacacaugagcaucaggccag

SEQ ID NO: 1504080 - RNA, 21 nt, Human
ucacacaugagcaucaggcca

SEQ ID NO: 1504081 - RNA, 22 nt, Human
ucacacagugagucgaggacag

SEQ ID NO: 1504082 - RNA, 23 nt, Human
ucacacagugagucgaggacagg

SEQ ID NO: 1504083 - RNA, 13 nt, Human
ucacaauacuguu

SEQ ID NO: 1504084 - RNA, 19 nt, Human
ucaauuacaggaaguacug

SEQ ID NO: 1504085 - RNA, 20 nt, Human
ucaauuacaggaaguacugg

SEQ ID NO: 1504086 - RNA, 21 nt, Human
ucacacaguauuacuucugcu

SEQ ID NO: 1504087 - RNA, 22 nt, Human
ucacacaguauuacuucugcua

SEQ ID NO: 1504088 - RNA, 13 nt, Human
ucacacagugagu

SEQ ID NO: 1504089 - RNA, 13 nt, Human
ucaaugcagcccc

SEQ ID NO: 1504090 - RNA, 18 nt, Human
ucaaugcacugacauugu

SEQ ID NO: 1504091 - RNA, 17 nt, Human
ucaaugguuugcaagga

SEQ ID NO: 1504092 - RNA, 13 nt, Human
ucaauuacaggaa

SEQ ID NO: 1504093 - RNA, 18 nt, Human
ucaauuacaggaaguacu

SEQ ID NO: 1504094 - RNA, 13 nt, Human
ucaauaggaaaaa

SEQ ID NO: 1504095 - RNA, 17 nt, Human
ucaauaggaaaaacuga

SEQ ID NO: 1504096 - RNA, 14 nt, Human
ucaauaggaaaaac

SEQ ID NO: 1504097 - RNA, 14 nt, Human
ucaaugcacugaca

SEQ ID NO: 1504098 - RNA, 13 nt, Human
guuuagcaguaua

SEQ ID NO: 1504099 - RNA, 13 nt, Human
guuuagaaagcuu

SEQ ID NO: 1504100 - RNA, 17 nt, Human
guuuagaaagcuugccc

SEQ ID NO: 1504101 - RNA, 21 nt, Human
gguuggccccugcccggcugc

SEQ ID NO: 1504102 - RNA, 21 nt, Human
guuuccuggcacugcuuccag

SEQ ID NO: 1504103 - RNA, 22 nt, Human
guuuccuggcacugcuuccagu

SEQ ID NO: 1504104 - RNA, 16 nt, Human
guuuccuggcacugcu

SEQ ID NO: 1504105 - RNA, 20 nt, Human
guuuccuggcacugcuucca

SEQ ID NO: 1504106 - RNA, 18 nt, Human
guuucagaaauguguuau

SEQ ID NO: 1504107 - RNA, 14 nt, Human
guuucagaaaugug

SEQ ID NO: 1504108 - RNA, 17 nt, Human
guuugaauauaaacacu

SEQ ID NO: 1504109 - RNA, 13 nt, Human
guuugaauauaaa

SEQ ID NO: 1504110 - RNA, 19 nt, Human
guuugaauauaaacacuau

SEQ ID NO: 1504111 - RNA, 16 nt, Human
guuugaaccaagaacu

SEQ ID NO: 1504112 - RNA, 20 nt, Human
guuucuaaagcugccagccg

SEQ ID NO: 1504113 - RNA, 16 nt, Human
guuucuaaagcugcca

SEQ ID NO: 1504114 - RNA, 14 nt, Human
guuucuaaagcugc

SEQ ID NO: 1504115 - RNA, 15 nt, Human
guuucuaaagcugcc

SEQ ID NO: 1504116 - RNA, 22 nt, Human
guuugauuaaauucuugcaaag

SEQ ID NO: 1504117 - RNA, 19 nt, Human
guuugauuaaauucuugca

SEQ ID NO: 1504118 - RNA, 17 nt, Human
guuugauuaaauucuug

SEQ ID NO: 1504119 - RNA, 20 nt, Human
guuuguaaauuaacuuuuau

SEQ ID NO: 1504120 - RNA, 19 nt, Human
guuuguaaauuaacuuuua

SEQ ID NO: 1504121 - RNA, 17 nt, Human
guuuguaaauuaacuuu

SEQ ID NO: 1504122 - RNA, 16 nt, Human
uaaaaaagaaacauuu

SEQ ID NO: 1504123 - RNA, 20 nt, Human
uaaaaaacugcugacuguuu

SEQ ID NO: 1504124 - RNA, 23 nt, Human
uaaaaaacugcugacuguuuucu

SEQ ID NO: 1504125 - RNA, 18 nt, Human
guuuucaggcuagaugua

SEQ ID NO: 1504126 - RNA, 16 nt, Human
guuuucaguguacaug

SEQ ID NO: 1504127 - RNA, 17 nt, Human
guuuucaguguacaugg

SEQ ID NO: 1504128 - RNA, 18 nt, Human
guuuguuucugaaaggga

SEQ ID NO: 1504129 - RNA, 14 nt, Human
guuuucuaaauuua

SEQ ID NO: 1504130 - RNA, 20 nt, Human
guuuuccagguuuaagcugu

SEQ ID NO: 1504131 - RNA, 16 nt, Human
guuuucauuaucucaa

SEQ ID NO: 1504132 - RNA, 15 nt, Human
guuuucugagaaaga

SEQ ID NO: 1504133 - RNA, 12 nt, Human
guuuucucuuga

SEQ ID NO: 1504134 - RNA, 19 nt, Human
guuuucucuugagagggug

SEQ ID NO: 1504135 - RNA, 19 nt, Human
guuuuguggaggagcucag

SEQ ID NO: 1504136 - RNA, 23 nt, Human
guuuuuauggcuuuugugcauua

SEQ ID NO: 1504137 - RNA, 22 nt, Human
guuuuuauggcuuuugugcauu

SEQ ID NO: 1504138 - RNA, 19 nt, Human
guuuuuauggcuuuugugc

SEQ ID NO: 1504139 - RNA, 15 nt, Human
guuuuuaacucaaua

SEQ ID NO: 1504140 - RNA, 19 nt, Human
guuuuuaacucaauauuuu

SEQ ID NO: 1504141 - RNA, 19 nt, Human
uaaaauccauacauuugug

SEQ ID NO: 1504142 - RNA, 18 nt, Human
uaaaauccauacauuugu

SEQ ID NO: 1504143 - RNA, 15 nt, Human
uaaaaaugguuuaaa

SEQ ID NO: 1504144 - RNA, 14 nt, Human
uaaaagaugaaaau

SEQ ID NO: 1504145 - RNA, 18 nt, Human
uaaacaauaucagacuuu

SEQ ID NO: 1504146 - RNA, 19 nt, Human
uaaacaagaccacguuucu

SEQ ID NO: 1504147 - RNA, 23 nt, Human
uaaacaagaccacguuucuaaag

SEQ ID NO: 1504148 - RNA, 18 nt, Human
uaaacaagaccacguuuc

SEQ ID NO: 1504149 - RNA, 19 nt, Human
uaaacaaauguaugauuac

SEQ ID NO: 1504150 - RNA, 12 nt, Human
uaaacaaaugua

SEQ ID NO: 1504151 - RNA, 20 nt, Human
uaaacugguauuuuaucuuu

SEQ ID NO: 1504152 - RNA, 19 nt, Human
uaaacuuaaucuaaaugga

SEQ ID NO: 1504153 - RNA, 18 nt, Human
uaaacuuaaucuaaaugg

SEQ ID NO: 1504154 - RNA, 14 nt, Human
uaaacuuaaucuaa

SEQ ID NO: 1504155 - RNA, 16 nt, Human
uaaacuuuaccuuuuu

SEQ ID NO: 1504156 - RNA, 22 nt, Human
uaaacuuuaccuuuuuuauaca

SEQ ID NO: 1504157 - RNA, 18 nt, Human
uaaauauaugcuaagucu

SEQ ID NO: 1504158 - RNA, 22 nt, Human
uaaauaaaccucaaaaugucua

SEQ ID NO: 1504159 - RNA, 19 nt, Human
uaaaucagccguguaacca

SEQ ID NO: 1504160 - RNA, 17 nt, Human
uaaauaaaaauaauccu

SEQ ID NO: 1504161 - RNA, 13 nt, Human
uaaaguuucuguu

SEQ ID NO: 1504162 - RNA, 21 nt, Human
uaaaguguauuuuuuuacuaa

SEQ ID NO: 1504163 - RNA, 23 nt, Human
uaaaguguauuuuuuuacuaaua

SEQ ID NO: 1504164 - RNA, 22 nt, Human
uaaaguguauuuuuuuacuaau

SEQ ID NO: 1504165 - RNA, 14 nt, Human
uaauguuucaaaca

SEQ ID NO: 1504166 - RNA, 15 nt, Human
uaauguuucaaacau

SEQ ID NO: 1504167 - RNA, 14 nt, Human
uaaugcgugcauac

SEQ ID NO: 1504168 - RNA, 21 nt, Human
uaauuaaauaaaaaucugugg

SEQ ID NO: 1504169 - RNA, 23 nt, Human
uaauuaaauuuugaguucuacau

SEQ ID NO: 1504170 - RNA, 17 nt, Human
uaauuaaaacacaacau

SEQ ID NO: 1504171 - RNA, 20 nt, Human
uaauuaaaagaauauuuuaa

SEQ ID NO: 1504172 - RNA, 18 nt, Human
uaauucuuagcucauucu

SEQ ID NO: 1504173 - RNA, 20 nt, Human
uaauucuucaccuuaggaau

SEQ ID NO: 1504174 - RNA, 22 nt, Human
uaauugacaggauuauuggaaa

SEQ ID NO: 1504175 - RNA, 20 nt, Human
uaauugacaggauuauugga

SEQ ID NO: 1504176 - RNA, 22 nt, Human
uaauuggaaaggcagcucuaaa

SEQ ID NO: 1504177 - RNA, 20 nt, Human
uaauuuguaguguuggagaa

SEQ ID NO: 1504178 - RNA, 18 nt, Human
uaauuugguuuucacauu

SEQ ID NO: 1504179 - RNA, 15 nt, Human
uaauuugguuuucac

SEQ ID NO: 1504180 - RNA, 17 nt, Human
uaauuugguuuucacau

SEQ ID NO: 1504181 - RNA, 23 nt, Human
uaauuuguaguguuggagaagaa

SEQ ID NO: 1504182 - RNA, 14 nt, Human
uaauuugugauaca

SEQ ID NO: 1504183 - RNA, 18 nt, Human
uaauuugugauacaaugc

SEQ ID NO: 1504184 - RNA, 15 nt, Human
uaauuugugauacaa

SEQ ID NO: 1504185 - RNA, 22 nt, Human
uaauuugugauacaaugcugug

SEQ ID NO: 1504186 - RNA, 19 nt, Human
uaauuugugauacaaugcu

SEQ ID NO: 1504187 - RNA, 13 nt, Human
uaauuuuaagaaa

SEQ ID NO: 1504188 - RNA, 15 nt, Human
uaauaauguuucaaa

SEQ ID NO: 1504189 - RNA, 14 nt, Human
uaauacaccacuac

SEQ ID NO: 1504190 - RNA, 21 nt, Human
uaauaguucagguaacaggca

SEQ ID NO: 1504191 - RNA, 14 nt, Human
uaauauaaaguugg

SEQ ID NO: 1504192 - RNA, 19 nt, Human
uaauauaaaguuggaugcg

SEQ ID NO: 1504193 - RNA, 15 nt, Human
uaauaacugugaagu

SEQ ID NO: 1504194 - RNA, 20 nt, Human
uaagugguacuaacuuuccu

SEQ ID NO: 1504195 - RNA, 16 nt, Human
uaauauggggaugcag

SEQ ID NO: 1504196 - RNA, 14 nt, Human
uaauauauuuccau

SEQ ID NO: 1504197 - RNA, 19 nt, Human
uaaugauaaguaaaugcua

SEQ ID NO: 1504198 - RNA, 19 nt, Human
uaaugccacuaaauugaca

SEQ ID NO: 1504199 - RNA, 12 nt, Human
uaaucuaaaugg

SEQ ID NO: 1504200 - RNA, 11 nt, Human
uaaucuaaaug

SEQ ID NO: 1504201 - RNA, 14 nt, Human
uaaauuuaguauuu

SEQ ID NO: 1504202 - RNA, 13 nt, Human
uaacagaaaugua

SEQ ID NO: 1504203 - RNA, 15 nt, Human
uaacagaaauguaca

SEQ ID NO: 1504204 - RNA, 14 nt, Human
uaacagaaauguac

SEQ ID NO: 1504205 - RNA, 17 nt, Human
uaaccaggggccaugaa

SEQ ID NO: 1504206 - RNA, 19 nt, Human
uaaccagcagaaaugccuu

SEQ ID NO: 1504207 - RNA, 16 nt, Human
uaaccagcagaaaugc

SEQ ID NO: 1504208 - RNA, 14 nt, Human
uaaccagcagaaau

SEQ ID NO: 1504209 - RNA, 19 nt, Human
uaacaggcagauacaggaa

SEQ ID NO: 1504210 - RNA, 20 nt, Human
uaacuuuuauaaacuuuacc

SEQ ID NO: 1504211 - RNA, 16 nt, Human
uaagcauuccaacuau

SEQ ID NO: 1504212 - RNA, 18 nt, Human
uaagcauuccaacuaucu

SEQ ID NO: 1504213 - RNA, 20 nt, Human
uaagcauuccaacuaucuca

SEQ ID NO: 1504214 - RNA, 13 nt, Human
uaagccagacauc

SEQ ID NO: 1504215 - RNA, 16 nt, Human
uaaggauguucuagca

SEQ ID NO: 1504216 - RNA, 23 nt, Human
uaaggaugcuuguacauaaugcg

SEQ ID NO: 1504217 - RNA, 22 nt, Human
uaaggaugcuuguacauaaugc

SEQ ID NO: 1504218 - RNA, 21 nt, Human
uaaggaugcuuguacauaaug

SEQ ID NO: 1504219 - RNA, 20 nt, Human
uaaggaugcuuguacauaau

SEQ ID NO: 1504220 - RNA, 20 nt, Human
uaagccagacaucaacagau

SEQ ID NO: 1504221 - RNA, 21 nt, Human
uaagccagacaucaacagaua

SEQ ID NO: 1504222 - RNA, 19 nt, Human
uaaggaugcuuguacauaa

SEQ ID NO: 1504223 - RNA, 17 nt, Human
uaagagagucuauuuac

SEQ ID NO: 1504224 - RNA, 21 nt, Human
uaagaacuacaaacaaaauuu

SEQ ID NO: 1504225 - RNA, 22 nt, Human
uaacuuuuauaaacuuuaccuu

SEQ ID NO: 1504226 - RNA, 21 nt, Human
uaacuuuuauaaacuuuaccu

SEQ ID NO: 1504227 - RNA, 13 nt, Human
uaacugugaaguu

SEQ ID NO: 1504228 - RNA, 19 nt, Human
uaagaaaucaaagagagaa

SEQ ID NO: 1504229 - RNA, 16 nt, Human
uaagauaaaugugcug

SEQ ID NO: 1504230 - RNA, 17 nt, Human
uaagauaaaugugcuga

SEQ ID NO: 1504231 - RNA, 16 nt, Human
uaagagguugauuaua

SEQ ID NO: 1504232 - RNA, 14 nt, Human
uaagauaaaugugc

SEQ ID NO: 1504233 - RNA, 12 nt, Human
uaagagggaggg

SEQ ID NO: 1504234 - RNA, 22 nt, Human
uaagagggagggagggcuccag

SEQ ID NO: 1504235 - RNA, 23 nt, Human
uaagagggagggagggcuccaga

SEQ ID NO: 1504236 - RNA, 23 nt, Human
uaagagggauuagggagagaaga

SEQ ID NO: 1504237 - RNA, 16 nt, Human
uagauguauguacuuc

SEQ ID NO: 1504238 - RNA, 20 nt, Human
uagauguauguacuucaugc

SEQ ID NO: 1504239 - RNA, 18 nt, Human
uagauaauacaccacuac

SEQ ID NO: 1504240 - RNA, 12 nt, Human
uagauguauaua

SEQ ID NO: 1504241 - RNA, 19 nt, Human
uagcagagaaugaaagggc

SEQ ID NO: 1504242 - RNA, 23 nt, Human
uagcagagaaugaaagggcccag

SEQ ID NO: 1504243 - RNA, 20 nt, Human
uagcagggcauggcugggaa

SEQ ID NO: 1504244 - RNA, 17 nt, Human
uagaguuuagcuggaaa

SEQ ID NO: 1504245 - RNA, 18 nt, Human
uagaguuuagcuggaaaa

SEQ ID NO: 1504246 - RNA, 16 nt, Human
uagagagagaccacuu

SEQ ID NO: 1504247 - RNA, 21 nt, Human
uagagguucaaagauauuuug

SEQ ID NO: 1504248 - RNA, 16 nt, Human
uagagguucaaagaua

SEQ ID NO: 1504249 - RNA, 19 nt, Human
uagagguucaaagauauuu

SEQ ID NO: 1504250 - RNA, 23 nt, Human
uaggaauugacccacaagaaaug

SEQ ID NO: 1504251 - RNA, 15 nt, Human
uaggaagguuaaugu

SEQ ID NO: 1504252 - RNA, 14 nt, Human
uaggccuggccaga

SEQ ID NO: 1504253 - RNA, 13 nt, Human
uaggccuggccag

SEQ ID NO: 1504254 - RNA, 13 nt, Human
uaggccaugggac

SEQ ID NO: 1504255 - RNA, 16 nt, Human
uaggccaugggacagg

SEQ ID NO: 1504256 - RNA, 13 nt, Human
uaggaacacuccu

SEQ ID NO: 1504257 - RNA, 14 nt, Human
uaggaacacuccuu

SEQ ID NO: 1504258 - RNA, 21 nt, Human
uaggaacuuaaauaaugugaa

SEQ ID NO: 1504259 - RNA, 17 nt, Human
uaggaacacuccuucac

SEQ ID NO: 1504260 - RNA, 13 nt, Human
uaggaagacuuug

SEQ ID NO: 1504261 - RNA, 14 nt, Human
uaggaagacuuugg

SEQ ID NO: 1504262 - RNA, 15 nt, Human
uaggaagacuuugga

SEQ ID NO: 1504263 - RNA, 16 nt, Human
uaggaagacuuuggaa

SEQ ID NO: 1504264 - RNA, 17 nt, Human
uaggaagacuuuggaaa

SEQ ID NO: 1504265 - RNA, 14 nt, Human
uagcccaaaaccaa

SEQ ID NO: 1504266 - RNA, 11 nt, Human
uagcugggacu

SEQ ID NO: 1504267 - RNA, 18 nt, Human
uagcugggacuacaggug

SEQ ID NO: 1504268 - RNA, 12 nt, Human
uagcugggacua

SEQ ID NO: 1504269 - RNA, 20 nt, Human
uagcugggacuacaggcacc

SEQ ID NO: 1504270 - RNA, 21 nt, Human
uagcucuaggagggcuggcaa

SEQ ID NO: 1504271 - RNA, 22 nt, Human
uagcucauucuccuuguguuac

SEQ ID NO: 1504272 - RNA, 17 nt, Human
uagccugccucuucucu

SEQ ID NO: 1504273 - RNA, 14 nt, Human
uagcuccccuccaa

SEQ ID NO: 1504274 - RNA, 18 nt, Human
uagucaaauugugugaaa

SEQ ID NO: 1504275 - RNA, 15 nt, Human
uaguggauguucuga

SEQ ID NO: 1504276 - RNA, 21 nt, Human
uaguuguaccgcaaugugacu

SEQ ID NO: 1504277 - RNA, 13 nt, Human
uaguuucuccaag

SEQ ID NO: 1504278 - RNA, 23 nt, Human
uaguuugauuaaauucuugcaaa

SEQ ID NO: 1504279 - RNA, 12 nt, Human
uaguuugcaguu

SEQ ID NO: 1504280 - RNA, 15 nt, Human
uaguuuuauaugcuu

SEQ ID NO: 1504281 - RNA, 18 nt, Human
uauaacaaugcuguauuu

SEQ ID NO: 1504282 - RNA, 18 nt, Human
uauaaugaaugaaacauu

SEQ ID NO: 1504283 - RNA, 20 nt, Human
uauaaugaaugaaacauuuu

SEQ ID NO: 1504284 - RNA, 16 nt, Human
uauacccagaaaguua

SEQ ID NO: 1504285 - RNA, 17 nt, Human
uauaauucuacuuugag

SEQ ID NO: 1504286 - RNA, 21 nt, Human
uauaauucagaaggaucuuca

SEQ ID NO: 1504287 - RNA, 14 nt, Human
uauaauguaagcuc

SEQ ID NO: 1504288 - RNA, 19 nt, Human
uauaauguaagcucuacug

SEQ ID NO: 1504289 - RNA, 20 nt, Human
uauaauguaagcucuacuga

SEQ ID NO: 1504290 - RNA, 14 nt, Human
uauauuuuaauuug

SEQ ID NO: 1504291 - RNA, 13 nt, Human
uauauuugaaaua

SEQ ID NO: 1504292 - RNA, 14 nt, Human
uauauuugaaauau

SEQ ID NO: 1504293 - RNA, 20 nt, Human
uauauuugaaauauugacuu

SEQ ID NO: 1504294 - RNA, 23 nt, Human
uauauuuauuacuguaagaaaau

SEQ ID NO: 1504295 - RNA, 15 nt, Human
uauauacauauauau

SEQ ID NO: 1504296 - RNA, 20 nt, Human
uauaugcucugcauguuaca

SEQ ID NO: 1504297 - RNA, 14 nt, Human
uauccuucagccug

SEQ ID NO: 1504298 - RNA, 16 nt, Human
uaucuaaauguugaaa

SEQ ID NO: 1504299 - RNA, 15 nt, Human
uaucuaaauguugaa

SEQ ID NO: 1504300 - RNA, 19 nt, Human
uaucgucacugcuuaacuu

SEQ ID NO: 1504301 - RNA, 16 nt, Human
uaucaugacaaagacu

SEQ ID NO: 1504302 - RNA, 17 nt, Human
uaucaugacaaagacug

SEQ ID NO: 1504303 - RNA, 17 nt, Human
uaucaggugcugccauc

SEQ ID NO: 1504304 - RNA, 19 nt, Human
uauauuuuuuguuaaauga

SEQ ID NO: 1504305 - RNA, 16 nt, Human
uacagaaauauccaug

SEQ ID NO: 1504306 - RNA, 13 nt, Human
uacagaauuuuau

SEQ ID NO: 1504307 - RNA, 24 nt, Human
uacagcaaggagauuuacaacugg

SEQ ID NO: 1504308 - RNA, 18 nt, Human
uacagaaaaguugaauuu

SEQ ID NO: 1504309 - RNA, 22 nt, Human
uacagaaaaguugaauuuuaca

SEQ ID NO: 1504310 - RNA, 13 nt, Human
uacacuuuaugca

SEQ ID NO: 1504311 - RNA, 19 nt, Human
uacacuguuucaaacuuua

SEQ ID NO: 1504312 - RNA, 18 nt, Human
uacacuguuucaaacuuu

SEQ ID NO: 1504313 - RNA, 17 nt, Human
uacacuguuucaaacuu

SEQ ID NO: 1504314 - RNA, 19 nt, Human
uacaggaaaagcugcugac

SEQ ID NO: 1504315 - RNA, 16 nt, Human
uacaggcacccaccau

SEQ ID NO: 1504316 - RNA, 23 nt, Human
uacagcuugaccgugaggccaga

SEQ ID NO: 1504317 - RNA, 17 nt, Human
uacaggaaaagcugcug

SEQ ID NO: 1504318 - RNA, 18 nt, Human
uacaggaaaagcugcuga

SEQ ID NO: 1504319 - RNA, 22 nt, Human
uacagcuugaccgugaggccag

SEQ ID NO: 1504320 - RNA, 13 nt, Human
uaauuuugugaag

SEQ ID NO: 1504321 - RNA, 17 nt, Human
uacacaaugguuuucuu

SEQ ID NO: 1504322 - RNA, 21 nt, Human
uacacaaugguuuucuugugu

SEQ ID NO: 1504323 - RNA, 23 nt, Human
uacacaaugguuuucuugugugu

SEQ ID NO: 1504324 - RNA, 21 nt, Human
uacacacacacgcgugcacac

SEQ ID NO: 1504325 - RNA, 15 nt, Human
uacacacacauacac

SEQ ID NO: 1504326 - RNA, 18 nt, Human
uacacaccuuauauuuac

SEQ ID NO: 1504327 - RNA, 14 nt, Human
uacacuguuucaaa

SEQ ID NO: 1504328 - RNA, 16 nt, Human
uacacugugcugaguc

SEQ ID NO: 1504329 - RNA, 22 nt, Human
uacacacugcauguuugugauu

SEQ ID NO: 1504330 - RNA, 15 nt, Human
uacccaaauuaagag

SEQ ID NO: 1504331 - RNA, 12 nt, Human
uacccaccccca

SEQ ID NO: 1504332 - RNA, 15 nt, Human
uacccacccccaccc

SEQ ID NO: 1504333 - RNA, 23 nt, Human
uacccacccccacccaagggccu

SEQ ID NO: 1504334 - RNA, 17 nt, Human
uacccacccccacccaa

SEQ ID NO: 1504335 - RNA, 19 nt, Human
uacccacccccacccaagg

SEQ ID NO: 1504336 - RNA, 11 nt, Human
uacccacugcu

SEQ ID NO: 1504337 - RNA, 12 nt, Human
uacccacugcuc

SEQ ID NO: 1504338 - RNA, 13 nt, Human
uacccacugcucu

SEQ ID NO: 1504339 - RNA, 14 nt, Human
uacccacugcucug

SEQ ID NO: 1504340 - RNA, 15 nt, Human
uacccacugcucugg

SEQ ID NO: 1504341 - RNA, 18 nt, Human
uacccagcgagcccuggu

SEQ ID NO: 1504342 - RNA, 22 nt, Human
uacccaggugcuaggaacacuc

SEQ ID NO: 1504343 - RNA, 13 nt, Human
uaccacagacaua

SEQ ID NO: 1504344 - RNA, 23 nt, Human
uaccacaggaaccacaagacugc

SEQ ID NO: 1504345 - RNA, 18 nt, Human
uaccaccagucugacugu

SEQ ID NO: 1504346 - RNA, 23 nt, Human
uaccauuuugggguacccacugc

SEQ ID NO: 1504347 - RNA, 16 nt, Human
uacauuuguauaaaau

SEQ ID NO: 1504348 - RNA, 23 nt, Human
uacauuuggagacacaacuauuu

SEQ ID NO: 1504349 - RNA, 17 nt, Human
uacauuuguauaaaaua

SEQ ID NO: 1504350 - RNA, 11 nt, Human
uacauuugugu

SEQ ID NO: 1504351 - RNA, 21 nt, Human
uacaugagguacugagaguga

SEQ ID NO: 1504352 - RNA, 22 nt, Human
uacaugagguacugagagugaa

SEQ ID NO: 1504353 - RNA, 16 nt, Human
uaccaacacgagcagg

SEQ ID NO: 1504354 - RNA, 18 nt, Human
uacauaagauaaaugugc

SEQ ID NO: 1504355 - RNA, 19 nt, Human
uacauaagauaaaugugcu

SEQ ID NO: 1504356 - RNA, 23 nt, Human
uacaguuacucagaauucucuag

SEQ ID NO: 1504357 - RNA, 19 nt, Human
uacaguuacucagaauucu

SEQ ID NO: 1504358 - RNA, 22 nt, Human
uacauaagauaaaugugcugaa

SEQ ID NO: 1504359 - RNA, 15 nt, Human
uacauaaguaauuca

SEQ ID NO: 1504360 - RNA, 20 nt, Human
uaccuuuguauucucuccug

SEQ ID NO: 1504361 - RNA, 20 nt, Human
uaccuuuuuuauacauaaac

SEQ ID NO: 1504362 - RNA, 19 nt, Human
uaccuuuuuuauacauaaa

SEQ ID NO: 1504363 - RNA, 18 nt, Human
uaccuuuuuuauacauaa

SEQ ID NO: 1504364 - RNA, 22 nt, Human
uacccaucccauaugccugggc

SEQ ID NO: 1504365 - RNA, 18 nt, Human
uacuaaccagcagaaaug

SEQ ID NO: 1504366 - RNA, 19 nt, Human
uacuaaccagcagaaaugc

SEQ ID NO: 1504367 - RNA, 22 nt, Human
uaccuuuuuuauacauaaacaa

SEQ ID NO: 1504368 - RNA, 23 nt, Human
uaccuuuguucccaaauuucaua

SEQ ID NO: 1504369 - RNA, 20 nt, Human
uacgaagaguauuuuugaca

SEQ ID NO: 1504370 - RNA, 22 nt, Human
uacgaagaguauuuuugacaga

SEQ ID NO: 1504371 - RNA, 23 nt, Human
uacgaagaguauuuuugacagaa

SEQ ID NO: 1504372 - RNA, 17 nt, Human
uacuaauagacaauuua

SEQ ID NO: 1504373 - RNA, 15 nt, Human
uacuaauagacaauu

SEQ ID NO: 1504374 - RNA, 13 nt, Human
uacuaacuuuccu

SEQ ID NO: 1504375 - RNA, 20 nt, Human
uacuaauagacaauuuauua

SEQ ID NO: 1504376 - RNA, 12 nt, Human
uacuacaguccu

SEQ ID NO: 1504377 - RNA, 17 nt, Human
uacuacaguccucccau

SEQ ID NO: 1504378 - RNA, 22 nt, Human
uacucagaauucucuaguuuga

SEQ ID NO: 1504379 - RNA, 16 nt, Human
uacucagaauucucua

SEQ ID NO: 1504380 - RNA, 14 nt, Human
uacucaccucaccc

SEQ ID NO: 1504381 - RNA, 13 nt, Human
uacuacuccugua

SEQ ID NO: 1504382 - RNA, 12 nt, Human
uacucaccucac

SEQ ID NO: 1504383 - RNA, 20 nt, Human
uacuacaguccucccaucuc

SEQ ID NO: 1504384 - RNA, 23 nt, Human
uacugauguuccuagugaaagag

SEQ ID NO: 1504385 - RNA, 15 nt, Human
uacugaggugcuaug

SEQ ID NO: 1504386 - RNA, 14 nt, Human
uacucccaucugug

SEQ ID NO: 1504387 - RNA, 16 nt, Human
uacucccaucugugaa

SEQ ID NO: 1504388 - RNA, 17 nt, Human
uacucccaucugugaaa

SEQ ID NO: 1504389 - RNA, 17 nt, Human
uagaaagacagagcugg

SEQ ID NO: 1504390 - RNA, 17 nt, Human
uagaacagauaaucagu

SEQ ID NO: 1504391 - RNA, 15 nt, Human
uagaaauauaauuga

SEQ ID NO: 1504392 - RNA, 20 nt, Human
uagaaauaucugaaaaugua

SEQ ID NO: 1504393 - RNA, 21 nt, Human
uagaaauaucugaaaauguau

SEQ ID NO: 1504394 - RNA, 23 nt, Human
uagaaauaucugaaaauguaugu

SEQ ID NO: 1504395 - RNA, 18 nt, Human
uacuugaauaaccaucug

SEQ ID NO: 1504396 - RNA, 20 nt, Human
uacuugaauaaccaucugaa

SEQ ID NO: 1504397 - RNA, 19 nt, Human
uacuuguggacacagcucu

SEQ ID NO: 1504398 - RNA, 15 nt, Human
uacuuguggacacag

SEQ ID NO: 1504399 - RNA, 18 nt, Human
uacuuguggacacagcuc

SEQ ID NO: 1504400 - RNA, 17 nt, Human
uacugcauaugaaagga

SEQ ID NO: 1504401 - RNA, 21 nt, Human
uacuguaucaugacaaagacu

SEQ ID NO: 1504402 - RNA, 17 nt, Human
gguuaggcauuguggga

SEQ ID NO: 1504403 - RNA, 13 nt, Human
gguuauggagagg

SEQ ID NO: 1504404 - RNA, 21 nt, Human
gguuacccaguuagcucucaa

SEQ ID NO: 1504405 - RNA, 13 nt, Human
gguugagguuuca

SEQ ID NO: 1504406 - RNA, 13 nt, Human
gguucaaagauau

SEQ ID NO: 1504407 - RNA, 21 nt, Human
gguucaaagauauuuugcuuu

SEQ ID NO: 1504408 - RNA, 16 nt, Human
gguggugaccucugcc

SEQ ID NO: 1504409 - RNA, 14 nt, Human
gguggugaccucug

SEQ ID NO: 1504410 - RNA, 15 nt, Human
gguggugaccucugc

SEQ ID NO: 1504411 - RNA, 12 nt, Human
gguggcuggguu

SEQ ID NO: 1504412 - RNA, 17 nt, Human
ggugucaagagggucug

SEQ ID NO: 1504413 - RNA, 19 nt, Human
ggugucaagagggucugag

SEQ ID NO: 1504414 - RNA, 19 nt, Human
ggugucaccugaagacuca

SEQ ID NO: 1504415 - RNA, 18 nt, Human
ggugguuucagaaaugug

SEQ ID NO: 1504416 - RNA, 17 nt, Human
ggugguuucagaaaugu

SEQ ID NO: 1504417 - RNA, 21 nt, Human
ggugguuauggagaggguguc

SEQ ID NO: 1504418 - RNA, 18 nt, Human
ggugguuuucuguucuuu

SEQ ID NO: 1504419 - RNA, 15 nt, Human
ggugguuuucuguuc

SEQ ID NO: 1504420 - RNA, 21 nt, Human
gguggugucuccaacccccca

SEQ ID NO: 1504421 - RNA, 17 nt, Human
ggucccaccccacacac

SEQ ID NO: 1504422 - RNA, 22 nt, Human
ggucccaccccacacacgccag

SEQ ID NO: 1504423 - RNA, 21 nt, Human
ggucucacuauguugcccagg

SEQ ID NO: 1504424 - RNA, 22 nt, Human
ggucucacucugucgcccaguc

SEQ ID NO: 1504425 - RNA, 23 nt, Human
ggucucacucugucgcccagucu

SEQ ID NO: 1504426 - RNA, 22 nt, Human
ggugaccagcaccaucucuccu

SEQ ID NO: 1504427 - RNA, 14 nt, Human
ggucugacccacug

SEQ ID NO: 1504428 - RNA, 15 nt, Human
ggugagaagcagagg

SEQ ID NO: 1504429 - RNA, 16 nt, Human
ggugagaggggaacag

SEQ ID NO: 1504430 - RNA, 15 nt, Human
ggugcgaucuggguu

SEQ ID NO: 1504431 - RNA, 23 nt, Human
ggugcuacaaaaacacagcaagg

SEQ ID NO: 1504432 - RNA, 16 nt, Human
ggugcuaucuccccca

SEQ ID NO: 1504433 - RNA, 17 nt, Human
ggugcuaucucccccag

SEQ ID NO: 1504434 - RNA, 19 nt, Human
ggugcuaucucccccagcc

SEQ ID NO: 1504435 - RNA, 20 nt, Human
ggugcuaucucccccagccc

SEQ ID NO: 1504436 - RNA, 15 nt, Human
ggugcugccauccag

SEQ ID NO: 1504437 - RNA, 21 nt, Human
ggugcuaucucccccagcccc

SEQ ID NO: 1504438 - RNA, 21 nt, Human
ggugcugccauccagguucag

SEQ ID NO: 1504439 - RNA, 19 nt, Human
gguggcagugggagcugcc

SEQ ID NO: 1504440 - RNA, 22 nt, Human
gguggcagugggagcugccugu

SEQ ID NO: 1504441 - RNA, 23 nt, Human
gguggccucccaacucaccccag

SEQ ID NO: 1504442 - RNA, 22 nt, Human
gguggccucccaacucacccca

SEQ ID NO: 1504443 - RNA, 17 nt, Human
gggguggggaccucagg

SEQ ID NO: 1504444 - RNA, 17 nt, Human
gggggaucacagccucu

SEQ ID NO: 1504445 - RNA, 22 nt, Human
ggggugcggcggucccagcucc

SEQ ID NO: 1504446 - RNA, 12 nt, Human
gggguggccucc

SEQ ID NO: 1504447 - RNA, 22 nt, Human
gggggaggugggauccuccagg

SEQ ID NO: 1504448 - RNA, 23 nt, Human
ggggcugcaccggcuggccuggc

SEQ ID NO: 1504449 - RNA, 19 nt, Human
ggggcugaggugggaggau

SEQ ID NO: 1504450 - RNA, 12 nt, Human
ggggcugcaccg

SEQ ID NO: 1504451 - RNA, 21 nt, Human
ggggcugcaccggcuggccug

SEQ ID NO: 1504452 - RNA, 22 nt, Human
ggggcugcaccggcuggccugg

SEQ ID NO: 1504453 - RNA, 17 nt, Human
ggguaagugagagaggg

SEQ ID NO: 1504454 - RNA, 14 nt, Human
gggucucacucugu

SEQ ID NO: 1504455 - RNA, 12 nt, Human
gggucugaggaa

SEQ ID NO: 1504456 - RNA, 21 nt, Human
gggucugaggaauccagaccc

SEQ ID NO: 1504457 - RNA, 17 nt, Human
ggggcugaggugggagg

SEQ ID NO: 1504458 - RNA, 14 nt, Human
ggggcucuucucau

SEQ ID NO: 1504459 - RNA, 16 nt, Human
ggggcaacccugguga

SEQ ID NO: 1504460 - RNA, 16 nt, Human
ggggaaaaucagccug

SEQ ID NO: 1504461 - RNA, 17 nt, Human
ggggaaaaucagccugc

SEQ ID NO: 1504462 - RNA, 19 nt, Human
ggggaaaaucagccugcuc

SEQ ID NO: 1504463 - RNA, 21 nt, Human
ggggaaaaucagccugcucca

SEQ ID NO: 1504464 - RNA, 24 nt, Human
ggggaaaaucagccugcuccagcu

SEQ ID NO: 1504465 - RNA, 22 nt, Human
ggguucaagcgauucuucugcu

SEQ ID NO: 1504466 - RNA, 23 nt, Human
ggguucaagcgauucuucugcuu

SEQ ID NO: 1504467 - RNA, 16 nt, Human
ggguuggccccugccc

SEQ ID NO: 1504468 - RNA, 21 nt, Human
ggguuggagcaguagcuggag

SEQ ID NO: 1504469 - RNA, 17 nt, Human
ggguucuacccaggugc

SEQ ID NO: 1504470 - RNA, 12 nt, Human
ggguucuaccca

SEQ ID NO: 1504471 - RNA, 17 nt, Human
gggugaagugaagacaa

SEQ ID NO: 1504472 - RNA, 19 nt, Human
gggugacagagcaagugag

SEQ ID NO: 1504473 - RNA, 21 nt, Human
gggugcggcggucccagcucc

SEQ ID NO: 1504474 - RNA, 18 nt, Human
gguagcauuuguguugaa

SEQ ID NO: 1504475 - RNA, 11 nt, Human
gguagaacaca

SEQ ID NO: 1504476 - RNA, 23 nt, Human
gguagaaauaucugaaaauguau

SEQ ID NO: 1504477 - RNA, 22 nt, Human
gguagaagcccuucuaccuucc

SEQ ID NO: 1504478 - RNA, 11 nt, Human
gguacccacug

SEQ ID NO: 1504479 - RNA, 16 nt, Human
gguacccacugcucug

SEQ ID NO: 1504480 - RNA, 13 nt, Human
gguacccacugcu

SEQ ID NO: 1504481 - RNA, 20 nt, Human
gguacuuguggacacagcuc

SEQ ID NO: 1504482 - RNA, 22 nt, Human
gguagaaauaucugaaaaugua

SEQ ID NO: 1504483 - RNA, 16 nt, Human
gguacuuguggacaca

SEQ ID NO: 1504484 - RNA, 17 nt, Human
gguacuuguggacacag

SEQ ID NO: 1504485 - RNA, 19 nt, Human
ggucaccagacggggcugg

SEQ ID NO: 1504486 - RNA, 12 nt, Human
ggucacucuggc

SEQ ID NO: 1504487 - RNA, 15 nt, Human
ggucccaccccacac

SEQ ID NO: 1504488 - RNA, 16 nt, Human
ggucccaccccacaca

SEQ ID NO: 1504489 - RNA, 11 nt, Human
ggucagagccu

SEQ ID NO: 1504490 - RNA, 13 nt, Human
gggcccugccucc

SEQ ID NO: 1504491 - RNA, 13 nt, Human
gggccuggccuga

SEQ ID NO: 1504492 - RNA, 19 nt, Human
gggccuggccugagcuggg

SEQ ID NO: 1504493 - RNA, 14 nt, Human
gggccuggccugag

SEQ ID NO: 1504494 - RNA, 18 nt, Human
gggccuggccugagcugg

SEQ ID NO: 1504495 - RNA, 13 nt, Human
gggccuggcuccc

SEQ ID NO: 1504496 - RNA, 20 nt, Human
gggcagugguguggagaagc

SEQ ID NO: 1504497 - RNA, 18 nt, Human
gggcagugggucccagau

SEQ ID NO: 1504498 - RNA, 12 nt, Human
gggcaugacacg

SEQ ID NO: 1504499 - RNA, 23 nt, Human
gggccacagagaaaguacuucuc

SEQ ID NO: 1504500 - RNA, 16 nt, Human
gggccacagagaaagu

SEQ ID NO: 1504501 - RNA, 17 nt, Human
gggcccagagagggugg

SEQ ID NO: 1504502 - RNA, 23 nt, Human
gggauccuggaguucugguuccu

SEQ ID NO: 1504503 - RNA, 18 nt, Human
gggcaacccuggugacca

SEQ ID NO: 1504504 - RNA, 15 nt, Human
gggauccuccaggug

SEQ ID NO: 1504505 - RNA, 16 nt, Human
gggauccuccaggugc

SEQ ID NO: 1504506 - RNA, 21 nt, Human
gggauaugauuuaaaucagcc

SEQ ID NO: 1504507 - RNA, 13 nt, Human
gggauagagagag

SEQ ID NO: 1504508 - RNA, 17 nt, Human
gggaggugggauccucc

SEQ ID NO: 1504509 - RNA, 16 nt, Human
gggaggugaccccagg

SEQ ID NO: 1504510 - RNA, 18 nt, Human
gggagugacagaggcagc

SEQ ID NO: 1504511 - RNA, 11 nt, Human
gggagugagcu

SEQ ID NO: 1504512 - RNA, 14 nt, Human
gggagugagcuggu

SEQ ID NO: 1504513 - RNA, 17 nt, Human
gggcagguugguggggg

SEQ ID NO: 1504514 - RNA, 11 nt, Human
gggcagagcag

SEQ ID NO: 1504515 - RNA, 12 nt, Human
gggcagagcaga

SEQ ID NO: 1504516 - RNA, 20 nt, Human
gggcacucagaagacacuga

SEQ ID NO: 1504517 - RNA, 14 nt, Human
gggcagaaggaaga

SEQ ID NO: 1504518 - RNA, 18 nt, Human
gggcagaaggaagacuuc

SEQ ID NO: 1504519 - RNA, 16 nt, Human
gggcacucagaagaca

SEQ ID NO: 1504520 - RNA, 19 nt, Human
gggcacucagaagacacug

SEQ ID NO: 1504521 - RNA, 13 nt, Human
gggcacagggucu

SEQ ID NO: 1504522 - RNA, 16 nt, Human
gggcacagggucucua

SEQ ID NO: 1504523 - RNA, 23 nt, Human
gggcacaccgggcacucagaaga

SEQ ID NO: 1504524 - RNA, 18 nt, Human
gggcacagaaaauggaag

SEQ ID NO: 1504525 - RNA, 20 nt, Human
gggcacagaaaauggaagac

SEQ ID NO: 1504526 - RNA, 21 nt, Human
gggcacagaaaauggaagaca

SEQ ID NO: 1504527 - RNA, 13 nt, Human
gggaaugaagaua

SEQ ID NO: 1504528 - RNA, 16 nt, Human
gggaauggcacagccc

SEQ ID NO: 1504529 - RNA, 22 nt, Human
gggaauggcacagcccaaagaa

SEQ ID NO: 1504530 - RNA, 17 nt, Human
gggaagggggcugggac

SEQ ID NO: 1504531 - RNA, 14 nt, Human
gggaagggggcugg

SEQ ID NO: 1504532 - RNA, 16 nt, Human
gggaagggggcuggga

SEQ ID NO: 1504533 - RNA, 23 nt, Human
gggaaggauacaaaagcauguga

SEQ ID NO: 1504534 - RNA, 21 nt, Human
gggaaggauacaaaagcaugu

SEQ ID NO: 1504535 - RNA, 14 nt, Human
ggcuuuugugcauu

SEQ ID NO: 1504536 - RNA, 17 nt, Human
gggacuacaggcaccca

SEQ ID NO: 1504537 - RNA, 16 nt, Human
gggacucaaugcacug

SEQ ID NO: 1504538 - RNA, 12 nt, Human
gggaccucaggc

SEQ ID NO: 1504539 - RNA, 13 nt, Human
gggaccucaggcc

SEQ ID NO: 1504540 - RNA, 15 nt, Human
gggaccucaggccug

SEQ ID NO: 1504541 - RNA, 22 nt, Human
ggcuugaguuuaaauuguaaua

SEQ ID NO: 1504542 - RNA, 21 nt, Human
ggcuuggggaccagagcugcc

SEQ ID NO: 1504543 - RNA, 10 nt, Human
ggcuuuugug

SEQ ID NO: 1504544 - RNA, 18 nt, Human
ggcugggcuucaguggca

SEQ ID NO: 1504545 - RNA, 13 nt, Human
ggcugggcuucag

SEQ ID NO: 1504546 - RNA, 17 nt, Human
ggcugggcuucaguggc

SEQ ID NO: 1504547 - RNA, 17 nt, Human
ggcugggcucccuuccc

SEQ ID NO: 1504548 - RNA, 18 nt, Human
ggcugggcucccuuccca

SEQ ID NO: 1504549 - RNA, 12 nt, Human
ggcugggcuuca

SEQ ID NO: 1504550 - RNA, 21 nt, Human
ggcuuagucacugagacagcc

SEQ ID NO: 1504551 - RNA, 11 nt, Human
ggcugcuucaa

SEQ ID NO: 1504552 - RNA, 12 nt, Human
ggcugcuucaag

SEQ ID NO: 1504553 - RNA, 14 nt, Human
ggcugcuucaagga

SEQ ID NO: 1504554 - RNA, 22 nt, Human
ggcugcuucaaggauccugagc

SEQ ID NO: 1504555 - RNA, 12 nt, Human
ggcugcagggag

SEQ ID NO: 1504556 - RNA, 13 nt, Human
ggcugcagggagu

SEQ ID NO: 1504557 - RNA, 14 nt, Human
ggcugcugaaggcu

SEQ ID NO: 1504558 - RNA, 17 nt, Human
ggcugcagggaguccga

SEQ ID NO: 1504559 - RNA, 18 nt, Human
ggcugcugaaggcucgag

SEQ ID NO: 1504560 - RNA, 15 nt, Human
ggcugcugaaggcuc

SEQ ID NO: 1504561 - RNA, 17 nt, Human
ggcugcugaaggcucga

SEQ ID NO: 1504562 - RNA, 15 nt, Human
ggcugggcagaggaa

SEQ ID NO: 1504563 - RNA, 19 nt, Human
ggcugggcagaggaaagca

SEQ ID NO: 1504564 - RNA, 13 nt, Human
ggcugggcagagg

SEQ ID NO: 1504565 - RNA, 14 nt, Human
ggcugggcagagga

SEQ ID NO: 1504566 - RNA, 20 nt, Human
ggcugggagagccuuccagg

SEQ ID NO: 1504567 - RNA, 23 nt, Human
ggcugggagagccuuccaggggu

SEQ ID NO: 1504568 - RNA, 19 nt, Human
ggcugggagagccuuccag

SEQ ID NO: 1504569 - RNA, 23 nt, Human
ggcugcuucaaggauccugagcc

SEQ ID NO: 1504570 - RNA, 20 nt, Human
ggccccugcccggcugcgga

SEQ ID NO: 1504571 - RNA, 16 nt, Human
ggccccugcccggcug

SEQ ID NO: 1504572 - RNA, 17 nt, Human
ggccccugcccggcugc

SEQ ID NO: 1504573 - RNA, 13 nt, Human
ggcugagguggga

SEQ ID NO: 1504574 - RNA, 15 nt, Human
ggcugaggugggagg

SEQ ID NO: 1504575 - RNA, 11 nt, Human
ggcugagccug

SEQ ID NO: 1504576 - RNA, 24 nt, Human
ggcugcaaaggguaucaggugcug

SEQ ID NO: 1504577 - RNA, 17 nt, Human
ggcugcaccggcuggcc

SEQ ID NO: 1504578 - RNA, 18 nt, Human
ggcugcaccggcuggccu

SEQ ID NO: 1504579 - RNA, 19 nt, Human
ggcugcaccggcuggccug

SEQ ID NO: 1504580 - RNA, 18 nt, Human
ggcugcaaaggguaucag

SEQ ID NO: 1504581 - RNA, 22 nt, Human
ggcugcaaaggguaucaggugc

SEQ ID NO: 1504582 - RNA, 23 nt, Human
ggcugcaaaggguaucaggugcu

SEQ ID NO: 1504583 - RNA, 14 nt, Human
ggccaggccagagg

SEQ ID NO: 1504584 - RNA, 16 nt, Human
ggccaggccagaggga

SEQ ID NO: 1504585 - RNA, 11 nt, Human
ggccaggcugg

SEQ ID NO: 1504586 - RNA, 16 nt, Human
ggccaggagccuccug

SEQ ID NO: 1504587 - RNA, 16 nt, Human
ggccacugugaagaga

SEQ ID NO: 1504588 - RNA, 14 nt, Human
ggccaggagccucc

SEQ ID NO: 1504589 - RNA, 11 nt, Human
ggccacuguga

SEQ ID NO: 1504590 - RNA, 17 nt, Human
ggcagguuggugggggc

SEQ ID NO: 1504591 - RNA, 15 nt, Human
ggcagguuggugggg

SEQ ID NO: 1504592 - RNA, 23 nt, Human
ggcauguucucugaggacacuaa

SEQ ID NO: 1504593 - RNA, 16 nt, Human
ggccaccugcggugcu

SEQ ID NO: 1504594 - RNA, 22 nt, Human
ggccaccugcggugcuaucucc

SEQ ID NO: 1504595 - RNA, 16 nt, Human
ggcauuccccaggagg

SEQ ID NO: 1504596 - RNA, 15 nt, Human
ggcauuccccaggag

SEQ ID NO: 1504597 - RNA, 16 nt, Human
ggccacaagacccuug

SEQ ID NO: 1504598 - RNA, 17 nt, Human
ggccacaagacccuugu

SEQ ID NO: 1504599 - RNA, 12 nt, Human
ggccaggcuggu

SEQ ID NO: 1504600 - RNA, 22 nt, Human
ggccaugggacagggaggacgc

SEQ ID NO: 1504601 - RNA, 13 nt, Human
ggccaugggccuc

SEQ ID NO: 1504602 - RNA, 16 nt, Human
ggccccucaggguccc

SEQ ID NO: 1504603 - RNA, 19 nt, Human
ggccccucagggucccugg

SEQ ID NO: 1504604 - RNA, 20 nt, Human
ggccccucagggucccuggu

SEQ ID NO: 1504605 - RNA, 21 nt, Human
ggccccucagggucccuggug

SEQ ID NO: 1504606 - RNA, 17 nt, Human
ggccccugccacccugg

SEQ ID NO: 1504607 - RNA, 18 nt, Human
ggccccugccacccuggg

SEQ ID NO: 1504608 - RNA, 13 nt, Human
ggccccugcccgg

SEQ ID NO: 1504609 - RNA, 13 nt, Human
ggccccugccacc

SEQ ID NO: 1504610 - RNA, 16 nt, Human
ggccccugccacccug

SEQ ID NO: 1504611 - RNA, 12 nt, Human
ggccccugccac

SEQ ID NO: 1504612 - RNA, 21 nt, Human
ggaucagucugauucccaagc

SEQ ID NO: 1504613 - RNA, 18 nt, Human
ggcaacugcauuggcuuu

SEQ ID NO: 1504614 - RNA, 19 nt, Human
ggcaacugcauuggcuuug

SEQ ID NO: 1504615 - RNA, 16 nt, Human
ggcaaggcugucaauu

SEQ ID NO: 1504616 - RNA, 17 nt, Human
ggcacccggccccugcu

SEQ ID NO: 1504617 - RNA, 15 nt, Human
ggcacccggccccug

SEQ ID NO: 1504618 - RNA, 16 nt, Human
ggcacccggccccugc

SEQ ID NO: 1504619 - RNA, 22 nt, Human
ggcagagcagagaccaucccug

SEQ ID NO: 1504620 - RNA, 20 nt, Human
ggcagagcagagaccauccc

SEQ ID NO: 1504621 - RNA, 15 nt, Human
ggcagagcagagacc

SEQ ID NO: 1504622 - RNA, 16 nt, Human
ggcagagcagagacca

SEQ ID NO: 1504623 - RNA, 18 nt, Human
ggcagcagaagggggugg

SEQ ID NO: 1504624 - RNA, 17 nt, Human
ggcagaggaaagcaaag

SEQ ID NO: 1504625 - RNA, 23 nt, Human
ggcagaguugaagacagagcuac

SEQ ID NO: 1504626 - RNA, 23 nt, Human
ggcagauacaggaaaagcugcug

SEQ ID NO: 1504627 - RNA, 13 nt, Human
ggcagguccaggg

SEQ ID NO: 1504628 - RNA, 23 nt, Human
ggcaggucuugaacuccuggccu

SEQ ID NO: 1504629 - RNA, 21 nt, Human
ggcagcugcgguccacccagg

SEQ ID NO: 1504630 - RNA, 21 nt, Human
ggcagcuugaggguugggcug

SEQ ID NO: 1504631 - RNA, 19 nt, Human
ggcagcugcgguccaccca

SEQ ID NO: 1504632 - RNA, 13 nt, Human
ggcagcucagaga

SEQ ID NO: 1504633 - RNA, 22 nt, Human
ggcagcucaccucucccuugga

SEQ ID NO: 1504634 - RNA, 18 nt, Human
ggcagcucaccucucccu

SEQ ID NO: 1504635 - RNA, 21 nt, Human
ggcagcucaccucucccuugg

SEQ ID NO: 1504636 - RNA, 20 nt, Human
ggaggacgcucucuggccuu

SEQ ID NO: 1504637 - RNA, 21 nt, Human
ggaggacgcucucuggccuuc

SEQ ID NO: 1504638 - RNA, 22 nt, Human
ggagccgaagcccaggggccgg

SEQ ID NO: 1504639 - RNA, 15 nt, Human
ggagccgaagcccag

SEQ ID NO: 1504640 - RNA, 17 nt, Human
ggagccgaagcccaggg

SEQ ID NO: 1504641 - RNA, 19 nt, Human
ggagccgaagcccaggggc

SEQ ID NO: 1504642 - RNA, 12 nt, Human
ggagggcuccag

SEQ ID NO: 1504643 - RNA, 13 nt, Human
ggagggcuccaga

SEQ ID NO: 1504644 - RNA, 12 nt, Human
ggagggagggcu

SEQ ID NO: 1504645 - RNA, 16 nt, Human
ggagggcagcagaagg

SEQ ID NO: 1504646 - RNA, 15 nt, Human
ggaggauguucuggg

SEQ ID NO: 1504647 - RNA, 23 nt, Human
ggaggaucacuugaguccagaag

SEQ ID NO: 1504648 - RNA, 17 nt, Human
ggaggaucucuugagcc

SEQ ID NO: 1504649 - RNA, 21 nt, Human
ggaggaucucuugagccuggg

SEQ ID NO: 1504650 - RNA, 11 nt, Human
ggagugacaga

SEQ ID NO: 1504651 - RNA, 16 nt, Human
ggagugacagaggcag

SEQ ID NO: 1504652 - RNA, 20 nt, Human
ggagucccaccuuggcugca

SEQ ID NO: 1504653 - RNA, 21 nt, Human
ggagucccaccuuggcugcag

SEQ ID NO: 1504654 - RNA, 17 nt, Human
ggagggcuccagacaca

SEQ ID NO: 1504655 - RNA, 14 nt, Human
ggagggcuccagac

SEQ ID NO: 1504656 - RNA, 15 nt, Human
ggagggcuccagaca

SEQ ID NO: 1504657 - RNA, 19 nt, Human
ggaggggagcaugggaagu

SEQ ID NO: 1504658 - RNA, 16 nt, Human
ggaucacagccucuga

SEQ ID NO: 1504659 - RNA, 23 nt, Human
ggagugaguugauagcacagacc

SEQ ID NO: 1504660 - RNA, 17 nt, Human
ggagugacagaggcagc

SEQ ID NO: 1504661 - RNA, 18 nt, Human
ggagugacagaggcagcc

SEQ ID NO: 1504662 - RNA, 19 nt, Human
ggagugacagaggcagccc

SEQ ID NO: 1504663 - RNA, 21 nt, Human
ggagugacagaggcagcccca

SEQ ID NO: 1504664 - RNA, 12 nt, Human
ggagugagcugg

SEQ ID NO: 1504665 - RNA, 14 nt, Human
ggagugagcugguu

SEQ ID NO: 1504666 - RNA, 21 nt, Human
ggagugaguugauagcacaga

SEQ ID NO: 1504667 - RNA, 20 nt, Human
ggaagccagcaggcucucag

SEQ ID NO: 1504668 - RNA, 20 nt, Human
ggagcaaaaucgaugcagug

SEQ ID NO: 1504669 - RNA, 20 nt, Human
ggagauuuacaacuggggga

SEQ ID NO: 1504670 - RNA, 15 nt, Human
ggagaggggcacagg

SEQ ID NO: 1504671 - RNA, 23 nt, Human
ggacugggccacuucuggguggg

SEQ ID NO: 1504672 - RNA, 21 nt, Human
ggagagcuagcagcagggagg

SEQ ID NO: 1504673 - RNA, 13 nt, Human
ggaagagccuugc

SEQ ID NO: 1504674 - RNA, 17 nt, Human
ggaagcacagcuucauu

SEQ ID NO: 1504675 - RNA, 13 nt, Human
ggaagcacaugcc

SEQ ID NO: 1504676 - RNA, 14 nt, Human
ggaagcacaugccu

SEQ ID NO: 1504677 - RNA, 15 nt, Human
ggaagcacaugccuc

SEQ ID NO: 1504678 - RNA, 17 nt, Human
ggaagcacaugccucuc

SEQ ID NO: 1504679 - RNA, 13 nt, Human
ggaagccagcagg

SEQ ID NO: 1504680 - RNA, 14 nt, Human
ggaagccagcaggc

SEQ ID NO: 1504681 - RNA, 15 nt, Human
ggaagccagcaggcu

SEQ ID NO: 1504682 - RNA, 16 nt, Human
ggaagccagcaggcuc

SEQ ID NO: 1504683 - RNA, 17 nt, Human
ggaagccagcaggcucu

SEQ ID NO: 1504684 - RNA, 18 nt, Human
ggaagccagcaggcucuc

SEQ ID NO: 1504685 - RNA, 23 nt, Human
ggaagcacaugccucucucaggc

SEQ ID NO: 1504686 - RNA, 21 nt, Human
ggaagcacaugccucucucag

SEQ ID NO: 1504687 - RNA, 22 nt, Human
ggaagcacaugccucucucagg

SEQ ID NO: 1504688 - RNA, 12 nt, Human
ggaaauauuuau

SEQ ID NO: 1504689 - RNA, 13 nt, Human
ggaaauauuuauu

SEQ ID NO: 1504690 - RNA, 15 nt, Human
ggaaauauuuauuuu

SEQ ID NO: 1504691 - RNA, 17 nt, Human
ggaaauauuuauuuuaa

SEQ ID NO: 1504692 - RNA, 18 nt, Human
ggaaauauuuauuuuaau

SEQ ID NO: 1504693 - RNA, 15 nt, Human
ggaaaaucagccugc

SEQ ID NO: 1504694 - RNA, 14 nt, Human
ggaaaauaaauuau

SEQ ID NO: 1504695 - RNA, 16 nt, Human
ggaaaucaaauaugca

SEQ ID NO: 1504696 - RNA, 19 nt, Human
ggaacagacuggaagcaca

SEQ ID NO: 1504697 - RNA, 20 nt, Human
ggaacagacuggaagcacag

SEQ ID NO: 1504698 - RNA, 20 nt, Human
ggaaaaaauaacaaugaaag

SEQ ID NO: 1504699 - RNA, 14 nt, Human
gcuuuuacuuaaac

SEQ ID NO: 1504700 - RNA, 13 nt, Human
ggaaaaauagccu

SEQ ID NO: 1504701 - RNA, 14 nt, Human
ggaaaaacugauuu

SEQ ID NO: 1504702 - RNA, 15 nt, Human
ggaaaaauagccugc

SEQ ID NO: 1504703 - RNA, 22 nt, Human
gcuuccagugaggcucugcccu

SEQ ID NO: 1504704 - RNA, 17 nt, Human
gcuucucacugccaugc

SEQ ID NO: 1504705 - RNA, 21 nt, Human
gcuuccagugaggcucugccc

SEQ ID NO: 1504706 - RNA, 19 nt, Human
gcuuccagugaggcucugc

SEQ ID NO: 1504707 - RNA, 20 nt, Human
gcuuccagugaggcucugcc

SEQ ID NO: 1504708 - RNA, 13 nt, Human
gcuguucagcugg

SEQ ID NO: 1504709 - RNA, 23 nt, Human
gcuguucacagccagacuggcac

SEQ ID NO: 1504710 - RNA, 15 nt, Human
gcuguucacagccag

SEQ ID NO: 1504711 - RNA, 16 nt, Human
gcuguucacagccaga

SEQ ID NO: 1504712 - RNA, 18 nt, Human
gcuugcccuguuaaaaga

SEQ ID NO: 1504713 - RNA, 13 nt, Human
gcuuggaggaagg

SEQ ID NO: 1504714 - RNA, 14 nt, Human
gcuuggaggaagga

SEQ ID NO: 1504715 - RNA, 15 nt, Human
gcuuggaggaaggaa

SEQ ID NO: 1504716 - RNA, 17 nt, Human
gcuugcccuggugccuc

SEQ ID NO: 1504717 - RNA, 19 nt, Human
gcuugcccuggugccucac

SEQ ID NO: 1504718 - RNA, 18 nt, Human
gcugggcuucaguggcag

SEQ ID NO: 1504719 - RNA, 19 nt, Human
gcugggcuucaguggcagc

SEQ ID NO: 1504720 - RNA, 12 nt, Human
gcuggggccagu

SEQ ID NO: 1504721 - RNA, 23 nt, Human
gcugggggaagaagcucucuccu

SEQ ID NO: 1504722 - RNA, 13 nt, Human
gcugggggccuca

SEQ ID NO: 1504723 - RNA, 15 nt, Human
gcuggucccacucag

SEQ ID NO: 1504724 - RNA, 19 nt, Human
gcuggucccacucagucca

SEQ ID NO: 1504725 - RNA, 19 nt, Human
gcugggggccucagugcca

SEQ ID NO: 1504726 - RNA, 20 nt, Human
gcugggggccucagugccac

SEQ ID NO: 1504727 - RNA, 17 nt, Human
gcugggcuucaguggca

SEQ ID NO: 1504728 - RNA, 19 nt, Human
gcugggagagccuuccagg

SEQ ID NO: 1504729 - RNA, 22 nt, Human
gcugggagagccuuccaggggu

SEQ ID NO: 1504730 - RNA, 12 nt, Human
gcugggagagcc

SEQ ID NO: 1504731 - RNA, 13 nt, Human
gcugggagagccu

SEQ ID NO: 1504732 - RNA, 17 nt, Human
gcugggagagccuucca

SEQ ID NO: 1504733 - RNA, 18 nt, Human
gcugggagagccuuccag

SEQ ID NO: 1504734 - RNA, 22 nt, Human
gcuguauuuuaaaagaaugauu

SEQ ID NO: 1504735 - RNA, 22 nt, Human
gcugguucaggguuggccccug

SEQ ID NO: 1504736 - RNA, 16 nt, Human
gcugucaauuacagga

SEQ ID NO: 1504737 - RNA, 21 nt, Human
gcugguuagagguucccuuug

SEQ ID NO: 1504738 - RNA, 15 nt, Human
gcugguucaggguug

SEQ ID NO: 1504739 - RNA, 20 nt, Human
gcuggucccacucaguccau

SEQ ID NO: 1504740 - RNA, 18 nt, Human
gcuggugucaccugaaga

SEQ ID NO: 1504741 - RNA, 19 nt, Human
gcugucccuuacgugaguc

SEQ ID NO: 1504742 - RNA, 22 nt, Human
gcugucccuuacgugaguccug

SEQ ID NO: 1504743 - RNA, 21 nt, Human
gcugucccuuacgugaguccu

SEQ ID NO: 1504744 - RNA, 17 nt, Human
gcugucaauuacaggaa

SEQ ID NO: 1504745 - RNA, 19 nt, Human
gcugucaauuacaggaagu

SEQ ID NO: 1504746 - RNA, 22 nt, Human
gcugucaauuacaggaaguacu

SEQ ID NO: 1504747 - RNA, 23 nt, Human
gcugucaauuacaggaaguacug

SEQ ID NO: 1504748 - RNA, 18 nt, Human
gcuagauguauguacuuc

SEQ ID NO: 1504749 - RNA, 11 nt, Human
gcugcccugug

SEQ ID NO: 1504750 - RNA, 22 nt, Human
gcuagcagcagggagggcuucu

SEQ ID NO: 1504751 - RNA, 12 nt, Human
gcugcccuguga

SEQ ID NO: 1504752 - RNA, 14 nt, Human
gcugcccugugagu

SEQ ID NO: 1504753 - RNA, 13 nt, Human
gcugcuucaagga

SEQ ID NO: 1504754 - RNA, 19 nt, Human
gcugcgguccacccaggag

SEQ ID NO: 1504755 - RNA, 17 nt, Human
gcugcgguccacccagg

SEQ ID NO: 1504756 - RNA, 18 nt, Human
gcugcgguccacccagga

SEQ ID NO: 1504757 - RNA, 23 nt, Human
gcugcuucaaggauccugagcca

SEQ ID NO: 1504758 - RNA, 21 nt, Human
gcugcuucaaggauccugagc

SEQ ID NO: 1504759 - RNA, 22 nt, Human
gcugcuucaaggauccugagcc

SEQ ID NO: 1504760 - RNA, 16 nt, Human
gcugcuugggcuucau

SEQ ID NO: 1504761 - RNA, 12 nt, Human
gcuggccuggcc

SEQ ID NO: 1504762 - RNA, 20 nt, Human
gcugggacaugggaaagggg

SEQ ID NO: 1504763 - RNA, 19 nt, Human
gcugggacuacagguguga

SEQ ID NO: 1504764 - RNA, 13 nt, Human
gcugggacuacag

SEQ ID NO: 1504765 - RNA, 18 nt, Human
gcugggacuacaggcacc

SEQ ID NO: 1504766 - RNA, 19 nt, Human
gcugggacuacaggcaccc

SEQ ID NO: 1504767 - RNA, 20 nt, Human
gcugggacuacaggcaccca

SEQ ID NO: 1504768 - RNA, 18 nt, Human
gcuggaccuugaacuggg

SEQ ID NO: 1504769 - RNA, 17 nt, Human
gcugcuugggcuucauc

SEQ ID NO: 1504770 - RNA, 22 nt, Human
gcugcuugggcuucauccuccu

SEQ ID NO: 1504771 - RNA, 21 nt, Human
gcuggaccuugaacuggguac

SEQ ID NO: 1504772 - RNA, 22 nt, Human
gcuggaccuugaacuggguacu

SEQ ID NO: 1504773 - RNA, 19 nt, Human
gcccuucuuuccacagaag

SEQ ID NO: 1504774 - RNA, 13 nt, Human
gcccuucucucca

SEQ ID NO: 1504775 - RNA, 16 nt, Human
gccgagauagccaagg

SEQ ID NO: 1504776 - RNA, 17 nt, Human
gccgggcaggguguggg

SEQ ID NO: 1504777 - RNA, 19 nt, Human
gccgcagcccugcagaggg

SEQ ID NO: 1504778 - RNA, 17 nt, Human
gccgagauagccaaggc

SEQ ID NO: 1504779 - RNA, 19 nt, Human
gccgagauagccaaggcca

SEQ ID NO: 1504780 - RNA, 15 nt, Human
gccgcagcccugcag

SEQ ID NO: 1504781 - RNA, 16 nt, Human
gccgcagcccugcaga

SEQ ID NO: 1504782 - RNA, 17 nt, Human
gccgcagcccugcagag

SEQ ID NO: 1504783 - RNA, 24 nt, Human
gccucaagugauucuccugccuca

SEQ ID NO: 1504784 - RNA, 18 nt, Human
gccucagcauccuggcac

SEQ ID NO: 1504785 - RNA, 21 nt, Human
gccucagcauccuggcacccg

SEQ ID NO: 1504786 - RNA, 20 nt, Human
gccgucuaccugaggggccu

SEQ ID NO: 1504787 - RNA, 22 nt, Human
gccgucuaccugaggggccucu

SEQ ID NO: 1504788 - RNA, 23 nt, Human
gccgucuaccugaggggccucuu

SEQ ID NO: 1504789 - RNA, 15 nt, Human
gccucucccaucacu

SEQ ID NO: 1504790 - RNA, 12 nt, Human
gccucagccucc

SEQ ID NO: 1504791 - RNA, 14 nt, Human
gccucagccuccca

SEQ ID NO: 1504792 - RNA, 22 nt, Human
gccucagccucccaaagugcug

SEQ ID NO: 1504793 - RNA, 18 nt, Human
gccucccgaauagcuggg

SEQ ID NO: 1504794 - RNA, 19 nt, Human
gccucccgaauagcuggga

SEQ ID NO: 1504795 - RNA, 20 nt, Human
gccucccgaauagcugggac

SEQ ID NO: 1504796 - RNA, 21 nt, Human
gccucccgaauagcugggacu

SEQ ID NO: 1504797 - RNA, 21 nt, Human
gccucccgaguagcugggacu

SEQ ID NO: 1504798 - RNA, 23 nt, Human
gccucccgaguagcugggacuac

SEQ ID NO: 1504799 - RNA, 21 nt, Human
gccucugcacuccccugcugg

SEQ ID NO: 1504800 - RNA, 15 nt, Human
gccugaagucacaca

SEQ ID NO: 1504801 - RNA, 16 nt, Human
gccugagauuucaucu

SEQ ID NO: 1504802 - RNA, 18 nt, Human
gccugagauuucaucugc

SEQ ID NO: 1504803 - RNA, 22 nt, Human
gccugagauuucaucugcucuc

SEQ ID NO: 1504804 - RNA, 15 nt, Human
gccucugacacacag

SEQ ID NO: 1504805 - RNA, 16 nt, Human
gccucugacacacagc

SEQ ID NO: 1504806 - RNA, 16 nt, Human
gccucugcacuccccu

SEQ ID NO: 1504807 - RNA, 17 nt, Human
gccucugcacuccccug

SEQ ID NO: 1504808 - RNA, 18 nt, Human
gccucugcacuccccugc

SEQ ID NO: 1504809 - RNA, 19 nt, Human
gccucugcacuccccugcu

SEQ ID NO: 1504810 - RNA, 20 nt, Human
gccucugcacuccccugcug

SEQ ID NO: 1504811 - RNA, 11 nt, Human
gccugcccagg

SEQ ID NO: 1504812 - RNA, 12 nt, Human
gccugcccaggc

SEQ ID NO: 1504813 - RNA, 23 nt, Human
gccugagauuucaucugcucucc

SEQ ID NO: 1504814 - RNA, 13 nt, Human
gccugcaggaccu

SEQ ID NO: 1504815 - RNA, 17 nt, Human
gccugcaggaccucgug

SEQ ID NO: 1504816 - RNA, 18 nt, Human
gccugcaggaccucgugc

SEQ ID NO: 1504817 - RNA, 23 nt, Human
gccugcaggaccucgugccaccc

SEQ ID NO: 1504818 - RNA, 21 nt, Human
gcuaacuagcuuggaaacugg

SEQ ID NO: 1504819 - RNA, 14 nt, Human
gcgugagccacugc

SEQ ID NO: 1504820 - RNA, 16 nt, Human
gcgugagccacugcac

SEQ ID NO: 1504821 - RNA, 15 nt, Human
gcgugagccacugca

SEQ ID NO: 1504822 - RNA, 17 nt, Human
gcuaacauggaaguacu

SEQ ID NO: 1504823 - RNA, 18 nt, Human
gcuaacauggaaguacua

SEQ ID NO: 1504824 - RNA, 21 nt, Human
gcuagacgagcaggcuucuuc

SEQ ID NO: 1504825 - RNA, 22 nt, Human
gcuagacgagcaggcuucuucc

SEQ ID NO: 1504826 - RNA, 19 nt, Human
gcgcuccugccgcagagcu

SEQ ID NO: 1504827 - RNA, 20 nt, Human
gcgcuccugccgcagagcug

SEQ ID NO: 1504828 - RNA, 21 nt, Human
gcgcuccugccgcagagcugg

SEQ ID NO: 1504829 - RNA, 20 nt, Human
gcgccuacaggagugagcac

SEQ ID NO: 1504830 - RNA, 21 nt, Human
gcgccuacaggagugagcacu

SEQ ID NO: 1504831 - RNA, 14 nt, Human
gcgcugccccuggc

SEQ ID NO: 1504832 - RNA, 17 nt, Human
gcgcugccccuggcagc

SEQ ID NO: 1504833 - RNA, 13 nt, Human
gcggucccagcuc

SEQ ID NO: 1504834 - RNA, 23 nt, Human
gcgguccacccaggagccccgag

SEQ ID NO: 1504835 - RNA, 23 nt, Human
gcggggacagcuccuucuguccu

SEQ ID NO: 1504836 - RNA, 14 nt, Human
gcggucccagcucc

SEQ ID NO: 1504837 - RNA, 18 nt, Human
gcggucccagcucccugg

SEQ ID NO: 1504838 - RNA, 22 nt, Human
gcggucccagcucccuggcucc

SEQ ID NO: 1504839 - RNA, 19 nt, Human
gcggaaugaaccacaucuu

SEQ ID NO: 1504840 - RNA, 19 nt, Human
gcggacagccacggccagg

SEQ ID NO: 1504841 - RNA, 23 nt, Human
gcggacagccacggccaggccag

SEQ ID NO: 1504842 - RNA, 19 nt, Human
gcggggacagcuccuucug

SEQ ID NO: 1504843 - RNA, 18 nt, Human
gccuuggggcugaugcag

SEQ ID NO: 1504844 - RNA, 19 nt, Human
gccuucggccuccauccug

SEQ ID NO: 1504845 - RNA, 18 nt, Human
gccuucggccuccauccu

SEQ ID NO: 1504846 - RNA, 16 nt, Human
gccuuuuauuucuuaa

SEQ ID NO: 1504847 - RNA, 23 nt, Human
gccuuauggaacacucugagacu

SEQ ID NO: 1504848 - RNA, 21 nt, Human
gccuuauggaacacucugaga

SEQ ID NO: 1504849 - RNA, 22 nt, Human
gccuuauggaacacucugagac

SEQ ID NO: 1504850 - RNA, 18 nt, Human
gccuguaaucacagcuac

SEQ ID NO: 1504851 - RNA, 16 nt, Human
gccugguggcagcugc

SEQ ID NO: 1504852 - RNA, 17 nt, Human
gccugguggcagcugcg

SEQ ID NO: 1504853 - RNA, 15 nt, Human
gccugguggcagcug

SEQ ID NO: 1504854 - RNA, 16 nt, Human
gccccagugcccacag

SEQ ID NO: 1504855 - RNA, 17 nt, Human
gccccagugcccacagg

SEQ ID NO: 1504856 - RNA, 21 nt, Human
gccccagugcccacaggauca

SEQ ID NO: 1504857 - RNA, 23 nt, Human
gccccauccucuguacagagccc

SEQ ID NO: 1504858 - RNA, 17 nt, Human
gccccauucugccugcc

SEQ ID NO: 1504859 - RNA, 18 nt, Human
gccccauucugccugccc

SEQ ID NO: 1504860 - RNA, 20 nt, Human
gccccauucugccugcccag

SEQ ID NO: 1504861 - RNA, 21 nt, Human
gccccauucugccugcccagg

SEQ ID NO: 1504862 - RNA, 15 nt, Human
gcccaguugggugga

SEQ ID NO: 1504863 - RNA, 22 nt, Human
gcccagucuggaaugcaguggu

SEQ ID NO: 1504864 - RNA, 16 nt, Human
gcccaggcuggcgugc

SEQ ID NO: 1504865 - RNA, 14 nt, Human
gcccaggcuggcgu

SEQ ID NO: 1504866 - RNA, 15 nt, Human
gcccaggcuggcgug

SEQ ID NO: 1504867 - RNA, 11 nt, Human
gcccaggcugg

SEQ ID NO: 1504868 - RNA, 12 nt, Human
gcccaggaaagg

SEQ ID NO: 1504869 - RNA, 15 nt, Human
gcccaggaaaggcuc

SEQ ID NO: 1504870 - RNA, 16 nt, Human
gcccaggaaaggcucc

SEQ ID NO: 1504871 - RNA, 18 nt, Human
gcccaggccuccuacagc

SEQ ID NO: 1504872 - RNA, 14 nt, Human
gccccgcccaggcu

SEQ ID NO: 1504873 - RNA, 22 nt, Human
gccccauucugccugcccaggc

SEQ ID NO: 1504874 - RNA, 23 nt, Human
gccccauucugccugcccaggcc

SEQ ID NO: 1504875 - RNA, 23 nt, Human
gccccgaggccuucucugaagga

SEQ ID NO: 1504876 - RNA, 17 nt, Human
gccccgugggguuccuc

SEQ ID NO: 1504877 - RNA, 23 nt, Human
gccccucaacucuccuccagagu

SEQ ID NO: 1504878 - RNA, 19 nt, Human
gccccucagggucccuggu

SEQ ID NO: 1504879 - RNA, 21 nt, Human
gccccucagggucccuggugg

SEQ ID NO: 1504880 - RNA, 19 nt, Human
gccccugcacuccagccug

SEQ ID NO: 1504881 - RNA, 23 nt, Human
gccccuggcagccccuguucugg

SEQ ID NO: 1504882 - RNA, 21 nt, Human
gcccgggcucugccucccauc

SEQ ID NO: 1504883 - RNA, 19 nt, Human
gcccgggcucugccuccca

SEQ ID NO: 1504884 - RNA, 20 nt, Human
gcccgggcucugccucccau

SEQ ID NO: 1504885 - RNA, 22 nt, Human
gcccucugcccacucccugcaa

SEQ ID NO: 1504886 - RNA, 19 nt, Human
gccccuucugacccaugcu

SEQ ID NO: 1504887 - RNA, 20 nt, Human
gccccuucugacccaugcug

SEQ ID NO: 1504888 - RNA, 13 nt, Human
gcccggcuccagg

SEQ ID NO: 1504889 - RNA, 14 nt, Human
gcccggcuccaggc

SEQ ID NO: 1504890 - RNA, 15 nt, Human
gcccggcuccaggcu

SEQ ID NO: 1504891 - RNA, 13 nt, Human
gcccgggcucugc

SEQ ID NO: 1504892 - RNA, 14 nt, Human
gcccgggcucugcc

SEQ ID NO: 1504893 - RNA, 15 nt, Human
gcccgggcucugccu

SEQ ID NO: 1504894 - RNA, 18 nt, Human
gcccgggcucugccuccc

SEQ ID NO: 1504895 - RNA, 16 nt, Human
gcccacagcuguauga

SEQ ID NO: 1504896 - RNA, 16 nt, Human
gccauuuguguuuaua

SEQ ID NO: 1504897 - RNA, 16 nt, Human
gcccaaagaugcagcc

SEQ ID NO: 1504898 - RNA, 19 nt, Human
gcccacaggaucagucuga

SEQ ID NO: 1504899 - RNA, 13 nt, Human
gcccacaggauca

SEQ ID NO: 1504900 - RNA, 18 nt, Human
gcccacaggaucagucug

SEQ ID NO: 1504901 - RNA, 15 nt, Human
gcccaccccucaaca

SEQ ID NO: 1504902 - RNA, 20 nt, Human
gccauuucuuccacaagagc

SEQ ID NO: 1504903 - RNA, 22 nt, Human
gccauuucuuccacaagagccc

SEQ ID NO: 1504904 - RNA, 22 nt, Human
gccaugggacagggaggacgcu

SEQ ID NO: 1504905 - RNA, 22 nt, Human
gccauuuaaagcuuauuaaaac

SEQ ID NO: 1504906 - RNA, 17 nt, Human
gccauuucuuccacaag

SEQ ID NO: 1504907 - RNA, 14 nt, Human
gccaugggacaggg

SEQ ID NO: 1504908 - RNA, 19 nt, Human
gccaugggacagggaggac

SEQ ID NO: 1504909 - RNA, 20 nt, Human
gccaggaagccagcaggcuc

SEQ ID NO: 1504910 - RNA, 19 nt, Human
gccaggaagccagcaggcu

SEQ ID NO: 1504911 - RNA, 11 nt, Human
gccaggaagcc

SEQ ID NO: 1504912 - RNA, 17 nt, Human
gccaggaagccagcagg

SEQ ID NO: 1504913 - RNA, 18 nt, Human
gccaggaagccagcaggc

SEQ ID NO: 1504914 - RNA, 23 nt, Human
gccaggggaaaaucagccugcuc

SEQ ID NO: 1504915 - RNA, 17 nt, Human
gccaggggaaaaucagc

SEQ ID NO: 1504916 - RNA, 21 nt, Human
gccaggggaaaaucagccugc

SEQ ID NO: 1504917 - RNA, 22 nt, Human
gccaggggaaaaucagccugcu

SEQ ID NO: 1504918 - RNA, 19 nt, Human
gccauccagguucagcuug

SEQ ID NO: 1504919 - RNA, 20 nt, Human
gccauccagguucagcuugu

SEQ ID NO: 1504920 - RNA, 17 nt, Human
gccaucccagccccaau

SEQ ID NO: 1504921 - RNA, 13 nt, Human
gccaucccagccc

SEQ ID NO: 1504922 - RNA, 14 nt, Human
gccaucccagcccc

SEQ ID NO: 1504923 - RNA, 15 nt, Human
gccaucccagcccca

SEQ ID NO: 1504924 - RNA, 16 nt, Human
gccaucccagccccaa

SEQ ID NO: 1504925 - RNA, 12 nt, Human
gccagagacaca

SEQ ID NO: 1504926 - RNA, 15 nt, Human
gccagagacacaagc

SEQ ID NO: 1504927 - RNA, 22 nt, Human
gccagagcuacccgcagaguuc

SEQ ID NO: 1504928 - RNA, 18 nt, Human
gccagagggagugacaga

SEQ ID NO: 1504929 - RNA, 19 nt, Human
gccacugcaccgggccaca

SEQ ID NO: 1504930 - RNA, 17 nt, Human
gccacugcaccgggcca

SEQ ID NO: 1504931 - RNA, 18 nt, Human
gccacugcaccgggccac

SEQ ID NO: 1504932 - RNA, 13 nt, Human
gccaaagccaaag

SEQ ID NO: 1504933 - RNA, 16 nt, Human
gccaaauaaugucucu

SEQ ID NO: 1504934 - RNA, 18 nt, Human
gccaaauaaugucucugu

SEQ ID NO: 1504935 - RNA, 22 nt, Human
gccaaauaaugucucugugaga

SEQ ID NO: 1504936 - RNA, 14 nt, Human
gccacggccaggcc

SEQ ID NO: 1504937 - RNA, 15 nt, Human
gccacggccaggcca

SEQ ID NO: 1504938 - RNA, 17 nt, Human
gccacggccaggccaga

SEQ ID NO: 1504939 - RNA, 16 nt, Human
gccacggccaggccag

SEQ ID NO: 1504940 - RNA, 22 nt, Human
gccacguucuuacuaguuuccc

SEQ ID NO: 1504941 - RNA, 21 nt, Human
gccacuauuguuagucucuug

SEQ ID NO: 1504942 - RNA, 17 nt, Human
gccagauucuuuccuga

SEQ ID NO: 1504943 - RNA, 19 nt, Human
gccagauucuuuccugagg

SEQ ID NO: 1504944 - RNA, 19 nt, Human
gccagagggagugacagag

SEQ ID NO: 1504945 - RNA, 20 nt, Human
gccagagggagugacagagg

SEQ ID NO: 1504946 - RNA, 16 nt, Human
gccagauucuuuccug

SEQ ID NO: 1504947 - RNA, 21 nt, Human
gccagccgagauagccaaggc

SEQ ID NO: 1504948 - RNA, 20 nt, Human
gccagccgagauagccaagg

SEQ ID NO: 1504949 - RNA, 12 nt, Human
gccagccuugac

SEQ ID NO: 1504950 - RNA, 14 nt, Human
gccagccuugacca

SEQ ID NO: 1504951 - RNA, 20 nt, Human
gccagccuugaccauucucc

SEQ ID NO: 1504952 - RNA, 21 nt, Human
gccagccuugaccauucucca

SEQ ID NO: 1504953 - RNA, 22 nt, Human
gccagccuugaccauucuccac

SEQ ID NO: 1504954 - RNA, 14 nt, Human
gccagcugcuuggg

SEQ ID NO: 1504955 - RNA, 16 nt, Human
gccagcugcuugggcu

SEQ ID NO: 1504956 - RNA, 15 nt, Human
gccagcugcuugggc

SEQ ID NO: 1504957 - RNA, 20 nt, Human
gcaggaggaucacuugaguc

SEQ ID NO: 1504958 - RNA, 15 nt, Human
gcaggaccucgugcc

SEQ ID NO: 1504959 - RNA, 12 nt, Human
gcagcagaaggg

SEQ ID NO: 1504960 - RNA, 13 nt, Human
gcagcagaagggg

SEQ ID NO: 1504961 - RNA, 20 nt, Human
gcagcagguggcagaauggg

SEQ ID NO: 1504962 - RNA, 19 nt, Human
gcagccucaaccuccuggg

SEQ ID NO: 1504963 - RNA, 20 nt, Human
gcagccucaaccuccugggc

SEQ ID NO: 1504964 - RNA, 14 nt, Human
gcagccuggacccu

SEQ ID NO: 1504965 - RNA, 16 nt, Human
gcagccugcaggaccu

SEQ ID NO: 1504966 - RNA, 13 nt, Human
gcagccugcagga

SEQ ID NO: 1504967 - RNA, 21 nt, Human
gcagccucaaccuccugggcu

SEQ ID NO: 1504968 - RNA, 22 nt, Human
gcagccucaaccuccugggcua

SEQ ID NO: 1504969 - RNA, 12 nt, Human
gcagcaauaaag

SEQ ID NO: 1504970 - RNA, 20 nt, Human
gcagaguugaagacagagcu

SEQ ID NO: 1504971 - RNA, 19 nt, Human
gcagaguugaagacagagc

SEQ ID NO: 1504972 - RNA, 16 nt, Human
gcagaguugaagacag

SEQ ID NO: 1504973 - RNA, 17 nt, Human
gcagaguugaagacaga

SEQ ID NO: 1504974 - RNA, 22 nt, Human
gcagauggaaugcuguguuaaa

SEQ ID NO: 1504975 - RNA, 18 nt, Human
gcagauggaaugcugugu

SEQ ID NO: 1504976 - RNA, 18 nt, Human
gcagaaggaagacuucau

SEQ ID NO: 1504977 - RNA, 19 nt, Human
gcagagaaugaaagggccc

SEQ ID NO: 1504978 - RNA, 20 nt, Human
gcagagaaugaaagggccca

SEQ ID NO: 1504979 - RNA, 21 nt, Human
gcagagaaugaaagggcccag

SEQ ID NO: 1504980 - RNA, 22 nt, Human
gcagagaaugaaagggcccaga

SEQ ID NO: 1504981 - RNA, 23 nt, Human
gcagagaaugaaagggcccagag

SEQ ID NO: 1504982 - RNA, 21 nt, Human
gcagagaauucucuuauccaa

SEQ ID NO: 1504983 - RNA, 15 nt, Human
gcagaguugaagaca

SEQ ID NO: 1504984 - RNA, 14 nt, Human
gcagagaccauccc

SEQ ID NO: 1504985 - RNA, 15 nt, Human
gcagagaccaucccu

SEQ ID NO: 1504986 - RNA, 17 nt, Human
gcagagaccaucccuga

SEQ ID NO: 1504987 - RNA, 19 nt, Human
gcagagaccaucccugaag

SEQ ID NO: 1504988 - RNA, 20 nt, Human
gcacagccucuuagaugcag

SEQ ID NO: 1504989 - RNA, 15 nt, Human
gcaaugaccuuucaa

SEQ ID NO: 1504990 - RNA, 13 nt, Human
gcaaugaccuuuc

SEQ ID NO: 1504991 - RNA, 14 nt, Human
gcaaugaccuuuca

SEQ ID NO: 1504992 - RNA, 19 nt, Human
gcacagcuaacauggaagu

SEQ ID NO: 1504993 - RNA, 21 nt, Human
gcacagcuucauuuccugugu

SEQ ID NO: 1504994 - RNA, 16 nt, Human
gcacagcuucauuucc

SEQ ID NO: 1504995 - RNA, 19 nt, Human
gcaccacugcacuccagcc

SEQ ID NO: 1504996 - RNA, 20 nt, Human
gcaccacugcacuccagccu

SEQ ID NO: 1504997 - RNA, 15 nt, Human
gcaccacgggcccgg

SEQ ID NO: 1504998 - RNA, 14 nt, Human
gcacccggccccug

SEQ ID NO: 1504999 - RNA, 15 nt, Human
gcacccggccccugc

SEQ ID NO: 1505000 - RNA, 17 nt, Human
gcacccggccccugcug

SEQ ID NO: 1505001 - RNA, 14 nt, Human
gcaccuccugccuc

SEQ ID NO: 1505002 - RNA, 15 nt, Human
gcaccuccugccucg

SEQ ID NO: 1505003 - RNA, 22 nt, Human
gcacugggcuuggggaccagag

SEQ ID NO: 1505004 - RNA, 23 nt, Human
gcacugggcuuggggaccagagc

SEQ ID NO: 1505005 - RNA, 15 nt, Human
gcacugucaagauga

SEQ ID NO: 1505006 - RNA, 12 nt, Human
gcagaaggaaga

SEQ ID NO: 1505007 - RNA, 13 nt, Human
gcagaaggaagac

SEQ ID NO: 1505008 - RNA, 14 nt, Human
gcagaaggaagacu

SEQ ID NO: 1505009 - RNA, 14 nt, Human
gcagaagacaguau

SEQ ID NO: 1505010 - RNA, 19 nt, Human
gcacuaaggugugcucuga

SEQ ID NO: 1505011 - RNA, 18 nt, Human
gcacuaaggugugcucug

SEQ ID NO: 1505012 - RNA, 17 nt, Human
gcacuaaggugugcucu

SEQ ID NO: 1505013 - RNA, 18 nt, Human
gcacccggccccugcugg

SEQ ID NO: 1505014 - RNA, 23 nt, Human
gcagugcuuccaaggauggacca

SEQ ID NO: 1505015 - RNA, 16 nt, Human
gcagugggagcugccu

SEQ ID NO: 1505016 - RNA, 15 nt, Human
gcaggcuacugucag

SEQ ID NO: 1505017 - RNA, 20 nt, Human
gcaggauucuuccucccucc

SEQ ID NO: 1505018 - RNA, 16 nt, Human
gcagggagggcuucug

SEQ ID NO: 1505019 - RNA, 14 nt, Human
gcagggcucagcgg

SEQ ID NO: 1505020 - RNA, 12 nt, Human
gcagggcucagc

SEQ ID NO: 1505021 - RNA, 13 nt, Human
gcaguucugaaga

SEQ ID NO: 1505022 - RNA, 14 nt, Human
gcaguucugaagaa

SEQ ID NO: 1505023 - RNA, 17 nt, Human
gcagugggagcugccug

SEQ ID NO: 1505024 - RNA, 18 nt, Human
gcagugggagcugccugu

SEQ ID NO: 1505025 - RNA, 21 nt, Human
gcaucaagaugugacauguuu

SEQ ID NO: 1505026 - RNA, 17 nt, Human
gcauauucaggaagcuc

SEQ ID NO: 1505027 - RNA, 18 nt, Human
gcauauucaggaagcuca

SEQ ID NO: 1505028 - RNA, 20 nt, Human
gcauauucaggaagcucagg

SEQ ID NO: 1505029 - RNA, 15 nt, Human
gcauauucaggaagc

SEQ ID NO: 1505030 - RNA, 17 nt, Human
gcauguuugugauugac

SEQ ID NO: 1505031 - RNA, 15 nt, Human
gcaugcugucccuua

SEQ ID NO: 1505032 - RNA, 20 nt, Human
gcaugacacgaauauugcug

SEQ ID NO: 1505033 - RNA, 14 nt, Human
gcaugcaccacggg

SEQ ID NO: 1505034 - RNA, 15 nt, Human
gcaugcaccacgggc

SEQ ID NO: 1505035 - RNA, 17 nt, Human
gcaugccuggauggggc

SEQ ID NO: 1505036 - RNA, 22 nt, Human
gcaugccuggauggggcugcac

SEQ ID NO: 1505037 - RNA, 18 nt, Human
gcaucaggccaggcccuc

SEQ ID NO: 1505038 - RNA, 16 nt, Human
gcaucaggccaggccc

SEQ ID NO: 1505039 - RNA, 17 nt, Human
gcaucaggccaggcccu

SEQ ID NO: 1505040 - RNA, 15 nt, Human
gcaucaggccaggcc

SEQ ID NO: 1505041 - RNA, 23 nt, Human
gcauuugcugaauacagaggcaa

SEQ ID NO: 1505042 - RNA, 21 nt, Human
gcauuuggugguuucagaaau

SEQ ID NO: 1505043 - RNA, 12 nt, Human
gcauuccccagg

SEQ ID NO: 1505044 - RNA, 12 nt, Human
gcauuccccacu

SEQ ID NO: 1505045 - RNA, 21 nt, Human
gccaaacucaccugccccuca

SEQ ID NO: 1505046 - RNA, 14 nt, Human
gccaaaggaagcac

SEQ ID NO: 1505047 - RNA, 16 nt, Human
gccaaaggaagcacau

SEQ ID NO: 1505048 - RNA, 20 nt, Human
gccaaaggaagcacaugccu

SEQ ID NO: 1505049 - RNA, 22 nt, Human
gcauuuugcuaaaugugaauga

SEQ ID NO: 1505050 - RNA, 23 nt, Human
gaucagcuuauugucuagugaaa

SEQ ID NO: 1505051 - RNA, 23 nt, Human
gaucacggcucacugcagccuca

SEQ ID NO: 1505052 - RNA, 17 nt, Human
gauaggucagugcaaau

SEQ ID NO: 1505053 - RNA, 16 nt, Human
gauacaaaagcaugug

SEQ ID NO: 1505054 - RNA, 17 nt, Human
gauacaaaagcauguga

SEQ ID NO: 1505055 - RNA, 18 nt, Human
gauauaugcucugcaugu

SEQ ID NO: 1505056 - RNA, 20 nt, Human
gauagugucccacggugccu

SEQ ID NO: 1505057 - RNA, 20 nt, Human
gaguucauacccuguuacca

SEQ ID NO: 1505058 - RNA, 11 nt, Human
gaguucuacau

SEQ ID NO: 1505059 - RNA, 24 nt, Human
gauaauacaccacuacauucuguu

SEQ ID NO: 1505060 - RNA, 23 nt, Human
gauaauacaccacuacauucugu

SEQ ID NO: 1505061 - RNA, 12 nt, Human
gauaauacacca

SEQ ID NO: 1505062 - RNA, 14 nt, Human
gauaauacaccacu

SEQ ID NO: 1505063 - RNA, 13 nt, Human
gaguucugguucc

SEQ ID NO: 1505064 - RNA, 13 nt, Human
gauaaacaguagu

SEQ ID NO: 1505065 - RNA, 14 nt, Human
gauccuggaaauca

SEQ ID NO: 1505066 - RNA, 13 nt, Human
gauccugagccag

SEQ ID NO: 1505067 - RNA, 12 nt, Human
gauccugagcca

SEQ ID NO: 1505068 - RNA, 13 nt, Human
gaucuaggaagac

SEQ ID NO: 1505069 - RNA, 14 nt, Human
gaucuaggaagacu

SEQ ID NO: 1505070 - RNA, 18 nt, Human
gaucuaggaagacuuugg

SEQ ID NO: 1505071 - RNA, 20 nt, Human
gaucuaggaagacuuuggaa

SEQ ID NO: 1505072 - RNA, 18 nt, Human
gauccuaggcauuugcug

SEQ ID NO: 1505073 - RNA, 14 nt, Human
gauccuccaggugc

SEQ ID NO: 1505074 - RNA, 16 nt, Human
gauccucccaccucag

SEQ ID NO: 1505075 - RNA, 17 nt, Human
gauccucccaccucagc

SEQ ID NO: 1505076 - RNA, 18 nt, Human
gauccucccaccucagcc

SEQ ID NO: 1505077 - RNA, 13 nt, Human
gaucauccacugu

SEQ ID NO: 1505078 - RNA, 16 nt, Human
gaucauccacugugcc

SEQ ID NO: 1505079 - RNA, 16 nt, Human
gaugagaggaaaucac

SEQ ID NO: 1505080 - RNA, 14 nt, Human
gaugcagugcuucc

SEQ ID NO: 1505081 - RNA, 15 nt, Human
gaugccugguggcag

SEQ ID NO: 1505082 - RNA, 16 nt, Human
gaugccugguggcagc

SEQ ID NO: 1505083 - RNA, 18 nt, Human
gaugaccuugaaugaugc

SEQ ID NO: 1505084 - RNA, 20 nt, Human
gaugaccuugaaugaugcca

SEQ ID NO: 1505085 - RNA, 14 nt, Human
gaugagaggaaauc

SEQ ID NO: 1505086 - RNA, 15 nt, Human
gaugcaccagcccuu

SEQ ID NO: 1505087 - RNA, 23 nt, Human
gaugcaccagcccuuagcaggga

SEQ ID NO: 1505088 - RNA, 22 nt, Human
gaucuucuguggguuucuaaag

SEQ ID NO: 1505089 - RNA, 19 nt, Human
gaucuucuuuauaauucua

SEQ ID NO: 1505090 - RNA, 15 nt, Human
gaugaaaugagguca

SEQ ID NO: 1505091 - RNA, 21 nt, Human
gaugaaaugaggucagagccu

SEQ ID NO: 1505092 - RNA, 13 nt, Human
gaucuuuaaaaua

SEQ ID NO: 1505093 - RNA, 12 nt, Human
gauuuaaaucag

SEQ ID NO: 1505094 - RNA, 20 nt, Human
gauuucaucugcucuccuuc

SEQ ID NO: 1505095 - RNA, 21 nt, Human
gauuucaucugcucuccuucc

SEQ ID NO: 1505096 - RNA, 22 nt, Human
gauuucaucugcucuccuuccu

SEQ ID NO: 1505097 - RNA, 22 nt, Human
gauuucuguuuagauaauacac

SEQ ID NO: 1505098 - RNA, 17 nt, Human
gauugcaacaggcuggg

SEQ ID NO: 1505099 - RNA, 18 nt, Human
gauugcaacaggcugggc

SEQ ID NO: 1505100 - RNA, 18 nt, Human
gauugcuugagcucagga

SEQ ID NO: 1505101 - RNA, 17 nt, Human
gauuggcucacacugag

SEQ ID NO: 1505102 - RNA, 18 nt, Human
gauuggcucacacugaga

SEQ ID NO: 1505103 - RNA, 20 nt, Human
gauuggcucacacugagaau

SEQ ID NO: 1505104 - RNA, 16 nt, Human
gauucccaagcucugc

SEQ ID NO: 1505105 - RNA, 17 nt, Human
gauucccaagcucugcu

SEQ ID NO: 1505106 - RNA, 19 nt, Human
gauucuuuccugaggcugg

SEQ ID NO: 1505107 - RNA, 18 nt, Human
gauucccaagcucugcuc

SEQ ID NO: 1505108 - RNA, 20 nt, Human
gauucuuuccugaggcuggg

SEQ ID NO: 1505109 - RNA, 22 nt, Human
gauucuuuccugaggcugggcu

SEQ ID NO: 1505110 - RNA, 16 nt, Human
gauugcaacaggcugg

SEQ ID NO: 1505111 - RNA, 22 nt, Human
gauuaaguaaugauaacuggaa

SEQ ID NO: 1505112 - RNA, 18 nt, Human
gauuaauauggggaugca

SEQ ID NO: 1505113 - RNA, 14 nt, Human
gauuaaguaaugau

SEQ ID NO: 1505114 - RNA, 21 nt, Human
gauguuuuaaggaugcuugua

SEQ ID NO: 1505115 - RNA, 14 nt, Human
gauguucugggaca

SEQ ID NO: 1505116 - RNA, 17 nt, Human
gaugccugguggcagcu

SEQ ID NO: 1505117 - RNA, 16 nt, Human
gaugcuagaacucccu

SEQ ID NO: 1505118 - RNA, 18 nt, Human
gauguucuagcauggcug

SEQ ID NO: 1505119 - RNA, 15 nt, Human
gauucccaagcucug

SEQ ID NO: 1505120 - RNA, 13 nt, Human
gauuacaagcgug

SEQ ID NO: 1505121 - RNA, 21 nt, Human
gauuacaagcgugagccacug

SEQ ID NO: 1505122 - RNA, 13 nt, Human
gauucagacagcu

SEQ ID NO: 1505123 - RNA, 14 nt, Human
gauucagacagcug

SEQ ID NO: 1505124 - RNA, 17 nt, Human
gauucagacagcugccu

SEQ ID NO: 1505125 - RNA, 18 nt, Human
gauucagacagcugccug

SEQ ID NO: 1505126 - RNA, 17 nt, Human
gcaauccugcaagaaca

SEQ ID NO: 1505127 - RNA, 14 nt, Human
gcaaggcugucaau

SEQ ID NO: 1505128 - RNA, 18 nt, Human
gcaaggcugucaauuaca

SEQ ID NO: 1505129 - RNA, 12 nt, Human
gcaagauguggg

SEQ ID NO: 1505130 - RNA, 16 nt, Human
gcaagaugugggcagu

SEQ ID NO: 1505131 - RNA, 15 nt, Human
gcaagcaccuccugc

SEQ ID NO: 1505132 - RNA, 16 nt, Human
gcaagcaccuccugcc

SEQ ID NO: 1505133 - RNA, 18 nt, Human
gcaagcaccuccugccuc

SEQ ID NO: 1505134 - RNA, 20 nt, Human
gcaagcaccuccugccucga

SEQ ID NO: 1505135 - RNA, 19 nt, Human
gcaagcucuuuuauaugcu

SEQ ID NO: 1505136 - RNA, 16 nt, Human
gcaaaccaucauugaa

SEQ ID NO: 1505137 - RNA, 17 nt, Human
gcaaaccaucauugaaa

SEQ ID NO: 1505138 - RNA, 19 nt, Human
gcaaaccaucauugaaauc

SEQ ID NO: 1505139 - RNA, 20 nt, Human
gcaaaccaucauugaaaucu

SEQ ID NO: 1505140 - RNA, 21 nt, Human
gcaaaccaucauugaaaucuu

SEQ ID NO: 1505141 - RNA, 18 nt, Human
gcaacugcauuggcuuug

SEQ ID NO: 1505142 - RNA, 21 nt, Human
gaagagaguccauauuucaau

SEQ ID NO: 1505143 - RNA, 19 nt, Human
gaagagaaugcacaaacag

SEQ ID NO: 1505144 - RNA, 20 nt, Human
gaagacuuuucuuucagcca

SEQ ID NO: 1505145 - RNA, 14 nt, Human
gaagacuuuggaaa

SEQ ID NO: 1505146 - RNA, 17 nt, Human
gaagacuuuggaaagag

SEQ ID NO: 1505147 - RNA, 12 nt, Human
gaagaacugaaa

SEQ ID NO: 1505148 - RNA, 13 nt, Human
gaagaacggggcu

SEQ ID NO: 1505149 - RNA, 20 nt, Human
gaagaacggggcucuucuca

SEQ ID NO: 1505150 - RNA, 22 nt, Human
gaagaacggggcucuucucauu

SEQ ID NO: 1505151 - RNA, 23 nt, Human
gaagaacggggcucuucucauuu

SEQ ID NO: 1505152 - RNA, 19 nt, Human
gaagacugcauuauauuua

SEQ ID NO: 1505153 - RNA, 11 nt, Human
gaagacuuugg

SEQ ID NO: 1505154 - RNA, 13 nt, Human
gaagacuuuggaa

SEQ ID NO: 1505155 - RNA, 23 nt, Human
gaacuuugaccucugcagcaaua

SEQ ID NO: 1505156 - RNA, 15 nt, Human
gaagauacugaaaua

SEQ ID NO: 1505157 - RNA, 18 nt, Human
gaagauguagaggagaaa

SEQ ID NO: 1505158 - RNA, 20 nt, Human
gaagagguuuuaaagcuucc

SEQ ID NO: 1505159 - RNA, 20 nt, Human
gaagauaauauuaaggaaga

SEQ ID NO: 1505160 - RNA, 17 nt, Human
gaagcauuuacuuugug

SEQ ID NO: 1505161 - RNA, 18 nt, Human
gaagcauuuacuuugugu

SEQ ID NO: 1505162 - RNA, 15 nt, Human
gaagccacaggccug

SEQ ID NO: 1505163 - RNA, 16 nt, Human
gaagccacaggccuga

SEQ ID NO: 1505164 - RNA, 16 nt, Human
gaagcccaggggccgg

SEQ ID NO: 1505165 - RNA, 23 nt, Human
gaagcccuucuaccuuccugcaa

SEQ ID NO: 1505166 - RNA, 20 nt, Human
gaagccagcaggcucucagg

SEQ ID NO: 1505167 - RNA, 17 nt, Human
gaagccacaggccugag

SEQ ID NO: 1505168 - RNA, 18 nt, Human
gaagccacaggccugaga

SEQ ID NO: 1505169 - RNA, 21 nt, Human
gaagccagcaggcucucaggc

SEQ ID NO: 1505170 - RNA, 22 nt, Human
gaagccagcaggcucucaggcc

SEQ ID NO: 1505171 - RNA, 13 nt, Human
gaagcccaggaaa

SEQ ID NO: 1505172 - RNA, 15 nt, Human
gaagcccaggaaagg

SEQ ID NO: 1505173 - RNA, 16 nt, Human
gaagcccaggaaaggc

SEQ ID NO: 1505174 - RNA, 19 nt, Human
gaagcccaggaaaggcucc

SEQ ID NO: 1505175 - RNA, 15 nt, Human
gaacauaaaauacaa

SEQ ID NO: 1505176 - RNA, 16 nt, Human
gaacagugauuaccag

SEQ ID NO: 1505177 - RNA, 20 nt, Human
gaacagugauuaccagggac

SEQ ID NO: 1505178 - RNA, 15 nt, Human
gaacacucugagacu

SEQ ID NO: 1505179 - RNA, 16 nt, Human
gaaauuguauuacaaa

SEQ ID NO: 1505180 - RNA, 18 nt, Human
gaaauuguauuacaaauc

SEQ ID NO: 1505181 - RNA, 13 nt, Human
gaacacucugaga

SEQ ID NO: 1505182 - RNA, 14 nt, Human
gaacacucugagac

SEQ ID NO: 1505183 - RNA, 18 nt, Human
gaaccuuuugagugccuu

SEQ ID NO: 1505184 - RNA, 19 nt, Human
gaaccuuuugagugccuua

SEQ ID NO: 1505185 - RNA, 21 nt, Human
gaaccuuuugagugccuuaca

SEQ ID NO: 1505186 - RNA, 23 nt, Human
gaacuacaaacaaaauuucuauu

SEQ ID NO: 1505187 - RNA, 22 nt, Human
gaacuacaaacaaaauuucuau

SEQ ID NO: 1505188 - RNA, 21 nt, Human
gaacuagaguuuagcuggaaa

SEQ ID NO: 1505189 - RNA, 22 nt, Human
gaaccuuuugagugccuuacac

SEQ ID NO: 1505190 - RNA, 12 nt, Human
gaaguccaagca

SEQ ID NO: 1505191 - RNA, 22 nt, Human
gaaguccaagcauuuagaugua

SEQ ID NO: 1505192 - RNA, 18 nt, Human
gaagucuuagauguauau

SEQ ID NO: 1505193 - RNA, 21 nt, Human
gaaguuucugccgcagcccug

SEQ ID NO: 1505194 - RNA, 15 nt, Human
gaagucuuagaugua

SEQ ID NO: 1505195 - RNA, 16 nt, Human
gaaguauccuucagcc

SEQ ID NO: 1505196 - RNA, 14 nt, Human
gaaguauccuucag

SEQ ID NO: 1505197 - RNA, 16 nt, Human
gaagggggcugggaca

SEQ ID NO: 1505198 - RNA, 19 nt, Human
gaagggggcugggacaugg

SEQ ID NO: 1505199 - RNA, 12 nt, Human
gaaggggguggu

SEQ ID NO: 1505200 - RNA, 19 nt, Human
gaaggggguggugucucca

SEQ ID NO: 1505201 - RNA, 15 nt, Human
gaaguacuggagaaa

SEQ ID NO: 1505202 - RNA, 18 nt, Human
gaaguacuauaauuuacc

SEQ ID NO: 1505203 - RNA, 22 nt, Human
gaaguaauaugcacacauuuuu

SEQ ID NO: 1505204 - RNA, 20 nt, Human
gaauacucuuauaucuauau

SEQ ID NO: 1505205 - RNA, 22 nt, Human
gaauagcugggacuacaggugu

SEQ ID NO: 1505206 - RNA, 23 nt, Human
gaauagcugggacuacaggugug

SEQ ID NO: 1505207 - RNA, 15 nt, Human
gaauaccuguccccc

SEQ ID NO: 1505208 - RNA, 13 nt, Human
gaauaccuguccc

SEQ ID NO: 1505209 - RNA, 16 nt, Human
gaauauuuuaacuucc

SEQ ID NO: 1505210 - RNA, 20 nt, Human
gaauaauccuaaacauauga

SEQ ID NO: 1505211 - RNA, 21 nt, Human
gaauacagaggcaacugcauu

SEQ ID NO: 1505212 - RNA, 17 nt, Human
gaauaauacaguaucuc

SEQ ID NO: 1505213 - RNA, 19 nt, Human
gaauaaucaaauacauuuu

SEQ ID NO: 1505214 - RNA, 20 nt, Human
gaaguuugagaucagccugg

SEQ ID NO: 1505215 - RNA, 18 nt, Human
gaauaacauguaauuaag

SEQ ID NO: 1505216 - RNA, 19 nt, Human
gaauaacauguaauuaagu

SEQ ID NO: 1505217 - RNA, 17 nt, Human
gaaugaagauacugaaa

SEQ ID NO: 1505218 - RNA, 18 nt, Human
gaaugaagauacugaaau

SEQ ID NO: 1505219 - RNA, 21 nt, Human
gaaugaagauacugaaauaaa

SEQ ID NO: 1505220 - RNA, 19 nt, Human
gaaugaagauacugaaaua

SEQ ID NO: 1505221 - RNA, 22 nt, Human
gaaugaaccacaucuugcucug

SEQ ID NO: 1505222 - RNA, 23 nt, Human
gaaugaaccacaucuugcucugc

SEQ ID NO: 1505223 - RNA, 17 nt, Human
gaauggcacagcccaaa

SEQ ID NO: 1505224 - RNA, 18 nt, Human
gaauguaagaacuacaaa

SEQ ID NO: 1505225 - RNA, 22 nt, Human
gaaugguuuucaaaauaaaaau

SEQ ID NO: 1505226 - RNA, 14 nt, Human
gaaugucaguguga

SEQ ID NO: 1505227 - RNA, 22 nt, Human
gaauuuaaauagcuuuuuucuc

SEQ ID NO: 1505228 - RNA, 22 nt, Human
gaauuguaaggaaugauuaauu

SEQ ID NO: 1505229 - RNA, 15 nt, Human
gaauuucccaaagca

SEQ ID NO: 1505230 - RNA, 19 nt, Human
gaauucucuaguuugauua

SEQ ID NO: 1505231 - RNA, 14 nt, Human
gaauugaaaaacca

SEQ ID NO: 1505232 - RNA, 14 nt, Human
gaauugaagcagga

SEQ ID NO: 1505233 - RNA, 20 nt, Human
gaaugucagugugacugauc

SEQ ID NO: 1505234 - RNA, 21 nt, Human
gaaugucagugugacugaucu

SEQ ID NO: 1505235 - RNA, 17 nt, Human
gaauucucuaguuugau

SEQ ID NO: 1505236 - RNA, 17 nt, Human
gaauucucagaaucuca

SEQ ID NO: 1505237 - RNA, 11 nt, Human
gacccugaggc

SEQ ID NO: 1505238 - RNA, 12 nt, Human
gacccugaggcc

SEQ ID NO: 1505239 - RNA, 16 nt, Human
gacccugaggcccaga

SEQ ID NO: 1505240 - RNA, 18 nt, Human
gacccugaggcccagagg

SEQ ID NO: 1505241 - RNA, 20 nt, Human
gacccugcccugugggcccc

SEQ ID NO: 1505242 - RNA, 22 nt, Human
gacccugcccugugggccccca

SEQ ID NO: 1505243 - RNA, 20 nt, Human
gacccaaaaggcagaagcaa

SEQ ID NO: 1505244 - RNA, 18 nt, Human
gacccaaaaggcagaagc

SEQ ID NO: 1505245 - RNA, 19 nt, Human
gacccaaaaggcagaagca

SEQ ID NO: 1505246 - RNA, 13 nt, Human
gacccaugcugcc

SEQ ID NO: 1505247 - RNA, 18 nt, Human
gacccaugcugcccugug

SEQ ID NO: 1505248 - RNA, 19 nt, Human
gacccaugcugcccuguga

SEQ ID NO: 1505249 - RNA, 20 nt, Human
gacccaugcugcccugugag

SEQ ID NO: 1505250 - RNA, 18 nt, Human
gaccacaaaacuuuucua

SEQ ID NO: 1505251 - RNA, 16 nt, Human
gaccacugcagaagac

SEQ ID NO: 1505252 - RNA, 18 nt, Human
gaccacugcagaagacag

SEQ ID NO: 1505253 - RNA, 22 nt, Human
gaccagacaccuugacagggca

SEQ ID NO: 1505254 - RNA, 21 nt, Human
gaccagagcugccaccugccu

SEQ ID NO: 1505255 - RNA, 23 nt, Human
gaccagacaccuugacagggcac

SEQ ID NO: 1505256 - RNA, 24 nt, Human
gaccagacaccuugacagggcaca

SEQ ID NO: 1505257 - RNA, 20 nt, Human
gaccagcaccaucucuccuc

SEQ ID NO: 1505258 - RNA, 21 nt, Human
gaccagcaccaucucuccucc

SEQ ID NO: 1505259 - RNA, 16 nt, Human
gacacuagaagauuuu

SEQ ID NO: 1505260 - RNA, 17 nt, Human
gacagacacaggcccgg

SEQ ID NO: 1505261 - RNA, 20 nt, Human
gacagacacaggcccggcuc

SEQ ID NO: 1505262 - RNA, 22 nt, Human
gacagacacaggcccggcucca

SEQ ID NO: 1505263 - RNA, 22 nt, Human
gacacgaauauugcugauggug

SEQ ID NO: 1505264 - RNA, 22 nt, Human
gaauuucccaaagcagugcaug

SEQ ID NO: 1505265 - RNA, 16 nt, Human
gaauuucccaaagcag

SEQ ID NO: 1505266 - RNA, 18 nt, Human
gaauuucccaaagcagug

SEQ ID NO: 1505267 - RNA, 12 nt, Human
gacagaggcagc

SEQ ID NO: 1505268 - RNA, 20 nt, Human
gacagagcuacacaggggaa

SEQ ID NO: 1505269 - RNA, 23 nt, Human
gacagaggcagccccauucugcc

SEQ ID NO: 1505270 - RNA, 13 nt, Human
gacagagggggug

SEQ ID NO: 1505271 - RNA, 19 nt, Human
gacagagugagacucuguc

SEQ ID NO: 1505272 - RNA, 21 nt, Human
gacagagucucacuguugccc

SEQ ID NO: 1505273 - RNA, 16 nt, Human
gacagagugagacucu

SEQ ID NO: 1505274 - RNA, 23 nt, Human
gacaggaugguucccuugaugaa

SEQ ID NO: 1505275 - RNA, 13 nt, Human
gacaggcaagcac

SEQ ID NO: 1505276 - RNA, 17 nt, Human
gacaggcaagcaccucc

SEQ ID NO: 1505277 - RNA, 18 nt, Human
gacaggcaagcaccuccu

SEQ ID NO: 1505278 - RNA, 24 nt, Human
gacaggcaaugcuggcuguuggcu

SEQ ID NO: 1505279 - RNA, 23 nt, Human
gacaggcaaugcuggcuguuggc

SEQ ID NO: 1505280 - RNA, 21 nt, Human
gacaggcauguucucugagga

SEQ ID NO: 1505281 - RNA, 20 nt, Human
gacaggcaagcaccuccugc

SEQ ID NO: 1505282 - RNA, 21 nt, Human
gacaggcaagcaccuccugcc

SEQ ID NO: 1505283 - RNA, 19 nt, Human
gacaggcaaugcuggcugu

SEQ ID NO: 1505284 - RNA, 17 nt, Human
gacauaaaaacaacuuu

SEQ ID NO: 1505285 - RNA, 23 nt, Human
gacaucaacugcaucaagaugug

SEQ ID NO: 1505286 - RNA, 16 nt, Human
gacaucaacugcauca

SEQ ID NO: 1505287 - RNA, 18 nt, Human
gacagggccagugcaguu

SEQ ID NO: 1505288 - RNA, 22 nt, Human
gacaggcauguucucugaggac

SEQ ID NO: 1505289 - RNA, 14 nt, Human
gacuggcacaguuu

SEQ ID NO: 1505290 - RNA, 18 nt, Human
gacuggcacaguuuucug

SEQ ID NO: 1505291 - RNA, 22 nt, Human
gacuggcacaguuuucugagaa

SEQ ID NO: 1505292 - RNA, 23 nt, Human
gacuggccaagguuuggggaaga

SEQ ID NO: 1505293 - RNA, 12 nt, Human
gacuucaucccu

SEQ ID NO: 1505294 - RNA, 20 nt, Human
gacuucaucccucuggggcu

SEQ ID NO: 1505295 - RNA, 23 nt, Human
gacuuacuguacaugaaaacaca

SEQ ID NO: 1505296 - RNA, 18 nt, Human
gacuuacuguacaugaaa

SEQ ID NO: 1505297 - RNA, 12 nt, Human
gacuuacuguac

SEQ ID NO: 1505298 - RNA, 16 nt, Human
gacuuacuguacauga

SEQ ID NO: 1505299 - RNA, 15 nt, Human
gacuuacuguacaug

SEQ ID NO: 1505300 - RNA, 21 nt, Human
gacucuacagaggccaugggc

SEQ ID NO: 1505301 - RNA, 15 nt, Human
gacucuacagaggcc

SEQ ID NO: 1505302 - RNA, 18 nt, Human
gacuacaggcacccacca

SEQ ID NO: 1505303 - RNA, 13 nt, Human
gacuacaggcacc

SEQ ID NO: 1505304 - RNA, 15 nt, Human
gacuacaggcaccca

SEQ ID NO: 1505305 - RNA, 18 nt, Human
gacuccugcaggcagcca

SEQ ID NO: 1505306 - RNA, 19 nt, Human
gacuccugcaggcagccag

SEQ ID NO: 1505307 - RNA, 20 nt, Human
gacuccugcaggcagccagg

SEQ ID NO: 1505308 - RNA, 21 nt, Human
gacuccugcaggcagccaggc

SEQ ID NO: 1505309 - RNA, 13 nt, Human
gacugaggccuga

SEQ ID NO: 1505310 - RNA, 14 nt, Human
gacugaggccugag

SEQ ID NO: 1505311 - RNA, 18 nt, Human
gacugaguacguugugca

SEQ ID NO: 1505312 - RNA, 16 nt, Human
gacugaggggagggga

SEQ ID NO: 1505313 - RNA, 21 nt, Human
gacugaggccugagcgcuccu

SEQ ID NO: 1505314 - RNA, 23 nt, Human
gacugaggccugagcgcuccugc

SEQ ID NO: 1505315 - RNA, 16 nt, Human
gacuaacuugucuuug

SEQ ID NO: 1505316 - RNA, 23 nt, Human
gacuaacuugucuuuggacccug

SEQ ID NO: 1505317 - RNA, 11 nt, Human
gacguguuaug

SEQ ID NO: 1505318 - RNA, 14 nt, Human
gacguguuaugacu

SEQ ID NO: 1505319 - RNA, 15 nt, Human
gacguguuaugacuc

SEQ ID NO: 1505320 - RNA, 11 nt, Human
gaccuuucaau

SEQ ID NO: 1505321 - RNA, 19 nt, Human
gaccuuucaauaggaaaaa

SEQ ID NO: 1505322 - RNA, 20 nt, Human
gaccuuucaauaggaaaaac

SEQ ID NO: 1505323 - RNA, 22 nt, Human
gacgcugugcugcccugcccac

SEQ ID NO: 1505324 - RNA, 13 nt, Human
gacggagucccac

SEQ ID NO: 1505325 - RNA, 14 nt, Human
gacggagucccacc

SEQ ID NO: 1505326 - RNA, 19 nt, Human
gacccuugccgucuaccug

SEQ ID NO: 1505327 - RNA, 20 nt, Human
gacccuugccgucuaccuga

SEQ ID NO: 1505328 - RNA, 23 nt, Human
gacccuugccgucuaccugaggg

SEQ ID NO: 1505329 - RNA, 15 nt, Human
gacccuugugguccc

SEQ ID NO: 1505330 - RNA, 14 nt, Human
gaccuucuccuuca

SEQ ID NO: 1505331 - RNA, 15 nt, Human
gaccuucuccuucac

SEQ ID NO: 1505332 - RNA, 16 nt, Human
gaccuucuccuucacc

SEQ ID NO: 1505333 - RNA, 20 nt, Human
gaccuucuccuucaccuuug

SEQ ID NO: 1505334 - RNA, 21 nt, Human
gaccuucuccuucaccuuugu

SEQ ID NO: 1505335 - RNA, 14 nt, Human
gaccuugaacuggg

SEQ ID NO: 1505336 - RNA, 15 nt, Human
gaccuucuaggaagc

SEQ ID NO: 1505337 - RNA, 17 nt, Human
cuuccuugcuuaaggua

SEQ ID NO: 1505338 - RNA, 20 nt, Human
cuuccuuggacucauuuuaa

SEQ ID NO: 1505339 - RNA, 19 nt, Human
cuuccuuggacucauuuua

SEQ ID NO: 1505340 - RNA, 15 nt, Human
cuuccuuuugaggga

SEQ ID NO: 1505341 - RNA, 13 nt, Human
cuucgcuccugug

SEQ ID NO: 1505342 - RNA, 14 nt, Human
cuucgcuccugugu

SEQ ID NO: 1505343 - RNA, 15 nt, Human
cuucgcuccuguguc

SEQ ID NO: 1505344 - RNA, 20 nt, Human
cuucgggaggucgaggcagg

SEQ ID NO: 1505345 - RNA, 21 nt, Human
cuucgggaggucgaggcagga

SEQ ID NO: 1505346 - RNA, 18 nt, Human
cuucggccuccauccuga

SEQ ID NO: 1505347 - RNA, 19 nt, Human
cuucggccuccauccugag

SEQ ID NO: 1505348 - RNA, 17 nt, Human
cuucggccuccauccug

SEQ ID NO: 1505349 - RNA, 16 nt, Human
cuucgcuccugugucu

SEQ ID NO: 1505350 - RNA, 22 nt, Human
cuucucauuucaccccucccuu

SEQ ID NO: 1505351 - RNA, 17 nt, Human
cuucuccaggcuguauc

SEQ ID NO: 1505352 - RNA, 16 nt, Human
cuucuccacccugcuc

SEQ ID NO: 1505353 - RNA, 14 nt, Human
cuucuccacccugc

SEQ ID NO: 1505354 - RNA, 15 nt, Human
cuucuccacccugcu

SEQ ID NO: 1505355 - RNA, 22 nt, Human
cuucuccuucaccuuugucccc

SEQ ID NO: 1505356 - RNA, 18 nt, Human
cuucugcuucagccuccc

SEQ ID NO: 1505357 - RNA, 16 nt, Human
cuucugcuucagccuc

SEQ ID NO: 1505358 - RNA, 17 nt, Human
cuucugcuucagccucc

SEQ ID NO: 1505359 - RNA, 21 nt, Human
cuucugccauauucuguuggc

SEQ ID NO: 1505360 - RNA, 20 nt, Human
cuucugccauuucugagauc

SEQ ID NO: 1505361 - RNA, 14 nt, Human
cuucucucaucucu

SEQ ID NO: 1505362 - RNA, 16 nt, Human
cuucucucaucucuua

SEQ ID NO: 1505363 - RNA, 12 nt, Human
cuucucuccagc

SEQ ID NO: 1505364 - RNA, 17 nt, Human
cuucugccauauucugu

SEQ ID NO: 1505365 - RNA, 18 nt, Human
cuucagcgguuuauauaa

SEQ ID NO: 1505366 - RNA, 15 nt, Human
cuucagcccucaccc

SEQ ID NO: 1505367 - RNA, 16 nt, Human
cuucagcccucacccc

SEQ ID NO: 1505368 - RNA, 17 nt, Human
cuucagcccucaccccu

SEQ ID NO: 1505369 - RNA, 19 nt, Human
cuucagcccucaccccugg

SEQ ID NO: 1505370 - RNA, 11 nt, Human
cuucagcugac

SEQ ID NO: 1505371 - RNA, 23 nt, Human
cuuccacaagagcccaggccucc

SEQ ID NO: 1505372 - RNA, 18 nt, Human
cuucauuuccugugucuu

SEQ ID NO: 1505373 - RNA, 13 nt, Human
cuucagugccuua

SEQ ID NO: 1505374 - RNA, 14 nt, Human
cuucagugccuuau

SEQ ID NO: 1505375 - RNA, 11 nt, Human
cuucagugccu

SEQ ID NO: 1505376 - RNA, 12 nt, Human
cuucagugccuu

SEQ ID NO: 1505377 - RNA, 17 nt, Human
cuuccagugaggcucug

SEQ ID NO: 1505378 - RNA, 15 nt, Human
cuuccagugaggcuc

SEQ ID NO: 1505379 - RNA, 14 nt, Human
cuuccagugaggcu

SEQ ID NO: 1505380 - RNA, 22 nt, Human
cuuccaggggugggacacccug

SEQ ID NO: 1505381 - RNA, 24 nt, Human
cuuccaggggugggacacccugug

SEQ ID NO: 1505382 - RNA, 19 nt, Human
cuguuuuauaauuuuguga

SEQ ID NO: 1505383 - RNA, 21 nt, Human
cuguuuguuucugaaagggac

SEQ ID NO: 1505384 - RNA, 23 nt, Human
cuguuuguuucugaaagggacgc

SEQ ID NO: 1505385 - RNA, 21 nt, Human
cuguuuuauuuuaauucaguu

SEQ ID NO: 1505386 - RNA, 14 nt, Human
cuguuuucucuuga

SEQ ID NO: 1505387 - RNA, 18 nt, Human
cuguuuugaaucucauaa

SEQ ID NO: 1505388 - RNA, 17 nt, Human
cuguuuucucuugagag

SEQ ID NO: 1505389 - RNA, 14 nt, Human
cuguuuagauaaua

SEQ ID NO: 1505390 - RNA, 12 nt, Human
cuguuuagauaa

SEQ ID NO: 1505391 - RNA, 18 nt, Human
cuguuuguuucugaaagg

SEQ ID NO: 1505392 - RNA, 22 nt, Human
cuuaacuucacauauugauuuc

SEQ ID NO: 1505393 - RNA, 17 nt, Human
cuuaacuucacauauug

SEQ ID NO: 1505394 - RNA, 16 nt, Human
cuuaacuucacauauu

SEQ ID NO: 1505395 - RNA, 15 nt, Human
cuuaacuucacauau

SEQ ID NO: 1505396 - RNA, 14 nt, Human
cuuaacuucacaua

SEQ ID NO: 1505397 - RNA, 12 nt, Human
cuuaacuucaca

SEQ ID NO: 1505398 - RNA, 11 nt, Human
cuuaacuauuc

SEQ ID NO: 1505399 - RNA, 21 nt, Human
cuuaagaagacugcauuauau

SEQ ID NO: 1505400 - RNA, 16 nt, Human
cuuaaucuaaauggaa

SEQ ID NO: 1505401 - RNA, 14 nt, Human
cuuaaucuaaaugg

SEQ ID NO: 1505402 - RNA, 18 nt, Human
cuuaaugccacuaaauug

SEQ ID NO: 1505403 - RNA, 14 nt, Human
cuuauaauuuaaaa

SEQ ID NO: 1505404 - RNA, 15 nt, Human
cuuauacauuugaua

SEQ ID NO: 1505405 - RNA, 13 nt, Human
cuuauaauuuaaa

SEQ ID NO: 1505406 - RNA, 21 nt, Human
cuuaggguuaugauuaaguaa

SEQ ID NO: 1505407 - RNA, 17 nt, Human
cuuagguuggcaaaaag

SEQ ID NO: 1505408 - RNA, 21 nt, Human
cuuagguuggcaaaaaggcag

SEQ ID NO: 1505409 - RNA, 15 nt, Human
cuuaugauugcagau

SEQ ID NO: 1505410 - RNA, 15 nt, Human
cuuauuuaaugaaag

SEQ ID NO: 1505411 - RNA, 19 nt, Human
cuuagaugcaguucugaag

SEQ ID NO: 1505412 - RNA, 20 nt, Human
cuuagaugcaguucugaaga

SEQ ID NO: 1505413 - RNA, 19 nt, Human
cuuagacagucccugccaa

SEQ ID NO: 1505414 - RNA, 17 nt, Human
cuuagacagucccugcc

SEQ ID NO: 1505415 - RNA, 18 nt, Human
cuuagacagucccugcca

SEQ ID NO: 1505416 - RNA, 15 nt, Human
cuuagaagucacaca

SEQ ID NO: 1505417 - RNA, 14 nt, Human
cuuagacagucccu

SEQ ID NO: 1505418 - RNA, 15 nt, Human
cuuagacagucccug

SEQ ID NO: 1505419 - RNA, 16 nt, Human
cuuagacagucccugc

SEQ ID NO: 1505420 - RNA, 24 nt, Human
cuuacuugcauaccaaguugauac

SEQ ID NO: 1505421 - RNA, 16 nt, Human
cuuacuguacaugaaa

SEQ ID NO: 1505422 - RNA, 14 nt, Human
cuuacuccaggaga

SEQ ID NO: 1505423 - RNA, 19 nt, Human
cuuacuaguuucccuugca

SEQ ID NO: 1505424 - RNA, 15 nt, Human
cuuacgugaguccug

SEQ ID NO: 1505425 - RNA, 20 nt, Human
cuugcuugauuguauggugg

SEQ ID NO: 1505426 - RNA, 20 nt, Human
cuuggaagcuccgcuuucua

SEQ ID NO: 1505427 - RNA, 22 nt, Human
cuugcucugcugacagacacag

SEQ ID NO: 1505428 - RNA, 22 nt, Human
cuugcccuguuaaaagaugaaa

SEQ ID NO: 1505429 - RNA, 17 nt, Human
cuugcaugaggcuagug

SEQ ID NO: 1505430 - RNA, 13 nt, Human
cuugcaugaggcu

SEQ ID NO: 1505431 - RNA, 14 nt, Human
cuugcaugaggcua

SEQ ID NO: 1505432 - RNA, 14 nt, Human
cuugcccuguuaaa

SEQ ID NO: 1505433 - RNA, 21 nt, Human
cuugaguugauucagcucugc

SEQ ID NO: 1505434 - RNA, 20 nt, Human
cuugaguugauucagcucug

SEQ ID NO: 1505435 - RNA, 19 nt, Human
cuugaguugauucagcucu

SEQ ID NO: 1505436 - RNA, 15 nt, Human
cuugcaauggcagcc

SEQ ID NO: 1505437 - RNA, 16 nt, Human
cuugcaauggcagccu

SEQ ID NO: 1505438 - RNA, 17 nt, Human
cuugcaauggcagccuu

SEQ ID NO: 1505439 - RNA, 18 nt, Human
cuugcaauggcagccuug

SEQ ID NO: 1505440 - RNA, 21 nt, Human
cuugcagacucuacagaggcc

SEQ ID NO: 1505441 - RNA, 16 nt, Human
cuugagccugggaggu

SEQ ID NO: 1505442 - RNA, 15 nt, Human
cuugaggguugggcu

SEQ ID NO: 1505443 - RNA, 17 nt, Human
cuugaggguugggcugg

SEQ ID NO: 1505444 - RNA, 12 nt, Human
cuugagccuggg

SEQ ID NO: 1505445 - RNA, 15 nt, Human
cuugagccugggagg

SEQ ID NO: 1505446 - RNA, 16 nt, Human
cuuggggcugaugcag

SEQ ID NO: 1505447 - RNA, 18 nt, Human
cuuggggcugaugcaguu

SEQ ID NO: 1505448 - RNA, 15 nt, Human
cuugguuuguaaauu

SEQ ID NO: 1505449 - RNA, 14 nt, Human
cuugguuuguaaau

SEQ ID NO: 1505450 - RNA, 20 nt, Human
cuugguuuguaaauuaacuu

SEQ ID NO: 1505451 - RNA, 20 nt, Human
cuugggccacugugaagaga

SEQ ID NO: 1505452 - RNA, 16 nt, Human
cuuggacucauuuuaa

SEQ ID NO: 1505453 - RNA, 17 nt, Human
cuuuaccuuuuuuauac

SEQ ID NO: 1505454 - RNA, 20 nt, Human
cuuuaccuuuuuuauacaua

SEQ ID NO: 1505455 - RNA, 19 nt, Human
cuuuaccuuuuuuauacau

SEQ ID NO: 1505456 - RNA, 22 nt, Human
cuuguguuuuuaacucaauauu

SEQ ID NO: 1505457 - RNA, 16 nt, Human
cuuguuaagauaguua

SEQ ID NO: 1505458 - RNA, 16 nt, Human
cuuguggucccacccc

SEQ ID NO: 1505459 - RNA, 19 nt, Human
cuuguggucccaccccaca

SEQ ID NO: 1505460 - RNA, 15 nt, Human
cuuguggucccaccc

SEQ ID NO: 1505461 - RNA, 21 nt, Human
cuuucuugaucaacaucuuuu

SEQ ID NO: 1505462 - RNA, 22 nt, Human
cuuucuugaucaacaucuuuuc

SEQ ID NO: 1505463 - RNA, 13 nt, Human
cuuucugaaauaa

SEQ ID NO: 1505464 - RNA, 16 nt, Human
cuuuccucuuuggucu

SEQ ID NO: 1505465 - RNA, 14 nt, Human
cuuuggcagaguuc

SEQ ID NO: 1505466 - RNA, 17 nt, Human
cuuugggccuggcuccc

SEQ ID NO: 1505467 - RNA, 23 nt, Human
cuuugugaggaagccgcuggggc

SEQ ID NO: 1505468 - RNA, 16 nt, Human
cuuuguucuggcucuu

SEQ ID NO: 1505469 - RNA, 21 nt, Human
cuuuguucuggcucuuccagg

SEQ ID NO: 1505470 - RNA, 13 nt, Human
cuuuguggcuucc

SEQ ID NO: 1505471 - RNA, 12 nt, Human
cuuugugauuuu

SEQ ID NO: 1505472 - RNA, 13 nt, Human
cuuugaccucugc

SEQ ID NO: 1505473 - RNA, 14 nt, Human
cuuugcuugaaaga

SEQ ID NO: 1505474 - RNA, 23 nt, Human
cuuuggaaagacuuuuccaaccc

SEQ ID NO: 1505475 - RNA, 12 nt, Human
cuuuggaaagac

SEQ ID NO: 1505476 - RNA, 14 nt, Human
gaaaacaaggauga

SEQ ID NO: 1505477 - RNA, 19 nt, Human
gaaaacacuguucucugcc

SEQ ID NO: 1505478 - RNA, 18 nt, Human
gaaaacaugcuacacacu

SEQ ID NO: 1505479 - RNA, 20 nt, Human
gaaaacacuguucucugccc

SEQ ID NO: 1505480 - RNA, 21 nt, Human
gaaaacacuguucucugcccu

SEQ ID NO: 1505481 - RNA, 16 nt, Human
cuuuuuuagaguugau

SEQ ID NO: 1505482 - RNA, 19 nt, Human
gaaaauaacaauaaaagac

SEQ ID NO: 1505483 - RNA, 14 nt, Human
gaaaaguauguuag

SEQ ID NO: 1505484 - RNA, 20 nt, Human
gaaaaguauguuagugcaaa

SEQ ID NO: 1505485 - RNA, 22 nt, Human
gaaaacacuguucucugcccuc

SEQ ID NO: 1505486 - RNA, 19 nt, Human
gaaaacaugcuacacacug

SEQ ID NO: 1505487 - RNA, 14 nt, Human
gaaaacguggcugc

SEQ ID NO: 1505488 - RNA, 22 nt, Human
cuuuuguucuugguuuguaaau

SEQ ID NO: 1505489 - RNA, 21 nt, Human
cuuuguuuguugucagcugaa

SEQ ID NO: 1505490 - RNA, 18 nt, Human
cuuuucuugcaugaggcu

SEQ ID NO: 1505491 - RNA, 15 nt, Human
cuuuucuguuugcua

SEQ ID NO: 1505492 - RNA, 23 nt, Human
cuggauuaaacuuaaucuaaaug

SEQ ID NO: 1505493 - RNA, 13 nt, Human
cuggauuaaacuu

SEQ ID NO: 1505494 - RNA, 16 nt, Human
cuggauggggcugcac

SEQ ID NO: 1505495 - RNA, 15 nt, Human
cuggauggggcugca

SEQ ID NO: 1505496 - RNA, 18 nt, Human
cuggcacaguuuucugag

SEQ ID NO: 1505497 - RNA, 19 nt, Human
cuggcacaguuuucugaga

SEQ ID NO: 1505498 - RNA, 23 nt, Human
cuggcacuauaauguaagcucua

SEQ ID NO: 1505499 - RNA, 20 nt, Human
cuggcacaguuuucugagaa

SEQ ID NO: 1505500 - RNA, 13 nt, Human
cuggcacugcuuc

SEQ ID NO: 1505501 - RNA, 14 nt, Human
cuggcacugcuucc

SEQ ID NO: 1505502 - RNA, 22 nt, Human
cuggccucaagugauucuccug

SEQ ID NO: 1505503 - RNA, 23 nt, Human
cuggccuagcauacguacacauu

SEQ ID NO: 1505504 - RNA, 12 nt, Human
cuggcccacugc

SEQ ID NO: 1505505 - RNA, 13 nt, Human
cuggcccacugca

SEQ ID NO: 1505506 - RNA, 17 nt, Human
cuggccuagcauacgua

SEQ ID NO: 1505507 - RNA, 16 nt, Human
cuggccaacgggguga

SEQ ID NO: 1505508 - RNA, 16 nt, Human
cuggccagaugcacca

SEQ ID NO: 1505509 - RNA, 15 nt, Human
cuggcacugcuucca

SEQ ID NO: 1505510 - RNA, 16 nt, Human
cuggcacugcuuccag

SEQ ID NO: 1505511 - RNA, 17 nt, Human
cuggcacugcuuccagu

SEQ ID NO: 1505512 - RNA, 18 nt, Human
cuggcacugcuuccagug

SEQ ID NO: 1505513 - RNA, 22 nt, Human
cuggccagaugcaccagcccuu

SEQ ID NO: 1505514 - RNA, 21 nt, Human
cuggccagaugcaccagcccu

SEQ ID NO: 1505515 - RNA, 17 nt, Human
cuggccagaugcaccag

SEQ ID NO: 1505516 - RNA, 18 nt, Human
cuggccagaugcaccagc

SEQ ID NO: 1505517 - RNA, 19 nt, Human
cuggccagaugcaccagcc

SEQ ID NO: 1505518 - RNA, 20 nt, Human
cuggccagaugcaccagccc

SEQ ID NO: 1505519 - RNA, 16 nt, Human
cuggagcccagaggag

SEQ ID NO: 1505520 - RNA, 17 nt, Human
cuggagcccagaggagg

SEQ ID NO: 1505521 - RNA, 16 nt, Human
cuggagcuagaauuug

SEQ ID NO: 1505522 - RNA, 17 nt, Human
cuggagcuagaauuuga

SEQ ID NO: 1505523 - RNA, 22 nt, Human
cuggagcuagaauuugauaugu

SEQ ID NO: 1505524 - RNA, 12 nt, Human
cuggagcucugc

SEQ ID NO: 1505525 - RNA, 14 nt, Human
cuggacaggcaugu

SEQ ID NO: 1505526 - RNA, 23 nt, Human
cuggaauaauccuaaacauauga

SEQ ID NO: 1505527 - RNA, 15 nt, Human
cuggaagcacagcuu

SEQ ID NO: 1505528 - RNA, 18 nt, Human
cuggaagcacagcuucau

SEQ ID NO: 1505529 - RNA, 15 nt, Human
cuggaaugcaguggu

SEQ ID NO: 1505530 - RNA, 18 nt, Human
cugcugaaacaacaaaua

SEQ ID NO: 1505531 - RNA, 13 nt, Human
cugcugaaacaac

SEQ ID NO: 1505532 - RNA, 16 nt, Human
cugggagcuuuuguag

SEQ ID NO: 1505533 - RNA, 22 nt, Human
cugggaacccaaguccaagcau

SEQ ID NO: 1505534 - RNA, 18 nt, Human
cugggaggucaaggcugc

SEQ ID NO: 1505535 - RNA, 20 nt, Human
cugggcaaugugauaaaacc

SEQ ID NO: 1505536 - RNA, 16 nt, Human
cugggagugagcuggu

SEQ ID NO: 1505537 - RNA, 13 nt, Human
cugggagugagcu

SEQ ID NO: 1505538 - RNA, 20 nt, Human
cuggcuguuggcugggggcc

SEQ ID NO: 1505539 - RNA, 21 nt, Human
cuggcuggguggcaccagcag

SEQ ID NO: 1505540 - RNA, 22 nt, Human
cuggcuggguggcaccagcagc

SEQ ID NO: 1505541 - RNA, 19 nt, Human
cuggcuguuggcugggggc

SEQ ID NO: 1505542 - RNA, 20 nt, Human
cuggcucuuccaggcuggga

SEQ ID NO: 1505543 - RNA, 18 nt, Human
cuggcucuuccaggcugg

SEQ ID NO: 1505544 - RNA, 19 nt, Human
cuggcucuuccaggcuggg

SEQ ID NO: 1505545 - RNA, 13 nt, Human
cuggccugagcug

SEQ ID NO: 1505546 - RNA, 17 nt, Human
cuggcucuuccaggcug

SEQ ID NO: 1505547 - RNA, 15 nt, Human
cuggccugagcuggg

SEQ ID NO: 1505548 - RNA, 21 nt, Human
cuggguacuuguggacacagc

SEQ ID NO: 1505549 - RNA, 23 nt, Human
cuggguacuuguggacacagcuc

SEQ ID NO: 1505550 - RNA, 21 nt, Human
cugggguggggaccucaggcc

SEQ ID NO: 1505551 - RNA, 22 nt, Human
cugggguggggaccucaggccu

SEQ ID NO: 1505552 - RNA, 23 nt, Human
cugggguggggaccucaggccug

SEQ ID NO: 1505553 - RNA, 20 nt, Human
cuggguacuuguggacacag

SEQ ID NO: 1505554 - RNA, 17 nt, Human
cugggguggggaccuca

SEQ ID NO: 1505555 - RNA, 18 nt, Human
cugggguggggaccucag

SEQ ID NO: 1505556 - RNA, 19 nt, Human
cugggguggggaccucagg

SEQ ID NO: 1505557 - RNA, 13 nt, Human
cugggggccucag

SEQ ID NO: 1505558 - RNA, 17 nt, Human
cugggggccucagugcc

SEQ ID NO: 1505559 - RNA, 18 nt, Human
cugggggccucagugcca

SEQ ID NO: 1505560 - RNA, 18 nt, Human
cugggcuucaguggcagc

SEQ ID NO: 1505561 - RNA, 19 nt, Human
cugggcuucaguggcagcu

SEQ ID NO: 1505562 - RNA, 20 nt, Human
cugggcuucaguggcagcug

SEQ ID NO: 1505563 - RNA, 21 nt, Human
cugggcuucaguggcagcugc

SEQ ID NO: 1505564 - RNA, 22 nt, Human
cugggcuucaguggcagcugcu

SEQ ID NO: 1505565 - RNA, 23 nt, Human
cugggcuucaguggcagcugcuu

SEQ ID NO: 1505566 - RNA, 13 nt, Human
cugggcuugggga

SEQ ID NO: 1505567 - RNA, 17 nt, Human
cugggcuuggggaccag

SEQ ID NO: 1505568 - RNA, 20 nt, Human
cugggcuuggggaccagagc

SEQ ID NO: 1505569 - RNA, 21 nt, Human
cugggcuuggggaccagagcu

SEQ ID NO: 1505570 - RNA, 19 nt, Human
cugggcucccuucccaccu

SEQ ID NO: 1505571 - RNA, 13 nt, Human
cuggguuggaggg

SEQ ID NO: 1505572 - RNA, 15 nt, Human
cugguccauagagag

SEQ ID NO: 1505573 - RNA, 17 nt, Human
cugguccauagagagca

SEQ ID NO: 1505574 - RNA, 18 nt, Human
cugguccauagagagcaa

SEQ ID NO: 1505575 - RNA, 21 nt, Human
cugguccauagagagcaagac

SEQ ID NO: 1505576 - RNA, 15 nt, Human
cuggucccacucagu

SEQ ID NO: 1505577 - RNA, 18 nt, Human
cuggucccacucagucca

SEQ ID NO: 1505578 - RNA, 23 nt, Human
cugguggcagugggagcugccug

SEQ ID NO: 1505579 - RNA, 12 nt, Human
cugguucucauc

SEQ ID NO: 1505580 - RNA, 14 nt, Human
cugguucucaucuu

SEQ ID NO: 1505581 - RNA, 15 nt, Human
cugguucucaucuuu

SEQ ID NO: 1505582 - RNA, 16 nt, Human
cugguucucaucuuuc

SEQ ID NO: 1505583 - RNA, 20 nt, Human
cugguucucaucuuucuuga

SEQ ID NO: 1505584 - RNA, 13 nt, Human
cugcccugcccac

SEQ ID NO: 1505585 - RNA, 14 nt, Human
cugcccugcccacc

SEQ ID NO: 1505586 - RNA, 15 nt, Human
cugcccugcccaccu

SEQ ID NO: 1505587 - RNA, 16 nt, Human
cugcccugcccaccug

SEQ ID NO: 1505588 - RNA, 11 nt, Human
cugcccggcug

SEQ ID NO: 1505589 - RNA, 15 nt, Human
cugcccggcugcgga

SEQ ID NO: 1505590 - RNA, 14 nt, Human
cugccccuggcagc

SEQ ID NO: 1505591 - RNA, 15 nt, Human
cugccccuggcagcc

SEQ ID NO: 1505592 - RNA, 16 nt, Human
cugccccuggcagccc

SEQ ID NO: 1505593 - RNA, 17 nt, Human
cugccccuggcagcccc

SEQ ID NO: 1505594 - RNA, 13 nt, Human
cugcccaggcccc

SEQ ID NO: 1505595 - RNA, 16 nt, Human
cugccauuucugagau

SEQ ID NO: 1505596 - RNA, 17 nt, Human
cugccaugccagcuuau

SEQ ID NO: 1505597 - RNA, 19 nt, Human
cugccaugccagcuuaucu

SEQ ID NO: 1505598 - RNA, 19 nt, Human
cugccagccgagauagcca

SEQ ID NO: 1505599 - RNA, 15 nt, Human
cugccaggaagccag

SEQ ID NO: 1505600 - RNA, 16 nt, Human
cugccaggaagccagc

SEQ ID NO: 1505601 - RNA, 18 nt, Human
cugccaggaagccagcag

SEQ ID NO: 1505602 - RNA, 19 nt, Human
cugccaggaagccagcagg

SEQ ID NO: 1505603 - RNA, 15 nt, Human
cugccacccugggga

SEQ ID NO: 1505604 - RNA, 16 nt, Human
cugccacccuggggag

SEQ ID NO: 1505605 - RNA, 20 nt, Human
cugccacccuggggagaaag

SEQ ID NO: 1505606 - RNA, 13 nt, Human
cugccucuucucu

SEQ ID NO: 1505607 - RNA, 14 nt, Human
cugccucuucucua

SEQ ID NO: 1505608 - RNA, 13 nt, Human
cugccugcccagg

SEQ ID NO: 1505609 - RNA, 14 nt, Human
cugccugcccaggc

SEQ ID NO: 1505610 - RNA, 15 nt, Human
cugccugcccaggcc

SEQ ID NO: 1505611 - RNA, 14 nt, Human
cugccucagccucc

SEQ ID NO: 1505612 - RNA, 13 nt, Human
cugccucagccuc

SEQ ID NO: 1505613 - RNA, 17 nt, Human
cugcccugcccaccugg

SEQ ID NO: 1505614 - RNA, 15 nt, Human
cugccuaagugcagc

SEQ ID NO: 1505615 - RNA, 20 nt, Human
cugcggaaugaaccacaucu

SEQ ID NO: 1505616 - RNA, 15 nt, Human
cugcgguccacccag

SEQ ID NO: 1505617 - RNA, 21 nt, Human
cugcggaaugaaccacaucuu

SEQ ID NO: 1505618 - RNA, 17 nt, Human
cugcgguccacccagga

SEQ ID NO: 1505619 - RNA, 16 nt, Human
cugcgguccacccagg

SEQ ID NO: 1505620 - RNA, 14 nt, Human
cugcuccagcuguu

SEQ ID NO: 1505621 - RNA, 15 nt, Human
cugcuccagcuguuc

SEQ ID NO: 1505622 - RNA, 16 nt, Human
cugcuccucuccccag

SEQ ID NO: 1505623 - RNA, 17 nt, Human
cugcuccucuccccagc

SEQ ID NO: 1505624 - RNA, 18 nt, Human
cugcuccucuccccagca

SEQ ID NO: 1505625 - RNA, 17 nt, Human
cugcucuccuuccugga

SEQ ID NO: 1505626 - RNA, 19 nt, Human
cugcucuccuuccuggagc

SEQ ID NO: 1505627 - RNA, 20 nt, Human
cugcucuccuuccuggagcc

SEQ ID NO: 1505628 - RNA, 12 nt, Human
cugacccacugc

SEQ ID NO: 1505629 - RNA, 13 nt, Human
cugacccaugcug

SEQ ID NO: 1505630 - RNA, 22 nt, Human
cugagugggggaucacagccuc

SEQ ID NO: 1505631 - RNA, 13 nt, Human
cugauaaagauga

SEQ ID NO: 1505632 - RNA, 17 nt, Human
cugagucugaaggcugg

SEQ ID NO: 1505633 - RNA, 13 nt, Human
cugagucugaagg

SEQ ID NO: 1505634 - RNA, 14 nt, Human
cugagucugaaggc

SEQ ID NO: 1505635 - RNA, 15 nt, Human
cugagucugaaggcu

SEQ ID NO: 1505636 - RNA, 16 nt, Human
cugagucugaaggcug

SEQ ID NO: 1505637 - RNA, 13 nt, Human
cugauguuccuag

SEQ ID NO: 1505638 - RNA, 18 nt, Human
cugauguuccuagugaaa

SEQ ID NO: 1505639 - RNA, 20 nt, Human
cugauguuccuagugaaaga

SEQ ID NO: 1505640 - RNA, 21 nt, Human
cugauguuccuagugaaagag

SEQ ID NO: 1505641 - RNA, 22 nt, Human
cugauucccaagcucugcuccu

SEQ ID NO: 1505642 - RNA, 19 nt, Human
cugauucccaagcucugcu

SEQ ID NO: 1505643 - RNA, 20 nt, Human
cugauucccaagcucugcuc

SEQ ID NO: 1505644 - RNA, 15 nt, Human
cugauucccaagcuc

SEQ ID NO: 1505645 - RNA, 17 nt, Human
cugauucccaagcucug

SEQ ID NO: 1505646 - RNA, 18 nt, Human
cugauucccaagcucugc

SEQ ID NO: 1505647 - RNA, 21 nt, Human
cugauaaagaugagugagcau

SEQ ID NO: 1505648 - RNA, 14 nt, Human
cugaucucucguga

SEQ ID NO: 1505649 - RNA, 17 nt, Human
cugcacccucaggcagg

SEQ ID NO: 1505650 - RNA, 18 nt, Human
cugcacccucaggcaggu

SEQ ID NO: 1505651 - RNA, 18 nt, Human
cugcacaagcugcacccu

SEQ ID NO: 1505652 - RNA, 13 nt, Human
cugcacaagcugc

SEQ ID NO: 1505653 - RNA, 14 nt, Human
cugcacaagcugca

SEQ ID NO: 1505654 - RNA, 15 nt, Human
cugcacaagcugcac

SEQ ID NO: 1505655 - RNA, 16 nt, Human
cugcacaagcugcacc

SEQ ID NO: 1505656 - RNA, 18 nt, Human
cugcaauuucauaugcug

SEQ ID NO: 1505657 - RNA, 20 nt, Human
cugcaauuucauaugcugua

SEQ ID NO: 1505658 - RNA, 22 nt, Human
cugcagggaguccgaaagggac

SEQ ID NO: 1505659 - RNA, 22 nt, Human
cugcagccucaaccuccugggc

SEQ ID NO: 1505660 - RNA, 19 nt, Human
cugcagccucaaccuccug

SEQ ID NO: 1505661 - RNA, 20 nt, Human
cugcagccucaaccuccugg

SEQ ID NO: 1505662 - RNA, 11 nt, Human
cugcagccuca

SEQ ID NO: 1505663 - RNA, 14 nt, Human
cugcacuugcagac

SEQ ID NO: 1505664 - RNA, 16 nt, Human
cugcacuugcagacuc

SEQ ID NO: 1505665 - RNA, 17 nt, Human
cugcacuugcagacucu

SEQ ID NO: 1505666 - RNA, 17 nt, Human
cugcaccggcuggccug

SEQ ID NO: 1505667 - RNA, 18 nt, Human
cugcaccggcuggccugg

SEQ ID NO: 1505668 - RNA, 19 nt, Human
cugcaccggcuggccuggc

SEQ ID NO: 1505669 - RNA, 20 nt, Human
cugcaccggcuggccuggcc

SEQ ID NO: 1505670 - RNA, 23 nt, Human
cugcagaagacaguauggcagcu

SEQ ID NO: 1505671 - RNA, 13 nt, Human
cugcagaagacag

SEQ ID NO: 1505672 - RNA, 14 nt, Human
cugaauuuaaauag

SEQ ID NO: 1505673 - RNA, 18 nt, Human
cugaauuuaaauagcuuu

SEQ ID NO: 1505674 - RNA, 23 nt, Human
cugaauuuaaauagcuuuuuucu

SEQ ID NO: 1505675 - RNA, 19 nt, Human
cugacagacacaggcccgg

SEQ ID NO: 1505676 - RNA, 11 nt, Human
cugacaggcaa

SEQ ID NO: 1505677 - RNA, 21 nt, Human
cugacagacacaggcccggcu

SEQ ID NO: 1505678 - RNA, 17 nt, Human
cugacauuguuggccaa

SEQ ID NO: 1505679 - RNA, 21 nt, Human
cugacaggcaaugcuggcugu

SEQ ID NO: 1505680 - RNA, 20 nt, Human
cugacaggcaaugcuggcug

SEQ ID NO: 1505681 - RNA, 16 nt, Human
cugacaggcaaugcug

SEQ ID NO: 1505682 - RNA, 17 nt, Human
cugacaggcaaugcugg

SEQ ID NO: 1505683 - RNA, 18 nt, Human
cugacaggcaaugcuggc

SEQ ID NO: 1505684 - RNA, 19 nt, Human
cugacaggcaaugcuggcu

SEQ ID NO: 1505685 - RNA, 21 nt, Human
cugacauuguuggccaaagcc

SEQ ID NO: 1505686 - RNA, 11 nt, Human
cugacccacug

SEQ ID NO: 1505687 - RNA, 21 nt, Human
cugaaccuggguaacuaggga

SEQ ID NO: 1505688 - RNA, 18 nt, Human
cucuuugggccuggcucc

SEQ ID NO: 1505689 - RNA, 19 nt, Human
cucuuuggucuacacugug

SEQ ID NO: 1505690 - RNA, 21 nt, Human
cucuuuggucuacacugugcu

SEQ ID NO: 1505691 - RNA, 21 nt, Human
cugaagacucauucuucugua

SEQ ID NO: 1505692 - RNA, 15 nt, Human
cugaacuuggcgcug

SEQ ID NO: 1505693 - RNA, 16 nt, Human
cugaacuuggcgcugc

SEQ ID NO: 1505694 - RNA, 21 nt, Human
cugaacuuggcgcugccccug

SEQ ID NO: 1505695 - RNA, 14 nt, Human
cugaagucacacag

SEQ ID NO: 1505696 - RNA, 16 nt, Human
cugaagucacacagug

SEQ ID NO: 1505697 - RNA, 15 nt, Human
cugaagucacacagu

SEQ ID NO: 1505698 - RNA, 24 nt, Human
cugaagucuuuguacagacaacaa

SEQ ID NO: 1505699 - RNA, 16 nt, Human
cugaauacagaggcaa

SEQ ID NO: 1505700 - RNA, 23 nt, Human
cucuuccaggcugggagagccuu

SEQ ID NO: 1505701 - RNA, 22 nt, Human
cucuuccaggcugggagagccu

SEQ ID NO: 1505702 - RNA, 21 nt, Human
cucuuccaggcugggagagcc

SEQ ID NO: 1505703 - RNA, 13 nt, Human
cucuucuccaggc

SEQ ID NO: 1505704 - RNA, 12 nt, Human
cucuucuccagg

SEQ ID NO: 1505705 - RNA, 13 nt, Human
cucuuaagaagac

SEQ ID NO: 1505706 - RNA, 13 nt, Human
cucuuaaaaccca

SEQ ID NO: 1505707 - RNA, 24 nt, Human
cucuuaaaacccaagugccuuagc

SEQ ID NO: 1505708 - RNA, 17 nt, Human
cucuggcagcucagaga

SEQ ID NO: 1505709 - RNA, 18 nt, Human
cucuggcagcucagagag

SEQ ID NO: 1505710 - RNA, 20 nt, Human
cucuggcagcucagagaggg

SEQ ID NO: 1505711 - RNA, 19 nt, Human
cucuggcagcucagagagg

SEQ ID NO: 1505712 - RNA, 18 nt, Human
cucuugguccugcugcag

SEQ ID NO: 1505713 - RNA, 19 nt, Human
cucuugguccugcugcagu

SEQ ID NO: 1505714 - RNA, 13 nt, Human
cucuugagccugg

SEQ ID NO: 1505715 - RNA, 16 nt, Human
cucuugaccucaggug

SEQ ID NO: 1505716 - RNA, 13 nt, Human
cucuugaccucag

SEQ ID NO: 1505717 - RNA, 15 nt, Human
cucuugaccucaggu

SEQ ID NO: 1505718 - RNA, 17 nt, Human
cucuuuccaucuacccu

SEQ ID NO: 1505719 - RNA, 13 nt, Human
cucuuucccuccc

SEQ ID NO: 1505720 - RNA, 15 nt, Human
cucuuuggacacuca

SEQ ID NO: 1505721 - RNA, 18 nt, Human
cucuuuggacacucacac

SEQ ID NO: 1505722 - RNA, 17 nt, Human
cucucaucucuuagcuc

SEQ ID NO: 1505723 - RNA, 23 nt, Human
cucucaggccagcugcuugggcu

SEQ ID NO: 1505724 - RNA, 12 nt, Human
cucuccagcccc

SEQ ID NO: 1505725 - RNA, 13 nt, Human
cucuccagccccu

SEQ ID NO: 1505726 - RNA, 13 nt, Human
cucucccaucacu

SEQ ID NO: 1505727 - RNA, 20 nt, Human
cucucccaucacuucccuac

SEQ ID NO: 1505728 - RNA, 14 nt, Human
cucucccaucacuu

SEQ ID NO: 1505729 - RNA, 18 nt, Human
cucucccaucacuucccu

SEQ ID NO: 1505730 - RNA, 15 nt, Human
cucucucacuccuug

SEQ ID NO: 1505731 - RNA, 16 nt, Human
cucucucacuccuuga

SEQ ID NO: 1505732 - RNA, 12 nt, Human
cucucucaggcc

SEQ ID NO: 1505733 - RNA, 13 nt, Human
cucucucaggcca

SEQ ID NO: 1505734 - RNA, 15 nt, Human
cucuccuguaccucu

SEQ ID NO: 1505735 - RNA, 14 nt, Human
cucuccuguaccuc

SEQ ID NO: 1505736 - RNA, 13 nt, Human
cucuccuguaccu

SEQ ID NO: 1505737 - RNA, 13 nt, Human
cucuccccagcaa

SEQ ID NO: 1505738 - RNA, 18 nt, Human
cucuccuguaccucuuga

SEQ ID NO: 1505739 - RNA, 17 nt, Human
cucuccuguaccucuug

SEQ ID NO: 1505740 - RNA, 22 nt, Human
cucuccuguaccucuugagccu

SEQ ID NO: 1505741 - RNA, 14 nt, Human
cucuggacaggcau

SEQ ID NO: 1505742 - RNA, 14 nt, Human
cucugccucugaca

SEQ ID NO: 1505743 - RNA, 16 nt, Human
cucugccucugacaca

SEQ ID NO: 1505744 - RNA, 12 nt, Human
cucugcccuugg

SEQ ID NO: 1505745 - RNA, 14 nt, Human
cucugcccuccaag

SEQ ID NO: 1505746 - RNA, 15 nt, Human
cucugcccuccaaga

SEQ ID NO: 1505747 - RNA, 16 nt, Human
cucugcccuccaagac

SEQ ID NO: 1505748 - RNA, 23 nt, Human
cucugcccuccaagaccuucucc

SEQ ID NO: 1505749 - RNA, 23 nt, Human
cucugcauacucauuaggauggc

SEQ ID NO: 1505750 - RNA, 10 nt, Human
cucugcacaa

SEQ ID NO: 1505751 - RNA, 22 nt, Human
cucugcaagaauugaagcagga

SEQ ID NO: 1505752 - RNA, 20 nt, Human
cucugagacucgcgacaaug

SEQ ID NO: 1505753 - RNA, 14 nt, Human
cucauauuuucaug

SEQ ID NO: 1505754 - RNA, 21 nt, Human
cucauuagcauuuugcuaaau

SEQ ID NO: 1505755 - RNA, 17 nt, Human
cucauuaggauggcuag

SEQ ID NO: 1505756 - RNA, 18 nt, Human
cucauuaggauggcuagu

SEQ ID NO: 1505757 - RNA, 16 nt, Human
cucauugaccugaggc

SEQ ID NO: 1505758 - RNA, 23 nt, Human
cucauucuucuguacgucugaca

SEQ ID NO: 1505759 - RNA, 13 nt, Human
cucauugaccuga

SEQ ID NO: 1505760 - RNA, 15 nt, Human
cucauugaccugagg

SEQ ID NO: 1505761 - RNA, 13 nt, Human
cucauucuucugu

SEQ ID NO: 1505762 - RNA, 14 nt, Human
cucauucuucugua

SEQ ID NO: 1505763 - RNA, 23 nt, Human
cuaaaagguaugcaaucaaaucu

SEQ ID NO: 1505764 - RNA, 12 nt, Human
cucagggucccu

SEQ ID NO: 1505765 - RNA, 14 nt, Human
cucagggucccugg

SEQ ID NO: 1505766 - RNA, 22 nt, Human
cucagguggggucacucuggca

SEQ ID NO: 1505767 - RNA, 23 nt, Human
cucagguggggucacucuggcag

SEQ ID NO: 1505768 - RNA, 15 nt, Human
cucaggugucccugc

SEQ ID NO: 1505769 - RNA, 16 nt, Human
cucaggugucccugca

SEQ ID NO: 1505770 - RNA, 17 nt, Human
cucaggugucccugcac

SEQ ID NO: 1505771 - RNA, 18 nt, Human
cucaggugucccugcacu

SEQ ID NO: 1505772 - RNA, 19 nt, Human
cucaggugucccugcacuu

SEQ ID NO: 1505773 - RNA, 14 nt, Human
cucaggugagaagc

SEQ ID NO: 1505774 - RNA, 15 nt, Human
cucauacccaccccc

SEQ ID NO: 1505775 - RNA, 22 nt, Human
cucauaauuuauacaggucaua

SEQ ID NO: 1505776 - RNA, 13 nt, Human
cucauaauuuaua

SEQ ID NO: 1505777 - RNA, 15 nt, Human
cucauaauuuauaca

SEQ ID NO: 1505778 - RNA, 20 nt, Human
cucauaguaugguggcuggg

SEQ ID NO: 1505779 - RNA, 18 nt, Human
cucauaguaugguggcug

SEQ ID NO: 1505780 - RNA, 19 nt, Human
cucauaguaugguggcugg

SEQ ID NO: 1505781 - RNA, 11 nt, Human
cuccacccugc

SEQ ID NO: 1505782 - RNA, 12 nt, Human
cuccacccugcu

SEQ ID NO: 1505783 - RNA, 17 nt, Human
cuccaccugccagggac

SEQ ID NO: 1505784 - RNA, 18 nt, Human
cuccaccugccagggaca

SEQ ID NO: 1505785 - RNA, 21 nt, Human
cuccaccugccagggacagag

SEQ ID NO: 1505786 - RNA, 19 nt, Human
cuccagcucaccagcccca

SEQ ID NO: 1505787 - RNA, 20 nt, Human
cuccagcucaccagccccag

SEQ ID NO: 1505788 - RNA, 13 nt, Human
cuccagcuguuca

SEQ ID NO: 1505789 - RNA, 18 nt, Human
cuccagcuguucagcugg

SEQ ID NO: 1505790 - RNA, 19 nt, Human
cuccagcuguucagcuggu

SEQ ID NO: 1505791 - RNA, 23 nt, Human
cuccauccugaggcuccacuugg

SEQ ID NO: 1505792 - RNA, 21 nt, Human
cuccauccugaggcuccacuu

SEQ ID NO: 1505793 - RNA, 15 nt, Human
cuccaggcuccuuua

SEQ ID NO: 1505794 - RNA, 11 nt, Human
cuccaggcucc

SEQ ID NO: 1505795 - RNA, 22 nt, Human
cucccaggcauuccccaggagg

SEQ ID NO: 1505796 - RNA, 17 nt, Human
cucccagucauuuaaua

SEQ ID NO: 1505797 - RNA, 17 nt, Human
cucccaggcauucccca

SEQ ID NO: 1505798 - RNA, 19 nt, Human
cucccaggcauuccccagg

SEQ ID NO: 1505799 - RNA, 20 nt, Human
cucccaggcauuccccagga

SEQ ID NO: 1505800 - RNA, 21 nt, Human
cucccaggcauuccccaggag

SEQ ID NO: 1505801 - RNA, 21 nt, Human
cucccaaggggcccaaauucu

SEQ ID NO: 1505802 - RNA, 22 nt, Human
cucccaaggggcccaaauucuu

SEQ ID NO: 1505803 - RNA, 14 nt, Human
cuccugugugugcg

SEQ ID NO: 1505804 - RNA, 14 nt, Human
cuccuucaccuuug

SEQ ID NO: 1505805 - RNA, 16 nt, Human
cuccuucaccuuuguc

SEQ ID NO: 1505806 - RNA, 19 nt, Human
cuccuucaccuuugucccc

SEQ ID NO: 1505807 - RNA, 21 nt, Human
cuccuucaccuuuguccccac

SEQ ID NO: 1505808 - RNA, 16 nt, Human
cuccugcaggcagcca

SEQ ID NO: 1505809 - RNA, 22 nt, Human
cuccugcaggcagccaggccac

SEQ ID NO: 1505810 - RNA, 15 nt, Human
cuccugcaggcagcc

SEQ ID NO: 1505811 - RNA, 21 nt, Human
cuccugcaggcagccaggcca

SEQ ID NO: 1505812 - RNA, 15 nt, Human
cuccugugucuugca

SEQ ID NO: 1505813 - RNA, 23 nt, Human
cuccugugucuugcaauggcagc

SEQ ID NO: 1505814 - RNA, 11 nt, Human
cuccugugugu

SEQ ID NO: 1505815 - RNA, 11 nt, Human
cuccuucuucc

SEQ ID NO: 1505816 - RNA, 21 nt, Human
cuccuugaaaacacuguucuc

SEQ ID NO: 1505817 - RNA, 13 nt, Human
cuccuucagcccu

SEQ ID NO: 1505818 - RNA, 14 nt, Human
cuccuucagcccuc

SEQ ID NO: 1505819 - RNA, 15 nt, Human
cuccuucagcccuca

SEQ ID NO: 1505820 - RNA, 17 nt, Human
cuccuucagcccucacc

SEQ ID NO: 1505821 - RNA, 20 nt, Human
cuccuucagcccucaccccu

SEQ ID NO: 1505822 - RNA, 14 nt, Human
cuccuucuguccua

SEQ ID NO: 1505823 - RNA, 15 nt, Human
cuccuucuguccuac

SEQ ID NO: 1505824 - RNA, 20 nt, Human
cuccuucuguccuacucugu

SEQ ID NO: 1505825 - RNA, 13 nt, Human
cucuaaauucuuu

SEQ ID NO: 1505826 - RNA, 17 nt, Human
cucuaaauucuuucauu

SEQ ID NO: 1505827 - RNA, 12 nt, Human
cucggagaagag

SEQ ID NO: 1505828 - RNA, 13 nt, Human
cucggagaagagc

SEQ ID NO: 1505829 - RNA, 20 nt, Human
cucggagaagagcuguucac

SEQ ID NO: 1505830 - RNA, 15 nt, Human
cucgcgacaaugcaa

SEQ ID NO: 1505831 - RNA, 16 nt, Human
cucgaguuacagacaa

SEQ ID NO: 1505832 - RNA, 20 nt, Human
cucgaguuacagacaaagcg

SEQ ID NO: 1505833 - RNA, 17 nt, Human
cucccuuucuucccuac

SEQ ID NO: 1505834 - RNA, 15 nt, Human
cucccuuucuccccu

SEQ ID NO: 1505835 - RNA, 23 nt, Human
cucccuuucuccccugcccccag

SEQ ID NO: 1505836 - RNA, 12 nt, Human
cucccuuucucc

SEQ ID NO: 1505837 - RNA, 14 nt, Human
cucccuuucucccc

SEQ ID NO: 1505838 - RNA, 13 nt, Human
cucccuuucaaca

SEQ ID NO: 1505839 - RNA, 17 nt, Human
cucccuuggauuguccc

SEQ ID NO: 1505840 - RNA, 20 nt, Human
cucccuuggauuguccccga

SEQ ID NO: 1505841 - RNA, 16 nt, Human
cucccuucucuucaca

SEQ ID NO: 1505842 - RNA, 14 nt, Human
cucccuuccucuuu

SEQ ID NO: 1505843 - RNA, 13 nt, Human
cucccuuccucuu

SEQ ID NO: 1505844 - RNA, 14 nt, Human
cucccaucacccgc

SEQ ID NO: 1505845 - RNA, 14 nt, Human
cucccaucucacac

SEQ ID NO: 1505846 - RNA, 21 nt, Human
cucccaucucacacaugagca

SEQ ID NO: 1505847 - RNA, 15 nt, Human
cucccaucucacaca

SEQ ID NO: 1505848 - RNA, 18 nt, Human
cucccaucucacacauga

SEQ ID NO: 1505849 - RNA, 10 nt, Human
cucccuuccu

SEQ ID NO: 1505850 - RNA, 13 nt, Human
cuccugcaggcag

SEQ ID NO: 1505851 - RNA, 14 nt, Human
cuccugcaggcagc

SEQ ID NO: 1505852 - RNA, 14 nt, Human
cuccucagaucuuc

SEQ ID NO: 1505853 - RNA, 12 nt, Human
cuccucagaucu

SEQ ID NO: 1505854 - RNA, 16 nt, Human
cgucaacucauauuuu

SEQ ID NO: 1505855 - RNA, 20 nt, Human
cgucaacucauauuuucaug

SEQ ID NO: 1505856 - RNA, 23 nt, Human
cggugcuaucucccccagcccca

SEQ ID NO: 1505857 - RNA, 12 nt, Human
cgugacaacacu

SEQ ID NO: 1505858 - RNA, 20 nt, Human
cgugcacacaccagagccca

SEQ ID NO: 1505859 - RNA, 21 nt, Human
cgugcacacaccagagcccac

SEQ ID NO: 1505860 - RNA, 18 nt, Human
cgugcauaccacuuuugu

SEQ ID NO: 1505861 - RNA, 14 nt, Human
cgugcauaccacuu

SEQ ID NO: 1505862 - RNA, 22 nt, Human
cgugcacacaccagagcccacc

SEQ ID NO: 1505863 - RNA, 19 nt, Human
cgugcauaccacuuuuguu

SEQ ID NO: 1505864 - RNA, 23 nt, Human
cgugcauaccacuuuuguucuug

SEQ ID NO: 1505865 - RNA, 15 nt, Human
cgucgguccuggugc

SEQ ID NO: 1505866 - RNA, 14 nt, Human
cgucuaccugaggg

SEQ ID NO: 1505867 - RNA, 13 nt, Human
cgucugacaggca

SEQ ID NO: 1505868 - RNA, 14 nt, Human
cgucugacaggcaa

SEQ ID NO: 1505869 - RNA, 11 nt, Human
cguccccuguc

SEQ ID NO: 1505870 - RNA, 14 nt, Human
cguccccugucccc

SEQ ID NO: 1505871 - RNA, 21 nt, Human
cguuucuaaaggcuaccuuug

SEQ ID NO: 1505872 - RNA, 19 nt, Human
cguuucuaaaggcuaccuu

SEQ ID NO: 1505873 - RNA, 20 nt, Human
cguuucuaugacacaugcaa

SEQ ID NO: 1505874 - RNA, 17 nt, Human
cguggcugcuucaagga

SEQ ID NO: 1505875 - RNA, 12 nt, Human
cguggcugcuuc

SEQ ID NO: 1505876 - RNA, 14 nt, Human
cguggcugcuucaa

SEQ ID NO: 1505877 - RNA, 15 nt, Human
cguggcugcuucaag

SEQ ID NO: 1505878 - RNA, 19 nt, Human
cgaucuggguucacugcaa

SEQ ID NO: 1505879 - RNA, 21 nt, Human
cgauucuucugcuucagccuc

SEQ ID NO: 1505880 - RNA, 13 nt, Human
cgauucuucugcu

SEQ ID NO: 1505881 - RNA, 19 nt, Human
cgauucuucugcuucagcc

SEQ ID NO: 1505882 - RNA, 11 nt, Human
cgcaaugugac

SEQ ID NO: 1505883 - RNA, 12 nt, Human
cgauuucuguuu

SEQ ID NO: 1505884 - RNA, 20 nt, Human
ccuuuguauucucuccugua

SEQ ID NO: 1505885 - RNA, 18 nt, Human
ccuuuguauucucuccug

SEQ ID NO: 1505886 - RNA, 15 nt, Human
ccuuuguauucucuc

SEQ ID NO: 1505887 - RNA, 14 nt, Human
cgaggacagggagg

SEQ ID NO: 1505888 - RNA, 13 nt, Human
cgaggacagggag

SEQ ID NO: 1505889 - RNA, 12 nt, Human
cgaggacaggga

SEQ ID NO: 1505890 - RNA, 18 nt, Human
cgaggccuucucugaagg

SEQ ID NO: 1505891 - RNA, 19 nt, Human
cgaggccuucucugaagga

SEQ ID NO: 1505892 - RNA, 12 nt, Human
ccuuggcugcag

SEQ ID NO: 1505893 - RNA, 13 nt, Human
ccuuggcugcagg

SEQ ID NO: 1505894 - RNA, 14 nt, Human
ccuuggcugcaggg

SEQ ID NO: 1505895 - RNA, 20 nt, Human
ccuuguggucccaccccaca

SEQ ID NO: 1505896 - RNA, 16 nt, Human
ccuuguggucccaccc

SEQ ID NO: 1505897 - RNA, 19 nt, Human
ccuuguggucccaccccac

SEQ ID NO: 1505898 - RNA, 13 nt, Human
ccuuuaagagaaa

SEQ ID NO: 1505899 - RNA, 14 nt, Human
ccuuuaagagaaau

SEQ ID NO: 1505900 - RNA, 15 nt, Human
ccuuuggcagaguuc

SEQ ID NO: 1505901 - RNA, 16 nt, Human
ccuuugcuugaaagaa

SEQ ID NO: 1505902 - RNA, 20 nt, Human
cgcgugcacacaccagagcc

SEQ ID NO: 1505903 - RNA, 16 nt, Human
cgcgugcacacaccag

SEQ ID NO: 1505904 - RNA, 19 nt, Human
cgcgugcacacaccagagc

SEQ ID NO: 1505905 - RNA, 21 nt, Human
cgcuaagagggagggagggcu

SEQ ID NO: 1505906 - RNA, 14 nt, Human
cgcuaagagggagg

SEQ ID NO: 1505907 - RNA, 15 nt, Human
cgcuaagagggaggg

SEQ ID NO: 1505908 - RNA, 16 nt, Human
cgcuaagagggaggga

SEQ ID NO: 1505909 - RNA, 13 nt, Human
cgcagacaggacc

SEQ ID NO: 1505910 - RNA, 14 nt, Human
cgcagacaggacca

SEQ ID NO: 1505911 - RNA, 15 nt, Human
cgcccccacugguga

SEQ ID NO: 1505912 - RNA, 16 nt, Human
cgcgacaaugcaaacc

SEQ ID NO: 1505913 - RNA, 17 nt, Human
cgcgacaaugcaaacca

SEQ ID NO: 1505914 - RNA, 20 nt, Human
cggaaugaaccacaucuugc

SEQ ID NO: 1505915 - RNA, 15 nt, Human
cggacagccacggcc

SEQ ID NO: 1505916 - RNA, 16 nt, Human
cggacagccacggcca

SEQ ID NO: 1505917 - RNA, 18 nt, Human
cggacagccacggccagg

SEQ ID NO: 1505918 - RNA, 13 nt, Human
cgcuccugugucu

SEQ ID NO: 1505919 - RNA, 20 nt, Human
cggacagccacggccaggcc

SEQ ID NO: 1505920 - RNA, 15 nt, Human
cggauuuggggugga

SEQ ID NO: 1505921 - RNA, 21 nt, Human
cgggaggauguucugggacac

SEQ ID NO: 1505922 - RNA, 20 nt, Human
cgggaggauguucugggaca

SEQ ID NO: 1505923 - RNA, 16 nt, Human
cgggaggucgaggcag

SEQ ID NO: 1505924 - RNA, 17 nt, Human
cgggaggucgaggcagg

SEQ ID NO: 1505925 - RNA, 12 nt, Human
cgggcaugacac

SEQ ID NO: 1505926 - RNA, 21 nt, Human
cgggcaggguguggggccaug

SEQ ID NO: 1505927 - RNA, 15 nt, Human
cgggcaugacacgaa

SEQ ID NO: 1505928 - RNA, 15 nt, Human
cggccuuuggcuuca

SEQ ID NO: 1505929 - RNA, 15 nt, Human
cggcuggccuggccc

SEQ ID NO: 1505930 - RNA, 16 nt, Human
cggcuggccuggcccc

SEQ ID NO: 1505931 - RNA, 18 nt, Human
cggcuggccuggccccuc

SEQ ID NO: 1505932 - RNA, 19 nt, Human
cggcuggccuggccccuca

SEQ ID NO: 1505933 - RNA, 16 nt, Human
cggccuccauccugag

SEQ ID NO: 1505934 - RNA, 17 nt, Human
cggccuccauccugagg

SEQ ID NO: 1505935 - RNA, 13 nt, Human
ccuggacccugug

SEQ ID NO: 1505936 - RNA, 14 nt, Human
ccuggacccugugg

SEQ ID NO: 1505937 - RNA, 20 nt, Human
ccuggcacugcuuccaguga

SEQ ID NO: 1505938 - RNA, 13 nt, Human
ccuggagcccaga

SEQ ID NO: 1505939 - RNA, 14 nt, Human
ccuggagcccagag

SEQ ID NO: 1505940 - RNA, 17 nt, Human
ccuggagcccagaggag

SEQ ID NO: 1505941 - RNA, 16 nt, Human
ccuggcagccccuguu

SEQ ID NO: 1505942 - RNA, 21 nt, Human
ccuggcacugcuuccagugag

SEQ ID NO: 1505943 - RNA, 16 nt, Human
ccuggcaugggaauga

SEQ ID NO: 1505944 - RNA, 17 nt, Human
ccuggcaugggaaugaa

SEQ ID NO: 1505945 - RNA, 14 nt, Human
ccuggccccucagg

SEQ ID NO: 1505946 - RNA, 16 nt, Human
ccuggccccucagggu

SEQ ID NO: 1505947 - RNA, 18 nt, Human
ccuggcaugggaaugaau

SEQ ID NO: 1505948 - RNA, 23 nt, Human
ccuggcaugggaaugaaugucag

SEQ ID NO: 1505949 - RNA, 12 nt, Human
ccugggcagaag

SEQ ID NO: 1505950 - RNA, 14 nt, Human
ccugggcagaagga

SEQ ID NO: 1505951 - RNA, 15 nt, Human
ccugggcagaaggaa

SEQ ID NO: 1505952 - RNA, 20 nt, Human
ccugggaggucaaggcugca

SEQ ID NO: 1505953 - RNA, 16 nt, Human
ccugggaucccucauc

SEQ ID NO: 1505954 - RNA, 20 nt, Human
ccugggaucccucauccuca

SEQ ID NO: 1505955 - RNA, 13 nt, Human
ccugcugguucag

SEQ ID NO: 1505956 - RNA, 19 nt, Human
ccugcugguucaggguugg

SEQ ID NO: 1505957 - RNA, 18 nt, Human
ccugcaacaccuuguuuc

SEQ ID NO: 1505958 - RNA, 19 nt, Human
ccugcaacaccuuguuucc

SEQ ID NO: 1505959 - RNA, 16 nt, Human
ccugcaaccugauugu

SEQ ID NO: 1505960 - RNA, 23 nt, Human
ccugcgucucauacucaccucac

SEQ ID NO: 1505961 - RNA, 17 nt, Human
ccugcuaauuccccaga

SEQ ID NO: 1505962 - RNA, 12 nt, Human
ccugcuccagcu

SEQ ID NO: 1505963 - RNA, 13 nt, Human
ccugcuccagcug

SEQ ID NO: 1505964 - RNA, 14 nt, Human
ccugcuccagcugu

SEQ ID NO: 1505965 - RNA, 22 nt, Human
ccugcuccagcuguucagcugg

SEQ ID NO: 1505966 - RNA, 20 nt, Human
ccugugaguacuacaguccu

SEQ ID NO: 1505967 - RNA, 17 nt, Human
ccugucccccugacaac

SEQ ID NO: 1505968 - RNA, 18 nt, Human
ccuguccccgcacugggc

SEQ ID NO: 1505969 - RNA, 19 nt, Human
ccugugccucugggacugg

SEQ ID NO: 1505970 - RNA, 15 nt, Human
ccugugccucuggga

SEQ ID NO: 1505971 - RNA, 17 nt, Human
ccugugccucugggacu

SEQ ID NO: 1505972 - RNA, 22 nt, Human
ccugugauggggcccugccucc

SEQ ID NO: 1505973 - RNA, 20 nt, Human
ccugugauggggcccugccu

SEQ ID NO: 1505974 - RNA, 21 nt, Human
ccugugauggggcccugccuc

SEQ ID NO: 1505975 - RNA, 17 nt, Human
ccugugauggggcccug

SEQ ID NO: 1505976 - RNA, 18 nt, Human
ccugugauggggcccugc

SEQ ID NO: 1505977 - RNA, 19 nt, Human
ccugugauggggcccugcc

SEQ ID NO: 1505978 - RNA, 21 nt, Human
ccuguagagugggagcugagu

SEQ ID NO: 1505979 - RNA, 23 nt, Human
ccuguagagugggagcugagugg

SEQ ID NO: 1505980 - RNA, 12 nt, Human
ccugguggcagc

SEQ ID NO: 1505981 - RNA, 13 nt, Human
ccugguggcagcu

SEQ ID NO: 1505982 - RNA, 14 nt, Human
ccugguggcagcuc

SEQ ID NO: 1505983 - RNA, 16 nt, Human
ccugguggcagcucac

SEQ ID NO: 1505984 - RNA, 17 nt, Human
ccugguggcagcucacc

SEQ ID NO: 1505985 - RNA, 18 nt, Human
ccugguggcagcucaccu

SEQ ID NO: 1505986 - RNA, 20 nt, Human
ccuguaauccuagcacuuug

SEQ ID NO: 1505987 - RNA, 14 nt, Human
ccuugaugaagaag

SEQ ID NO: 1505988 - RNA, 22 nt, Human
ccuugaccauucuccaccugcc

SEQ ID NO: 1505989 - RNA, 21 nt, Human
ccuugaccauucuccaccugc

SEQ ID NO: 1505990 - RNA, 22 nt, Human
ccuugaguugauucagcucugc

SEQ ID NO: 1505991 - RNA, 23 nt, Human
ccuugaguugauucagcucugca

SEQ ID NO: 1505992 - RNA, 14 nt, Human
ccuugacagggcac

SEQ ID NO: 1505993 - RNA, 15 nt, Human
ccuugacagggcaca

SEQ ID NO: 1505994 - RNA, 17 nt, Human
ccuugacagggcacacc

SEQ ID NO: 1505995 - RNA, 19 nt, Human
ccuugaccauucuccaccu

SEQ ID NO: 1505996 - RNA, 20 nt, Human
ccuugaccauucuccaccug

SEQ ID NO: 1505997 - RNA, 15 nt, Human
ccuugaaaacacugu

SEQ ID NO: 1505998 - RNA, 13 nt, Human
ccuucgcuccugu

SEQ ID NO: 1505999 - RNA, 14 nt, Human
ccuucgcuccugug

SEQ ID NO: 1506000 - RNA, 15 nt, Human
ccuucgcuccugugu

SEQ ID NO: 1506001 - RNA, 18 nt, Human
ccuucgcuccugugucuu

SEQ ID NO: 1506002 - RNA, 17 nt, Human
ccuugaacuuugaccuc

SEQ ID NO: 1506003 - RNA, 16 nt, Human
ccuugaacuggguacu

SEQ ID NO: 1506004 - RNA, 19 nt, Human
ccuugaacuuugaccucug

SEQ ID NO: 1506005 - RNA, 20 nt, Human
ccuugaaaacuuuaugcuaa

SEQ ID NO: 1506006 - RNA, 17 nt, Human
ccuugaaugaugccaug

SEQ ID NO: 1506007 - RNA, 19 nt, Human
ccuugaaaacacuguucuc

SEQ ID NO: 1506008 - RNA, 21 nt, Human
ccuugaaaacacuguucucug

SEQ ID NO: 1506009 - RNA, 22 nt, Human
ccuugaaaacacuguucucugc

SEQ ID NO: 1506010 - RNA, 14 nt, Human
ccuugaacugggua

SEQ ID NO: 1506011 - RNA, 13 nt, Human
ccuugacagggca

SEQ ID NO: 1506012 - RNA, 11 nt, Human
ccuuuggcuuc

SEQ ID NO: 1506013 - RNA, 20 nt, Human
ccuucagugccuuauggaac

SEQ ID NO: 1506014 - RNA, 15 nt, Human
ccuucagugccuuau

SEQ ID NO: 1506015 - RNA, 10 nt, Human
ccuucagugc

SEQ ID NO: 1506016 - RNA, 13 nt, Human
ccuucagugccuu

SEQ ID NO: 1506017 - RNA, 14 nt, Human
ccuucagugccuua

SEQ ID NO: 1506018 - RNA, 15 nt, Human
ccuuccagggguggg

SEQ ID NO: 1506019 - RNA, 16 nt, Human
ccuuccagggguggga

SEQ ID NO: 1506020 - RNA, 18 nt, Human
ccuuccaggggugggaca

SEQ ID NO: 1506021 - RNA, 22 nt, Human
ccuuccaggggugggacacccu

SEQ ID NO: 1506022 - RNA, 14 nt, Human
ccuuccucuuucca

SEQ ID NO: 1506023 - RNA, 14 nt, Human
ccuuaccagcagag

SEQ ID NO: 1506024 - RNA, 17 nt, Human
ccuuaccagcagagcac

SEQ ID NO: 1506025 - RNA, 15 nt, Human
ccuuaccagcagagc

SEQ ID NO: 1506026 - RNA, 16 nt, Human
ccuuaccagcagagca

SEQ ID NO: 1506027 - RNA, 20 nt, Human
ccuuaccucggugccuuccu

SEQ ID NO: 1506028 - RNA, 14 nt, Human
ccuuaccugccagg

SEQ ID NO: 1506029 - RNA, 21 nt, Human
ccuuagacagucccugccaau

SEQ ID NO: 1506030 - RNA, 18 nt, Human
ccuuagacagucccugcc

SEQ ID NO: 1506031 - RNA, 19 nt, Human
ccuuagacagucccugcca

SEQ ID NO: 1506032 - RNA, 16 nt, Human
ccuuagacagucccug

SEQ ID NO: 1506033 - RNA, 17 nt, Human
ccuuagacagucccugc

SEQ ID NO: 1506034 - RNA, 19 nt, Human
ccuucagugccuuauggaa

SEQ ID NO: 1506035 - RNA, 22 nt, Human
ccucugcacuccccugcugggu

SEQ ID NO: 1506036 - RNA, 14 nt, Human
ccucugcacucccc

SEQ ID NO: 1506037 - RNA, 15 nt, Human
ccucugcacuccccu

SEQ ID NO: 1506038 - RNA, 20 nt, Human
ccucugcacuccccugcugg

SEQ ID NO: 1506039 - RNA, 21 nt, Human
ccucugcacuccccugcuggg

SEQ ID NO: 1506040 - RNA, 20 nt, Human
ccucugcacaagcugcaccc

SEQ ID NO: 1506041 - RNA, 17 nt, Human
ccucugcacaagcugca

SEQ ID NO: 1506042 - RNA, 19 nt, Human
ccucugcacaagcugcacc

SEQ ID NO: 1506043 - RNA, 17 nt, Human
ccucugacacacagcuc

SEQ ID NO: 1506044 - RNA, 18 nt, Human
ccucugacacacagcucu

SEQ ID NO: 1506045 - RNA, 15 nt, Human
ccucugcacaagcug

SEQ ID NO: 1506046 - RNA, 12 nt, Human
ccucugggacug

SEQ ID NO: 1506047 - RNA, 23 nt, Human
ccuccugugugugcgccuacagg

SEQ ID NO: 1506048 - RNA, 12 nt, Human
ccucucccauca

SEQ ID NO: 1506049 - RNA, 23 nt, Human
ccucugaaaaccaauguucucuc

SEQ ID NO: 1506050 - RNA, 16 nt, Human
ccucugacacacagcu

SEQ ID NO: 1506051 - RNA, 13 nt, Human
ccuccugggcuaa

SEQ ID NO: 1506052 - RNA, 13 nt, Human
ccuccugugugug

SEQ ID NO: 1506053 - RNA, 15 nt, Human
ccuccugugugugcg

SEQ ID NO: 1506054 - RNA, 22 nt, Human
ccuccugugugugcgccuacag

SEQ ID NO: 1506055 - RNA, 13 nt, Human
ccuccugccucga

SEQ ID NO: 1506056 - RNA, 13 nt, Human
ccucccucccucu

SEQ ID NO: 1506057 - RNA, 15 nt, Human
ccucccucccucuuu

SEQ ID NO: 1506058 - RNA, 16 nt, Human
ccucccucccucuuuc

SEQ ID NO: 1506059 - RNA, 20 nt, Human
ccucagaaaacaaggaugaa

SEQ ID NO: 1506060 - RNA, 16 nt, Human
ccucagcauccuggca

SEQ ID NO: 1506061 - RNA, 17 nt, Human
ccucagcauccuggcac

SEQ ID NO: 1506062 - RNA, 11 nt, Human
ccucaggccug

SEQ ID NO: 1506063 - RNA, 14 nt, Human
ccucaggccugggg

SEQ ID NO: 1506064 - RNA, 21 nt, Human
ccucaggccugggggcugggc

SEQ ID NO: 1506065 - RNA, 23 nt, Human
ccucaggccugggggcugggcag

SEQ ID NO: 1506066 - RNA, 14 nt, Human
ccucagggucccug

SEQ ID NO: 1506067 - RNA, 17 nt, Human
ccucaggugagaagcag

SEQ ID NO: 1506068 - RNA, 22 nt, Human
ccucaggugauccacccaccuc

SEQ ID NO: 1506069 - RNA, 17 nt, Human
ccucaggugauccaccc

SEQ ID NO: 1506070 - RNA, 19 nt, Human
ccucaggugauccacccac

SEQ ID NO: 1506071 - RNA, 16 nt, Human
ccucaggugagaagca

SEQ ID NO: 1506072 - RNA, 15 nt, Human
ccucagggucccugg

SEQ ID NO: 1506073 - RNA, 19 nt, Human
ccucagucuggcccuuccu

SEQ ID NO: 1506074 - RNA, 15 nt, Human
ccucagucuggcccu

SEQ ID NO: 1506075 - RNA, 20 nt, Human
ccugaacaggauauucucac

SEQ ID NO: 1506076 - RNA, 16 nt, Human
ccugaagaacuauuuu

SEQ ID NO: 1506077 - RNA, 21 nt, Human
ccugaagacucauucuucugu

SEQ ID NO: 1506078 - RNA, 14 nt, Human
ccugaaggccccgc

SEQ ID NO: 1506079 - RNA, 19 nt, Human
ccugaagucacacagugag

SEQ ID NO: 1506080 - RNA, 13 nt, Human
ccugaaggccccg

SEQ ID NO: 1506081 - RNA, 15 nt, Human
ccugaagucacacag

SEQ ID NO: 1506082 - RNA, 16 nt, Human
ccugaagucacacagu

SEQ ID NO: 1506083 - RNA, 17 nt, Human
ccugaagucacacagug

SEQ ID NO: 1506084 - RNA, 18 nt, Human
ccugaaagaggaaugaag

SEQ ID NO: 1506085 - RNA, 23 nt, Human
ccugaaagaggaaugaaguacuc

SEQ ID NO: 1506086 - RNA, 17 nt, Human
ccucuuaugggcugggu

SEQ ID NO: 1506087 - RNA, 22 nt, Human
ccucuuuggucuacacugugcu

SEQ ID NO: 1506088 - RNA, 23 nt, Human
ccucuuagaugcaguucugaaga

SEQ ID NO: 1506089 - RNA, 14 nt, Human
ccucuuaugggcug

SEQ ID NO: 1506090 - RNA, 15 nt, Human
ccucuuaugggcugg

SEQ ID NO: 1506091 - RNA, 16 nt, Human
ccucuuaugggcuggg

SEQ ID NO: 1506092 - RNA, 14 nt, Human
ccucuuagaaaaac

SEQ ID NO: 1506093 - RNA, 21 nt, Human
ccucuguccccuucucucauc

SEQ ID NO: 1506094 - RNA, 22 nt, Human
ccucuguccccuucucucaucu

SEQ ID NO: 1506095 - RNA, 14 nt, Human
ccucuguccccuuc

SEQ ID NO: 1506096 - RNA, 17 nt, Human
ccucuguccccuucucu

SEQ ID NO: 1506097 - RNA, 18 nt, Human
ccucuguccccuucucuc

SEQ ID NO: 1506098 - RNA, 19 nt, Human
ccucuguccccuucucuca

SEQ ID NO: 1506099 - RNA, 14 nt, Human
ccucuguacagagc

SEQ ID NO: 1506100 - RNA, 15 nt, Human
ccucuguacagagcc

SEQ ID NO: 1506101 - RNA, 16 nt, Human
ccucuguacagagccc

SEQ ID NO: 1506102 - RNA, 17 nt, Human
ccucuguacagagccca

SEQ ID NO: 1506103 - RNA, 18 nt, Human
ccucuguacagagcccac

SEQ ID NO: 1506104 - RNA, 23 nt, Human
ccucuguacagagcccacgcccc

SEQ ID NO: 1506105 - RNA, 12 nt, Human
ccugaggcccag

SEQ ID NO: 1506106 - RNA, 13 nt, Human
ccugaggcccaga

SEQ ID NO: 1506107 - RNA, 14 nt, Human
ccugaggcccagag

SEQ ID NO: 1506108 - RNA, 12 nt, Human
ccugacaacacu

SEQ ID NO: 1506109 - RNA, 14 nt, Human
ccugacaacacuca

SEQ ID NO: 1506110 - RNA, 15 nt, Human
ccugacaacacucau

SEQ ID NO: 1506111 - RNA, 16 nt, Human
ccugacaacacucauu

SEQ ID NO: 1506112 - RNA, 23 nt, Human
ccugaggcccuucucuccagccc

SEQ ID NO: 1506113 - RNA, 21 nt, Human
ccugaggcccuucucuccagc

SEQ ID NO: 1506114 - RNA, 22 nt, Human
ccugaggcccuucucuccagcc

SEQ ID NO: 1506115 - RNA, 16 nt, Human
ccugaggcccuucucu

SEQ ID NO: 1506116 - RNA, 17 nt, Human
ccugaggcccuucucuc

SEQ ID NO: 1506117 - RNA, 19 nt, Human
ccugaggcccuucucucca

SEQ ID NO: 1506118 - RNA, 20 nt, Human
ccugaggcccuucucuccag

SEQ ID NO: 1506119 - RNA, 18 nt, Human
ccugaggcuccacuuggu

SEQ ID NO: 1506120 - RNA, 20 nt, Human
ccugaggcuccacuuggucu

SEQ ID NO: 1506121 - RNA, 14 nt, Human
ccugaugcuucuuc

SEQ ID NO: 1506122 - RNA, 19 nt, Human
ccugaugcuucuucagaga

SEQ ID NO: 1506123 - RNA, 17 nt, Human
ccugaugcuucuucaga

SEQ ID NO: 1506124 - RNA, 18 nt, Human
ccugaugcuucuucagag

SEQ ID NO: 1506125 - RNA, 23 nt, Human
ccugauugugucucuugguccug

SEQ ID NO: 1506126 - RNA, 23 nt, Human
ccugacaacacucauugaccuga

SEQ ID NO: 1506127 - RNA, 20 nt, Human
cccuuguggucccaccccac

SEQ ID NO: 1506128 - RNA, 18 nt, Human
cccuuguggucccacccc

SEQ ID NO: 1506129 - RNA, 18 nt, Human
cccuuggggagcaggcuc

SEQ ID NO: 1506130 - RNA, 14 nt, Human
cccuugugguccca

SEQ ID NO: 1506131 - RNA, 16 nt, Human
cccuuguggucccacc

SEQ ID NO: 1506132 - RNA, 14 nt, Human
cccuuucuccccug

SEQ ID NO: 1506133 - RNA, 22 nt, Human
cccuuucuccccugcccccagg

SEQ ID NO: 1506134 - RNA, 20 nt, Human
cccuuugacgccaucccagc

SEQ ID NO: 1506135 - RNA, 16 nt, Human
cccuugaugaagaagu

SEQ ID NO: 1506136 - RNA, 19 nt, Human
cccuuaccucggugccuuc

SEQ ID NO: 1506137 - RNA, 22 nt, Human
cccuugccgucuaccugagggg

SEQ ID NO: 1506138 - RNA, 17 nt, Human
cccuugccgucuaccug

SEQ ID NO: 1506139 - RNA, 18 nt, Human
cccuugccgucuaccuga

SEQ ID NO: 1506140 - RNA, 19 nt, Human
cccuuuuuuggcugcugaa

SEQ ID NO: 1506141 - RNA, 17 nt, Human
ccgagaaggaagccucc

SEQ ID NO: 1506142 - RNA, 19 nt, Human
ccgagauagccaaggccaa

SEQ ID NO: 1506143 - RNA, 22 nt, Human
ccgagauagccaaggccaaagg

SEQ ID NO: 1506144 - RNA, 17 nt, Human
cccuuuuuuggcugcug

SEQ ID NO: 1506145 - RNA, 18 nt, Human
cccuuuuuuggcugcuga

SEQ ID NO: 1506146 - RNA, 11 nt, Human
cccuuuuccuu

SEQ ID NO: 1506147 - RNA, 13 nt, Human
cccuuuucuguuu

SEQ ID NO: 1506148 - RNA, 18 nt, Human
ccgagaucacgccacugc

SEQ ID NO: 1506149 - RNA, 13 nt, Human
ccgagggcugagc

SEQ ID NO: 1506150 - RNA, 16 nt, Human
ccgagggcugagccug

SEQ ID NO: 1506151 - RNA, 22 nt, Human
ccgagggcugagccugguccca

SEQ ID NO: 1506152 - RNA, 17 nt, Human
ccccucagggucccugg

SEQ ID NO: 1506153 - RNA, 18 nt, Human
ccccucagggucccuggu

SEQ ID NO: 1506154 - RNA, 20 nt, Human
ccccucagggucccuggugg

SEQ ID NO: 1506155 - RNA, 21 nt, Human
cccugguggcagugggagcug

SEQ ID NO: 1506156 - RNA, 16 nt, Human
cccugguggcaguggg

SEQ ID NO: 1506157 - RNA, 19 nt, Human
cccugguggcagugggagc

SEQ ID NO: 1506158 - RNA, 21 nt, Human
cccuguagagugggagcugag

SEQ ID NO: 1506159 - RNA, 16 nt, Human
cccugugggcccccaa

SEQ ID NO: 1506160 - RNA, 18 nt, Human
cccugugggcccccaaau

SEQ ID NO: 1506161 - RNA, 15 nt, Human
cccuguuuguuucug

SEQ ID NO: 1506162 - RNA, 16 nt, Human
cccuguuuguuucuga

SEQ ID NO: 1506163 - RNA, 17 nt, Human
cccccaggacugggcca

SEQ ID NO: 1506164 - RNA, 12 nt, Human
ccccccagcacu

SEQ ID NO: 1506165 - RNA, 13 nt, Human
ccccccagcacug

SEQ ID NO: 1506166 - RNA, 14 nt, Human
ccccccagcacuga

SEQ ID NO: 1506167 - RNA, 11 nt, Human
cccccaggacu

SEQ ID NO: 1506168 - RNA, 12 nt, Human
cccccaggacug

SEQ ID NO: 1506169 - RNA, 13 nt, Human
cccccaggacugg

SEQ ID NO: 1506170 - RNA, 15 nt, Human
cccccaggacugggc

SEQ ID NO: 1506171 - RNA, 12 nt, Human
cccccagcccca

SEQ ID NO: 1506172 - RNA, 13 nt, Human
cccccagcacuga

SEQ ID NO: 1506173 - RNA, 15 nt, Human
cccccagcacugagg

SEQ ID NO: 1506174 - RNA, 17 nt, Human
cccccagcacugaggaa

SEQ ID NO: 1506175 - RNA, 18 nt, Human
cccccagcacugaggaag

SEQ ID NO: 1506176 - RNA, 21 nt, Human
cccccgcugucagccauuccu

SEQ ID NO: 1506177 - RNA, 13 nt, Human
ccccaggaggcca

SEQ ID NO: 1506178 - RNA, 18 nt, Human
ccccaggagggaggcagg

SEQ ID NO: 1506179 - RNA, 19 nt, Human
ccccaggagggaggcaggg

SEQ ID NO: 1506180 - RNA, 14 nt, Human
ccccaggaggccag

SEQ ID NO: 1506181 - RNA, 15 nt, Human
ccccaggaggccagc

SEQ ID NO: 1506182 - RNA, 21 nt, Human
ccccaggaggccagccuugac

SEQ ID NO: 1506183 - RNA, 22 nt, Human
ccccaggaggccagccuugacc

SEQ ID NO: 1506184 - RNA, 12 nt, Human
ccccacugguga

SEQ ID NO: 1506185 - RNA, 13 nt, Human
ccccacuggugac

SEQ ID NO: 1506186 - RNA, 14 nt, Human
ccccacuggugaca

SEQ ID NO: 1506187 - RNA, 14 nt, Human
ccuaaaguguauuu

SEQ ID NO: 1506188 - RNA, 20 nt, Human
ccgggcacucagaagacacu

SEQ ID NO: 1506189 - RNA, 12 nt, Human
ccggcuggccug

SEQ ID NO: 1506190 - RNA, 13 nt, Human
ccggcuggccugg

SEQ ID NO: 1506191 - RNA, 15 nt, Human
ccggcuggccuggcc

SEQ ID NO: 1506192 - RNA, 15 nt, Human
ccgggcacucagaag

SEQ ID NO: 1506193 - RNA, 17 nt, Human
ccucacaguccuuacca

SEQ ID NO: 1506194 - RNA, 15 nt, Human
ccucaccccacugug

SEQ ID NO: 1506195 - RNA, 15 nt, Human
ccucaccccugguuc

SEQ ID NO: 1506196 - RNA, 12 nt, Human
ccucaccccacu

SEQ ID NO: 1506197 - RNA, 20 nt, Human
ccucacaguccuuaccagca

SEQ ID NO: 1506198 - RNA, 22 nt, Human
ccucacaguccuuaccagcaga

SEQ ID NO: 1506199 - RNA, 17 nt, Human
ccucaccuuucccaucu

SEQ ID NO: 1506200 - RNA, 20 nt, Human
ccucaccccugguucucauc

SEQ ID NO: 1506201 - RNA, 21 nt, Human
ccucaccccugguucucaucu

SEQ ID NO: 1506202 - RNA, 22 nt, Human
ccucaccccugguucucaucuu

SEQ ID NO: 1506203 - RNA, 23 nt, Human
ccucaccccugguucucaucuuu

SEQ ID NO: 1506204 - RNA, 21 nt, Human
cccaauucuuacaaacaugug

SEQ ID NO: 1506205 - RNA, 18 nt, Human
cccaagggccuggccuga

SEQ ID NO: 1506206 - RNA, 19 nt, Human
cccaagggccuggccugag

SEQ ID NO: 1506207 - RNA, 23 nt, Human
cccaagggccuggccugagcugg

SEQ ID NO: 1506208 - RNA, 20 nt, Human
cccagagggccugcaaggga

SEQ ID NO: 1506209 - RNA, 20 nt, Human
cccagauugcaacaggcugg

SEQ ID NO: 1506210 - RNA, 21 nt, Human
cccagauugcaacaggcuggg

SEQ ID NO: 1506211 - RNA, 22 nt, Human
cccagauugcaacaggcugggc

SEQ ID NO: 1506212 - RNA, 18 nt, Human
cccagcaagugagagcug

SEQ ID NO: 1506213 - RNA, 19 nt, Human
cccagcgagcccugguggc

SEQ ID NO: 1506214 - RNA, 23 nt, Human
cccagcgagcccugguggcagug

SEQ ID NO: 1506215 - RNA, 17 nt, Human
cccagcgagcccuggug

SEQ ID NO: 1506216 - RNA, 18 nt, Human
cccagcgagcccuggugg

SEQ ID NO: 1506217 - RNA, 9 nt, Human
cccagcucc

SEQ ID NO: 1506218 - RNA, 18 nt, Human
cccagccccuucugaccc

SEQ ID NO: 1506219 - RNA, 12 nt, Human
cccagccugcua

SEQ ID NO: 1506220 - RNA, 19 nt, Human
cccagcaagugagagcugg

SEQ ID NO: 1506221 - RNA, 20 nt, Human
cccagcaagugagagcuggg

SEQ ID NO: 1506222 - RNA, 21 nt, Human
cccagcaagugagagcugggu

SEQ ID NO: 1506223 - RNA, 22 nt, Human
cccagcaagugagagcugggug

SEQ ID NO: 1506224 - RNA, 23 nt, Human
cccagcaagugagagcugggugu

SEQ ID NO: 1506225 - RNA, 23 nt, Human
cccagauugcaacaggcugggcu

SEQ ID NO: 1506226 - RNA, 11 nt, Human
cccagccccuu

SEQ ID NO: 1506227 - RNA, 13 nt, Human
cccagugcccaca

SEQ ID NO: 1506228 - RNA, 20 nt, Human
cccagucuggaaugcagugg

SEQ ID NO: 1506229 - RNA, 23 nt, Human
cccaggugcuaggaacacuccuu

SEQ ID NO: 1506230 - RNA, 16 nt, Human
cccaggugauauuuuu

SEQ ID NO: 1506231 - RNA, 22 nt, Human
cccaggugcuaggaacacuccu

SEQ ID NO: 1506232 - RNA, 13 nt, Human
cccaggugccagu

SEQ ID NO: 1506233 - RNA, 17 nt, Human
cccaggccuccuacagc

SEQ ID NO: 1506234 - RNA, 18 nt, Human
cccaggccuccuacagcu

SEQ ID NO: 1506235 - RNA, 12 nt, Human
cccaggggccgg

SEQ ID NO: 1506236 - RNA, 22 nt, Human
cccaggcauuccccaggaggcc

SEQ ID NO: 1506237 - RNA, 23 nt, Human
cccaggcauuccccaggaggcca

SEQ ID NO: 1506238 - RNA, 17 nt, Human
cccaggcaggucuugaa

SEQ ID NO: 1506239 - RNA, 20 nt, Human
cccaggcauuccccaggagg

SEQ ID NO: 1506240 - RNA, 21 nt, Human
cccaggcauuccccaggaggc

SEQ ID NO: 1506241 - RNA, 11 nt, Human
cccaggccccu

SEQ ID NO: 1506242 - RNA, 16 nt, Human
cccaggccccugccac

SEQ ID NO: 1506243 - RNA, 18 nt, Human
cccaggccccugccaccc

SEQ ID NO: 1506244 - RNA, 21 nt, Human
cccaggccccugccacccugg

SEQ ID NO: 1506245 - RNA, 22 nt, Human
cccaggccccugccacccuggg

SEQ ID NO: 1506246 - RNA, 11 nt, Human
cccaggcaggu

SEQ ID NO: 1506247 - RNA, 13 nt, Human
cccaggcaggucu

SEQ ID NO: 1506248 - RNA, 21 nt, Human
cccaggagccccgaggccuuc

SEQ ID NO: 1506249 - RNA, 13 nt, Human
cccaggaggccag

SEQ ID NO: 1506250 - RNA, 22 nt, Human
cccaggaggccagccuugacca

SEQ ID NO: 1506251 - RNA, 17 nt, Human
cccaugcugcccuguga

SEQ ID NO: 1506252 - RNA, 18 nt, Human
cccaugcugcccugugag

SEQ ID NO: 1506253 - RNA, 15 nt, Human
cccaugcugcccugu

SEQ ID NO: 1506254 - RNA, 16 nt, Human
cccaugcugcccugug

SEQ ID NO: 1506255 - RNA, 15 nt, Human
cccagugcccacagg

SEQ ID NO: 1506256 - RNA, 20 nt, Human
cccagugcccacaggaucag

SEQ ID NO: 1506257 - RNA, 18 nt, Human
cccagugccgagaaggaa

SEQ ID NO: 1506258 - RNA, 13 nt, Human
cccauucugccug

SEQ ID NO: 1506259 - RNA, 22 nt, Human
ccccaaauggaaaugggcagag

SEQ ID NO: 1506260 - RNA, 14 nt, Human
ccccacccaagggc

SEQ ID NO: 1506261 - RNA, 20 nt, Human
ccccacccaagggccuggcc

SEQ ID NO: 1506262 - RNA, 21 nt, Human
ccccacccaagggccuggccu

SEQ ID NO: 1506263 - RNA, 17 nt, Human
ccccaggaggccagccu

SEQ ID NO: 1506264 - RNA, 22 nt, Human
ccccucagggucccugguggca

SEQ ID NO: 1506265 - RNA, 22 nt, Human
ccaucauugaaaucuuuuugcu

SEQ ID NO: 1506266 - RNA, 18 nt, Human
ccauccagguucagcuug

SEQ ID NO: 1506267 - RNA, 12 nt, Human
ccauccucugua

SEQ ID NO: 1506268 - RNA, 19 nt, Human
ccauccucuguacagagcc

SEQ ID NO: 1506269 - RNA, 13 nt, Human
ccaucaccagaca

SEQ ID NO: 1506270 - RNA, 13 nt, Human
ccauaugccuggg

SEQ ID NO: 1506271 - RNA, 18 nt, Human
ccaucaaggguacacugc

SEQ ID NO: 1506272 - RNA, 20 nt, Human
ccagugaggcucugcccuug

SEQ ID NO: 1506273 - RNA, 18 nt, Human
ccagugaggcucugcccu

SEQ ID NO: 1506274 - RNA, 19 nt, Human
ccagugaggcucugcccuu

SEQ ID NO: 1506275 - RNA, 15 nt, Human
ccaugccuccucagg

SEQ ID NO: 1506276 - RNA, 15 nt, Human
ccaugcugcccugug

SEQ ID NO: 1506277 - RNA, 14 nt, Human
ccaugcugcccugu

SEQ ID NO: 1506278 - RNA, 13 nt, Human
ccaugcuccuggc

SEQ ID NO: 1506279 - RNA, 11 nt, Human
ccaugcugccc

SEQ ID NO: 1506280 - RNA, 13 nt, Human
ccaugcugcccug

SEQ ID NO: 1506281 - RNA, 16 nt, Human
ccaugauguuuagaaa

SEQ ID NO: 1506282 - RNA, 18 nt, Human
ccaugauguuuuccauga

SEQ ID NO: 1506283 - RNA, 19 nt, Human
ccaugauuaaccacuucag

SEQ ID NO: 1506284 - RNA, 21 nt, Human
ccaugauuaaccacuucagcu

SEQ ID NO: 1506285 - RNA, 14 nt, Human
ccaugaagauguag

SEQ ID NO: 1506286 - RNA, 20 nt, Human
ccauccucuguacagagccc

SEQ ID NO: 1506287 - RNA, 22 nt, Human
ccauuuugggguacccacugcu

SEQ ID NO: 1506288 - RNA, 20 nt, Human
ccauuuugggguacccacug

SEQ ID NO: 1506289 - RNA, 18 nt, Human
cccaaaaggcagaagcaa

SEQ ID NO: 1506290 - RNA, 13 nt, Human
cccaaaaggcaga

SEQ ID NO: 1506291 - RNA, 16 nt, Human
cccaaagcagugcaug

SEQ ID NO: 1506292 - RNA, 12 nt, Human
cccaaagaugca

SEQ ID NO: 1506293 - RNA, 15 nt, Human
cccaaagaugcagcc

SEQ ID NO: 1506294 - RNA, 12 nt, Human
cccaaagaagga

SEQ ID NO: 1506295 - RNA, 13 nt, Human
ccauggacuuugu

SEQ ID NO: 1506296 - RNA, 14 nt, Human
ccauggacuuuguu

SEQ ID NO: 1506297 - RNA, 15 nt, Human
ccauucuccaccugc

SEQ ID NO: 1506298 - RNA, 16 nt, Human
ccauucuccaccugcc

SEQ ID NO: 1506299 - RNA, 21 nt, Human
ccauucugccugcccaggccc

SEQ ID NO: 1506300 - RNA, 19 nt, Human
ccauucugccugcccaggc

SEQ ID NO: 1506301 - RNA, 20 nt, Human
ccauucugccugcccaggcc

SEQ ID NO: 1506302 - RNA, 17 nt, Human
ccauucuccaccugcca

SEQ ID NO: 1506303 - RNA, 18 nt, Human
ccauucuccaccugccag

SEQ ID NO: 1506304 - RNA, 17 nt, Human
ccauucugccugcccag

SEQ ID NO: 1506305 - RNA, 18 nt, Human
ccauucugccugcccagg

SEQ ID NO: 1506306 - RNA, 21 nt, Human
cccacaaaggagagcuagcag

SEQ ID NO: 1506307 - RNA, 22 nt, Human
ccaggaagccagcaggcucuca

SEQ ID NO: 1506308 - RNA, 14 nt, Human
ccagcucuggucca

SEQ ID NO: 1506309 - RNA, 17 nt, Human
ccagcucugguccauag

SEQ ID NO: 1506310 - RNA, 21 nt, Human
ccagcucugguccauagagag

SEQ ID NO: 1506311 - RNA, 22 nt, Human
ccagcucugguccauagagagc

SEQ ID NO: 1506312 - RNA, 23 nt, Human
ccagcugcuugggcuucauccuc

SEQ ID NO: 1506313 - RNA, 13 nt, Human
ccagcugcuuggg

SEQ ID NO: 1506314 - RNA, 22 nt, Human
ccagagcccaccuuggcucaag

SEQ ID NO: 1506315 - RNA, 16 nt, Human
ccagagcccaccuugg

SEQ ID NO: 1506316 - RNA, 19 nt, Human
ccagccuugaccauucucc

SEQ ID NO: 1506317 - RNA, 20 nt, Human
ccagccuugaccauucucca

SEQ ID NO: 1506318 - RNA, 21 nt, Human
ccagcgagcccugguggcagu

SEQ ID NO: 1506319 - RNA, 11 nt, Human
ccagcucuggu

SEQ ID NO: 1506320 - RNA, 12 nt, Human
ccagcucugguc

SEQ ID NO: 1506321 - RNA, 13 nt, Human
ccagcucuggucc

SEQ ID NO: 1506322 - RNA, 22 nt, Human
ccagccuugaccauucuccacc

SEQ ID NO: 1506323 - RNA, 14 nt, Human
ccagcgagcccugg

SEQ ID NO: 1506324 - RNA, 15 nt, Human
ccagcgagcccuggu

SEQ ID NO: 1506325 - RNA, 16 nt, Human
ccagcgagcccuggug

SEQ ID NO: 1506326 - RNA, 13 nt, Human
ccaguaucuugaa

SEQ ID NO: 1506327 - RNA, 16 nt, Human
ccagugaauucuugaa

SEQ ID NO: 1506328 - RNA, 20 nt, Human
ccagugaauucuugaaggaa

SEQ ID NO: 1506329 - RNA, 15 nt, Human
ccagguucagcuugu

SEQ ID NO: 1506330 - RNA, 21 nt, Human
ccaggugcuaggaacacuccu

SEQ ID NO: 1506331 - RNA, 14 nt, Human
ccagguucagcuug

SEQ ID NO: 1506332 - RNA, 18 nt, Human
ccaggugcacaagcucca

SEQ ID NO: 1506333 - RNA, 17 nt, Human
ccaggugccaguuaugg

SEQ ID NO: 1506334 - RNA, 19 nt, Human
ccaggugcuaggaacacuc

SEQ ID NO: 1506335 - RNA, 20 nt, Human
ccaggcuguaucccaugagc

SEQ ID NO: 1506336 - RNA, 19 nt, Human
ccaggcuggucucaaacuc

SEQ ID NO: 1506337 - RNA, 13 nt, Human
ccaggccccugcc

SEQ ID NO: 1506338 - RNA, 13 nt, Human
ccaggcauggugg

SEQ ID NO: 1506339 - RNA, 17 nt, Human
ccaggcauuccccagga

SEQ ID NO: 1506340 - RNA, 14 nt, Human
ccaggcauucccca

SEQ ID NO: 1506341 - RNA, 21 nt, Human
ccaggccacaagacccuugug

SEQ ID NO: 1506342 - RNA, 24 nt, Human
ccaggcauuccccaggaggccagc

SEQ ID NO: 1506343 - RNA, 23 nt, Human
ccaggcauuccccaggaggccag

SEQ ID NO: 1506344 - RNA, 14 nt, Human
ccaggaggccagcc

SEQ ID NO: 1506345 - RNA, 13 nt, Human
ccaggaggccagc

SEQ ID NO: 1506346 - RNA, 12 nt, Human
ccaggaggccag

SEQ ID NO: 1506347 - RNA, 13 nt, Human
ccaggagccuccu

SEQ ID NO: 1506348 - RNA, 14 nt, Human
ccaggagccuccug

SEQ ID NO: 1506349 - RNA, 18 nt, Human
ccaggagccuccugcccu

SEQ ID NO: 1506350 - RNA, 16 nt, Human
ccaggagccccgaggc

SEQ ID NO: 1506351 - RNA, 19 nt, Human
ccaggagccuccugcccuu

SEQ ID NO: 1506352 - RNA, 15 nt, Human
ccaggagccccgagg

SEQ ID NO: 1506353 - RNA, 16 nt, Human
ccaggagcagccacau

SEQ ID NO: 1506354 - RNA, 20 nt, Human
ccacaggaaccacaagacug

SEQ ID NO: 1506355 - RNA, 16 nt, Human
ccacaggaucagucug

SEQ ID NO: 1506356 - RNA, 20 nt, Human
ccacacccagcccacuucug

SEQ ID NO: 1506357 - RNA, 21 nt, Human
ccacacccagcccacuucugc

SEQ ID NO: 1506358 - RNA, 22 nt, Human
ccacacccagcccacuucugcc

SEQ ID NO: 1506359 - RNA, 22 nt, Human
ccacaggccugagauuucaucu

SEQ ID NO: 1506360 - RNA, 14 nt, Human
ccacaggccugaga

SEQ ID NO: 1506361 - RNA, 19 nt, Human
ccacaggccugagauuuca

SEQ ID NO: 1506362 - RNA, 11 nt, Human
ccacaggccug

SEQ ID NO: 1506363 - RNA, 12 nt, Human
ccacaggccuga

SEQ ID NO: 1506364 - RNA, 15 nt, Human
ccacaggcuuaggga

SEQ ID NO: 1506365 - RNA, 18 nt, Human
ccacaggcuuagggacag

SEQ ID NO: 1506366 - RNA, 19 nt, Human
ccacaggcuuagggacagg

SEQ ID NO: 1506367 - RNA, 21 nt, Human
ccacaggcuuagggacaggac

SEQ ID NO: 1506368 - RNA, 20 nt, Human
ccacaucuugcucugcugac

SEQ ID NO: 1506369 - RNA, 19 nt, Human
ccacaucuugcucugcuga

SEQ ID NO: 1506370 - RNA, 18 nt, Human
ccacaucuugcucugcug

SEQ ID NO: 1506371 - RNA, 16 nt, Human
ccacaugugcacaugc

SEQ ID NO: 1506372 - RNA, 16 nt, Human
ccacauuccugaugcu

SEQ ID NO: 1506373 - RNA, 21 nt, Human
ccaccaacauacucccaucug

SEQ ID NO: 1506374 - RNA, 16 nt, Human
ccaauauucauagcag

SEQ ID NO: 1506375 - RNA, 23 nt, Human
ccacccaggagccccgaggccuu

SEQ ID NO: 1506376 - RNA, 17 nt, Human
ccacccccacccaaggg

SEQ ID NO: 1506377 - RNA, 23 nt, Human
ccacggccaggccagagggagug

SEQ ID NO: 1506378 - RNA, 18 nt, Human
ccacgcuggagugcagug

SEQ ID NO: 1506379 - RNA, 19 nt, Human
ccacgcuggagugcaguga

SEQ ID NO: 1506380 - RNA, 16 nt, Human
ccacggccaggccaga

SEQ ID NO: 1506381 - RNA, 18 nt, Human
ccacggccaggccagagg

SEQ ID NO: 1506382 - RNA, 16 nt, Human
ccacgcuggagugcag

SEQ ID NO: 1506383 - RNA, 15 nt, Human
ccacccccacccaag

SEQ ID NO: 1506384 - RNA, 15 nt, Human
ccaccccacacacgc

SEQ ID NO: 1506385 - RNA, 14 nt, Human
ccacuacauucugu

SEQ ID NO: 1506386 - RNA, 15 nt, Human
ccacuacauucuguu

SEQ ID NO: 1506387 - RNA, 11 nt, Human
ccacuacauuc

SEQ ID NO: 1506388 - RNA, 17 nt, Human
ccacuacauucuguuaa

SEQ ID NO: 1506389 - RNA, 16 nt, Human
ccacuacauucuguua

SEQ ID NO: 1506390 - RNA, 18 nt, Human
ccacucaguccauagcag

SEQ ID NO: 1506391 - RNA, 13 nt, Human
ccacuucagcuga

SEQ ID NO: 1506392 - RNA, 14 nt, Human
ccacuucagcugac

SEQ ID NO: 1506393 - RNA, 13 nt, Human
ccacugcagaaga

SEQ ID NO: 1506394 - RNA, 18 nt, Human
ccacugcagaagacagua

SEQ ID NO: 1506395 - RNA, 23 nt, Human
ccagaaguuugagaucagccugg

SEQ ID NO: 1506396 - RNA, 22 nt, Human
ccagaaguuugagaucagccug

SEQ ID NO: 1506397 - RNA, 18 nt, Human
ccagaauuucccaaagca

SEQ ID NO: 1506398 - RNA, 21 nt, Human
ccagaauuucccaaagcagug

SEQ ID NO: 1506399 - RNA, 21 nt, Human
ccagacaccuugacagggcac

SEQ ID NO: 1506400 - RNA, 12 nt, Human
ccagaauuuccc

SEQ ID NO: 1506401 - RNA, 19 nt, Human
ccagaauuucccaaagcag

SEQ ID NO: 1506402 - RNA, 14 nt, Human
ccaagcaaguauua

SEQ ID NO: 1506403 - RNA, 17 nt, Human
ccaagcauuuagaugua

SEQ ID NO: 1506404 - RNA, 22 nt, Human
ccaagcauaccaacacgagcag

SEQ ID NO: 1506405 - RNA, 14 nt, Human
ccaagcucccaggc

SEQ ID NO: 1506406 - RNA, 15 nt, Human
ccaagcucccaggca

SEQ ID NO: 1506407 - RNA, 16 nt, Human
ccaagcucccaggcau

SEQ ID NO: 1506408 - RNA, 22 nt, Human
ccaagcucccaggcauucccca

SEQ ID NO: 1506409 - RNA, 17 nt, Human
ccaaggccaaaggaagc

SEQ ID NO: 1506410 - RNA, 20 nt, Human
ccaagucaagugaaaaagga

SEQ ID NO: 1506411 - RNA, 18 nt, Human
ccaaggugggaggauugc

SEQ ID NO: 1506412 - RNA, 13 nt, Human
ccaaggugggagg

SEQ ID NO: 1506413 - RNA, 23 nt, Human
ccaagguuuggggaagaacgaag

SEQ ID NO: 1506414 - RNA, 22 nt, Human
ccaaggggaauguuugccucug

SEQ ID NO: 1506415 - RNA, 19 nt, Human
ccaagggccuggccugagc

SEQ ID NO: 1506416 - RNA, 16 nt, Human
ccaagggccuggccug

SEQ ID NO: 1506417 - RNA, 18 nt, Human
ccaagggccuggccugag

SEQ ID NO: 1506418 - RNA, 15 nt, Human
ccaagggccuggccu

SEQ ID NO: 1506419 - RNA, 18 nt, Human
ccaaggccaaaggaagca

SEQ ID NO: 1506420 - RNA, 21 nt, Human
ccaaggccaaaggaagcacau

SEQ ID NO: 1506421 - RNA, 18 nt, Human
ccaaaguacacuguuuca

SEQ ID NO: 1506422 - RNA, 15 nt, Human
ccaaaguacacuguu

SEQ ID NO: 1506423 - RNA, 20 nt, Human
ccaaaguacacuguuucaaa

SEQ ID NO: 1506424 - RNA, 13 nt, Human
ccaacaucaacau

SEQ ID NO: 1506425 - RNA, 21 nt, Human
ccaacauacucccaucuguga

SEQ ID NO: 1506426 - RNA, 22 nt, Human
ccaacauacucccaucugugaa

SEQ ID NO: 1506427 - RNA, 17 nt, Human
ccaacauacucccaucu

SEQ ID NO: 1506428 - RNA, 18 nt, Human
ccaacauacucccaucug

SEQ ID NO: 1506429 - RNA, 19 nt, Human
ccaacauacucccaucugu

SEQ ID NO: 1506430 - RNA, 20 nt, Human
ccaacauacucccaucugug

SEQ ID NO: 1506431 - RNA, 22 nt, Human
ccaaacugacucuuaagaagac

SEQ ID NO: 1506432 - RNA, 23 nt, Human
ccaaagcagugcaugcugucccu

SEQ ID NO: 1506433 - RNA, 19 nt, Human
ccaaagccaaagcuaggcc

SEQ ID NO: 1506434 - RNA, 17 nt, Human
ccaaagccuccuccagc

SEQ ID NO: 1506435 - RNA, 22 nt, Human
ccaaagccuccuccagccgcca

SEQ ID NO: 1506436 - RNA, 20 nt, Human
ccaaacucaccugccccuca

SEQ ID NO: 1506437 - RNA, 21 nt, Human
ccaaagcuaggccuggccaga

SEQ ID NO: 1506438 - RNA, 16 nt, Human
ccaaagcuaggccugg

SEQ ID NO: 1506439 - RNA, 17 nt, Human
ccaaagcuaggccuggc

SEQ ID NO: 1506440 - RNA, 15 nt, Human
ccaaagcuaggccug

SEQ ID NO: 1506441 - RNA, 16 nt, Human
ccaaaggcucucuccu

SEQ ID NO: 1506442 - RNA, 15 nt, Human
ccaaaggaagcacau

SEQ ID NO: 1506443 - RNA, 23 nt, Human
ccaaaggaagcacaugccucucu

SEQ ID NO: 1506444 - RNA, 12 nt, Human
ccaacccucauc

SEQ ID NO: 1506445 - RNA, 21 nt, Human
ccaaccccccagcacugagga

SEQ ID NO: 1506446 - RNA, 13 nt, Human
ccaaccccccagc

SEQ ID NO: 1506447 - RNA, 14 nt, Human
ccaaccccccagca

SEQ ID NO: 1506448 - RNA, 15 nt, Human
ccaaccccccagcac

SEQ ID NO: 1506449 - RNA, 17 nt, Human
ccaaccccccagcacug

SEQ ID NO: 1506450 - RNA, 18 nt, Human
ccaaccccccagcacuga

SEQ ID NO: 1506451 - RNA, 19 nt, Human
ccaaccccccagcacugag

SEQ ID NO: 1506452 - RNA, 20 nt, Human
ccaaccccccagcacugagg

SEQ ID NO: 1506453 - RNA, 19 nt, Human
ccaagaagcccaggaaagg

SEQ ID NO: 1506454 - RNA, 20 nt, Human
ccaagaagcccaggaaaggc

SEQ ID NO: 1506455 - RNA, 23 nt, Human
ccaagcagagguugggaggccau

SEQ ID NO: 1506456 - RNA, 13 nt, Human
cauugugggaagg

SEQ ID NO: 1506457 - RNA, 17 nt, Human
cauuguuggccaaagcc

SEQ ID NO: 1506458 - RNA, 18 nt, Human
cauuguuggccaaagcca

SEQ ID NO: 1506459 - RNA, 14 nt, Human
cacccaagggccug

SEQ ID NO: 1506460 - RNA, 15 nt, Human
cacccaagggccugg

SEQ ID NO: 1506461 - RNA, 12 nt, Human
cauuuccugugu

SEQ ID NO: 1506462 - RNA, 13 nt, Human
cauuuccuguguc

SEQ ID NO: 1506463 - RNA, 17 nt, Human
cauuuaggccaugggac

SEQ ID NO: 1506464 - RNA, 16 nt, Human
cauuuaaaagauacag

SEQ ID NO: 1506465 - RNA, 15 nt, Human
cauuuaaaagauaca

SEQ ID NO: 1506466 - RNA, 12 nt, Human
cauuuaaaagau

SEQ ID NO: 1506467 - RNA, 21 nt, Human
cauuuaaaagauacaguuacu

SEQ ID NO: 1506468 - RNA, 16 nt, Human
cacccaagggccuggc

SEQ ID NO: 1506469 - RNA, 19 nt, Human
cauuuuagggguagcauuu

SEQ ID NO: 1506470 - RNA, 23 nt, Human
cauuuuucuuagggaaggauaca

SEQ ID NO: 1506471 - RNA, 13 nt, Human
cauuugcucaugg

SEQ ID NO: 1506472 - RNA, 13 nt, Human
cauuugcuccuuu

SEQ ID NO: 1506473 - RNA, 14 nt, Human
cauuugcuccuuuc

SEQ ID NO: 1506474 - RNA, 22 nt, Human
cauuuguuugaacugauaaaga

SEQ ID NO: 1506475 - RNA, 20 nt, Human
cauuuguuugaacugauaaa

SEQ ID NO: 1506476 - RNA, 13 nt, Human
cauuugcugaaua

SEQ ID NO: 1506477 - RNA, 17 nt, Human
cauuuguuugaacugau

SEQ ID NO: 1506478 - RNA, 20 nt, Human
cauuugagcagggcucagcg

SEQ ID NO: 1506479 - RNA, 20 nt, Human
cauuugcuaacuagcuugga

SEQ ID NO: 1506480 - RNA, 17 nt, Human
cauuugagcagggcuca

SEQ ID NO: 1506481 - RNA, 18 nt, Human
cauuugagcagggcucag

SEQ ID NO: 1506482 - RNA, 20 nt, Human
cauuugaaaauuuugauguu

SEQ ID NO: 1506483 - RNA, 22 nt, Human
cauuugaaaauuuugauguuuu

SEQ ID NO: 1506484 - RNA, 20 nt, Human
cugagacucgcgacaaugca

SEQ ID NO: 1506485 - RNA, 17 nt, Human
cugagacucgcgacaau

SEQ ID NO: 1506486 - RNA, 19 nt, Human
cugagacucgcgacaaugc

SEQ ID NO: 1506487 - RNA, 15 nt, Human
cugcauguuugugau

SEQ ID NO: 1506488 - RNA, 13 nt, Human
cugcauguuacau

SEQ ID NO: 1506489 - RNA, 13 nt, Human
cugcauuggcuuu

SEQ ID NO: 1506490 - RNA, 22 nt, Human
cugcauuuaaaagauacaguua

SEQ ID NO: 1506491 - RNA, 20 nt, Human
cugcauuuaaaagauacagu

SEQ ID NO: 1506492 - RNA, 15 nt, Human
cugccaaugggagcu

SEQ ID NO: 1506493 - RNA, 17 nt, Human
cugccaaugggagcuca

SEQ ID NO: 1506494 - RNA, 14 nt, Human
cugccccucaacuc

SEQ ID NO: 1506495 - RNA, 22 nt, Human
cugccccucaacucuccuccag

SEQ ID NO: 1506496 - RNA, 12 nt, Human
cugcccugugag

SEQ ID NO: 1506497 - RNA, 13 nt, Human
cugcccugugagu

SEQ ID NO: 1506498 - RNA, 15 nt, Human
cugcccugugggccc

SEQ ID NO: 1506499 - RNA, 16 nt, Human
cugcccugugggcccc

SEQ ID NO: 1506500 - RNA, 18 nt, Human
cugcccugugggccccca

SEQ ID NO: 1506501 - RNA, 12 nt, Human
cugccauccagg

SEQ ID NO: 1506502 - RNA, 11 nt, Human
cugccagggac

SEQ ID NO: 1506503 - RNA, 12 nt, Human
cugccagggaca

SEQ ID NO: 1506504 - RNA, 15 nt, Human
cugccagggacagag

SEQ ID NO: 1506505 - RNA, 20 nt, Human
cugccauauucuguuggcca

SEQ ID NO: 1506506 - RNA, 21 nt, Human
cugccauauucuguuggccag

SEQ ID NO: 1506507 - RNA, 22 nt, Human
cugccauauucuguuggccagu

SEQ ID NO: 1506508 - RNA, 23 nt, Human
cugccauauucuguuggccagug

SEQ ID NO: 1506509 - RNA, 15 nt, Human
cugcuacagagcaga

SEQ ID NO: 1506510 - RNA, 16 nt, Human
cugcuaauuccccaga

SEQ ID NO: 1506511 - RNA, 16 nt, Human
cugccuguugggccag

SEQ ID NO: 1506512 - RNA, 18 nt, Human
cugccuguugggccagga

SEQ ID NO: 1506513 - RNA, 19 nt, Human
cugccuguugggccaggag

SEQ ID NO: 1506514 - RNA, 23 nt, Human
cugccugggaucccucauccuca

SEQ ID NO: 1506515 - RNA, 14 nt, Human
cugccuguucagcu

SEQ ID NO: 1506516 - RNA, 15 nt, Human
cugccuguucagcuc

SEQ ID NO: 1506517 - RNA, 15 nt, Human
cugccucgaacuggc

SEQ ID NO: 1506518 - RNA, 17 nt, Human
cugccucgaacuggcug

SEQ ID NO: 1506519 - RNA, 18 nt, Human
cugccucgaacuggcugc

SEQ ID NO: 1506520 - RNA, 19 nt, Human
cugccucgaacuggcugca

SEQ ID NO: 1506521 - RNA, 19 nt, Human
cugcccugugggcccccaa

SEQ ID NO: 1506522 - RNA, 17 nt, Human
cuggaacacuaaugagg

SEQ ID NO: 1506523 - RNA, 21 nt, Human
cuggaaaucaggguuaguauu

SEQ ID NO: 1506524 - RNA, 16 nt, Human
cuggaaauauuaagaa

SEQ ID NO: 1506525 - RNA, 23 nt, Human
cugcuucagccucccgaguagcu

SEQ ID NO: 1506526 - RNA, 22 nt, Human
cugcuuuuuaaagaaugcucuu

SEQ ID NO: 1506527 - RNA, 14 nt, Human
cugcuucagccucc

SEQ ID NO: 1506528 - RNA, 16 nt, Human
cugcuucagccucccg

SEQ ID NO: 1506529 - RNA, 17 nt, Human
cugcuuaacuucacaua

SEQ ID NO: 1506530 - RNA, 15 nt, Human
cugcuuaacuucaca

SEQ ID NO: 1506531 - RNA, 20 nt, Human
cugcuuaacuucacauauug

SEQ ID NO: 1506532 - RNA, 13 nt, Human
cugcuucagccuc

SEQ ID NO: 1506533 - RNA, 13 nt, Human
cugcuuaacuuca

SEQ ID NO: 1506534 - RNA, 15 nt, Human
cugcugacagacaca

SEQ ID NO: 1506535 - RNA, 18 nt, Human
cugcugacagacacaggc

SEQ ID NO: 1506536 - RNA, 19 nt, Human
cugcugacagacacaggcc

SEQ ID NO: 1506537 - RNA, 20 nt, Human
cugcugacagacacaggccc

SEQ ID NO: 1506538 - RNA, 21 nt, Human
cugcugacagacacaggcccg

SEQ ID NO: 1506539 - RNA, 23 nt, Human
cugcugacagacacaggcccggc

SEQ ID NO: 1506540 - RNA, 11 nt, Human
cugcugacagu

SEQ ID NO: 1506541 - RNA, 21 nt, Human
cuguaggaagguuaauguuca

SEQ ID NO: 1506542 - RNA, 20 nt, Human
cugucauuugagcagggcuc

SEQ ID NO: 1506543 - RNA, 23 nt, Human
cugucagcuccccucggagaaga

SEQ ID NO: 1506544 - RNA, 17 nt, Human
cugucauuugagcaggg

SEQ ID NO: 1506545 - RNA, 18 nt, Human
cugucauuugagcagggc

SEQ ID NO: 1506546 - RNA, 18 nt, Human
cugucagccauuccuguu

SEQ ID NO: 1506547 - RNA, 21 nt, Human
cugucagcuccccucggagaa

SEQ ID NO: 1506548 - RNA, 15 nt, Human
cugucgcccagucug

SEQ ID NO: 1506549 - RNA, 13 nt, Human
cugucgcccaguc

SEQ ID NO: 1506550 - RNA, 18 nt, Human
cugugaaguuuacauugu

SEQ ID NO: 1506551 - RNA, 15 nt, Human
cugugaagagaacca

SEQ ID NO: 1506552 - RNA, 16 nt, Human
cugugagaugcuagaa

SEQ ID NO: 1506553 - RNA, 21 nt, Human
cugugagaugcuagaacuccc

SEQ ID NO: 1506554 - RNA, 18 nt, Human
cugugagacucgagaacu

SEQ ID NO: 1506555 - RNA, 20 nt, Human
cugugagacucgagaacuuu

SEQ ID NO: 1506556 - RNA, 14 nt, Human
cugugcucuggaca

SEQ ID NO: 1506557 - RNA, 15 nt, Human
cugugcucuggacag

SEQ ID NO: 1506558 - RNA, 23 nt, Human
cuggugacuuuccucuuuggucu

SEQ ID NO: 1506559 - RNA, 14 nt, Human
cuggguucuaccca

SEQ ID NO: 1506560 - RNA, 15 nt, Human
cuggugacuuuccuc

SEQ ID NO: 1506561 - RNA, 20 nt, Human
cuggugacuuuccucuuugg

SEQ ID NO: 1506562 - RNA, 21 nt, Human
cuggugacuuuccucuuuggu

SEQ ID NO: 1506563 - RNA, 15 nt, Human
cuggguucacugcaa

SEQ ID NO: 1506564 - RNA, 14 nt, Human
cuggguucacugca

SEQ ID NO: 1506565 - RNA, 23 nt, Human
cuggguggcaccagcagccugga

SEQ ID NO: 1506566 - RNA, 16 nt, Human
cuggguguggcgcagc

SEQ ID NO: 1506567 - RNA, 17 nt, Human
cuggguguggcgcagca

SEQ ID NO: 1506568 - RNA, 16 nt, Human
cuggggccgaaagaac

SEQ ID NO: 1506569 - RNA, 18 nt, Human
cugggcagaaggaagacu

SEQ ID NO: 1506570 - RNA, 17 nt, Human
cugggcagaaggaagac

SEQ ID NO: 1506571 - RNA, 10 nt, Human
cugggacagg

SEQ ID NO: 1506572 - RNA, 12 nt, Human
cugggacacagu

SEQ ID NO: 1506573 - RNA, 13 nt, Human
cugggacacaguu

SEQ ID NO: 1506574 - RNA, 17 nt, Human
cuggccccucagggucc

SEQ ID NO: 1506575 - RNA, 18 nt, Human
cuggccccucaggguccc

SEQ ID NO: 1506576 - RNA, 20 nt, Human
cuggccccucagggucccug

SEQ ID NO: 1506577 - RNA, 21 nt, Human
cuggccccucagggucccugg

SEQ ID NO: 1506578 - RNA, 12 nt, Human
cuggcagcucag

SEQ ID NO: 1506579 - RNA, 13 nt, Human
cuggcagcucaga

SEQ ID NO: 1506580 - RNA, 14 nt, Human
cuggcagcucagag

SEQ ID NO: 1506581 - RNA, 13 nt, Human
cuggccccucagg

SEQ ID NO: 1506582 - RNA, 15 nt, Human
cuggcagcucagaga

SEQ ID NO: 1506583 - RNA, 15 nt, Human
cuucacuguaaaaua

SEQ ID NO: 1506584 - RNA, 20 nt, Human
cuucagagacuccugcaggc

SEQ ID NO: 1506585 - RNA, 18 nt, Human
cuucagagacuccugcag

SEQ ID NO: 1506586 - RNA, 19 nt, Human
cuucagagacuccugcagg

SEQ ID NO: 1506587 - RNA, 21 nt, Human
cuucaucugacuaugacauaa

SEQ ID NO: 1506588 - RNA, 22 nt, Human
cuuccagugaggcucugcccuu

SEQ ID NO: 1506589 - RNA, 23 nt, Human
cuuccagugaggcucugcccuug

SEQ ID NO: 1506590 - RNA, 21 nt, Human
cuuccagugaggcucugcccu

SEQ ID NO: 1506591 - RNA, 20 nt, Human
cuucaugcauagguuuagca

SEQ ID NO: 1506592 - RNA, 11 nt, Human
cuucccaccuc

SEQ ID NO: 1506593 - RNA, 21 nt, Human
cuucccaccucucucacuccu

SEQ ID NO: 1506594 - RNA, 23 nt, Human
cuucccaccucucucacuccuug

SEQ ID NO: 1506595 - RNA, 23 nt, Human
cuuauuguagcauccuggaauau

SEQ ID NO: 1506596 - RNA, 21 nt, Human
cuucaccuuuguccccaccgc

SEQ ID NO: 1506597 - RNA, 20 nt, Human
cuuauuguagcauccuggaa

SEQ ID NO: 1506598 - RNA, 22 nt, Human
cuucaccuuuguccccaccgca

SEQ ID NO: 1506599 - RNA, 15 nt, Human
cuucacggaagagcc

SEQ ID NO: 1506600 - RNA, 19 nt, Human
cuucacggaagagccuugc

SEQ ID NO: 1506601 - RNA, 17 nt, Human
cuuauggaacacucuga

SEQ ID NO: 1506602 - RNA, 19 nt, Human
cuuauggaacacucugaga

SEQ ID NO: 1506603 - RNA, 20 nt, Human
cuuauggaacacucugagac

SEQ ID NO: 1506604 - RNA, 21 nt, Human
cuuauggaacacucugagacu

SEQ ID NO: 1506605 - RNA, 13 nt, Human
cuuauggaacacu

SEQ ID NO: 1506606 - RNA, 16 nt, Human
cuuauggaacacucug

SEQ ID NO: 1506607 - RNA, 12 nt, Human
cugugcugaguc

SEQ ID NO: 1506608 - RNA, 14 nt, Human
cugugcugagucug

SEQ ID NO: 1506609 - RNA, 19 nt, Human
cugugcugagucugaaggc

SEQ ID NO: 1506610 - RNA, 13 nt, Human
cuugaugaagaag

SEQ ID NO: 1506611 - RNA, 20 nt, Human
cuuggcgcugccccuggcag

SEQ ID NO: 1506612 - RNA, 12 nt, Human
cuuggcgcugcc

SEQ ID NO: 1506613 - RNA, 14 nt, Human
cuuggcgcugcccc

SEQ ID NO: 1506614 - RNA, 17 nt, Human
cuuggcgcugccccugg

SEQ ID NO: 1506615 - RNA, 12 nt, Human
cuugaugaagaa

SEQ ID NO: 1506616 - RNA, 20 nt, Human
cuugacagggcacaccgggc

SEQ ID NO: 1506617 - RNA, 19 nt, Human
cuugaauuguaaggaauga

SEQ ID NO: 1506618 - RNA, 14 nt, Human
cuugacagggcaca

SEQ ID NO: 1506619 - RNA, 15 nt, Human
cuugacagggcacac

SEQ ID NO: 1506620 - RNA, 13 nt, Human
cuugacagggcac

SEQ ID NO: 1506621 - RNA, 13 nt, Human
cuucuaggaagcu

SEQ ID NO: 1506622 - RNA, 17 nt, Human
cuucuaagucauucaua

SEQ ID NO: 1506623 - RNA, 23 nt, Human
cuucuaaguaaaaccacagcagu

SEQ ID NO: 1506624 - RNA, 17 nt, Human
cuuccugcaacaccuug

SEQ ID NO: 1506625 - RNA, 15 nt, Human
cuucugccauauucu

SEQ ID NO: 1506626 - RNA, 20 nt, Human
cuucugacccaugcugcccu

SEQ ID NO: 1506627 - RNA, 21 nt, Human
cuucugacccaugcugcccug

SEQ ID NO: 1506628 - RNA, 22 nt, Human
cuucugacccaugcugcccugu

SEQ ID NO: 1506629 - RNA, 23 nt, Human
cuucugacccaugcugcccugug

SEQ ID NO: 1506630 - RNA, 22 nt, Human
cuuuccugaggcugggcucccu

SEQ ID NO: 1506631 - RNA, 23 nt, Human
cuuucagccaagaauucuuaaau

SEQ ID NO: 1506632 - RNA, 20 nt, Human
cuuucagccaagaauucuua

SEQ ID NO: 1506633 - RNA, 21 nt, Human
cuuucaaugguuugcaaggaa

SEQ ID NO: 1506634 - RNA, 22 nt, Human
cuuucaaugguuugcaaggaag

SEQ ID NO: 1506635 - RNA, 20 nt, Human
cuuucaaugguuugcaagga

SEQ ID NO: 1506636 - RNA, 14 nt, Human
cuuuuauaaacuuu

SEQ ID NO: 1506637 - RNA, 13 nt, Human
cuuuuauaaacuu

SEQ ID NO: 1506638 - RNA, 15 nt, Human
cuuucuagccagagg

SEQ ID NO: 1506639 - RNA, 16 nt, Human
cuuucuagccagagga

SEQ ID NO: 1506640 - RNA, 18 nt, Human
gaaauauuuauuuuaaua

SEQ ID NO: 1506641 - RNA, 22 nt, Human
gaaauauuuauuuuaauaaugu

SEQ ID NO: 1506642 - RNA, 18 nt, Human
gaaaucaaauaugcaaag

SEQ ID NO: 1506643 - RNA, 21 nt, Human
gaaaucaaauaugcaaagcac

SEQ ID NO: 1506644 - RNA, 19 nt, Human
gaaaucaaauaugcaaagc

SEQ ID NO: 1506645 - RNA, 20 nt, Human
gaaaucaaauaugcaaagca

SEQ ID NO: 1506646 - RNA, 17 nt, Human
gaaauauuuauuuuaau

SEQ ID NO: 1506647 - RNA, 22 nt, Human
gaaagggacuuggaagcuccgc

SEQ ID NO: 1506648 - RNA, 20 nt, Human
gaaagggacgcuacccggga

SEQ ID NO: 1506649 - RNA, 19 nt, Human
gaaagggacuuggaagcuc

SEQ ID NO: 1506650 - RNA, 13 nt, Human
gaaacuuuuggaa

SEQ ID NO: 1506651 - RNA, 15 nt, Human
gaaacuuuuggaagg

SEQ ID NO: 1506652 - RNA, 21 nt, Human
gaaagaaaauaccaaggaaca

SEQ ID NO: 1506653 - RNA, 20 nt, Human
gaaagacuaucuaaauguug

SEQ ID NO: 1506654 - RNA, 14 nt, Human
gaaagacuauucaa

SEQ ID NO: 1506655 - RNA, 15 nt, Human
gaaagacuauucaaa

SEQ ID NO: 1506656 - RNA, 22 nt, Human
gaaaggcuccaggagcagccac

SEQ ID NO: 1506657 - RNA, 21 nt, Human
gaaaggcuccaggagcagcca

SEQ ID NO: 1506658 - RNA, 17 nt, Human
gaaagacuauucaaaca

SEQ ID NO: 1506659 - RNA, 13 nt, Human
cuuuugugcauua

SEQ ID NO: 1506660 - RNA, 12 nt, Human
cuuuugugcauu

SEQ ID NO: 1506661 - RNA, 23 nt, Human
cuuuuuuggcugcugaaggcucg

SEQ ID NO: 1506662 - RNA, 19 nt, Human
cuuuuguagaagucacauu

SEQ ID NO: 1506663 - RNA, 18 nt, Human
cuuuugucuaugggacuc

SEQ ID NO: 1506664 - RNA, 18 nt, Human
cuuuuggaagguauuuaa

SEQ ID NO: 1506665 - RNA, 16 nt, Human
cuuuugccguuauuaa

SEQ ID NO: 1506666 - RNA, 23 nt, Human
cuuuugcccacacuugggagcaa

SEQ ID NO: 1506667 - RNA, 14 nt, Human
gaaaauuuuaaaaa

SEQ ID NO: 1506668 - RNA, 15 nt, Human
gaaaauguaugugua

SEQ ID NO: 1506669 - RNA, 19 nt, Human
gaaaauggacguguuauga

SEQ ID NO: 1506670 - RNA, 23 nt, Human
gaaaauggacguguuaugacucc

SEQ ID NO: 1506671 - RNA, 18 nt, Human
gaaaagaaaaaugagccu

SEQ ID NO: 1506672 - RNA, 21 nt, Human
gaaaauggaagacagcucuua

SEQ ID NO: 1506673 - RNA, 14 nt, Human
gaaaaacugauuuu

SEQ ID NO: 1506674 - RNA, 19 nt, Human
gcagagcagagaccauccc

SEQ ID NO: 1506675 - RNA, 20 nt, Human
gcagagcagagaccaucccu

SEQ ID NO: 1506676 - RNA, 24 nt, Human
gcagagcaccuuagacagucccug

SEQ ID NO: 1506677 - RNA, 12 nt, Human
gcagagcagaga

SEQ ID NO: 1506678 - RNA, 14 nt, Human
gcagagcagagacc

SEQ ID NO: 1506679 - RNA, 15 nt, Human
gcagagcagagacca

SEQ ID NO: 1506680 - RNA, 19 nt, Human
gcagagcaccuuagacagu

SEQ ID NO: 1506681 - RNA, 22 nt, Human
gcagagcaccuuagacaguccc

SEQ ID NO: 1506682 - RNA, 23 nt, Human
gcagagcaccuuagacagucccu

SEQ ID NO: 1506683 - RNA, 17 nt, Human
gcacugacagauuucca

SEQ ID NO: 1506684 - RNA, 12 nt, Human
gcacugacagau

SEQ ID NO: 1506685 - RNA, 12 nt, Human
gcacugacauug

SEQ ID NO: 1506686 - RNA, 13 nt, Human
gcaagugagagcu

SEQ ID NO: 1506687 - RNA, 15 nt, Human
gcaagugagagcugg

SEQ ID NO: 1506688 - RNA, 23 nt, Human
gcaauaaggggagaguaacccug

SEQ ID NO: 1506689 - RNA, 22 nt, Human
gcacaagcuccaagcucccagg

SEQ ID NO: 1506690 - RNA, 23 nt, Human
gcacaagcuccaagcucccaggc

SEQ ID NO: 1506691 - RNA, 14 nt, Human
gcacaagcugcacc

SEQ ID NO: 1506692 - RNA, 21 nt, Human
gcaccggcuggccuggccccu

SEQ ID NO: 1506693 - RNA, 23 nt, Human
gcaccggcuggccuggccccuca

SEQ ID NO: 1506694 - RNA, 19 nt, Human
gcaccggcuggccuggccc

SEQ ID NO: 1506695 - RNA, 14 nt, Human
gcacaugccucucu

SEQ ID NO: 1506696 - RNA, 17 nt, Human
gcacaugccucucucag

SEQ ID NO: 1506697 - RNA, 18 nt, Human
gcacaugccucucucagg

SEQ ID NO: 1506698 - RNA, 19 nt, Human
gcacaugccucucucaggc

SEQ ID NO: 1506699 - RNA, 20 nt, Human
gcacaugccucucucaggcc

SEQ ID NO: 1506700 - RNA, 21 nt, Human
gcacaugccucucucaggcca

SEQ ID NO: 1506701 - RNA, 22 nt, Human
gcacaugccucucucaggccaa

SEQ ID NO: 1506702 - RNA, 22 nt, Human
gcacaagcugcacccucaggca

SEQ ID NO: 1506703 - RNA, 20 nt, Human
gcacaguuuucugagaaaga

SEQ ID NO: 1506704 - RNA, 18 nt, Human
gcacaguuuucugagaaa

SEQ ID NO: 1506705 - RNA, 14 nt, Human
gcacaguuuucuga

SEQ ID NO: 1506706 - RNA, 17 nt, Human
gcacaguuuucugagaa

SEQ ID NO: 1506707 - RNA, 21 nt, Human
gcacaucagcacgauuucugu

SEQ ID NO: 1506708 - RNA, 20 nt, Human
gcacaucagcacgauuucug

SEQ ID NO: 1506709 - RNA, 19 nt, Human
gcacaucagcacgauuucu

SEQ ID NO: 1506710 - RNA, 13 nt, Human
gcacaugccucuc

SEQ ID NO: 1506711 - RNA, 20 nt, Human
gcauaccacuuuuguucuug

SEQ ID NO: 1506712 - RNA, 17 nt, Human
gcauaccacuuuuguuc

SEQ ID NO: 1506713 - RNA, 14 nt, Human
gcauacguacacau

SEQ ID NO: 1506714 - RNA, 13 nt, Human
gcagggaaacagc

SEQ ID NO: 1506715 - RNA, 23 nt, Human
gcaggcucucaggccagcugcuu

SEQ ID NO: 1506716 - RNA, 17 nt, Human
gcagcugcgguccaccc

SEQ ID NO: 1506717 - RNA, 19 nt, Human
gcagcugcgguccacccag

SEQ ID NO: 1506718 - RNA, 20 nt, Human
gcaggcucucaggccagcug

SEQ ID NO: 1506719 - RNA, 22 nt, Human
gcaggcucucaggccagcugcu

SEQ ID NO: 1506720 - RNA, 16 nt, Human
gcagccacauuccuga

SEQ ID NO: 1506721 - RNA, 14 nt, Human
gcagccacuauugu

SEQ ID NO: 1506722 - RNA, 12 nt, Human
gcagccaggcca

SEQ ID NO: 1506723 - RNA, 16 nt, Human
gcagccaggccacaag

SEQ ID NO: 1506724 - RNA, 13 nt, Human
gcagccaggccac

SEQ ID NO: 1506725 - RNA, 14 nt, Human
gcagccaggccaca

SEQ ID NO: 1506726 - RNA, 17 nt, Human
gauauuuuuuucuuuuc

SEQ ID NO: 1506727 - RNA, 15 nt, Human
gauauuuuuuucuuu

SEQ ID NO: 1506728 - RNA, 16 nt, Human
gauauuuugcuuugug

SEQ ID NO: 1506729 - RNA, 15 nt, Human
gaucucuaacuucac

SEQ ID NO: 1506730 - RNA, 18 nt, Human
gaucucuugagccuggga

SEQ ID NO: 1506731 - RNA, 17 nt, Human
gaucucuugagccuggg

SEQ ID NO: 1506732 - RNA, 12 nt, Human
gaucucuugagc

SEQ ID NO: 1506733 - RNA, 16 nt, Human
gaucucuugagccugg

SEQ ID NO: 1506734 - RNA, 21 nt, Human
gaugaugaaaugaggucagag

SEQ ID NO: 1506735 - RNA, 20 nt, Human
gaugaucuuugcagacaggc

SEQ ID NO: 1506736 - RNA, 21 nt, Human
gaugaucuuugcagacaggca

SEQ ID NO: 1506737 - RNA, 14 nt, Human
gaugugaacacauc

SEQ ID NO: 1506738 - RNA, 16 nt, Human
gaugugaacacaucag

SEQ ID NO: 1506739 - RNA, 14 nt, Human
gauuaccagggacu

SEQ ID NO: 1506740 - RNA, 17 nt, Human
gauuagggagagaagau

SEQ ID NO: 1506741 - RNA, 21 nt, Human
gauuauuuucuacacauacau

SEQ ID NO: 1506742 - RNA, 18 nt, Human
gauucuccuucagcccuc

SEQ ID NO: 1506743 - RNA, 12 nt, Human
gauucuccuuca

SEQ ID NO: 1506744 - RNA, 13 nt, Human
gauucuccuucag

SEQ ID NO: 1506745 - RNA, 17 nt, Human
gauucuccuucagcccu

SEQ ID NO: 1506746 - RNA, 16 nt, Human
gaguuuagcuggaaaa

SEQ ID NO: 1506747 - RNA, 13 nt, Human
gagugcagugagc

SEQ ID NO: 1506748 - RNA, 20 nt, Human
gaguuguuacauuuuuaagu

SEQ ID NO: 1506749 - RNA, 16 nt, Human
gaguuguuacauuuuu

SEQ ID NO: 1506750 - RNA, 20 nt, Human
gaguuugggguaugggagag

SEQ ID NO: 1506751 - RNA, 16 nt, Human
gagucccaccuuggcu

SEQ ID NO: 1506752 - RNA, 20 nt, Human
gagucccaccuuggcugcag

SEQ ID NO: 1506753 - RNA, 15 nt, Human
gagucaccaagccca

SEQ ID NO: 1506754 - RNA, 13 nt, Human
gagucaccaagcc

SEQ ID NO: 1506755 - RNA, 14 nt, Human
gagucaccaagccc

SEQ ID NO: 1506756 - RNA, 11 nt, Human
gagugcaguga

SEQ ID NO: 1506757 - RNA, 12 nt, Human
gagugcagugag

SEQ ID NO: 1506758 - RNA, 21 nt, Human
gagucccaccuuggcugcagg

SEQ ID NO: 1506759 - RNA, 12 nt, Human
gagugagcuggu

SEQ ID NO: 1506760 - RNA, 13 nt, Human
gaggugggauccu

SEQ ID NO: 1506761 - RNA, 12 nt, Human
gaggugggaucc

SEQ ID NO: 1506762 - RNA, 11 nt, Human
gaggugggagg

SEQ ID NO: 1506763 - RNA, 14 nt, Human
gaggucuguucuuu

SEQ ID NO: 1506764 - RNA, 13 nt, Human
gaggucuguucuu

SEQ ID NO: 1506765 - RNA, 13 nt, Human
gauaugugaacag

SEQ ID NO: 1506766 - RNA, 14 nt, Human
gauaugugaacagu

SEQ ID NO: 1506767 - RNA, 20 nt, Human
gauauguaccuaacgaagua

SEQ ID NO: 1506768 - RNA, 11 nt, Human
gauacuacagu

SEQ ID NO: 1506769 - RNA, 16 nt, Human
gauacuacaguuuguu

SEQ ID NO: 1506770 - RNA, 13 nt, Human
gauacccauccca

SEQ ID NO: 1506771 - RNA, 14 nt, Human
gauacccaucccau

SEQ ID NO: 1506772 - RNA, 14 nt, Human
gacagugaaagaaa

SEQ ID NO: 1506773 - RNA, 17 nt, Human
gacagucaccucaugga

SEQ ID NO: 1506774 - RNA, 20 nt, Human
gacaggguuuugccauguug

SEQ ID NO: 1506775 - RNA, 22 nt, Human
gacaggguuuugccauguuggc

SEQ ID NO: 1506776 - RNA, 11 nt, Human
gacagcuccuu

SEQ ID NO: 1506777 - RNA, 16 nt, Human
gacagaauauguuuca

SEQ ID NO: 1506778 - RNA, 12 nt, Human
gacagacacagg

SEQ ID NO: 1506779 - RNA, 21 nt, Human
gacagcccgggcucugccucc

SEQ ID NO: 1506780 - RNA, 22 nt, Human
gacagcccgggcucugccuccc

SEQ ID NO: 1506781 - RNA, 23 nt, Human
gacagcccgggcucugccuccca

SEQ ID NO: 1506782 - RNA, 15 nt, Human
gacacugaugggcaa

SEQ ID NO: 1506783 - RNA, 16 nt, Human
gacacuuaaaaauggu

SEQ ID NO: 1506784 - RNA, 13 nt, Human
gacacugaugggc

SEQ ID NO: 1506785 - RNA, 11 nt, Human
gaauuaguuuu

SEQ ID NO: 1506786 - RNA, 12 nt, Human
gaauuaugaaac

SEQ ID NO: 1506787 - RNA, 19 nt, Human
gaauuuuggcugugucucc

SEQ ID NO: 1506788 - RNA, 15 nt, Human
gacaaaauggaauac

SEQ ID NO: 1506789 - RNA, 14 nt, Human
gacacacagcucug

SEQ ID NO: 1506790 - RNA, 15 nt, Human
gacacacagcucugu

SEQ ID NO: 1506791 - RNA, 17 nt, Human
gacacacagcucugucc

SEQ ID NO: 1506792 - RNA, 18 nt, Human
gacacacagcucuguccu

SEQ ID NO: 1506793 - RNA, 19 nt, Human
gacacacagcucuguccug

SEQ ID NO: 1506794 - RNA, 21 nt, Human
gaauuuugugcccccauguaa

SEQ ID NO: 1506795 - RNA, 23 nt, Human
gaauuuuggcugugucucccuuc

SEQ ID NO: 1506796 - RNA, 20 nt, Human
gaauuuugugcccccaugua

SEQ ID NO: 1506797 - RNA, 14 nt, Human
gacacacugaagaa

SEQ ID NO: 1506798 - RNA, 13 nt, Human
gacacacugaaga

SEQ ID NO: 1506799 - RNA, 12 nt, Human
gacacacaugaa

SEQ ID NO: 1506800 - RNA, 21 nt, Human
gacacacagcucuguccuggg

SEQ ID NO: 1506801 - RNA, 19 nt, Human
gaagucuuuguacagacaa

SEQ ID NO: 1506802 - RNA, 20 nt, Human
gaagucuuuguacagacaac

SEQ ID NO: 1506803 - RNA, 18 nt, Human
gaagucuuuguacagaca

SEQ ID NO: 1506804 - RNA, 19 nt, Human
gaaggcucgagcaugccug

SEQ ID NO: 1506805 - RNA, 16 nt, Human
gaaggcucgagcaugc

SEQ ID NO: 1506806 - RNA, 17 nt, Human
gaaggcucgagcaugcc

SEQ ID NO: 1506807 - RNA, 19 nt, Human
gaagcuccgcuuucuaccc

SEQ ID NO: 1506808 - RNA, 14 nt, Human
gaagcucagggccu

SEQ ID NO: 1506809 - RNA, 15 nt, Human
gaagcucagggccug

SEQ ID NO: 1506810 - RNA, 23 nt, Human
gaagcucagggccuggcucaggu

SEQ ID NO: 1506811 - RNA, 20 nt, Human
gaagcucagggccuggcuca

SEQ ID NO: 1506812 - RNA, 21 nt, Human
gaagcucagggccuggcucag

SEQ ID NO: 1506813 - RNA, 16 nt, Human
gaagcucagggccugg

SEQ ID NO: 1506814 - RNA, 17 nt, Human
gaagcucagggccuggc

SEQ ID NO: 1506815 - RNA, 18 nt, Human
gaagcucagggccuggcu

SEQ ID NO: 1506816 - RNA, 19 nt, Human
gaagcucagggccuggcuc

SEQ ID NO: 1506817 - RNA, 20 nt, Human
gaaugagagacacacugaag

SEQ ID NO: 1506818 - RNA, 22 nt, Human
gaaugagagacacacugaagaa

SEQ ID NO: 1506819 - RNA, 23 nt, Human
gaaugagagacacacugaagaag

SEQ ID NO: 1506820 - RNA, 11 nt, Human
gaaugaauguc

SEQ ID NO: 1506821 - RNA, 14 nt, Human
gaaugaaugucagu

SEQ ID NO: 1506822 - RNA, 18 nt, Human
gaaugaaugucaguguga

SEQ ID NO: 1506823 - RNA, 22 nt, Human
gaaugaaugucagugugacuga

SEQ ID NO: 1506824 - RNA, 17 nt, Human
gacucuuaagaagacug

SEQ ID NO: 1506825 - RNA, 18 nt, Human
gacucuuaagaagacugc

SEQ ID NO: 1506826 - RNA, 16 nt, Human
gacucuuaagaagacu

SEQ ID NO: 1506827 - RNA, 19 nt, Human
gacucugucucaaaaaaac

SEQ ID NO: 1506828 - RNA, 12 nt, Human
gacucugucuca

SEQ ID NO: 1506829 - RNA, 13 nt, Human
gacuaugacauaa

SEQ ID NO: 1506830 - RNA, 22 nt, Human
gacuaucuaaauguugaaagau

SEQ ID NO: 1506831 - RNA, 23 nt, Human
gacuuuucuuucagccaagaauu

SEQ ID NO: 1506832 - RNA, 21 nt, Human
gacuuuucuuuguggcuuccu

SEQ ID NO: 1506833 - RNA, 12 nt, Human
gagaaggaagcc

SEQ ID NO: 1506834 - RNA, 16 nt, Human
gagaagcggcuggcag

SEQ ID NO: 1506835 - RNA, 13 nt, Human
gagaagcggcugg

SEQ ID NO: 1506836 - RNA, 15 nt, Human
gagaagcggcuggca

SEQ ID NO: 1506837 - RNA, 21 nt, Human
gagacccugucucaaaaaaag

SEQ ID NO: 1506838 - RNA, 22 nt, Human
gagacguuuuuggaagaguagu

SEQ ID NO: 1506839 - RNA, 15 nt, Human
gagaaucacuugaac

SEQ ID NO: 1506840 - RNA, 14 nt, Human
gagaaucacuugaa

SEQ ID NO: 1506841 - RNA, 21 nt, Human
gagauugcaccacugcacucc

SEQ ID NO: 1506842 - RNA, 18 nt, Human
gagauugcaccacugcac

SEQ ID NO: 1506843 - RNA, 23 nt, Human
gagauuucaucugcucuccuucc

SEQ ID NO: 1506844 - RNA, 13 nt, Human
gagauuuacaacu

SEQ ID NO: 1506845 - RNA, 13 nt, Human
gagauuucaucug

SEQ ID NO: 1506846 - RNA, 17 nt, Human
gagauuucaucugcucu

SEQ ID NO: 1506847 - RNA, 19 nt, Human
gagauuucaucugcucucc

SEQ ID NO: 1506848 - RNA, 20 nt, Human
gagauuucaucugcucuccu

SEQ ID NO: 1506849 - RNA, 21 nt, Human
gagauuucaucugcucuccuu

SEQ ID NO: 1506850 - RNA, 22 nt, Human
gagauuucaucugcucuccuuc

SEQ ID NO: 1506851 - RNA, 21 nt, Human
gagaugaugccaugggcccuc

SEQ ID NO: 1506852 - RNA, 22 nt, Human
gagaggcauccaguaucuugaa

SEQ ID NO: 1506853 - RNA, 14 nt, Human
gagaggcauccagu

SEQ ID NO: 1506854 - RNA, 17 nt, Human
gagacuccugcaggcag

SEQ ID NO: 1506855 - RNA, 18 nt, Human
gagacuccugcaggcagc

SEQ ID NO: 1506856 - RNA, 15 nt, Human
gagacuccugcaggc

SEQ ID NO: 1506857 - RNA, 16 nt, Human
gagacuccugcaggca

SEQ ID NO: 1506858 - RNA, 18 nt, Human
gagcugggugucaagagg

SEQ ID NO: 1506859 - RNA, 22 nt, Human
gagccuugaacuuugaccucug

SEQ ID NO: 1506860 - RNA, 13 nt, Human
gagccccgaggcc

SEQ ID NO: 1506861 - RNA, 14 nt, Human
gagccuuccagggg

SEQ ID NO: 1506862 - RNA, 15 nt, Human
gagccuuccaggggu

SEQ ID NO: 1506863 - RNA, 16 nt, Human
gagccuuccaggggug

SEQ ID NO: 1506864 - RNA, 17 nt, Human
gagccuuccaggggugg

SEQ ID NO: 1506865 - RNA, 13 nt, Human
gagcgacagugag

SEQ ID NO: 1506866 - RNA, 18 nt, Human
gagcggagaaaggaaggg

SEQ ID NO: 1506867 - RNA, 21 nt, Human
gagcggagaaaggaagggcug

SEQ ID NO: 1506868 - RNA, 21 nt, Human
gagcugccuguucagcuccag

SEQ ID NO: 1506869 - RNA, 22 nt, Human
gagcugccuguucagcuccagc

SEQ ID NO: 1506870 - RNA, 13 nt, Human
gagcaucaggcca

SEQ ID NO: 1506871 - RNA, 22 nt, Human
gagcaugccuggauggggcugc

SEQ ID NO: 1506872 - RNA, 12 nt, Human
gagcaucaggcc

SEQ ID NO: 1506873 - RNA, 21 nt, Human
gagcagggcucagcggggaca

SEQ ID NO: 1506874 - RNA, 14 nt, Human
gagcagggcucagc

SEQ ID NO: 1506875 - RNA, 22 nt, Human
gccaugugcuaguaauuggaaa

SEQ ID NO: 1506876 - RNA, 14 nt, Human
gccaugugccaggu

SEQ ID NO: 1506877 - RNA, 13 nt, Human
gcccaggcagguc

SEQ ID NO: 1506878 - RNA, 14 nt, Human
gcccaggcaggucu

SEQ ID NO: 1506879 - RNA, 16 nt, Human
gcccaggcaggucuug

SEQ ID NO: 1506880 - RNA, 15 nt, Human
gcccaggccccugcc

SEQ ID NO: 1506881 - RNA, 13 nt, Human
gcccaggccccug

SEQ ID NO: 1506882 - RNA, 17 nt, Human
gcccaggccccugccac

SEQ ID NO: 1506883 - RNA, 18 nt, Human
gcccaggccccugccacc

SEQ ID NO: 1506884 - RNA, 22 nt, Human
gccccugcugguucaggguugg

SEQ ID NO: 1506885 - RNA, 15 nt, Human
gccccuggaugcagc

SEQ ID NO: 1506886 - RNA, 16 nt, Human
gccauaugaaaaggcu

SEQ ID NO: 1506887 - RNA, 22 nt, Human
gccaguuggucccccuuccaug

SEQ ID NO: 1506888 - RNA, 23 nt, Human
gccaguuggucccccuuccaugg

SEQ ID NO: 1506889 - RNA, 16 nt, Human
gccaguuggucccccu

SEQ ID NO: 1506890 - RNA, 18 nt, Human
gccaguuggucccccuuc

SEQ ID NO: 1506891 - RNA, 20 nt, Human
gccaguuggucccccuucca

SEQ ID NO: 1506892 - RNA, 21 nt, Human
gccaguuggucccccuuccau

SEQ ID NO: 1506893 - RNA, 13 nt, Human
gccaguugguccc

SEQ ID NO: 1506894 - RNA, 22 nt, Human
gccaguuauggcuauaggugcu

SEQ ID NO: 1506895 - RNA, 21 nt, Human
gccaguggccuuccccagcau

SEQ ID NO: 1506896 - RNA, 13 nt, Human
gccagugugacaa

SEQ ID NO: 1506897 - RNA, 13 nt, Human
gccaggccacaag

SEQ ID NO: 1506898 - RNA, 18 nt, Human
gccaggccacaagacccu

SEQ ID NO: 1506899 - RNA, 21 nt, Human
gccaggccacaagacccuugu

SEQ ID NO: 1506900 - RNA, 15 nt, Human
gccaggccagaggga

SEQ ID NO: 1506901 - RNA, 22 nt, Human
gccaggccagagggagugacag

SEQ ID NO: 1506902 - RNA, 23 nt, Human
gccaggccacaagacccuugugg

SEQ ID NO: 1506903 - RNA, 13 nt, Human
gccaggcccucug

SEQ ID NO: 1506904 - RNA, 14 nt, Human
gccaggcccucugc

SEQ ID NO: 1506905 - RNA, 15 nt, Human
gccaggcccucugcc

SEQ ID NO: 1506906 - RNA, 12 nt, Human
gccuccagggcu

SEQ ID NO: 1506907 - RNA, 13 nt, Human
gccuccagggcug

SEQ ID NO: 1506908 - RNA, 14 nt, Human
gccuccagggcugg

SEQ ID NO: 1506909 - RNA, 19 nt, Human
gccuccuuugugaggaagc

SEQ ID NO: 1506910 - RNA, 20 nt, Human
gccuccuuugugaggaagcc

SEQ ID NO: 1506911 - RNA, 21 nt, Human
gccuccuuugugaggaagccg

SEQ ID NO: 1506912 - RNA, 16 nt, Human
gccuccauccugaggc

SEQ ID NO: 1506913 - RNA, 20 nt, Human
gccuccauccugaggcucca

SEQ ID NO: 1506914 - RNA, 16 nt, Human
gccuccagggcuggac

SEQ ID NO: 1506915 - RNA, 17 nt, Human
gccuccagggcuggacu

SEQ ID NO: 1506916 - RNA, 18 nt, Human
gccuccagggcuggacug

SEQ ID NO: 1506917 - RNA, 19 nt, Human
gccuccagggcuggacuga

SEQ ID NO: 1506918 - RNA, 20 nt, Human
gccuccagggcuggacugag

SEQ ID NO: 1506919 - RNA, 13 nt, Human
gccugcuccagcu

SEQ ID NO: 1506920 - RNA, 17 nt, Human
gccugcuaauuccccag

SEQ ID NO: 1506921 - RNA, 23 nt, Human
gccugcuaauuccccagauugca

SEQ ID NO: 1506922 - RNA, 15 nt, Human
gcuacugucagcucc

SEQ ID NO: 1506923 - RNA, 19 nt, Human
gcuacuguccuacccaccc

SEQ ID NO: 1506924 - RNA, 20 nt, Human
gcuacuguccuacccacccu

SEQ ID NO: 1506925 - RNA, 17 nt, Human
gcuacuugggaggcuga

SEQ ID NO: 1506926 - RNA, 16 nt, Human
gcuaauuuuucauuuu

SEQ ID NO: 1506927 - RNA, 17 nt, Human
gcguuucuaugacacau

SEQ ID NO: 1506928 - RNA, 17 nt, Human
gcuacaaaaacacagca

SEQ ID NO: 1506929 - RNA, 18 nt, Human
gcuacaaaaacacagcaa

SEQ ID NO: 1506930 - RNA, 19 nt, Human
gcuacaaaaacacagcaag

SEQ ID NO: 1506931 - RNA, 19 nt, Human
gcgugcacacaccagagcc

SEQ ID NO: 1506932 - RNA, 18 nt, Human
gcgugcacacaccagagc

SEQ ID NO: 1506933 - RNA, 14 nt, Human
gcgugcacacacca

SEQ ID NO: 1506934 - RNA, 20 nt, Human
gcgugguggacaugcacagc

SEQ ID NO: 1506935 - RNA, 16 nt, Human
gcggccuuuggcuuca

SEQ ID NO: 1506936 - RNA, 13 nt, Human
gcgauucuucugc

SEQ ID NO: 1506937 - RNA, 15 nt, Human
gcgagcccugguggc

SEQ ID NO: 1506938 - RNA, 17 nt, Human
gcgauucuucugcuuca

SEQ ID NO: 1506939 - RNA, 14 nt, Human
gcgauucuucugcu

SEQ ID NO: 1506940 - RNA, 22 nt, Human
gcuuuuuucucugauacagaaa

SEQ ID NO: 1506941 - RNA, 18 nt, Human
ggaaaauuuuaaaaauac

SEQ ID NO: 1506942 - RNA, 16 nt, Human
ggaaacccagcucugg

SEQ ID NO: 1506943 - RNA, 12 nt, Human
gcuuuugugcau

SEQ ID NO: 1506944 - RNA, 15 nt, Human
gcuuuuggucugugu

SEQ ID NO: 1506945 - RNA, 18 nt, Human
gcuuuugucuaugggacu

SEQ ID NO: 1506946 - RNA, 14 nt, Human
gcuuugaucccuuc

SEQ ID NO: 1506947 - RNA, 17 nt, Human
gcuuugaucccuucuua

SEQ ID NO: 1506948 - RNA, 21 nt, Human
ggaagaacggggcucuucuca

SEQ ID NO: 1506949 - RNA, 14 nt, Human
ggaagacaauguga

SEQ ID NO: 1506950 - RNA, 16 nt, Human
ggaagacaaugugaaa

SEQ ID NO: 1506951 - RNA, 13 nt, Human
ggaacaccuccuc

SEQ ID NO: 1506952 - RNA, 23 nt, Human
ggaacaaggcaaggcugucaauu

SEQ ID NO: 1506953 - RNA, 15 nt, Human
ggaacacuccuucac

SEQ ID NO: 1506954 - RNA, 19 nt, Human
ggaacacuccuucacagau

SEQ ID NO: 1506955 - RNA, 14 nt, Human
ggaaaugggcagag

SEQ ID NO: 1506956 - RNA, 16 nt, Human
ggaaaugggcagagca

SEQ ID NO: 1506957 - RNA, 17 nt, Human
ggaaaugggcagagcag

SEQ ID NO: 1506958 - RNA, 18 nt, Human
ggaaaugggcagagcaga

SEQ ID NO: 1506959 - RNA, 22 nt, Human
ggaaaugggcagagcagagacc

SEQ ID NO: 1506960 - RNA, 15 nt, Human
ggaacaaggcaaggc

SEQ ID NO: 1506961 - RNA, 17 nt, Human
ggaacaaggcaaggcug

SEQ ID NO: 1506962 - RNA, 21 nt, Human
ggaacaaggcaaggcugucaa

SEQ ID NO: 1506963 - RNA, 12 nt, Human
ggaagacuuugg

SEQ ID NO: 1506964 - RNA, 22 nt, Human
ggaagacaaugugaaaagaaaa

SEQ ID NO: 1506965 - RNA, 17 nt, Human
ggaagacuucaucccuc

SEQ ID NO: 1506966 - RNA, 20 nt, Human
ggaagacuucaucccucugg

SEQ ID NO: 1506967 - RNA, 19 nt, Human
gcuuccuggcaauagucaa

SEQ ID NO: 1506968 - RNA, 23 nt, Human
gcuuccagugaggcucugcccuu

SEQ ID NO: 1506969 - RNA, 15 nt, Human
gcuucuucagagacu

SEQ ID NO: 1506970 - RNA, 12 nt, Human
gcuucuucagag

SEQ ID NO: 1506971 - RNA, 18 nt, Human
gcuuguaaauagcucagg

SEQ ID NO: 1506972 - RNA, 19 nt, Human
gcuuguaaauagcucaggu

SEQ ID NO: 1506973 - RNA, 23 nt, Human
gcuugaccgugaggccagagaca

SEQ ID NO: 1506974 - RNA, 18 nt, Human
gcuugaccuuuaagagaa

SEQ ID NO: 1506975 - RNA, 16 nt, Human
gcuugaccgugaggcc

SEQ ID NO: 1506976 - RNA, 22 nt, Human
gcuugaccuuuaagagaaauga

SEQ ID NO: 1506977 - RNA, 17 nt, Human
gcuuguaaauagcucag

SEQ ID NO: 1506978 - RNA, 18 nt, Human
gcuucaaggauccugagc

SEQ ID NO: 1506979 - RNA, 14 nt, Human
gcuucaaggauccu

SEQ ID NO: 1506980 - RNA, 14 nt, Human
gcuucaguggcagc

SEQ ID NO: 1506981 - RNA, 15 nt, Human
gcuucaguggcagcu

SEQ ID NO: 1506982 - RNA, 13 nt, Human
gcuguuggcuggg

SEQ ID NO: 1506983 - RNA, 14 nt, Human
gcuguuggcugggg

SEQ ID NO: 1506984 - RNA, 14 nt, Human
gcugugccacaggc

SEQ ID NO: 1506985 - RNA, 15 nt, Human
gcugugccacaggcu

SEQ ID NO: 1506986 - RNA, 20 nt, Human
gcugugccacaggcuuaggg

SEQ ID NO: 1506987 - RNA, 19 nt, Human
gcugugccacaggcuuagg

SEQ ID NO: 1506988 - RNA, 12 nt, Human
gcuguauuuuaa

SEQ ID NO: 1506989 - RNA, 13 nt, Human
gcuguauuuuaaa

SEQ ID NO: 1506990 - RNA, 13 nt, Human
gcugugccacagg

SEQ ID NO: 1506991 - RNA, 20 nt, Human
gcugguucggauuuggggug

SEQ ID NO: 1506992 - RNA, 21 nt, Human
gcugguucggauuuggggugg

SEQ ID NO: 1506993 - RNA, 23 nt, Human
gcugguucaggguuggccccugc

SEQ ID NO: 1506994 - RNA, 14 nt, Human
gcuggagcucugcc

SEQ ID NO: 1506995 - RNA, 15 nt, Human
gcuggagugugaggg

SEQ ID NO: 1506996 - RNA, 21 nt, Human
gcuggagugugaggguccugc

SEQ ID NO: 1506997 - RNA, 17 nt, Human
gcugaauacagaggcaa

SEQ ID NO: 1506998 - RNA, 22 nt, Human
gcugaauacagaggcaacugca

SEQ ID NO: 1506999 - RNA, 13 nt, Human
gcugacagacaca

SEQ ID NO: 1507000 - RNA, 14 nt, Human
gcucuguccuggga

SEQ ID NO: 1507001 - RNA, 16 nt, Human
gcugaaacaacaaaua

SEQ ID NO: 1507002 - RNA, 21 nt, Human
gcucugcccauccugccccug

SEQ ID NO: 1507003 - RNA, 23 nt, Human
gcucugaucauccacugugccau

SEQ ID NO: 1507004 - RNA, 15 nt, Human
gcucugcccauccug

SEQ ID NO: 1507005 - RNA, 21 nt, Human
gcucugaucauccacugugcc

SEQ ID NO: 1507006 - RNA, 22 nt, Human
gcucugaucauccacugugcca

SEQ ID NO: 1507007 - RNA, 20 nt, Human
gcucugaucauccacugugc

SEQ ID NO: 1507008 - RNA, 17 nt, Human
gcucucaggccagcugc

SEQ ID NO: 1507009 - RNA, 18 nt, Human
gcucucaggccagcugcu

SEQ ID NO: 1507010 - RNA, 19 nt, Human
gcucucaggccagcugcuu

SEQ ID NO: 1507011 - RNA, 20 nt, Human
gcucucaggccagcugcuug

SEQ ID NO: 1507012 - RNA, 18 nt, Human
gcucucaaguuaucaggg

SEQ ID NO: 1507013 - RNA, 19 nt, Human
gcucuacugaggugcuaug

SEQ ID NO: 1507014 - RNA, 16 nt, Human
gcuccucuccccagca

SEQ ID NO: 1507015 - RNA, 19 nt, Human
gcuccucuccccagcaagu

SEQ ID NO: 1507016 - RNA, 15 nt, Human
gcuccucuccccagc

SEQ ID NO: 1507017 - RNA, 17 nt, Human
gcuccagcucaccagcc

SEQ ID NO: 1507018 - RNA, 13 nt, Human
gcuccagcucacc

SEQ ID NO: 1507019 - RNA, 14 nt, Human
gcuccagcucacca

SEQ ID NO: 1507020 - RNA, 23 nt, Human
gcuccagacacauguccaagaag

SEQ ID NO: 1507021 - RNA, 18 nt, Human
gcuccagacacaugucca

SEQ ID NO: 1507022 - RNA, 21 nt, Human
gcuccagacacauguccaaga

SEQ ID NO: 1507023 - RNA, 20 nt, Human
gcuccacuuggucugugaga

SEQ ID NO: 1507024 - RNA, 9 nt, Human
gcuccagac

SEQ ID NO: 1507025 - RNA, 17 nt, Human
gcugccccuggcagccc

SEQ ID NO: 1507026 - RNA, 17 nt, Human
gcugccauccagguuca

SEQ ID NO: 1507027 - RNA, 13 nt, Human
gcugccccuggca

SEQ ID NO: 1507028 - RNA, 15 nt, Human
gcugccccuggcagc

SEQ ID NO: 1507029 - RNA, 16 nt, Human
gcugccccuggcagcc

SEQ ID NO: 1507030 - RNA, 12 nt, Human
gcugcugacagu

SEQ ID NO: 1507031 - RNA, 12 nt, Human
gcugccauccag

SEQ ID NO: 1507032 - RNA, 13 nt, Human
gcugccauccagg

SEQ ID NO: 1507033 - RNA, 16 nt, Human
gcugcacccucaggca

SEQ ID NO: 1507034 - RNA, 13 nt, Human
gcugcacccucag

SEQ ID NO: 1507035 - RNA, 15 nt, Human
gcugcacccucaggc

SEQ ID NO: 1507036 - RNA, 15 nt, Human
aaauaauuuuuauau

SEQ ID NO: 1507037 - RNA, 13 nt, Human
aaauaaugugaaa

SEQ ID NO: 1507038 - RNA, 18 nt, Human
aaauaauuuuuauauuug

SEQ ID NO: 1507039 - RNA, 20 nt, Human
aaauaauuuuuauauuugaa

SEQ ID NO: 1507040 - RNA, 12 nt, Human
aaauaaugugaa

SEQ ID NO: 1507041 - RNA, 12 nt, Human
aaauaaugucuc

SEQ ID NO: 1507042 - RNA, 13 nt, Human
aaauaaugucucu

SEQ ID NO: 1507043 - RNA, 17 nt, Human
guaacaaugaagauaaa

SEQ ID NO: 1507044 - RNA, 14 nt, Human
aaauaaugugaaac

SEQ ID NO: 1507045 - RNA, 12 nt, Human
guaaaaugugaa

SEQ ID NO: 1507046 - RNA, 19 nt, Human
guaaaaugugaagugaaug

SEQ ID NO: 1507047 - RNA, 20 nt, Human
guaaaaugugaagugaauga

SEQ ID NO: 1507048 - RNA, 22 nt, Human
guaaaaugugaagugaaugaaa

SEQ ID NO: 1507049 - RNA, 20 nt, Human
gguuuggacaaaauggaaua

SEQ ID NO: 1507050 - RNA, 14 nt, Human
gguuugcaaggaag

SEQ ID NO: 1507051 - RNA, 15 nt, Human
gguuugaauauaaac

SEQ ID NO: 1507052 - RNA, 18 nt, Human
gguuugaauauaaacacu

SEQ ID NO: 1507053 - RNA, 23 nt, Human
aaaguuauugauaaguucauaca

SEQ ID NO: 1507054 - RNA, 16 nt, Human
aaaguugaauuuuaca

SEQ ID NO: 1507055 - RNA, 21 nt, Human
aaaguuucucuuuucaaaaca

SEQ ID NO: 1507056 - RNA, 23 nt, Human
aaaguuucucuuuucaaaacauu

SEQ ID NO: 1507057 - RNA, 13 nt, Human
gguuucagaaaug

SEQ ID NO: 1507058 - RNA, 12 nt, Human
gguuucagaaau

SEQ ID NO: 1507059 - RNA, 13 nt, Human
gguuucugaaaau

SEQ ID NO: 1507060 - RNA, 15 nt, Human
gguuucagaaaugug

SEQ ID NO: 1507061 - RNA, 14 nt, Human
gguuucagaaaugu

SEQ ID NO: 1507062 - RNA, 12 nt, Human
gguucucaucuu

SEQ ID NO: 1507063 - RNA, 16 nt, Human
gguuuagaaagcuugc

SEQ ID NO: 1507064 - RNA, 12 nt, Human
gguguggagaag

SEQ ID NO: 1507065 - RNA, 12 nt, Human
gguguggaagag

SEQ ID NO: 1507066 - RNA, 21 nt, Human
ggugugcggccuuuggcuuca

SEQ ID NO: 1507067 - RNA, 13 nt, Human
ggugugcucugau

SEQ ID NO: 1507068 - RNA, 22 nt, Human
gguucaggguuggccccugccc

SEQ ID NO: 1507069 - RNA, 18 nt, Human
gguucaggguuggccccu

SEQ ID NO: 1507070 - RNA, 21 nt, Human
gguucaggguuggccccugcc

SEQ ID NO: 1507071 - RNA, 22 nt, Human
gguucccuuugacgccauccca

SEQ ID NO: 1507072 - RNA, 21 nt, Human
gguucccuuugacgccauccc

SEQ ID NO: 1507073 - RNA, 20 nt, Human
ggugggaggauugcuugagc

SEQ ID NO: 1507074 - RNA, 14 nt, Human
ggugggauccucca

SEQ ID NO: 1507075 - RNA, 15 nt, Human
ggugggauccuccag

SEQ ID NO: 1507076 - RNA, 19 nt, Human
ggugggauccuccaggugc

SEQ ID NO: 1507077 - RNA, 13 nt, Human
gguggggcagcuu

SEQ ID NO: 1507078 - RNA, 17 nt, Human
gguggggcagcuugagg

SEQ ID NO: 1507079 - RNA, 15 nt, Human
gguggggucacucug

SEQ ID NO: 1507080 - RNA, 23 nt, Human
gguggggucacucuggcagcuca

SEQ ID NO: 1507081 - RNA, 13 nt, Human
ggugucgggcaug

SEQ ID NO: 1507082 - RNA, 16 nt, Human
ggugucgggcaugaca

SEQ ID NO: 1507083 - RNA, 16 nt, Human
ggugugacugaauuuc

SEQ ID NO: 1507084 - RNA, 19 nt, Human
ggugucuccaaccccccag

SEQ ID NO: 1507085 - RNA, 23 nt, Human
ggugucuccaaccccccagcacu

SEQ ID NO: 1507086 - RNA, 16 nt, Human
ggugugaccacugcag

SEQ ID NO: 1507087 - RNA, 18 nt, Human
ggugugagucaccaagcc

SEQ ID NO: 1507088 - RNA, 14 nt, Human
ggucggaaaacaug

SEQ ID NO: 1507089 - RNA, 17 nt, Human
ggucuacacugugcuga

SEQ ID NO: 1507090 - RNA, 13 nt, Human
ggucggaaaacau

SEQ ID NO: 1507091 - RNA, 14 nt, Human
gguccuggugcccu

SEQ ID NO: 1507092 - RNA, 24 nt, Human
gguccuggugcccuggaugcccag

SEQ ID NO: 1507093 - RNA, 12 nt, Human
gguccuggugcc

SEQ ID NO: 1507094 - RNA, 13 nt, Human
gguccuggugccc

SEQ ID NO: 1507095 - RNA, 17 nt, Human
aaagacuauucaaacag

SEQ ID NO: 1507096 - RNA, 15 nt, Human
aaagacuauucaaac

SEQ ID NO: 1507097 - RNA, 13 nt, Human
aaagcaaaggaga

SEQ ID NO: 1507098 - RNA, 14 nt, Human
aaagauuuucagaa

SEQ ID NO: 1507099 - RNA, 13 nt, Human
aaagauuuucaga

SEQ ID NO: 1507100 - RNA, 21 nt, Human
gguccugcugcaguugccagu

SEQ ID NO: 1507101 - RNA, 23 nt, Human
gguccugcugcaguugccaguca

SEQ ID NO: 1507102 - RNA, 15 nt, Human
ggugccaguuauggc

SEQ ID NO: 1507103 - RNA, 21 nt, Human
ggucuugaacuccuggccuca

SEQ ID NO: 1507104 - RNA, 16 nt, Human
ggugcacaagcuccaa

SEQ ID NO: 1507105 - RNA, 18 nt, Human
ggugcaaugaccuuucaa

SEQ ID NO: 1507106 - RNA, 19 nt, Human
ggugcaaugaccuuucaau

SEQ ID NO: 1507107 - RNA, 20 nt, Human
ggugcaaugaccuuucaaua

SEQ ID NO: 1507108 - RNA, 16 nt, Human
aaagcaucacuuggga

SEQ ID NO: 1507109 - RNA, 17 nt, Human
aaagcagggacuugaac

SEQ ID NO: 1507110 - RNA, 14 nt, Human
gguggaugccuggu

SEQ ID NO: 1507111 - RNA, 21 nt, Human
gguggaugccugguggcagcu

SEQ ID NO: 1507112 - RNA, 22 nt, Human
aaagcagcguuucuaugacaca

SEQ ID NO: 1507113 - RNA, 18 nt, Human
aaagcagcguuucuauga

SEQ ID NO: 1507114 - RNA, 16 nt, Human
aaagcagcguuucuau

SEQ ID NO: 1507115 - RNA, 21 nt, Human
gguaugaccuucuaggaagcu

SEQ ID NO: 1507116 - RNA, 22 nt, Human
gguaugaucacggcucacugca

SEQ ID NO: 1507117 - RNA, 14 nt, Human
gguaugcaaucaaa

SEQ ID NO: 1507118 - RNA, 19 nt, Human
gguccacccaggagccccg

SEQ ID NO: 1507119 - RNA, 17 nt, Human
gguccacccaggagccc

SEQ ID NO: 1507120 - RNA, 12 nt, Human
gguccacccagg

SEQ ID NO: 1507121 - RNA, 13 nt, Human
gguccacccagga

SEQ ID NO: 1507122 - RNA, 15 nt, Human
gguccacccaggagc

SEQ ID NO: 1507123 - RNA, 16 nt, Human
gguccacccaggagcc

SEQ ID NO: 1507124 - RNA, 17 nt, Human
aaagacuaucuaaaugu

SEQ ID NO: 1507125 - RNA, 14 nt, Human
aaagacuauucaaa

SEQ ID NO: 1507126 - RNA, 12 nt, Human
aaacuuuacuau

SEQ ID NO: 1507127 - RNA, 18 nt, Human
aaacuuuacuauggcccu

SEQ ID NO: 1507128 - RNA, 22 nt, Human
aaacuuuaccuuuuuuauacau

SEQ ID NO: 1507129 - RNA, 17 nt, Human
aaacuuuaccuuuuuua

SEQ ID NO: 1507130 - RNA, 15 nt, Human
gguccauagagagca

SEQ ID NO: 1507131 - RNA, 12 nt, Human
ggguggugaccu

SEQ ID NO: 1507132 - RNA, 17 nt, Human
ggguguggcgcagcaua

SEQ ID NO: 1507133 - RNA, 19 nt, Human
ggguggcaccagcagccug

SEQ ID NO: 1507134 - RNA, 20 nt, Human
ggguggggaccucaggccug

SEQ ID NO: 1507135 - RNA, 13 nt, Human
ggguggaugccug

SEQ ID NO: 1507136 - RNA, 17 nt, Human
ggguggaugccuggugg

SEQ ID NO: 1507137 - RNA, 15 nt, Human
ggguggcaccagcag

SEQ ID NO: 1507138 - RNA, 18 nt, Human
gguaacuagggaagauaa

SEQ ID NO: 1507139 - RNA, 14 nt, Human
gguaacaggcagau

SEQ ID NO: 1507140 - RNA, 20 nt, Human
gguaacaggcagauacagga

SEQ ID NO: 1507141 - RNA, 20 nt, Human
ggguuuuauuguuuaaaauc

SEQ ID NO: 1507142 - RNA, 17 nt, Human
ggguuucuaaagcugcc

SEQ ID NO: 1507143 - RNA, 20 nt, Human
aaacaagcacuaaacaaaga

SEQ ID NO: 1507144 - RNA, 16 nt, Human
aaacacauuuuucuua

SEQ ID NO: 1507145 - RNA, 20 nt, Human
aaacaagaccacguuucuaa

SEQ ID NO: 1507146 - RNA, 12 nt, Human
ggggacagcucc

SEQ ID NO: 1507147 - RNA, 14 nt, Human
ggggacagcuccuu

SEQ ID NO: 1507148 - RNA, 20 nt, Human
ggggacagcuccuucugucc

SEQ ID NO: 1507149 - RNA, 16 nt, Human
aaacaugcuacacacu

SEQ ID NO: 1507150 - RNA, 15 nt, Human
aaaauuucuauuaaa

SEQ ID NO: 1507151 - RNA, 15 nt, Human
aaaaugugauaugua

SEQ ID NO: 1507152 - RNA, 12 nt, Human
aaaaugugaagu

SEQ ID NO: 1507153 - RNA, 22 nt, Human
gggcuggguucuacccaggugc

SEQ ID NO: 1507154 - RNA, 12 nt, Human
gggcugggcaga

SEQ ID NO: 1507155 - RNA, 20 nt, Human
gggcuggguucuacccaggu

SEQ ID NO: 1507156 - RNA, 10 nt, Human
gggcucagca

SEQ ID NO: 1507157 - RNA, 22 nt, Human
gggcugcaccggcuggccuggc

SEQ ID NO: 1507158 - RNA, 18 nt, Human
gggcucagcaaaagaugc

SEQ ID NO: 1507159 - RNA, 21 nt, Human
gggcugcaugcgggcuuccuc

SEQ ID NO: 1507160 - RNA, 18 nt, Human
gggcugcaugcgggcuuc

SEQ ID NO: 1507161 - RNA, 15 nt, Human
gggcgggaggauguu

SEQ ID NO: 1507162 - RNA, 15 nt, Human
gggccuccugugugu

SEQ ID NO: 1507163 - RNA, 13 nt, Human
gggccuccugugu

SEQ ID NO: 1507164 - RNA, 20 nt, Human
gggccucuuaugggcugggu

SEQ ID NO: 1507165 - RNA, 13 nt, Human
gggccaugccucc

SEQ ID NO: 1507166 - RNA, 23 nt, Human
gggccaugccuccucaggagccg

SEQ ID NO: 1507167 - RNA, 22 nt, Human
gggccaugccuccucaggagcc

SEQ ID NO: 1507168 - RNA, 14 nt, Human
gggccaguuggucc

SEQ ID NO: 1507169 - RNA, 18 nt, Human
gggccaguuggucccccu

SEQ ID NO: 1507170 - RNA, 22 nt, Human
gggccaguuggucccccuucca

SEQ ID NO: 1507171 - RNA, 23 nt, Human
gggccaguuggucccccuuccau

SEQ ID NO: 1507172 - RNA, 12 nt, Human
gggccaggagcc

SEQ ID NO: 1507173 - RNA, 11 nt, Human
gggccaggagc

SEQ ID NO: 1507174 - RNA, 19 nt, Human
aaaaguauguuagugcaaa

SEQ ID NO: 1507175 - RNA, 16 nt, Human
aaaaucuguggugguc

SEQ ID NO: 1507176 - RNA, 14 nt, Human
aaaaugagccuggc

SEQ ID NO: 1507177 - RNA, 21 nt, Human
aaaaugagccuggcaagaaug

SEQ ID NO: 1507178 - RNA, 14 nt, Human
gggagggcuccaga

SEQ ID NO: 1507179 - RNA, 15 nt, Human
gggagggcuccagac

SEQ ID NO: 1507180 - RNA, 17 nt, Human
gggagggcuccagacac

SEQ ID NO: 1507181 - RNA, 18 nt, Human
gggagggcuccagacaca

SEQ ID NO: 1507182 - RNA, 17 nt, Human
gggaggucgaggcagga

SEQ ID NO: 1507183 - RNA, 18 nt, Human
gggaggucgaggcaggag

SEQ ID NO: 1507184 - RNA, 19 nt, Human
gggaggucgaggcaggagg

SEQ ID NO: 1507185 - RNA, 19 nt, Human
aaaagguaugcaaucaaau

SEQ ID NO: 1507186 - RNA, 15 nt, Human
gggcaggccagagcu

SEQ ID NO: 1507187 - RNA, 16 nt, Human
gggauuguaaaauggu

SEQ ID NO: 1507188 - RNA, 17 nt, Human
gggauuguaaaauggug

SEQ ID NO: 1507189 - RNA, 15 nt, Human
gggauuacaggugug

SEQ ID NO: 1507190 - RNA, 23 nt, Human
gggcagagcagagaccaucccug

SEQ ID NO: 1507191 - RNA, 17 nt, Human
gggcagagcagagacca

SEQ ID NO: 1507192 - RNA, 22 nt, Human
gggcagagcagagaccaucccu

SEQ ID NO: 1507193 - RNA, 16 nt, Human
gggcaacccccagccu

SEQ ID NO: 1507194 - RNA, 18 nt, Human
gggcaacccccagccugc

SEQ ID NO: 1507195 - RNA, 20 nt, Human
gggcaacccccagccugcua

SEQ ID NO: 1507196 - RNA, 16 nt, Human
gggcagagcagagacc

SEQ ID NO: 1507197 - RNA, 13 nt, Human
aaaaauauauuua

SEQ ID NO: 1507198 - RNA, 15 nt, Human
aaaaauauauuuaau

SEQ ID NO: 1507199 - RNA, 19 nt, Human
aaaaauauauuuaaugaua

SEQ ID NO: 1507200 - RNA, 20 nt, Human
gggacauuugcucauggaau

SEQ ID NO: 1507201 - RNA, 21 nt, Human
gggacauuugcucauggaauu

SEQ ID NO: 1507202 - RNA, 21 nt, Human
gggacagcuccuucuguccua

SEQ ID NO: 1507203 - RNA, 15 nt, Human
gggacaggaccccag

SEQ ID NO: 1507204 - RNA, 17 nt, Human
gggacaggaccccagcu

SEQ ID NO: 1507205 - RNA, 19 nt, Human
gggacaggaccccagcucu

SEQ ID NO: 1507206 - RNA, 21 nt, Human
gggacaggaccccagcucugc

SEQ ID NO: 1507207 - RNA, 22 nt, Human
gggacaggaccccagcucugcg

SEQ ID NO: 1507208 - RNA, 16 nt, Human
gggaaggauacaaaag

SEQ ID NO: 1507209 - RNA, 13 nt, Human
gggaaggauacaa

SEQ ID NO: 1507210 - RNA, 13 nt, Human
gggacagaggggg

SEQ ID NO: 1507211 - RNA, 22 nt, Human
gggacagaggggguggccuccc

SEQ ID NO: 1507212 - RNA, 23 nt, Human
gggacagaggggguggccuccca

SEQ ID NO: 1507213 - RNA, 14 nt, Human
aaaaccacagcagu

SEQ ID NO: 1507214 - RNA, 13 nt, Human
aaaaccacagcag

SEQ ID NO: 1507215 - RNA, 22 nt, Human
aaaacugcugacuguuuucucu

SEQ ID NO: 1507216 - RNA, 13 nt, Human
aaaacucauuuuu

SEQ ID NO: 1507217 - RNA, 23 nt, Human
aaaacugcugacuguuuucucuu

SEQ ID NO: 1507218 - RNA, 13 nt, Human
aaaagaugcuucu

SEQ ID NO: 1507219 - RNA, 12 nt, Human
aaaaccacagca

SEQ ID NO: 1507220 - RNA, 15 nt, Human
aaaacaugcuacaca

SEQ ID NO: 1507221 - RNA, 22 nt, Human
aaaaauggaacauaaaauacaa

SEQ ID NO: 1507222 - RNA, 17 nt, Human
aaaaaucucaaauuucu

SEQ ID NO: 1507223 - RNA, 14 nt, Human
aaaaaucucaaauu

SEQ ID NO: 1507224 - RNA, 14 nt, Human
ggaguggccacaga

SEQ ID NO: 1507225 - RNA, 15 nt, Human
ggaguucugguuccu

SEQ ID NO: 1507226 - RNA, 16 nt, Human
ggauggggcugcaccg

SEQ ID NO: 1507227 - RNA, 18 nt, Human
ggauggauuuccagccaa

SEQ ID NO: 1507228 - RNA, 12 nt, Human
ggauggcaagau

SEQ ID NO: 1507229 - RNA, 15 nt, Human
ggauccuccaggugc

SEQ ID NO: 1507230 - RNA, 14 nt, Human
ggauccuccaggug

SEQ ID NO: 1507231 - RNA, 13 nt, Human
ggauccugagcca

SEQ ID NO: 1507232 - RNA, 14 nt, Human
ggauccugagccag

SEQ ID NO: 1507233 - RNA, 22 nt, Human
ggaucuucaucugacuaugaca

SEQ ID NO: 1507234 - RNA, 24 nt, Human
ggcacagaaaauggaagacagcuc

SEQ ID NO: 1507235 - RNA, 15 nt, Human
ggauguucugggaca

SEQ ID NO: 1507236 - RNA, 22 nt, Human
ggauguugaaaaaguucugcag

SEQ ID NO: 1507237 - RNA, 16 nt, Human
ggauguucugggacac

SEQ ID NO: 1507238 - RNA, 14 nt, Human
ggaggucgaggcag

SEQ ID NO: 1507239 - RNA, 14 nt, Human
ggaggugaccccag

SEQ ID NO: 1507240 - RNA, 20 nt, Human
ggaggucaaggcugcaguga

SEQ ID NO: 1507241 - RNA, 16 nt, Human
ggaggggggagguggg

SEQ ID NO: 1507242 - RNA, 12 nt, Human
ggaggccagccu

SEQ ID NO: 1507243 - RNA, 11 nt, Human
ggaggccagcc

SEQ ID NO: 1507244 - RNA, 20 nt, Human
ggaggaaggaaacccagcuc

SEQ ID NO: 1507245 - RNA, 23 nt, Human
ggaggaaggaaacccagcucugg

SEQ ID NO: 1507246 - RNA, 19 nt, Human
ggaggaaggaaacccagcu

SEQ ID NO: 1507247 - RNA, 16 nt, Human
ggagccccgaggccuu

SEQ ID NO: 1507248 - RNA, 22 nt, Human
ggagccccgaggccuucucuga

SEQ ID NO: 1507249 - RNA, 12 nt, Human
ggagcugccugu

SEQ ID NO: 1507250 - RNA, 22 nt, Human
ggagcugccuguucagcuccag

SEQ ID NO: 1507251 - RNA, 21 nt, Human
ggagcugccuguucagcucca

SEQ ID NO: 1507252 - RNA, 24 nt, Human
ggcacugcuuccagugaggcucug

SEQ ID NO: 1507253 - RNA, 15 nt, Human
ggcaccagcagccug

SEQ ID NO: 1507254 - RNA, 16 nt, Human
ggcaccagcagccugg

SEQ ID NO: 1507255 - RNA, 17 nt, Human
ggcagugggagcugccu

SEQ ID NO: 1507256 - RNA, 18 nt, Human
ggcagugggagcugccug

SEQ ID NO: 1507257 - RNA, 19 nt, Human
ggcagugggagcugccugu

SEQ ID NO: 1507258 - RNA, 18 nt, Human
ggcauccaguaucuugaa

SEQ ID NO: 1507259 - RNA, 15 nt, Human
ggcauauuuuucaca

SEQ ID NO: 1507260 - RNA, 17 nt, Human
ggcauauuuuucacaua

SEQ ID NO: 1507261 - RNA, 16 nt, Human
ggccaggcuggucuca

SEQ ID NO: 1507262 - RNA, 18 nt, Human
ggccaggcuggucucaaa

SEQ ID NO: 1507263 - RNA, 14 nt, Human
ggccaggcuggucu

SEQ ID NO: 1507264 - RNA, 21 nt, Human
ggccaaacucaccugccccuc

SEQ ID NO: 1507265 - RNA, 17 nt, Human
ggccaaacucaccugcc

SEQ ID NO: 1507266 - RNA, 22 nt, Human
ggccagagcuacccgcagaguu

SEQ ID NO: 1507267 - RNA, 16 nt, Human
ggccagugugacaagg

SEQ ID NO: 1507268 - RNA, 19 nt, Human
ggccaguggccuuccccag

SEQ ID NO: 1507269 - RNA, 22 nt, Human
ggccaguggccuuccccagcau

SEQ ID NO: 1507270 - RNA, 17 nt, Human
ggccaugccuccucagg

SEQ ID NO: 1507271 - RNA, 18 nt, Human
ggccaugccuccucagga

SEQ ID NO: 1507272 - RNA, 21 nt, Human
ggccaugccuccucaggagcc

SEQ ID NO: 1507273 - RNA, 16 nt, Human
ggcccuucucuccagc

SEQ ID NO: 1507274 - RNA, 17 nt, Human
ggcccuucucuccagcc

SEQ ID NO: 1507275 - RNA, 19 nt, Human
ggcccuucucuccagcccc

SEQ ID NO: 1507276 - RNA, 18 nt, Human
ggcccuucucuccagccc

SEQ ID NO: 1507277 - RNA, 23 nt, Human
ggcucagcaaaagaugcuucuca

SEQ ID NO: 1507278 - RNA, 23 nt, Human
ggcucagcggggacagcuccuuc

SEQ ID NO: 1507279 - RNA, 21 nt, Human
ggcucagcggggacagcuccu

SEQ ID NO: 1507280 - RNA, 22 nt, Human
ggcucagcggggacagcuccuu

SEQ ID NO: 1507281 - RNA, 17 nt, Human
ggcucacugcagccuca

SEQ ID NO: 1507282 - RNA, 16 nt, Human
ggcucacugcagccuc

SEQ ID NO: 1507283 - RNA, 19 nt, Human
ggcgugcaguggugcgauc

SEQ ID NO: 1507284 - RNA, 15 nt, Human
ggccugagcugggau

SEQ ID NO: 1507285 - RNA, 13 nt, Human
ggccuccauccug

SEQ ID NO: 1507286 - RNA, 14 nt, Human
ggccuuuggcuuca

SEQ ID NO: 1507287 - RNA, 15 nt, Human
ggccuucucugaagg

SEQ ID NO: 1507288 - RNA, 16 nt, Human
ggccuucucugaagga

SEQ ID NO: 1507289 - RNA, 13 nt, Human
ggccuuuggcuuc

SEQ ID NO: 1507290 - RNA, 21 nt, Human
ggccuggccagaugcaccagc

SEQ ID NO: 1507291 - RNA, 21 nt, Human
ggccugugucuaguuguuuga

SEQ ID NO: 1507292 - RNA, 23 nt, Human
ggccuucggccuccauccugagg

SEQ ID NO: 1507293 - RNA, 12 nt, Human
ggccuucucuga

SEQ ID NO: 1507294 - RNA, 19 nt, Human
auuacaguggggaaugaag

SEQ ID NO: 1507295 - RNA, 17 nt, Human
auuacaggaaguacugg

SEQ ID NO: 1507296 - RNA, 22 nt, Human
auuacaagcgugagccacugca

SEQ ID NO: 1507297 - RNA, 18 nt, Human
auguuugccucugccucu

SEQ ID NO: 1507298 - RNA, 16 nt, Human
auucaaauguauuaca

SEQ ID NO: 1507299 - RNA, 18 nt, Human
auucaaauguauuacagu

SEQ ID NO: 1507300 - RNA, 18 nt, Human
auucaaugccccugaauu

SEQ ID NO: 1507301 - RNA, 20 nt, Human
auucaaugccccugaauuua

SEQ ID NO: 1507302 - RNA, 19 nt, Human
auucacaagacccaaaagg

SEQ ID NO: 1507303 - RNA, 18 nt, Human
auuaugaauuacauuugu

SEQ ID NO: 1507304 - RNA, 21 nt, Human
auuaugaugugggucaaggaa

SEQ ID NO: 1507305 - RNA, 23 nt, Human
auuaugcaugaaguaauaugcac

SEQ ID NO: 1507306 - RNA, 14 nt, Human
auuaugaauuacau

SEQ ID NO: 1507307 - RNA, 17 nt, Human
auuaugaauuacauuug

SEQ ID NO: 1507308 - RNA, 18 nt, Human
auuaugaaacuuuuggaa

SEQ ID NO: 1507309 - RNA, 21 nt, Human
auuaggugugacugaauuucu

SEQ ID NO: 1507310 - RNA, 18 nt, Human
auuaggugugacugaauu

SEQ ID NO: 1507311 - RNA, 16 nt, Human
auuaggugugacugaa

SEQ ID NO: 1507312 - RNA, 16 nt, Human
auuagggagagaagau

SEQ ID NO: 1507313 - RNA, 19 nt, Human
auucauaaugacuuaagca

SEQ ID NO: 1507314 - RNA, 19 nt, Human
auucauagcagcuuauuca

SEQ ID NO: 1507315 - RNA, 22 nt, Human
auucauagcagcuuauucacaa

SEQ ID NO: 1507316 - RNA, 14 nt, Human
auucauaaugacuu

SEQ ID NO: 1507317 - RNA, 15 nt, Human
auucauaaugacuua

SEQ ID NO: 1507318 - RNA, 11 nt, Human
auucuuuccug

SEQ ID NO: 1507319 - RNA, 14 nt, Human
auucuucugcuuca

SEQ ID NO: 1507320 - RNA, 15 nt, Human
auucuugaaggaaaa

SEQ ID NO: 1507321 - RNA, 18 nt, Human
auucuugaaggaaaauga

SEQ ID NO: 1507322 - RNA, 11 nt, Human
auucuucugcu

SEQ ID NO: 1507323 - RNA, 12 nt, Human
auucuucugcuu

SEQ ID NO: 1507324 - RNA, 13 nt, Human
auucuuuccugag

SEQ ID NO: 1507325 - RNA, 20 nt, Human
auugcuacuguccuacccac

SEQ ID NO: 1507326 - RNA, 22 nt, Human
auugcuacuguccuacccaccc

SEQ ID NO: 1507327 - RNA, 17 nt, Human
auugauaugcuuauaca

SEQ ID NO: 1507328 - RNA, 15 nt, Human
auugcuacuguccua

SEQ ID NO: 1507329 - RNA, 21 nt, Human
auugauaagaaccuuuugagu

SEQ ID NO: 1507330 - RNA, 22 nt, Human
auugauaaguucauacauugua

SEQ ID NO: 1507331 - RNA, 15 nt, Human
auugcugauggugca

SEQ ID NO: 1507332 - RNA, 16 nt, Human
auugcugauggugcaa

SEQ ID NO: 1507333 - RNA, 18 nt, Human
auugcugauggugcaaug

SEQ ID NO: 1507334 - RNA, 19 nt, Human
auugcugauggugcaauga

SEQ ID NO: 1507335 - RNA, 23 nt, Human
auugcugauggugcaaugaccuu

SEQ ID NO: 1507336 - RNA, 12 nt, Human
auugcugcuuga

SEQ ID NO: 1507337 - RNA, 14 nt, Human
auugcuugagcuca

SEQ ID NO: 1507338 - RNA, 16 nt, Human
auuguuagucucuuga

SEQ ID NO: 1507339 - RNA, 21 nt, Human
auugugucucuugguccugcu

SEQ ID NO: 1507340 - RNA, 23 nt, Human
auugugucucuugguccugcugc

SEQ ID NO: 1507341 - RNA, 14 nt, Human
auuguaaauaguau

SEQ ID NO: 1507342 - RNA, 14 nt, Human
auuguaaaauggug

SEQ ID NO: 1507343 - RNA, 18 nt, Human
auugcuugagcucaggag

SEQ ID NO: 1507344 - RNA, 19 nt, Human
auuuuauagcuacuaauuu

SEQ ID NO: 1507345 - RNA, 23 nt, Human
auuuguuugaacugauaaagaug

SEQ ID NO: 1507346 - RNA, 22 nt, Human
auuuguuugaacugauaaagau

SEQ ID NO: 1507347 - RNA, 14 nt, Human
auuugcucauggaa

SEQ ID NO: 1507348 - RNA, 17 nt, Human
auuugcucauggaauug

SEQ ID NO: 1507349 - RNA, 13 nt, Human
auuugcuccuuuc

SEQ ID NO: 1507350 - RNA, 20 nt, Human
auuugugauacaaugcugug

SEQ ID NO: 1507351 - RNA, 17 nt, Human
auuugugauacaaugcu

SEQ ID NO: 1507352 - RNA, 20 nt, Human
auuuuaugccuuuuauuucu

SEQ ID NO: 1507353 - RNA, 21 nt, Human
auuuuaugccuuuuauuucuu

SEQ ID NO: 1507354 - RNA, 15 nt, Human
caaacagucucagga

SEQ ID NO: 1507355 - RNA, 21 nt, Human
caaaccaucauugaaaucuuu

SEQ ID NO: 1507356 - RNA, 19 nt, Human
caaaccaucauugaaaucu

SEQ ID NO: 1507357 - RNA, 18 nt, Human
caaaagaugcuucucacu

SEQ ID NO: 1507358 - RNA, 15 nt, Human
caaaaggcagaagca

SEQ ID NO: 1507359 - RNA, 20 nt, Human
caaaaaaaaaaaaaaauuag

SEQ ID NO: 1507360 - RNA, 16 nt, Human
caaaagaugcuucuca

SEQ ID NO: 1507361 - RNA, 20 nt, Human
caaagauauuuugcuuugug

SEQ ID NO: 1507362 - RNA, 20 nt, Human
caacaccucugcacaagcug

SEQ ID NO: 1507363 - RNA, 23 nt, Human
caacacgagcaggcuacugucag

SEQ ID NO: 1507364 - RNA, 15 nt, Human
caaauccuugaagau

SEQ ID NO: 1507365 - RNA, 20 nt, Human
caaauggaaaugggcagagc

SEQ ID NO: 1507366 - RNA, 21 nt, Human
caaauggaaaugggcagagca

SEQ ID NO: 1507367 - RNA, 22 nt, Human
caaauggaaaugggcagagcag

SEQ ID NO: 1507368 - RNA, 22 nt, Human
caacacucacauuuauucugcu

SEQ ID NO: 1507369 - RNA, 14 nt, Human
caaaguagaagucu

SEQ ID NO: 1507370 - RNA, 21 nt, Human
caaaguagaagucuuagaugu

SEQ ID NO: 1507371 - RNA, 13 nt, Human
caaagugcuggga

SEQ ID NO: 1507372 - RNA, 22 nt, Human
caaaguacacuguuucaaacuu

SEQ ID NO: 1507373 - RNA, 15 nt, Human
caaagcagugcaugc

SEQ ID NO: 1507374 - RNA, 17 nt, Human
caaagcagugcaugcug

SEQ ID NO: 1507375 - RNA, 23 nt, Human
caaagauauuuugcuuugugauu

SEQ ID NO: 1507376 - RNA, 22 nt, Human
caaagauauuuugcuuugugau

SEQ ID NO: 1507377 - RNA, 20 nt, Human
caaagcacugacuucuaagu

SEQ ID NO: 1507378 - RNA, 22 nt, Human
caaagcacugacuucuaaguaa

SEQ ID NO: 1507379 - RNA, 16 nt, Human
cacugcauguuuguga

SEQ ID NO: 1507380 - RNA, 13 nt, Human
cacugcagccuca

SEQ ID NO: 1507381 - RNA, 20 nt, Human
cacugcacuccagccugggu

SEQ ID NO: 1507382 - RNA, 21 nt, Human
cacugcagaagacaguauggc

SEQ ID NO: 1507383 - RNA, 12 nt, Human
cacugcagccuc

SEQ ID NO: 1507384 - RNA, 15 nt, Human
cacugcacuccagcc

SEQ ID NO: 1507385 - RNA, 16 nt, Human
cacugcacuccagccu

SEQ ID NO: 1507386 - RNA, 18 nt, Human
cacugcacuccagccugg

SEQ ID NO: 1507387 - RNA, 19 nt, Human
cacugcacuccagccuggg

SEQ ID NO: 1507388 - RNA, 22 nt, Human
cacuuguguuuugcaagccaga

SEQ ID NO: 1507389 - RNA, 16 nt, Human
cacuugucaauaaaau

SEQ ID NO: 1507390 - RNA, 19 nt, Human
cacuuguguuuugcaagcc

SEQ ID NO: 1507391 - RNA, 22 nt, Human
cacugguucuucuuggucucag

SEQ ID NO: 1507392 - RNA, 16 nt, Human
cacuuacacuuuaugc

SEQ ID NO: 1507393 - RNA, 18 nt, Human
cacuuacacuuuaugcac

SEQ ID NO: 1507394 - RNA, 12 nt, Human
cacuccccugcu

SEQ ID NO: 1507395 - RNA, 13 nt, Human
cacuccccugcug

SEQ ID NO: 1507396 - RNA, 14 nt, Human
cacuccccugcugg

SEQ ID NO: 1507397 - RNA, 15 nt, Human
cacuccccugcuggg

SEQ ID NO: 1507398 - RNA, 11 nt, Human
cacugacagau

SEQ ID NO: 1507399 - RNA, 14 nt, Human
cacuaguauuucua

SEQ ID NO: 1507400 - RNA, 16 nt, Human
cacuccagugagacag

SEQ ID NO: 1507401 - RNA, 16 nt, Human
cacuccagccugggug

SEQ ID NO: 1507402 - RNA, 20 nt, Human
cacuagggcagggacaggau

SEQ ID NO: 1507403 - RNA, 21 nt, Human
cacuagggcagggacaggaua

SEQ ID NO: 1507404 - RNA, 14 nt, Human
caccugccccucaa

SEQ ID NO: 1507405 - RNA, 15 nt, Human
caccugccccucaac

SEQ ID NO: 1507406 - RNA, 16 nt, Human
caccugccccucaacu

SEQ ID NO: 1507407 - RNA, 17 nt, Human
cacccuggggagaaagu

SEQ ID NO: 1507408 - RNA, 14 nt, Human
caccucagccuccc

SEQ ID NO: 1507409 - RNA, 13 nt, Human
caccucagccucc

SEQ ID NO: 1507410 - RNA, 17 nt, Human
cacccugaaagcccuga

SEQ ID NO: 1507411 - RNA, 15 nt, Human
cacccuggggagaaa

SEQ ID NO: 1507412 - RNA, 16 nt, Human
cacccuggggagaaag

SEQ ID NO: 1507413 - RNA, 14 nt, Human
cacccucaggcagg

SEQ ID NO: 1507414 - RNA, 17 nt, Human
caccugccuguugggcc

SEQ ID NO: 1507415 - RNA, 19 nt, Human
caccugccuguugggccag

SEQ ID NO: 1507416 - RNA, 24 nt, Human
caccugccuguugggccaggagcc

SEQ ID NO: 1507417 - RNA, 14 nt, Human
caccuuggcugcag

SEQ ID NO: 1507418 - RNA, 15 nt, Human
caccuuggcucaagu

SEQ ID NO: 1507419 - RNA, 13 nt, Human
caccuuggcugca

SEQ ID NO: 1507420 - RNA, 12 nt, Human
caccccagcccc

SEQ ID NO: 1507421 - RNA, 11 nt, Human
caccccagccc

SEQ ID NO: 1507422 - RNA, 17 nt, Human
cacacaugaaguccaag

SEQ ID NO: 1507423 - RNA, 22 nt, Human
cacacaugaaguccaagcauuu

SEQ ID NO: 1507424 - RNA, 20 nt, Human
cacacaugagcaucaggcca

SEQ ID NO: 1507425 - RNA, 15 nt, Human
cacacauacacacac

SEQ ID NO: 1507426 - RNA, 21 nt, Human
cacacagugagucgaggacag

SEQ ID NO: 1507427 - RNA, 23 nt, Human
cacacagugagucgaggacaggg

SEQ ID NO: 1507428 - RNA, 18 nt, Human
cacacagugagucgagga

SEQ ID NO: 1507429 - RNA, 20 nt, Human
cacacaguauuacuucugcu

SEQ ID NO: 1507430 - RNA, 23 nt, Human
cacacaguauuacuucugcuaca

SEQ ID NO: 1507431 - RNA, 21 nt, Human
cacagacauacuaaccagcag

SEQ ID NO: 1507432 - RNA, 19 nt, Human
cacagacauacuaaccagc

SEQ ID NO: 1507433 - RNA, 11 nt, Human
cacagccucug

SEQ ID NO: 1507434 - RNA, 13 nt, Human
cacagacccugcc

SEQ ID NO: 1507435 - RNA, 23 nt, Human
cacagaaaauggaagacagcucu

SEQ ID NO: 1507436 - RNA, 19 nt, Human
cacagaaaauucuucucca

SEQ ID NO: 1507437 - RNA, 21 nt, Human
cacacaugagcaucaggccag

SEQ ID NO: 1507438 - RNA, 22 nt, Human
cacacaugagcaucaggccagg

SEQ ID NO: 1507439 - RNA, 18 nt, Human
cacagaaaauggaagaca

SEQ ID NO: 1507440 - RNA, 19 nt, Human
cacagaaaauggaagacag

SEQ ID NO: 1507441 - RNA, 20 nt, Human
cacagaaaauggaagacagc

SEQ ID NO: 1507442 - RNA, 22 nt, Human
cacagaaaauggaagacagcuc

SEQ ID NO: 1507443 - RNA, 20 nt, Human
cacaguauuacuucugcuac

SEQ ID NO: 1507444 - RNA, 21 nt, Human
cacaguauuacuucugcuaca

SEQ ID NO: 1507445 - RNA, 17 nt, Human
cacagccucuuagaugc

SEQ ID NO: 1507446 - RNA, 21 nt, Human
cacagccucuuagaugcaguu

SEQ ID NO: 1507447 - RNA, 22 nt, Human
cacaggccugagauuucaucug

SEQ ID NO: 1507448 - RNA, 23 nt, Human
cacaggccugagauuucaucugc

SEQ ID NO: 1507449 - RNA, 19 nt, Human
cacaggggaaaagaggagu

SEQ ID NO: 1507450 - RNA, 17 nt, Human
cacaggggaaaagagga

SEQ ID NO: 1507451 - RNA, 18 nt, Human
cacaggggaaaagaggag

SEQ ID NO: 1507452 - RNA, 13 nt, Human
cacaggccugaga

SEQ ID NO: 1507453 - RNA, 14 nt, Human
cacaggccugagau

SEQ ID NO: 1507454 - RNA, 15 nt, Human
cacaggccugagauu

SEQ ID NO: 1507455 - RNA, 19 nt, Human
cacaggccugagauuucau

SEQ ID NO: 1507456 - RNA, 20 nt, Human
cacaggccugagauuucauc

SEQ ID NO: 1507457 - RNA, 15 nt, Human
caaugcuguauuuua

SEQ ID NO: 1507458 - RNA, 16 nt, Human
caaugcuguauuuuaa

SEQ ID NO: 1507459 - RNA, 17 nt, Human
caaugcuguauuuuaaa

SEQ ID NO: 1507460 - RNA, 13 nt, Human
caauuuaaagcaa

SEQ ID NO: 1507461 - RNA, 15 nt, Human
caauucuugccaaau

SEQ ID NO: 1507462 - RNA, 11 nt, Human
caauggcagcc

SEQ ID NO: 1507463 - RNA, 12 nt, Human
caauggcagccu

SEQ ID NO: 1507464 - RNA, 18 nt, Human
cacaagacugcacaucaa

SEQ ID NO: 1507465 - RNA, 13 nt, Human
caauuuauuaugg

SEQ ID NO: 1507466 - RNA, 14 nt, Human
cacaagagcccagg

SEQ ID NO: 1507467 - RNA, 16 nt, Human
cacaagagcccaggcc

SEQ ID NO: 1507468 - RNA, 13 nt, Human
cacaagcuccaag

SEQ ID NO: 1507469 - RNA, 14 nt, Human
cacaagcuccaagc

SEQ ID NO: 1507470 - RNA, 15 nt, Human
cacaagcuccaagcu

SEQ ID NO: 1507471 - RNA, 17 nt, Human
cacaagagcccaggccu

SEQ ID NO: 1507472 - RNA, 17 nt, Human
cacaagcuccaagcucc

SEQ ID NO: 1507473 - RNA, 23 nt, Human
cacaagcuccaagcucccaggca

SEQ ID NO: 1507474 - RNA, 17 nt, Human
cacaagcugcacccuca

SEQ ID NO: 1507475 - RNA, 23 nt, Human
cacaagcugcacccucaggcagg

SEQ ID NO: 1507476 - RNA, 17 nt, Human
cacacagcucuguccug

SEQ ID NO: 1507477 - RNA, 20 nt, Human
cacacagcucuguccuggga

SEQ ID NO: 1507478 - RNA, 19 nt, Human
caauaaagcagcguuucua

SEQ ID NO: 1507479 - RNA, 13 nt, Human
caagcucugcucc

SEQ ID NO: 1507480 - RNA, 17 nt, Human
caagcuccaagcuccca

SEQ ID NO: 1507481 - RNA, 12 nt, Human
caagcuccaagc

SEQ ID NO: 1507482 - RNA, 20 nt, Human
caagcugcacccucaggcag

SEQ ID NO: 1507483 - RNA, 14 nt, Human
caagcucugcuccu

SEQ ID NO: 1507484 - RNA, 15 nt, Human
caagcucugcuccuc

SEQ ID NO: 1507485 - RNA, 14 nt, Human
caagcugcacccuc

SEQ ID NO: 1507486 - RNA, 18 nt, Human
caagcugcacccucaggc

SEQ ID NO: 1507487 - RNA, 13 nt, Human
caagucaagugaa

SEQ ID NO: 1507488 - RNA, 17 nt, Human
caagucaagugaaaaag

SEQ ID NO: 1507489 - RNA, 14 nt, Human
caaguccaagcaua

SEQ ID NO: 1507490 - RNA, 17 nt, Human
caaggccaaaggaagca

SEQ ID NO: 1507491 - RNA, 18 nt, Human
caaggccaaaggaagcac

SEQ ID NO: 1507492 - RNA, 15 nt, Human
caaggccaaaggaag

SEQ ID NO: 1507493 - RNA, 16 nt, Human
caaggccaaaggaagc

SEQ ID NO: 1507494 - RNA, 15 nt, Human
caggguuggccccug

SEQ ID NO: 1507495 - RNA, 16 nt, Human
caggguuggccccugc

SEQ ID NO: 1507496 - RNA, 21 nt, Human
cagggucucuaccauccccug

SEQ ID NO: 1507497 - RNA, 23 nt, Human
cagggucucacucugucgcccag

SEQ ID NO: 1507498 - RNA, 23 nt, Human
cagguuuuuggucugacccacug

SEQ ID NO: 1507499 - RNA, 13 nt, Human
caggugcugccau

SEQ ID NO: 1507500 - RNA, 14 nt, Human
caggugcugccauc

SEQ ID NO: 1507501 - RNA, 17 nt, Human
caggguuggccccugcc

SEQ ID NO: 1507502 - RNA, 21 nt, Human
caggguuggccccugcccggc

SEQ ID NO: 1507503 - RNA, 18 nt, Human
caguaaaugggggugcau

SEQ ID NO: 1507504 - RNA, 20 nt, Human
caguaaaugggggugcauuu

SEQ ID NO: 1507505 - RNA, 19 nt, Human
caguaaaugggggugcauu

SEQ ID NO: 1507506 - RNA, 16 nt, Human
cagucaccccggccac

SEQ ID NO: 1507507 - RNA, 17 nt, Human
cagucaccccggccacc

SEQ ID NO: 1507508 - RNA, 22 nt, Human
cagggaggacgcucucuggccu

SEQ ID NO: 1507509 - RNA, 15 nt, Human
caggcugggcuucag

SEQ ID NO: 1507510 - RNA, 14 nt, Human
caggcugggcuuca

SEQ ID NO: 1507511 - RNA, 16 nt, Human
cagggagggcuucugc

SEQ ID NO: 1507512 - RNA, 20 nt, Human
cagggcucagcggggacagc

SEQ ID NO: 1507513 - RNA, 20 nt, Human
cagggcuggacugaggccug

SEQ ID NO: 1507514 - RNA, 21 nt, Human
cagggcuggacugaggccuga

SEQ ID NO: 1507515 - RNA, 12 nt, Human
cagggcucagcg

SEQ ID NO: 1507516 - RNA, 15 nt, Human
cagggcucagcgggg

SEQ ID NO: 1507517 - RNA, 20 nt, Human
caggccugggggcugggcag

SEQ ID NO: 1507518 - RNA, 22 nt, Human
caggccugggggcugggcagag

SEQ ID NO: 1507519 - RNA, 23 nt, Human
caggccugggggcugggcagagg

SEQ ID NO: 1507520 - RNA, 17 nt, Human
caggcuggcgugcagug

SEQ ID NO: 1507521 - RNA, 18 nt, Human
caggcuggcgugcagugg

SEQ ID NO: 1507522 - RNA, 19 nt, Human
caggcuggcgugcaguggu

SEQ ID NO: 1507523 - RNA, 16 nt, Human
caggcugggagagccu

SEQ ID NO: 1507524 - RNA, 18 nt, Human
caggcugggagagccuuc

SEQ ID NO: 1507525 - RNA, 19 nt, Human
caggcugggagagccuucc

SEQ ID NO: 1507526 - RNA, 20 nt, Human
caggcugggagagccuucca

SEQ ID NO: 1507527 - RNA, 22 nt, Human
cagggcuggacugaggccugag

SEQ ID NO: 1507528 - RNA, 23 nt, Human
cagggcuggacugaggccugagc

SEQ ID NO: 1507529 - RNA, 23 nt, Human
caggacagcccuucuuuccacag

SEQ ID NO: 1507530 - RNA, 24 nt, Human
caggacagcccuucuuuccacaga

SEQ ID NO: 1507531 - RNA, 13 nt, Human
caggaccagggau

SEQ ID NO: 1507532 - RNA, 21 nt, Human
caggaccagggauuuccauga

SEQ ID NO: 1507533 - RNA, 13 nt, Human
caggaccucaggu

SEQ ID NO: 1507534 - RNA, 21 nt, Human
caggcaaugcuggcuguuggc

SEQ ID NO: 1507535 - RNA, 14 nt, Human
caggaggccagccu

SEQ ID NO: 1507536 - RNA, 12 nt, Human
caggaggccagc

SEQ ID NO: 1507537 - RNA, 13 nt, Human
caggaggccagcc

SEQ ID NO: 1507538 - RNA, 19 nt, Human
caggcaaugcuggcuguug

SEQ ID NO: 1507539 - RNA, 20 nt, Human
caggcaaugcuggcuguugg

SEQ ID NO: 1507540 - RNA, 13 nt, Human
caggccagcugcu

SEQ ID NO: 1507541 - RNA, 15 nt, Human
caggccagcugcuug

SEQ ID NO: 1507542 - RNA, 17 nt, Human
caggccagcugcuuggg

SEQ ID NO: 1507543 - RNA, 13 nt, Human
caggccaggcccu

SEQ ID NO: 1507544 - RNA, 14 nt, Human
caggccaggcccuc

SEQ ID NO: 1507545 - RNA, 15 nt, Human
caggccaggcccucu

SEQ ID NO: 1507546 - RNA, 16 nt, Human
caggccaggcccucug

SEQ ID NO: 1507547 - RNA, 23 nt, Human
caggaaaggcuccaggagcagcc

SEQ ID NO: 1507548 - RNA, 21 nt, Human
caggaaaggcuccaggagcag

SEQ ID NO: 1507549 - RNA, 22 nt, Human
caggaaaggcuccaggagcagc

SEQ ID NO: 1507550 - RNA, 19 nt, Human
caggaaaagcugcugacag

SEQ ID NO: 1507551 - RNA, 20 nt, Human
caggaaaagcugcugacagu

SEQ ID NO: 1507552 - RNA, 15 nt, Human
cagcuguucagcugg

SEQ ID NO: 1507553 - RNA, 16 nt, Human
cagcuguucagcuggu

SEQ ID NO: 1507554 - RNA, 19 nt, Human
cagcuguucagcugguuga

SEQ ID NO: 1507555 - RNA, 16 nt, Human
cagcuuauucacaaga

SEQ ID NO: 1507556 - RNA, 17 nt, Human
cagcuuauucacaagac

SEQ ID NO: 1507557 - RNA, 22 nt, Human
caggaaaucaaauaugcaaagc

SEQ ID NO: 1507558 - RNA, 21 nt, Human
caggaaaucaaauaugcaaag

SEQ ID NO: 1507559 - RNA, 19 nt, Human
caggaaaucaaauaugcaa

SEQ ID NO: 1507560 - RNA, 23 nt, Human
cagccccauucugccugcccagg

SEQ ID NO: 1507561 - RNA, 24 nt, Human
cagccccauucugccugcccaggc

SEQ ID NO: 1507562 - RNA, 19 nt, Human
cagccccauucugccugcc

SEQ ID NO: 1507563 - RNA, 20 nt, Human
cagccccauucugccugccc

SEQ ID NO: 1507564 - RNA, 22 nt, Human
cagccccauucugccugcccag

SEQ ID NO: 1507565 - RNA, 19 nt, Human
cagccccgugggguuccuc

SEQ ID NO: 1507566 - RNA, 13 nt, Human
cagcccuuagcag

SEQ ID NO: 1507567 - RNA, 15 nt, Human
cagcccuuagcaggg

SEQ ID NO: 1507568 - RNA, 23 nt, Human
cagccgccaugcuccuggcccac

SEQ ID NO: 1507569 - RNA, 12 nt, Human
cagccugcagga

SEQ ID NO: 1507570 - RNA, 21 nt, Human
cagccugcaggaccucgugcc

SEQ ID NO: 1507571 - RNA, 23 nt, Human
cagccugagcgacagugagacuc

SEQ ID NO: 1507572 - RNA, 17 nt, Human
cagccucugaaaaccaa

SEQ ID NO: 1507573 - RNA, 14 nt, Human
cagcguuucuauga

SEQ ID NO: 1507574 - RNA, 16 nt, Human
cagcguuucuaugaca

SEQ ID NO: 1507575 - RNA, 19 nt, Human
cagcguuucuaugacacau

SEQ ID NO: 1507576 - RNA, 14 nt, Human
cagcggggacagcu

SEQ ID NO: 1507577 - RNA, 18 nt, Human
cagauuggcucacacuga

SEQ ID NO: 1507578 - RNA, 20 nt, Human
cagauuggcucacacugaga

SEQ ID NO: 1507579 - RNA, 15 nt, Human
cagauuucacucucc

SEQ ID NO: 1507580 - RNA, 16 nt, Human
cagauuucacucuccu

SEQ ID NO: 1507581 - RNA, 18 nt, Human
cagauuucacucuccuug

SEQ ID NO: 1507582 - RNA, 19 nt, Human
cagauuucacucuccuugg

SEQ ID NO: 1507583 - RNA, 17 nt, Human
cagauuggcucacacug

SEQ ID NO: 1507584 - RNA, 11 nt, Human
cagcacugagg

SEQ ID NO: 1507585 - RNA, 12 nt, Human
cagcacugagga

SEQ ID NO: 1507586 - RNA, 13 nt, Human
cagcacugaggaa

SEQ ID NO: 1507587 - RNA, 15 nt, Human
cagcacugaggaaga

SEQ ID NO: 1507588 - RNA, 17 nt, Human
cagcacugaggaagaac

SEQ ID NO: 1507589 - RNA, 16 nt, Human
cagcauauucaggaag

SEQ ID NO: 1507590 - RNA, 17 nt, Human
cagcauauucaggaagc

SEQ ID NO: 1507591 - RNA, 18 nt, Human
cagcauauucaggaagcu

SEQ ID NO: 1507592 - RNA, 16 nt, Human
cagagguugcagugag

SEQ ID NO: 1507593 - RNA, 20 nt, Human
cagagcuacccgcagaguuc

SEQ ID NO: 1507594 - RNA, 9 nt, Human
cagagcugg

SEQ ID NO: 1507595 - RNA, 17 nt, Human
cagagcuacacagggga

SEQ ID NO: 1507596 - RNA, 22 nt, Human
cagagcuacacaggggaaaaga

SEQ ID NO: 1507597 - RNA, 16 nt, Human
cagagagggugggagu

SEQ ID NO: 1507598 - RNA, 23 nt, Human
cagagagggugggagugggccca

SEQ ID NO: 1507599 - RNA, 14 nt, Human
cagagccugcaguu

SEQ ID NO: 1507600 - RNA, 20 nt, Human
cagagagggugggagugggc

SEQ ID NO: 1507601 - RNA, 22 nt, Human
cagagagggugggagugggccc

SEQ ID NO: 1507602 - RNA, 23 nt, Human
cagagacuccugcaggcagccag

SEQ ID NO: 1507603 - RNA, 21 nt, Human
cagagacuccugcaggcagcc

SEQ ID NO: 1507604 - RNA, 22 nt, Human
cagagacuccugcaggcagcca

SEQ ID NO: 1507605 - RNA, 20 nt, Human
cagagacuccugcaggcagc

SEQ ID NO: 1507606 - RNA, 20 nt, Human
caucagcuugcccuguuaaa

SEQ ID NO: 1507607 - RNA, 13 nt, Human
caucaggccaggc

SEQ ID NO: 1507608 - RNA, 19 nt, Human
caucagcacgauuucuguu

SEQ ID NO: 1507609 - RNA, 15 nt, Human
caucagcugcugaaa

SEQ ID NO: 1507610 - RNA, 17 nt, Human
caucagcugcugaaaca

SEQ ID NO: 1507611 - RNA, 18 nt, Human
caucagcugcugaaacaa

SEQ ID NO: 1507612 - RNA, 18 nt, Human
caucagcacgauuucugu

SEQ ID NO: 1507613 - RNA, 17 nt, Human
caucagcacgauuucug

SEQ ID NO: 1507614 - RNA, 17 nt, Human
caucccagccccaauga

SEQ ID NO: 1507615 - RNA, 16 nt, Human
caucccagccccaaug

SEQ ID NO: 1507616 - RNA, 13 nt, Human
caucccagcccca

SEQ ID NO: 1507617 - RNA, 14 nt, Human
caucccagccccaa

SEQ ID NO: 1507618 - RNA, 14 nt, Human
caucaggccaggcc

SEQ ID NO: 1507619 - RNA, 21 nt, Human
caucaggccaggcccucugcc

SEQ ID NO: 1507620 - RNA, 22 nt, Human
caucaggccaggcccucugccc

SEQ ID NO: 1507621 - RNA, 23 nt, Human
caucaggccaggcccucugccca

SEQ ID NO: 1507622 - RNA, 18 nt, Human
caucugugaaaggaaaga

SEQ ID NO: 1507623 - RNA, 19 nt, Human
caucugugaaaggaaagag

SEQ ID NO: 1507624 - RNA, 21 nt, Human
caucuuagguuggcaaaaagg

SEQ ID NO: 1507625 - RNA, 22 nt, Human
caucuuagguuggcaaaaaggc

SEQ ID NO: 1507626 - RNA, 17 nt, Human
caugacacgaauauugc

SEQ ID NO: 1507627 - RNA, 18 nt, Human
caugacacgaauauugcu

SEQ ID NO: 1507628 - RNA, 16 nt, Human
caugaauuaguuuuau

SEQ ID NO: 1507629 - RNA, 14 nt, Human
caugacacgaauau

SEQ ID NO: 1507630 - RNA, 22 nt, Human
caugcaaggucauuuuuuuuaa

SEQ ID NO: 1507631 - RNA, 18 nt, Human
caugcaaggucauuuuuu

SEQ ID NO: 1507632 - RNA, 17 nt, Human
caugcaaggucauuuuu

SEQ ID NO: 1507633 - RNA, 22 nt, Human
cauggccuuugcuugaaagaaa

SEQ ID NO: 1507634 - RNA, 19 nt, Human
cauggccuuugcuugaaag

SEQ ID NO: 1507635 - RNA, 16 nt, Human
caugcugcccugugag

SEQ ID NO: 1507636 - RNA, 18 nt, Human
caugcugcccugugagua

SEQ ID NO: 1507637 - RNA, 17 nt, Human
cauaaugcgugcauacc

SEQ ID NO: 1507638 - RNA, 14 nt, Human
cauaaugcgugcau

SEQ ID NO: 1507639 - RNA, 21 nt, Human
caguuuguuaguaugaggcau

SEQ ID NO: 1507640 - RNA, 21 nt, Human
cauaaugcgugcauaccacuu

SEQ ID NO: 1507641 - RNA, 15 nt, Human
cauacaauuccaaac

SEQ ID NO: 1507642 - RNA, 17 nt, Human
cauagauucccugagca

SEQ ID NO: 1507643 - RNA, 18 nt, Human
cauagauucccugagcag

SEQ ID NO: 1507644 - RNA, 22 nt, Human
cauauuaccacagacauacuaa

SEQ ID NO: 1507645 - RNA, 21 nt, Human
cauauuaccacagacauacua

SEQ ID NO: 1507646 - RNA, 20 nt, Human
cauauuaccacagacauacu

SEQ ID NO: 1507647 - RNA, 17 nt, Human
cauauuaccacagacau

SEQ ID NO: 1507648 - RNA, 18 nt, Human
cagucaccccggccaccu

SEQ ID NO: 1507649 - RNA, 12 nt, Human
cauuuccaagca

SEQ ID NO: 1507650 - RNA, 23 nt, Human
cauuuggugguuucagaaaugug

SEQ ID NO: 1507651 - RNA, 22 nt, Human
cauuuggugguuucagaaaugu

SEQ ID NO: 1507652 - RNA, 19 nt, Human
ccaaaaagauuuucagaaa

SEQ ID NO: 1507653 - RNA, 17 nt, Human
ccaaaacucuccucugc

SEQ ID NO: 1507654 - RNA, 13 nt, Human
cauuucaccccuc

SEQ ID NO: 1507655 - RNA, 14 nt, Human
cauuucaccccucc

SEQ ID NO: 1507656 - RNA, 15 nt, Human
cauuucaccccuccc

SEQ ID NO: 1507657 - RNA, 16 nt, Human
cauuucaccccucccu

SEQ ID NO: 1507658 - RNA, 17 nt, Human
cauuucaccccucccuu

SEQ ID NO: 1507659 - RNA, 18 nt, Human
cauuucaccccucccuuu

SEQ ID NO: 1507660 - RNA, 19 nt, Human
cauuucaccccucccuuuc

SEQ ID NO: 1507661 - RNA, 20 nt, Human
cauuucaccccucccuuucu

SEQ ID NO: 1507662 - RNA, 21 nt, Human
cauuucaccccucccuuucuc

SEQ ID NO: 1507663 - RNA, 22 nt, Human
cauuucaccccucccuuucucc

SEQ ID NO: 1507664 - RNA, 23 nt, Human
cauuucaccccucccuuucuccc

SEQ ID NO: 1507665 - RNA, 16 nt, Human
cauuuauucugcucac

SEQ ID NO: 1507666 - RNA, 18 nt, Human
cauugcugggcuugucug

SEQ ID NO: 1507667 - RNA, 14 nt, Human
cauugcggacagcc

SEQ ID NO: 1507668 - RNA, 15 nt, Human
cauugcggacagcca

SEQ ID NO: 1507669 - RNA, 17 nt, Human
cauugcggacagccacg

SEQ ID NO: 1507670 - RNA, 21 nt, Human
cauugcggacagccacggcca

SEQ ID NO: 1507671 - RNA, 22 nt, Human
cauggcuggagcuagaauuuga

SEQ ID NO: 1507672 - RNA, 22 nt, Human
cauggcugccaaugggagcuca

SEQ ID NO: 1507673 - RNA, 15 nt, Human
cauguucucugagga

SEQ ID NO: 1507674 - RNA, 17 nt, Human
cauuaucuagauacugu

SEQ ID NO: 1507675 - RNA, 16 nt, Human
cauuaucuagauacug

SEQ ID NO: 1507676 - RNA, 12 nt, Human
cauuaucuagau

SEQ ID NO: 1507677 - RNA, 15 nt, Human
cauuaggauggcuag

SEQ ID NO: 1507678 - RNA, 20 nt, Human
cauucuccuuguguuacuaa

SEQ ID NO: 1507679 - RNA, 16 nt, Human
cauucuccuuguguua

SEQ ID NO: 1507680 - RNA, 18 nt, Human
cauuaucuagauacugua

SEQ ID NO: 1507681 - RNA, 22 nt, Human
cauuaugaugugggucaaggaa

SEQ ID NO: 1507682 - RNA, 23 nt, Human
cauuaugaugugggucaaggaau

SEQ ID NO: 1507683 - RNA, 12 nt, Human
ccaaauuaagag

SEQ ID NO: 1507684 - RNA, 20 nt, Human
ccaaaacucuccucugcugc

SEQ ID NO: 1507685 - RNA, 23 nt, Human
ccaaugcacuuuguucuggcucu

SEQ ID NO: 1507686 - RNA, 20 nt, Human
ccaaugcacuuuguucuggc

SEQ ID NO: 1507687 - RNA, 22 nt, Human
ccaaugcacuuuguucuggcuc

SEQ ID NO: 1507688 - RNA, 20 nt, Human
ccaauguucucucuucucca

SEQ ID NO: 1507689 - RNA, 22 nt, Human
ccaauuauaugagacguuuuug

SEQ ID NO: 1507690 - RNA, 19 nt, Human
ccaccgcagacaggaccag

SEQ ID NO: 1507691 - RNA, 18 nt, Human
ccaccgcagacaggacca

SEQ ID NO: 1507692 - RNA, 14 nt, Human
ccaccuuggcucaa

SEQ ID NO: 1507693 - RNA, 15 nt, Human
ccaccuuggcucaag

SEQ ID NO: 1507694 - RNA, 18 nt, Human
ccaccaucaccagacagg

SEQ ID NO: 1507695 - RNA, 20 nt, Human
ccaccaucaagccaccaaca

SEQ ID NO: 1507696 - RNA, 14 nt, Human
ccaccgcagacagg

SEQ ID NO: 1507697 - RNA, 17 nt, Human
ccaccgcagacaggacc

SEQ ID NO: 1507698 - RNA, 16 nt, Human
ccaccaucaagccacc

SEQ ID NO: 1507699 - RNA, 17 nt, Human
ccaccaucaagccacca

SEQ ID NO: 1507700 - RNA, 15 nt, Human
ccagauccuggaaau

SEQ ID NO: 1507701 - RNA, 20 nt, Human
ccagagggccugcaagggag

SEQ ID NO: 1507702 - RNA, 16 nt, Human
ccaccuuggcucaagu

SEQ ID NO: 1507703 - RNA, 17 nt, Human
ccagagggccugcaagg

SEQ ID NO: 1507704 - RNA, 18 nt, Human
ccagagggccugcaaggg

SEQ ID NO: 1507705 - RNA, 19 nt, Human
ccagagggccugcaaggga

SEQ ID NO: 1507706 - RNA, 23 nt, Human
ccagaugcaccagcccuuagcag

SEQ ID NO: 1507707 - RNA, 18 nt, Human
ccagaugcaccagcccuu

SEQ ID NO: 1507708 - RNA, 17 nt, Human
ccagaugcaccagcccu

SEQ ID NO: 1507709 - RNA, 15 nt, Human
ccagaugcaccagcc

SEQ ID NO: 1507710 - RNA, 16 nt, Human
ccaggaaaggcuccag

SEQ ID NO: 1507711 - RNA, 14 nt, Human
ccaggaaaggcucc

SEQ ID NO: 1507712 - RNA, 15 nt, Human
ccaggaaaggcucca

SEQ ID NO: 1507713 - RNA, 12 nt, Human
ccaggaagccag

SEQ ID NO: 1507714 - RNA, 14 nt, Human
ccaggaagccagca

SEQ ID NO: 1507715 - RNA, 13 nt, Human
ccaggaagccagc

SEQ ID NO: 1507716 - RNA, 11 nt, Human
ccagccccugg

SEQ ID NO: 1507717 - RNA, 12 nt, Human
ccagccccugga

SEQ ID NO: 1507718 - RNA, 17 nt, Human
ccagcuguucagcuggu

SEQ ID NO: 1507719 - RNA, 16 nt, Human
ccagcuuaucucaggg

SEQ ID NO: 1507720 - RNA, 19 nt, Human
ccagcuuaaaggggcuaga

SEQ ID NO: 1507721 - RNA, 15 nt, Human
ccagcucaccagccc

SEQ ID NO: 1507722 - RNA, 16 nt, Human
ccagcucaccagcccc

SEQ ID NO: 1507723 - RNA, 22 nt, Human
ccagcucaccagccccagugcc

SEQ ID NO: 1507724 - RNA, 13 nt, Human
ccagcaggcucuc

SEQ ID NO: 1507725 - RNA, 15 nt, Human
ccagcaggcucucag

SEQ ID NO: 1507726 - RNA, 22 nt, Human
ccaugucaagagucgcugugcc

SEQ ID NO: 1507727 - RNA, 21 nt, Human
ccaugagccucagcauccugg

SEQ ID NO: 1507728 - RNA, 23 nt, Human
ccaugagccucagcauccuggca

SEQ ID NO: 1507729 - RNA, 20 nt, Human
ccauggucggaaaacaugcu

SEQ ID NO: 1507730 - RNA, 23 nt, Human
ccaguuggguggaugccuggugg

SEQ ID NO: 1507731 - RNA, 23 nt, Human
ccaguuccuuucaaugguuugca

SEQ ID NO: 1507732 - RNA, 21 nt, Human
ccaguuccuuucaaugguuug

SEQ ID NO: 1507733 - RNA, 22 nt, Human
ccaguuccuuucaaugguuugc

SEQ ID NO: 1507734 - RNA, 23 nt, Human
ccaguuggucccccuuccaugga

SEQ ID NO: 1507735 - RNA, 14 nt, Human
ccaucccagcccca

SEQ ID NO: 1507736 - RNA, 15 nt, Human
ccaucccagccccaa

SEQ ID NO: 1507737 - RNA, 14 nt, Human
ccaucccugaaggc

SEQ ID NO: 1507738 - RNA, 15 nt, Human
ccaucccugaaggcc

SEQ ID NO: 1507739 - RNA, 17 nt, Human
ccaucccugaaggcccc

SEQ ID NO: 1507740 - RNA, 20 nt, Human
ccaucccugaaggccccgcc

SEQ ID NO: 1507741 - RNA, 17 nt, Human
ccaguuggguggaugcc

SEQ ID NO: 1507742 - RNA, 19 nt, Human
ccaguuggguggaugccug

SEQ ID NO: 1507743 - RNA, 20 nt, Human
ccaguuggguggaugccugg

SEQ ID NO: 1507744 - RNA, 20 nt, Human
ccaggcuccuuuagcgccca

SEQ ID NO: 1507745 - RNA, 21 nt, Human
ccaggcuccuuuagcgcccag

SEQ ID NO: 1507746 - RNA, 19 nt, Human
ccaggcuggcgugcagugg

SEQ ID NO: 1507747 - RNA, 17 nt, Human
ccaggcuggcgugcagu

SEQ ID NO: 1507748 - RNA, 18 nt, Human
ccaggcuggcgugcagug

SEQ ID NO: 1507749 - RNA, 19 nt, Human
ccaggggaaaaucagccug

SEQ ID NO: 1507750 - RNA, 20 nt, Human
ccaggggaaaaucagccugc

SEQ ID NO: 1507751 - RNA, 13 nt, Human
ccaggggugggac

SEQ ID NO: 1507752 - RNA, 21 nt, Human
ccaggggaaaaucagccugcu

SEQ ID NO: 1507753 - RNA, 19 nt, Human
ccaggggugggacacccug

SEQ ID NO: 1507754 - RNA, 14 nt, Human
ccaggggugggaca

SEQ ID NO: 1507755 - RNA, 17 nt, Human
ccaggggugggacaccc

SEQ ID NO: 1507756 - RNA, 13 nt, Human
cccauccucugua

SEQ ID NO: 1507757 - RNA, 20 nt, Human
cccauauuuguacaccaaua

SEQ ID NO: 1507758 - RNA, 15 nt, Human
cccaggaaaggcucc

SEQ ID NO: 1507759 - RNA, 13 nt, Human
cccaggcuggcgu

SEQ ID NO: 1507760 - RNA, 17 nt, Human
cccaggcuggcgugcag

SEQ ID NO: 1507761 - RNA, 23 nt, Human
cccagcucugguccauagagagc

SEQ ID NO: 1507762 - RNA, 18 nt, Human
cccacccugaaagcccug

SEQ ID NO: 1507763 - RNA, 17 nt, Human
cccacccccacccaagg

SEQ ID NO: 1507764 - RNA, 15 nt, Human
cccacccccacccaa

SEQ ID NO: 1507765 - RNA, 20 nt, Human
cccacccaagggccuggccu

SEQ ID NO: 1507766 - RNA, 21 nt, Human
cccacccaagggccuggccug

SEQ ID NO: 1507767 - RNA, 22 nt, Human
cccacccaagggccuggccuga

SEQ ID NO: 1507768 - RNA, 22 nt, Human
cccacugcuuuuggucugugug

SEQ ID NO: 1507769 - RNA, 19 nt, Human
cccacugcuuuuggucugu

SEQ ID NO: 1507770 - RNA, 12 nt, Human
cccacugcucug

SEQ ID NO: 1507771 - RNA, 13 nt, Human
cccacugcucugg

SEQ ID NO: 1507772 - RNA, 12 nt, Human
cccacucccugc

SEQ ID NO: 1507773 - RNA, 23 nt, Human
ccccgaggccuucucugaaggac

SEQ ID NO: 1507774 - RNA, 13 nt, Human
ccccggccaccug

SEQ ID NO: 1507775 - RNA, 23 nt, Human
ccccaaaacucuccucugcugcu

SEQ ID NO: 1507776 - RNA, 22 nt, Human
cccauuguggucacaggaagua

SEQ ID NO: 1507777 - RNA, 23 nt, Human
cccauuguggucacaggaaguag

SEQ ID NO: 1507778 - RNA, 22 nt, Human
ccccaaaacucuccucugcugc

SEQ ID NO: 1507779 - RNA, 22 nt, Human
cccccaaauggaaaugggcaga

SEQ ID NO: 1507780 - RNA, 22 nt, Human
ccccagcaagugagagcugggu

SEQ ID NO: 1507781 - RNA, 12 nt, Human
ccccagcacuga

SEQ ID NO: 1507782 - RNA, 13 nt, Human
ccccagcacugag

SEQ ID NO: 1507783 - RNA, 15 nt, Human
ccccagcacugagga

SEQ ID NO: 1507784 - RNA, 16 nt, Human
ccccagcacugaggaa

SEQ ID NO: 1507785 - RNA, 17 nt, Human
cccggccaccugcggug

SEQ ID NO: 1507786 - RNA, 18 nt, Human
cccuauuagagaagagau

SEQ ID NO: 1507787 - RNA, 23 nt, Human
cccgggaggcagagguugcagug

SEQ ID NO: 1507788 - RNA, 13 nt, Human
cccggccaccugc

SEQ ID NO: 1507789 - RNA, 14 nt, Human
cccggccaccugcg

SEQ ID NO: 1507790 - RNA, 12 nt, Human
cccggcuccagg

SEQ ID NO: 1507791 - RNA, 13 nt, Human
cccggcuccaggc

SEQ ID NO: 1507792 - RNA, 14 nt, Human
cccggcuccaggcu

SEQ ID NO: 1507793 - RNA, 15 nt, Human
cccggcuccaggcuc

SEQ ID NO: 1507794 - RNA, 16 nt, Human
cccggcuccaggcucc

SEQ ID NO: 1507795 - RNA, 14 nt, Human
cccgaauagcuggg

SEQ ID NO: 1507796 - RNA, 16 nt, Human
cccgaauagcugggac

SEQ ID NO: 1507797 - RNA, 13 nt, Human
ccucuuggguuca

SEQ ID NO: 1507798 - RNA, 19 nt, Human
ccucuugagccuugaacuu

SEQ ID NO: 1507799 - RNA, 13 nt, Human
ccucuugagccuu

SEQ ID NO: 1507800 - RNA, 22 nt, Human
ccugcacuugcagacucuacag

SEQ ID NO: 1507801 - RNA, 17 nt, Human
ccugcaggaccucgugc

SEQ ID NO: 1507802 - RNA, 18 nt, Human
ccugcaggaccucgugcc

SEQ ID NO: 1507803 - RNA, 14 nt, Human
ccucucucaggcca

SEQ ID NO: 1507804 - RNA, 13 nt, Human
ccucucucacucc

SEQ ID NO: 1507805 - RNA, 14 nt, Human
ccucucucacuccu

SEQ ID NO: 1507806 - RNA, 15 nt, Human
ccucucucacuccuu

SEQ ID NO: 1507807 - RNA, 17 nt, Human
ccucucucacuccuuga

SEQ ID NO: 1507808 - RNA, 12 nt, Human
ccucucucaggc

SEQ ID NO: 1507809 - RNA, 22 nt, Human
ccucugccugaagucacacagu

SEQ ID NO: 1507810 - RNA, 13 nt, Human
ccucugcugcugg

SEQ ID NO: 1507811 - RNA, 14 nt, Human
ccucugcugcuggc

SEQ ID NO: 1507812 - RNA, 15 nt, Human
ccucugcugcuggcu

SEQ ID NO: 1507813 - RNA, 16 nt, Human
ccucugcugcuggcug

SEQ ID NO: 1507814 - RNA, 17 nt, Human
ccucugcugcuggcugg

SEQ ID NO: 1507815 - RNA, 18 nt, Human
ccucugcugcuggcuggu

SEQ ID NO: 1507816 - RNA, 16 nt, Human
ccugcccauuggagag

SEQ ID NO: 1507817 - RNA, 12 nt, Human
ccugcugggugu

SEQ ID NO: 1507818 - RNA, 21 nt, Human
ccugcuggguguggcgcagca

SEQ ID NO: 1507819 - RNA, 14 nt, Human
ccugcugggugugg

SEQ ID NO: 1507820 - RNA, 20 nt, Human
ccugcuggguguggcgcagc

SEQ ID NO: 1507821 - RNA, 14 nt, Human
ccugcccaggcccc

SEQ ID NO: 1507822 - RNA, 15 nt, Human
ccugcccaggccccu

SEQ ID NO: 1507823 - RNA, 16 nt, Human
ccugcccaggccccug

SEQ ID NO: 1507824 - RNA, 18 nt, Human
ccugcccaggccccugcc

SEQ ID NO: 1507825 - RNA, 15 nt, Human
ccuggaguucugguu

SEQ ID NO: 1507826 - RNA, 16 nt, Human
ccuggaguucugguuc

SEQ ID NO: 1507827 - RNA, 17 nt, Human
ccuggaguucugguucc

SEQ ID NO: 1507828 - RNA, 19 nt, Human
ccuggaugcagccucacag

SEQ ID NO: 1507829 - RNA, 14 nt, Human
ccuggaugcagccu

SEQ ID NO: 1507830 - RNA, 17 nt, Human
ccuggaugcagccucac

SEQ ID NO: 1507831 - RNA, 13 nt, Human
ccuggaugcagcc

SEQ ID NO: 1507832 - RNA, 18 nt, Human
ccuggcacccggccccug

SEQ ID NO: 1507833 - RNA, 12 nt, Human
ccuggccucugc

SEQ ID NO: 1507834 - RNA, 16 nt, Human
ccuggccucugcacuc

SEQ ID NO: 1507835 - RNA, 13 nt, Human
ccuggccugagcu

SEQ ID NO: 1507836 - RNA, 14 nt, Human
ccuggccucugcac

SEQ ID NO: 1507837 - RNA, 15 nt, Human
ccuggccucugcacu

SEQ ID NO: 1507838 - RNA, 17 nt, Human
cccuucuuuccacagaa

SEQ ID NO: 1507839 - RNA, 20 nt, Human
ccgaauagcugggacuacag

SEQ ID NO: 1507840 - RNA, 16 nt, Human
ccgacccuugccgucu

SEQ ID NO: 1507841 - RNA, 17 nt, Human
ccgccaaggcuggggga

SEQ ID NO: 1507842 - RNA, 16 nt, Human
ccgccaugcuccuggc

SEQ ID NO: 1507843 - RNA, 20 nt, Human
ccgcccaggcuuagucacug

SEQ ID NO: 1507844 - RNA, 21 nt, Human
cccuucugacccaugcugccc

SEQ ID NO: 1507845 - RNA, 22 nt, Human
cccuucugacccaugcugcccu

SEQ ID NO: 1507846 - RNA, 23 nt, Human
cccuucugacccaugcugcccug

SEQ ID NO: 1507847 - RNA, 16 nt, Human
cccuucuaccuuccug

SEQ ID NO: 1507848 - RNA, 16 nt, Human
cccuucgcuccugugu

SEQ ID NO: 1507849 - RNA, 18 nt, Human
cccuucgcuccugugucu

SEQ ID NO: 1507850 - RNA, 13 nt, Human
cccucaccccugg

SEQ ID NO: 1507851 - RNA, 20 nt, Human
cccucaccccugguucucau

SEQ ID NO: 1507852 - RNA, 22 nt, Human
cccucaccccugguucucaucu

SEQ ID NO: 1507853 - RNA, 12 nt, Human
cccugcccugug

SEQ ID NO: 1507854 - RNA, 13 nt, Human
cccugcccugugg

SEQ ID NO: 1507855 - RNA, 21 nt, Human
cccugcccugugggcccccaa

SEQ ID NO: 1507856 - RNA, 12 nt, Human
cccuggcagccc

SEQ ID NO: 1507857 - RNA, 13 nt, Human
cccuggcagcccc

SEQ ID NO: 1507858 - RNA, 14 nt, Human
cccugcccuguggg

SEQ ID NO: 1507859 - RNA, 15 nt, Human
cccugcccugugggc

SEQ ID NO: 1507860 - RNA, 16 nt, Human
cccugcccugugggcc

SEQ ID NO: 1507861 - RNA, 20 nt, Human
cccugcccugugggccccca

SEQ ID NO: 1507862 - RNA, 14 nt, Human
cccuggcagccccu

SEQ ID NO: 1507863 - RNA, 16 nt, Human
cccuggcagccccugu

SEQ ID NO: 1507864 - RNA, 16 nt, Human
ccguagguuauuuuca

SEQ ID NO: 1507865 - RNA, 12 nt, Human
ccggcuccaggc

SEQ ID NO: 1507866 - RNA, 23 nt, Human
ccuaggcauuugcugaauacaga

SEQ ID NO: 1507867 - RNA, 17 nt, Human
ccuagcacuuugggagg

SEQ ID NO: 1507868 - RNA, 19 nt, Human
ccucaacucuccuccagag

SEQ ID NO: 1507869 - RNA, 15 nt, Human
ccucaacucuccucc

SEQ ID NO: 1507870 - RNA, 15 nt, Human
ccucaagagaaggca

SEQ ID NO: 1507871 - RNA, 11 nt, Human
ccucagccucc

SEQ ID NO: 1507872 - RNA, 22 nt, Human
ccucagccucccaaagugcugg

SEQ ID NO: 1507873 - RNA, 22 nt, Human
ccucccaaggggcccaaauucu

SEQ ID NO: 1507874 - RNA, 19 nt, Human
ccucauguucuuaauucuu

SEQ ID NO: 1507875 - RNA, 18 nt, Human
ccucauuagcauuuugcu

SEQ ID NO: 1507876 - RNA, 23 nt, Human
ccucagccucccaaagugcuggg

SEQ ID NO: 1507877 - RNA, 22 nt, Human
ccucagccucccgaauagcugg

SEQ ID NO: 1507878 - RNA, 13 nt, Human
ccucauguucuua

SEQ ID NO: 1507879 - RNA, 20 nt, Human
ccucauguccacugguucuu

SEQ ID NO: 1507880 - RNA, 16 nt, Human
cuaacuucaccauauu

SEQ ID NO: 1507881 - RNA, 15 nt, Human
cuaacuucaccauau

SEQ ID NO: 1507882 - RNA, 20 nt, Human
cuaacgaaguauccuucagc

SEQ ID NO: 1507883 - RNA, 18 nt, Human
cuacaugagguacugaga

SEQ ID NO: 1507884 - RNA, 15 nt, Human
cuacaugagguacug

SEQ ID NO: 1507885 - RNA, 23 nt, Human
cuacauaaguaauucaagaaaac

SEQ ID NO: 1507886 - RNA, 18 nt, Human
cuacauacaauuccaaac

SEQ ID NO: 1507887 - RNA, 22 nt, Human
cuacauaaguaauucaagaaaa

SEQ ID NO: 1507888 - RNA, 15 nt, Human
cuacaguccucccau

SEQ ID NO: 1507889 - RNA, 16 nt, Human
cuacaguccucccauc

SEQ ID NO: 1507890 - RNA, 17 nt, Human
cuacaguccucccaucu

SEQ ID NO: 1507891 - RNA, 18 nt, Human
cuacaguccucccaucuc

SEQ ID NO: 1507892 - RNA, 13 nt, Human
cuacaguugaaaa

SEQ ID NO: 1507893 - RNA, 19 nt, Human
cuacaguugaaaaacagcu

SEQ ID NO: 1507894 - RNA, 15 nt, Human
cuacaaaaacacagc

SEQ ID NO: 1507895 - RNA, 18 nt, Human
cuaagugaggaugaaaaa

SEQ ID NO: 1507896 - RNA, 20 nt, Human
cuaagugauccucccaccuc

SEQ ID NO: 1507897 - RNA, 22 nt, Human
cuaagugauccucccaccucag

SEQ ID NO: 1507898 - RNA, 20 nt, Human
cuaagugaaauaagccagac

SEQ ID NO: 1507899 - RNA, 23 nt, Human
cuaagugaaauaagccagacauc

SEQ ID NO: 1507900 - RNA, 23 nt, Human
cuaguugaucagcuuauugucua

SEQ ID NO: 1507901 - RNA, 22 nt, Human
cuaguuccaccaucaagccacc

SEQ ID NO: 1507902 - RNA, 19 nt, Human
cuagggaaaaaccagcgug

SEQ ID NO: 1507903 - RNA, 21 nt, Human
cuagggaaaaaccagcgugug

SEQ ID NO: 1507904 - RNA, 18 nt, Human
cuaguuccaccaucaagc

SEQ ID NO: 1507905 - RNA, 20 nt, Human
cuaguuccaccaucaagcca

SEQ ID NO: 1507906 - RNA, 23 nt, Human
cuagcagcagggagggcuucugc

SEQ ID NO: 1507907 - RNA, 17 nt, Human
cuagcauggcugccaau

SEQ ID NO: 1507908 - RNA, 22 nt, Human
cuagcagcagggagggcuucug

SEQ ID NO: 1507909 - RNA, 16 nt, Human
cuagaacucccuuuca

SEQ ID NO: 1507910 - RNA, 17 nt, Human
cuagaacucccuuucaa

SEQ ID NO: 1507911 - RNA, 18 nt, Human
cuagaacucccuuucaac

SEQ ID NO: 1507912 - RNA, 19 nt, Human
cuagaacucccuuucaaca

SEQ ID NO: 1507913 - RNA, 19 nt, Human
cuagaaauuccccacccug

SEQ ID NO: 1507914 - RNA, 15 nt, Human
cuaccugaggggccu

SEQ ID NO: 1507915 - RNA, 11 nt, Human
cuaccugaggg

SEQ ID NO: 1507916 - RNA, 14 nt, Human
cuaccugaggggcc

SEQ ID NO: 1507917 - RNA, 14 nt, Human
cggagucccaccuu

SEQ ID NO: 1507918 - RNA, 15 nt, Human
cggcggucccagcuc

SEQ ID NO: 1507919 - RNA, 16 nt, Human
cggcggucccagcucc

SEQ ID NO: 1507920 - RNA, 18 nt, Human
cggcucacugcagccuca

SEQ ID NO: 1507921 - RNA, 19 nt, Human
cggcggucccagcucccug

SEQ ID NO: 1507922 - RNA, 19 nt, Human
cggcucacugcagccucaa

SEQ ID NO: 1507923 - RNA, 14 nt, Human
cgccuacaggagug

SEQ ID NO: 1507924 - RNA, 23 nt, Human
cgccaaggcugggggaagaagcu

SEQ ID NO: 1507925 - RNA, 13 nt, Human
cgccaaggcuggg

SEQ ID NO: 1507926 - RNA, 16 nt, Human
cgccaaggcuggggga

SEQ ID NO: 1507927 - RNA, 12 nt, Human
cgccaaggcugg

SEQ ID NO: 1507928 - RNA, 17 nt, Human
cgaguuacagacaaagc

SEQ ID NO: 1507929 - RNA, 18 nt, Human
cgaguuacagacaaagcg

SEQ ID NO: 1507930 - RNA, 14 nt, Human
cgaguagcugggac

SEQ ID NO: 1507931 - RNA, 15 nt, Human
cgaguagcugggacu

SEQ ID NO: 1507932 - RNA, 16 nt, Human
cgaguagcugggacua

SEQ ID NO: 1507933 - RNA, 22 nt, Human
ccuucuggaauaaggagaauga

SEQ ID NO: 1507934 - RNA, 23 nt, Human
ccuucugacccaugcugcccugu

SEQ ID NO: 1507935 - RNA, 21 nt, Human
ccuucugacccaugcugcccu

SEQ ID NO: 1507936 - RNA, 22 nt, Human
ccuucugacccaugcugcccug

SEQ ID NO: 1507937 - RNA, 20 nt, Human
ccuggccugagcugggauga

SEQ ID NO: 1507938 - RNA, 14 nt, Human
ccuggccugagcug

SEQ ID NO: 1507939 - RNA, 15 nt, Human
ccuggccugagcugg

SEQ ID NO: 1507940 - RNA, 12 nt, Human
ccuucugaccca

SEQ ID NO: 1507941 - RNA, 16 nt, Human
ccuucugacccaugcu

SEQ ID NO: 1507942 - RNA, 17 nt, Human
ccuucugacccaugcug

SEQ ID NO: 1507943 - RNA, 20 nt, Human
ccuucugacccaugcugccc

SEQ ID NO: 1507944 - RNA, 19 nt, Human
ccuuuuuuauacauaaaca

SEQ ID NO: 1507945 - RNA, 23 nt, Human
cgaccagacaccuugacagggca

SEQ ID NO: 1507946 - RNA, 18 nt, Human
ccuuuuuuauacauaaac

SEQ ID NO: 1507947 - RNA, 17 nt, Human
ccuuuuuuauacauaaa

SEQ ID NO: 1507948 - RNA, 15 nt, Human
cgacagugagacucu

SEQ ID NO: 1507949 - RNA, 16 nt, Human
cgacagugagacucug

SEQ ID NO: 1507950 - RNA, 12 nt, Human
ccuuuuuuauac

SEQ ID NO: 1507951 - RNA, 14 nt, Human
ccuuuagcgcccag

SEQ ID NO: 1507952 - RNA, 20 nt, Human
ccuuuagcgcccaguugggu

SEQ ID NO: 1507953 - RNA, 20 nt, Human
ccuugccgucuaccugaggg

SEQ ID NO: 1507954 - RNA, 20 nt, Human
cuccaaccccccagcacuga

SEQ ID NO: 1507955 - RNA, 21 nt, Human
cuccaaccccccagcacugag

SEQ ID NO: 1507956 - RNA, 22 nt, Human
cuccaaccccccagcacugagg

SEQ ID NO: 1507957 - RNA, 23 nt, Human
cuccaaccccccagcacugagga

SEQ ID NO: 1507958 - RNA, 14 nt, Human
cuccaaccccccag

SEQ ID NO: 1507959 - RNA, 15 nt, Human
cuccaaccccccagc

SEQ ID NO: 1507960 - RNA, 17 nt, Human
cuccaaccccccagcac

SEQ ID NO: 1507961 - RNA, 18 nt, Human
cuccaaccccccagcacu

SEQ ID NO: 1507962 - RNA, 19 nt, Human
cuccaaccccccagcacug

SEQ ID NO: 1507963 - RNA, 19 nt, Human
cucauguucuuaauucuua

SEQ ID NO: 1507964 - RNA, 18 nt, Human
cucauguucuuaauucuu

SEQ ID NO: 1507965 - RNA, 14 nt, Human
cucauguucuuaau

SEQ ID NO: 1507966 - RNA, 12 nt, Human
cucauguucuua

SEQ ID NO: 1507967 - RNA, 12 nt, Human
cucaucuuucuu

SEQ ID NO: 1507968 - RNA, 13 nt, Human
cucaucuuucuug

SEQ ID NO: 1507969 - RNA, 15 nt, Human
cucaucuuucuugau

SEQ ID NO: 1507970 - RNA, 20 nt, Human
cucagucuggcccuuccuuu

SEQ ID NO: 1507971 - RNA, 13 nt, Human
cucagugccacua

SEQ ID NO: 1507972 - RNA, 17 nt, Human
cucagucuggcccuucc

SEQ ID NO: 1507973 - RNA, 18 nt, Human
cucagucuggcccuuccu

SEQ ID NO: 1507974 - RNA, 22 nt, Human
cucagccucccaaagugcuggg

SEQ ID NO: 1507975 - RNA, 13 nt, Human
cucagccucccga

SEQ ID NO: 1507976 - RNA, 21 nt, Human
cucagccucccaaagugcugg

SEQ ID NO: 1507977 - RNA, 14 nt, Human
cucagccucccaaa

SEQ ID NO: 1507978 - RNA, 16 nt, Human
cucagccucccaaagu

SEQ ID NO: 1507979 - RNA, 13 nt, Human
cucagccucccaa

SEQ ID NO: 1507980 - RNA, 13 nt, Human
cucaggccagcug

SEQ ID NO: 1507981 - RNA, 13 nt, Human
cucagcggggaca

SEQ ID NO: 1507982 - RNA, 14 nt, Human
cucaggccagcugc

SEQ ID NO: 1507983 - RNA, 15 nt, Human
cucaggccagcugcu

SEQ ID NO: 1507984 - RNA, 21 nt, Human
cucaggccagcugcuugggcu

SEQ ID NO: 1507985 - RNA, 22 nt, Human
cucaggccagcugcuugggcuu

SEQ ID NO: 1507986 - RNA, 14 nt, Human
cucaggccuggggg

SEQ ID NO: 1507987 - RNA, 20 nt, Human
cucaggccugggggcugggc

SEQ ID NO: 1507988 - RNA, 22 nt, Human
cucaggccugggggcugggcag

SEQ ID NO: 1507989 - RNA, 21 nt, Human
cucaggccugggggcugggca

SEQ ID NO: 1507990 - RNA, 11 nt, Human
cuccaggugca

SEQ ID NO: 1507991 - RNA, 16 nt, Human
cuccaagaccuucucc

SEQ ID NO: 1507992 - RNA, 17 nt, Human
cuccaagaccuucuccu

SEQ ID NO: 1507993 - RNA, 18 nt, Human
cuccaagaccuucuccuu

SEQ ID NO: 1507994 - RNA, 21 nt, Human
cuccaagaccuucuccuucac

SEQ ID NO: 1507995 - RNA, 22 nt, Human
cuccacuuucuagccagaggag

SEQ ID NO: 1507996 - RNA, 15 nt, Human
cuccagaauuuccca

SEQ ID NO: 1507997 - RNA, 18 nt, Human
cuccagaauuucccaaag

SEQ ID NO: 1507998 - RNA, 21 nt, Human
cuccagaauuucccaaagcag

SEQ ID NO: 1507999 - RNA, 17 nt, Human
cuccagacacaugucca

SEQ ID NO: 1508000 - RNA, 19 nt, Human
cuccagacacauguccaag

SEQ ID NO: 1508001 - RNA, 15 nt, Human
cuccccuccaaccug

SEQ ID NO: 1508002 - RNA, 12 nt, Human
cucccaccucag

SEQ ID NO: 1508003 - RNA, 13 nt, Human
cucccaccucagc

SEQ ID NO: 1508004 - RNA, 21 nt, Human
cuccagugagacagcucugca

SEQ ID NO: 1508005 - RNA, 19 nt, Human
cuccgcuuucuacccagcg

SEQ ID NO: 1508006 - RNA, 17 nt, Human
cuccgccuuaccaggag

SEQ ID NO: 1508007 - RNA, 20 nt, Human
cucuuagaugcaguucugaa

SEQ ID NO: 1508008 - RNA, 21 nt, Human
cucuuagaugcaguucugaag

SEQ ID NO: 1508009 - RNA, 16 nt, Human
cugaaaauuaacacug

SEQ ID NO: 1508010 - RNA, 17 nt, Human
cugaaaauuaacacugc

SEQ ID NO: 1508011 - RNA, 16 nt, Human
cugaaaauguaugugu

SEQ ID NO: 1508012 - RNA, 19 nt, Human
cugaaggacauugcggaca

SEQ ID NO: 1508013 - RNA, 20 nt, Human
cugaaggacauugcggacag

SEQ ID NO: 1508014 - RNA, 21 nt, Human
cugaaggacauugcggacagc

SEQ ID NO: 1508015 - RNA, 13 nt, Human
cugaaggccccgc

SEQ ID NO: 1508016 - RNA, 14 nt, Human
cugaaggccccgcc

SEQ ID NO: 1508017 - RNA, 17 nt, Human
cugaaggccccgcccag

SEQ ID NO: 1508018 - RNA, 18 nt, Human
cugaaggccccgcccagg

SEQ ID NO: 1508019 - RNA, 12 nt, Human
cugacagacaca

SEQ ID NO: 1508020 - RNA, 14 nt, Human
cugacagacacagg

SEQ ID NO: 1508021 - RNA, 15 nt, Human
cugacagacacaggc

SEQ ID NO: 1508022 - RNA, 18 nt, Human
cugacccaugcugcccug

SEQ ID NO: 1508023 - RNA, 17 nt, Human
cugacccaugcugcccu

SEQ ID NO: 1508024 - RNA, 19 nt, Human
cugacccaugcugcccugu

SEQ ID NO: 1508025 - RNA, 20 nt, Human
cugacccaugcugcccugug

SEQ ID NO: 1508026 - RNA, 15 nt, Human
cucuuagaugcaguu

SEQ ID NO: 1508027 - RNA, 17 nt, Human
cucuguacagagcccac

SEQ ID NO: 1508028 - RNA, 21 nt, Human
cucuguacagagcccacgccc

SEQ ID NO: 1508029 - RNA, 19 nt, Human
cucugguccauagagagca

SEQ ID NO: 1508030 - RNA, 16 nt, Human
cucugguccauagaga

SEQ ID NO: 1508031 - RNA, 18 nt, Human
cucugguccauagagagc

SEQ ID NO: 1508032 - RNA, 17 nt, Human
cucugcugacagacaca

SEQ ID NO: 1508033 - RNA, 18 nt, Human
cucugcugacagacacag

SEQ ID NO: 1508034 - RNA, 19 nt, Human
cucugcugacagacacagg

SEQ ID NO: 1508035 - RNA, 20 nt, Human
cucugcugacagacacaggc

SEQ ID NO: 1508036 - RNA, 14 nt, Human
cucugcacuccccu

SEQ ID NO: 1508037 - RNA, 19 nt, Human
cucugcagcaauaaagcag

SEQ ID NO: 1508038 - RNA, 18 nt, Human
cucugcagcaauaaagca

SEQ ID NO: 1508039 - RNA, 23 nt, Human
cucugcagcaauaaagcagcguu

SEQ ID NO: 1508040 - RNA, 19 nt, Human
cucugcgucgguccuggug

SEQ ID NO: 1508041 - RNA, 20 nt, Human
cucugcgucgguccuggugc

SEQ ID NO: 1508042 - RNA, 21 nt, Human
cucugcgucgguccuggugcc

SEQ ID NO: 1508043 - RNA, 22 nt, Human
cucugcgucgguccuggugccc

SEQ ID NO: 1508044 - RNA, 21 nt, Human
cucucacuuguuuuauuuaac

SEQ ID NO: 1508045 - RNA, 15 nt, Human
cucucacuccuugaa

SEQ ID NO: 1508046 - RNA, 19 nt, Human
cucucagauuguaccauug

SEQ ID NO: 1508047 - RNA, 12 nt, Human
cucucacuccuu

SEQ ID NO: 1508048 - RNA, 14 nt, Human
cucucacuccuuga

SEQ ID NO: 1508049 - RNA, 15 nt, Human
cucuccccaugaugu

SEQ ID NO: 1508050 - RNA, 13 nt, Human
cucucuggccuuc

SEQ ID NO: 1508051 - RNA, 15 nt, Human
cucugaaggacauug

SEQ ID NO: 1508052 - RNA, 12 nt, Human
cucucuggccuu

SEQ ID NO: 1508053 - RNA, 11 nt, Human
cucucuggccu

SEQ ID NO: 1508054 - RNA, 12 nt, Human
cucuccuccaga

SEQ ID NO: 1508055 - RNA, 20 nt, Human
cuccgcuuucuacccagcga

SEQ ID NO: 1508056 - RNA, 22 nt, Human
augucuauaaaccgaacugaug

SEQ ID NO: 1508057 - RNA, 16 nt, Human
auguccacugguucuu

SEQ ID NO: 1508058 - RNA, 21 nt, Human
augucagugugacugaucucu

SEQ ID NO: 1508059 - RNA, 16 nt, Human
augucagugugacuga

SEQ ID NO: 1508060 - RNA, 19 nt, Human
auguccaagaagcccagga

SEQ ID NO: 1508061 - RNA, 23 nt, Human
auguccaagaagcccaggaaagg

SEQ ID NO: 1508062 - RNA, 14 nt, Human
auguauaauauuuu

SEQ ID NO: 1508063 - RNA, 15 nt, Human
auguaucaaugagua

SEQ ID NO: 1508064 - RNA, 22 nt, Human
uuugggggaaaauuuagaaaua

SEQ ID NO: 1508065 - RNA, 15 nt, Human
auguaucugagcagg

SEQ ID NO: 1508066 - RNA, 12 nt, Human
auguauguguaa

SEQ ID NO: 1508067 - RNA, 15 nt, Human
auguauguguaagua

SEQ ID NO: 1508068 - RNA, 11 nt, Human
uuugcucaugg

SEQ ID NO: 1508069 - RNA, 12 nt, Human
uuugcucaugga

SEQ ID NO: 1508070 - RNA, 15 nt, Human
auggcuauaggugcu

SEQ ID NO: 1508071 - RNA, 13 nt, Human
uuugcucauggaa

SEQ ID NO: 1508072 - RNA, 14 nt, Human
uuuggggauauuuu

SEQ ID NO: 1508073 - RNA, 22 nt, Human
uuugggaggccaaggugggagg

SEQ ID NO: 1508074 - RNA, 17 nt, Human
uuuguagaagucacauu

SEQ ID NO: 1508075 - RNA, 17 nt, Human
uuuguagcacugacaga

SEQ ID NO: 1508076 - RNA, 19 nt, Human
uuuguagcacugacagauu

SEQ ID NO: 1508077 - RNA, 14 nt, Human
uuuguuugaacuga

SEQ ID NO: 1508078 - RNA, 13 nt, Human
uuuguuugaacug

SEQ ID NO: 1508079 - RNA, 12 nt, Human
uuuguuugaacu

SEQ ID NO: 1508080 - RNA, 15 nt, Human
uuugugauacaaugc

SEQ ID NO: 1508081 - RNA, 18 nt, Human
uuugugaggaagccgcug

SEQ ID NO: 1508082 - RNA, 19 nt, Human
uuugugaggaagccgcugg

SEQ ID NO: 1508083 - RNA, 13 nt, Human
uuuguagagccag

SEQ ID NO: 1508084 - RNA, 15 nt, Human
uuuuaagugcugcau

SEQ ID NO: 1508085 - RNA, 11 nt, Human
uuuuaagaaau

SEQ ID NO: 1508086 - RNA, 15 nt, Human
uuuuaagaggcaggg

SEQ ID NO: 1508087 - RNA, 16 nt, Human
uuuuaagaggcagggu

SEQ ID NO: 1508088 - RNA, 13 nt, Human
uuuuaacucaaua

SEQ ID NO: 1508089 - RNA, 14 nt, Human
uuuuaaaagaauga

SEQ ID NO: 1508090 - RNA, 15 nt, Human
uuuuaaaagaaugau

SEQ ID NO: 1508091 - RNA, 13 nt, Human
uuuuaaaaaagaa

SEQ ID NO: 1508092 - RNA, 13 nt, Human
uuuguuugugcau

SEQ ID NO: 1508093 - RNA, 18 nt, Human
uuuguuugaacugauaaa

SEQ ID NO: 1508094 - RNA, 18 nt, Human
auguuucaaacauauaua

SEQ ID NO: 1508095 - RNA, 21 nt, Human
auguuucaaacauauauaaca

SEQ ID NO: 1508096 - RNA, 14 nt, Human
auguuuuccaugag

SEQ ID NO: 1508097 - RNA, 15 nt, Human
auguugugauguauu

SEQ ID NO: 1508098 - RNA, 16 nt, Human
auuaaaagaauauuuu

SEQ ID NO: 1508099 - RNA, 17 nt, Human
auguuuuucuucucccu

SEQ ID NO: 1508100 - RNA, 17 nt, Human
auguuuuuguguauuug

SEQ ID NO: 1508101 - RNA, 20 nt, Human
auuaaaaaaucaguuguaca

SEQ ID NO: 1508102 - RNA, 18 nt, Human
auguuuuucuucucccuc

SEQ ID NO: 1508103 - RNA, 23 nt, Human
auuaacuuuuauaaacuuuaccu

SEQ ID NO: 1508104 - RNA, 13 nt, Human
auuaagaaagacu

SEQ ID NO: 1508105 - RNA, 14 nt, Human
auuaagaaagacua

SEQ ID NO: 1508106 - RNA, 12 nt, Human
auuaacuuuuau

SEQ ID NO: 1508107 - RNA, 20 nt, Human
auuaacuuuuauaaacuuua

SEQ ID NO: 1508108 - RNA, 19 nt, Human
auuaacuuuuauaaacuuu

SEQ ID NO: 1508109 - RNA, 17 nt, Human
auuaacuuuuauaaacu

SEQ ID NO: 1508110 - RNA, 16 nt, Human
auuaacuuuuauaaac

SEQ ID NO: 1508111 - RNA, 21 nt, Human
auuaaacuuaaucuaaaugga

SEQ ID NO: 1508112 - RNA, 19 nt, Human
auuaaacuuaaucuaaaug

SEQ ID NO: 1508113 - RNA, 17 nt, Human
auuaaacuuaaucuaaa

SEQ ID NO: 1508114 - RNA, 18 nt, Human
auuaaccacuucagcuga

SEQ ID NO: 1508115 - RNA, 20 nt, Human
auuaaccacuucagcugacu

SEQ ID NO: 1508116 - RNA, 17 nt, Human
auuaaccacuucagcug

SEQ ID NO: 1508117 - RNA, 19 nt, Human
uuuuccagguuuaagcugu

SEQ ID NO: 1508118 - RNA, 18 nt, Human
uuuuccaugaaaaugcaa

SEQ ID NO: 1508119 - RNA, 19 nt, Human
uuuuccaugaaaaugcaac

SEQ ID NO: 1508120 - RNA, 22 nt, Human
uuuuauggcacuaguauuucua

SEQ ID NO: 1508121 - RNA, 19 nt, Human
uuuuauggcacuaguauuu

SEQ ID NO: 1508122 - RNA, 23 nt, Human
uuuuauggaggcuuugcauagau

SEQ ID NO: 1508123 - RNA, 14 nt, Human
uuuuauaauuuugu

SEQ ID NO: 1508124 - RNA, 19 nt, Human
uuuuaugccuuuuauuucu

SEQ ID NO: 1508125 - RNA, 17 nt, Human
uuuuauaaacuuuaccu

SEQ ID NO: 1508126 - RNA, 14 nt, Human
uuuuauaaacuuua

SEQ ID NO: 1508127 - RNA, 19 nt, Human
uuuuauaaacuuuaccuuu

SEQ ID NO: 1508128 - RNA, 14 nt, Human
auguuggccaggcu

SEQ ID NO: 1508129 - RNA, 16 nt, Human
auguuggccaggcugg

SEQ ID NO: 1508130 - RNA, 13 nt, Human
uuuuauaaacuuu

SEQ ID NO: 1508131 - RNA, 12 nt, Human
uuuuauaaacuu

SEQ ID NO: 1508132 - RNA, 15 nt, Human
auguugacaugggac

SEQ ID NO: 1508133 - RNA, 21 nt, Human
auguucaucauccuaagcuau

SEQ ID NO: 1508134 - RNA, 19 nt, Human
auguucaucaaugaaugaa

SEQ ID NO: 1508135 - RNA, 21 nt, Human
uuuuaagugcugcauuuaaaa

SEQ ID NO: 1508136 - RNA, 17 nt, Human
uuuuaagugcugcauuu

SEQ ID NO: 1508137 - RNA, 16 nt, Human
uuuuaagugcugcauu

SEQ ID NO: 1508138 - RNA, 16 nt, Human
auuauauuuacaaaug

SEQ ID NO: 1508139 - RNA, 18 nt, Human
auuaucucaaaacugcac

SEQ ID NO: 1508140 - RNA, 23 nt, Human
auuaucucaaaacugcacuguca

SEQ ID NO: 1508141 - RNA, 17 nt, Human
auuauauuuacaaaugg

SEQ ID NO: 1508142 - RNA, 23 nt, Human
auuauuuauuaaaugcccagccc

SEQ ID NO: 1508143 - RNA, 20 nt, Human
auuauuaccuuacagaaguu

SEQ ID NO: 1508144 - RNA, 13 nt, Human
auuaaguaaugau

SEQ ID NO: 1508145 - RNA, 15 nt, Human
auuaaguaaugauaa

SEQ ID NO: 1508146 - RNA, 21 nt, Human
auuaaguaaugauaacuggaa

SEQ ID NO: 1508147 - RNA, 15 nt, Human
auuaauauauuucca

SEQ ID NO: 1508148 - RNA, 20 nt, Human
auuaauauggggaugcagca

SEQ ID NO: 1508149 - RNA, 23 nt, Human
uuuuuuaaaaaagaaacauuugg

SEQ ID NO: 1508150 - RNA, 20 nt, Human
auuaagagagucuauuuacg

SEQ ID NO: 1508151 - RNA, 13 nt, Human
auuacauuuguau

SEQ ID NO: 1508152 - RNA, 15 nt, Human
auuacauuuguauaa

SEQ ID NO: 1508153 - RNA, 16 nt, Human
auuacauuuguauaaa

SEQ ID NO: 1508154 - RNA, 19 nt, Human
auuaccacagacauacuaa

SEQ ID NO: 1508155 - RNA, 12 nt, Human
auuaccagggac

SEQ ID NO: 1508156 - RNA, 22 nt, Human
auuaccugaauuuuggcugugu

SEQ ID NO: 1508157 - RNA, 20 nt, Human
auuccacuuauaggaauuga

SEQ ID NO: 1508158 - RNA, 19 nt, Human
auuccccaggaggccagcc

SEQ ID NO: 1508159 - RNA, 20 nt, Human
auuccccagauugcaacagg

SEQ ID NO: 1508160 - RNA, 16 nt, Human
auuccccaggaggcca

SEQ ID NO: 1508161 - RNA, 14 nt, Human
auucaaacagucuc

SEQ ID NO: 1508162 - RNA, 15 nt, Human
auucaaacagucuca

SEQ ID NO: 1508163 - RNA, 21 nt, Human
auucaguuguuagugugucuu

SEQ ID NO: 1508164 - RNA, 23 nt, Human
auucaggaagcucagggccuggc

SEQ ID NO: 1508165 - RNA, 14 nt, Human
auucagcucugcaa

SEQ ID NO: 1508166 - RNA, 18 nt, Human
auucagcucugcaagaau

SEQ ID NO: 1508167 - RNA, 21 nt, Human
auucaggaagcucagggccug

SEQ ID NO: 1508168 - RNA, 22 nt, Human
auucaggaagcucagggccugg

SEQ ID NO: 1508169 - RNA, 16 nt, Human
auucaaacagucucag

SEQ ID NO: 1508170 - RNA, 17 nt, Human
auugaccugaggcccuu

SEQ ID NO: 1508171 - RNA, 13 nt, Human
auugaccugaggc

SEQ ID NO: 1508172 - RNA, 15 nt, Human
auugcaacaggcugg

SEQ ID NO: 1508173 - RNA, 18 nt, Human
auugacaggauuauugga

SEQ ID NO: 1508174 - RNA, 16 nt, Human
auugcaacaggcuggg

SEQ ID NO: 1508175 - RNA, 21 nt, Human
auugcaacaggcugggcuuca

SEQ ID NO: 1508176 - RNA, 16 nt, Human
auugcggacagccacg

SEQ ID NO: 1508177 - RNA, 18 nt, Human
auugcggacagccacggc

SEQ ID NO: 1508178 - RNA, 19 nt, Human
auugcggacagccacggcc

SEQ ID NO: 1508179 - RNA, 17 nt, Human
auugcccacgcuggagu

SEQ ID NO: 1508180 - RNA, 21 nt, Human
auugcccacgcuggagugcag

SEQ ID NO: 1508181 - RNA, 23 nt, Human
auugccauuucuuccacaagagc

SEQ ID NO: 1508182 - RNA, 19 nt, Human
auucucacagcuccaagaa

SEQ ID NO: 1508183 - RNA, 21 nt, Human
auucucacagcuccaagaauu

SEQ ID NO: 1508184 - RNA, 22 nt, Human
auucucacagcuccaagaauuu

SEQ ID NO: 1508185 - RNA, 14 nt, Human
auucucagaaucuc

SEQ ID NO: 1508186 - RNA, 13 nt, Human
auucuacuuugag

SEQ ID NO: 1508187 - RNA, 16 nt, Human
auucuacuuugagugc

SEQ ID NO: 1508188 - RNA, 18 nt, Human
auucucagaaucucaaau

SEQ ID NO: 1508189 - RNA, 20 nt, Human
auucucagaaucucaaauaa

SEQ ID NO: 1508190 - RNA, 13 nt, Human
auucuccaccugc

SEQ ID NO: 1508191 - RNA, 16 nt, Human
auucuccaccugccag

SEQ ID NO: 1508192 - RNA, 17 nt, Human
auucuccaccugccagg

SEQ ID NO: 1508193 - RNA, 20 nt, Human
auugacacuuaaaaaugguu

SEQ ID NO: 1508194 - RNA, 18 nt, Human
auucuccaccugccaggg

SEQ ID NO: 1508195 - RNA, 14 nt, Human
auugcuacuguccu

SEQ ID NO: 1508196 - RNA, 16 nt, Human
auuuaaccucuaaauu

SEQ ID NO: 1508197 - RNA, 18 nt, Human
auuuaaccucuaaauucu

SEQ ID NO: 1508198 - RNA, 19 nt, Human
auuuaauuuuuuugagaca

SEQ ID NO: 1508199 - RNA, 23 nt, Human
auuuaauuuuuuugagacagagu

SEQ ID NO: 1508200 - RNA, 16 nt, Human
auuuacaaaugggaaa

SEQ ID NO: 1508201 - RNA, 22 nt, Human
auuuacaacugggggaggguga

SEQ ID NO: 1508202 - RNA, 21 nt, Human
auuguuuggggaugagaaagg

SEQ ID NO: 1508203 - RNA, 19 nt, Human
auuuaaagcuuauuaaaac

SEQ ID NO: 1508204 - RNA, 16 nt, Human
auuuaacagaaaugua

SEQ ID NO: 1508205 - RNA, 19 nt, Human
auuuaacagaaauguacag

SEQ ID NO: 1508206 - RNA, 17 nt, Human
auuuaacagaaauguac

SEQ ID NO: 1508207 - RNA, 20 nt, Human
auuuaacagaaauguacagc

SEQ ID NO: 1508208 - RNA, 15 nt, Human
auuguauuacaaauc

SEQ ID NO: 1508209 - RNA, 14 nt, Human
auuguauuacaaau

SEQ ID NO: 1508210 - RNA, 13 nt, Human
auugugccccugc

SEQ ID NO: 1508211 - RNA, 21 nt, Human
auuggcucacacugagaaugu

SEQ ID NO: 1508212 - RNA, 21 nt, Human
auugcuaaucaccaaaggcuc

SEQ ID NO: 1508213 - RNA, 23 nt, Human
auuggcuuuggguugcaggaccu

SEQ ID NO: 1508214 - RNA, 13 nt, Human
auuuaaaagauac

SEQ ID NO: 1508215 - RNA, 23 nt, Human
auuuccugggagcuuuuguagaa

SEQ ID NO: 1508216 - RNA, 22 nt, Human
auuuccugggagcuuuuguaga

SEQ ID NO: 1508217 - RNA, 16 nt, Human
auuuauuauggcacau

SEQ ID NO: 1508218 - RNA, 14 nt, Human
auuuccugugucuu

SEQ ID NO: 1508219 - RNA, 13 nt, Human
auuucuaaaucuc

SEQ ID NO: 1508220 - RNA, 12 nt, Human
auuucuaaaucu

SEQ ID NO: 1508221 - RNA, 21 nt, Human
auuucuaaaucuccaaaauaa

SEQ ID NO: 1508222 - RNA, 22 nt, Human
auuuauuacuguaagaaaauau

SEQ ID NO: 1508223 - RNA, 20 nt, Human
auuuauuaaaugcccagccc

SEQ ID NO: 1508224 - RNA, 13 nt, Human
auuuauuauggca

SEQ ID NO: 1508225 - RNA, 22 nt, Human
auuuauuaaaugcccagccccu

SEQ ID NO: 1508226 - RNA, 18 nt, Human
auuuguaguguuggagaa

SEQ ID NO: 1508227 - RNA, 21 nt, Human
auuugguuuucacauuggaaa

SEQ ID NO: 1508228 - RNA, 22 nt, Human
auuugguuuucacauuggaaac

SEQ ID NO: 1508229 - RNA, 15 nt, Human
auuugguuuucacau

SEQ ID NO: 1508230 - RNA, 17 nt, Human
auuugguuuucacauug

SEQ ID NO: 1508231 - RNA, 20 nt, Human
auuuggugguuucagaaaug

SEQ ID NO: 1508232 - RNA, 18 nt, Human
auuuggugguuucagaaa

SEQ ID NO: 1508233 - RNA, 23 nt, Human
auuugguaaggggaauugaggac

SEQ ID NO: 1508234 - RNA, 17 nt, Human
auuuggugguuucagaa

SEQ ID NO: 1508235 - RNA, 20 nt, Human
auuuggagacacaacuauuu

SEQ ID NO: 1508236 - RNA, 12 nt, Human
auuuggggugga

SEQ ID NO: 1508237 - RNA, 21 nt, Human
auuuggagacacaacuauuuu

SEQ ID NO: 1508238 - RNA, 17 nt, Human
auuugagcagggcucag

SEQ ID NO: 1508239 - RNA, 23 nt, Human
auuugaggucuguucuuuccaaa

SEQ ID NO: 1508240 - RNA, 15 nt, Human
auuugaggucuguuc

SEQ ID NO: 1508241 - RNA, 20 nt, Human
auuucuuuugccguuauuaa

SEQ ID NO: 1508242 - RNA, 19 nt, Human
auuuguaguguuggagaag

SEQ ID NO: 1508243 - RNA, 15 nt, Human
auuuguaucacaaau

SEQ ID NO: 1508244 - RNA, 14 nt, Human
auuuuaauaauguu

SEQ ID NO: 1508245 - RNA, 15 nt, Human
auuuuaauaauguuu

SEQ ID NO: 1508246 - RNA, 16 nt, Human
auuuuaauaauguuuc

SEQ ID NO: 1508247 - RNA, 13 nt, Human
auuuuacauaaau

SEQ ID NO: 1508248 - RNA, 21 nt, Human
auuuuacuuuaaaaggagcca

SEQ ID NO: 1508249 - RNA, 13 nt, Human
auuuuauuaugca

SEQ ID NO: 1508250 - RNA, 15 nt, Human
auuuuauuaugcaug

SEQ ID NO: 1508251 - RNA, 14 nt, Human
auuuuauuaugcau

SEQ ID NO: 1508252 - RNA, 17 nt, Human
auuuuauuaugcaugaa

SEQ ID NO: 1508253 - RNA, 23 nt, Human
auuucuuuugccguuauuaaaaa

SEQ ID NO: 1508254 - RNA, 21 nt, Human
aucucauuuccaagcaaguau

SEQ ID NO: 1508255 - RNA, 18 nt, Human
aucucauaauuuauacag

SEQ ID NO: 1508256 - RNA, 17 nt, Human
aucucauaauuuauaca

SEQ ID NO: 1508257 - RNA, 23 nt, Human
aucucauuuccaagcaaguauua

SEQ ID NO: 1508258 - RNA, 13 nt, Human
aucuccaaaauaa

SEQ ID NO: 1508259 - RNA, 14 nt, Human
aucucccccagccc

SEQ ID NO: 1508260 - RNA, 13 nt, Human
aucucuuagcucc

SEQ ID NO: 1508261 - RNA, 16 nt, Human
aucucuuagcuccccu

SEQ ID NO: 1508262 - RNA, 18 nt, Human
aucucuuagcuccccucc

SEQ ID NO: 1508263 - RNA, 19 nt, Human
aucucuuagcuccccucca

SEQ ID NO: 1508264 - RNA, 12 nt, Human
aucucccccagc

SEQ ID NO: 1508265 - RNA, 13 nt, Human
aucucccccagcc

SEQ ID NO: 1508266 - RNA, 16 nt, Human
aucucacacaugagca

SEQ ID NO: 1508267 - RNA, 13 nt, Human
aucucaauauuuc

SEQ ID NO: 1508268 - RNA, 15 nt, Human
aucucacacaugagc

SEQ ID NO: 1508269 - RNA, 15 nt, Human
auccuaguuccacca

SEQ ID NO: 1508270 - RNA, 19 nt, Human
auccuaguuccaccaucaa

SEQ ID NO: 1508271 - RNA, 14 nt, Human
aucucagggccugg

SEQ ID NO: 1508272 - RNA, 14 nt, Human
uugcaccacugcac

SEQ ID NO: 1508273 - RNA, 12 nt, Human
uugcaugaggcu

SEQ ID NO: 1508274 - RNA, 15 nt, Human
uugauucagacagcu

SEQ ID NO: 1508275 - RNA, 16 nt, Human
uugauucagacagcug

SEQ ID NO: 1508276 - RNA, 22 nt, Human
aucucuuagcuccccuccaacc

SEQ ID NO: 1508277 - RNA, 23 nt, Human
aucucuuagcuccccuccaaccu

SEQ ID NO: 1508278 - RNA, 18 nt, Human
uugauggugguauguuuu

SEQ ID NO: 1508279 - RNA, 19 nt, Human
uugauggugguauguuuuc

SEQ ID NO: 1508280 - RNA, 11 nt, Human
uugauguguuu

SEQ ID NO: 1508281 - RNA, 20 nt, Human
uugauguguuuauuuauaga

SEQ ID NO: 1508282 - RNA, 14 nt, Human
uugauucagacagc

SEQ ID NO: 1508283 - RNA, 13 nt, Human
uugcccuguuaaa

SEQ ID NO: 1508284 - RNA, 13 nt, Human
uugccgucuaccu

SEQ ID NO: 1508285 - RNA, 14 nt, Human
uugccguuauuaaa

SEQ ID NO: 1508286 - RNA, 19 nt, Human
uugccgucuaccugagggg

SEQ ID NO: 1508287 - RNA, 15 nt, Human
uugccgucuaccuga

SEQ ID NO: 1508288 - RNA, 18 nt, Human
uugccgucuaccugaggg

SEQ ID NO: 1508289 - RNA, 18 nt, Human
aucuugaauuguaaggaa

SEQ ID NO: 1508290 - RNA, 19 nt, Human
aucuugcucugcugacaga

SEQ ID NO: 1508291 - RNA, 19 nt, Human
aucuggguucacugcaacc

SEQ ID NO: 1508292 - RNA, 16 nt, Human
augaagauacugaaau

SEQ ID NO: 1508293 - RNA, 17 nt, Human
augaagauacugaaaua

SEQ ID NO: 1508294 - RNA, 18 nt, Human
augaagauguagaggaga

SEQ ID NO: 1508295 - RNA, 13 nt, Human
augaaugaauggc

SEQ ID NO: 1508296 - RNA, 17 nt, Human
augaaauauuauguuaa

SEQ ID NO: 1508297 - RNA, 18 nt, Human
augaaauauuauguuaaa

SEQ ID NO: 1508298 - RNA, 20 nt, Human
augaaauauuauguuaaaac

SEQ ID NO: 1508299 - RNA, 15 nt, Human
augaaagggcccaga

SEQ ID NO: 1508300 - RNA, 15 nt, Human
augaagauacugaaa

SEQ ID NO: 1508301 - RNA, 15 nt, Human
augaauuaaguuuuu

SEQ ID NO: 1508302 - RNA, 14 nt, Human
uuggggauauuuuu

SEQ ID NO: 1508303 - RNA, 22 nt, Human
uuggggggcugaggugggagga

SEQ ID NO: 1508304 - RNA, 22 nt, Human
uuggaugguguuacauauuaua

SEQ ID NO: 1508305 - RNA, 18 nt, Human
uuggcuagagguucaaag

SEQ ID NO: 1508306 - RNA, 23 nt, Human
uuggcgcugccccuggcagcccc

SEQ ID NO: 1508307 - RNA, 13 nt, Human
aucuuuuucuaac

SEQ ID NO: 1508308 - RNA, 12 nt, Human
augaaagauuca

SEQ ID NO: 1508309 - RNA, 15 nt, Human
augaaagcagggacu

SEQ ID NO: 1508310 - RNA, 13 nt, Human
uuggcugcaggga

SEQ ID NO: 1508311 - RNA, 16 nt, Human
uuguauaaaauaauuu

SEQ ID NO: 1508312 - RNA, 17 nt, Human
uuguauaaaauaauuuu

SEQ ID NO: 1508313 - RNA, 23 nt, Human
uuguaguguuggagaagaacuga

SEQ ID NO: 1508314 - RNA, 19 nt, Human
uuguauaaaauaauuuuua

SEQ ID NO: 1508315 - RNA, 22 nt, Human
augacacaugcaaggucauuuu

SEQ ID NO: 1508316 - RNA, 14 nt, Human
augacacaugcaag

SEQ ID NO: 1508317 - RNA, 16 nt, Human
uuguaucacaaaucuu

SEQ ID NO: 1508318 - RNA, 19 nt, Human
uuguaucacaaaucuuaac

SEQ ID NO: 1508319 - RNA, 13 nt, Human
augagagacacac

SEQ ID NO: 1508320 - RNA, 14 nt, Human
augagagacacacu

SEQ ID NO: 1508321 - RNA, 17 nt, Human
augagagacacacugaa

SEQ ID NO: 1508322 - RNA, 19 nt, Human
augagagacacacugaaga

SEQ ID NO: 1508323 - RNA, 21 nt, Human
augagaaagguugaagcacca

SEQ ID NO: 1508324 - RNA, 22 nt, Human
augagaaagguugaagcaccaa

SEQ ID NO: 1508325 - RNA, 14 nt, Human
augacuuacuguac

SEQ ID NO: 1508326 - RNA, 22 nt, Human
augacuuaagcacacuugacau

SEQ ID NO: 1508327 - RNA, 18 nt, Human
augacacgaauauugcug

SEQ ID NO: 1508328 - RNA, 17 nt, Human
augacuuacuguacaug

SEQ ID NO: 1508329 - RNA, 16 nt, Human
augacuuacuguacau

SEQ ID NO: 1508330 - RNA, 22 nt, Human
uuuagcuggaaaaguauguuag

SEQ ID NO: 1508331 - RNA, 13 nt, Human
uuuauauaagcuu

SEQ ID NO: 1508332 - RNA, 24 nt, Human
uuuauggcuuuugugcauuaucua

SEQ ID NO: 1508333 - RNA, 23 nt, Human
augcugucuacacuaagagagaa

SEQ ID NO: 1508334 - RNA, 22 nt, Human
augcugucuacacuaagagaga

SEQ ID NO: 1508335 - RNA, 23 nt, Human
augcugucccuuacgugaguccu

SEQ ID NO: 1508336 - RNA, 19 nt, Human
augcugucccuuacgugag

SEQ ID NO: 1508337 - RNA, 14 nt, Human
auggaacacucuga

SEQ ID NO: 1508338 - RNA, 15 nt, Human
auggaacacucugag

SEQ ID NO: 1508339 - RNA, 16 nt, Human
auggaacacucugaga

SEQ ID NO: 1508340 - RNA, 15 nt, Human
auggaagacagcucu

SEQ ID NO: 1508341 - RNA, 16 nt, Human
uuuauuacuguaagaa

SEQ ID NO: 1508342 - RNA, 16 nt, Human
augcuagaacucccuu

SEQ ID NO: 1508343 - RNA, 19 nt, Human
augcuagaacucccuuuca

SEQ ID NO: 1508344 - RNA, 15 nt, Human
augcuagaacucccu

SEQ ID NO: 1508345 - RNA, 15 nt, Human
augcucugcauguua

SEQ ID NO: 1508346 - RNA, 22 nt, Human
augcuguaacuuucugaaauaa

SEQ ID NO: 1508347 - RNA, 17 nt, Human
auggaauacucuuauau

SEQ ID NO: 1508348 - RNA, 16 nt, Human
auggaaugcuguguua

SEQ ID NO: 1508349 - RNA, 16 nt, Human
auggaauacucuuaua

SEQ ID NO: 1508350 - RNA, 16 nt, Human
auggaagacagcucuu

SEQ ID NO: 1508351 - RNA, 17 nt, Human
auggaaugcuguguuaa

SEQ ID NO: 1508352 - RNA, 22 nt, Human
uuucaucugcucuccuuccugg

SEQ ID NO: 1508353 - RNA, 19 nt, Human
auggacaugaucuucuuua

SEQ ID NO: 1508354 - RNA, 14 nt, Human
auggacaugaucuu

SEQ ID NO: 1508355 - RNA, 19 nt, Human
auggacagaagaaggcagc

SEQ ID NO: 1508356 - RNA, 20 nt, Human
auggacagaagaaggcagca

SEQ ID NO: 1508357 - RNA, 20 nt, Human
auggcuaguaucaaaagaaa

SEQ ID NO: 1508358 - RNA, 20 nt, Human
auggccuuugcuugaaagaa

SEQ ID NO: 1508359 - RNA, 14 nt, Human
auggccgggcaggg

SEQ ID NO: 1508360 - RNA, 21 nt, Human
auggccgggcgcgguggcuca

SEQ ID NO: 1508361 - RNA, 23 nt, Human
auggcacagcccaaagaaggaaa

SEQ ID NO: 1508362 - RNA, 23 nt, Human
auggcacaucagcacgauuucug

SEQ ID NO: 1508363 - RNA, 17 nt, Human
auggcacaucagcacga

SEQ ID NO: 1508364 - RNA, 19 nt, Human
auggacuaacuugucuuug

SEQ ID NO: 1508365 - RNA, 19 nt, Human
auggacguguuaugacucc

SEQ ID NO: 1508366 - RNA, 20 nt, Human
auggacguguuaugacucca

SEQ ID NO: 1508367 - RNA, 18 nt, Human
auggauuuccagccaaag

SEQ ID NO: 1508368 - RNA, 23 nt, Human
auggacguguuaugacuccagaa

SEQ ID NO: 1508369 - RNA, 12 nt, Human
augauucccagc

SEQ ID NO: 1508370 - RNA, 21 nt, Human
augauucaaaugucuauaaac

SEQ ID NO: 1508371 - RNA, 21 nt, Human
augauucaacagguuuuccug

SEQ ID NO: 1508372 - RNA, 15 nt, Human
uuguugucugcaacu

SEQ ID NO: 1508373 - RNA, 19 nt, Human
augauuaaccacuucagcu

SEQ ID NO: 1508374 - RNA, 22 nt, Human
augauuaugaauuacauuugua

SEQ ID NO: 1508375 - RNA, 20 nt, Human
augauuaaccacuucagcug

SEQ ID NO: 1508376 - RNA, 21 nt, Human
augauuaaccacuucagcuga

SEQ ID NO: 1508377 - RNA, 14 nt, Human
augcaacaacaugu

SEQ ID NO: 1508378 - RNA, 16 nt, Human
augcaacaacauguau

SEQ ID NO: 1508379 - RNA, 21 nt, Human
augcaacaacauguauaauau

SEQ ID NO: 1508380 - RNA, 13 nt, Human
augcaccagcccu

SEQ ID NO: 1508381 - RNA, 14 nt, Human
augcaccagcccuu

SEQ ID NO: 1508382 - RNA, 12 nt, Human
augcacuuuguu

SEQ ID NO: 1508383 - RNA, 20 nt, Human
augagagacacacugaagaa

SEQ ID NO: 1508384 - RNA, 21 nt, Human
augagagacacacugaagaag

SEQ ID NO: 1508385 - RNA, 23 nt, Human
augagagacacacugaagaagca

SEQ ID NO: 1508386 - RNA, 18 nt, Human
uugugauacaaugcugug

SEQ ID NO: 1508387 - RNA, 19 nt, Human
uugugauacaaugcugugc

SEQ ID NO: 1508388 - RNA, 23 nt, Human
uugugugaaagguacuucaaauc

SEQ ID NO: 1508389 - RNA, 13 nt, Human
uugugguuaaucu

SEQ ID NO: 1508390 - RNA, 17 nt, Human
uuguguguuuauuguca

SEQ ID NO: 1508391 - RNA, 20 nt, Human
uuguguuaaguauguguaaa

SEQ ID NO: 1508392 - RNA, 19 nt, Human
uuguucuggcucuuccagg

SEQ ID NO: 1508393 - RNA, 20 nt, Human
uuguucuggcucuuccaggc

SEQ ID NO: 1508394 - RNA, 22 nt, Human
uuguucuggcucuuccaggcug

SEQ ID NO: 1508395 - RNA, 14 nt, Human
uuguuuucauuauc

SEQ ID NO: 1508396 - RNA, 16 nt, Human
augcacuuuguucugg

SEQ ID NO: 1508397 - RNA, 15 nt, Human
augcacuuuguucug

SEQ ID NO: 1508398 - RNA, 13 nt, Human
uuguuuucagugu

SEQ ID NO: 1508399 - RNA, 16 nt, Human
uuguuuucaguguaca

SEQ ID NO: 1508400 - RNA, 16 nt, Human
uuuaagcaaguuaagu

SEQ ID NO: 1508401 - RNA, 17 nt, Human
uuuaagcaaguuaagug

SEQ ID NO: 1508402 - RNA, 16 nt, Human
uuuaagugcugcauuu

SEQ ID NO: 1508403 - RNA, 15 nt, Human
uuuaagugcugcauu

SEQ ID NO: 1508404 - RNA, 19 nt, Human
uuuaagugcugcauuuaaa

SEQ ID NO: 1508405 - RNA, 17 nt, Human
uuuaagugcugcauuua

SEQ ID NO: 1508406 - RNA, 18 nt, Human
augcaguucugaagaaga

SEQ ID NO: 1508407 - RNA, 19 nt, Human
augcaguucugaagaagau

SEQ ID NO: 1508408 - RNA, 11 nt, Human
augcccagccc

SEQ ID NO: 1508409 - RNA, 15 nt, Human
augccacuaaauuga

SEQ ID NO: 1508410 - RNA, 17 nt, Human
augccacuaaauugaca

SEQ ID NO: 1508411 - RNA, 15 nt, Human
augcaguucugaaga

SEQ ID NO: 1508412 - RNA, 17 nt, Human
augcaguucugaagaag

SEQ ID NO: 1508413 - RNA, 13 nt, Human
augcagugcuucc

SEQ ID NO: 1508414 - RNA, 17 nt, Human
augcagccucacagucc

SEQ ID NO: 1508415 - RNA, 14 nt, Human
augcagccucacag

SEQ ID NO: 1508416 - RNA, 15 nt, Human
augcagccucacagu

SEQ ID NO: 1508417 - RNA, 19 nt, Human
uuuaauuuuuuugagacag

SEQ ID NO: 1508418 - RNA, 13 nt, Human
augcagccucaca

SEQ ID NO: 1508419 - RNA, 21 nt, Human
uucuaaguaaaaccacagcag

SEQ ID NO: 1508420 - RNA, 14 nt, Human
uucuauaauuuaaa

SEQ ID NO: 1508421 - RNA, 13 nt, Human
uucuauaauuuaa

SEQ ID NO: 1508422 - RNA, 21 nt, Human
uucucacugccaugccagcuu

SEQ ID NO: 1508423 - RNA, 13 nt, Human
aucaggccaggcc

SEQ ID NO: 1508424 - RNA, 14 nt, Human
aucaggccaggccc

SEQ ID NO: 1508425 - RNA, 13 nt, Human
uucucagaaucuc

SEQ ID NO: 1508426 - RNA, 13 nt, Human
uucgcuccugugu

SEQ ID NO: 1508427 - RNA, 19 nt, Human
uucuaaaucuccaaaauaa

SEQ ID NO: 1508428 - RNA, 20 nt, Human
uucuaacaaaaaaauauauu

SEQ ID NO: 1508429 - RNA, 13 nt, Human
uucuaagaaguga

SEQ ID NO: 1508430 - RNA, 19 nt, Human
uucuaaguaaaaccacagc

SEQ ID NO: 1508431 - RNA, 20 nt, Human
uucuaaguaaaaccacagca

SEQ ID NO: 1508432 - RNA, 21 nt, Human
uucgcaggauucuuccucccu

SEQ ID NO: 1508433 - RNA, 21 nt, Human
uucgaugggcccaauucuuac

SEQ ID NO: 1508434 - RNA, 20 nt, Human
uucgaugggcccaauucuua

SEQ ID NO: 1508435 - RNA, 15 nt, Human
auauuuuacauaaau

SEQ ID NO: 1508436 - RNA, 16 nt, Human
auauuuuacauaaauu

SEQ ID NO: 1508437 - RNA, 20 nt, Human
auauuuuacauaaauuuagu

SEQ ID NO: 1508438 - RNA, 11 nt, Human
auauuuuaauu

SEQ ID NO: 1508439 - RNA, 15 nt, Human
uuccccuccuccacu

SEQ ID NO: 1508440 - RNA, 15 nt, Human
uucccuauuagagaa

SEQ ID NO: 1508441 - RNA, 18 nt, Human
uucccuuuuuuggcugcu

SEQ ID NO: 1508442 - RNA, 19 nt, Human
uucccuuuuuuggcugcug

SEQ ID NO: 1508443 - RNA, 20 nt, Human
uucccuuuuuuggcugcuga

SEQ ID NO: 1508444 - RNA, 16 nt, Human
auauuuuccaugaaaa

SEQ ID NO: 1508445 - RNA, 18 nt, Human
auauuuuccaugaaaaug

SEQ ID NO: 1508446 - RNA, 14 nt, Human
aucaaguuauuuuu

SEQ ID NO: 1508447 - RNA, 22 nt, Human
aucaaccccuucgcuccugugu

SEQ ID NO: 1508448 - RNA, 19 nt, Human
aucaaccccuucgcuccug

SEQ ID NO: 1508449 - RNA, 20 nt, Human
aucaaccccuucgcuccugu

SEQ ID NO: 1508450 - RNA, 20 nt, Human
aucaaauaugcaaagcacug

SEQ ID NO: 1508451 - RNA, 15 nt, Human
auauuuuuaauuaaa

SEQ ID NO: 1508452 - RNA, 14 nt, Human
auccauacauuugu

SEQ ID NO: 1508453 - RNA, 20 nt, Human
uucuggcuaugcauuugaaa

SEQ ID NO: 1508454 - RNA, 18 nt, Human
uucuggcuaugcauuuga

SEQ ID NO: 1508455 - RNA, 14 nt, Human
uucugccgcagccc

SEQ ID NO: 1508456 - RNA, 15 nt, Human
uucugccgcagcccu

SEQ ID NO: 1508457 - RNA, 16 nt, Human
uucugccgcagcccug

SEQ ID NO: 1508458 - RNA, 15 nt, Human
uucuggcucuuccag

SEQ ID NO: 1508459 - RNA, 20 nt, Human
aucauuucugcaucagcugc

SEQ ID NO: 1508460 - RNA, 21 nt, Human
aucauugaaaucuuuuugcuu

SEQ ID NO: 1508461 - RNA, 21 nt, Human
aucaggccaggcccucugccc

SEQ ID NO: 1508462 - RNA, 22 nt, Human
aucaggccaggcccucugccca

SEQ ID NO: 1508463 - RNA, 23 nt, Human
aucaggccaggcccucugcccac

SEQ ID NO: 1508464 - RNA, 16 nt, Human
uucucuuuucaaaaca

SEQ ID NO: 1508465 - RNA, 17 nt, Human
uucucuacucuagggaa

SEQ ID NO: 1508466 - RNA, 19 nt, Human
uucugcagccacuauuguu

SEQ ID NO: 1508467 - RNA, 13 nt, Human
uucugccgcagcc

SEQ ID NO: 1508468 - RNA, 16 nt, Human
uucugacccaugcugc

SEQ ID NO: 1508469 - RNA, 14 nt, Human
uucugacccaugcu

SEQ ID NO: 1508470 - RNA, 18 nt, Human
uugaacccgggaggcaga

SEQ ID NO: 1508471 - RNA, 21 nt, Human
auccuaggcauuugcugaaua

SEQ ID NO: 1508472 - RNA, 13 nt, Human
auccuaguuccac

SEQ ID NO: 1508473 - RNA, 20 nt, Human
auccuagucacuaccuucau

SEQ ID NO: 1508474 - RNA, 19 nt, Human
uugaaauauugacuuuuua

SEQ ID NO: 1508475 - RNA, 20 nt, Human
uugaaauauaggaacuuaaa

SEQ ID NO: 1508476 - RNA, 11 nt, Human
uugaaaucuuu

SEQ ID NO: 1508477 - RNA, 13 nt, Human
uugaaauuuccua

SEQ ID NO: 1508478 - RNA, 21 nt, Human
uugaaauuuuuauuaaauuau

SEQ ID NO: 1508479 - RNA, 13 nt, Human
uucuugcaaagua

SEQ ID NO: 1508480 - RNA, 21 nt, Human
uucuugaucaacaucuuuucu

SEQ ID NO: 1508481 - RNA, 12 nt, Human
uucuugcaaagu

SEQ ID NO: 1508482 - RNA, 22 nt, Human
uucuuucuggcuaugcauuuga

SEQ ID NO: 1508483 - RNA, 17 nt, Human
uucuuaaacaaauguau

SEQ ID NO: 1508484 - RNA, 13 nt, Human
uucuuaauucuua

SEQ ID NO: 1508485 - RNA, 15 nt, Human
uucuuacaaacaugu

SEQ ID NO: 1508486 - RNA, 18 nt, Human
uucuguucuuucuggcua

SEQ ID NO: 1508487 - RNA, 21 nt, Human
uucuguuggccagugugacaa

SEQ ID NO: 1508488 - RNA, 20 nt, Human
uucuguuuuucuaggccugg

SEQ ID NO: 1508489 - RNA, 15 nt, Human
auagcuuuuuucucu

SEQ ID NO: 1508490 - RNA, 12 nt, Human
auaggaaaaacu

SEQ ID NO: 1508491 - RNA, 14 nt, Human
auaggaaaaacuga

SEQ ID NO: 1508492 - RNA, 16 nt, Human
auaggaaaaacugauu

SEQ ID NO: 1508493 - RNA, 17 nt, Human
auaggaaaaacugauuu

SEQ ID NO: 1508494 - RNA, 17 nt, Human
auaggcguaacuaauuu

SEQ ID NO: 1508495 - RNA, 20 nt, Human
uucacagaugggugcuugga

SEQ ID NO: 1508496 - RNA, 15 nt, Human
uucacaguucucucc

SEQ ID NO: 1508497 - RNA, 20 nt, Human
uucacaguucucuccuucuu

SEQ ID NO: 1508498 - RNA, 23 nt, Human
uucacaagacccaaaaggcagaa

SEQ ID NO: 1508499 - RNA, 18 nt, Human
uuauuuuuagacagaguc

SEQ ID NO: 1508500 - RNA, 17 nt, Human
uuauuuuuagacagagu

SEQ ID NO: 1508501 - RNA, 21 nt, Human
uuauuuuguucauacauauuu

SEQ ID NO: 1508502 - RNA, 18 nt, Human
uuaguuuugugaagguga

SEQ ID NO: 1508503 - RNA, 17 nt, Human
uuauuuuguucauacau

SEQ ID NO: 1508504 - RNA, 14 nt, Human
uucaaacauauaua

SEQ ID NO: 1508505 - RNA, 18 nt, Human
uucaaacagucucaggaa

SEQ ID NO: 1508506 - RNA, 17 nt, Human
uucaaaauaaaaaugag

SEQ ID NO: 1508507 - RNA, 21 nt, Human
uucaagcgauucuucugcuuc

SEQ ID NO: 1508508 - RNA, 21 nt, Human
auauauauuuuuuucugaaau

SEQ ID NO: 1508509 - RNA, 13 nt, Human
auauauauuuuaa

SEQ ID NO: 1508510 - RNA, 14 nt, Human
auauauaacaaugc

SEQ ID NO: 1508511 - RNA, 12 nt, Human
auauauaaccag

SEQ ID NO: 1508512 - RNA, 13 nt, Human
auauauaaccagu

SEQ ID NO: 1508513 - RNA, 13 nt, Human
auagucuuucagu

SEQ ID NO: 1508514 - RNA, 15 nt, Human
auaguggugugauuu

SEQ ID NO: 1508515 - RNA, 17 nt, Human
auaguggcuuaaaacaa

SEQ ID NO: 1508516 - RNA, 20 nt, Human
auaguuguaccgcaauguga

SEQ ID NO: 1508517 - RNA, 22 nt, Human
auaguuggcuaggaccccucca

SEQ ID NO: 1508518 - RNA, 22 nt, Human
auaguuaagcgugcauaaguua

SEQ ID NO: 1508519 - RNA, 20 nt, Human
auaguucccaggugauauuu

SEQ ID NO: 1508520 - RNA, 15 nt, Human
auauguggaguucau

SEQ ID NO: 1508521 - RNA, 16 nt, Human
auauguggaguucauc

SEQ ID NO: 1508522 - RNA, 18 nt, Human
uucauuuaggugaggaag

SEQ ID NO: 1508523 - RNA, 12 nt, Human
uuccaagagcug

SEQ ID NO: 1508524 - RNA, 13 nt, Human
uuccaagagcuga

SEQ ID NO: 1508525 - RNA, 15 nt, Human
uuccaaggguacuaa

SEQ ID NO: 1508526 - RNA, 17 nt, Human
uuccaaggguacuaagg

SEQ ID NO: 1508527 - RNA, 17 nt, Human
uuccaggggugggacac

SEQ ID NO: 1508528 - RNA, 19 nt, Human
uuccaccaucaagccacca

SEQ ID NO: 1508529 - RNA, 18 nt, Human
uucccaacuccagaaagu

SEQ ID NO: 1508530 - RNA, 12 nt, Human
uucccaaauuuc

SEQ ID NO: 1508531 - RNA, 13 nt, Human
uucccaagcucug

SEQ ID NO: 1508532 - RNA, 14 nt, Human
uucccaagcucugc

SEQ ID NO: 1508533 - RNA, 15 nt, Human
uucccaagcucugcu

SEQ ID NO: 1508534 - RNA, 16 nt, Human
uucccaagcucugcuc

SEQ ID NO: 1508535 - RNA, 12 nt, Human
uucccaccucuc

SEQ ID NO: 1508536 - RNA, 22 nt, Human
uucccaccucucucacuccuug

SEQ ID NO: 1508537 - RNA, 18 nt, Human
uucccaagcucugcuccu

SEQ ID NO: 1508538 - RNA, 23 nt, Human
uucccaaagcagugcaugcuguc

SEQ ID NO: 1508539 - RNA, 17 nt, Human
uuccagguuuaagcugu

SEQ ID NO: 1508540 - RNA, 13 nt, Human
uuccaggcuggga

SEQ ID NO: 1508541 - RNA, 21 nt, Human
uuccaggggugggacacccug

SEQ ID NO: 1508542 - RNA, 17 nt, Human
uuccagugaggcucugc

SEQ ID NO: 1508543 - RNA, 19 nt, Human
uuccagugaggcucugccc

SEQ ID NO: 1508544 - RNA, 20 nt, Human
uuccagugaggcucugcccu

SEQ ID NO: 1508545 - RNA, 21 nt, Human
uuccagugaggcucugcccuu

SEQ ID NO: 1508546 - RNA, 22 nt, Human
uuccagugaggcucugcccuug

SEQ ID NO: 1508547 - RNA, 14 nt, Human
auaucuaguaugaa

SEQ ID NO: 1508548 - RNA, 15 nt, Human
auaucuaguaugaaa

SEQ ID NO: 1508549 - RNA, 17 nt, Human
auaucuaguaugaaauu

SEQ ID NO: 1508550 - RNA, 19 nt, Human
auaucuccgucaacucaua

SEQ ID NO: 1508551 - RNA, 20 nt, Human
auaucuccgucaacucauau

SEQ ID NO: 1508552 - RNA, 21 nt, Human
auaucuccgucaacucauauu

SEQ ID NO: 1508553 - RNA, 16 nt, Human
auaucugaaaauguau

SEQ ID NO: 1508554 - RNA, 17 nt, Human
auaucugaaaauguaug

SEQ ID NO: 1508555 - RNA, 20 nt, Human
auaucugaaaauguaugugu

SEQ ID NO: 1508556 - RNA, 13 nt, Human
auaucuuguagcu

SEQ ID NO: 1508557 - RNA, 17 nt, Human
auauguaacaagccacc

SEQ ID NO: 1508558 - RNA, 16 nt, Human
auauguaacaagccac

SEQ ID NO: 1508559 - RNA, 22 nt, Human
auaugcacacauuuuuuaaaug

SEQ ID NO: 1508560 - RNA, 16 nt, Human
auaugcacacauuuuu

SEQ ID NO: 1508561 - RNA, 15 nt, Human
auaugcacacauuuu

SEQ ID NO: 1508562 - RNA, 14 nt, Human
auaugcacacauuu

SEQ ID NO: 1508563 - RNA, 18 nt, Human
uucagugccuuauggaac

SEQ ID NO: 1508564 - RNA, 12 nt, Human
uucauacauauu

SEQ ID NO: 1508565 - RNA, 23 nt, Human
uucauacauauuuuuguagcacu

SEQ ID NO: 1508566 - RNA, 13 nt, Human
uucauacauugua

SEQ ID NO: 1508567 - RNA, 19 nt, Human
uucauacauuguacgaaga

SEQ ID NO: 1508568 - RNA, 13 nt, Human
uucagaaaugugu

SEQ ID NO: 1508569 - RNA, 11 nt, Human
uucagaaaugu

SEQ ID NO: 1508570 - RNA, 12 nt, Human
uucagugccuua

SEQ ID NO: 1508571 - RNA, 13 nt, Human
uucagugccuuau

SEQ ID NO: 1508572 - RNA, 13 nt, Human
auauauuuaauga

SEQ ID NO: 1508573 - RNA, 15 nt, Human
auauauuuaaugaua

SEQ ID NO: 1508574 - RNA, 21 nt, Human
uucaucccucuggggcuguuc

SEQ ID NO: 1508575 - RNA, 17 nt, Human
uucaucccucuggggcu

SEQ ID NO: 1508576 - RNA, 20 nt, Human
uuagggaaggauacaaaagc

SEQ ID NO: 1508577 - RNA, 21 nt, Human
uuagggacaggaccccagcuc

SEQ ID NO: 1508578 - RNA, 22 nt, Human
uuagggacaggaccccagcucu

SEQ ID NO: 1508579 - RNA, 14 nt, Human
uuagggagagaaga

SEQ ID NO: 1508580 - RNA, 16 nt, Human
uuaggugugacugaau

SEQ ID NO: 1508581 - RNA, 16 nt, Human
uuaggugaggaagcaa

SEQ ID NO: 1508582 - RNA, 21 nt, Human
uuaggugugacugaauuucuu

SEQ ID NO: 1508583 - RNA, 15 nt, Human
uuaguuucuccaagc

SEQ ID NO: 1508584 - RNA, 22 nt, Human
uuaguuugcaguuacacuaaaa

SEQ ID NO: 1508585 - RNA, 14 nt, Human
uuagcggagacgga

SEQ ID NO: 1508586 - RNA, 18 nt, Human
uuagccaagugugguaga

SEQ ID NO: 1508587 - RNA, 18 nt, Human
auaauuuaccugaagucu

SEQ ID NO: 1508588 - RNA, 18 nt, Human
uuagcaaauucuguuuuu

SEQ ID NO: 1508589 - RNA, 12 nt, Human
auaauacaccac

SEQ ID NO: 1508590 - RNA, 20 nt, Human
auaauacaccacuacauucu

SEQ ID NO: 1508591 - RNA, 18 nt, Human
auaauacaccacuacauu

SEQ ID NO: 1508592 - RNA, 21 nt, Human
auaauacaccacuacauucug

SEQ ID NO: 1508593 - RNA, 14 nt, Human
uuagacagucccug

SEQ ID NO: 1508594 - RNA, 18 nt, Human
auaauccuaaacauauga

SEQ ID NO: 1508595 - RNA, 20 nt, Human
auaaucccuggaugauauuu

SEQ ID NO: 1508596 - RNA, 21 nt, Human
auaaucccuggaugauauuuu

SEQ ID NO: 1508597 - RNA, 20 nt, Human
auaaugcgugcauaccacuu

SEQ ID NO: 1508598 - RNA, 15 nt, Human
auaaugcgugcauac

SEQ ID NO: 1508599 - RNA, 15 nt, Human
auaaugaaugaaaca

SEQ ID NO: 1508600 - RNA, 22 nt, Human
auaauugacaggauuauuggaa

SEQ ID NO: 1508601 - RNA, 14 nt, Human
auaaauaaaaauaa

SEQ ID NO: 1508602 - RNA, 15 nt, Human
auaaauaguuuauga

SEQ ID NO: 1508603 - RNA, 18 nt, Human
auaaauauuuuugccaua

SEQ ID NO: 1508604 - RNA, 13 nt, Human
auaaauaaaaaua

SEQ ID NO: 1508605 - RNA, 22 nt, Human
auaacgauaaaagacagugaaa

SEQ ID NO: 1508606 - RNA, 16 nt, Human
auaacuaaaagguaug

SEQ ID NO: 1508607 - RNA, 13 nt, Human
auaacugugaagu

SEQ ID NO: 1508608 - RNA, 11 nt, Human
auaaauuauuu

SEQ ID NO: 1508609 - RNA, 16 nt, Human
auaaccaucugaaagu

SEQ ID NO: 1508610 - RNA, 19 nt, Human
uuacccucauguucuuaau

SEQ ID NO: 1508611 - RNA, 16 nt, Human
uuacaggcacuaaagu

SEQ ID NO: 1508612 - RNA, 20 nt, Human
uuagacagagucucacuguu

SEQ ID NO: 1508613 - RNA, 13 nt, Human
uuagacagucccu

SEQ ID NO: 1508614 - RNA, 13 nt, Human
uguuucaaacaua

SEQ ID NO: 1508615 - RNA, 23 nt, Human
aguugccagucaccccggccacc

SEQ ID NO: 1508616 - RNA, 17 nt, Human
aguuggguggaugccug

SEQ ID NO: 1508617 - RNA, 19 nt, Human
aguugggcuuccucauagu

SEQ ID NO: 1508618 - RNA, 14 nt, Human
aguuuaaauuguaa

SEQ ID NO: 1508619 - RNA, 17 nt, Human
aguuggucccccuucca

SEQ ID NO: 1508620 - RNA, 11 nt, Human
aguuggucccc

SEQ ID NO: 1508621 - RNA, 13 nt, Human
aguuggucccccu

SEQ ID NO: 1508622 - RNA, 13 nt, Human
uuaaaaaaaaucc

SEQ ID NO: 1508623 - RNA, 13 nt, Human
aguuuacauugua

SEQ ID NO: 1508624 - RNA, 20 nt, Human
uuaacagaaauguacagcaa

SEQ ID NO: 1508625 - RNA, 19 nt, Human
uuaacacugcuuguguuuu

SEQ ID NO: 1508626 - RNA, 19 nt, Human
uuaacagaaauguacagca

SEQ ID NO: 1508627 - RNA, 18 nt, Human
uuaaauaaugugaaacug

SEQ ID NO: 1508628 - RNA, 16 nt, Human
uuaaauaaugugaaac

SEQ ID NO: 1508629 - RNA, 19 nt, Human
uuaaauaaugugaaacugg

SEQ ID NO: 1508630 - RNA, 22 nt, Human
uuaaacaaauguaugauuacau

SEQ ID NO: 1508631 - RNA, 17 nt, Human
uuaaaaaucucaaauuu

SEQ ID NO: 1508632 - RNA, 16 nt, Human
uuaaaaaucucaaauu

SEQ ID NO: 1508633 - RNA, 15 nt, Human
uuaaaaaucucaaau

SEQ ID NO: 1508634 - RNA, 14 nt, Human
uuaaaaaucucaaa

SEQ ID NO: 1508635 - RNA, 15 nt, Human
uuaaauaaugugaaa

SEQ ID NO: 1508636 - RNA, 12 nt, Human
auaaaauaauuu

SEQ ID NO: 1508637 - RNA, 15 nt, Human
auaaaauaauuuuua

SEQ ID NO: 1508638 - RNA, 21 nt, Human
uuaagaaaaaggaugcacaga

SEQ ID NO: 1508639 - RNA, 20 nt, Human
uuaagaaaaaggaugcacag

SEQ ID NO: 1508640 - RNA, 23 nt, Human
aguuuuuauggcuuuugugcauu

SEQ ID NO: 1508641 - RNA, 19 nt, Human
aguuuucugagaaagacua

SEQ ID NO: 1508642 - RNA, 23 nt, Human
aguuuucugagaaagacuauuca

SEQ ID NO: 1508643 - RNA, 9 nt, Human
uuaaggugg

SEQ ID NO: 1508644 - RNA, 20 nt, Human
uuaagaagacugcauuauau

SEQ ID NO: 1508645 - RNA, 22 nt, Human
uuaagaaagacuaucuaaaugu

SEQ ID NO: 1508646 - RNA, 14 nt, Human
uuaaguauguguaa

SEQ ID NO: 1508647 - RNA, 22 nt, Human
uuaagugcugcauuuaaaagau

SEQ ID NO: 1508648 - RNA, 19 nt, Human
uuaagugcugcauuuaaaa

SEQ ID NO: 1508649 - RNA, 16 nt, Human
uuaagugcugcauuua

SEQ ID NO: 1508650 - RNA, 15 nt, Human
uuaagugcugcauuu

SEQ ID NO: 1508651 - RNA, 22 nt, Human
uuaaucugguuuauuuuuguuc

SEQ ID NO: 1508652 - RNA, 18 nt, Human
uuaaugaaagacuguaca

SEQ ID NO: 1508653 - RNA, 19 nt, Human
uuaaugaaagacuguacaa

SEQ ID NO: 1508654 - RNA, 13 nt, Human
uuaaucauuaggu

SEQ ID NO: 1508655 - RNA, 23 nt, Human
uuaaucauuaggugugacugaau

SEQ ID NO: 1508656 - RNA, 22 nt, Human
uuaaucauuaggugugacugaa

SEQ ID NO: 1508657 - RNA, 23 nt, Human
aguguuggagaagaacugaaauc

SEQ ID NO: 1508658 - RNA, 17 nt, Human
aguguuggagaagaacu

SEQ ID NO: 1508659 - RNA, 18 nt, Human
aguguuggagaagaacug

SEQ ID NO: 1508660 - RNA, 14 nt, Human
aguguuggagaaga

SEQ ID NO: 1508661 - RNA, 16 nt, Human
aguguuggagaagaac

SEQ ID NO: 1508662 - RNA, 15 nt, Human
aguuagaacauuugc

SEQ ID NO: 1508663 - RNA, 20 nt, Human
uguucuugguuuguaaauua

SEQ ID NO: 1508664 - RNA, 22 nt, Human
uguucuugguuuguaaauuaac

SEQ ID NO: 1508665 - RNA, 19 nt, Human
uguucuuucacccuuuucu

SEQ ID NO: 1508666 - RNA, 13 nt, Human
uguugcccaggcu

SEQ ID NO: 1508667 - RNA, 15 nt, Human
uguugcccaggcugg

SEQ ID NO: 1508668 - RNA, 17 nt, Human
uguuccccuccuccacu

SEQ ID NO: 1508669 - RNA, 19 nt, Human
uguuccccuccuccacucu

SEQ ID NO: 1508670 - RNA, 12 nt, Human
uguuccccuccu

SEQ ID NO: 1508671 - RNA, 13 nt, Human
uguuccccuccuc

SEQ ID NO: 1508672 - RNA, 15 nt, Human
uguuccccuccucca

SEQ ID NO: 1508673 - RNA, 23 nt, Human
uguuccccuccuccacucucccc

SEQ ID NO: 1508674 - RNA, 18 nt, Human
uguucuagcauggcugcc

SEQ ID NO: 1508675 - RNA, 18 nt, Human
uguucuuaguuugcaguu

SEQ ID NO: 1508676 - RNA, 13 nt, Human
uguugucugcaac

SEQ ID NO: 1508677 - RNA, 16 nt, Human
uguugucugcaacucu

SEQ ID NO: 1508678 - RNA, 12 nt, Human
uguugugaaugu

SEQ ID NO: 1508679 - RNA, 13 nt, Human
uguugugaauguu

SEQ ID NO: 1508680 - RNA, 14 nt, Human
uguugugauguauu

SEQ ID NO: 1508681 - RNA, 20 nt, Human
uguugugauguauucuagcu

SEQ ID NO: 1508682 - RNA, 14 nt, Human
uguuuauugucaaa

SEQ ID NO: 1508683 - RNA, 17 nt, Human
uguuuauugucaaagug

SEQ ID NO: 1508684 - RNA, 20 nt, Human
aguucggugagcuacaaaug

SEQ ID NO: 1508685 - RNA, 15 nt, Human
aguucuacauaagua

SEQ ID NO: 1508686 - RNA, 19 nt, Human
aguucggugagcuacaaau

SEQ ID NO: 1508687 - RNA, 12 nt, Human
aguucucuccuu

SEQ ID NO: 1508688 - RNA, 23 nt, Human
aguuccucauuagcauuuugcua

SEQ ID NO: 1508689 - RNA, 16 nt, Human
aguucaauucucauuu

SEQ ID NO: 1508690 - RNA, 20 nt, Human
agugcugggauuacaagcgu

SEQ ID NO: 1508691 - RNA, 22 nt, Human
agugcugcauuuaaaagauaca

SEQ ID NO: 1508692 - RNA, 19 nt, Human
agugcugggauuacaggug

SEQ ID NO: 1508693 - RNA, 20 nt, Human
agugcugcauuuaaaagaua

SEQ ID NO: 1508694 - RNA, 17 nt, Human
agugccuuacacaaugg

SEQ ID NO: 1508695 - RNA, 21 nt, Human
agugccuguaaucacagcuac

SEQ ID NO: 1508696 - RNA, 15 nt, Human
agugccuuacacaau

SEQ ID NO: 1508697 - RNA, 14 nt, Human
ugugguuaaugcca

SEQ ID NO: 1508698 - RNA, 20 nt, Human
ugugguuaaugccauggaca

SEQ ID NO: 1508699 - RNA, 15 nt, Human
ugugguuaaugccau

SEQ ID NO: 1508700 - RNA, 12 nt, Human
ugugguuucauu

SEQ ID NO: 1508701 - RNA, 16 nt, Human
agugcuuccaaggaug

SEQ ID NO: 1508702 - RNA, 14 nt, Human
uguguuaugaagca

SEQ ID NO: 1508703 - RNA, 20 nt, Human
ugugucagguggggcagcuu

SEQ ID NO: 1508704 - RNA, 17 nt, Human
ugugucagguggggcag

SEQ ID NO: 1508705 - RNA, 19 nt, Human
ugugucagguggggcagcu

SEQ ID NO: 1508706 - RNA, 13 nt, Human
ugugucucuuggu

SEQ ID NO: 1508707 - RNA, 16 nt, Human
ugugucucuugguccu

SEQ ID NO: 1508708 - RNA, 13 nt, Human
uguguugugaaug

SEQ ID NO: 1508709 - RNA, 21 nt, Human
uguuaacauggacaugaucuu

SEQ ID NO: 1508710 - RNA, 11 nt, Human
aguggaaaaau

SEQ ID NO: 1508711 - RNA, 18 nt, Human
aguggaaaaauagccugc

SEQ ID NO: 1508712 - RNA, 19 nt, Human
aguggaaaaauagccugcc

SEQ ID NO: 1508713 - RNA, 19 nt, Human
uguuaaugauagcuacugu

SEQ ID NO: 1508714 - RNA, 17 nt, Human
uguuaaugguuugaaua

SEQ ID NO: 1508715 - RNA, 14 nt, Human
agugcacuaaugug

SEQ ID NO: 1508716 - RNA, 16 nt, Human
agugccaaaaacaaca

SEQ ID NO: 1508717 - RNA, 14 nt, Human
agugcaugcugucc

SEQ ID NO: 1508718 - RNA, 14 nt, Human
agugcccacaggau

SEQ ID NO: 1508719 - RNA, 22 nt, Human
agugcaaauugucacaggacag

SEQ ID NO: 1508720 - RNA, 18 nt, Human
agugcaaauugucacagg

SEQ ID NO: 1508721 - RNA, 21 nt, Human
agugcaaauugucacaggaca

SEQ ID NO: 1508722 - RNA, 21 nt, Human
agugaguugauagcacagacc

SEQ ID NO: 1508723 - RNA, 16 nt, Human
agugagucgaggacag

SEQ ID NO: 1508724 - RNA, 22 nt, Human
agugauucuccugccucagccu

SEQ ID NO: 1508725 - RNA, 24 nt, Human
agugauucuccugccucagccucc

SEQ ID NO: 1508726 - RNA, 16 nt, Human
ugugcucuggacaggc

SEQ ID NO: 1508727 - RNA, 18 nt, Human
ugugcucuggacaggcau

SEQ ID NO: 1508728 - RNA, 19 nt, Human
ugugcucuggacaggcaug

SEQ ID NO: 1508729 - RNA, 13 nt, Human
ugugcugcccugc

SEQ ID NO: 1508730 - RNA, 14 nt, Human
ugugcugcccugcc

SEQ ID NO: 1508731 - RNA, 15 nt, Human
ugugcugcccugccc

SEQ ID NO: 1508732 - RNA, 21 nt, Human
agucucacuguugcccaggcu

SEQ ID NO: 1508733 - RNA, 20 nt, Human
agucucacuguugcccaggc

SEQ ID NO: 1508734 - RNA, 18 nt, Human
agucucacuguugcccag

SEQ ID NO: 1508735 - RNA, 19 nt, Human
agucucacuguugcccagg

SEQ ID NO: 1508736 - RNA, 21 nt, Human
ugugcccuaaaguguauuuuu

SEQ ID NO: 1508737 - RNA, 20 nt, Human
ugugcccuaaaguguauuuu

SEQ ID NO: 1508738 - RNA, 22 nt, Human
ugugcucugaucauccacugug

SEQ ID NO: 1508739 - RNA, 23 nt, Human
ugugcucugaucauccacugugc

SEQ ID NO: 1508740 - RNA, 15 nt, Human
ugugcucuggacagg

SEQ ID NO: 1508741 - RNA, 17 nt, Human
uguaagaaaauaucacu

SEQ ID NO: 1508742 - RNA, 19 nt, Human
uguaagaacuacaaacaaa

SEQ ID NO: 1508743 - RNA, 17 nt, Human
uguaacuuucugaaaua

SEQ ID NO: 1508744 - RNA, 14 nt, Human
agguuggugggggc

SEQ ID NO: 1508745 - RNA, 17 nt, Human
aggugguuauggagagg

SEQ ID NO: 1508746 - RNA, 14 nt, Human
agguugcagugagc

SEQ ID NO: 1508747 - RNA, 15 nt, Human
uguaaguaaacgguc

SEQ ID NO: 1508748 - RNA, 22 nt, Human
uguaagcucuacugaggugcua

SEQ ID NO: 1508749 - RNA, 23 nt, Human
aggucuugaacuccuggccucaa

SEQ ID NO: 1508750 - RNA, 15 nt, Human
aggugcacaagcucc

SEQ ID NO: 1508751 - RNA, 16 nt, Human
aggugcacaagcucca

SEQ ID NO: 1508752 - RNA, 17 nt, Human
aggugcacaagcuccaa

SEQ ID NO: 1508753 - RNA, 18 nt, Human
aggugcacaagcuccaag

SEQ ID NO: 1508754 - RNA, 20 nt, Human
aggugcacaagcuccaagcu

SEQ ID NO: 1508755 - RNA, 20 nt, Human
aggugggauccuccaggugc

SEQ ID NO: 1508756 - RNA, 21 nt, Human
aggugcacaagcuccaagcuc

SEQ ID NO: 1508757 - RNA, 20 nt, Human
aguaauaugcacacauuuuu

SEQ ID NO: 1508758 - RNA, 19 nt, Human
aguaauaugcacacauuuu

SEQ ID NO: 1508759 - RNA, 18 nt, Human
aguaauaugcacacauuu

SEQ ID NO: 1508760 - RNA, 15 nt, Human
aguaaaaccacagca

SEQ ID NO: 1508761 - RNA, 11 nt, Human
agguuuuccug

SEQ ID NO: 1508762 - RNA, 14 nt, Human
uguaauuugugaua

SEQ ID NO: 1508763 - RNA, 18 nt, Human
uguagaggagaaacugga

SEQ ID NO: 1508764 - RNA, 13 nt, Human
uguagagugggag

SEQ ID NO: 1508765 - RNA, 14 nt, Human
uguagagugggagc

SEQ ID NO: 1508766 - RNA, 19 nt, Human
aguacaccacaagggucac

SEQ ID NO: 1508767 - RNA, 20 nt, Human
aguagaaagacagagcuggg

SEQ ID NO: 1508768 - RNA, 21 nt, Human
aguagaaagacagagcuggga

SEQ ID NO: 1508769 - RNA, 14 nt, Human
aguacacuguuuca

SEQ ID NO: 1508770 - RNA, 20 nt, Human
aguacacuguuucaaacuuu

SEQ ID NO: 1508771 - RNA, 16 nt, Human
aguacacuguuucaaa

SEQ ID NO: 1508772 - RNA, 17 nt, Human
aguagaagucuuagaug

SEQ ID NO: 1508773 - RNA, 13 nt, Human
aguagaacagaua

SEQ ID NO: 1508774 - RNA, 19 nt, Human
aguagaacagauaaucagu

SEQ ID NO: 1508775 - RNA, 12 nt, Human
aguagagacagg

SEQ ID NO: 1508776 - RNA, 19 nt, Human
aguagauaggccaugggca

SEQ ID NO: 1508777 - RNA, 20 nt, Human
uguaggaagguuaauguuca

SEQ ID NO: 1508778 - RNA, 13 nt, Human
aguauuucuauga

SEQ ID NO: 1508779 - RNA, 15 nt, Human
aguauuucuaugaaa

SEQ ID NO: 1508780 - RNA, 14 nt, Human
aguauguguaaaau

SEQ ID NO: 1508781 - RNA, 22 nt, Human
aguauuucuaugaaauauuaug

SEQ ID NO: 1508782 - RNA, 16 nt, Human
aguauuugagaguucu

SEQ ID NO: 1508783 - RNA, 19 nt, Human
agucacauuccugaacagg

SEQ ID NO: 1508784 - RNA, 18 nt, Human
agucacauuccugaacag

SEQ ID NO: 1508785 - RNA, 20 nt, Human
agucacauuccugaacagga

SEQ ID NO: 1508786 - RNA, 13 nt, Human
agucaccaagccc

SEQ ID NO: 1508787 - RNA, 14 nt, Human
agucaccaagccca

SEQ ID NO: 1508788 - RNA, 19 nt, Human
agucacugagacagcccgg

SEQ ID NO: 1508789 - RNA, 16 nt, Human
ugucagcugaaccugg

SEQ ID NO: 1508790 - RNA, 19 nt, Human
ugucagcugaaccugggua

SEQ ID NO: 1508791 - RNA, 16 nt, Human
ugucagguggggcagc

SEQ ID NO: 1508792 - RNA, 21 nt, Human
ugucaauaaaauccauacauu

SEQ ID NO: 1508793 - RNA, 17 nt, Human
ugucaagagucgcugug

SEQ ID NO: 1508794 - RNA, 19 nt, Human
ugucaagagucgcugugcc

SEQ ID NO: 1508795 - RNA, 19 nt, Human
ugucaagagggucugagga

SEQ ID NO: 1508796 - RNA, 15 nt, Human
ugucaagccauaauu

SEQ ID NO: 1508797 - RNA, 14 nt, Human
uguauuuuuuuacu

SEQ ID NO: 1508798 - RNA, 16 nt, Human
uguauuuuuuuacuaa

SEQ ID NO: 1508799 - RNA, 20 nt, Human
ugucaaucagccuaguugau

SEQ ID NO: 1508800 - RNA, 16 nt, Human
aguaggaagacuuugg

SEQ ID NO: 1508801 - RNA, 17 nt, Human
aguaggaagacuuugga

SEQ ID NO: 1508802 - RNA, 18 nt, Human
aguaggaagacuuuggaa

SEQ ID NO: 1508803 - RNA, 19 nt, Human
aguaggaagacuuuggaaa

SEQ ID NO: 1508804 - RNA, 22 nt, Human
aguaggaagacuuuggaaagac

SEQ ID NO: 1508805 - RNA, 19 nt, Human
agucagggguucccuuuuu

SEQ ID NO: 1508806 - RNA, 12 nt, Human
agucccugccaa

SEQ ID NO: 1508807 - RNA, 16 nt, Human
agucucacuguugccc

SEQ ID NO: 1508808 - RNA, 17 nt, Human
agucucacuguugccca

SEQ ID NO: 1508809 - RNA, 23 nt, Human
aguccgaaagggacuuggaagcu

SEQ ID NO: 1508810 - RNA, 16 nt, Human
agucaggaaagagaac

SEQ ID NO: 1508811 - RNA, 12 nt, Human
ugucgggcauga

SEQ ID NO: 1508812 - RNA, 14 nt, Human
ugucgcccagucug

SEQ ID NO: 1508813 - RNA, 15 nt, Human
ugucgcccagucugg

SEQ ID NO: 1508814 - RNA, 14 nt, Human
ugucgggcaugaca

SEQ ID NO: 1508815 - RNA, 15 nt, Human
ugucgggcaugacac

SEQ ID NO: 1508816 - RNA, 13 nt, Human
uguccgagcuuug

SEQ ID NO: 1508817 - RNA, 14 nt, Human
uguccgagcuuuga

SEQ ID NO: 1508818 - RNA, 16 nt, Human
uguccuacccacccuc

SEQ ID NO: 1508819 - RNA, 20 nt, Human
ugguaaggggaauugaggac

SEQ ID NO: 1508820 - RNA, 16 nt, Human
ugguacuaacuuuccu

SEQ ID NO: 1508821 - RNA, 22 nt, Human
agggucucacucugucgcccag

SEQ ID NO: 1508822 - RNA, 15 nt, Human
agggugggagugggc

SEQ ID NO: 1508823 - RNA, 22 nt, Human
ugggugcuuggaggaaggaaac

SEQ ID NO: 1508824 - RNA, 15 nt, Human
ugggugcuuggagga

SEQ ID NO: 1508825 - RNA, 19 nt, Human
ugggugcuuggaggaagga

SEQ ID NO: 1508826 - RNA, 20 nt, Human
uggggucacucuggcagcuc

SEQ ID NO: 1508827 - RNA, 19 nt, Human
uggggucacucuggcagcu

SEQ ID NO: 1508828 - RNA, 23 nt, Human
aggggagcaaaaucgaugcagug

SEQ ID NO: 1508829 - RNA, 20 nt, Human
aggggugggacacccuguga

SEQ ID NO: 1508830 - RNA, 22 nt, Human
aggggugggacacccugugaug

SEQ ID NO: 1508831 - RNA, 15 nt, Human
aggggguggccuccc

SEQ ID NO: 1508832 - RNA, 17 nt, Human
aggggguggccucccaa

SEQ ID NO: 1508833 - RNA, 18 nt, Human
aggggguggccucccaac

SEQ ID NO: 1508834 - RNA, 24 nt, Human
agggguucccuuuuuuggcugcug

SEQ ID NO: 1508835 - RNA, 21 nt, Human
agggucucacuauguugccca

SEQ ID NO: 1508836 - RNA, 22 nt, Human
agggucucacuauguugcccag

SEQ ID NO: 1508837 - RNA, 23 nt, Human
agggucucacuauguugcccagg

SEQ ID NO: 1508838 - RNA, 17 nt, Human
aggguuaugauuaagua

SEQ ID NO: 1508839 - RNA, 13 nt, Human
aggguuauaauaa

SEQ ID NO: 1508840 - RNA, 22 nt, Human
aggguguggggccaugccuccu

SEQ ID NO: 1508841 - RNA, 23 nt, Human
aggguguggggccaugccuccuc

SEQ ID NO: 1508842 - RNA, 22 nt, Human
aggguguccggucccuguccca

SEQ ID NO: 1508843 - RNA, 16 nt, Human
uggucugacccacugc

SEQ ID NO: 1508844 - RNA, 17 nt, Human
uggucugacccacugcu

SEQ ID NO: 1508845 - RNA, 18 nt, Human
uggucugacccacugcuu

SEQ ID NO: 1508846 - RNA, 17 nt, Human
uggucucaaacucuuga

SEQ ID NO: 1508847 - RNA, 23 nt, Human
uggucucaaacucuugaccucag

SEQ ID NO: 1508848 - RNA, 16 nt, Human
uggucucaaacucuug

SEQ ID NO: 1508849 - RNA, 16 nt, Human
uggucccaccccacac

SEQ ID NO: 1508850 - RNA, 13 nt, Human
uggucccacucag

SEQ ID NO: 1508851 - RNA, 14 nt, Human
uggucccaccccac

SEQ ID NO: 1508852 - RNA, 15 nt, Human
uggucccaccccaca

SEQ ID NO: 1508853 - RNA, 18 nt, Human
uggucaccaaaucagcug

SEQ ID NO: 1508854 - RNA, 22 nt, Human
uggucagauuugaacucuucaa

SEQ ID NO: 1508855 - RNA, 20 nt, Human
uggucaccaaaucagcugcu

SEQ ID NO: 1508856 - RNA, 20 nt, Human
aggucauuuuuuuuaagaaa

SEQ ID NO: 1508857 - RNA, 17 nt, Human
aggucauuuuuuuuaag

SEQ ID NO: 1508858 - RNA, 12 nt, Human
aggucagagccu

SEQ ID NO: 1508859 - RNA, 18 nt, Human
aggucauauuaauauauu

SEQ ID NO: 1508860 - RNA, 19 nt, Human
aggucauauuaauauauuu

SEQ ID NO: 1508861 - RNA, 23 nt, Human
agguacuucaaauccuugaagau

SEQ ID NO: 1508862 - RNA, 17 nt, Human
agguagaaauaucugaa

SEQ ID NO: 1508863 - RNA, 19 nt, Human
agguagaaauaucugaaaa

SEQ ID NO: 1508864 - RNA, 13 nt, Human
aggguugggcugg

SEQ ID NO: 1508865 - RNA, 18 nt, Human
aggguuggccccugcccg

SEQ ID NO: 1508866 - RNA, 23 nt, Human
aggguuggccccugcccggcugc

SEQ ID NO: 1508867 - RNA, 21 nt, Human
agguaugcaaucaaaucugcu

SEQ ID NO: 1508868 - RNA, 23 nt, Human
agguagaaauaucugaaaaugua

SEQ ID NO: 1508869 - RNA, 14 nt, Human
uggggaaugaagau

SEQ ID NO: 1508870 - RNA, 15 nt, Human
uggggaaugaagaua

SEQ ID NO: 1508871 - RNA, 23 nt, Human
ugggcuggguucuacccaggugc

SEQ ID NO: 1508872 - RNA, 18 nt, Human
ugggcuggguucuaccca

SEQ ID NO: 1508873 - RNA, 19 nt, Human
ugggcuggguucuacccag

SEQ ID NO: 1508874 - RNA, 13 nt, Human
uggggaccucagg

SEQ ID NO: 1508875 - RNA, 17 nt, Human
uggggaccagagcugcc

SEQ ID NO: 1508876 - RNA, 18 nt, Human
uggggaccagagcugcca

SEQ ID NO: 1508877 - RNA, 14 nt, Human
uggggaccagagcu

SEQ ID NO: 1508878 - RNA, 15 nt, Human
uggggaccagagcug

SEQ ID NO: 1508879 - RNA, 20 nt, Human
ugggcucccuucccaccucu

SEQ ID NO: 1508880 - RNA, 21 nt, Human
ugggcucccuucccaccucuc

SEQ ID NO: 1508881 - RNA, 23 nt, Human
agggcuucugccauuucugagau

SEQ ID NO: 1508882 - RNA, 18 nt, Human
ugggcucccuucccaccu

SEQ ID NO: 1508883 - RNA, 19 nt, Human
ugggcucccuucccaccuc

SEQ ID NO: 1508884 - RNA, 14 nt, Human
uggggcccugccuc

SEQ ID NO: 1508885 - RNA, 12 nt, Human
uggggagaaagu

SEQ ID NO: 1508886 - RNA, 23 nt, Human
uggggaccucaggccugggggcu

SEQ ID NO: 1508887 - RNA, 15 nt, Human
uggggcccugccucc

SEQ ID NO: 1508888 - RNA, 16 nt, Human
uggggcccugccuccu

SEQ ID NO: 1508889 - RNA, 18 nt, Human
uggggcggugagagggga

SEQ ID NO: 1508890 - RNA, 15 nt, Human
ugggguacccacugc

SEQ ID NO: 1508891 - RNA, 16 nt, Human
ugggguacccacugcu

SEQ ID NO: 1508892 - RNA, 17 nt, Human
uggggucacucuggcag

SEQ ID NO: 1508893 - RNA, 18 nt, Human
uggggucacucuggcagc

SEQ ID NO: 1508894 - RNA, 15 nt, Human
ugggguaugggagag

SEQ ID NO: 1508895 - RNA, 14 nt, Human
ugggguacccacug

SEQ ID NO: 1508896 - RNA, 22 nt, Human
uggggcugcaccggcuggccug

SEQ ID NO: 1508897 - RNA, 20 nt, Human
uggggcugcaccggcuggcc

SEQ ID NO: 1508898 - RNA, 16 nt, Human
ugggcaacccccagcc

SEQ ID NO: 1508899 - RNA, 14 nt, Human
ugggaguacaaaag

SEQ ID NO: 1508900 - RNA, 18 nt, Human
ugggaggucaaggcugca

SEQ ID NO: 1508901 - RNA, 19 nt, Human
ugggaggucaaggcugcag

SEQ ID NO: 1508902 - RNA, 20 nt, Human
ugggaggucaaggcugcagu

SEQ ID NO: 1508903 - RNA, 23 nt, Human
ugggaggucaaggcugcagugag

SEQ ID NO: 1508904 - RNA, 22 nt, Human
ugggccacuucuggguggggca

SEQ ID NO: 1508905 - RNA, 17 nt, Human
ugggcaacccccagccu

SEQ ID NO: 1508906 - RNA, 20 nt, Human
ugggcaacccccagccugcu

SEQ ID NO: 1508907 - RNA, 21 nt, Human
ugggcaacccccagccugcua

SEQ ID NO: 1508908 - RNA, 13 nt, Human
ugggccaggagcc

SEQ ID NO: 1508909 - RNA, 20 nt, Human
ugggcccaaugcacuuuguu

SEQ ID NO: 1508910 - RNA, 14 nt, Human
ugggccaggagccu

SEQ ID NO: 1508911 - RNA, 16 nt, Human
ugggccaggagccucc

SEQ ID NO: 1508912 - RNA, 17 nt, Human
agggcagggacaggaua

SEQ ID NO: 1508913 - RNA, 23 nt, Human
agggcccagagaggguggugacc

SEQ ID NO: 1508914 - RNA, 17 nt, Human
agggaggugaccccagg

SEQ ID NO: 1508915 - RNA, 17 nt, Human
agggagugacagaggca

SEQ ID NO: 1508916 - RNA, 18 nt, Human
agggagugacagaggcag

SEQ ID NO: 1508917 - RNA, 20 nt, Human
agggagugacagaggcagcc

SEQ ID NO: 1508918 - RNA, 19 nt, Human
agggagugacagaggcagc

SEQ ID NO: 1508919 - RNA, 15 nt, Human
agggcagcagaaggg

SEQ ID NO: 1508920 - RNA, 21 nt, Human
agggcagcagaaggggguggu

SEQ ID NO: 1508921 - RNA, 15 nt, Human
agggagggcuucugc

SEQ ID NO: 1508922 - RNA, 23 nt, Human
aggacagcccuucuuuccacaga

SEQ ID NO: 1508923 - RNA, 21 nt, Human
ugcuugaggcaacucaucuua

SEQ ID NO: 1508924 - RNA, 13 nt, Human
ugcuuguacauaa

SEQ ID NO: 1508925 - RNA, 12 nt, Human
ugcuuguacaua

SEQ ID NO: 1508926 - RNA, 14 nt, Human
ugcuuggaggaagg

SEQ ID NO: 1508927 - RNA, 15 nt, Human
ugcuuggaggaagga

SEQ ID NO: 1508928 - RNA, 16 nt, Human
ugcuuggaggaaggaa

SEQ ID NO: 1508929 - RNA, 16 nt, Human
ugcuuugugauuuuug

SEQ ID NO: 1508930 - RNA, 14 nt, Human
ugcuuugugauuuu

SEQ ID NO: 1508931 - RNA, 12 nt, Human
ugcuuugugauu

SEQ ID NO: 1508932 - RNA, 22 nt, Human
ugcuuguacauaaugcgugcau

SEQ ID NO: 1508933 - RNA, 16 nt, Human
ugcuuguacauaaugc

SEQ ID NO: 1508934 - RNA, 14 nt, Human
ugcuuguacauaau

SEQ ID NO: 1508935 - RNA, 17 nt, Human
ugcuuugugauuuuugu

SEQ ID NO: 1508936 - RNA, 14 nt, Human
ugcuuuuggucugu

SEQ ID NO: 1508937 - RNA, 17 nt, Human
ugcuuuuggucugugug

SEQ ID NO: 1508938 - RNA, 13 nt, Human
uggaagguauuua

SEQ ID NO: 1508939 - RNA, 17 nt, Human
uggaagguauuuaauag

SEQ ID NO: 1508940 - RNA, 18 nt, Human
uggaaguacuauaauuua

SEQ ID NO: 1508941 - RNA, 17 nt, Human
uggaaaugggcagagca

SEQ ID NO: 1508942 - RNA, 18 nt, Human
uggaaaugggcagagcag

SEQ ID NO: 1508943 - RNA, 16 nt, Human
uggaagcacagcuuca

SEQ ID NO: 1508944 - RNA, 13 nt, Human
aggauccugagcc

SEQ ID NO: 1508945 - RNA, 14 nt, Human
aggauccugagcca

SEQ ID NO: 1508946 - RNA, 14 nt, Human
uggagcucguggaa

SEQ ID NO: 1508947 - RNA, 14 nt, Human
aggcaaugcuggcu

SEQ ID NO: 1508948 - RNA, 20 nt, Human
aggcacccaccaucaugucu

SEQ ID NO: 1508949 - RNA, 21 nt, Human
aggcacccaccaucaugucug

SEQ ID NO: 1508950 - RNA, 22 nt, Human
aggcacccaccaucaugucugg

SEQ ID NO: 1508951 - RNA, 14 nt, Human
uggagaagaacuga

SEQ ID NO: 1508952 - RNA, 22 nt, Human
uggagaagccacaggccugaga

SEQ ID NO: 1508953 - RNA, 23 nt, Human
uggagaagccacaggccugagau

SEQ ID NO: 1508954 - RNA, 13 nt, Human
uggagaagcggcu

SEQ ID NO: 1508955 - RNA, 22 nt, Human
uggagaagcggcuggcagccca

SEQ ID NO: 1508956 - RNA, 13 nt, Human
uggagaagaacug

SEQ ID NO: 1508957 - RNA, 20 nt, Human
uggaccuugaacuggguacu

SEQ ID NO: 1508958 - RNA, 23 nt, Human
uggacacagcucuucuccaggcu

SEQ ID NO: 1508959 - RNA, 16 nt, Human
uggacccugaggccca

SEQ ID NO: 1508960 - RNA, 18 nt, Human
uggacccugaggcccaga

SEQ ID NO: 1508961 - RNA, 19 nt, Human
uggacccugaggcccagag

SEQ ID NO: 1508962 - RNA, 20 nt, Human
uggacccugaggcccagagg

SEQ ID NO: 1508963 - RNA, 21 nt, Human
uggacccugaggcccagaggg

SEQ ID NO: 1508964 - RNA, 23 nt, Human
uggacccuguggaugauaaaaca

SEQ ID NO: 1508965 - RNA, 22 nt, Human
uggacacagcucuucuccaggc

SEQ ID NO: 1508966 - RNA, 13 nt, Human
uggacacagcucu

SEQ ID NO: 1508967 - RNA, 14 nt, Human
uggacacagcucuu

SEQ ID NO: 1508968 - RNA, 19 nt, Human
aggaucucuugagccuggg

SEQ ID NO: 1508969 - RNA, 17 nt, Human
aggaucucuugagccug

SEQ ID NO: 1508970 - RNA, 18 nt, Human
aggaucucuugagccugg

SEQ ID NO: 1508971 - RNA, 21 nt, Human
uggauuguccccgacccuugc

SEQ ID NO: 1508972 - RNA, 13 nt, Human
uggauuguccccg

SEQ ID NO: 1508973 - RNA, 14 nt, Human
uggaguauauguca

SEQ ID NO: 1508974 - RNA, 16 nt, Human
aggcagccccauucug

SEQ ID NO: 1508975 - RNA, 17 nt, Human
aggcagccccauucugc

SEQ ID NO: 1508976 - RNA, 16 nt, Human
aggccaaaggaagcac

SEQ ID NO: 1508977 - RNA, 18 nt, Human
aggccaaaggaagcacau

SEQ ID NO: 1508978 - RNA, 19 nt, Human
aggccaaaggaagcacaug

SEQ ID NO: 1508979 - RNA, 20 nt, Human
aggccaaaggaagcacaugc

SEQ ID NO: 1508980 - RNA, 16 nt, Human
aggccaaggugggagg

SEQ ID NO: 1508981 - RNA, 18 nt, Human
aggccaaggugggaggau

SEQ ID NO: 1508982 - RNA, 20 nt, Human
uggagguacgaaaagagggg

SEQ ID NO: 1508983 - RNA, 18 nt, Human
uggcacaguuuucugaga

SEQ ID NO: 1508984 - RNA, 19 nt, Human
uggcacaguuuucugagaa

SEQ ID NO: 1508985 - RNA, 20 nt, Human
uggcacaguuuucugagaaa

SEQ ID NO: 1508986 - RNA, 17 nt, Human
uggcagccuuggcaaac

SEQ ID NO: 1508987 - RNA, 15 nt, Human
uggcagcucaccucu

SEQ ID NO: 1508988 - RNA, 19 nt, Human
uggcagcucaccucucccu

SEQ ID NO: 1508989 - RNA, 17 nt, Human
aggccacaagacccuug

SEQ ID NO: 1508990 - RNA, 18 nt, Human
aggccacaagacccuugu

SEQ ID NO: 1508991 - RNA, 19 nt, Human
aggccacaagacccuugug

SEQ ID NO: 1508992 - RNA, 14 nt, Human
aggccagagggagu

SEQ ID NO: 1508993 - RNA, 16 nt, Human
aggccccgcccaggcu

SEQ ID NO: 1508994 - RNA, 20 nt, Human
aggccagagggagugacaga

SEQ ID NO: 1508995 - RNA, 21 nt, Human
aggcccagagggccugcaagg

SEQ ID NO: 1508996 - RNA, 13 nt, Human
uggccucuucaga

SEQ ID NO: 1508997 - RNA, 13 nt, Human
uggcccacgcacu

SEQ ID NO: 1508998 - RNA, 20 nt, Human
aggccugggggcugggcaga

SEQ ID NO: 1508999 - RNA, 12 nt, Human
aggccuggggac

SEQ ID NO: 1509000 - RNA, 18 nt, Human
aggccugggggcugggca

SEQ ID NO: 1509001 - RNA, 14 nt, Human
uggccuucggccuc

SEQ ID NO: 1509002 - RNA, 13 nt, Human
uggccuuccccag

SEQ ID NO: 1509003 - RNA, 23 nt, Human
uggccuuccccagcaugcaccac

SEQ ID NO: 1509004 - RNA, 15 nt, Human
uggccuuccccagca

SEQ ID NO: 1509005 - RNA, 18 nt, Human
uggccugagcugggauga

SEQ ID NO: 1509006 - RNA, 18 nt, Human
uggccuggccccucaggg

SEQ ID NO: 1509007 - RNA, 21 nt, Human
uggccuggccccucagggucc

SEQ ID NO: 1509008 - RNA, 12 nt, Human
aggccccugcca

SEQ ID NO: 1509009 - RNA, 16 nt, Human
aggccugagauuucau

SEQ ID NO: 1509010 - RNA, 17 nt, Human
aggccccgcccaggcuu

SEQ ID NO: 1509011 - RNA, 19 nt, Human
aggccugagcgcuccugcc

SEQ ID NO: 1509012 - RNA, 21 nt, Human
aggccugagcgcuccugccgc

SEQ ID NO: 1509013 - RNA, 22 nt, Human
aggccugagcgcuccugccgca

SEQ ID NO: 1509014 - RNA, 17 nt, Human
aggccugagauuucauc

SEQ ID NO: 1509015 - RNA, 19 nt, Human
aggccugagauuucaucug

SEQ ID NO: 1509016 - RNA, 20 nt, Human
aggccugagauuucaucugc

SEQ ID NO: 1509017 - RNA, 21 nt, Human
aggccugagauuucaucugcu

SEQ ID NO: 1509018 - RNA, 22 nt, Human
aggccugagauuucaucugcuc

SEQ ID NO: 1509019 - RNA, 23 nt, Human
aggccugagauuucaucugcucu

SEQ ID NO: 1509020 - RNA, 14 nt, Human
aggccugagcgcuc

SEQ ID NO: 1509021 - RNA, 18 nt, Human
aggccugagcgcuccugc

SEQ ID NO: 1509022 - RNA, 16 nt, Human
uggcauauuuuucaca

SEQ ID NO: 1509023 - RNA, 17 nt, Human
uggcauauuuuucacau

SEQ ID NO: 1509024 - RNA, 21 nt, Human
uggccaaagccaaagcuaggc

SEQ ID NO: 1509025 - RNA, 23 nt, Human
uggccaaagccaaagcuaggccu

SEQ ID NO: 1509026 - RNA, 23 nt, Human
uggccagugugacaaggauugcu

SEQ ID NO: 1509027 - RNA, 14 nt, Human
ugcucauggaauug

SEQ ID NO: 1509028 - RNA, 17 nt, Human
ugcucuggacaggcaug

SEQ ID NO: 1509029 - RNA, 15 nt, Human
ugcucuggacaggca

SEQ ID NO: 1509030 - RNA, 16 nt, Human
ugcucuggacaggcau

SEQ ID NO: 1509031 - RNA, 14 nt, Human
ugcucuggacaggc

SEQ ID NO: 1509032 - RNA, 20 nt, Human
ugcuaucucccccagcccca

SEQ ID NO: 1509033 - RNA, 19 nt, Human
ugcuaucucccccagcccc

SEQ ID NO: 1509034 - RNA, 23 nt, Human
agcuuuaucaaagggugaaaauu

SEQ ID NO: 1509035 - RNA, 13 nt, Human
aggaaauauuuau

SEQ ID NO: 1509036 - RNA, 15 nt, Human
aggaaaucaccgaaa

SEQ ID NO: 1509037 - RNA, 19 nt, Human
aggaaaucaccgaaaacgu

SEQ ID NO: 1509038 - RNA, 11 nt, Human
aggaagcacau

SEQ ID NO: 1509039 - RNA, 16 nt, Human
aggaagcacaugccuc

SEQ ID NO: 1509040 - RNA, 17 nt, Human
aggaagcacaugccucu

SEQ ID NO: 1509041 - RNA, 12 nt, Human
aggaaauauuua

SEQ ID NO: 1509042 - RNA, 15 nt, Human
aggaaaggcuccagg

SEQ ID NO: 1509043 - RNA, 16 nt, Human
aggaaaggcuccagga

SEQ ID NO: 1509044 - RNA, 16 nt, Human
ugcugacuguuuucuc

SEQ ID NO: 1509045 - RNA, 13 nt, Human
aggaaaggcucca

SEQ ID NO: 1509046 - RNA, 14 nt, Human
aggaaaggcuccag

SEQ ID NO: 1509047 - RNA, 18 nt, Human
aggaagccgcuggggcca

SEQ ID NO: 1509048 - RNA, 19 nt, Human
aggaagccgcuggggccag

SEQ ID NO: 1509049 - RNA, 20 nt, Human
aggaagccgcuggggccagu

SEQ ID NO: 1509050 - RNA, 22 nt, Human
aggaagcacaugccucucucag

SEQ ID NO: 1509051 - RNA, 21 nt, Human
aggaagccagcaggcucucag

SEQ ID NO: 1509052 - RNA, 22 nt, Human
aggaagccagcaggcucucagg

SEQ ID NO: 1509053 - RNA, 23 nt, Human
aggaagccagcaggcucucaggc

SEQ ID NO: 1509054 - RNA, 12 nt, Human
aggaagcucagg

SEQ ID NO: 1509055 - RNA, 23 nt, Human
aggaaggaaacccagcucugguc

SEQ ID NO: 1509056 - RNA, 20 nt, Human
aggaaggaaacccagcucug

SEQ ID NO: 1509057 - RNA, 22 nt, Human
aggaaggaaacccagcucuggu

SEQ ID NO: 1509058 - RNA, 21 nt, Human
ugcuguauuuuaaaagaauga

SEQ ID NO: 1509059 - RNA, 22 nt, Human
ugcuguauuuuaaaagaaugau

SEQ ID NO: 1509060 - RNA, 13 nt, Human
ugcuguauuuuaa

SEQ ID NO: 1509061 - RNA, 21 nt, Human
ugcugggauuacaagcgugag

SEQ ID NO: 1509062 - RNA, 17 nt, Human
ugcugggauuacaggug

SEQ ID NO: 1509063 - RNA, 19 nt, Human
ugcugggauuacaagcgug

SEQ ID NO: 1509064 - RNA, 19 nt, Human
ugcuggcuguuggcugggg

SEQ ID NO: 1509065 - RNA, 21 nt, Human
ugcuggcuguuggcugggggc

SEQ ID NO: 1509066 - RNA, 13 nt, Human
ugcugcccugccc

SEQ ID NO: 1509067 - RNA, 16 nt, Human
ugcugcccugcccacc

SEQ ID NO: 1509068 - RNA, 17 nt, Human
ugcugcccugcccaccu

SEQ ID NO: 1509069 - RNA, 18 nt, Human
ugcugcccugcccaccug

SEQ ID NO: 1509070 - RNA, 12 nt, Human
ugcugcccugug

SEQ ID NO: 1509071 - RNA, 11 nt, Human
ugcugcccugu

SEQ ID NO: 1509072 - RNA, 19 nt, Human
ugcugcccugcccaccugg

SEQ ID NO: 1509073 - RNA, 21 nt, Human
ugcugcccugcccaccuggcc

SEQ ID NO: 1509074 - RNA, 16 nt, Human
ugcuuccagugaggcu

SEQ ID NO: 1509075 - RNA, 18 nt, Human
aggacacuaaccacgcug

SEQ ID NO: 1509076 - RNA, 19 nt, Human
aggacacuaaccacgcugg

SEQ ID NO: 1509077 - RNA, 12 nt, Human
ugcuucaaggau

SEQ ID NO: 1509078 - RNA, 21 nt, Human
ugcuucaaggauccugagcca

SEQ ID NO: 1509079 - RNA, 23 nt, Human
ugcuucaaggauccugagccaga

SEQ ID NO: 1509080 - RNA, 23 nt, Human
ugcuguauuuuaaaagaaugauu

SEQ ID NO: 1509081 - RNA, 17 nt, Human
ugcugucccuuacguga

SEQ ID NO: 1509082 - RNA, 19 nt, Human
ugcugucccuuacgugagu

SEQ ID NO: 1509083 - RNA, 15 nt, Human
ugcugucccuuuucc

SEQ ID NO: 1509084 - RNA, 17 nt, Human
ugcugucccuuuuccuu

SEQ ID NO: 1509085 - RNA, 21 nt, Human
agcugugcucuggacaggcau

SEQ ID NO: 1509086 - RNA, 23 nt, Human
agcugugcucuggacaggcaugu

SEQ ID NO: 1509087 - RNA, 20 nt, Human
agcugugcucuggacaggca

SEQ ID NO: 1509088 - RNA, 15 nt, Human
agcugggacuacagg

SEQ ID NO: 1509089 - RNA, 14 nt, Human
agcuguuacugucu

SEQ ID NO: 1509090 - RNA, 16 nt, Human
agcuguucacagccag

SEQ ID NO: 1509091 - RNA, 19 nt, Human
agcuguucacagccagacu

SEQ ID NO: 1509092 - RNA, 13 nt, Human
agcuguucagcug

SEQ ID NO: 1509093 - RNA, 14 nt, Human
agcuguucagcugg

SEQ ID NO: 1509094 - RNA, 18 nt, Human
ugccuguucagcuccagc

SEQ ID NO: 1509095 - RNA, 20 nt, Human
ugccuguucagcuccagcuc

SEQ ID NO: 1509096 - RNA, 20 nt, Human
ugccuguugggccaggagcc

SEQ ID NO: 1509097 - RNA, 21 nt, Human
ugccuguucagcuccagcuca

SEQ ID NO: 1509098 - RNA, 15 nt, Human
ugccuuauggaacac

SEQ ID NO: 1509099 - RNA, 16 nt, Human
ugccuuauggaacacu

SEQ ID NO: 1509100 - RNA, 14 nt, Human
ugccugcccaggcc

SEQ ID NO: 1509101 - RNA, 15 nt, Human
ugccugcccaggccc

SEQ ID NO: 1509102 - RNA, 16 nt, Human
ugccugcccaggcccc

SEQ ID NO: 1509103 - RNA, 12 nt, Human
ugcccaggcagg

SEQ ID NO: 1509104 - RNA, 13 nt, Human
ugcccaggcaggu

SEQ ID NO: 1509105 - RNA, 14 nt, Human
ugcccaggcagguc

SEQ ID NO: 1509106 - RNA, 13 nt, Human
ugccucugccucu

SEQ ID NO: 1509107 - RNA, 14 nt, Human
ugccucugccucug

SEQ ID NO: 1509108 - RNA, 15 nt, Human
ugccucugccucuga

SEQ ID NO: 1509109 - RNA, 17 nt, Human
ugccucugccucugaca

SEQ ID NO: 1509110 - RNA, 21 nt, Human
agcugcuuuugucuaugggac

SEQ ID NO: 1509111 - RNA, 22 nt, Human
agcugcuuuugucuaugggacu

SEQ ID NO: 1509112 - RNA, 21 nt, Human
agcugcuugggcuucauccuc

SEQ ID NO: 1509113 - RNA, 21 nt, Human
agcugccuguucagcuccagc

SEQ ID NO: 1509114 - RNA, 22 nt, Human
agcugccuguucagcuccagcu

SEQ ID NO: 1509115 - RNA, 14 nt, Human
ugccuggauggggc

SEQ ID NO: 1509116 - RNA, 15 nt, Human
ugccuggauggggcu

SEQ ID NO: 1509117 - RNA, 20 nt, Human
agcugccuguucagcuccag

SEQ ID NO: 1509118 - RNA, 11 nt, Human
ugcuacacacu

SEQ ID NO: 1509119 - RNA, 20 nt, Human
ugcuacaaaaacacagcaag

SEQ ID NO: 1509120 - RNA, 16 nt, Human
ugcuacaaaaacacag

SEQ ID NO: 1509121 - RNA, 17 nt, Human
ugcuacaaaaacacagc

SEQ ID NO: 1509122 - RNA, 18 nt, Human
ugcuacaaaaacacagca

SEQ ID NO: 1509123 - RNA, 19 nt, Human
ugcuacaaaaacacagcaa

SEQ ID NO: 1509124 - RNA, 19 nt, Human
agcuugaccgugaggccag

SEQ ID NO: 1509125 - RNA, 17 nt, Human
agcuugaaacugagaug

SEQ ID NO: 1509126 - RNA, 14 nt, Human
agcuugaggguugg

SEQ ID NO: 1509127 - RNA, 18 nt, Human
agcuugaggguugggcug

SEQ ID NO: 1509128 - RNA, 22 nt, Human
agcuugaggguugggcuggugu

SEQ ID NO: 1509129 - RNA, 18 nt, Human
agcuuguaaauagcucag

SEQ ID NO: 1509130 - RNA, 17 nt, Human
ugccuuuggcagaguuc

SEQ ID NO: 1509131 - RNA, 22 nt, Human
ugcggacagccacggccaggcc

SEQ ID NO: 1509132 - RNA, 23 nt, Human
ugcggacagccacggccaggcca

SEQ ID NO: 1509133 - RNA, 18 nt, Human
ugcggcggucccagcucc

SEQ ID NO: 1509134 - RNA, 13 nt, Human
ugcggcgguccca

SEQ ID NO: 1509135 - RNA, 14 nt, Human
ugcggcggucccag

SEQ ID NO: 1509136 - RNA, 17 nt, Human
ugcggcggucccagcuc

SEQ ID NO: 1509137 - RNA, 17 nt, Human
ugcggccuuuggcuuca

SEQ ID NO: 1509138 - RNA, 19 nt, Human
ugcggccuuuggcuucacg

SEQ ID NO: 1509139 - RNA, 20 nt, Human
ugcgggcuuccuccuggugu

SEQ ID NO: 1509140 - RNA, 18 nt, Human
ugcgguccacccaggagc

SEQ ID NO: 1509141 - RNA, 21 nt, Human
ugcggugcuaucucccccagc

SEQ ID NO: 1509142 - RNA, 17 nt, Human
ugcggugcuaucucccc

SEQ ID NO: 1509143 - RNA, 12 nt, Human
agcuaggccugg

SEQ ID NO: 1509144 - RNA, 16 nt, Human
agcuaggccuggccag

SEQ ID NO: 1509145 - RNA, 14 nt, Human
agcuaggccuggcc

SEQ ID NO: 1509146 - RNA, 15 nt, Human
agcuaggccuggcca

SEQ ID NO: 1509147 - RNA, 18 nt, Human
agcucaggugucccugca

SEQ ID NO: 1509148 - RNA, 22 nt, Human
agcucaggugucccugcacuug

SEQ ID NO: 1509149 - RNA, 20 nt, Human
agcucaggugucccugcacu

SEQ ID NO: 1509150 - RNA, 21 nt, Human
agcucaggugucccugcacuu

SEQ ID NO: 1509151 - RNA, 21 nt, Human
ugcccagccccuucugaccca

SEQ ID NO: 1509152 - RNA, 20 nt, Human
ugcccacaggaucagucuga

SEQ ID NO: 1509153 - RNA, 19 nt, Human
ugcccacaggaucagucug

SEQ ID NO: 1509154 - RNA, 21 nt, Human
agcucauucuccuuguguuac

SEQ ID NO: 1509155 - RNA, 20 nt, Human
agcucauucuccuuguguua

SEQ ID NO: 1509156 - RNA, 19 nt, Human
agcuacuaauuuuaaaaug

SEQ ID NO: 1509157 - RNA, 19 nt, Human
agcgugagccacugcaccg

SEQ ID NO: 1509158 - RNA, 22 nt, Human
agcgugagccacugcaccgggc

SEQ ID NO: 1509159 - RNA, 15 nt, Human
agcgugcauaaguua

SEQ ID NO: 1509160 - RNA, 13 nt, Human
agcuagaauuuga

SEQ ID NO: 1509161 - RNA, 16 nt, Human
agcuagaauuugauau

SEQ ID NO: 1509162 - RNA, 17 nt, Human
agcuacuugggaggcug

SEQ ID NO: 1509163 - RNA, 18 nt, Human
agcuacuugggaggcuga

SEQ ID NO: 1509164 - RNA, 18 nt, Human
agcuagacgagcaggcuu

SEQ ID NO: 1509165 - RNA, 22 nt, Human
agccuggucccacgagggugcc

SEQ ID NO: 1509166 - RNA, 21 nt, Human
agccugugccucugggacugg

SEQ ID NO: 1509167 - RNA, 22 nt, Human
agccugggugacagagcaagug

SEQ ID NO: 1509168 - RNA, 19 nt, Human
agccugcuccagcuguuca

SEQ ID NO: 1509169 - RNA, 22 nt, Human
agccugcuccagcuguucagcu

SEQ ID NO: 1509170 - RNA, 14 nt, Human
ugcauaccacuuuu

SEQ ID NO: 1509171 - RNA, 15 nt, Human
agccugcuccagcug

SEQ ID NO: 1509172 - RNA, 16 nt, Human
agccugcuccagcugu

SEQ ID NO: 1509173 - RNA, 17 nt, Human
agccugcuccagcuguu

SEQ ID NO: 1509174 - RNA, 12 nt, Human
ugcauaccacuu

SEQ ID NO: 1509175 - RNA, 16 nt, Human
agcggagaaaggaagg

SEQ ID NO: 1509176 - RNA, 20 nt, Human
ugcauuaucuagauacugua

SEQ ID NO: 1509177 - RNA, 20 nt, Human
agcggagaaaggaagggcug

SEQ ID NO: 1509178 - RNA, 18 nt, Human
agcggagacggaguccca

SEQ ID NO: 1509179 - RNA, 20 nt, Human
agccuuggggcugaugcagu

SEQ ID NO: 1509180 - RNA, 11 nt, Human
agccuuccagg

SEQ ID NO: 1509181 - RNA, 14 nt, Human
agccuuccaggggu

SEQ ID NO: 1509182 - RNA, 16 nt, Human
agccuuccaggggugg

SEQ ID NO: 1509183 - RNA, 17 nt, Human
agccuuccagggguggg

SEQ ID NO: 1509184 - RNA, 22 nt, Human
ugcauuaucuagauacuguauc

SEQ ID NO: 1509185 - RNA, 21 nt, Human
ugcauuaucuagauacuguau

SEQ ID NO: 1509186 - RNA, 17 nt, Human
agccucccaaagugcug

SEQ ID NO: 1509187 - RNA, 22 nt, Human
agccugaaagaggaaugaagua

SEQ ID NO: 1509188 - RNA, 17 nt, Human
ugcagccucacaguccu

SEQ ID NO: 1509189 - RNA, 16 nt, Human
ugcagccucacagucc

SEQ ID NO: 1509190 - RNA, 13 nt, Human
ugcagccucacag

SEQ ID NO: 1509191 - RNA, 15 nt, Human
ugcagccucacaguc

SEQ ID NO: 1509192 - RNA, 18 nt, Human
ugcagccugcaggaccuc

SEQ ID NO: 1509193 - RNA, 17 nt, Human
ugcagccugcaggaccu

SEQ ID NO: 1509194 - RNA, 14 nt, Human
ugcauaaguuaacu

SEQ ID NO: 1509195 - RNA, 17 nt, Human
ugcauaaguuaacuucc

SEQ ID NO: 1509196 - RNA, 23 nt, Human
agcccuucuaccuuccugcaaca

SEQ ID NO: 1509197 - RNA, 23 nt, Human
ugcacuauagccuaggugacaga

SEQ ID NO: 1509198 - RNA, 17 nt, Human
agcccuucuuuccacag

SEQ ID NO: 1509199 - RNA, 20 nt, Human
agccgagauagccaaggcca

SEQ ID NO: 1509200 - RNA, 16 nt, Human
agccucccaaagugcu

SEQ ID NO: 1509201 - RNA, 20 nt, Human
agccucauguccacugguuc

SEQ ID NO: 1509202 - RNA, 15 nt, Human
agccucauguccacu

SEQ ID NO: 1509203 - RNA, 22 nt, Human
agccucagcauccuggcacccg

SEQ ID NO: 1509204 - RNA, 23 nt, Human
agccucagcauccuggcacccgg

SEQ ID NO: 1509205 - RNA, 17 nt, Human
agccucagcauccuggc

SEQ ID NO: 1509206 - RNA, 19 nt, Human
agccucagcauccuggcac

SEQ ID NO: 1509207 - RNA, 20 nt, Human
agccucagcauccuggcacc

SEQ ID NO: 1509208 - RNA, 21 nt, Human
agccucagcauccuggcaccc

SEQ ID NO: 1509209 - RNA, 20 nt, Human
ugcacacauuuuuuaaaugc

SEQ ID NO: 1509210 - RNA, 10 nt, Human
ugcacacauu

SEQ ID NO: 1509211 - RNA, 14 nt, Human
ugcacgugugugca

SEQ ID NO: 1509212 - RNA, 15 nt, Human
ugcacgugugugcac

SEQ ID NO: 1509213 - RNA, 16 nt, Human
ugcacccucaggcagg

SEQ ID NO: 1509214 - RNA, 17 nt, Human
ugcacccucaggcaggu

SEQ ID NO: 1509215 - RNA, 20 nt, Human
agccccuucugacccaugcu

SEQ ID NO: 1509216 - RNA, 24 nt, Human
agccccuucugacccaugcugccc

SEQ ID NO: 1509217 - RNA, 15 nt, Human
ugcacaagcugcacc

SEQ ID NO: 1509218 - RNA, 22 nt, Human
agcccugguggcagugggagcu

SEQ ID NO: 1509219 - RNA, 23 nt, Human
agcccugguggcagugggagcug

SEQ ID NO: 1509220 - RNA, 18 nt, Human
ugcacaagcugcacccuc

SEQ ID NO: 1509221 - RNA, 21 nt, Human
ugcacaagcugcacccucagg

SEQ ID NO: 1509222 - RNA, 15 nt, Human
ugauucuccugccuc

SEQ ID NO: 1509223 - RNA, 19 nt, Human
ugauucuccugccucagcc

SEQ ID NO: 1509224 - RNA, 20 nt, Human
ugauucuccugccucagccu

SEQ ID NO: 1509225 - RNA, 18 nt, Human
agcccauggcacucuaug

SEQ ID NO: 1509226 - RNA, 20 nt, Human
agccccaaaacucuccucug

SEQ ID NO: 1509227 - RNA, 21 nt, Human
agccccaaaacucuccucugc

SEQ ID NO: 1509228 - RNA, 22 nt, Human
agccccaaaacucuccucugcu

SEQ ID NO: 1509229 - RNA, 22 nt, Human
agccccuggaugcagccucaca

SEQ ID NO: 1509230 - RNA, 19 nt, Human
agccccuggaugcagccuc

SEQ ID NO: 1509231 - RNA, 17 nt, Human
agccccuggaugcagcc

SEQ ID NO: 1509232 - RNA, 18 nt, Human
agccccuggaugcagccu

SEQ ID NO: 1509233 - RNA, 24 nt, Human
agccccaaaacucuccucugcugc

SEQ ID NO: 1509234 - RNA, 17 nt, Human
agccccgaggccuucuc

SEQ ID NO: 1509235 - RNA, 22 nt, Human
agccccgaggccuucucugaag

SEQ ID NO: 1509236 - RNA, 14 nt, Human
ugagucaccaagcc

SEQ ID NO: 1509237 - RNA, 16 nt, Human
ugagucaccaagccca

SEQ ID NO: 1509238 - RNA, 17 nt, Human
ugagucaccaagcccag

SEQ ID NO: 1509239 - RNA, 17 nt, Human
ugagugccuuacacaau

SEQ ID NO: 1509240 - RNA, 20 nt, Human
ugagugccuuacacaauggu

SEQ ID NO: 1509241 - RNA, 21 nt, Human
ugagugggugaauaauacagu

SEQ ID NO: 1509242 - RNA, 18 nt, Human
ugagugucuuaauuaaaa

SEQ ID NO: 1509243 - RNA, 12 nt, Human
ugauacagaaaa

SEQ ID NO: 1509244 - RNA, 21 nt, Human
ugauacagaaaaguugaauuu

SEQ ID NO: 1509245 - RNA, 21 nt, Human
ugauacaaugcugugcccuaa

SEQ ID NO: 1509246 - RNA, 20 nt, Human
ugauacaaugcugugcccua

SEQ ID NO: 1509247 - RNA, 19 nt, Human
ugauacgcaacauaauuaa

SEQ ID NO: 1509248 - RNA, 17 nt, Human
ugauacuacaguuuguu

SEQ ID NO: 1509249 - RNA, 14 nt, Human
ugauacuacaguuu

SEQ ID NO: 1509250 - RNA, 12 nt, Human
ugauaaguaaau

SEQ ID NO: 1509251 - RNA, 18 nt, Human
ugaguucauacccuguua

SEQ ID NO: 1509252 - RNA, 17 nt, Human
ugaguucauacccuguu

SEQ ID NO: 1509253 - RNA, 23 nt, Human
agcauaaauguugacaugggaca

SEQ ID NO: 1509254 - RNA, 15 nt, Human
agcauacguacacau

SEQ ID NO: 1509255 - RNA, 21 nt, Human
agcauacguacacauuuuauu

SEQ ID NO: 1509256 - RNA, 20 nt, Human
agcauacguacacauuuuau

SEQ ID NO: 1509257 - RNA, 19 nt, Human
agcauacguacacauuuua

SEQ ID NO: 1509258 - RNA, 18 nt, Human
agcauacguacacauuuu

SEQ ID NO: 1509259 - RNA, 17 nt, Human
agcauacguacacauuu

SEQ ID NO: 1509260 - RNA, 16 nt, Human
agcauacguacacauu

SEQ ID NO: 1509261 - RNA, 22 nt, Human
ugaguaacugauuuguaacaag

SEQ ID NO: 1509262 - RNA, 15 nt, Human
ugaguacuacagucc

SEQ ID NO: 1509263 - RNA, 16 nt, Human
agcauauucaggaagc

SEQ ID NO: 1509264 - RNA, 14 nt, Human
agcauauucaggaa

SEQ ID NO: 1509265 - RNA, 14 nt, Human
ugaguagucucaug

SEQ ID NO: 1509266 - RNA, 17 nt, Human
ugaguacuacaguccuc

SEQ ID NO: 1509267 - RNA, 21 nt, Human
ugaguacuacaguccucccau

SEQ ID NO: 1509268 - RNA, 22 nt, Human
ugaguacuacaguccucccauc

SEQ ID NO: 1509269 - RNA, 23 nt, Human
ugaguacuacaguccucccaucu

SEQ ID NO: 1509270 - RNA, 12 nt, Human
ugauaugggucu

SEQ ID NO: 1509271 - RNA, 15 nt, Human
ugauaugugaacagu

SEQ ID NO: 1509272 - RNA, 16 nt, Human
ugauaugugaacaguu

SEQ ID NO: 1509273 - RNA, 17 nt, Human
ugauauuuuuuaucaua

SEQ ID NO: 1509274 - RNA, 19 nt, Human
ugauauuuuuuaucauaaa

SEQ ID NO: 1509275 - RNA, 17 nt, Human
ugaucaaacaugucucu

SEQ ID NO: 1509276 - RNA, 23 nt, Human
ugaucaacaucuuuucuugccuc

SEQ ID NO: 1509277 - RNA, 14 nt, Human
ugaucaacaucuuu

SEQ ID NO: 1509278 - RNA, 17 nt, Human
ugaucaacaucuuuucu

SEQ ID NO: 1509279 - RNA, 18 nt, Human
ugaucaacaucuuuucuu

SEQ ID NO: 1509280 - RNA, 21 nt, Human
ugaucaacaucuuuucuugcc

SEQ ID NO: 1509281 - RNA, 19 nt, Human
ugaucacggcucacugcag

SEQ ID NO: 1509282 - RNA, 20 nt, Human
agcaucacaugaacuuguaa

SEQ ID NO: 1509283 - RNA, 13 nt, Human
agcaucaggccag

SEQ ID NO: 1509284 - RNA, 22 nt, Human
agcauauucaggaagcucaggg

SEQ ID NO: 1509285 - RNA, 20 nt, Human
ugaucacggcucacugcagc

SEQ ID NO: 1509286 - RNA, 21 nt, Human
ugaucacggcucacugcagcc

SEQ ID NO: 1509287 - RNA, 20 nt, Human
agcaugucgucaaagcugaa

SEQ ID NO: 1509288 - RNA, 17 nt, Human
agcaugucgucaaagcu

SEQ ID NO: 1509289 - RNA, 13 nt, Human
agcauggcugcca

SEQ ID NO: 1509290 - RNA, 12 nt, Human
agcauggcugcc

SEQ ID NO: 1509291 - RNA, 14 nt, Human
agcaucaggccagg

SEQ ID NO: 1509292 - RNA, 16 nt, Human
agcaucaggccaggcc

SEQ ID NO: 1509293 - RNA, 17 nt, Human
agcaucaggccaggccc

SEQ ID NO: 1509294 - RNA, 18 nt, Human
agcaucaggccaggcccu

SEQ ID NO: 1509295 - RNA, 19 nt, Human
agcaucaggccaggcccuc

SEQ ID NO: 1509296 - RNA, 20 nt, Human
agcaucaggccaggcccucu

SEQ ID NO: 1509297 - RNA, 18 nt, Human
agcauggcauauuuuuca

SEQ ID NO: 1509298 - RNA, 19 nt, Human
agcauggcauauuuuucac

SEQ ID NO: 1509299 - RNA, 21 nt, Human
agcauggcauauuuuucacau

SEQ ID NO: 1509300 - RNA, 22 nt, Human
agcauggcauauuuuucacaua

SEQ ID NO: 1509301 - RNA, 17 nt, Human
agcauuguaaaugugcu

SEQ ID NO: 1509302 - RNA, 18 nt, Human
agcauuguaaaugugcuu

SEQ ID NO: 1509303 - RNA, 17 nt, Human
ugaugaagaaguugaua

SEQ ID NO: 1509304 - RNA, 15 nt, Human
agccacggccaggcc

SEQ ID NO: 1509305 - RNA, 14 nt, Human
agccacggccaggc

SEQ ID NO: 1509306 - RNA, 17 nt, Human
agccacauauugagaug

SEQ ID NO: 1509307 - RNA, 14 nt, Human
agccacauuccuga

SEQ ID NO: 1509308 - RNA, 18 nt, Human
agccacauuccugaugcu

SEQ ID NO: 1509309 - RNA, 19 nt, Human
agccaccaacauacuccca

SEQ ID NO: 1509310 - RNA, 20 nt, Human
agccaccaacauacucccau

SEQ ID NO: 1509311 - RNA, 23 nt, Human
agccaccaacauacucccaucug

SEQ ID NO: 1509312 - RNA, 15 nt, Human
ugauggugguauguu

SEQ ID NO: 1509313 - RNA, 18 nt, Human
ugauguuuuaaggaugcu

SEQ ID NO: 1509314 - RNA, 17 nt, Human
ugauguuuuaaggaugc

SEQ ID NO: 1509315 - RNA, 14 nt, Human
ugaugauccuaggc

SEQ ID NO: 1509316 - RNA, 20 nt, Human
ugaugauccuaggcauuugc

SEQ ID NO: 1509317 - RNA, 14 nt, Human
ugaugaucuuuaaa

SEQ ID NO: 1509318 - RNA, 16 nt, Human
ugauggugcaaugacc

SEQ ID NO: 1509319 - RNA, 17 nt, Human
ugaugaucuuuaaaaua

SEQ ID NO: 1509320 - RNA, 17 nt, Human
ugauggugcaaugaccu

SEQ ID NO: 1509321 - RNA, 23 nt, Human
ugauggugcaaugaccuuucaau

SEQ ID NO: 1509322 - RNA, 12 nt, Human
ugauuaaaccaa

SEQ ID NO: 1509323 - RNA, 16 nt, Human
ugauuaccagggacug

SEQ ID NO: 1509324 - RNA, 14 nt, Human
ugauuaccagggac

SEQ ID NO: 1509325 - RNA, 13 nt, Human
agccacugcaccg

SEQ ID NO: 1509326 - RNA, 16 nt, Human
agccacugcaccgggc

SEQ ID NO: 1509327 - RNA, 21 nt, Human
agccacugcaccgggccacag

SEQ ID NO: 1509328 - RNA, 22 nt, Human
agccacugcaccgggccacaga

SEQ ID NO: 1509329 - RNA, 12 nt, Human
agccaggccaca

SEQ ID NO: 1509330 - RNA, 14 nt, Human
agccaggccacaag

SEQ ID NO: 1509331 - RNA, 19 nt, Human
agccagacuggcacaguuu

SEQ ID NO: 1509332 - RNA, 14 nt, Human
agccagacuggcac

SEQ ID NO: 1509333 - RNA, 23 nt, Human
agccaguaaaugggggugcauuu

SEQ ID NO: 1509334 - RNA, 12 nt, Human
agccagggucuc

SEQ ID NO: 1509335 - RNA, 21 nt, Human
agccaggccacaagacccuug

SEQ ID NO: 1509336 - RNA, 22 nt, Human
agccaggccacaagacccuugu

SEQ ID NO: 1509337 - RNA, 19 nt, Human
ugauucccaagcucugcuc

SEQ ID NO: 1509338 - RNA, 21 nt, Human
ugauucccaagcucugcuccu

SEQ ID NO: 1509339 - RNA, 15 nt, Human
ugauucccaagcucu

SEQ ID NO: 1509340 - RNA, 16 nt, Human
ugauucccaagcucug

SEQ ID NO: 1509341 - RNA, 18 nt, Human
ugauucccaagcucugcu

SEQ ID NO: 1509342 - RNA, 15 nt, Human
ugauucauaaugacu

SEQ ID NO: 1509343 - RNA, 13 nt, Human
ugauucagcucug

SEQ ID NO: 1509344 - RNA, 14 nt, Human
ugauucagcucugc

SEQ ID NO: 1509345 - RNA, 24 nt, Human
agcccaggaaaggcuccaggagca

SEQ ID NO: 1509346 - RNA, 22 nt, Human
agcccaggaaaggcuccaggag

SEQ ID NO: 1509347 - RNA, 23 nt, Human
agcccaggaaaggcuccaggagc

SEQ ID NO: 1509348 - RNA, 19 nt, Human
agcccaggaaaggcuccag

SEQ ID NO: 1509349 - RNA, 20 nt, Human
agcccaggaaaggcuccagg

SEQ ID NO: 1509350 - RNA, 21 nt, Human
agcccaggaaaggcuccagga

SEQ ID NO: 1509351 - RNA, 12 nt, Human
agcccagaggag

SEQ ID NO: 1509352 - RNA, 14 nt, Human
agcccagaggaggg

SEQ ID NO: 1509353 - RNA, 15 nt, Human
agcccagaggagggc

SEQ ID NO: 1509354 - RNA, 16 nt, Human
agcccagaggagggca

SEQ ID NO: 1509355 - RNA, 16 nt, Human
agaugcaguucugaag

SEQ ID NO: 1509356 - RNA, 17 nt, Human
agaugcaguucugaaga

SEQ ID NO: 1509357 - RNA, 17 nt, Human
ugacacuuaaaaauggu

SEQ ID NO: 1509358 - RNA, 16 nt, Human
agaugccgcauuugga

SEQ ID NO: 1509359 - RNA, 18 nt, Human
agauggaaugcuguguua

SEQ ID NO: 1509360 - RNA, 13 nt, Human
agauggaaugcug

SEQ ID NO: 1509361 - RNA, 15 nt, Human
agauggaaugcugug

SEQ ID NO: 1509362 - RNA, 17 nt, Human
ugacccaugcugcccug

SEQ ID NO: 1509363 - RNA, 16 nt, Human
ugacccaugcugcccu

SEQ ID NO: 1509364 - RNA, 21 nt, Human
ugacccaugcugcccugugag

SEQ ID NO: 1509365 - RNA, 14 nt, Human
ugacccaugcugcc

SEQ ID NO: 1509366 - RNA, 15 nt, Human
ugacccaugcugccc

SEQ ID NO: 1509367 - RNA, 20 nt, Human
ugaccccaggagggaggcag

SEQ ID NO: 1509368 - RNA, 22 nt, Human
ugaccccaggagggaggcaggg

SEQ ID NO: 1509369 - RNA, 18 nt, Human
ugaccugaggcccuucuc

SEQ ID NO: 1509370 - RNA, 19 nt, Human
ugaccugaggcccuucucu

SEQ ID NO: 1509371 - RNA, 17 nt, Human
ugaccuucuaggaagcu

SEQ ID NO: 1509372 - RNA, 16 nt, Human
ugacuuacuguacaug

SEQ ID NO: 1509373 - RNA, 15 nt, Human
ugacuuacuguacau

SEQ ID NO: 1509374 - RNA, 13 nt, Human
ugacuuacuguac

SEQ ID NO: 1509375 - RNA, 23 nt, Human
agcaagacgcugugcugcccugc

SEQ ID NO: 1509376 - RNA, 17 nt, Human
agcaagacgcugugcug

SEQ ID NO: 1509377 - RNA, 20 nt, Human
agcaagacgcugugcugccc

SEQ ID NO: 1509378 - RNA, 21 nt, Human
agcaagacgcugugcugcccu

SEQ ID NO: 1509379 - RNA, 22 nt, Human
agcaagacgcugugcugcccug

SEQ ID NO: 1509380 - RNA, 20 nt, Human
ugagaagcagaggaaggaga

SEQ ID NO: 1509381 - RNA, 13 nt, Human
agcaagacgcugu

SEQ ID NO: 1509382 - RNA, 16 nt, Human
agcaagacgcugugcu

SEQ ID NO: 1509383 - RNA, 23 nt, Human
agcaacgcaggcccccaggugcc

SEQ ID NO: 1509384 - RNA, 17 nt, Human
agauuugaacucuucaa

SEQ ID NO: 1509385 - RNA, 14 nt, Human
agauuggcucacac

SEQ ID NO: 1509386 - RNA, 19 nt, Human
agauuggcucacacugaga

SEQ ID NO: 1509387 - RNA, 22 nt, Human
agauuggcucacacugagaaug

SEQ ID NO: 1509388 - RNA, 12 nt, Human
agauuuuguugg

SEQ ID NO: 1509389 - RNA, 21 nt, Human
agauuuugaaauuuuuauuaa

SEQ ID NO: 1509390 - RNA, 13 nt, Human
agauuggaaggaa

SEQ ID NO: 1509391 - RNA, 15 nt, Human
agauucccugagcag

SEQ ID NO: 1509392 - RNA, 19 nt, Human
ugacuuacuguacaugaaa

SEQ ID NO: 1509393 - RNA, 22 nt, Human
ugacuucuaaguaaaaccacag

SEQ ID NO: 1509394 - RNA, 23 nt, Human
ugacuucuaaguaaaaccacagc

SEQ ID NO: 1509395 - RNA, 22 nt, Human
agauucauauuuacuucuuaua

SEQ ID NO: 1509396 - RNA, 24 nt, Human
ugacuucuaaguaaaaccacagca

SEQ ID NO: 1509397 - RNA, 15 nt, Human
agagguuaagguggg

SEQ ID NO: 1509398 - RNA, 16 nt, Human
agagguggggagcaga

SEQ ID NO: 1509399 - RNA, 14 nt, Human
agaguauuuuugac

SEQ ID NO: 1509400 - RNA, 15 nt, Human
agaguauuuuugaca

SEQ ID NO: 1509401 - RNA, 14 nt, Human
ugaaaguacauuug

SEQ ID NO: 1509402 - RNA, 23 nt, Human
ugaaaguacauuuggagacacaa

SEQ ID NO: 1509403 - RNA, 20 nt, Human
agagggagggagggcuccag

SEQ ID NO: 1509404 - RNA, 16 nt, Human
agagggagggagggcu

SEQ ID NO: 1509405 - RNA, 14 nt, Human
ugaauauaaacacu

SEQ ID NO: 1509406 - RNA, 17 nt, Human
agaguauuuuugacaga

SEQ ID NO: 1509407 - RNA, 18 nt, Human
agaguauuuuugacagaa

SEQ ID NO: 1509408 - RNA, 15 nt, Human
ugaauacuuuauaaa

SEQ ID NO: 1509409 - RNA, 22 nt, Human
ugaaggguaauuauauaguuac

SEQ ID NO: 1509410 - RNA, 14 nt, Human
ugaagucacacagu

SEQ ID NO: 1509411 - RNA, 19 nt, Human
ugacacacagcucuguccu

SEQ ID NO: 1509412 - RNA, 20 nt, Human
ugacacacagcucuguccug

SEQ ID NO: 1509413 - RNA, 19 nt, Human
ugacaaagacugaguacgu

SEQ ID NO: 1509414 - RNA, 16 nt, Human
ugacacacagcucugu

SEQ ID NO: 1509415 - RNA, 18 nt, Human
ugacacacagcucugucc

SEQ ID NO: 1509416 - RNA, 20 nt, Human
ugacacaugcaaggucauuu

SEQ ID NO: 1509417 - RNA, 12 nt, Human
ugacacaugcaa

SEQ ID NO: 1509418 - RNA, 23 nt, Human
ugaauuucuuuugccguuauuaa

SEQ ID NO: 1509419 - RNA, 17 nt, Human
agauaaggguaucuggu

SEQ ID NO: 1509420 - RNA, 17 nt, Human
agaguuguuacauuuuu

SEQ ID NO: 1509421 - RNA, 22 nt, Human
agagucagaaguuucugccgca

SEQ ID NO: 1509422 - RNA, 15 nt, Human
agagucacuggaaca

SEQ ID NO: 1509423 - RNA, 20 nt, Human
agaguauuuuugacagaaua

SEQ ID NO: 1509424 - RNA, 20 nt, Human
agaguuguuacauuuuuaag

SEQ ID NO: 1509425 - RNA, 19 nt, Human
agaguuguuacauuuuuaa

SEQ ID NO: 1509426 - RNA, 21 nt, Human
agaguuguuacauuuuuaagu

SEQ ID NO: 1509427 - RNA, 16 nt, Human
agauacuguaucauga

SEQ ID NO: 1509428 - RNA, 15 nt, Human
agauacuguaucaug

SEQ ID NO: 1509429 - RNA, 22 nt, Human
agauauuuugcuuugugauuuu

SEQ ID NO: 1509430 - RNA, 18 nt, Human
agaucaaaagguuaauaa

SEQ ID NO: 1509431 - RNA, 21 nt, Human
agauauuuugcuuugugauuu

SEQ ID NO: 1509432 - RNA, 20 nt, Human
agauauuuugcuuugugauu

SEQ ID NO: 1509433 - RNA, 22 nt, Human
agauacaguuacucagaauucu

SEQ ID NO: 1509434 - RNA, 11 nt, Human
agauacuguau

SEQ ID NO: 1509435 - RNA, 13 nt, Human
agauacaguuacu

SEQ ID NO: 1509436 - RNA, 20 nt, Human
agauacaggaaaagcugcug

SEQ ID NO: 1509437 - RNA, 18 nt, Human
agauaauauuaaggaaga

SEQ ID NO: 1509438 - RNA, 22 nt, Human
agauaauauuaaggaagacaau

SEQ ID NO: 1509439 - RNA, 12 nt, Human
ugaaacuuuugg

SEQ ID NO: 1509440 - RNA, 13 nt, Human
ugaaagacuguac

SEQ ID NO: 1509441 - RNA, 15 nt, Human
ugaaagacuguacaa

SEQ ID NO: 1509442 - RNA, 11 nt, Human
agagacuccug

SEQ ID NO: 1509443 - RNA, 17 nt, Human
agagacuccugcaggca

SEQ ID NO: 1509444 - RNA, 18 nt, Human
agagacuccugcaggcag

SEQ ID NO: 1509445 - RNA, 19 nt, Human
agagacuccugcaggcagc

SEQ ID NO: 1509446 - RNA, 20 nt, Human
agagacuccugcaggcagcc

SEQ ID NO: 1509447 - RNA, 21 nt, Human
agagacuccugcaggcagcca

SEQ ID NO: 1509448 - RNA, 22 nt, Human
agagacuccugcaggcagccag

SEQ ID NO: 1509449 - RNA, 19 nt, Human
agagcaagacgcugugcug

SEQ ID NO: 1509450 - RNA, 23 nt, Human
agagcaagacgcugugcugcccu

SEQ ID NO: 1509451 - RNA, 22 nt, Human
agagaucaaccccuucgcuccu

SEQ ID NO: 1509452 - RNA, 23 nt, Human
agagacuccugcaggcagccagg

SEQ ID NO: 1509453 - RNA, 14 nt, Human
agagagaaaauaaa

SEQ ID NO: 1509454 - RNA, 14 nt, Human
agagcugccaccug

SEQ ID NO: 1509455 - RNA, 11 nt, Human
agagcugaggc

SEQ ID NO: 1509456 - RNA, 20 nt, Human
agagcuagcagcagggaggg

SEQ ID NO: 1509457 - RNA, 13 nt, Human
agagccuuccagg

SEQ ID NO: 1509458 - RNA, 15 nt, Human
agagccuuccagggg

SEQ ID NO: 1509459 - RNA, 17 nt, Human
agagccuuccaggggug

SEQ ID NO: 1509460 - RNA, 22 nt, Human
agagccuuccaggggugggaca

SEQ ID NO: 1509461 - RNA, 22 nt, Human
agagcaccuuagacagucccug

SEQ ID NO: 1509462 - RNA, 23 nt, Human
agagcaccuuagacagucccugc

SEQ ID NO: 1509463 - RNA, 19 nt, Human
ugaaacucguuaauuugua

SEQ ID NO: 1509464 - RNA, 22 nt, Human
ugaaacugagaugugaacacau

SEQ ID NO: 1509465 - RNA, 20 nt, Human
ugaaaaucuuauaauuuaaa

SEQ ID NO: 1509466 - RNA, 19 nt, Human
ugaaaaucgugacaacacu

SEQ ID NO: 1509467 - RNA, 17 nt, Human
ugaaaauguauguguaa

SEQ ID NO: 1509468 - RNA, 22 nt, Human
ugaaaaaguucugcagauaaac

SEQ ID NO: 1509469 - RNA, 20 nt, Human
ugaaaaaggaggaagagaaa

SEQ ID NO: 1509470 - RNA, 22 nt, Human
ugaaaaaggaggaagagaaaaa

SEQ ID NO: 1509471 - RNA, 22 nt, Human
ugaaaaagaccuuuggagcaaa

SEQ ID NO: 1509472 - RNA, 20 nt, Human
ugaaaaagcuggauuuucuu

SEQ ID NO: 1509473 - RNA, 16 nt, Human
ugaaaaaggaggaaga

SEQ ID NO: 1509474 - RNA, 22 nt, Human
ucuuuggucuacacugugcuga

SEQ ID NO: 1509475 - RNA, 20 nt, Human
ucuuucuggcuaugcauuug

SEQ ID NO: 1509476 - RNA, 21 nt, Human
ucuuucuggcuaugcauuuga

SEQ ID NO: 1509477 - RNA, 13 nt, Human
ucuugauucauaa

SEQ ID NO: 1509478 - RNA, 16 nt, Human
ucuugagccuugaacu

SEQ ID NO: 1509479 - RNA, 13 nt, Human
ucuugagccuggg

SEQ ID NO: 1509480 - RNA, 16 nt, Human
ucuugagccugggagg

SEQ ID NO: 1509481 - RNA, 16 nt, Human
agacuauucaaacagu

SEQ ID NO: 1509482 - RNA, 15 nt, Human
agacuauucaaacag

SEQ ID NO: 1509483 - RNA, 12 nt, Human
agacuauucaaa

SEQ ID NO: 1509484 - RNA, 14 nt, Human
agacuauucaaaca

SEQ ID NO: 1509485 - RNA, 21 nt, Human
agaccuucuccuucaccuuug

SEQ ID NO: 1509486 - RNA, 23 nt, Human
agaccuucuccuucaccuuuguc

SEQ ID NO: 1509487 - RNA, 11 nt, Human
agaccuucucc

SEQ ID NO: 1509488 - RNA, 15 nt, Human
agaccuucuccuuca

SEQ ID NO: 1509489 - RNA, 18 nt, Human
agaccuucuccuucaccu

SEQ ID NO: 1509490 - RNA, 17 nt, Human
ucuuggucagauuugaa

SEQ ID NO: 1509491 - RNA, 14 nt, Human
ucuugguccugcug

SEQ ID NO: 1509492 - RNA, 19 nt, Human
ucuugcaauggcagccuug

SEQ ID NO: 1509493 - RNA, 18 nt, Human
ucuugcaauggcagccuu

SEQ ID NO: 1509494 - RNA, 22 nt, Human
ucuugcaauggcagccuuggca

SEQ ID NO: 1509495 - RNA, 23 nt, Human
ucuugcaauggcagccuuggcaa

SEQ ID NO: 1509496 - RNA, 15 nt, Human
ucuuuaacucauaaa

SEQ ID NO: 1509497 - RNA, 15 nt, Human
ucuugguccugcugc

SEQ ID NO: 1509498 - RNA, 17 nt, Human
ucuugguccugcugcag

SEQ ID NO: 1509499 - RNA, 19 nt, Human
ucuugguccugcugcaguu

SEQ ID NO: 1509500 - RNA, 17 nt, Human
ucuuuccugaggcuggg

SEQ ID NO: 1509501 - RNA, 15 nt, Human
ucuuccucccucccu

SEQ ID NO: 1509502 - RNA, 14 nt, Human
ucuuccucccuccc

SEQ ID NO: 1509503 - RNA, 19 nt, Human
ucuucccuacaguugaaaa

SEQ ID NO: 1509504 - RNA, 22 nt, Human
ucuucccuacaguugaaaaaca

SEQ ID NO: 1509505 - RNA, 14 nt, Human
agaaucacuugaac

SEQ ID NO: 1509506 - RNA, 17 nt, Human
ucuucagagacuccugc

SEQ ID NO: 1509507 - RNA, 18 nt, Human
ucuucagagacuccugca

SEQ ID NO: 1509508 - RNA, 15 nt, Human
ucuucacaacagauu

SEQ ID NO: 1509509 - RNA, 12 nt, Human
ucuucagagacu

SEQ ID NO: 1509510 - RNA, 21 nt, Human
ucuuccaggcugggagagccu

SEQ ID NO: 1509511 - RNA, 20 nt, Human
ucuucagagacuccugcagg

SEQ ID NO: 1509512 - RNA, 15 nt, Human
ucuuccaggcuggga

SEQ ID NO: 1509513 - RNA, 17 nt, Human
ucuuccaggcugggaga

SEQ ID NO: 1509514 - RNA, 20 nt, Human
ucuuccaggcugggagagcc

SEQ ID NO: 1509515 - RNA, 19 nt, Human
agacauucuuccaaaaaga

SEQ ID NO: 1509516 - RNA, 19 nt, Human
agacauacuaaccagcaga

SEQ ID NO: 1509517 - RNA, 21 nt, Human
agacauagaauuaacacauga

SEQ ID NO: 1509518 - RNA, 17 nt, Human
agacaucaacagauaaa

SEQ ID NO: 1509519 - RNA, 18 nt, Human
agacaucaacagauaaau

SEQ ID NO: 1509520 - RNA, 21 nt, Human
ucuucugaacuuggcgcugcc

SEQ ID NO: 1509521 - RNA, 12 nt, Human
ucuucugcuuca

SEQ ID NO: 1509522 - RNA, 19 nt, Human
ucuucugcuucagccuccc

SEQ ID NO: 1509523 - RNA, 20 nt, Human
ucuucuguggguuucuaaag

SEQ ID NO: 1509524 - RNA, 15 nt, Human
ucuucuguacgucug

SEQ ID NO: 1509525 - RNA, 20 nt, Human
ucuucuguacgucugacagg

SEQ ID NO: 1509526 - RNA, 22 nt, Human
ucugcuuugggguuuaucagaa

SEQ ID NO: 1509527 - RNA, 23 nt, Human
ucugcuuuuuaaagaaugcucuu

SEQ ID NO: 1509528 - RNA, 17 nt, Human
ucuggcagcucagagag

SEQ ID NO: 1509529 - RNA, 20 nt, Human
ucuggcagaguugaagacag

SEQ ID NO: 1509530 - RNA, 23 nt, Human
ucuggcagaguugaagacagagc

SEQ ID NO: 1509531 - RNA, 18 nt, Human
ucuggcagcucagagagg

SEQ ID NO: 1509532 - RNA, 21 nt, Human
ucuggcagcucagagagggug

SEQ ID NO: 1509533 - RNA, 10 nt, Human
ucuggccuuc

SEQ ID NO: 1509534 - RNA, 13 nt, Human
agaaguugauaug

SEQ ID NO: 1509535 - RNA, 22 nt, Human
agaaguuugagaucagccuggg

SEQ ID NO: 1509536 - RNA, 16 nt, Human
agaaggaucuucaucu

SEQ ID NO: 1509537 - RNA, 17 nt, Human
agaauaaucaaauacau

SEQ ID NO: 1509538 - RNA, 20 nt, Human
agaaauuacuaauuuuacuu

SEQ ID NO: 1509539 - RNA, 19 nt, Human
agaaccuuuugagugccuu

SEQ ID NO: 1509540 - RNA, 23 nt, Human
agaaccuuuugagugccuuacac

SEQ ID NO: 1509541 - RNA, 17 nt, Human
agaacucccuuucaaca

SEQ ID NO: 1509542 - RNA, 16 nt, Human
agaacucccuuucaac

SEQ ID NO: 1509543 - RNA, 19 nt, Human
agaagcaccaaucaugaau

SEQ ID NO: 1509544 - RNA, 16 nt, Human
agaagcagaggaagga

SEQ ID NO: 1509545 - RNA, 14 nt, Human
agaacuuucauuuu

SEQ ID NO: 1509546 - RNA, 15 nt, Human
agaacuuucauuuuu

SEQ ID NO: 1509547 - RNA, 16 nt, Human
agaacuuucauuuuuu

SEQ ID NO: 1509548 - RNA, 18 nt, Human
agaacuuucauuuuuuuc

SEQ ID NO: 1509549 - RNA, 19 nt, Human
agaagccacaggccugaga

SEQ ID NO: 1509550 - RNA, 21 nt, Human
agaagccacaggccugagauu

SEQ ID NO: 1509551 - RNA, 20 nt, Human
ucugcccauccugccccuga

SEQ ID NO: 1509552 - RNA, 12 nt, Human
ucugcccuuggu

SEQ ID NO: 1509553 - RNA, 23 nt, Human
ucugcccuugguuaggcauugug

SEQ ID NO: 1509554 - RNA, 22 nt, Human
ucucucacuuguuuuauuuaac

SEQ ID NO: 1509555 - RNA, 12 nt, Human
ucucucaggcca

SEQ ID NO: 1509556 - RNA, 21 nt, Human
ucucucaggccaaacucaccu

SEQ ID NO: 1509557 - RNA, 16 nt, Human
acuuuguguucaccuu

SEQ ID NO: 1509558 - RNA, 18 nt, Human
acuuuguguucaccuugu

SEQ ID NO: 1509559 - RNA, 21 nt, Human
ucuccuuggugucgggcauga

SEQ ID NO: 1509560 - RNA, 23 nt, Human
ucuccuuggugucgggcaugaca

SEQ ID NO: 1509561 - RNA, 22 nt, Human
acuuguuuuauuuaaccucuaa

SEQ ID NO: 1509562 - RNA, 15 nt, Human
acuuguggacacagc

SEQ ID NO: 1509563 - RNA, 16 nt, Human
acuuuaaaaggagcca

SEQ ID NO: 1509564 - RNA, 18 nt, Human
acuugucuuuggacccug

SEQ ID NO: 1509565 - RNA, 14 nt, Human
acuuguggacacag

SEQ ID NO: 1509566 - RNA, 23 nt, Human
acuuuggaaagaguaggaagacu

SEQ ID NO: 1509567 - RNA, 15 nt, Human
acuuuggaacaagau

SEQ ID NO: 1509568 - RNA, 12 nt, Human
acuuuggaaaga

SEQ ID NO: 1509569 - RNA, 13 nt, Human
acuuuggaaagag

SEQ ID NO: 1509570 - RNA, 14 nt, Human
acuuuggaaagagu

SEQ ID NO: 1509571 - RNA, 20 nt, Human
ucugaaggguaauuauauag

SEQ ID NO: 1509572 - RNA, 18 nt, Human
ucugaaggcuggguucug

SEQ ID NO: 1509573 - RNA, 15 nt, Human
agaaaugccuuaccc

SEQ ID NO: 1509574 - RNA, 20 nt, Human
agaaagcagaacagugauua

SEQ ID NO: 1509575 - RNA, 17 nt, Human
agaaagcagaacaguga

SEQ ID NO: 1509576 - RNA, 18 nt, Human
agaaagcagaacagugau

SEQ ID NO: 1509577 - RNA, 18 nt, Human
agaaagacagagcuggga

SEQ ID NO: 1509578 - RNA, 18 nt, Human
agaaagacuauucaaaca

SEQ ID NO: 1509579 - RNA, 16 nt, Human
agaaagacuauucaaa

SEQ ID NO: 1509580 - RNA, 20 nt, Human
agaaagacuaucuaaauguu

SEQ ID NO: 1509581 - RNA, 22 nt, Human
agaaagacuaucuaaauguuga

SEQ ID NO: 1509582 - RNA, 16 nt, Human
agaaaacaaggaugaa

SEQ ID NO: 1509583 - RNA, 16 nt, Human
agaaacacaacuauau

SEQ ID NO: 1509584 - RNA, 23 nt, Human
agaaacuuaagguuaccuuuguu

SEQ ID NO: 1509585 - RNA, 15 nt, Human
agaaacauuugguaa

SEQ ID NO: 1509586 - RNA, 17 nt, Human
ucucuugguccugcugc

SEQ ID NO: 1509587 - RNA, 18 nt, Human
ucucuugguccugcugca

SEQ ID NO: 1509588 - RNA, 18 nt, Human
agaaaaaugagccuggca

SEQ ID NO: 1509589 - RNA, 17 nt, Human
agaaaaaauauuuuccu

SEQ ID NO: 1509590 - RNA, 23 nt, Human
agaaaaaauauuuuccugccagg

SEQ ID NO: 1509591 - RNA, 20 nt, Human
acuuccagauccuggaaauc

SEQ ID NO: 1509592 - RNA, 18 nt, Human
acuuccaauuuacauacu

SEQ ID NO: 1509593 - RNA, 17 nt, Human
acuuccacugccauccu

SEQ ID NO: 1509594 - RNA, 12 nt, Human
ucuaccugaggg

SEQ ID NO: 1509595 - RNA, 19 nt, Human
ucuaccugaggggccucuu

SEQ ID NO: 1509596 - RNA, 15 nt, Human
acuuacuguacauga

SEQ ID NO: 1509597 - RNA, 20 nt, Human
acuuagagguggggagcaga

SEQ ID NO: 1509598 - RNA, 14 nt, Human
acuuacuguacaug

SEQ ID NO: 1509599 - RNA, 13 nt, Human
acuuacuguacau

SEQ ID NO: 1509600 - RNA, 16 nt, Human
acuuacuguacaugaa

SEQ ID NO: 1509601 - RNA, 13 nt, Human
ucuauaauuuaaa

SEQ ID NO: 1509602 - RNA, 23 nt, Human
ucuaguuugauuaaauucuugca

SEQ ID NO: 1509603 - RNA, 17 nt, Human
ucuagcauggcauauuu

SEQ ID NO: 1509604 - RNA, 18 nt, Human
ucuagcauggcauauuuu

SEQ ID NO: 1509605 - RNA, 24 nt, Human
ucuagauacuguaucaugacaaag

SEQ ID NO: 1509606 - RNA, 17 nt, Human
acuucccagugaauucu

SEQ ID NO: 1509607 - RNA, 23 nt, Human
acuugaacccgggaggcagaggu

SEQ ID NO: 1509608 - RNA, 19 nt, Human
acuugagaauuacccuuuu

SEQ ID NO: 1509609 - RNA, 18 nt, Human
acuugacagaacacuguc

SEQ ID NO: 1509610 - RNA, 20 nt, Human
acuugacagaacacugucuu

SEQ ID NO: 1509611 - RNA, 17 nt, Human
acuugacagaacacugu

SEQ ID NO: 1509612 - RNA, 14 nt, Human
acuugucuuuggac

SEQ ID NO: 1509613 - RNA, 20 nt, Human
acuugaucauuuuuaccauu
